United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 87

SEQ ID NO: 3677526 - DNA, 13 bp, Homo sapiens
tttgaatgttaat

SEQ ID NO: 3677527 - DNA, 16 bp, Homo sapiens
tttgaatgttaatttt

SEQ ID NO: 3677528 - DNA, 19 bp, Homo sapiens
tttgaatgttaattttttg

SEQ ID NO: 3677529 - DNA, 17 bp, Homo sapiens
tttgacatgggtatttt

SEQ ID NO: 3677530 - DNA, 21 bp, Homo sapiens
tttgactaattttacatgttt

SEQ ID NO: 3677531 - DNA, 21 bp, Homo sapiens
tttgactagggattcaggctg

SEQ ID NO: 3677532 - DNA, 23 bp, Homo sapiens
tttgacttaatgtgattactgct

SEQ ID NO: 3677533 - DNA, 16 bp, Homo sapiens
tttgagaccagcctgg

SEQ ID NO: 3677534 - DNA, 16 bp, Homo sapiens
tttgatgcatgtcttt

SEQ ID NO: 3677535 - DNA, 22 bp, Homo sapiens
tttgatgcatgtcttttaaaat

SEQ ID NO: 3677536 - DNA, 19 bp, Homo sapiens
tttgatgtttgtggcctca

SEQ ID NO: 3677537 - DNA, 22 bp, Homo sapiens
tttgattcaaaatatttaaaaa

SEQ ID NO: 3677538 - DNA, 19 bp, Homo sapiens
tttgcacatgtttcctcta

SEQ ID NO: 3677539 - DNA, 22 bp, Homo sapiens
tttgcagctgcccagcccctcc

SEQ ID NO: 3677540 - DNA, 22 bp, Homo sapiens
tttgctaactagcttggaaact

SEQ ID NO: 3677541 - DNA, 19 bp, Homo sapiens
tttgctgtgaggctgtcct

SEQ ID NO: 3677542 - DNA, 19 bp, Homo sapiens
tttgcttgctcatatgcat

SEQ ID NO: 3677543 - DNA, 19 bp, Homo sapiens
tttggacctaaatggcctc

SEQ ID NO: 3677544 - DNA, 22 bp, Homo sapiens
tttggagtgttatgtatttcct

SEQ ID NO: 3677545 - DNA, 22 bp, Homo sapiens
tttgggaggccaaggtgggagg

SEQ ID NO: 3677546 - DNA, 20 bp, Homo sapiens
tttggggtagctagaggaac

SEQ ID NO: 3677547 - DNA, 22 bp, Homo sapiens
tttgggtatgtttaatctgtta

SEQ ID NO: 3677548 - DNA, 16 bp, Homo sapiens
tttggtacaaaaataa

SEQ ID NO: 3677549 - DNA, 15 bp, Homo sapiens
tttggtgtacagact

SEQ ID NO: 3677550 - DNA, 19 bp, Homo sapiens
tttgtaaatgcctcttaaa

SEQ ID NO: 3677551 - DNA, 17 bp, Homo sapiens
tttgtagctaacagtga

SEQ ID NO: 3677552 - DNA, 22 bp, Homo sapiens
tttgtatgaaattataatctgt

SEQ ID NO: 3677553 - DNA, 21 bp, Homo sapiens
tttgtcgggcaccagccagcg

SEQ ID NO: 3677554 - DNA, 23 bp, Homo sapiens
tttgtcttaaaaagtggaaaaat

SEQ ID NO: 3677555 - DNA, 18 bp, Homo sapiens
tttgtggccaaggagctg

SEQ ID NO: 3677556 - DNA, 15 bp, Homo sapiens
tttgtggcctcagaa

SEQ ID NO: 3677557 - DNA, 12 bp, Homo sapiens
tttgtggctggg

SEQ ID NO: 3677558 - DNA, 14 bp, Homo sapiens
tttgtgtaacatat

SEQ ID NO: 3677559 - DNA, 17 bp, Homo sapiens
tttgtgtgttgtctctt

SEQ ID NO: 3677560 - DNA, 17 bp, Homo sapiens
tttgttaggattttcac

SEQ ID NO: 3677561 - DNA, 17 bp, Homo sapiens
tttgttcaagttttggg

SEQ ID NO: 3677562 - DNA, 19 bp, Homo sapiens
ttttaaaaacatagaaaaa

SEQ ID NO: 3677563 - DNA, 13 bp, Homo sapiens
ttttaaaaaccta

SEQ ID NO: 3677564 - DNA, 15 bp, Homo sapiens
ttttaaaactggacc

SEQ ID NO: 3677565 - DNA, 20 bp, Homo sapiens
ttttaaaactggacctgtat

SEQ ID NO: 3677566 - DNA, 20 bp, Homo sapiens
ttttaaaccctattggtaaa

SEQ ID NO: 3677567 - DNA, 11 bp, Homo sapiens
ttttaaagaat

SEQ ID NO: 3677568 - DNA, 17 bp, Homo sapiens
ttttaatgatgacaaaa

SEQ ID NO: 3677569 - DNA, 20 bp, Homo sapiens
ttttaatgctatttgaacaa

SEQ ID NO: 3677570 - DNA, 15 bp, Homo sapiens
ttttacaagatgtat

SEQ ID NO: 3677571 - DNA, 17 bp, Homo sapiens
ttttatagcctggactg

SEQ ID NO: 3677572 - DNA, 20 bp, Homo sapiens
ttttatagcctggactgcta

SEQ ID NO: 3677573 - DNA, 19 bp, Homo sapiens
ttttatgagaaagccttct

SEQ ID NO: 3677574 - DNA, 19 bp, Homo sapiens
ttttcaaaatagaaaagtt

SEQ ID NO: 3677575 - DNA, 20 bp, Homo sapiens
ttttcacagctttgaggaac

SEQ ID NO: 3677576 - DNA, 18 bp, Homo sapiens
ttttcacattagaagaca

SEQ ID NO: 3677577 - DNA, 18 bp, Homo sapiens
ttttcagaacctcttccc

SEQ ID NO: 3677578 - DNA, 17 bp, Homo sapiens
ttttcagatgtgaacca

SEQ ID NO: 3677579 - DNA, 17 bp, Homo sapiens
ttttcattcctaaagaa

SEQ ID NO: 3677580 - DNA, 11 bp, Homo sapiens
ttttccaaatg

SEQ ID NO: 3677581 - DNA, 14 bp, Homo sapiens
ttttccaaatgctt

SEQ ID NO: 3677582 - DNA, 21 bp, Homo sapiens
ttttccaacttggctgcagga

SEQ ID NO: 3677583 - DNA, 18 bp, Homo sapiens
ttttccatgaaaatgcaa

SEQ ID NO: 3677584 - DNA, 21 bp, Homo sapiens
ttttccatggcaggaaggctt

SEQ ID NO: 3677585 - DNA, 18 bp, Homo sapiens
ttttccccccactctccc

SEQ ID NO: 3677586 - DNA, 19 bp, Homo sapiens
ttttccccccactctcccc

SEQ ID NO: 3677587 - DNA, 16 bp, Homo sapiens
ttttctacgtttcttt

SEQ ID NO: 3677588 - DNA, 16 bp, Homo sapiens
ttttctggaaaatgct

SEQ ID NO: 3677589 - DNA, 20 bp, Homo sapiens
ttttctggaaaatgcttctt

SEQ ID NO: 3677590 - DNA, 12 bp, Homo sapiens
ttttctttgcaa

SEQ ID NO: 3677591 - DNA, 15 bp, Homo sapiens
ttttctttgcaaagt

SEQ ID NO: 3677592 - DNA, 17 bp, Homo sapiens
ttttggacttcaaagca

SEQ ID NO: 3677593 - DNA, 17 bp, Homo sapiens
ttttggagtgttatgta

SEQ ID NO: 3677594 - DNA, 13 bp, Homo sapiens
ttttgttttacaa

SEQ ID NO: 3677595 - DNA, 18 bp, Homo sapiens
ttttgttttttcaaaata

SEQ ID NO: 3677596 - DNA, 16 bp, Homo sapiens
tttttaaattttgtaa

SEQ ID NO: 3677597 - DNA, 23 bp, Homo sapiens
tttttaagggttatcttagatgt

SEQ ID NO: 3677598 - DNA, 13 bp, Homo sapiens
tttttacagctgt

SEQ ID NO: 3677599 - DNA, 22 bp, Homo sapiens
tttttcacataaagggaacaaa

SEQ ID NO: 3677600 - DNA, 21 bp, Homo sapiens
tttttctcgctgtcctttcta

SEQ ID NO: 3677601 - DNA, 12 bp, Homo sapiens
tttttggacttc

SEQ ID NO: 3677602 - DNA, 19 bp, Homo sapiens
tttttggagtgttatgtat

SEQ ID NO: 3677603 - DNA, 20 bp, Homo sapiens
tttttggagtgttatgtatt

SEQ ID NO: 3677604 - DNA, 16 bp, Homo sapiens
tttttgtaaatgtgta

SEQ ID NO: 3677605 - DNA, 20 bp, Homo sapiens
tttttgtggttttgagaaag

SEQ ID NO: 3677606 - DNA, 15 bp, Homo sapiens
tttttgtgtatttgt

SEQ ID NO: 3677607 - DNA, 19 bp, Homo sapiens
ttttttcattttgttctgt

SEQ ID NO: 3677608 - DNA, 16 bp, Homo sapiens
ttttttggtacaaaaa

SEQ ID NO: 3677609 - DNA, 13 bp, Homo sapiens
tttttttcctttt

SEQ ID NO: 3677610 - DNA, 21 bp, Homo sapiens
ctgctaccgttgacttccagg

SEQ ID NO: 3677611 - DNA, 15 bp, Homo sapiens
ctgctacctctgaga

SEQ ID NO: 3677612 - DNA, 18 bp, Homo sapiens
ctgctacctctgagaaga

SEQ ID NO: 3677613 - DNA, 20 bp, Homo sapiens
ctgctacctttcaaagcttg

SEQ ID NO: 3677614 - DNA, 17 bp, Homo sapiens
ctgctactggcaaaagg

SEQ ID NO: 3677615 - DNA, 14 bp, Homo sapiens
ctgctatagcctgg

SEQ ID NO: 3677616 - DNA, 11 bp, Homo sapiens
ctgctccacca

SEQ ID NO: 3677617 - DNA, 13 bp, Homo sapiens
ctgctccaccctt

SEQ ID NO: 3677618 - DNA, 17 bp, Homo sapiens
ctgctccacccttggcc

SEQ ID NO: 3677619 - DNA, 19 bp, Homo sapiens
ctgctccacccttggcctg

SEQ ID NO: 3677620 - DNA, 20 bp, Homo sapiens
ctgctccacccttggcctgt

SEQ ID NO: 3677621 - DNA, 14 bp, Homo sapiens
ctgctccagacctg

SEQ ID NO: 3677622 - DNA, 14 bp, Homo sapiens
ctgctccagctgtt

SEQ ID NO: 3677623 - DNA, 19 bp, Homo sapiens
ctgctccagctgttcagct

SEQ ID NO: 3677624 - DNA, 20 bp, Homo sapiens
ctgctccagctgttcagctg

SEQ ID NO: 3677625 - DNA, 14 bp, Homo sapiens
ctgctcctagaggg

SEQ ID NO: 3677626 - DNA, 22 bp, Homo sapiens
ctgctcctagagggaggggcct

SEQ ID NO: 3677627 - DNA, 13 bp, Homo sapiens
ctgctcctcatgg

SEQ ID NO: 3677628 - DNA, 14 bp, Homo sapiens
ctgctcctcatggt

SEQ ID NO: 3677629 - DNA, 16 bp, Homo sapiens
ctgctctgctcagctg

SEQ ID NO: 3677630 - DNA, 18 bp, Homo sapiens
ctgctctttctctgccag

SEQ ID NO: 3677631 - DNA, 19 bp, Homo sapiens
ctgctctttctctgccagt

SEQ ID NO: 3677632 - DNA, 22 bp, Homo sapiens
ctgctctttctctgccagtgac

SEQ ID NO: 3677633 - DNA, 16 bp, Homo sapiens
ctgctgacctccacag

SEQ ID NO: 3677634 - DNA, 19 bp, Homo sapiens
ctgctgagatacatacaga

SEQ ID NO: 3677635 - DNA, 20 bp, Homo sapiens
ctgctgagatacatacagaa

SEQ ID NO: 3677636 - DNA, 23 bp, Homo sapiens
ctgctgcttaagtgcatgcattg

SEQ ID NO: 3677637 - DNA, 14 bp, Homo sapiens
ctgctggcttgcag

SEQ ID NO: 3677638 - DNA, 16 bp, Homo sapiens
ctgctggcttgcagtg

SEQ ID NO: 3677639 - DNA, 13 bp, Homo sapiens
ctgctgggccccg

SEQ ID NO: 3677640 - DNA, 16 bp, Homo sapiens
ctgctggtccgtggga

SEQ ID NO: 3677641 - DNA, 18 bp, Homo sapiens
ctgcttcccatgcctgca

SEQ ID NO: 3677642 - DNA, 15 bp, Homo sapiens
ctgcttcctcctgga

SEQ ID NO: 3677643 - DNA, 16 bp, Homo sapiens
ctgcttcctcctggaa

SEQ ID NO: 3677644 - DNA, 14 bp, Homo sapiens
ctgcttctctgact

SEQ ID NO: 3677645 - DNA, 15 bp, Homo sapiens
ctgcttctctgactt

SEQ ID NO: 3677646 - DNA, 17 bp, Homo sapiens
ctgcttctctgacttct

SEQ ID NO: 3677647 - DNA, 23 bp, Homo sapiens
ctgcttctctgacttctgcctgg

SEQ ID NO: 3677648 - DNA, 17 bp, Homo sapiens
ctgctttaacagtggag

SEQ ID NO: 3677649 - DNA, 20 bp, Homo sapiens
ctgctttaacagtggagctg

SEQ ID NO: 3677650 - DNA, 22 bp, Homo sapiens
ctgcttttccttggggcaggca

SEQ ID NO: 3677651 - DNA, 20 bp, Homo sapiens
ctggaaaataatactgctga

SEQ ID NO: 3677652 - DNA, 16 bp, Homo sapiens
ctggaacaaattattt

SEQ ID NO: 3677653 - DNA, 19 bp, Homo sapiens
ctggaacactatagagaac

SEQ ID NO: 3677654 - DNA, 13 bp, Homo sapiens
ctggaacccagac

SEQ ID NO: 3677655 - DNA, 17 bp, Homo sapiens
ctggaacctcagcctgg

SEQ ID NO: 3677656 - DNA, 16 bp, Homo sapiens
ctggaacctgcaaaaa

SEQ ID NO: 3677657 - DNA, 18 bp, Homo sapiens
ctggaacctgcaaaaaat

SEQ ID NO: 3677658 - DNA, 14 bp, Homo sapiens
ctggaacttgggga

SEQ ID NO: 3677659 - DNA, 18 bp, Homo sapiens
ctggaagaaaaaaaccac

SEQ ID NO: 3677660 - DNA, 15 bp, Homo sapiens
ctggaagtttctggt

SEQ ID NO: 3677661 - DNA, 23 bp, Homo sapiens
ctggaagtttctggtgccatttc

SEQ ID NO: 3677662 - DNA, 13 bp, Homo sapiens
ctggacagaggcg

SEQ ID NO: 3677663 - DNA, 15 bp, Homo sapiens
ctggacagaggcggg

SEQ ID NO: 3677664 - DNA, 19 bp, Homo sapiens
ctggacagccccaccctgg

SEQ ID NO: 3677665 - DNA, 23 bp, Homo sapiens
ctggacagcctcttctgtcccaa

SEQ ID NO: 3677666 - DNA, 14 bp, Homo sapiens
ctggaccccagcct

SEQ ID NO: 3677667 - DNA, 22 bp, Homo sapiens
ctggaccccagccttggtgggg

SEQ ID NO: 3677668 - DNA, 16 bp, Homo sapiens
ctggacctgtatattt

SEQ ID NO: 3677669 - DNA, 23 bp, Homo sapiens
ctggacggggcgggccctgcctg

SEQ ID NO: 3677670 - DNA, 14 bp, Homo sapiens
ctggagaagcacca

SEQ ID NO: 3677671 - DNA, 15 bp, Homo sapiens
ctggagaagcaccag

SEQ ID NO: 3677672 - DNA, 20 bp, Homo sapiens
ctggagagcactgccaggac

SEQ ID NO: 3677673 - DNA, 20 bp, Homo sapiens
ctggagatcctcctgcagac

SEQ ID NO: 3677674 - DNA, 14 bp, Homo sapiens
ctggagcccaggga

SEQ ID NO: 3677675 - DNA, 13 bp, Homo sapiens
ctggagccccatc

SEQ ID NO: 3677676 - DNA, 13 bp, Homo sapiens
ctggaggcccagt

SEQ ID NO: 3677677 - DNA, 14 bp, Homo sapiens
ctggagtacccagc

SEQ ID NO: 3677678 - DNA, 16 bp, Homo sapiens
ctggagtacccagcct

SEQ ID NO: 3677679 - DNA, 14 bp, Homo sapiens
ctggagtgcagtga

SEQ ID NO: 3677680 - DNA, 24 bp, Homo sapiens
ctggagtggccactaagcagagga

SEQ ID NO: 3677681 - DNA, 15 bp, Homo sapiens
ctggagttgatctgg

SEQ ID NO: 3677682 - DNA, 16 bp, Homo sapiens
ctggagttgatctgga

SEQ ID NO: 3677683 - DNA, 21 bp, Homo sapiens
ctggatggggcagagcttctc

SEQ ID NO: 3677684 - DNA, 22 bp, Homo sapiens
ctggatggggcagagcttctcc

SEQ ID NO: 3677685 - DNA, 21 bp, Homo sapiens
ctggattccccatctcaggcc

SEQ ID NO: 3677686 - DNA, 13 bp, Homo sapiens
ctggatttgatga

SEQ ID NO: 3677687 - DNA, 19 bp, Homo sapiens
ctggcactcttgttcccac

SEQ ID NO: 3677688 - DNA, 11 bp, Homo sapiens
ctggcagccca

SEQ ID NO: 3677689 - DNA, 12 bp, Homo sapiens
ctggcagctctg

SEQ ID NO: 3677690 - DNA, 17 bp, Homo sapiens
ctggcagctctggacag

SEQ ID NO: 3677691 - DNA, 20 bp, Homo sapiens
ctggcagctctggacagccc

SEQ ID NO: 3677692 - DNA, 18 bp, Homo sapiens
ctggcaggtcaacctcgc

SEQ ID NO: 3677693 - DNA, 15 bp, Homo sapiens
ctggccagacacagg

SEQ ID NO: 3677694 - DNA, 17 bp, Homo sapiens
ctggccagacacaggcc

SEQ ID NO: 3677695 - DNA, 19 bp, Homo sapiens
ctggccagacacaggccct

SEQ ID NO: 3677696 - DNA, 15 bp, Homo sapiens
ctggccaggagctct

SEQ ID NO: 3677697 - DNA, 14 bp, Homo sapiens
ctggccaggcagat

SEQ ID NO: 3677698 - DNA, 21 bp, Homo sapiens
ctggccagtccaggctgccgt

SEQ ID NO: 3677699 - DNA, 19 bp, Homo sapiens
ctggcccagggcccagagc

SEQ ID NO: 3677700 - DNA, 21 bp, Homo sapiens
ctggcccagggcccagagccc

SEQ ID NO: 3677701 - DNA, 23 bp, Homo sapiens
ctggcccagggcccagagcccag

SEQ ID NO: 3677702 - DNA, 16 bp, Homo sapiens
ctggccctccactcct

SEQ ID NO: 3677703 - DNA, 21 bp, Homo sapiens
ctggccctccactcctcatcc

SEQ ID NO: 3677704 - DNA, 17 bp, Homo sapiens
ctggccgagggtcctgg

SEQ ID NO: 3677705 - DNA, 15 bp, Homo sapiens
ctggccttctcctac

SEQ ID NO: 3677706 - DNA, 22 bp, Homo sapiens
ctggctagagtcctcactccca

SEQ ID NO: 3677707 - DNA, 16 bp, Homo sapiens
ctggctcctgaggggc

SEQ ID NO: 3677708 - DNA, 17 bp, Homo sapiens
ctggctcctgaggggca

SEQ ID NO: 3677709 - DNA, 20 bp, Homo sapiens
ctggctgactaagccccgtc

SEQ ID NO: 3677710 - DNA, 23 bp, Homo sapiens
ctggctgactaagccccgtctga

SEQ ID NO: 3677711 - DNA, 13 bp, Homo sapiens
ctggctgtcgaga

SEQ ID NO: 3677712 - DNA, 15 bp, Homo sapiens
ctggcttagtgccac

SEQ ID NO: 3677713 - DNA, 13 bp, Homo sapiens
ctggcttctggcc

SEQ ID NO: 3677714 - DNA, 14 bp, Homo sapiens
ctggctttggcttc

SEQ ID NO: 3677715 - DNA, 20 bp, Homo sapiens
ctgggaaccgccctcctgat

SEQ ID NO: 3677716 - DNA, 14 bp, Homo sapiens
ctgggaagcccgga

SEQ ID NO: 3677717 - DNA, 16 bp, Homo sapiens
ctgggaagcccggact

SEQ ID NO: 3677718 - DNA, 19 bp, Homo sapiens
ctgggaaggttccatgaag

SEQ ID NO: 3677719 - DNA, 20 bp, Homo sapiens
ctgggaccaggctccaatgg

SEQ ID NO: 3677720 - DNA, 17 bp, Homo sapiens
ctgggactcagccttca

SEQ ID NO: 3677721 - DNA, 18 bp, Homo sapiens
ctgggacttctgggtctc

SEQ ID NO: 3677722 - DNA, 20 bp, Homo sapiens
ctgggagaaatctggcttct

SEQ ID NO: 3677723 - DNA, 20 bp, Homo sapiens
ctgggagctccactctgctt

SEQ ID NO: 3677724 - DNA, 19 bp, Homo sapiens
ctgggatgtttctgtcaca

SEQ ID NO: 3677725 - DNA, 21 bp, Homo sapiens
ctgggatttatgctcatgaac

SEQ ID NO: 3677726 - DNA, 17 bp, Homo sapiens
ctgggcagaaggccaag

SEQ ID NO: 3677727 - DNA, 15 bp, Homo sapiens
ctgggcagccaggct

SEQ ID NO: 3677728 - DNA, 11 bp, Homo sapiens
ctgggccctgg

SEQ ID NO: 3677729 - DNA, 16 bp, Homo sapiens
tgttctaacatgtaat

SEQ ID NO: 3677730 - DNA, 23 bp, Homo sapiens
tgttctggggggacccagtgcag

SEQ ID NO: 3677731 - DNA, 19 bp, Homo sapiens
tgttctgtttgttattgtt

SEQ ID NO: 3677732 - DNA, 16 bp, Homo sapiens
tgttgacacaggtctt

SEQ ID NO: 3677733 - DNA, 16 bp, Homo sapiens
tgttgacatatttaat

SEQ ID NO: 3677734 - DNA, 21 bp, Homo sapiens
tgttgacatatttaatgtttt

SEQ ID NO: 3677735 - DNA, 19 bp, Homo sapiens
tgttgatcatgtacttttt

SEQ ID NO: 3677736 - DNA, 22 bp, Homo sapiens
tgttgatcatgtactttttagt

SEQ ID NO: 3677737 - DNA, 18 bp, Homo sapiens
tgttgccaagctccaagc

SEQ ID NO: 3677738 - DNA, 12 bp, Homo sapiens
tgttggcaggct

SEQ ID NO: 3677739 - DNA, 18 bp, Homo sapiens
tgttggcaggctggccag

SEQ ID NO: 3677740 - DNA, 21 bp, Homo sapiens
tgttggcaggctggccagtcc

SEQ ID NO: 3677741 - DNA, 17 bp, Homo sapiens
tgttgtaaaacaaaatt

SEQ ID NO: 3677742 - DNA, 22 bp, Homo sapiens
tgttgtaaaacaaaatttgact

SEQ ID NO: 3677743 - DNA, 13 bp, Homo sapiens
tgttgtgtgtgca

SEQ ID NO: 3677744 - DNA, 12 bp, Homo sapiens
tgtttaaaacat

SEQ ID NO: 3677745 - DNA, 16 bp, Homo sapiens
tgtttaaaacatcatt

SEQ ID NO: 3677746 - DNA, 17 bp, Homo sapiens
tgtttacatttactgaa

SEQ ID NO: 3677747 - DNA, 14 bp, Homo sapiens
tgtttatggcctca

SEQ ID NO: 3677748 - DNA, 24 bp, Homo sapiens
tgtttatggcctcagctgcctcac

SEQ ID NO: 3677749 - DNA, 22 bp, Homo sapiens
tgtttattttctacgtttcttt

SEQ ID NO: 3677750 - DNA, 23 bp, Homo sapiens
tgtttcacaccggaaggttttta

SEQ ID NO: 3677751 - DNA, 23 bp, Homo sapiens
tgtttcacggggcccttacctgt

SEQ ID NO: 3677752 - DNA, 18 bp, Homo sapiens
tgtttccagcagaagaca

SEQ ID NO: 3677753 - DNA, 15 bp, Homo sapiens
tgtttcgtggggagg

SEQ ID NO: 3677754 - DNA, 11 bp, Homo sapiens
tgtttctgtaa

SEQ ID NO: 3677755 - DNA, 16 bp, Homo sapiens
tgtttctgtaagaaac

SEQ ID NO: 3677756 - DNA, 20 bp, Homo sapiens
tgtttgaaaaagctggtctt

SEQ ID NO: 3677757 - DNA, 14 bp, Homo sapiens
tgtttgcaagcagg

SEQ ID NO: 3677758 - DNA, 13 bp, Homo sapiens
tgtttgctttctg

SEQ ID NO: 3677759 - DNA, 14 bp, Homo sapiens
tgtttgtaaatgcc

SEQ ID NO: 3677760 - DNA, 17 bp, Homo sapiens
tgtttgttgtcagctga

SEQ ID NO: 3677761 - DNA, 18 bp, Homo sapiens
tgttttaaaactggacct

SEQ ID NO: 3677762 - DNA, 14 bp, Homo sapiens
tgttttaaatgtac

SEQ ID NO: 3677763 - DNA, 23 bp, Homo sapiens
tgttttaaatgtacagacatatt

SEQ ID NO: 3677764 - DNA, 16 bp, Homo sapiens
tgttttatgagaaagc

SEQ ID NO: 3677765 - DNA, 15 bp, Homo sapiens
tgttttctcttgaga

SEQ ID NO: 3677766 - DNA, 13 bp, Homo sapiens
tgttttgaggaat

SEQ ID NO: 3677767 - DNA, 13 bp, Homo sapiens
tgtttttaatgct

SEQ ID NO: 3677768 - DNA, 19 bp, Homo sapiens
tgtttttaatgctatttga

SEQ ID NO: 3677769 - DNA, 13 bp, Homo sapiens
tgtttttgtctta

SEQ ID NO: 3677770 - DNA, 13 bp, Homo sapiens
ttaaaaaaaatcc

SEQ ID NO: 3677771 - DNA, 14 bp, Homo sapiens
ttaaaaaatatttt

SEQ ID NO: 3677772 - DNA, 16 bp, Homo sapiens
ttaaaaacatagaaaa

SEQ ID NO: 3677773 - DNA, 16 bp, Homo sapiens
ttaaaaaggtttacag

SEQ ID NO: 3677774 - DNA, 18 bp, Homo sapiens
ttaaaaagtggaaaaata

SEQ ID NO: 3677775 - DNA, 12 bp, Homo sapiens
ttaaaacacttt

SEQ ID NO: 3677776 - DNA, 21 bp, Homo sapiens
ttaaaatggtttgtcctgatg

SEQ ID NO: 3677777 - DNA, 22 bp, Homo sapiens
ttaaacacacagatacacacac

SEQ ID NO: 3677778 - DNA, 21 bp, Homo sapiens
ttaaacacttatcttctggat

SEQ ID NO: 3677779 - DNA, 22 bp, Homo sapiens
ttaaactctgttgcaagtgcaa

SEQ ID NO: 3677780 - DNA, 21 bp, Homo sapiens
ttaaagcttatttttctgtga

SEQ ID NO: 3677781 - DNA, 13 bp, Homo sapiens
ttaaagtgaattg

SEQ ID NO: 3677782 - DNA, 18 bp, Homo sapiens
ttaaatagtaaaaataaa

SEQ ID NO: 3677783 - DNA, 16 bp, Homo sapiens
ttaaatatccaggtgt

SEQ ID NO: 3677784 - DNA, 18 bp, Homo sapiens
ttaaatattatgctgctt

SEQ ID NO: 3677785 - DNA, 22 bp, Homo sapiens
ttaaatattttctattttaaga

SEQ ID NO: 3677786 - DNA, 16 bp, Homo sapiens
ttaaatgtacagacat

SEQ ID NO: 3677787 - DNA, 21 bp, Homo sapiens
ttaaatgtacagacatattta

SEQ ID NO: 3677788 - DNA, 16 bp, Homo sapiens
ttaaattacaatttta

SEQ ID NO: 3677789 - DNA, 17 bp, Homo sapiens
ttaaattacaattttat

SEQ ID NO: 3677790 - DNA, 18 bp, Homo sapiens
ttaaattacaattttatc

SEQ ID NO: 3677791 - DNA, 15 bp, Homo sapiens
ttaaattttgtaatg

SEQ ID NO: 3677792 - DNA, 18 bp, Homo sapiens
ttaacaaactcttcagtt

SEQ ID NO: 3677793 - DNA, 17 bp, Homo sapiens
ttaacaatctaacaata

SEQ ID NO: 3677794 - DNA, 14 bp, Homo sapiens
ttaacagagtctga

SEQ ID NO: 3677795 - DNA, 15 bp, Homo sapiens
ttaacctctgcacta

SEQ ID NO: 3677796 - DNA, 15 bp, Homo sapiens
ttaaccttgtataaa

SEQ ID NO: 3677797 - DNA, 21 bp, Homo sapiens
ttaactgccaatccttaaata

SEQ ID NO: 3677798 - DNA, 21 bp, Homo sapiens
ttaactggtgcactttgtaaa

SEQ ID NO: 3677799 - DNA, 23 bp, Homo sapiens
ttaactggtgcactttgtaaatt

SEQ ID NO: 3677800 - DNA, 16 bp, Homo sapiens
ttaactgtgaaatacc

SEQ ID NO: 3677801 - DNA, 19 bp, Homo sapiens
ttaacttggtcagagccac

SEQ ID NO: 3677802 - DNA, 14 bp, Homo sapiens
ttaagaactgctgt

SEQ ID NO: 3677803 - DNA, 22 bp, Homo sapiens
ttaagaatacacaggatatttt

SEQ ID NO: 3677804 - DNA, 11 bp, Homo sapiens
ttaagacctgg

SEQ ID NO: 3677805 - DNA, 18 bp, Homo sapiens
ttaagactgattttaata

SEQ ID NO: 3677806 - DNA, 21 bp, Homo sapiens
ttaagctgttcctgttcagta

SEQ ID NO: 3677807 - DNA, 11 bp, Homo sapiens
ttaaggaacat

SEQ ID NO: 3677808 - DNA, 22 bp, Homo sapiens
ttaaggcgtggcttctgcagga

SEQ ID NO: 3677809 - DNA, 23 bp, Homo sapiens
ttaaggctgaggaaaggccagct

SEQ ID NO: 3677810 - DNA, 14 bp, Homo sapiens
ttaaggtgtagcca

SEQ ID NO: 3677811 - DNA, 22 bp, Homo sapiens
ttaagtaccaatgggaagcagg

SEQ ID NO: 3677812 - DNA, 15 bp, Homo sapiens
ttaataaaaaggcac

SEQ ID NO: 3677813 - DNA, 17 bp, Homo sapiens
ttaatacttgaactgtt

SEQ ID NO: 3677814 - DNA, 17 bp, Homo sapiens
ttaatagggaatatatc

SEQ ID NO: 3677815 - DNA, 23 bp, Homo sapiens
ttaatataaagtagtcctgtgaa

SEQ ID NO: 3677816 - DNA, 22 bp, Homo sapiens
ttaatatggggatgcagcatta

SEQ ID NO: 3677817 - DNA, 13 bp, Homo sapiens
ttaatcattttca

SEQ ID NO: 3677818 - DNA, 15 bp, Homo sapiens
ttaatcattttcatt

SEQ ID NO: 3677819 - DNA, 22 bp, Homo sapiens
ttaatgaatcgtaatgaagttg

SEQ ID NO: 3677820 - DNA, 16 bp, Homo sapiens
ttaatgctatttgaac

SEQ ID NO: 3677821 - DNA, 15 bp, Homo sapiens
ttaatgtttaaaaca

SEQ ID NO: 3677822 - DNA, 18 bp, Homo sapiens
ttaatgttttaaatgtac

SEQ ID NO: 3677823 - DNA, 13 bp, Homo sapiens
ttaattgctttga

SEQ ID NO: 3677824 - DNA, 15 bp, Homo sapiens
ttaatttatttagtt

SEQ ID NO: 3677825 - DNA, 14 bp, Homo sapiens
ttaatttgttgtag

SEQ ID NO: 3677826 - DNA, 17 bp, Homo sapiens
ttaatttttaatgatga

SEQ ID NO: 3677827 - DNA, 12 bp, Homo sapiens
ttacaaacatgt

SEQ ID NO: 3677828 - DNA, 13 bp, Homo sapiens
ttacaactgaaac

SEQ ID NO: 3677829 - DNA, 22 bp, Homo sapiens
ttacaactgaaacctaggaagc

SEQ ID NO: 3677830 - DNA, 13 bp, Homo sapiens
ttacaacttgtat

SEQ ID NO: 3677831 - DNA, 17 bp, Homo sapiens
ttacaagtttatatata

SEQ ID NO: 3677832 - DNA, 20 bp, Homo sapiens
ttacacaatggtttttaaat

SEQ ID NO: 3677833 - DNA, 22 bp, Homo sapiens
ttacacaatggtttttaaattt

SEQ ID NO: 3677834 - DNA, 16 bp, Homo sapiens
ttacagatttaataca

SEQ ID NO: 3677835 - DNA, 14 bp, Homo sapiens
ttacagtgcagtgc

SEQ ID NO: 3677836 - DNA, 20 bp, Homo sapiens
ttactataagaactttgagc

SEQ ID NO: 3677837 - DNA, 14 bp, Homo sapiens
ttactgggccctga

SEQ ID NO: 3677838 - DNA, 16 bp, Homo sapiens
ttactgttttgaggaa

SEQ ID NO: 3677839 - DNA, 21 bp, Homo sapiens
ttacttaaaccgccaaggctg

SEQ ID NO: 3677840 - DNA, 14 bp, Homo sapiens
ttacttggcttttt

SEQ ID NO: 3677841 - DNA, 17 bp, Homo sapiens
ttagaccccatacaagt

SEQ ID NO: 3677842 - DNA, 13 bp, Homo sapiens
ttagagattataa

SEQ ID NO: 3677843 - DNA, 20 bp, Homo sapiens
ttagatacactaaaaatctg

SEQ ID NO: 3677844 - DNA, 15 bp, Homo sapiens
ttagatgtttcacac

SEQ ID NO: 3677845 - DNA, 18 bp, Homo sapiens
ttagcaaattctgttttt

SEQ ID NO: 3677846 - DNA, 17 bp, Homo sapiens
ttagccagatttgtctt

SEQ ID NO: 3677847 - DNA, 15 bp, Homo sapiens
ttagcctccctgaaa

SEQ ID NO: 3677848 - DNA, 13 bp, Homo sapiens
ttagctcctgtgg

SEQ ID NO: 3677849 - DNA, 13 bp, Homo sapiens
ttaggagaagcca

SEQ ID NO: 3677850 - DNA, 16 bp, Homo sapiens
ttaggattttcacatt

SEQ ID NO: 3677851 - DNA, 18 bp, Homo sapiens
ttaggctggtggcccagg

SEQ ID NO: 3677852 - DNA, 19 bp, Homo sapiens
ttaggctggtggcccagga

SEQ ID NO: 3677853 - DNA, 20 bp, Homo sapiens
ttagggacatttccaagctg

SEQ ID NO: 3677854 - DNA, 17 bp, Homo sapiens
ttagggcaccaggggtt

SEQ ID NO: 3677855 - DNA, 19 bp, Homo sapiens
ttaggtgtgggggaagcac

SEQ ID NO: 3677856 - DNA, 15 bp, Homo sapiens
ttagtgacaaaatag

SEQ ID NO: 3677857 - DNA, 20 bp, Homo sapiens
ttagtgagcagtgagcactg

SEQ ID NO: 3677858 - DNA, 13 bp, Homo sapiens
ttagtggcaccgc

SEQ ID NO: 3677859 - DNA, 14 bp, Homo sapiens
ttagttccttgagt

SEQ ID NO: 3677860 - DNA, 16 bp, Homo sapiens
ttagtttgtgtgttgt

SEQ ID NO: 3677861 - DNA, 18 bp, Homo sapiens
ttagtttttaacaatcta

SEQ ID NO: 3677862 - DNA, 18 bp, Homo sapiens
ttataccccaataatcaa

SEQ ID NO: 3677863 - DNA, 19 bp, Homo sapiens
ttatactcttcctattttt

SEQ ID NO: 3677864 - DNA, 17 bp, Homo sapiens
ttatactgtacaataaa

SEQ ID NO: 3677865 - DNA, 18 bp, Homo sapiens
ttatactgtacaataaaa

SEQ ID NO: 3677866 - DNA, 14 bp, Homo sapiens
ttataggtgagaaa

SEQ ID NO: 3677867 - DNA, 19 bp, Homo sapiens
ttatattaatgtacttgtt

SEQ ID NO: 3677868 - DNA, 16 bp, Homo sapiens
ttatattatttacatt

SEQ ID NO: 3677869 - DNA, 22 bp, Homo sapiens
ttatatttcagatgtaatgttt

SEQ ID NO: 3677870 - DNA, 18 bp, Homo sapiens
ttatatttgtgctatagt

SEQ ID NO: 3677871 - DNA, 12 bp, Homo sapiens
ttatcacctcat

SEQ ID NO: 3677872 - DNA, 18 bp, Homo sapiens
ttatcacctcattctgaa

SEQ ID NO: 3677873 - DNA, 16 bp, Homo sapiens
ttatcctaagggaaga

SEQ ID NO: 3677874 - DNA, 20 bp, Homo sapiens
ttatcctcctgttctgaaac

SEQ ID NO: 3677875 - DNA, 22 bp, Homo sapiens
ttatcttatactgtacaataaa

SEQ ID NO: 3677876 - DNA, 17 bp, Homo sapiens
ttatgctctcactgttt

SEQ ID NO: 3677877 - DNA, 16 bp, Homo sapiens
ttatgctgctttaaca

SEQ ID NO: 3677878 - DNA, 12 bp, Homo sapiens
ttatggcctcag

SEQ ID NO: 3677879 - DNA, 14 bp, Homo sapiens
ttatgtgatcaatt

SEQ ID NO: 3677880 - DNA, 19 bp, Homo sapiens
ttatgtgtgaggagctgct

SEQ ID NO: 3677881 - DNA, 13 bp, Homo sapiens
ttattacatgtaa

SEQ ID NO: 3677882 - DNA, 15 bp, Homo sapiens
ttattacatgtaatt

SEQ ID NO: 3677883 - DNA, 17 bp, Homo sapiens
ttattatatttgacatg

SEQ ID NO: 3677884 - DNA, 19 bp, Homo sapiens
ttattatcctcctgttctg

SEQ ID NO: 3677885 - DNA, 18 bp, Homo sapiens
ttattcagtaactgtcag

SEQ ID NO: 3677886 - DNA, 19 bp, Homo sapiens
ttattcgtagatattggac

SEQ ID NO: 3677887 - DNA, 16 bp, Homo sapiens
ttattgtctgtctaca

SEQ ID NO: 3677888 - DNA, 21 bp, Homo sapiens
ttattgtctgtctacatttct

SEQ ID NO: 3677889 - DNA, 18 bp, Homo sapiens
ttattttctacgtttctt

SEQ ID NO: 3677890 - DNA, 22 bp, Homo sapiens
ttcaaaatatttaaaaatgtct

SEQ ID NO: 3677891 - DNA, 18 bp, Homo sapiens
ttcaaatcattccttaga

SEQ ID NO: 3677892 - DNA, 22 bp, Homo sapiens
ttcaacaaatattcactggccc

SEQ ID NO: 3677893 - DNA, 16 bp, Homo sapiens
ttcaacagtgaagaca

SEQ ID NO: 3677894 - DNA, 22 bp, Homo sapiens
ttcaaccaaggaggaattgaaa

SEQ ID NO: 3677895 - DNA, 21 bp, Homo sapiens
ttcaactgccaaaatgctcta

SEQ ID NO: 3677896 - DNA, 17 bp, Homo sapiens
ttcaagcagtcgtgcct

SEQ ID NO: 3677897 - DNA, 18 bp, Homo sapiens
ttcaagcagtcgtgcctg

SEQ ID NO: 3677898 - DNA, 12 bp, Homo sapiens
ttcaagtgccaa

SEQ ID NO: 3677899 - DNA, 12 bp, Homo sapiens
ttcaagtgccta

SEQ ID NO: 3677900 - DNA, 22 bp, Homo sapiens
ttcaagttttgggtatgtttaa

SEQ ID NO: 3677901 - DNA, 17 bp, Homo sapiens
ttcaatttccaagagct

SEQ ID NO: 3677902 - DNA, 15 bp, Homo sapiens
ttcacaaaatttcca

SEQ ID NO: 3677903 - DNA, 15 bp, Homo sapiens
ttcacaaagcccaag

SEQ ID NO: 3677904 - DNA, 21 bp, Homo sapiens
ttcacagttctttgggccaga

SEQ ID NO: 3677905 - DNA, 16 bp, Homo sapiens
ttcacattagaagaca

SEQ ID NO: 3677906 - DNA, 20 bp, Homo sapiens
ttcacattgtttgctgctat

SEQ ID NO: 3677907 - DNA, 18 bp, Homo sapiens
ttcacggaagagccttgc

SEQ ID NO: 3677908 - DNA, 13 bp, Homo sapiens
ttcacttttctgt

SEQ ID NO: 3677909 - DNA, 23 bp, Homo sapiens
ttcacttttctgtaaatatacat

SEQ ID NO: 3677910 - DNA, 15 bp, Homo sapiens
ttcagaaagaagtgg

SEQ ID NO: 3677911 - DNA, 19 bp, Homo sapiens
ttcagaacctcttccccag

SEQ ID NO: 3677912 - DNA, 21 bp, Homo sapiens
ttcagaagtggagatttcagt

SEQ ID NO: 3677913 - DNA, 21 bp, Homo sapiens
ttcagagtttgtcatatactg

SEQ ID NO: 3677914 - DNA, 14 bp, Homo sapiens
ttcagatgtaatgt

SEQ ID NO: 3677915 - DNA, 13 bp, Homo sapiens
ttcagcaaaccat

SEQ ID NO: 3677916 - DNA, 17 bp, Homo sapiens
ttcagcagcaaattttc

SEQ ID NO: 3677917 - DNA, 20 bp, Homo sapiens
ttcagcagcaaattttcagc

SEQ ID NO: 3677918 - DNA, 11 bp, Homo sapiens
ttcagccaagg

SEQ ID NO: 3677919 - DNA, 17 bp, Homo sapiens
ttcagccaggagctggg

SEQ ID NO: 3677920 - DNA, 20 bp, Homo sapiens
ttcagcccaccagccacctc

SEQ ID NO: 3677921 - DNA, 14 bp, Homo sapiens
ttcagcctgccttc

SEQ ID NO: 3677922 - DNA, 15 bp, Homo sapiens
ttcagcctgccttct

SEQ ID NO: 3677923 - DNA, 17 bp, Homo sapiens
ttcagctgacttttctg

SEQ ID NO: 3677924 - DNA, 16 bp, Homo sapiens
ttcaggctgcttggga

SEQ ID NO: 3677925 - DNA, 16 bp, Homo sapiens
ttcaggggactcagcc

SEQ ID NO: 3677926 - DNA, 19 bp, Homo sapiens
ttcaggggactcagccctg

SEQ ID NO: 3677927 - DNA, 19 bp, Homo sapiens
ttcaggtagctgcccctgg

SEQ ID NO: 3677928 - DNA, 14 bp, Homo sapiens
ttcagtaagccgtg

SEQ ID NO: 3677929 - DNA, 21 bp, Homo sapiens
ttcagtacttttttaaatatt

SEQ ID NO: 3677930 - DNA, 17 bp, Homo sapiens
ttcagtccaataggtgt

SEQ ID NO: 3677931 - DNA, 14 bp, Homo sapiens
ttcatgcagtgctc

SEQ ID NO: 3677932 - DNA, 13 bp, Homo sapiens
ttcattcatcctg

SEQ ID NO: 3677933 - DNA, 17 bp, Homo sapiens
ttcattctccttgttgt

SEQ ID NO: 3677934 - DNA, 14 bp, Homo sapiens
ttcattctctttta

SEQ ID NO: 3677935 - DNA, 15 bp, Homo sapiens
ttcattttcagagtg

SEQ ID NO: 3677936 - DNA, 18 bp, Homo sapiens
ttccaacacatttcactt

SEQ ID NO: 3677937 - DNA, 22 bp, Homo sapiens
ttccaacttggctgcaggaatc

SEQ ID NO: 3677938 - DNA, 19 bp, Homo sapiens
ttccaagctgttagttgct

SEQ ID NO: 3677939 - DNA, 15 bp, Homo sapiens
ttccaccacagccag

SEQ ID NO: 3677940 - DNA, 16 bp, Homo sapiens
ttccaccacagccagc

SEQ ID NO: 3677941 - DNA, 17 bp, Homo sapiens
ttccacgggggctgtgg

SEQ ID NO: 3677942 - DNA, 21 bp, Homo sapiens
ttccagcatttagctggccac

SEQ ID NO: 3677943 - DNA, 14 bp, Homo sapiens
ttccagcccctctg

SEQ ID NO: 3677944 - DNA, 17 bp, Homo sapiens
ttccagcccctctggtc

SEQ ID NO: 3677945 - DNA, 17 bp, Homo sapiens
ttccaggtttaagctgt

SEQ ID NO: 3677946 - DNA, 18 bp, Homo sapiens
ttccaggtttaagctgtt

SEQ ID NO: 3677947 - DNA, 19 bp, Homo sapiens
ttccatccacccctgcgtc

SEQ ID NO: 3677948 - DNA, 15 bp, Homo sapiens
ttccatgaaaatgca

SEQ ID NO: 3677949 - DNA, 23 bp, Homo sapiens
ttccatgcctgtagctttcctgg

SEQ ID NO: 3677950 - DNA, 17 bp, Homo sapiens
ttccatggcaggaaggc

SEQ ID NO: 3677951 - DNA, 22 bp, Homo sapiens
ttccatgggaccacaactattt

SEQ ID NO: 3677952 - DNA, 14 bp, Homo sapiens
ttccatggttacca

SEQ ID NO: 3677953 - DNA, 15 bp, Homo sapiens
ttccattagcatttg

SEQ ID NO: 3677954 - DNA, 12 bp, Homo sapiens
ttccatttccaa

SEQ ID NO: 3677955 - DNA, 15 bp, Homo sapiens
ttcccaactctagct

SEQ ID NO: 3677956 - DNA, 19 bp, Homo sapiens
ttcccagagtcatctgatt

SEQ ID NO: 3677957 - DNA, 23 bp, Homo sapiens
ttcccatggggagggattctggt

SEQ ID NO: 3677958 - DNA, 14 bp, Homo sapiens
ttcccattggcttt

SEQ ID NO: 3677959 - DNA, 18 bp, Homo sapiens
ttccccccactctcccca

SEQ ID NO: 3677960 - DNA, 15 bp, Homo sapiens
ttccctacctcaggc

SEQ ID NO: 3677961 - DNA, 22 bp, Homo sapiens
ttccctgggaaccgccctcctg

SEQ ID NO: 3677962 - DNA, 21 bp, Homo sapiens
ttccctgggtggagcaggact

SEQ ID NO: 3677963 - DNA, 11 bp, Homo sapiens
ttcccttggcc

SEQ ID NO: 3677964 - DNA, 16 bp, Homo sapiens
ttccgcaccctgccta

SEQ ID NO: 3677965 - DNA, 20 bp, Homo sapiens
ttccgtaggtagatgtgtaa

SEQ ID NO: 3677966 - DNA, 23 bp, Homo sapiens
ttccgtatctccctggagaagca

SEQ ID NO: 3677967 - DNA, 16 bp, Homo sapiens
ttcctaatatcaaatg

SEQ ID NO: 3677968 - DNA, 23 bp, Homo sapiens
ttcctacaagagcagcctgtggc

SEQ ID NO: 3677969 - DNA, 16 bp, Homo sapiens
ttcctatctttacatc

SEQ ID NO: 3677970 - DNA, 14 bp, Homo sapiens
ttcctcagcctggg

SEQ ID NO: 3677971 - DNA, 15 bp, Homo sapiens
ttcctcattccttgt

SEQ ID NO: 3677972 - DNA, 11 bp, Homo sapiens
ttcctcccttc

SEQ ID NO: 3677973 - DNA, 18 bp, Homo sapiens
ttcctcccttctgctact

SEQ ID NO: 3677974 - DNA, 14 bp, Homo sapiens
ttcctcctggaaat

SEQ ID NO: 3677975 - DNA, 13 bp, Homo sapiens
ttcctctgtgcca

SEQ ID NO: 3677976 - DNA, 22 bp, Homo sapiens
ttcctctttgctttgctttctg

SEQ ID NO: 3677977 - DNA, 22 bp, Homo sapiens
ttcctctttttatttagttcct

SEQ ID NO: 3677978 - DNA, 18 bp, Homo sapiens
ttcctgaaacaacttgga

SEQ ID NO: 3677979 - DNA, 16 bp, Homo sapiens
ttcctgaagaaccagt

SEQ ID NO: 3677980 - DNA, 16 bp, Homo sapiens
ttcctgcaaccactct

SEQ ID NO: 3677981 - DNA, 16 bp, Homo sapiens
ttcctgccccaggcct

SEQ ID NO: 3677982 - DNA, 15 bp, Homo sapiens
ttcctggaacctgga

SEQ ID NO: 3677983 - DNA, 11 bp, Homo sapiens
ttcctggaagc

SEQ ID NO: 3677984 - DNA, 14 bp, Homo sapiens
ttcctggatggggc

SEQ ID NO: 3677985 - DNA, 20 bp, Homo sapiens
ttcctggatggggcagagct

SEQ ID NO: 3677986 - DNA, 15 bp, Homo sapiens
ttcctggccctccac

SEQ ID NO: 3677987 - DNA, 21 bp, Homo sapiens
ttcctggggtaaagtatcact

SEQ ID NO: 3677988 - DNA, 14 bp, Homo sapiens
ttcctggtccctca

SEQ ID NO: 3677989 - DNA, 16 bp, Homo sapiens
ttcctgtccagctcca

SEQ ID NO: 3677990 - DNA, 14 bp, Homo sapiens
ttccttagatacct

SEQ ID NO: 3677991 - DNA, 20 bp, Homo sapiens
ttccttgagttgattcagct

SEQ ID NO: 3677992 - DNA, 15 bp, Homo sapiens
ttcgagaccagcctg

SEQ ID NO: 3677993 - DNA, 16 bp, Homo sapiens
ttcgagaccagcctgg

SEQ ID NO: 3677994 - DNA, 22 bp, Homo sapiens
ttcgcttcttgcctctgtgctg

SEQ ID NO: 3677995 - DNA, 22 bp, Homo sapiens
ttcggtggctagtcaagctcct

SEQ ID NO: 3677996 - DNA, 17 bp, Homo sapiens
ttcgttctgtactgtta

SEQ ID NO: 3677997 - DNA, 14 bp, Homo sapiens
ttcgttctttttaa

SEQ ID NO: 3677998 - DNA, 21 bp, Homo sapiens
ttctaatgaggagagaaaata

SEQ ID NO: 3677999 - DNA, 16 bp, Homo sapiens
ttctaatggaatggtt

SEQ ID NO: 3678000 - DNA, 17 bp, Homo sapiens
ttctaatggaatggttt

SEQ ID NO: 3678001 - DNA, 22 bp, Homo sapiens
ttctaattaaccttactaatta

SEQ ID NO: 3678002 - DNA, 18 bp, Homo sapiens
ttctacccaacggccctg

SEQ ID NO: 3678003 - DNA, 16 bp, Homo sapiens
ttctaggcatctctgt

SEQ ID NO: 3678004 - DNA, 13 bp, Homo sapiens
ttctaggcctggg

SEQ ID NO: 3678005 - DNA, 12 bp, Homo sapiens
ttctatgtatgt

SEQ ID NO: 3678006 - DNA, 22 bp, Homo sapiens
ttctattttaagactgatttta

SEQ ID NO: 3678007 - DNA, 18 bp, Homo sapiens
ttctcatactacaggata

SEQ ID NO: 3678008 - DNA, 21 bp, Homo sapiens
ttctccacctcccacaaagga

SEQ ID NO: 3678009 - DNA, 16 bp, Homo sapiens
ttctccgttagctcct

SEQ ID NO: 3678010 - DNA, 17 bp, Homo sapiens
ttctccgttagctcctg

SEQ ID NO: 3678011 - DNA, 20 bp, Homo sapiens
ttctccgttagctcctgtgg

SEQ ID NO: 3678012 - DNA, 18 bp, Homo sapiens
ttctccttggaggacagt

SEQ ID NO: 3678013 - DNA, 17 bp, Homo sapiens
ttctcgtgcctccccac

SEQ ID NO: 3678014 - DNA, 17 bp, Homo sapiens
ttctctccgcgggtggg

SEQ ID NO: 3678015 - DNA, 22 bp, Homo sapiens
ttctctccttggcctttcctgg

SEQ ID NO: 3678016 - DNA, 23 bp, Homo sapiens
ttctctccttggcctttcctgga

SEQ ID NO: 3678017 - DNA, 11 bp, Homo sapiens
ttctctgctcc

SEQ ID NO: 3678018 - DNA, 13 bp, Homo sapiens
ttctctgtacttt

SEQ ID NO: 3678019 - DNA, 16 bp, Homo sapiens
ttctcttgggtgggac

SEQ ID NO: 3678020 - DNA, 19 bp, Homo sapiens
ttctgaaaattaacactgc

SEQ ID NO: 3678021 - DNA, 13 bp, Homo sapiens
ttctgaaacctta

SEQ ID NO: 3678022 - DNA, 16 bp, Homo sapiens
ttctgaactttggaag

SEQ ID NO: 3678023 - DNA, 18 bp, Homo sapiens
ttctgacctcaagtgatt

SEQ ID NO: 3678024 - DNA, 19 bp, Homo sapiens
ttctgattccgcaccctgc

SEQ ID NO: 3678025 - DNA, 16 bp, Homo sapiens
ttctgccagggagctt

SEQ ID NO: 3678026 - DNA, 19 bp, Homo sapiens
ttctgccatctagccagcc

SEQ ID NO: 3678027 - DNA, 17 bp, Homo sapiens
ttctgccggccctgggg

SEQ ID NO: 3678028 - DNA, 18 bp, Homo sapiens
ttctgccggccctggggc

SEQ ID NO: 3678029 - DNA, 16 bp, Homo sapiens
ttctgcctgccagctg

SEQ ID NO: 3678030 - DNA, 18 bp, Homo sapiens
ttctgcctgccagctgca

SEQ ID NO: 3678031 - DNA, 19 bp, Homo sapiens
ttctgcctgccagctgcac

SEQ ID NO: 3678032 - DNA, 16 bp, Homo sapiens
ttctgcctttgatgtt

SEQ ID NO: 3678033 - DNA, 22 bp, Homo sapiens
ttctgctcagaggccttgctgt

SEQ ID NO: 3678034 - DNA, 9 bp, Homo sapiens
ttctgctcc

SEQ ID NO: 3678035 - DNA, 19 bp, Homo sapiens
ttctggaatttgttcaagt

SEQ ID NO: 3678036 - DNA, 21 bp, Homo sapiens
ttctggaatttgttcaagttt

SEQ ID NO: 3678037 - DNA, 22 bp, Homo sapiens
ttctggaatttgttcaagtttt

SEQ ID NO: 3678038 - DNA, 11 bp, Homo sapiens
ttctggcaccg

SEQ ID NO: 3678039 - DNA, 14 bp, Homo sapiens
ttctggccaggaag

SEQ ID NO: 3678040 - DNA, 19 bp, Homo sapiens
ttctggggggacccagtgc

SEQ ID NO: 3678041 - DNA, 20 bp, Homo sapiens
ttctggggggacccagtgca

SEQ ID NO: 3678042 - DNA, 21 bp, Homo sapiens
ttctggggggacccagtgcag

SEQ ID NO: 3678043 - DNA, 15 bp, Homo sapiens
ttctgtactgttact

SEQ ID NO: 3678044 - DNA, 14 bp, Homo sapiens
ttctgtcccaagtc

SEQ ID NO: 3678045 - DNA, 17 bp, Homo sapiens
ttctgtccgagctttga

SEQ ID NO: 3678046 - DNA, 21 bp, Homo sapiens
ttctgtccgagctttgaaaat

SEQ ID NO: 3678047 - DNA, 15 bp, Homo sapiens
ttctgtgacccatct

SEQ ID NO: 3678048 - DNA, 19 bp, Homo sapiens
ttctgtgacccatctgtag

SEQ ID NO: 3678049 - DNA, 19 bp, Homo sapiens
ttctgtgagacccccacac

SEQ ID NO: 3678050 - DNA, 21 bp, Homo sapiens
ttctgtgtatctctttcacat

SEQ ID NO: 3678051 - DNA, 17 bp, Homo sapiens
ttcttaaaaaattgaaa

SEQ ID NO: 3678052 - DNA, 16 bp, Homo sapiens
ttcttaaacacttgca

SEQ ID NO: 3678053 - DNA, 23 bp, Homo sapiens
ttcttaacaaactcttcagttaa

SEQ ID NO: 3678054 - DNA, 16 bp, Homo sapiens
ttcttacgcaatgctt

SEQ ID NO: 3678055 - DNA, 19 bp, Homo sapiens
ttcttcagtctggactata

SEQ ID NO: 3678056 - DNA, 19 bp, Homo sapiens
ttcttccaacacatttcac

SEQ ID NO: 3678057 - DNA, 14 bp, Homo sapiens
ttcttcctggatgg

SEQ ID NO: 3678058 - DNA, 18 bp, Homo sapiens
ttcttcgttctttttaag

SEQ ID NO: 3678059 - DNA, 14 bp, Homo sapiens
ttcttctggtgcta

SEQ ID NO: 3678060 - DNA, 17 bp, Homo sapiens
ttcttggggcccagtgc

SEQ ID NO: 3678061 - DNA, 18 bp, Homo sapiens
ttcttggggcccagtgca

SEQ ID NO: 3678062 - DNA, 19 bp, Homo sapiens
ttcttggtaactgattacc

SEQ ID NO: 3678063 - DNA, 19 bp, Homo sapiens
ttcttggtttatgtcttgt

SEQ ID NO: 3678064 - DNA, 15 bp, Homo sapiens
ttcttgtgttctgta

SEQ ID NO: 3678065 - DNA, 14 bp, Homo sapiens
ttctttaaagaagt

SEQ ID NO: 3678066 - DNA, 19 bp, Homo sapiens
ttctttaaccttgtataaa

SEQ ID NO: 3678067 - DNA, 14 bp, Homo sapiens
ttctttagagatta

SEQ ID NO: 3678068 - DNA, 18 bp, Homo sapiens
ttctttgcagctgcccag

SEQ ID NO: 3678069 - DNA, 13 bp, Homo sapiens
ttctttgggccag

SEQ ID NO: 3678070 - DNA, 18 bp, Homo sapiens
ttctttttttccttttta

SEQ ID NO: 3678071 - DNA, 21 bp, Homo sapiens
ttcttttttttttttttgaga

SEQ ID NO: 3678072 - DNA, 19 bp, Homo sapiens
ttgaaaggtccaaatgttt

SEQ ID NO: 3678073 - DNA, 17 bp, Homo sapiens
ttgaacccaggagttca

SEQ ID NO: 3678074 - DNA, 16 bp, Homo sapiens
ttgaagaactgcaggc

SEQ ID NO: 3678075 - DNA, 19 bp, Homo sapiens
ttgaagaactgcaggccct

SEQ ID NO: 3678076 - DNA, 19 bp, Homo sapiens
ttgaagggccagagccagg

SEQ ID NO: 3678077 - DNA, 14 bp, Homo sapiens
ttgaattgttacat

SEQ ID NO: 3678078 - DNA, 17 bp, Homo sapiens
ttgacagaacactgtct

SEQ ID NO: 3678079 - DNA, 14 bp, Homo sapiens
ttgacagctttgct

SEQ ID NO: 3678080 - DNA, 17 bp, Homo sapiens
ttgacagctttgctgct

SEQ ID NO: 3678081 - DNA, 23 bp, Homo sapiens
ttgacagggccttaaaattactt

SEQ ID NO: 3678082 - DNA, 13 bp, Homo sapiens
ttgacatatttaa

SEQ ID NO: 3678083 - DNA, 17 bp, Homo sapiens
ttgacatatttaatgtt

SEQ ID NO: 3678084 - DNA, 16 bp, Homo sapiens
ttgaccaagcaggaag

SEQ ID NO: 3678085 - DNA, 22 bp, Homo sapiens
ttgaccaagcaggaagctcaga

SEQ ID NO: 3678086 - DNA, 23 bp, Homo sapiens
tggccttctcctacttagggaag

SEQ ID NO: 3678087 - DNA, 22 bp, Homo sapiens
tggcctttaagcctgcattctt

SEQ ID NO: 3678088 - DNA, 12 bp, Homo sapiens
tggcctttcctg

SEQ ID NO: 3678089 - DNA, 14 bp, Homo sapiens
tggcctttcctgga

SEQ ID NO: 3678090 - DNA, 15 bp, Homo sapiens
tggcgccgtctccag

SEQ ID NO: 3678091 - DNA, 18 bp, Homo sapiens
tggcgccgtctccagggg

SEQ ID NO: 3678092 - DNA, 20 bp, Homo sapiens
tggcgcttagagaggacaat

SEQ ID NO: 3678093 - DNA, 17 bp, Homo sapiens
tggcgggactggagaaa

SEQ ID NO: 3678094 - DNA, 15 bp, Homo sapiens
tggctaagagtgtcc

SEQ ID NO: 3678095 - DNA, 23 bp, Homo sapiens
tggctagaggccagccccaccca

SEQ ID NO: 3678096 - DNA, 20 bp, Homo sapiens
tggctagtcaagctcctcct

SEQ ID NO: 3678097 - DNA, 23 bp, Homo sapiens
tggctagtcaagctcctcctccc

SEQ ID NO: 3678098 - DNA, 16 bp, Homo sapiens
tggctcacacctgtaa

SEQ ID NO: 3678099 - DNA, 14 bp, Homo sapiens
tggctcctgagggg

SEQ ID NO: 3678100 - DNA, 21 bp, Homo sapiens
tggctcctgaggggcatctgc

SEQ ID NO: 3678101 - DNA, 19 bp, Homo sapiens
tggctcgaatctctgtgcc

SEQ ID NO: 3678102 - DNA, 19 bp, Homo sapiens
tggctctgaccgaaacagc

SEQ ID NO: 3678103 - DNA, 14 bp, Homo sapiens
tggctctgggtggg

SEQ ID NO: 3678104 - DNA, 18 bp, Homo sapiens
tggctctgggtgggcgtg

SEQ ID NO: 3678105 - DNA, 21 bp, Homo sapiens
tggctgaaattctcctggagg

SEQ ID NO: 3678106 - DNA, 13 bp, Homo sapiens
tggctgagcccct

SEQ ID NO: 3678107 - DNA, 20 bp, Homo sapiens
tggctggaagatcctgcggg

SEQ ID NO: 3678108 - DNA, 18 bp, Homo sapiens
tggctgggctgctcctga

SEQ ID NO: 3678109 - DNA, 16 bp, Homo sapiens
tggctggtccagggct

SEQ ID NO: 3678110 - DNA, 16 bp, Homo sapiens
tggctgtaatcatttg

SEQ ID NO: 3678111 - DNA, 18 bp, Homo sapiens
tggctgtcaatgggacct

SEQ ID NO: 3678112 - DNA, 19 bp, Homo sapiens
tggcttctggccaggaagc

SEQ ID NO: 3678113 - DNA, 21 bp, Homo sapiens
tggcttctggccaggaagctt

SEQ ID NO: 3678114 - DNA, 16 bp, Homo sapiens
tggcttgggcagcatc

SEQ ID NO: 3678115 - DNA, 21 bp, Homo sapiens
tggctttctctccttggcctt

SEQ ID NO: 3678116 - DNA, 22 bp, Homo sapiens
tggctttttccaaatgcttcta

SEQ ID NO: 3678117 - DNA, 21 bp, Homo sapiens
tgggaagcccggactgaccaa

SEQ ID NO: 3678118 - DNA, 12 bp, Homo sapiens
tgggaaggggag

SEQ ID NO: 3678119 - DNA, 11 bp, Homo sapiens
tgggacagggc

SEQ ID NO: 3678120 - DNA, 18 bp, Homo sapiens
tgggacagggcttctcct

SEQ ID NO: 3678121 - DNA, 21 bp, Homo sapiens
tgggacagggcttctcctgcg

SEQ ID NO: 3678122 - DNA, 21 bp, Homo sapiens
tgggacatttttgtctgtcct

SEQ ID NO: 3678123 - DNA, 22 bp, Homo sapiens
tgggacatttttgtctgtccta

SEQ ID NO: 3678124 - DNA, 14 bp, Homo sapiens
tgggacggtgccca

SEQ ID NO: 3678125 - DNA, 17 bp, Homo sapiens
tgggactacaggcatgc

SEQ ID NO: 3678126 - DNA, 13 bp, Homo sapiens
tgggactcagcct

SEQ ID NO: 3678127 - DNA, 23 bp, Homo sapiens
tgggactcagccttcagacagag

SEQ ID NO: 3678128 - DNA, 13 bp, Homo sapiens
tgggactcttccc

SEQ ID NO: 3678129 - DNA, 13 bp, Homo sapiens
tgggagccccagg

SEQ ID NO: 3678130 - DNA, 22 bp, Homo sapiens
tgggagctccactctgcttctc

SEQ ID NO: 3678131 - DNA, 20 bp, Homo sapiens
tgggaggatctcttgagcct

SEQ ID NO: 3678132 - DNA, 22 bp, Homo sapiens
tgggaggattgcttgagctcag

SEQ ID NO: 3678133 - DNA, 19 bp, Homo sapiens
tgggaggccaaggtgggag

SEQ ID NO: 3678134 - DNA, 20 bp, Homo sapiens
tgggaggccaaggtgggagg

SEQ ID NO: 3678135 - DNA, 23 bp, Homo sapiens
tgggataaagatgcaaggaccag

SEQ ID NO: 3678136 - DNA, 19 bp, Homo sapiens
tgggatccgagggcccctc

SEQ ID NO: 3678137 - DNA, 16 bp, Homo sapiens
tgggcaatatagcaag

SEQ ID NO: 3678138 - DNA, 17 bp, Homo sapiens
tgggcacacacacccgc

SEQ ID NO: 3678139 - DNA, 15 bp, Homo sapiens
tgggcagaaggccaa

SEQ ID NO: 3678140 - DNA, 18 bp, Homo sapiens
tgggcagaaggccaagag

SEQ ID NO: 3678141 - DNA, 12 bp, Homo sapiens
tgggcagagctg

SEQ ID NO: 3678142 - DNA, 20 bp, Homo sapiens
tgggcagagctggctctgag

SEQ ID NO: 3678143 - DNA, 16 bp, Homo sapiens
tgggcagccaggctgc

SEQ ID NO: 3678144 - DNA, 19 bp, Homo sapiens
tgggcagctgtcccttgct

SEQ ID NO: 3678145 - DNA, 23 bp, Homo sapiens
tgggcattgatggggaaggaggc

SEQ ID NO: 3678146 - DNA, 13 bp, Homo sapiens
tgggccagacatg

SEQ ID NO: 3678147 - DNA, 12 bp, Homo sapiens
tgggccagtcct

SEQ ID NO: 3678148 - DNA, 15 bp, Homo sapiens
tgggccagtcctggt

SEQ ID NO: 3678149 - DNA, 16 bp, Homo sapiens
tgggccctaccctcct

SEQ ID NO: 3678150 - DNA, 17 bp, Homo sapiens
tgggccctaccctcctg

SEQ ID NO: 3678151 - DNA, 18 bp, Homo sapiens
tgggccctaccctcctgc

SEQ ID NO: 3678152 - DNA, 20 bp, Homo sapiens
tgggccctaccctcctgctg

SEQ ID NO: 3678153 - DNA, 21 bp, Homo sapiens
tgggccctaccctcctgctga

SEQ ID NO: 3678154 - DNA, 22 bp, Homo sapiens
tgggccctaccctcctgctgag

SEQ ID NO: 3678155 - DNA, 23 bp, Homo sapiens
tgggccctaccctcctgctgagc

SEQ ID NO: 3678156 - DNA, 14 bp, Homo sapiens
tgggccctgggctg

SEQ ID NO: 3678157 - DNA, 13 bp, Homo sapiens
tgggcctgcagaa

SEQ ID NO: 3678158 - DNA, 16 bp, Homo sapiens
tgggcctgctccagac

SEQ ID NO: 3678159 - DNA, 14 bp, Homo sapiens
tgggcgtggcctgc

SEQ ID NO: 3678160 - DNA, 23 bp, Homo sapiens
tgggcgtggcctgcataggctcc

SEQ ID NO: 3678161 - DNA, 16 bp, Homo sapiens
tgggctgctcctcatg

SEQ ID NO: 3678162 - DNA, 13 bp, Homo sapiens
tgggctgctcctg

SEQ ID NO: 3678163 - DNA, 19 bp, Homo sapiens
tgggctgtttctgcttatt

SEQ ID NO: 3678164 - DNA, 22 bp, Homo sapiens
tggggaaaggggtcggctgacc

SEQ ID NO: 3678165 - DNA, 14 bp, Homo sapiens
tggggactgctacc

SEQ ID NO: 3678166 - DNA, 23 bp, Homo sapiens
tggggactgctacctctgagaag

SEQ ID NO: 3678167 - DNA, 16 bp, Homo sapiens
tggggagggcaggtcc

SEQ ID NO: 3678168 - DNA, 17 bp, Homo sapiens
tggggaggggctctgcg

SEQ ID NO: 3678169 - DNA, 17 bp, Homo sapiens
tggggagttaagacctg

SEQ ID NO: 3678170 - DNA, 19 bp, Homo sapiens
tggggagttaagacctggc

SEQ ID NO: 3678171 - DNA, 20 bp, Homo sapiens
tggggagttaagacctggca

SEQ ID NO: 3678172 - DNA, 17 bp, Homo sapiens
tggggcacggctctggg

SEQ ID NO: 3678173 - DNA, 15 bp, Homo sapiens
tggggcagagcttct

SEQ ID NO: 3678174 - DNA, 22 bp, Homo sapiens
tggggcagagcttctcctgacc

SEQ ID NO: 3678175 - DNA, 14 bp, Homo sapiens
tggggcagggagct

SEQ ID NO: 3678176 - DNA, 19 bp, Homo sapiens
tggggccagatccagcctg

SEQ ID NO: 3678177 - DNA, 12 bp, Homo sapiens
tggggcccagtg

SEQ ID NO: 3678178 - DNA, 13 bp, Homo sapiens
tggggcccagtgc

SEQ ID NO: 3678179 - DNA, 14 bp, Homo sapiens
tggggcccagtgca

SEQ ID NO: 3678180 - DNA, 17 bp, Homo sapiens
tggggcgggtcctagct

SEQ ID NO: 3678181 - DNA, 20 bp, Homo sapiens
tggggcgggtcctagctgtt

SEQ ID NO: 3678182 - DNA, 11 bp, Homo sapiens
tggggctccta

SEQ ID NO: 3678183 - DNA, 16 bp, Homo sapiens
tggggctcctacctgg

SEQ ID NO: 3678184 - DNA, 18 bp, Homo sapiens
tgggggaactcagatcca

SEQ ID NO: 3678185 - DNA, 20 bp, Homo sapiens
tgggggaactcagatccagg

SEQ ID NO: 3678186 - DNA, 16 bp, Homo sapiens
tgggggagcctctgga

SEQ ID NO: 3678187 - DNA, 20 bp, Homo sapiens
tgggggagcctctggaatgc

SEQ ID NO: 3678188 - DNA, 16 bp, Homo sapiens
tgggggcacaggaggc

SEQ ID NO: 3678189 - DNA, 19 bp, Homo sapiens
tggggggacccagtgcaga

SEQ ID NO: 3678190 - DNA, 19 bp, Homo sapiens
tggggggctgaggtgggag

SEQ ID NO: 3678191 - DNA, 13 bp, Homo sapiens
tgggggggtggcc

SEQ ID NO: 3678192 - DNA, 14 bp, Homo sapiens
tgggggggtggccg

SEQ ID NO: 3678193 - DNA, 13 bp, Homo sapiens
tgggggtgggcca

SEQ ID NO: 3678194 - DNA, 16 bp, Homo sapiens
tgggggtgggccaggc

SEQ ID NO: 3678195 - DNA, 11 bp, Homo sapiens
tgggggtgggg

SEQ ID NO: 3678196 - DNA, 17 bp, Homo sapiens
tgggggtggggctccta

SEQ ID NO: 3678197 - DNA, 20 bp, Homo sapiens
tgggggtggggctcctacct

SEQ ID NO: 3678198 - DNA, 16 bp, Homo sapiens
tggggtaggctgctcc

SEQ ID NO: 3678199 - DNA, 23 bp, Homo sapiens
tggggtccacttccccctcttca

SEQ ID NO: 3678200 - DNA, 21 bp, Homo sapiens
tggggtctggagttgatctgg

SEQ ID NO: 3678201 - DNA, 23 bp, Homo sapiens
tggggtttaaatatccaggtgtg

SEQ ID NO: 3678202 - DNA, 16 bp, Homo sapiens
tgggtaactagggaag

SEQ ID NO: 3678203 - DNA, 16 bp, Homo sapiens
tgggtaagaagaaagc

SEQ ID NO: 3678204 - DNA, 13 bp, Homo sapiens
tgggtcaaggaat

SEQ ID NO: 3678205 - DNA, 15 bp, Homo sapiens
tgggtccctctgccc

SEQ ID NO: 3678206 - DNA, 14 bp, Homo sapiens
tgggtctgtgcatt

SEQ ID NO: 3678207 - DNA, 21 bp, Homo sapiens
tgggtggcaccagcagcctgg

SEQ ID NO: 3678208 - DNA, 22 bp, Homo sapiens
tgggtggcaccagcagcctgga

SEQ ID NO: 3678209 - DNA, 13 bp, Homo sapiens
tgggtggggcttc

SEQ ID NO: 3678210 - DNA, 14 bp, Homo sapiens
tgggttctgcctgc

SEQ ID NO: 3678211 - DNA, 16 bp, Homo sapiens
tgggttgcagacagga

SEQ ID NO: 3678212 - DNA, 18 bp, Homo sapiens
tggtaaaaactgcagtgt

SEQ ID NO: 3678213 - DNA, 15 bp, Homo sapiens
tggtacaaaaataaa

SEQ ID NO: 3678214 - DNA, 21 bp, Homo sapiens
tggtacaaaaataaatttata

SEQ ID NO: 3678215 - DNA, 15 bp, Homo sapiens
tggtacaacggaggc

SEQ ID NO: 3678216 - DNA, 13 bp, Homo sapiens
tggtaccagatgc

SEQ ID NO: 3678217 - DNA, 20 bp, Homo sapiens
tggtagagtgtgcctgaagt

SEQ ID NO: 3678218 - DNA, 22 bp, Homo sapiens
tggtaggaccaagcatcttggg

SEQ ID NO: 3678219 - DNA, 18 bp, Homo sapiens
tggtagtcctcccaagct

SEQ ID NO: 3678220 - DNA, 19 bp, Homo sapiens
tggtagtcctcccaagctg

SEQ ID NO: 3678221 - DNA, 22 bp, Homo sapiens
tggtagtcctcccaagctgtgc

SEQ ID NO: 3678222 - DNA, 23 bp, Homo sapiens
tggtagtcctcccaagctgtgct

SEQ ID NO: 3678223 - DNA, 13 bp, Homo sapiens
tggtatatataca

SEQ ID NO: 3678224 - DNA, 15 bp, Homo sapiens
tggtcagagccactc

SEQ ID NO: 3678225 - DNA, 12 bp, Homo sapiens
tggtcagagtgc

SEQ ID NO: 3678226 - DNA, 17 bp, Homo sapiens
tggtcagagtgccactg

SEQ ID NO: 3678227 - DNA, 19 bp, Homo sapiens
tggtccagggaagctggcc

SEQ ID NO: 3678228 - DNA, 13 bp, Homo sapiens
tggtccagggcta

SEQ ID NO: 3678229 - DNA, 21 bp, Homo sapiens
tggtccagggctagtgacttg

SEQ ID NO: 3678230 - DNA, 17 bp, Homo sapiens
tggtccgctttcctgga

SEQ ID NO: 3678231 - DNA, 20 bp, Homo sapiens
tggtccgtgggacggtgccc

SEQ ID NO: 3678232 - DNA, 19 bp, Homo sapiens
tggtctcttcttggggccc

SEQ ID NO: 3678233 - DNA, 18 bp, Homo sapiens
tggtctgttggcaggctg

SEQ ID NO: 3678234 - DNA, 22 bp, Homo sapiens
tggtgccatttctgaactgtta

SEQ ID NO: 3678235 - DNA, 17 bp, Homo sapiens
tggtgccccaggaccag

SEQ ID NO: 3678236 - DNA, 20 bp, Homo sapiens
tggtgccccaggaccagctc

SEQ ID NO: 3678237 - DNA, 18 bp, Homo sapiens
tggtggccactgagctgg

SEQ ID NO: 3678238 - DNA, 14 bp, Homo sapiens
tggtggctgggctg

SEQ ID NO: 3678239 - DNA, 16 bp, Homo sapiens
tggtgggggcctcggt

SEQ ID NO: 3678240 - DNA, 18 bp, Homo sapiens
tggtgggggcctcggtgt

SEQ ID NO: 3678241 - DNA, 16 bp, Homo sapiens
tggtggtaaccctggt

SEQ ID NO: 3678242 - DNA, 15 bp, Homo sapiens
tggtggtatctgagt

SEQ ID NO: 3678243 - DNA, 14 bp, Homo sapiens
tggtgtggcctgtg

SEQ ID NO: 3678244 - DNA, 15 bp, Homo sapiens
tggtgtggcctgtgg

SEQ ID NO: 3678245 - DNA, 22 bp, Homo sapiens
tggttaagttttcttgtttctg

SEQ ID NO: 3678246 - DNA, 19 bp, Homo sapiens
tggttcatatttatacttt

SEQ ID NO: 3678247 - DNA, 22 bp, Homo sapiens
tggttgagttcaggtagctgcc

SEQ ID NO: 3678248 - DNA, 19 bp, Homo sapiens
tggttgctgttttcctccc

SEQ ID NO: 3678249 - DNA, 19 bp, Homo sapiens
tggtttatcagcaaaaaag

SEQ ID NO: 3678250 - DNA, 13 bp, Homo sapiens
tggtttatgtctt

SEQ ID NO: 3678251 - DNA, 13 bp, Homo sapiens
tggttttgagaaa

SEQ ID NO: 3678252 - DNA, 23 bp, Homo sapiens
tgtaaaaaaaccaccaaaaacaa

SEQ ID NO: 3678253 - DNA, 22 bp, Homo sapiens
tgtaaaatcctacagtgaaatg

SEQ ID NO: 3678254 - DNA, 18 bp, Homo sapiens
tgtaaataggatttttag

SEQ ID NO: 3678255 - DNA, 14 bp, Homo sapiens
tgtaaatatacata

SEQ ID NO: 3678256 - DNA, 11 bp, Homo sapiens
tgtaaatgcct

SEQ ID NO: 3678257 - DNA, 13 bp, Homo sapiens
tgtaaattatatt

SEQ ID NO: 3678258 - DNA, 15 bp, Homo sapiens
tgtaaattgaagaag

SEQ ID NO: 3678259 - DNA, 22 bp, Homo sapiens
tgtaagaataggcattaacaca

SEQ ID NO: 3678260 - DNA, 20 bp, Homo sapiens
tgtaagcatactttgtaaat

SEQ ID NO: 3678261 - DNA, 13 bp, Homo sapiens
tgtaagttatgtt

SEQ ID NO: 3678262 - DNA, 19 bp, Homo sapiens
tgtaagttatgttttacat

SEQ ID NO: 3678263 - DNA, 20 bp, Homo sapiens
tgtaagttatgttttacatg

SEQ ID NO: 3678264 - DNA, 14 bp, Homo sapiens
tgtaatcatttgtt

SEQ ID NO: 3678265 - DNA, 18 bp, Homo sapiens
tgtaatgttttctttgca

SEQ ID NO: 3678266 - DNA, 19 bp, Homo sapiens
tgtaatgttttctttgcaa

SEQ ID NO: 3678267 - DNA, 21 bp, Homo sapiens
tgtaatgttttctttgcaaag

SEQ ID NO: 3678268 - DNA, 12 bp, Homo sapiens
tgtacaataaaa

SEQ ID NO: 3678269 - DNA, 16 bp, Homo sapiens
tgtacaataaaaacat

SEQ ID NO: 3678270 - DNA, 17 bp, Homo sapiens
tgtacagacatatttaa

SEQ ID NO: 3678271 - DNA, 19 bp, Homo sapiens
tgtacagacatatttaact

SEQ ID NO: 3678272 - DNA, 20 bp, Homo sapiens
tgtacagacatatttaactg

SEQ ID NO: 3678273 - DNA, 17 bp, Homo sapiens
tgtacagtagattttcc

SEQ ID NO: 3678274 - DNA, 18 bp, Homo sapiens
tgtacatttctataaata

SEQ ID NO: 3678275 - DNA, 15 bp, Homo sapiens
tgtaccaagaatctt

SEQ ID NO: 3678276 - DNA, 22 bp, Homo sapiens
tgtacccagtagggtttgacat

SEQ ID NO: 3678277 - DNA, 18 bp, Homo sapiens
tgtactaaagccaaacat

SEQ ID NO: 3678278 - DNA, 12 bp, Homo sapiens
tgtactacaatt

SEQ ID NO: 3678279 - DNA, 12 bp, Homo sapiens
tgtactcagtgg

SEQ ID NO: 3678280 - DNA, 16 bp, Homo sapiens
tgtagccacaccagga

SEQ ID NO: 3678281 - DNA, 15 bp, Homo sapiens
tgtagctaacagtga

SEQ ID NO: 3678282 - DNA, 16 bp, Homo sapiens
tgtagctaacagtgaa

SEQ ID NO: 3678283 - DNA, 17 bp, Homo sapiens
tgtagctaacagtgaag

SEQ ID NO: 3678284 - DNA, 17 bp, Homo sapiens
tgtagctttcctggtcc

SEQ ID NO: 3678285 - DNA, 19 bp, Homo sapiens
tgtaggagctgcagttctt

SEQ ID NO: 3678286 - DNA, 15 bp, Homo sapiens
tgtaggggttaactt

SEQ ID NO: 3678287 - DNA, 22 bp, Homo sapiens
tgtagtccgtgctgacagctgc

SEQ ID NO: 3678288 - DNA, 12 bp, Homo sapiens
tgtatacatctt

SEQ ID NO: 3678289 - DNA, 21 bp, Homo sapiens
tgtatacatcttatagatgca

SEQ ID NO: 3678290 - DNA, 22 bp, Homo sapiens
tgtatacatcttatagatgcaa

SEQ ID NO: 3678291 - DNA, 16 bp, Homo sapiens
tgtatatttaggaaaa

SEQ ID NO: 3678292 - DNA, 18 bp, Homo sapiens
tgtatgaaattataatct

SEQ ID NO: 3678293 - DNA, 17 bp, Homo sapiens
tgtatgtaggagctgca

SEQ ID NO: 3678294 - DNA, 23 bp, Homo sapiens
tgtatgtaggagctgcagttctt

SEQ ID NO: 3678295 - DNA, 19 bp, Homo sapiens
tgtatgtgtctcccaggtg

SEQ ID NO: 3678296 - DNA, 21 bp, Homo sapiens
tgtatgttattatattccgta

SEQ ID NO: 3678297 - DNA, 16 bp, Homo sapiens
tgtatgttgacttttt

SEQ ID NO: 3678298 - DNA, 15 bp, Homo sapiens
tgtattagtcacaga

SEQ ID NO: 3678299 - DNA, 16 bp, Homo sapiens
tgtattgattttcaca

SEQ ID NO: 3678300 - DNA, 21 bp, Homo sapiens
tgtattgattttcacagcttt

SEQ ID NO: 3678301 - DNA, 17 bp, Homo sapiens
tgtatttatgtgtgagg

SEQ ID NO: 3678302 - DNA, 17 bp, Homo sapiens
tgtatttttaaagcatg

SEQ ID NO: 3678303 - DNA, 16 bp, Homo sapiens
tgtcaaagatatgtta

SEQ ID NO: 3678304 - DNA, 14 bp, Homo sapiens
tgtcaagacatttc

SEQ ID NO: 3678305 - DNA, 15 bp, Homo sapiens
tgtcaagacatttct

SEQ ID NO: 3678306 - DNA, 22 bp, Homo sapiens
tgtcaagagtagttatataatt

SEQ ID NO: 3678307 - DNA, 22 bp, Homo sapiens
tgtcaagatgagtggttttctt

SEQ ID NO: 3678308 - DNA, 22 bp, Homo sapiens
tgtcactcaaggcggtgcttga

SEQ ID NO: 3678309 - DNA, 15 bp, Homo sapiens
tgtcagcatagaagt

SEQ ID NO: 3678310 - DNA, 16 bp, Homo sapiens
tgtcagctgaacctgg

SEQ ID NO: 3678311 - DNA, 16 bp, Homo sapiens
tgtcatatactgccat

SEQ ID NO: 3678312 - DNA, 17 bp, Homo sapiens
tgtcatatactgccatg

SEQ ID NO: 3678313 - DNA, 13 bp, Homo sapiens
tgtcatctcagct

SEQ ID NO: 3678314 - DNA, 12 bp, Homo sapiens
tgtcatggtcct

SEQ ID NO: 3678315 - DNA, 20 bp, Homo sapiens
tgtcatggtcctttctggaa

SEQ ID NO: 3678316 - DNA, 13 bp, Homo sapiens
tgtcatttgttaa

SEQ ID NO: 3678317 - DNA, 23 bp, Homo sapiens
tgtccaagtacttaactatctgt

SEQ ID NO: 3678318 - DNA, 12 bp, Homo sapiens
tgtccagcacct

SEQ ID NO: 3678319 - DNA, 15 bp, Homo sapiens
tgtccagcaccttgt

SEQ ID NO: 3678320 - DNA, 12 bp, Homo sapiens
tgtccagcctgg

SEQ ID NO: 3678321 - DNA, 23 bp, Homo sapiens
tgtccagcctgggcagccaggct

SEQ ID NO: 3678322 - DNA, 16 bp, Homo sapiens
tgtccagctccaacct

SEQ ID NO: 3678323 - DNA, 23 bp, Homo sapiens
tgtccagctccaacctgcaaaga

SEQ ID NO: 3678324 - DNA, 20 bp, Homo sapiens
tgtccatgcgctcagggcca

SEQ ID NO: 3678325 - DNA, 13 bp, Homo sapiens
tgtcccagccagt

SEQ ID NO: 3678326 - DNA, 18 bp, Homo sapiens
tgtccccgctgctgtgca

SEQ ID NO: 3678327 - DNA, 17 bp, Homo sapiens
tgtcctccagaagcctc

SEQ ID NO: 3678328 - DNA, 15 bp, Homo sapiens
tgtcctgatgctttt

SEQ ID NO: 3678329 - DNA, 16 bp, Homo sapiens
tgtcctgtacattgtg

SEQ ID NO: 3678330 - DNA, 15 bp, Homo sapiens
tgtcgctcatgtgtg

SEQ ID NO: 3678331 - DNA, 14 bp, Homo sapiens
tgtctagagaggga

SEQ ID NO: 3678332 - DNA, 19 bp, Homo sapiens
tgtctcaggactctgaaaa

SEQ ID NO: 3678333 - DNA, 22 bp, Homo sapiens
tgtctcctatatatttctatta

SEQ ID NO: 3678334 - DNA, 15 bp, Homo sapiens
tgtctcctctctggt

SEQ ID NO: 3678335 - DNA, 18 bp, Homo sapiens
tgtctgaacccaggcagc

SEQ ID NO: 3678336 - DNA, 22 bp, Homo sapiens
tgtctgaacccaggcagctggc

SEQ ID NO: 3678337 - DNA, 14 bp, Homo sapiens
tgtctgagcccaac

SEQ ID NO: 3678338 - DNA, 21 bp, Homo sapiens
tgtctgcatttcggtggctag

SEQ ID NO: 3678339 - DNA, 15 bp, Homo sapiens
tgtctgtcaatcaca

SEQ ID NO: 3678340 - DNA, 16 bp, Homo sapiens
tgtctgtcaatcacag

SEQ ID NO: 3678341 - DNA, 14 bp, Homo sapiens
tgtctgtcctacaa

SEQ ID NO: 3678342 - DNA, 14 bp, Homo sapiens
tgtctgtctggcac

SEQ ID NO: 3678343 - DNA, 19 bp, Homo sapiens
tgtcttgctgttgacatat

SEQ ID NO: 3678344 - DNA, 21 bp, Homo sapiens
tgtcttgggcagagctggctc

SEQ ID NO: 3678345 - DNA, 22 bp, Homo sapiens
tgtcttgggcagagctggctct

SEQ ID NO: 3678346 - DNA, 12 bp, Homo sapiens
tgtcttgttctt

SEQ ID NO: 3678347 - DNA, 12 bp, Homo sapiens
tgtcttttgaca

SEQ ID NO: 3678348 - DNA, 17 bp, Homo sapiens
tgtcttttgacatttta

SEQ ID NO: 3678349 - DNA, 13 bp, Homo sapiens
tgtgaaaagaaaa

SEQ ID NO: 3678350 - DNA, 15 bp, Homo sapiens
tgtgaaaagaaaaat

SEQ ID NO: 3678351 - DNA, 21 bp, Homo sapiens
tgtgaaaagaaaaatgagcct

SEQ ID NO: 3678352 - DNA, 18 bp, Homo sapiens
tgtgaaaatatctgctca

SEQ ID NO: 3678353 - DNA, 23 bp, Homo sapiens
tgtgaaataccacaagcctgaga

SEQ ID NO: 3678354 - DNA, 18 bp, Homo sapiens
tgtgaaccggctcccacc

SEQ ID NO: 3678355 - DNA, 13 bp, Homo sapiens
tgtgaactggaag

SEQ ID NO: 3678356 - DNA, 22 bp, Homo sapiens
tgtgaagatgatatactatttt

SEQ ID NO: 3678357 - DNA, 21 bp, Homo sapiens
tgtgacaattctgtttttaat

SEQ ID NO: 3678358 - DNA, 23 bp, Homo sapiens
tgtgaccctctttgctgaagaat

SEQ ID NO: 3678359 - DNA, 21 bp, Homo sapiens
tgtgacttcttcttctttgtt

SEQ ID NO: 3678360 - DNA, 21 bp, Homo sapiens
tgtgagaagtgaatgctggga

SEQ ID NO: 3678361 - DNA, 15 bp, Homo sapiens
tgtgagacccccaca

SEQ ID NO: 3678362 - DNA, 17 bp, Homo sapiens
tgtgaggcttgcccagg

SEQ ID NO: 3678363 - DNA, 13 bp, Homo sapiens
tgtgataaggaaa

SEQ ID NO: 3678364 - DNA, 16 bp, Homo sapiens
tgtgattgacagcttt

SEQ ID NO: 3678365 - DNA, 22 bp, Homo sapiens
tgtgattgacagctttgctgct

SEQ ID NO: 3678366 - DNA, 23 bp, Homo sapiens
tgtgattgacagctttgctgctg

SEQ ID NO: 3678367 - DNA, 18 bp, Homo sapiens
tgtgcaacagggtatgga

SEQ ID NO: 3678368 - DNA, 10 bp, Homo sapiens
tgtgcacatc

SEQ ID NO: 3678369 - DNA, 21 bp, Homo sapiens
tgtgcacatccgcgtgtgcct

SEQ ID NO: 3678370 - DNA, 16 bp, Homo sapiens
tgtgcactaaggggcc

SEQ ID NO: 3678371 - DNA, 23 bp, Homo sapiens
tgtgcactaaggggcccggccag

SEQ ID NO: 3678372 - DNA, 15 bp, Homo sapiens
tgtgcatagtttctt

SEQ ID NO: 3678373 - DNA, 20 bp, Homo sapiens
tgtgccacgctcctctgttt

SEQ ID NO: 3678374 - DNA, 21 bp, Homo sapiens
tgtgccatttctcagggaagt

SEQ ID NO: 3678375 - DNA, 19 bp, Homo sapiens
tgtgccccatgcctgtcca

SEQ ID NO: 3678376 - DNA, 14 bp, Homo sapiens
tgtgccttcgtctt

SEQ ID NO: 3678377 - DNA, 14 bp, Homo sapiens
tgtgctacagatga

SEQ ID NO: 3678378 - DNA, 17 bp, Homo sapiens
tgtgctagaaattttca

SEQ ID NO: 3678379 - DNA, 17 bp, Homo sapiens
tgtgctgggaagcccgg

SEQ ID NO: 3678380 - DNA, 17 bp, Homo sapiens
tgtgctgggagctccac

SEQ ID NO: 3678381 - DNA, 14 bp, Homo sapiens
tgtgcttttcctga

SEQ ID NO: 3678382 - DNA, 21 bp, Homo sapiens
tgtggagaagcggctggcagc

SEQ ID NO: 3678383 - DNA, 16 bp, Homo sapiens
tgtggagccgaggcct

SEQ ID NO: 3678384 - DNA, 13 bp, Homo sapiens
tgtggaggctcct

SEQ ID NO: 3678385 - DNA, 15 bp, Homo sapiens
tgtggaggctcctgt

SEQ ID NO: 3678386 - DNA, 19 bp, Homo sapiens
tgtggaggctcctgtggta

SEQ ID NO: 3678387 - DNA, 14 bp, Homo sapiens
tgtggatcagagat

SEQ ID NO: 3678388 - DNA, 19 bp, Homo sapiens
tgtggatggcagtgtgggg

SEQ ID NO: 3678389 - DNA, 17 bp, Homo sapiens
tgtggcaatctgtgggc

SEQ ID NO: 3678390 - DNA, 17 bp, Homo sapiens
tgtggcatctttgcctt

SEQ ID NO: 3678391 - DNA, 17 bp, Homo sapiens
tgtggccaaggagctgc

SEQ ID NO: 3678392 - DNA, 18 bp, Homo sapiens
tgtggccaaggagctgct

SEQ ID NO: 3678393 - DNA, 20 bp, Homo sapiens
tgtggccaaggagctgctat

SEQ ID NO: 3678394 - DNA, 21 bp, Homo sapiens
tgtggccaaggagctgctata

SEQ ID NO: 3678395 - DNA, 21 bp, Homo sapiens
tgtggccagctgcatctgtct

SEQ ID NO: 3678396 - DNA, 23 bp, Homo sapiens
tgtggccccaccctgggccctgg

SEQ ID NO: 3678397 - DNA, 16 bp, Homo sapiens
tgtggctagtgacaaa

SEQ ID NO: 3678398 - DNA, 22 bp, Homo sapiens
tgtggctcacgtgagagtgtct

SEQ ID NO: 3678399 - DNA, 17 bp, Homo sapiens
tgtggctccaggccaaa

SEQ ID NO: 3678400 - DNA, 22 bp, Homo sapiens
tgtggctccaggccaaagtgcc

SEQ ID NO: 3678401 - DNA, 16 bp, Homo sapiens
tgtggctctgggtggg

SEQ ID NO: 3678402 - DNA, 18 bp, Homo sapiens
tgtggctctgggtgggcg

SEQ ID NO: 3678403 - DNA, 21 bp, Homo sapiens
tgtggctgggggcaggagggc

SEQ ID NO: 3678404 - DNA, 17 bp, Homo sapiens
tgtgggatctgaggagt

SEQ ID NO: 3678405 - DNA, 21 bp, Homo sapiens
tgtggggagggcaggtccagc

SEQ ID NO: 3678406 - DNA, 15 bp, Homo sapiens
tgtgggtacctgtat

SEQ ID NO: 3678407 - DNA, 15 bp, Homo sapiens
tgtgggtcaaggaat

SEQ ID NO: 3678408 - DNA, 18 bp, Homo sapiens
tgtgggtccctctgcccc

SEQ ID NO: 3678409 - DNA, 21 bp, Homo sapiens
tgtgtaaaaaaaccaccaaaa

SEQ ID NO: 3678410 - DNA, 13 bp, Homo sapiens
tgtgtaacatatt

SEQ ID NO: 3678411 - DNA, 17 bp, Homo sapiens
tgtgtatctctttcaca

SEQ ID NO: 3678412 - DNA, 19 bp, Homo sapiens
tgtgtcccaggcagggaga

SEQ ID NO: 3678413 - DNA, 12 bp, Homo sapiens
tgtgtctgagcc

SEQ ID NO: 3678414 - DNA, 19 bp, Homo sapiens
tgtgtctttaaatgctgct

SEQ ID NO: 3678415 - DNA, 15 bp, Homo sapiens
tgtgtgattgacagc

SEQ ID NO: 3678416 - DNA, 19 bp, Homo sapiens
tgtgtgattgacagctttg

SEQ ID NO: 3678417 - DNA, 15 bp, Homo sapiens
tgtgtgcgtgtcagt

SEQ ID NO: 3678418 - DNA, 16 bp, Homo sapiens
tgtgtgtcccaggcag

SEQ ID NO: 3678419 - DNA, 13 bp, Homo sapiens
tgtgtgtgcgtgt

SEQ ID NO: 3678420 - DNA, 16 bp, Homo sapiens
tgtgtgtgtgtgtgcg

SEQ ID NO: 3678421 - DNA, 14 bp, Homo sapiens
tgtgttcctgcttt

SEQ ID NO: 3678422 - DNA, 16 bp, Homo sapiens
tgtgttgccaagctcc

SEQ ID NO: 3678423 - DNA, 21 bp, Homo sapiens
tgtgtttacatttactgaaat

SEQ ID NO: 3678424 - DNA, 14 bp, Homo sapiens
tgtgtttgctttct

SEQ ID NO: 3678425 - DNA, 15 bp, Homo sapiens
tgtgtttgctttctg

SEQ ID NO: 3678426 - DNA, 20 bp, Homo sapiens
tgttaagcgtgtctgtattt

SEQ ID NO: 3678427 - DNA, 19 bp, Homo sapiens
tgttacaagtttatatata

SEQ ID NO: 3678428 - DNA, 15 bp, Homo sapiens
tgttactgggccctg

SEQ ID NO: 3678429 - DNA, 15 bp, Homo sapiens
tgttactgtcttcag

SEQ ID NO: 3678430 - DNA, 19 bp, Homo sapiens
tgttatagaatagcctgag

SEQ ID NO: 3678431 - DNA, 21 bp, Homo sapiens
tgttatcttatactgtacaat

SEQ ID NO: 3678432 - DNA, 20 bp, Homo sapiens
tgttatgtactagtgttctg

SEQ ID NO: 3678433 - DNA, 14 bp, Homo sapiens
tgttattagatgtt

SEQ ID NO: 3678434 - DNA, 19 bp, Homo sapiens
tgttattatatttgacatg

SEQ ID NO: 3678435 - DNA, 14 bp, Homo sapiens
tgttcagcactgtc

SEQ ID NO: 3678436 - DNA, 13 bp, Homo sapiens
tgttcagtaataa

SEQ ID NO: 3678437 - DNA, 15 bp, Homo sapiens
tgttcatagcccagt

SEQ ID NO: 3678438 - DNA, 19 bp, Homo sapiens
tgttcatagcccagtagac

SEQ ID NO: 3678439 - DNA, 20 bp, Homo sapiens
tgttcccaccaggctgctca

SEQ ID NO: 3678440 - DNA, 13 bp, Homo sapiens
tgttccccagaga

SEQ ID NO: 3678441 - DNA, 15 bp, Homo sapiens
tccctacctcaggca

SEQ ID NO: 3678442 - DNA, 16 bp, Homo sapiens
tccctattagagaaga

SEQ ID NO: 3678443 - DNA, 15 bp, Homo sapiens
tccctcaccttggca

SEQ ID NO: 3678444 - DNA, 16 bp, Homo sapiens
tccctcccccccatgc

SEQ ID NO: 3678445 - DNA, 21 bp, Homo sapiens
tccctcccccccatgcactgt

SEQ ID NO: 3678446 - DNA, 14 bp, Homo sapiens
tccctcctcacctc

SEQ ID NO: 3678447 - DNA, 16 bp, Homo sapiens
tccctcctcacctctg

SEQ ID NO: 3678448 - DNA, 18 bp, Homo sapiens
tccctcctcacctctgga

SEQ ID NO: 3678449 - DNA, 18 bp, Homo sapiens
tccctctctcttctgctc

SEQ ID NO: 3678450 - DNA, 20 bp, Homo sapiens
tccctctctcttctgctcca

SEQ ID NO: 3678451 - DNA, 17 bp, Homo sapiens
tccctgaaaatgttttt

SEQ ID NO: 3678452 - DNA, 16 bp, Homo sapiens
tccctgcagctgaccg

SEQ ID NO: 3678453 - DNA, 10 bp, Homo sapiens
tccctgccaa

SEQ ID NO: 3678454 - DNA, 19 bp, Homo sapiens
tccctggagaagcaccagc

SEQ ID NO: 3678455 - DNA, 14 bp, Homo sapiens
tccctggctcccat

SEQ ID NO: 3678456 - DNA, 16 bp, Homo sapiens
tccctggggacggggc

SEQ ID NO: 3678457 - DNA, 19 bp, Homo sapiens
tccctggggacggggctcc

SEQ ID NO: 3678458 - DNA, 21 bp, Homo sapiens
tccctggggacggggctcccc

SEQ ID NO: 3678459 - DNA, 13 bp, Homo sapiens
tccctgggggcgg

SEQ ID NO: 3678460 - DNA, 20 bp, Homo sapiens
tccctgggggcgggactcct

SEQ ID NO: 3678461 - DNA, 19 bp, Homo sapiens
tccctgggggtggggctcc

SEQ ID NO: 3678462 - DNA, 20 bp, Homo sapiens
tccctgggggtggggctcct

SEQ ID NO: 3678463 - DNA, 17 bp, Homo sapiens
tccctggttgcctcatg

SEQ ID NO: 3678464 - DNA, 17 bp, Homo sapiens
tccctgtgttgtctcta

SEQ ID NO: 3678465 - DNA, 12 bp, Homo sapiens
tcccttcccctc

SEQ ID NO: 3678466 - DNA, 22 bp, Homo sapiens
tcccttctagggttattgcatt

SEQ ID NO: 3678467 - DNA, 14 bp, Homo sapiens
tcccttctgctact

SEQ ID NO: 3678468 - DNA, 14 bp, Homo sapiens
tcccttgagccctc

SEQ ID NO: 3678469 - DNA, 20 bp, Homo sapiens
tcccttgcttgcctgcaggg

SEQ ID NO: 3678470 - DNA, 12 bp, Homo sapiens
tcccttggcctc

SEQ ID NO: 3678471 - DNA, 13 bp, Homo sapiens
tcccttggcctca

SEQ ID NO: 3678472 - DNA, 19 bp, Homo sapiens
tcccttgtgtcaagacatt

SEQ ID NO: 3678473 - DNA, 21 bp, Homo sapiens
tcccttgtgtcaagacatttc

SEQ ID NO: 3678474 - DNA, 19 bp, Homo sapiens
tccctttccttccatccct

SEQ ID NO: 3678475 - DNA, 22 bp, Homo sapiens
tccctttgtctgtcaatcacag

SEQ ID NO: 3678476 - DNA, 18 bp, Homo sapiens
tcccttttaatcctggct

SEQ ID NO: 3678477 - DNA, 17 bp, Homo sapiens
tcccttttaggtgaggg

SEQ ID NO: 3678478 - DNA, 12 bp, Homo sapiens
tccgactgcttt

SEQ ID NO: 3678479 - DNA, 15 bp, Homo sapiens
tccgactgctttgga

SEQ ID NO: 3678480 - DNA, 18 bp, Homo sapiens
tccgagggcccctctcca

SEQ ID NO: 3678481 - DNA, 17 bp, Homo sapiens
tccgatggtatctgggt

SEQ ID NO: 3678482 - DNA, 22 bp, Homo sapiens
tccgcaccctgcctacgccagg

SEQ ID NO: 3678483 - DNA, 18 bp, Homo sapiens
tccgcctgtccacagccc

SEQ ID NO: 3678484 - DNA, 14 bp, Homo sapiens
tccgcgtgtgcctg

SEQ ID NO: 3678485 - DNA, 18 bp, Homo sapiens
tccgcgtgtgcctgtgtg

SEQ ID NO: 3678486 - DNA, 15 bp, Homo sapiens
tccgctttcctggag

SEQ ID NO: 3678487 - DNA, 17 bp, Homo sapiens
tccgctttcctggagcc

SEQ ID NO: 3678488 - DNA, 19 bp, Homo sapiens
tccgtgctgacagctgctc

SEQ ID NO: 3678489 - DNA, 24 bp, Homo sapiens
tccgtgcttgtttgctcacctggg

SEQ ID NO: 3678490 - DNA, 19 bp, Homo sapiens
tccgtggtcagagtgccac

SEQ ID NO: 3678491 - DNA, 17 bp, Homo sapiens
tccgttagctcctgtgg

SEQ ID NO: 3678492 - DNA, 15 bp, Homo sapiens
tccgttggccactcc

SEQ ID NO: 3678493 - DNA, 15 bp, Homo sapiens
tcctaatcatccaat

SEQ ID NO: 3678494 - DNA, 22 bp, Homo sapiens
tcctacaagagcagcctgtggc

SEQ ID NO: 3678495 - DNA, 14 bp, Homo sapiens
tcctacccatcccc

SEQ ID NO: 3678496 - DNA, 14 bp, Homo sapiens
tcctacctgaaggc

SEQ ID NO: 3678497 - DNA, 18 bp, Homo sapiens
tcctacctgaaggcaggg

SEQ ID NO: 3678498 - DNA, 19 bp, Homo sapiens
tcctacctgaaggcagggc

SEQ ID NO: 3678499 - DNA, 21 bp, Homo sapiens
tcctacctgaaggcagggctc

SEQ ID NO: 3678500 - DNA, 10 bp, Homo sapiens
tcctacctgg

SEQ ID NO: 3678501 - DNA, 23 bp, Homo sapiens
tcctacctgggggcagaactcct

SEQ ID NO: 3678502 - DNA, 20 bp, Homo sapiens
tcctacttagggaagaaaaa

SEQ ID NO: 3678503 - DNA, 22 bp, Homo sapiens
tcctagaaattccccaccctga

SEQ ID NO: 3678504 - DNA, 20 bp, Homo sapiens
tcctagcacttgtctcagga

SEQ ID NO: 3678505 - DNA, 14 bp, Homo sapiens
tcctatatatttct

SEQ ID NO: 3678506 - DNA, 15 bp, Homo sapiens
tcctatatatttcta

SEQ ID NO: 3678507 - DNA, 13 bp, Homo sapiens
tcctatctttaca

SEQ ID NO: 3678508 - DNA, 14 bp, Homo sapiens
tcctattttcttga

SEQ ID NO: 3678509 - DNA, 15 bp, Homo sapiens
tcctcacctctggac

SEQ ID NO: 3678510 - DNA, 20 bp, Homo sapiens
tcctcacctctggactggct

SEQ ID NO: 3678511 - DNA, 21 bp, Homo sapiens
tcctcacctctggactggcta

SEQ ID NO: 3678512 - DNA, 23 bp, Homo sapiens
tcctcacctctggactggctaga

SEQ ID NO: 3678513 - DNA, 13 bp, Homo sapiens
tcctcactcccag

SEQ ID NO: 3678514 - DNA, 14 bp, Homo sapiens
tcctcactcccagt

SEQ ID NO: 3678515 - DNA, 20 bp, Homo sapiens
tcctcagccttgccagagat

SEQ ID NO: 3678516 - DNA, 21 bp, Homo sapiens
tcctcatttggggtagctaga

SEQ ID NO: 3678517 - DNA, 16 bp, Homo sapiens
tcctccaatggaaatt

SEQ ID NO: 3678518 - DNA, 16 bp, Homo sapiens
tcctccagaagcctct

SEQ ID NO: 3678519 - DNA, 12 bp, Homo sapiens
tcctccagcagg

SEQ ID NO: 3678520 - DNA, 21 bp, Homo sapiens
tcctcccaagctgtgctggga

SEQ ID NO: 3678521 - DNA, 21 bp, Homo sapiens
tcctcccaatttcagactccc

SEQ ID NO: 3678522 - DNA, 20 bp, Homo sapiens
tcctcccacccggctgcaga

SEQ ID NO: 3678523 - DNA, 14 bp, Homo sapiens
tcctccctgccctc

SEQ ID NO: 3678524 - DNA, 19 bp, Homo sapiens
tcctccctgccctcgggtc

SEQ ID NO: 3678525 - DNA, 12 bp, Homo sapiens
tcctccctgggg

SEQ ID NO: 3678526 - DNA, 15 bp, Homo sapiens
tcctccctgggggcg

SEQ ID NO: 3678527 - DNA, 20 bp, Homo sapiens
tcctccctgggggcgggact

SEQ ID NO: 3678528 - DNA, 10 bp, Homo sapiens
tcctcccttc

SEQ ID NO: 3678529 - DNA, 17 bp, Homo sapiens
tcctcccttctgctact

SEQ ID NO: 3678530 - DNA, 18 bp, Homo sapiens
tcctcccttctgctactg

SEQ ID NO: 3678531 - DNA, 14 bp, Homo sapiens
tcctccgtccagcc

SEQ ID NO: 3678532 - DNA, 16 bp, Homo sapiens
tcctccgtccagccgc

SEQ ID NO: 3678533 - DNA, 14 bp, Homo sapiens
tcctcctcccaccc

SEQ ID NO: 3678534 - DNA, 20 bp, Homo sapiens
tcctcctcccacccggctgc

SEQ ID NO: 3678535 - DNA, 14 bp, Homo sapiens
tcctcctccctgca

SEQ ID NO: 3678536 - DNA, 18 bp, Homo sapiens
tcctcctccctgcatctg

SEQ ID NO: 3678537 - DNA, 18 bp, Homo sapiens
tcctcctgaaggaggcgg

SEQ ID NO: 3678538 - DNA, 16 bp, Homo sapiens
tcctcctgcccacctg

SEQ ID NO: 3678539 - DNA, 14 bp, Homo sapiens
tcctcgcaagctgg

SEQ ID NO: 3678540 - DNA, 19 bp, Homo sapiens
tcctctccccagcccagag

SEQ ID NO: 3678541 - DNA, 13 bp, Homo sapiens
tcctctccctgcc

SEQ ID NO: 3678542 - DNA, 18 bp, Homo sapiens
tcctctccctgccaagtc

SEQ ID NO: 3678543 - DNA, 21 bp, Homo sapiens
tcctctctggtggctgggctg

SEQ ID NO: 3678544 - DNA, 14 bp, Homo sapiens
tcctctgtggccag

SEQ ID NO: 3678545 - DNA, 20 bp, Homo sapiens
tcctctttgctttgctttct

SEQ ID NO: 3678546 - DNA, 14 bp, Homo sapiens
tcctgaagaaccag

SEQ ID NO: 3678547 - DNA, 21 bp, Homo sapiens
tcctgaaggaggcggggctct

SEQ ID NO: 3678548 - DNA, 22 bp, Homo sapiens
tcctgaaggaggcggggctcta

SEQ ID NO: 3678549 - DNA, 22 bp, Homo sapiens
tcctgaatgaggcggagctcca

SEQ ID NO: 3678550 - DNA, 17 bp, Homo sapiens
tcctgaccaagactgag

SEQ ID NO: 3678551 - DNA, 13 bp, Homo sapiens
tcctgaccagggc

SEQ ID NO: 3678552 - DNA, 20 bp, Homo sapiens
tcctgacctgtctcaccatg

SEQ ID NO: 3678553 - DNA, 17 bp, Homo sapiens
tcctgactcatccgcct

SEQ ID NO: 3678554 - DNA, 15 bp, Homo sapiens
tcctgataaagcaca

SEQ ID NO: 3678555 - DNA, 21 bp, Homo sapiens
tcctgataaagcacagctgta

SEQ ID NO: 3678556 - DNA, 16 bp, Homo sapiens
tcctgcaaccactctg

SEQ ID NO: 3678557 - DNA, 21 bp, Homo sapiens
tcctgcacttacttgcttatt

SEQ ID NO: 3678558 - DNA, 14 bp, Homo sapiens
tcctgccaggcatg

SEQ ID NO: 3678559 - DNA, 18 bp, Homo sapiens
tcctgccattcttctggt

SEQ ID NO: 3678560 - DNA, 22 bp, Homo sapiens
tcctgcttgatgggattctgga

SEQ ID NO: 3678561 - DNA, 23 bp, Homo sapiens
tcctgcttgatgggattctggac

SEQ ID NO: 3678562 - DNA, 14 bp, Homo sapiens
tcctgcttttctaa

SEQ ID NO: 3678563 - DNA, 17 bp, Homo sapiens
tcctggatgtttggaaa

SEQ ID NO: 3678564 - DNA, 13 bp, Homo sapiens
tcctggctcctga

SEQ ID NO: 3678565 - DNA, 13 bp, Homo sapiens
tcctgggagagga

SEQ ID NO: 3678566 - DNA, 23 bp, Homo sapiens
tcctgggagaggacagggacttc

SEQ ID NO: 3678567 - DNA, 16 bp, Homo sapiens
tcctgggcctgcagaa

SEQ ID NO: 3678568 - DNA, 22 bp, Homo sapiens
tcctgggggtggaggcctgcct

SEQ ID NO: 3678569 - DNA, 22 bp, Homo sapiens
tcctgggtggtctgcaggcagg

SEQ ID NO: 3678570 - DNA, 16 bp, Homo sapiens
tcctggttgtctgaac

SEQ ID NO: 3678571 - DNA, 17 bp, Homo sapiens
tcctggttgtctgaacc

SEQ ID NO: 3678572 - DNA, 23 bp, Homo sapiens
tcctggttgtctgaacccaggca

SEQ ID NO: 3678573 - DNA, 14 bp, Homo sapiens
tcctgtacattgtg

SEQ ID NO: 3678574 - DNA, 20 bp, Homo sapiens
tcctgtattcagacagatga

SEQ ID NO: 3678575 - DNA, 13 bp, Homo sapiens
tcctgtccagctc

SEQ ID NO: 3678576 - DNA, 22 bp, Homo sapiens
tcctgtgaatgccactgccttc

SEQ ID NO: 3678577 - DNA, 12 bp, Homo sapiens
tcctgtggcccc

SEQ ID NO: 3678578 - DNA, 13 bp, Homo sapiens
tcctgtgggtggg

SEQ ID NO: 3678579 - DNA, 16 bp, Homo sapiens
tcctgtggtagtcctc

SEQ ID NO: 3678580 - DNA, 19 bp, Homo sapiens
tcctgtggtagtcctccca

SEQ ID NO: 3678581 - DNA, 21 bp, Homo sapiens
tcctgtggtagtcctcccaag

SEQ ID NO: 3678582 - DNA, 18 bp, Homo sapiens
tccttacccatctgcacc

SEQ ID NO: 3678583 - DNA, 17 bp, Homo sapiens
tccttagatctggcatg

SEQ ID NO: 3678584 - DNA, 14 bp, Homo sapiens
tccttccaacagga

SEQ ID NO: 3678585 - DNA, 18 bp, Homo sapiens
tccttcccattggctttc

SEQ ID NO: 3678586 - DNA, 19 bp, Homo sapiens
tccttgaagaactgcaggc

SEQ ID NO: 3678587 - DNA, 16 bp, Homo sapiens
tccttggaggacagtg

SEQ ID NO: 3678588 - DNA, 18 bp, Homo sapiens
tccttggaggacagtggg

SEQ ID NO: 3678589 - DNA, 16 bp, Homo sapiens
tccttggcctttcctg

SEQ ID NO: 3678590 - DNA, 20 bp, Homo sapiens
tccttgggaggccccactgg

SEQ ID NO: 3678591 - DNA, 21 bp, Homo sapiens
tccttgggaggccccactggg

SEQ ID NO: 3678592 - DNA, 19 bp, Homo sapiens
tcctttctagagcactgcc

SEQ ID NO: 3678593 - DNA, 17 bp, Homo sapiens
tcctttgcgcctgtgac

SEQ ID NO: 3678594 - DNA, 22 bp, Homo sapiens
tcgaatctctgtgccttcgtct

SEQ ID NO: 3678595 - DNA, 18 bp, Homo sapiens
tcgagaaacagcctgtgt

SEQ ID NO: 3678596 - DNA, 18 bp, Homo sapiens
tcgagaccagcctggcca

SEQ ID NO: 3678597 - DNA, 18 bp, Homo sapiens
tcgagctgggaaggttcc

SEQ ID NO: 3678598 - DNA, 22 bp, Homo sapiens
tcgatactgcgactttctgcct

SEQ ID NO: 3678599 - DNA, 11 bp, Homo sapiens
tcgcagaggca

SEQ ID NO: 3678600 - DNA, 14 bp, Homo sapiens
tcgcataaagaaga

SEQ ID NO: 3678601 - DNA, 19 bp, Homo sapiens
tcgcccaggctggagtgca

SEQ ID NO: 3678602 - DNA, 22 bp, Homo sapiens
tcgcctgacaaccactggtctg

SEQ ID NO: 3678603 - DNA, 22 bp, Homo sapiens
tcgctgagggcagactggggca

SEQ ID NO: 3678604 - DNA, 15 bp, Homo sapiens
tcgcttcttgcctct

SEQ ID NO: 3678605 - DNA, 16 bp, Homo sapiens
tcgcttcttgcctctg

SEQ ID NO: 3678606 - DNA, 19 bp, Homo sapiens
tcgcttcttgcctctgtgc

SEQ ID NO: 3678607 - DNA, 17 bp, Homo sapiens
tcggcgtggcccaaggc

SEQ ID NO: 3678608 - DNA, 17 bp, Homo sapiens
tcgggaggtcgaggcag

SEQ ID NO: 3678609 - DNA, 17 bp, Homo sapiens
tcgggcaccagccagcg

SEQ ID NO: 3678610 - DNA, 19 bp, Homo sapiens
tcggggccatttggccggc

SEQ ID NO: 3678611 - DNA, 20 bp, Homo sapiens
tcggggccatttggccggct

SEQ ID NO: 3678612 - DNA, 17 bp, Homo sapiens
tcgggtctccccacctg

SEQ ID NO: 3678613 - DNA, 20 bp, Homo sapiens
tcggtatccccccatcttgc

SEQ ID NO: 3678614 - DNA, 18 bp, Homo sapiens
tcgtcactaatacacagt

SEQ ID NO: 3678615 - DNA, 23 bp, Homo sapiens
tcgtcccgtccctccctttcctc

SEQ ID NO: 3678616 - DNA, 19 bp, Homo sapiens
tcgtgccaattatagtttg

SEQ ID NO: 3678617 - DNA, 15 bp, Homo sapiens
tcgtgcctgtgtcca

SEQ ID NO: 3678618 - DNA, 21 bp, Homo sapiens
tcgtgcctgtgtccatgcgct

SEQ ID NO: 3678619 - DNA, 18 bp, Homo sapiens
tcgtggggtgtgctggga

SEQ ID NO: 3678620 - DNA, 21 bp, Homo sapiens
tcgttctgtactgttactggg

SEQ ID NO: 3678621 - DNA, 14 bp, Homo sapiens
tcgttctttttaag

SEQ ID NO: 3678622 - DNA, 18 bp, Homo sapiens
tcgttctttttaagttaa

SEQ ID NO: 3678623 - DNA, 20 bp, Homo sapiens
tctaaaccccagattcttca

SEQ ID NO: 3678624 - DNA, 15 bp, Homo sapiens
tctaactcctgccat

SEQ ID NO: 3678625 - DNA, 14 bp, Homo sapiens
tctaactggacagc

SEQ ID NO: 3678626 - DNA, 20 bp, Homo sapiens
tctaagtaatggttaagttt

SEQ ID NO: 3678627 - DNA, 19 bp, Homo sapiens
tctaatctagatatcgact

SEQ ID NO: 3678628 - DNA, 18 bp, Homo sapiens
tctaattaaccttactaa

SEQ ID NO: 3678629 - DNA, 16 bp, Homo sapiens
tctaccctcccacccc

SEQ ID NO: 3678630 - DNA, 18 bp, Homo sapiens
tctaccctcccaccccct

SEQ ID NO: 3678631 - DNA, 18 bp, Homo sapiens
tctacctgcaggcggggc

SEQ ID NO: 3678632 - DNA, 21 bp, Homo sapiens
tctacttaatccaatgggttt

SEQ ID NO: 3678633 - DNA, 14 bp, Homo sapiens
tctactttgattct

SEQ ID NO: 3678634 - DNA, 20 bp, Homo sapiens
tctagaacatccctgccagc

SEQ ID NO: 3678635 - DNA, 20 bp, Homo sapiens
tctagaagactgtcagcttc

SEQ ID NO: 3678636 - DNA, 15 bp, Homo sapiens
tctagagcagggatt

SEQ ID NO: 3678637 - DNA, 18 bp, Homo sapiens
tctagatggctcctctca

SEQ ID NO: 3678638 - DNA, 23 bp, Homo sapiens
tctaggatagctaactgtaaatc

SEQ ID NO: 3678639 - DNA, 20 bp, Homo sapiens
tctaggattgggcctcccat

SEQ ID NO: 3678640 - DNA, 12 bp, Homo sapiens
tctagggaaaaa

SEQ ID NO: 3678641 - DNA, 19 bp, Homo sapiens
tctagggaaaaaccagcgt

SEQ ID NO: 3678642 - DNA, 18 bp, Homo sapiens
tctagggttattgcattt

SEQ ID NO: 3678643 - DNA, 23 bp, Homo sapiens
tctaggtgcccttggaggccagc

SEQ ID NO: 3678644 - DNA, 18 bp, Homo sapiens
tctagtgccttctaaagg

SEQ ID NO: 3678645 - DNA, 14 bp, Homo sapiens
tctatatatataat

SEQ ID NO: 3678646 - DNA, 12 bp, Homo sapiens
tctatgtatgtt

SEQ ID NO: 3678647 - DNA, 16 bp, Homo sapiens
tctatgtatgttaatt

SEQ ID NO: 3678648 - DNA, 20 bp, Homo sapiens
tctatgtgtatgttgacttt

SEQ ID NO: 3678649 - DNA, 16 bp, Homo sapiens
tctcaaaaaaagaaaa

SEQ ID NO: 3678650 - DNA, 13 bp, Homo sapiens
tctcaaccatccc

SEQ ID NO: 3678651 - DNA, 19 bp, Homo sapiens
tctcacagtgggagccagg

SEQ ID NO: 3678652 - DNA, 22 bp, Homo sapiens
tctcacagtgggagccagggct

SEQ ID NO: 3678653 - DNA, 12 bp, Homo sapiens
tctcacctcagc

SEQ ID NO: 3678654 - DNA, 15 bp, Homo sapiens
tctcacctcctgctg

SEQ ID NO: 3678655 - DNA, 16 bp, Homo sapiens
tctcacctcctgctgg

SEQ ID NO: 3678656 - DNA, 15 bp, Homo sapiens
tctcagctcactgtg

SEQ ID NO: 3678657 - DNA, 12 bp, Homo sapiens
tctcagggcctg

SEQ ID NO: 3678658 - DNA, 14 bp, Homo sapiens
tctcagggcctggt

SEQ ID NO: 3678659 - DNA, 19 bp, Homo sapiens
tctcagggcctggtcgttt

SEQ ID NO: 3678660 - DNA, 16 bp, Homo sapiens
tctcagttctcttgct

SEQ ID NO: 3678661 - DNA, 18 bp, Homo sapiens
tctcagttctcttgcttt

SEQ ID NO: 3678662 - DNA, 17 bp, Homo sapiens
tctcatgggaaggggag

SEQ ID NO: 3678663 - DNA, 22 bp, Homo sapiens
tctccagagagaaatcaggcct

SEQ ID NO: 3678664 - DNA, 21 bp, Homo sapiens
tctccagggagggtatttatt

SEQ ID NO: 3678665 - DNA, 18 bp, Homo sapiens
tctccaggggctgcttcc

SEQ ID NO: 3678666 - DNA, 23 bp, Homo sapiens
tctccaggggctgcttcctcctg

SEQ ID NO: 3678667 - DNA, 13 bp, Homo sapiens
tctccccacacta

SEQ ID NO: 3678668 - DNA, 14 bp, Homo sapiens
tctccccagcccag

SEQ ID NO: 3678669 - DNA, 16 bp, Homo sapiens
tctccccagcccagag

SEQ ID NO: 3678670 - DNA, 18 bp, Homo sapiens
tctccccagcccagagac

SEQ ID NO: 3678671 - DNA, 19 bp, Homo sapiens
tctccccagcccagagaca

SEQ ID NO: 3678672 - DNA, 19 bp, Homo sapiens
tctccccaggtccagctct

SEQ ID NO: 3678673 - DNA, 14 bp, Homo sapiens
tctccctgccaagt

SEQ ID NO: 3678674 - DNA, 20 bp, Homo sapiens
tctccctgccaagtctcaga

SEQ ID NO: 3678675 - DNA, 23 bp, Homo sapiens
tctccctggggacggggctcccc

SEQ ID NO: 3678676 - DNA, 14 bp, Homo sapiens
tctccgcgggtggg

SEQ ID NO: 3678677 - DNA, 16 bp, Homo sapiens
tctccgttagctcctg

SEQ ID NO: 3678678 - DNA, 18 bp, Homo sapiens
tctccgttagctcctgtg

SEQ ID NO: 3678679 - DNA, 19 bp, Homo sapiens
tctccgttagctcctgtgg

SEQ ID NO: 3678680 - DNA, 20 bp, Homo sapiens
tctccgttagctcctgtggc

SEQ ID NO: 3678681 - DNA, 23 bp, Homo sapiens
tctccgttagctcctgtggcccc

SEQ ID NO: 3678682 - DNA, 19 bp, Homo sapiens
tctcctatatatttctatt

SEQ ID NO: 3678683 - DNA, 16 bp, Homo sapiens
tctcctcctgcccacc

SEQ ID NO: 3678684 - DNA, 15 bp, Homo sapiens
tctcctctctaaaag

SEQ ID NO: 3678685 - DNA, 14 bp, Homo sapiens
tctcctgactttta

SEQ ID NO: 3678686 - DNA, 14 bp, Homo sapiens
tctcctgcctcagc

SEQ ID NO: 3678687 - DNA, 18 bp, Homo sapiens
tctcctgcgggggcgagg

SEQ ID NO: 3678688 - DNA, 10 bp, Homo sapiens
tctcctggaa

SEQ ID NO: 3678689 - DNA, 14 bp, Homo sapiens
tctccttggaggac

SEQ ID NO: 3678690 - DNA, 17 bp, Homo sapiens
tctccttttttcccagc

SEQ ID NO: 3678691 - DNA, 14 bp, Homo sapiens
tctcgggagaggat

SEQ ID NO: 3678692 - DNA, 17 bp, Homo sapiens
tctcgtcccgtccctcc

SEQ ID NO: 3678693 - DNA, 15 bp, Homo sapiens
tctctacaaaaagca

SEQ ID NO: 3678694 - DNA, 23 bp, Homo sapiens
tctctccttggcctttcctggaa

SEQ ID NO: 3678695 - DNA, 14 bp, Homo sapiens
tctctcttctgctc

SEQ ID NO: 3678696 - DNA, 17 bp, Homo sapiens
tctctgacttctgcctg

SEQ ID NO: 3678697 - DNA, 18 bp, Homo sapiens
tctctgacttctgcctgg

SEQ ID NO: 3678698 - DNA, 15 bp, Homo sapiens
tctctgccagtgaca

SEQ ID NO: 3678699 - DNA, 21 bp, Homo sapiens
tctctgccagtgacagacagg

SEQ ID NO: 3678700 - DNA, 13 bp, Homo sapiens
tctctgcccaacc

SEQ ID NO: 3678701 - DNA, 13 bp, Homo sapiens
tctctgctccacc

SEQ ID NO: 3678702 - DNA, 14 bp, Homo sapiens
tctctgctccacca

SEQ ID NO: 3678703 - DNA, 11 bp, Homo sapiens
tctctgctctg

SEQ ID NO: 3678704 - DNA, 13 bp, Homo sapiens
tctctgctctgct

SEQ ID NO: 3678705 - DNA, 21 bp, Homo sapiens
tctctgtacttttcattctct

SEQ ID NO: 3678706 - DNA, 17 bp, Homo sapiens
tctctgtgccttcgtct

SEQ ID NO: 3678707 - DNA, 17 bp, Homo sapiens
tctcttccctgcgcctg

SEQ ID NO: 3678708 - DNA, 14 bp, Homo sapiens
tctcttgagcctgg

SEQ ID NO: 3678709 - DNA, 13 bp, Homo sapiens
tctgaaaaggaac

SEQ ID NO: 3678710 - DNA, 19 bp, Homo sapiens
tctgaaactatagaataaa

SEQ ID NO: 3678711 - DNA, 15 bp, Homo sapiens
tctgaacccaggcag

SEQ ID NO: 3678712 - DNA, 17 bp, Homo sapiens
tctgaacccaggcagct

SEQ ID NO: 3678713 - DNA, 21 bp, Homo sapiens
tctgaacccaggcagctggca

SEQ ID NO: 3678714 - DNA, 22 bp, Homo sapiens
tctgaacccaggcagctggcag

SEQ ID NO: 3678715 - DNA, 23 bp, Homo sapiens
tctgaacccaggcagctggcagg

SEQ ID NO: 3678716 - DNA, 14 bp, Homo sapiens
tctgaactgttaca

SEQ ID NO: 3678717 - DNA, 17 bp, Homo sapiens
tctgaccagcagcgcct

SEQ ID NO: 3678718 - DNA, 13 bp, Homo sapiens
tctgaccccagcc

SEQ ID NO: 3678719 - DNA, 15 bp, Homo sapiens
tctgaccccagccca

SEQ ID NO: 3678720 - DNA, 16 bp, Homo sapiens
tctgaccccagcccag

SEQ ID NO: 3678721 - DNA, 17 bp, Homo sapiens
tctgaccccagcccaga

SEQ ID NO: 3678722 - DNA, 16 bp, Homo sapiens
tctgactcggtttctc

SEQ ID NO: 3678723 - DNA, 19 bp, Homo sapiens
tctgactcggtttctccaa

SEQ ID NO: 3678724 - DNA, 20 bp, Homo sapiens
tctgacttctgcctggagac

SEQ ID NO: 3678725 - DNA, 11 bp, Homo sapiens
tctgagaagac

SEQ ID NO: 3678726 - DNA, 14 bp, Homo sapiens
tctgagcccaaccc

SEQ ID NO: 3678727 - DNA, 21 bp, Homo sapiens
tctgagcgcctccatccaagg

SEQ ID NO: 3678728 - DNA, 23 bp, Homo sapiens
tctgagtgttttatgagaaagcc

SEQ ID NO: 3678729 - DNA, 21 bp, Homo sapiens
tctgatgcaagcaagaaacac

SEQ ID NO: 3678730 - DNA, 21 bp, Homo sapiens
tctgattccgcaccctgccta

SEQ ID NO: 3678731 - DNA, 18 bp, Homo sapiens
tctgcaaaacgagggggt

SEQ ID NO: 3678732 - DNA, 15 bp, Homo sapiens
tctgcacccccctgg

SEQ ID NO: 3678733 - DNA, 19 bp, Homo sapiens
tctgcagatcttccgtggt

SEQ ID NO: 3678734 - DNA, 22 bp, Homo sapiens
tctgcagatcttccgtggtcag

SEQ ID NO: 3678735 - DNA, 22 bp, Homo sapiens
tctgcaggaatcccggctccag

SEQ ID NO: 3678736 - DNA, 13 bp, Homo sapiens
tctgcaggcaggg

SEQ ID NO: 3678737 - DNA, 14 bp, Homo sapiens
tctgcatctttttg

SEQ ID NO: 3678738 - DNA, 14 bp, Homo sapiens
tctgccaggccccc

SEQ ID NO: 3678739 - DNA, 23 bp, Homo sapiens
tctgccaggcccccaagcctgca

SEQ ID NO: 3678740 - DNA, 14 bp, Homo sapiens
tctgccagggagct

SEQ ID NO: 3678741 - DNA, 23 bp, Homo sapiens
tctgccagtgacagacaggctct

SEQ ID NO: 3678742 - DNA, 15 bp, Homo sapiens
tctgccattgggacc

SEQ ID NO: 3678743 - DNA, 17 bp, Homo sapiens
tctgccattgggaccct

SEQ ID NO: 3678744 - DNA, 12 bp, Homo sapiens
tctgcccaaccc

SEQ ID NO: 3678745 - DNA, 15 bp, Homo sapiens
tctgccccatcctcc

SEQ ID NO: 3678746 - DNA, 18 bp, Homo sapiens
tctgccccatcctccagc

SEQ ID NO: 3678747 - DNA, 13 bp, Homo sapiens
tctgcccctcccc

SEQ ID NO: 3678748 - DNA, 18 bp, Homo sapiens
tctgcccctcccccaacc

SEQ ID NO: 3678749 - DNA, 22 bp, Homo sapiens
tctgcccctcccccaaccccca

SEQ ID NO: 3678750 - DNA, 17 bp, Homo sapiens
tctgcctgccagctgca

SEQ ID NO: 3678751 - DNA, 12 bp, Homo sapiens
tctgcctggagt

SEQ ID NO: 3678752 - DNA, 10 bp, Homo sapiens
tctgcctttg

SEQ ID NO: 3678753 - DNA, 13 bp, Homo sapiens
tctgctcagaggc

SEQ ID NO: 3678754 - DNA, 21 bp, Homo sapiens
tctgctcagaggccttgctgt

SEQ ID NO: 3678755 - DNA, 14 bp, Homo sapiens
tctgctcagcttct

SEQ ID NO: 3678756 - DNA, 18 bp, Homo sapiens
tctgctcagcttctcctg

SEQ ID NO: 3678757 - DNA, 12 bp, Homo sapiens
tctgctccacca

SEQ ID NO: 3678758 - DNA, 15 bp, Homo sapiens
tctgctccacccttg

SEQ ID NO: 3678759 - DNA, 17 bp, Homo sapiens
tctgctccacccttggc

SEQ ID NO: 3678760 - DNA, 19 bp, Homo sapiens
tctgctccacccttggcct

SEQ ID NO: 3678761 - DNA, 23 bp, Homo sapiens
tctgctccacccttggcctgtct

SEQ ID NO: 3678762 - DNA, 14 bp, Homo sapiens
tctgctctttctct

SEQ ID NO: 3678763 - DNA, 18 bp, Homo sapiens
tctgctctttctctgcca

SEQ ID NO: 3678764 - DNA, 19 bp, Homo sapiens
tctgctctttctctgccag

SEQ ID NO: 3678765 - DNA, 16 bp, Homo sapiens
tctgcttatttcatct

SEQ ID NO: 3678766 - DNA, 18 bp, Homo sapiens
tctgcttatttcatctgt

SEQ ID NO: 3678767 - DNA, 15 bp, Homo sapiens
tctggaaaatgcttc

SEQ ID NO: 3678768 - DNA, 18 bp, Homo sapiens
tctggaaaatgcttcttg

SEQ ID NO: 3678769 - DNA, 18 bp, Homo sapiens
tctggaacccagactcag

SEQ ID NO: 3678770 - DNA, 20 bp, Homo sapiens
tctggaacctcagcctggcc

SEQ ID NO: 3678771 - DNA, 21 bp, Homo sapiens
tctggaacctcagcctggcca

SEQ ID NO: 3678772 - DNA, 16 bp, Homo sapiens
tctggaagtttctggt

SEQ ID NO: 3678773 - DNA, 18 bp, Homo sapiens
tctggacagccccaccct

SEQ ID NO: 3678774 - DNA, 19 bp, Homo sapiens
tctggacaggatgtgtttg

SEQ ID NO: 3678775 - DNA, 14 bp, Homo sapiens
tctggagtggccac

SEQ ID NO: 3678776 - DNA, 15 bp, Homo sapiens
tctggagtggccact

SEQ ID NO: 3678777 - DNA, 19 bp, Homo sapiens
tctggagtggccactaagc

SEQ ID NO: 3678778 - DNA, 20 bp, Homo sapiens
tctggattccccatctcagg

SEQ ID NO: 3678779 - DNA, 20 bp, Homo sapiens
tctggcttctggccaggaag

SEQ ID NO: 3678780 - DNA, 17 bp, Homo sapiens
tctgggaccaggctcca

SEQ ID NO: 3678781 - DNA, 18 bp, Homo sapiens
tctggggggacccagtgc

SEQ ID NO: 3678782 - DNA, 19 bp, Homo sapiens
tctggggggacccagtgca

SEQ ID NO: 3678783 - DNA, 20 bp, Homo sapiens
tctggggggacccagtgcag

SEQ ID NO: 3678784 - DNA, 20 bp, Homo sapiens
tctgggtgggcggggcacta

SEQ ID NO: 3678785 - DNA, 14 bp, Homo sapiens
tctggtcccttgca

SEQ ID NO: 3678786 - DNA, 15 bp, Homo sapiens
tctggtcgctcctgc

SEQ ID NO: 3678787 - DNA, 17 bp, Homo sapiens
tctggtgccatttctga

SEQ ID NO: 3678788 - DNA, 21 bp, Homo sapiens
tctggtggccactgagctggc

SEQ ID NO: 3678789 - DNA, 14 bp, Homo sapiens
tctggtggccccgt

SEQ ID NO: 3678790 - DNA, 21 bp, Homo sapiens
tctggtggctgggctgctcct

SEQ ID NO: 3678791 - DNA, 16 bp, Homo sapiens
tctggtggtctgttgg

SEQ ID NO: 3678792 - DNA, 22 bp, Homo sapiens
tctgtagggatttttggctaca

SEQ ID NO: 3678793 - DNA, 24 bp, Homo sapiens
tctgtagtaatttattgtctgtct

SEQ ID NO: 3678794 - DNA, 20 bp, Homo sapiens
tctgtcaatcacagtctcag

SEQ ID NO: 3678795 - DNA, 19 bp, Homo sapiens
tctgtccgagctttgaaaa

SEQ ID NO: 3678796 - DNA, 13 bp, Homo sapiens
tctgtcctcagcc

SEQ ID NO: 3678797 - DNA, 19 bp, Homo sapiens
tctgtcctcagccttgcca

SEQ ID NO: 3678798 - DNA, 14 bp, Homo sapiens
tctgtctacatttc

SEQ ID NO: 3678799 - DNA, 18 bp, Homo sapiens
tctgtctacttgctcagg

SEQ ID NO: 3678800 - DNA, 23 bp, Homo sapiens
tctgtctacttgctcaggtactt

SEQ ID NO: 3678801 - DNA, 17 bp, Homo sapiens
tctgtctggtggccccg

SEQ ID NO: 3678802 - DNA, 14 bp, Homo sapiens
tctgtcttctggac

SEQ ID NO: 3678803 - DNA, 16 bp, Homo sapiens
tctgtgacccatctgt

SEQ ID NO: 3678804 - DNA, 14 bp, Homo sapiens
tctgtgccacgctc

SEQ ID NO: 3678805 - DNA, 16 bp, Homo sapiens
tctgtgccacgctcct

SEQ ID NO: 3678806 - DNA, 23 bp, Homo sapiens
tctgtgccacgctcctctgtttg

SEQ ID NO: 3678807 - DNA, 15 bp, Homo sapiens
tctgtgccatttctc

SEQ ID NO: 3678808 - DNA, 16 bp, Homo sapiens
tctgtggccagcctgg

SEQ ID NO: 3678809 - DNA, 20 bp, Homo sapiens
tctgtggccagcctggcatc

SEQ ID NO: 3678810 - DNA, 22 bp, Homo sapiens
tctgtgggccctaccctcctgc

SEQ ID NO: 3678811 - DNA, 20 bp, Homo sapiens
tctgtgtgtgtgtgtgtgcg

SEQ ID NO: 3678812 - DNA, 15 bp, Homo sapiens
tctgttcccttcctc

SEQ ID NO: 3678813 - DNA, 15 bp, Homo sapiens
tctgttgtaagaata

SEQ ID NO: 3678814 - DNA, 20 bp, Homo sapiens
tctgtttcctgacattgtct

SEQ ID NO: 3678815 - DNA, 18 bp, Homo sapiens
tcttaaaaagtggaaaaa

SEQ ID NO: 3678816 - DNA, 19 bp, Homo sapiens
tcttaaattatatatttat

SEQ ID NO: 3678817 - DNA, 14 bp, Homo sapiens
tcttaatacttgaa

SEQ ID NO: 3678818 - DNA, 14 bp, Homo sapiens
tcttacaaacatgt

SEQ ID NO: 3678819 - DNA, 14 bp, Homo sapiens
tcttagagaataag

SEQ ID NO: 3678820 - DNA, 14 bp, Homo sapiens
tcttatactgtaca

SEQ ID NO: 3678821 - DNA, 21 bp, Homo sapiens
tcttatgctctcactgtttgt

SEQ ID NO: 3678822 - DNA, 12 bp, Homo sapiens
tcttatttaatc

SEQ ID NO: 3678823 - DNA, 16 bp, Homo sapiens
tcttcagtaagccgtg

SEQ ID NO: 3678824 - DNA, 22 bp, Homo sapiens
tcttcagtctggactatattgg

SEQ ID NO: 3678825 - DNA, 15 bp, Homo sapiens
tcttcagttaattct

SEQ ID NO: 3678826 - DNA, 15 bp, Homo sapiens
tcttccaaaggcagc

SEQ ID NO: 3678827 - DNA, 16 bp, Homo sapiens
tcttccaaaggcagcg

SEQ ID NO: 3678828 - DNA, 18 bp, Homo sapiens
tcttcccgaaccccaagg

SEQ ID NO: 3678829 - DNA, 19 bp, Homo sapiens
tcttcccgaaccccaagga

SEQ ID NO: 3678830 - DNA, 22 bp, Homo sapiens
tcttccctacagttgaaaaaca

SEQ ID NO: 3678831 - DNA, 21 bp, Homo sapiens
tcttccgtggtcagagtgcca

SEQ ID NO: 3678832 - DNA, 22 bp, Homo sapiens
tcttcctggatggggcagagct

SEQ ID NO: 3678833 - DNA, 16 bp, Homo sapiens
tcttctgaatatttta

SEQ ID NO: 3678834 - DNA, 12 bp, Homo sapiens
tcttctgctcca

SEQ ID NO: 3678835 - DNA, 14 bp, Homo sapiens
tcttctgctccacc

SEQ ID NO: 3678836 - DNA, 15 bp, Homo sapiens
tcttctgtcccaagt

SEQ ID NO: 3678837 - DNA, 19 bp, Homo sapiens
tcttcttggggcccagtgc

SEQ ID NO: 3678838 - DNA, 13 bp, Homo sapiens
tcttgaaggtgct

SEQ ID NO: 3678839 - DNA, 14 bp, Homo sapiens
tcttgagcagtggc

SEQ ID NO: 3678840 - DNA, 21 bp, Homo sapiens
tcttgagtcaaaaaacatgag

SEQ ID NO: 3678841 - DNA, 14 bp, Homo sapiens
tcttgagtttgtcg

SEQ ID NO: 3678842 - DNA, 22 bp, Homo sapiens
tcttgagtttgtcgctcatgtg

SEQ ID NO: 3678843 - DNA, 14 bp, Homo sapiens
tcttgcctccaggt

SEQ ID NO: 3678844 - DNA, 15 bp, Homo sapiens
tcttgcctctgtgct

SEQ ID NO: 3678845 - DNA, 22 bp, Homo sapiens
tcttgctctgtctcccaggctg

SEQ ID NO: 3678846 - DNA, 14 bp, Homo sapiens
tcttgctggaagac

SEQ ID NO: 3678847 - DNA, 21 bp, Homo sapiens
tcttgctgttgacatatttaa

SEQ ID NO: 3678848 - DNA, 18 bp, Homo sapiens
tcttggcttaatcatttt

SEQ ID NO: 3678849 - DNA, 19 bp, Homo sapiens
tcttggcttaatcattttc

SEQ ID NO: 3678850 - DNA, 23 bp, Homo sapiens
tcttgggcagagctggctctgag

SEQ ID NO: 3678851 - DNA, 20 bp, Homo sapiens
tcttgggggggtggccgctg

SEQ ID NO: 3678852 - DNA, 18 bp, Homo sapiens
tcttgggtgggacagggc

SEQ ID NO: 3678853 - DNA, 18 bp, Homo sapiens
tcttgtgcttttcctgat

SEQ ID NO: 3678854 - DNA, 21 bp, Homo sapiens
tcttgtggaagacacttgctg

SEQ ID NO: 3678855 - DNA, 23 bp, Homo sapiens
tcttgtggaagacacttgctgag

SEQ ID NO: 3678856 - DNA, 16 bp, Homo sapiens
tctttaaaagagagag

SEQ ID NO: 3678857 - DNA, 23 bp, Homo sapiens
tctttaaaagagagagagagaaa

SEQ ID NO: 3678858 - DNA, 20 bp, Homo sapiens
tctttaaaatgtaaagccat

SEQ ID NO: 3678859 - DNA, 21 bp, Homo sapiens
tctttacatctatgtgtatgt

SEQ ID NO: 3678860 - DNA, 20 bp, Homo sapiens
tctttagagattataacaaa

SEQ ID NO: 3678861 - DNA, 15 bp, Homo sapiens
tctttaggagattta

SEQ ID NO: 3678862 - DNA, 15 bp, Homo sapiens
tctttatgcttgcaa

SEQ ID NO: 3678863 - DNA, 12 bp, Homo sapiens
tctttattttgt

SEQ ID NO: 3678864 - DNA, 17 bp, Homo sapiens
tctttattttgtgtaaa

SEQ ID NO: 3678865 - DNA, 22 bp, Homo sapiens
tctttcacattgtttgctgcta

SEQ ID NO: 3678866 - DNA, 23 bp, Homo sapiens
tctttcagtacttttttaaatat

SEQ ID NO: 3678867 - DNA, 12 bp, Homo sapiens
tctttgaatttc

SEQ ID NO: 3678868 - DNA, 21 bp, Homo sapiens
tctttgcaaagtattgtaaat

SEQ ID NO: 3678869 - DNA, 14 bp, Homo sapiens
tctttgccttgggc

SEQ ID NO: 3678870 - DNA, 21 bp, Homo sapiens
tctttgccttgggctgctcct

SEQ ID NO: 3678871 - DNA, 17 bp, Homo sapiens
tctttggacactcacac

SEQ ID NO: 3678872 - DNA, 15 bp, Homo sapiens
tctttgggccagaca

SEQ ID NO: 3678873 - DNA, 17 bp, Homo sapiens
tctttggtgtacagact

SEQ ID NO: 3678874 - DNA, 23 bp, Homo sapiens
tctttgtagctaacagtgaagat

SEQ ID NO: 3678875 - DNA, 22 bp, Homo sapiens
tctttgtggccaaggagctgct

SEQ ID NO: 3678876 - DNA, 16 bp, Homo sapiens
tctttgttcatagccc

SEQ ID NO: 3678877 - DNA, 21 bp, Homo sapiens
tcttttctcccttttaatcct

SEQ ID NO: 3678878 - DNA, 17 bp, Homo sapiens
tcttttgaattgttaca

SEQ ID NO: 3678879 - DNA, 18 bp, Homo sapiens
tcttttgaattgttacat

SEQ ID NO: 3678880 - DNA, 16 bp, Homo sapiens
tctttttgttgtaaaa

SEQ ID NO: 3678881 - DNA, 20 bp, Homo sapiens
tgaaaaaaaaaaagaagaag

SEQ ID NO: 3678882 - DNA, 21 bp, Homo sapiens
tgaaaaaaaaaaagaagaaga

SEQ ID NO: 3678883 - DNA, 22 bp, Homo sapiens
tgaaaagaaaaatgagcctggc

SEQ ID NO: 3678884 - DNA, 23 bp, Homo sapiens
tgaaaatatctgctcaaaacttt

SEQ ID NO: 3678885 - DNA, 18 bp, Homo sapiens
tgaaaatgcaacaacatg

SEQ ID NO: 3678886 - DNA, 16 bp, Homo sapiens
tgaaaattaacactgc

SEQ ID NO: 3678887 - DNA, 15 bp, Homo sapiens
tgaaacagaaaaata

SEQ ID NO: 3678888 - DNA, 15 bp, Homo sapiens
tgaaacctaggaagc

SEQ ID NO: 3678889 - DNA, 17 bp, Homo sapiens
tgaaactatagaataaa

SEQ ID NO: 3678890 - DNA, 21 bp, Homo sapiens
tgaaagaggctgaggcctgga

SEQ ID NO: 3678891 - DNA, 18 bp, Homo sapiens
tgaaagccctgagctttc

SEQ ID NO: 3678892 - DNA, 20 bp, Homo sapiens
tgaaagggagctatcaggaa

SEQ ID NO: 3678893 - DNA, 11 bp, Homo sapiens
tgaaagtgact

SEQ ID NO: 3678894 - DNA, 14 bp, Homo sapiens
tgaaagtgcatttt

SEQ ID NO: 3678895 - DNA, 18 bp, Homo sapiens
tgaaagtgcatttttgta

SEQ ID NO: 3678896 - DNA, 22 bp, Homo sapiens
tgaaagtgttgggattggttaa

SEQ ID NO: 3678897 - DNA, 20 bp, Homo sapiens
tgaaagttttcagaacctct

SEQ ID NO: 3678898 - DNA, 17 bp, Homo sapiens
tgaaataaaactggctt

SEQ ID NO: 3678899 - DNA, 13 bp, Homo sapiens
tgaaatagtctgt

SEQ ID NO: 3678900 - DNA, 16 bp, Homo sapiens
tgaaatagtctgtgtg

SEQ ID NO: 3678901 - DNA, 18 bp, Homo sapiens
tgaaatagtctgtgtgaa

SEQ ID NO: 3678902 - DNA, 15 bp, Homo sapiens
tgaaatctgtcaaga

SEQ ID NO: 3678903 - DNA, 22 bp, Homo sapiens
tgaaattacgggtacctgaaga

SEQ ID NO: 3678904 - DNA, 14 bp, Homo sapiens
tgaaattctcctgg

SEQ ID NO: 3678905 - DNA, 18 bp, Homo sapiens
tgaactaaaaagagactg

SEQ ID NO: 3678906 - DNA, 19 bp, Homo sapiens
tgaactaaaaagagactgt

SEQ ID NO: 3678907 - DNA, 23 bp, Homo sapiens
tgaactaaaaagagactgtgcca

SEQ ID NO: 3678908 - DNA, 16 bp, Homo sapiens
tgaactataaaaagca

SEQ ID NO: 3678909 - DNA, 12 bp, Homo sapiens
tgaactggaaga

SEQ ID NO: 3678910 - DNA, 17 bp, Homo sapiens
tgaactggaagaaagca

SEQ ID NO: 3678911 - DNA, 23 bp, Homo sapiens
tgaactgttgcccttctgtccaa

SEQ ID NO: 3678912 - DNA, 14 bp, Homo sapiens
tgaagaactgcagg

SEQ ID NO: 3678913 - DNA, 15 bp, Homo sapiens
tgaagaactgcaggc

SEQ ID NO: 3678914 - DNA, 18 bp, Homo sapiens
tgaagaactgcaggccct

SEQ ID NO: 3678915 - DNA, 20 bp, Homo sapiens
tgaagaactgcaggccctgg

SEQ ID NO: 3678916 - DNA, 15 bp, Homo sapiens
tgaagaagcctcaca

SEQ ID NO: 3678917 - DNA, 18 bp, Homo sapiens
tgaagattatttcattcg

SEQ ID NO: 3678918 - DNA, 22 bp, Homo sapiens
tgaagatttacctcgttctgct

SEQ ID NO: 3678919 - DNA, 20 bp, Homo sapiens
tgaagcagcctctccccagg

SEQ ID NO: 3678920 - DNA, 11 bp, Homo sapiens
tgaagccagct

SEQ ID NO: 3678921 - DNA, 13 bp, Homo sapiens
tgaagccgtgcct

SEQ ID NO: 3678922 - DNA, 13 bp, Homo sapiens
tgaaggaaatgaa

SEQ ID NO: 3678923 - DNA, 12 bp, Homo sapiens
tgaaggaccctt

SEQ ID NO: 3678924 - DNA, 17 bp, Homo sapiens
tgaaggaggcggggctc

SEQ ID NO: 3678925 - DNA, 18 bp, Homo sapiens
tgaaggaggcggggctct

SEQ ID NO: 3678926 - DNA, 14 bp, Homo sapiens
tgaaggcagggctc

SEQ ID NO: 3678927 - DNA, 19 bp, Homo sapiens
tgaaggcagggctcctccc

SEQ ID NO: 3678928 - DNA, 22 bp, Homo sapiens
tgaaggcagggctcctccctgg

SEQ ID NO: 3678929 - DNA, 19 bp, Homo sapiens
tgaaggccgagaagcaaga

SEQ ID NO: 3678930 - DNA, 12 bp, Homo sapiens
tgaagggccaga

SEQ ID NO: 3678931 - DNA, 16 bp, Homo sapiens
tgaagggcctcccagc

SEQ ID NO: 3678932 - DNA, 13 bp, Homo sapiens
tgaaggtttctga

SEQ ID NO: 3678933 - DNA, 14 bp, Homo sapiens
tgaagtaagcaaag

SEQ ID NO: 3678934 - DNA, 15 bp, Homo sapiens
tgaataacatttaaa

SEQ ID NO: 3678935 - DNA, 13 bp, Homo sapiens
tgaataatacagt

SEQ ID NO: 3678936 - DNA, 22 bp, Homo sapiens
tgaataatcatgtgaaatgttt

SEQ ID NO: 3678937 - DNA, 22 bp, Homo sapiens
tgaatatatttaagcaacatct

SEQ ID NO: 3678938 - DNA, 12 bp, Homo sapiens
tgaatctttgac

SEQ ID NO: 3678939 - DNA, 13 bp, Homo sapiens
tgaatctttgact

SEQ ID NO: 3678940 - DNA, 23 bp, Homo sapiens
tgaatgatgatcctaggcatttg

SEQ ID NO: 3678941 - DNA, 15 bp, Homo sapiens
tgaatgccactgcct

SEQ ID NO: 3678942 - DNA, 22 bp, Homo sapiens
tgaatgccactgccttcgcttc

SEQ ID NO: 3678943 - DNA, 16 bp, Homo sapiens
tgaattcctagaatta

SEQ ID NO: 3678944 - DNA, 13 bp, Homo sapiens
tgaattgttacat

SEQ ID NO: 3678945 - DNA, 23 bp, Homo sapiens
tgaatttctgacctcaagtgatt

SEQ ID NO: 3678946 - DNA, 23 bp, Homo sapiens
tgaatttcttgatttttcagggt

SEQ ID NO: 3678947 - DNA, 23 bp, Homo sapiens
tgaattttctttttaataaaaag

SEQ ID NO: 3678948 - DNA, 19 bp, Homo sapiens
tgacaaccgagaaggttta

SEQ ID NO: 3678949 - DNA, 12 bp, Homo sapiens
tgacacaaacac

SEQ ID NO: 3678950 - DNA, 17 bp, Homo sapiens
tgacacccaagagggct

SEQ ID NO: 3678951 - DNA, 18 bp, Homo sapiens
tgacactgactagagtga

SEQ ID NO: 3678952 - DNA, 14 bp, Homo sapiens
tgacagaacactgt

SEQ ID NO: 3678953 - DNA, 15 bp, Homo sapiens
tgacagaacactgtc

SEQ ID NO: 3678954 - DNA, 16 bp, Homo sapiens
tgacagaacactgtct

SEQ ID NO: 3678955 - DNA, 17 bp, Homo sapiens
tgacagaacactgtctt

SEQ ID NO: 3678956 - DNA, 14 bp, Homo sapiens
tgacagacaggctc

SEQ ID NO: 3678957 - DNA, 19 bp, Homo sapiens
tgacagacaggctcttagc

SEQ ID NO: 3678958 - DNA, 12 bp, Homo sapiens
tgacagctgctc

SEQ ID NO: 3678959 - DNA, 15 bp, Homo sapiens
tgacagctttgctgc

SEQ ID NO: 3678960 - DNA, 18 bp, Homo sapiens
tgacagctttgctgctga

SEQ ID NO: 3678961 - DNA, 16 bp, Homo sapiens
tgacataatatattct

SEQ ID NO: 3678962 - DNA, 11 bp, Homo sapiens
tgacatattta

SEQ ID NO: 3678963 - DNA, 14 bp, Homo sapiens
tgacatatttaatg

SEQ ID NO: 3678964 - DNA, 15 bp, Homo sapiens
tgacatatttaatgt

SEQ ID NO: 3678965 - DNA, 21 bp, Homo sapiens
tgacatatttaatgttttaaa

SEQ ID NO: 3678966 - DNA, 15 bp, Homo sapiens
tgacatatttttgct

SEQ ID NO: 3678967 - DNA, 21 bp, Homo sapiens
tgacatctgattggcagatga

SEQ ID NO: 3678968 - DNA, 14 bp, Homo sapiens
tgacattgccaaaa

SEQ ID NO: 3678969 - DNA, 19 bp, Homo sapiens
tgacattgccaaaaaggat

SEQ ID NO: 3678970 - DNA, 11 bp, Homo sapiens
tgacattgtct

SEQ ID NO: 3678971 - DNA, 17 bp, Homo sapiens
tgacatttcattagcca

SEQ ID NO: 3678972 - DNA, 14 bp, Homo sapiens
tgaccaagcaggaa

SEQ ID NO: 3678973 - DNA, 16 bp, Homo sapiens
tgaccaagcaggaagc

SEQ ID NO: 3678974 - DNA, 18 bp, Homo sapiens
tgaccaagcaggaagctc

SEQ ID NO: 3678975 - DNA, 19 bp, Homo sapiens
tgaccaagcaggaagctca

SEQ ID NO: 3678976 - DNA, 22 bp, Homo sapiens
tgaccaagtgatgtgtttacat

SEQ ID NO: 3678977 - DNA, 14 bp, Homo sapiens
tgaccacccacctg

SEQ ID NO: 3678978 - DNA, 18 bp, Homo sapiens
tgaccacccacctgacca

SEQ ID NO: 3678979 - DNA, 23 bp, Homo sapiens
tgaccatccactctaccctccca

SEQ ID NO: 3678980 - DNA, 14 bp, Homo sapiens
tgacccatctgtag

SEQ ID NO: 3678981 - DNA, 16 bp, Homo sapiens
tgaccccagcccagac

SEQ ID NO: 3678982 - DNA, 19 bp, Homo sapiens
tgaccccagcccagacagc

SEQ ID NO: 3678983 - DNA, 17 bp, Homo sapiens
tgacctccacagcttcc

SEQ ID NO: 3678984 - DNA, 15 bp, Homo sapiens
tgacctgaggaagcg

SEQ ID NO: 3678985 - DNA, 22 bp, Homo sapiens
tgaccttatgagaaactgcatg

SEQ ID NO: 3678986 - DNA, 17 bp, Homo sapiens
tgaccttctaggaagct

SEQ ID NO: 3678987 - DNA, 18 bp, Homo sapiens
tgacctttagtgccaact

SEQ ID NO: 3678988 - DNA, 24 bp, Homo sapiens
tgacgtgaccggacttttctgcaa

SEQ ID NO: 3678989 - DNA, 17 bp, Homo sapiens
tgactaagccccgtctg

SEQ ID NO: 3678990 - DNA, 16 bp, Homo sapiens
tgactaatggcatgag

SEQ ID NO: 3678991 - DNA, 21 bp, Homo sapiens
tgactaattttacatgtttat

SEQ ID NO: 3678992 - DNA, 16 bp, Homo sapiens
tgactagagtgatgac

SEQ ID NO: 3678993 - DNA, 19 bp, Homo sapiens
tgactagggattcaggctg

SEQ ID NO: 3678994 - DNA, 21 bp, Homo sapiens
tgactagggattcaggctgct

SEQ ID NO: 3678995 - DNA, 14 bp, Homo sapiens
tgactcatccgcct

SEQ ID NO: 3678996 - DNA, 15 bp, Homo sapiens
tgactcggtttctcc

SEQ ID NO: 3678997 - DNA, 18 bp, Homo sapiens
tgacttctgcctggagac

SEQ ID NO: 3678998 - DNA, 13 bp, Homo sapiens
tgactttttataa

SEQ ID NO: 3678999 - DNA, 17 bp, Homo sapiens
tgagaaaaatgtaaaat

SEQ ID NO: 3679000 - DNA, 20 bp, Homo sapiens
tgagaaagtacagcagtaga

SEQ ID NO: 3679001 - DNA, 22 bp, Homo sapiens
tgagaagtgaatgctgggactc

SEQ ID NO: 3679002 - DNA, 13 bp, Homo sapiens
tgagaccagcctg

SEQ ID NO: 3679003 - DNA, 14 bp, Homo sapiens
tgagaccagcctgg

SEQ ID NO: 3679004 - DNA, 17 bp, Homo sapiens
tgagactcagtgcagat

SEQ ID NO: 3679005 - DNA, 18 bp, Homo sapiens
tgagactcagtgcagatg

SEQ ID NO: 3679006 - DNA, 13 bp, Homo sapiens
tgagatgctggtt

SEQ ID NO: 3679007 - DNA, 22 bp, Homo sapiens
tgagatttttaaaaaatatttt

SEQ ID NO: 3679008 - DNA, 22 bp, Homo sapiens
tgagcacaactttaagaggaca

SEQ ID NO: 3679009 - DNA, 13 bp, Homo sapiens
tgagcaccagggg

SEQ ID NO: 3679010 - DNA, 14 bp, Homo sapiens
tgagcaccagggga

SEQ ID NO: 3679011 - DNA, 21 bp, Homo sapiens
tgagcactgaaacattatttt

SEQ ID NO: 3679012 - DNA, 16 bp, Homo sapiens
tgagccagcttagcaa

SEQ ID NO: 3679013 - DNA, 17 bp, Homo sapiens
tgagcctgcagggaagc

SEQ ID NO: 3679014 - DNA, 19 bp, Homo sapiens
tgagcctgggaggtcaagg

SEQ ID NO: 3679015 - DNA, 22 bp, Homo sapiens
tgagcctgggaggtcaaggctg

SEQ ID NO: 3679016 - DNA, 20 bp, Homo sapiens
tgagcgcctccatccaaggc

SEQ ID NO: 3679017 - DNA, 24 bp, Homo sapiens
tgagctactgccgtcagtgctgtg

SEQ ID NO: 3679018 - DNA, 14 bp, Homo sapiens
tgagctgcctccag

SEQ ID NO: 3679019 - DNA, 19 bp, Homo sapiens
tgagctgcctccagcctgg

SEQ ID NO: 3679020 - DNA, 22 bp, Homo sapiens
tgagctgcctccagcctggtgg

SEQ ID NO: 3679021 - DNA, 14 bp, Homo sapiens
tgagctggctgact

SEQ ID NO: 3679022 - DNA, 16 bp, Homo sapiens
tgaggaaaggccagct

SEQ ID NO: 3679023 - DNA, 18 bp, Homo sapiens
tgaggaaaggccagctgg

SEQ ID NO: 3679024 - DNA, 17 bp, Homo sapiens
tgaggaagcgtgaaggc

SEQ ID NO: 3679025 - DNA, 13 bp, Homo sapiens
tgaggaggaggct

SEQ ID NO: 3679026 - DNA, 22 bp, Homo sapiens
tgaggatgacagtgacacccag

SEQ ID NO: 3679027 - DNA, 17 bp, Homo sapiens
tgaggatgtcactcaga

SEQ ID NO: 3679028 - DNA, 13 bp, Homo sapiens
tgaggcagggaag

SEQ ID NO: 3679029 - DNA, 12 bp, Homo sapiens
tgaggcctgggc

SEQ ID NO: 3679030 - DNA, 22 bp, Homo sapiens
tgaggcggagctccaggatggg

SEQ ID NO: 3679031 - DNA, 18 bp, Homo sapiens
tgaggctgtcctgtacat

SEQ ID NO: 3679032 - DNA, 17 bp, Homo sapiens
tgaggcttcttcctgga

SEQ ID NO: 3679033 - DNA, 18 bp, Homo sapiens
tgaggcttcttcctggat

SEQ ID NO: 3679034 - DNA, 12 bp, Homo sapiens
tgaggcttgccc

SEQ ID NO: 3679035 - DNA, 23 bp, Homo sapiens
tgaggcttgcccaggagcaagtg

SEQ ID NO: 3679036 - DNA, 15 bp, Homo sapiens
tgaggggagcatgct

SEQ ID NO: 3679037 - DNA, 21 bp, Homo sapiens
tgagggggaattcctggaacc

SEQ ID NO: 3679038 - DNA, 22 bp, Homo sapiens
tgagggggaattcctggaacct

SEQ ID NO: 3679039 - DNA, 18 bp, Homo sapiens
tgaggtcatagcagtgct

SEQ ID NO: 3679040 - DNA, 23 bp, Homo sapiens
tgaggtcccctcgtcccatccag

SEQ ID NO: 3679041 - DNA, 15 bp, Homo sapiens
tgaggtgaaagggag

SEQ ID NO: 3679042 - DNA, 16 bp, Homo sapiens
tgaggtgaaagggagc

SEQ ID NO: 3679043 - DNA, 15 bp, Homo sapiens
tgagtatctcctcgc

SEQ ID NO: 3679044 - DNA, 17 bp, Homo sapiens
tgagtcaaaaaacatga

SEQ ID NO: 3679045 - DNA, 13 bp, Homo sapiens
tgagtccagaagt

SEQ ID NO: 3679046 - DNA, 21 bp, Homo sapiens
tgagtctgggcagctgtccct

SEQ ID NO: 3679047 - DNA, 15 bp, Homo sapiens
tgagtgaaggaaatg

SEQ ID NO: 3679048 - DNA, 21 bp, Homo sapiens
tgagtgggggatcacagcctc

SEQ ID NO: 3679049 - DNA, 13 bp, Homo sapiens
tgagttaactgtg

SEQ ID NO: 3679050 - DNA, 17 bp, Homo sapiens
tgagttggacttcagtc

SEQ ID NO: 3679051 - DNA, 19 bp, Homo sapiens
tgagttggacttcagtctt

SEQ ID NO: 3679052 - DNA, 20 bp, Homo sapiens
tgagttggtgttgacatgtg

SEQ ID NO: 3679053 - DNA, 19 bp, Homo sapiens
tgagtttgtcgctcatgtg

SEQ ID NO: 3679054 - DNA, 19 bp, Homo sapiens
tgataagttcctttccttt

SEQ ID NO: 3679055 - DNA, 20 bp, Homo sapiens
tgatacagtcaacaagcctg

SEQ ID NO: 3679056 - DNA, 16 bp, Homo sapiens
tgatagtcttttgctt

SEQ ID NO: 3679057 - DNA, 18 bp, Homo sapiens
tgatattaagaactgctg

SEQ ID NO: 3679058 - DNA, 11 bp, Homo sapiens
tgatcaaggcc

SEQ ID NO: 3679059 - DNA, 13 bp, Homo sapiens
tgatcactgtgaa

SEQ ID NO: 3679060 - DNA, 14 bp, Homo sapiens
tgatcatgtacttt

SEQ ID NO: 3679061 - DNA, 17 bp, Homo sapiens
tgatcattttcccccca

SEQ ID NO: 3679062 - DNA, 21 bp, Homo sapiens
tgatcattttccccccactct

SEQ ID NO: 3679063 - DNA, 14 bp, Homo sapiens
tgatcctctcacct

SEQ ID NO: 3679064 - DNA, 15 bp, Homo sapiens
tgatcctggaggccc

SEQ ID NO: 3679065 - DNA, 16 bp, Homo sapiens
tgatcctggaggccca

SEQ ID NO: 3679066 - DNA, 20 bp, Homo sapiens
tgatcctggaggcccagttc

SEQ ID NO: 3679067 - DNA, 14 bp, Homo sapiens
tgatctggaaccca

SEQ ID NO: 3679068 - DNA, 18 bp, Homo sapiens
tgatctggaacccagact

SEQ ID NO: 3679069 - DNA, 14 bp, Homo sapiens
tgatgactgcttgt

SEQ ID NO: 3679070 - DNA, 17 bp, Homo sapiens
tgatgagttaactgtga

SEQ ID NO: 3679071 - DNA, 16 bp, Homo sapiens
tgatgatcactgtgaa

SEQ ID NO: 3679072 - DNA, 19 bp, Homo sapiens
tgatgatcactgtgaaaat

SEQ ID NO: 3679073 - DNA, 13 bp, Homo sapiens
tgatgcatgtctt

SEQ ID NO: 3679074 - DNA, 21 bp, Homo sapiens
tgatgcctctgtcttctggac

SEQ ID NO: 3679075 - DNA, 18 bp, Homo sapiens
tgatgctccgccaggaag

SEQ ID NO: 3679076 - DNA, 15 bp, Homo sapiens
tgatgctggatgctc

SEQ ID NO: 3679077 - DNA, 20 bp, Homo sapiens
tgatgctggatgctccttcc

SEQ ID NO: 3679078 - DNA, 12 bp, Homo sapiens
tgatggaagtgg

SEQ ID NO: 3679079 - DNA, 23 bp, Homo sapiens
tgatggaagtgggccagtcctgg

SEQ ID NO: 3679080 - DNA, 18 bp, Homo sapiens
tgatggcaacagatctgg

SEQ ID NO: 3679081 - DNA, 14 bp, Homo sapiens
tgatggggaaggag

SEQ ID NO: 3679082 - DNA, 24 bp, Homo sapiens
tgatggggcaagggcacaagtcct

SEQ ID NO: 3679083 - DNA, 15 bp, Homo sapiens
tgatggtgatgaaat

SEQ ID NO: 3679084 - DNA, 16 bp, Homo sapiens
tgatgtatacatctta

SEQ ID NO: 3679085 - DNA, 19 bp, Homo sapiens
tgatgtttgtggcctcaga

SEQ ID NO: 3679086 - DNA, 20 bp, Homo sapiens
tgatgtttgtggcctcagaa

SEQ ID NO: 3679087 - DNA, 13 bp, Homo sapiens
tgattaacatttg

SEQ ID NO: 3679088 - DNA, 17 bp, Homo sapiens
tgattcaaaatatttaa

SEQ ID NO: 3679089 - DNA, 13 bp, Homo sapiens
tgattcagctctg

SEQ ID NO: 3679090 - DNA, 19 bp, Homo sapiens
tgattgacagctttgctgc

SEQ ID NO: 3679091 - DNA, 21 bp, Homo sapiens
tgattgacagctttgctgctg

SEQ ID NO: 3679092 - DNA, 22 bp, Homo sapiens
tgattggacaggcatgggtgca

SEQ ID NO: 3679093 - DNA, 19 bp, Homo sapiens
tgattggtgcaacccttac

SEQ ID NO: 3679094 - DNA, 21 bp, Homo sapiens
tgatttaggagaagccaggaa

SEQ ID NO: 3679095 - DNA, 16 bp, Homo sapiens
tgattttcacagcttt

SEQ ID NO: 3679096 - DNA, 15 bp, Homo sapiens
tgattttcattgctg

SEQ ID NO: 3679097 - DNA, 13 bp, Homo sapiens
tgattttctggat

SEQ ID NO: 3679098 - DNA, 12 bp, Homo sapiens
tgcaaagtattg

SEQ ID NO: 3679099 - DNA, 16 bp, Homo sapiens
tgcaaagtattgtaaa

SEQ ID NO: 3679100 - DNA, 15 bp, Homo sapiens
tgcaacaacatgtat

SEQ ID NO: 3679101 - DNA, 15 bp, Homo sapiens
tgcaaccactctgtg

SEQ ID NO: 3679102 - DNA, 16 bp, Homo sapiens
tgcaaccactctgtgg

SEQ ID NO: 3679103 - DNA, 22 bp, Homo sapiens
tgcaaccactctgtggccagcc

SEQ ID NO: 3679104 - DNA, 24 bp, Homo sapiens
tgcaaccactctgtggccagcctg

SEQ ID NO: 3679105 - DNA, 20 bp, Homo sapiens
tgcaacggtctcctgactgg

SEQ ID NO: 3679106 - DNA, 22 bp, Homo sapiens
tgcaacggtctcctgactggtg

SEQ ID NO: 3679107 - DNA, 13 bp, Homo sapiens
tgcaagcagagga

SEQ ID NO: 3679108 - DNA, 21 bp, Homo sapiens
tgcaataaatctgacccagtg

SEQ ID NO: 3679109 - DNA, 23 bp, Homo sapiens
tgcaataaatctgacccagtgcc

SEQ ID NO: 3679110 - DNA, 21 bp, Homo sapiens
tgcacatgactcgggggtggg

SEQ ID NO: 3679111 - DNA, 17 bp, Homo sapiens
tgcacatgtttcctcta

SEQ ID NO: 3679112 - DNA, 14 bp, Homo sapiens
tgcaccaccaagcc

SEQ ID NO: 3679113 - DNA, 16 bp, Homo sapiens
tgcaccaccaagccaa

SEQ ID NO: 3679114 - DNA, 15 bp, Homo sapiens
tgcaccactgcactc

SEQ ID NO: 3679115 - DNA, 21 bp, Homo sapiens
tgcaccccaaagctttcctgc

SEQ ID NO: 3679116 - DNA, 17 bp, Homo sapiens
tgcacgtggagagctgg

SEQ ID NO: 3679117 - DNA, 15 bp, Homo sapiens
tgcacgtggcctctt

SEQ ID NO: 3679118 - DNA, 16 bp, Homo sapiens
tgcacgtggcctcttg

SEQ ID NO: 3679119 - DNA, 17 bp, Homo sapiens
tgcacgtggcctcttga

SEQ ID NO: 3679120 - DNA, 23 bp, Homo sapiens
tgcactaaggggcccggccagcc

SEQ ID NO: 3679121 - DNA, 16 bp, Homo sapiens
tgcactactgacatgt

SEQ ID NO: 3679122 - DNA, 16 bp, Homo sapiens
tgcactccagcctggg

SEQ ID NO: 3679123 - DNA, 14 bp, Homo sapiens
tgcactccatccag

SEQ ID NO: 3679124 - DNA, 14 bp, Homo sapiens
tgcactgatgctgc

SEQ ID NO: 3679125 - DNA, 17 bp, Homo sapiens
tgcactgatgctgcccc

SEQ ID NO: 3679126 - DNA, 15 bp, Homo sapiens
tgcactgtgaaggac

SEQ ID NO: 3679127 - DNA, 11 bp, Homo sapiens
tgcagaatgta

SEQ ID NO: 3679128 - DNA, 12 bp, Homo sapiens
tgcagaatgtaa

SEQ ID NO: 3679129 - DNA, 13 bp, Homo sapiens
tgcagacaggaat

SEQ ID NO: 3679130 - DNA, 15 bp, Homo sapiens
tgcagacaggaatct

SEQ ID NO: 3679131 - DNA, 20 bp, Homo sapiens
tgcagacaggaatcttaagg

SEQ ID NO: 3679132 - DNA, 15 bp, Homo sapiens
tgcagaggccagagg

SEQ ID NO: 3679133 - DNA, 19 bp, Homo sapiens
tgcagaggtaccctgggtg

SEQ ID NO: 3679134 - DNA, 21 bp, Homo sapiens
tgcagatcttccgtggtcaga

SEQ ID NO: 3679135 - DNA, 14 bp, Homo sapiens
tgcagcagaggaca

SEQ ID NO: 3679136 - DNA, 17 bp, Homo sapiens
tgcagcagggatgccct

SEQ ID NO: 3679137 - DNA, 18 bp, Homo sapiens
tgcagcagggatgccctg

SEQ ID NO: 3679138 - DNA, 12 bp, Homo sapiens
tgcagcccatgc

SEQ ID NO: 3679139 - DNA, 14 bp, Homo sapiens
tgcagcccatgccc

SEQ ID NO: 3679140 - DNA, 19 bp, Homo sapiens
tgcagcccatgcccacctg

SEQ ID NO: 3679141 - DNA, 18 bp, Homo sapiens
tgcaggaatcccggctcc

SEQ ID NO: 3679142 - DNA, 19 bp, Homo sapiens
tgcaggaatctttaaaaga

SEQ ID NO: 3679143 - DNA, 18 bp, Homo sapiens
tgcaggacctcaggtgag

SEQ ID NO: 3679144 - DNA, 12 bp, Homo sapiens
tgcaggccctgg

SEQ ID NO: 3679145 - DNA, 14 bp, Homo sapiens
tgcaggcggggctc

SEQ ID NO: 3679146 - DNA, 19 bp, Homo sapiens
tgcaggcggggctcctcct

SEQ ID NO: 3679147 - DNA, 22 bp, Homo sapiens
tgcaggcggggctcctcctgaa

SEQ ID NO: 3679148 - DNA, 13 bp, Homo sapiens
tgcagtcatcttg

SEQ ID NO: 3679149 - DNA, 18 bp, Homo sapiens
tgcagtgatgtatacatc

SEQ ID NO: 3679150 - DNA, 21 bp, Homo sapiens
tgcagtggcgcattctaggct

SEQ ID NO: 3679151 - DNA, 19 bp, Homo sapiens
tgcagttcagcaccaccct

SEQ ID NO: 3679152 - DNA, 12 bp, Homo sapiens
tgcagttcttgt

SEQ ID NO: 3679153 - DNA, 17 bp, Homo sapiens
tgcagttcttgtggaag

SEQ ID NO: 3679154 - DNA, 18 bp, Homo sapiens
tgcagttcttgtggaaga

SEQ ID NO: 3679155 - DNA, 22 bp, Homo sapiens
tgcagttcttgtggaagacact

SEQ ID NO: 3679156 - DNA, 14 bp, Homo sapiens
tgcataagtgaaaa

SEQ ID NO: 3679157 - DNA, 22 bp, Homo sapiens
tgcataagtgaaaatcttacaa

SEQ ID NO: 3679158 - DNA, 18 bp, Homo sapiens
tgcataccaacctgggca

SEQ ID NO: 3679159 - DNA, 13 bp, Homo sapiens
tgcatagtttctt

SEQ ID NO: 3679160 - DNA, 14 bp, Homo sapiens
tgcatagtttcttt

SEQ ID NO: 3679161 - DNA, 18 bp, Homo sapiens
tgcatagtttctttattt

SEQ ID NO: 3679162 - DNA, 18 bp, Homo sapiens
tgcatctgaccagcagcg

SEQ ID NO: 3679163 - DNA, 21 bp, Homo sapiens
tgcatctgaccagcagcgcct

SEQ ID NO: 3679164 - DNA, 14 bp, Homo sapiens
tgcatggggcgggt

SEQ ID NO: 3679165 - DNA, 19 bp, Homo sapiens
tgcatggtgccccaggacc

SEQ ID NO: 3679166 - DNA, 19 bp, Homo sapiens
tgcattcttaacaaactct

SEQ ID NO: 3679167 - DNA, 15 bp, Homo sapiens
tgcattgagctgcct

SEQ ID NO: 3679168 - DNA, 16 bp, Homo sapiens
tgcattgagctgcctc

SEQ ID NO: 3679169 - DNA, 18 bp, Homo sapiens
tgcatttgtgctagaaat

SEQ ID NO: 3679170 - DNA, 22 bp, Homo sapiens
tgcatttttgtaaatgtgtaca

SEQ ID NO: 3679171 - DNA, 21 bp, Homo sapiens
tgccaaaataccagagccttc

SEQ ID NO: 3679172 - DNA, 20 bp, Homo sapiens
tgccaaagctagggtggccc

SEQ ID NO: 3679173 - DNA, 18 bp, Homo sapiens
tgccaacttcccctctaa

SEQ ID NO: 3679174 - DNA, 16 bp, Homo sapiens
tgccaaggccagagtg

SEQ ID NO: 3679175 - DNA, 21 bp, Homo sapiens
tgccaaggccagagtggcctg

SEQ ID NO: 3679176 - DNA, 23 bp, Homo sapiens
tgccaattgctaccgagaaggtt

SEQ ID NO: 3679177 - DNA, 12 bp, Homo sapiens
tgccaccaggag

SEQ ID NO: 3679178 - DNA, 14 bp, Homo sapiens
tgccaccaggagaa

SEQ ID NO: 3679179 - DNA, 18 bp, Homo sapiens
tgccaccaggccacctcc

SEQ ID NO: 3679180 - DNA, 16 bp, Homo sapiens
tgccacccacctccct

SEQ ID NO: 3679181 - DNA, 21 bp, Homo sapiens
tgccacccacctccctgcctc

SEQ ID NO: 3679182 - DNA, 17 bp, Homo sapiens
tgccactcactaggccc

SEQ ID NO: 3679183 - DNA, 19 bp, Homo sapiens
tgccactgccttcgcttct

SEQ ID NO: 3679184 - DNA, 18 bp, Homo sapiens
tgccagcggtttcctggt

SEQ ID NO: 3679185 - DNA, 18 bp, Homo sapiens
tgccagcttatctcaggg

SEQ ID NO: 3679186 - DNA, 23 bp, Homo sapiens
tgccaggacccaccactggaagc

SEQ ID NO: 3679187 - DNA, 18 bp, Homo sapiens
tgccagggaactggcctg

SEQ ID NO: 3679188 - DNA, 12 bp, Homo sapiens
tgccagggagct

SEQ ID NO: 3679189 - DNA, 14 bp, Homo sapiens
tgccatcgctgtga

SEQ ID NO: 3679190 - DNA, 18 bp, Homo sapiens
tgccatctagccagcccc

SEQ ID NO: 3679191 - DNA, 17 bp, Homo sapiens
tgccatgatgcctctgt

SEQ ID NO: 3679192 - DNA, 18 bp, Homo sapiens
tgccatggacagaagaag

SEQ ID NO: 3679193 - DNA, 20 bp, Homo sapiens
tgccatggacagaagaaggc

SEQ ID NO: 3679194 - DNA, 15 bp, Homo sapiens
tgccatgttggccag

SEQ ID NO: 3679195 - DNA, 19 bp, Homo sapiens
tgccattgggaccctccag

SEQ ID NO: 3679196 - DNA, 16 bp, Homo sapiens
tgccatttctcaggga

SEQ ID NO: 3679197 - DNA, 22 bp, Homo sapiens
tgccatttctgaactgttacaa

SEQ ID NO: 3679198 - DNA, 20 bp, Homo sapiens
tgcccaaatccttagatctg

SEQ ID NO: 3679199 - DNA, 16 bp, Homo sapiens
tgcccaagccagaggc

SEQ ID NO: 3679200 - DNA, 12 bp, Homo sapiens
tgcccagagctg

SEQ ID NO: 3679201 - DNA, 16 bp, Homo sapiens
tgcccagagctgctgg

SEQ ID NO: 3679202 - DNA, 20 bp, Homo sapiens
tgcccagagctgctggtctc

SEQ ID NO: 3679203 - DNA, 20 bp, Homo sapiens
tgcccagcccctcctccctg

SEQ ID NO: 3679204 - DNA, 20 bp, Homo sapiens
tgcccatcacagggttgggc

SEQ ID NO: 3679205 - DNA, 20 bp, Homo sapiens
tgccccaggaccagctcagg

SEQ ID NO: 3679206 - DNA, 14 bp, Homo sapiens
tgccccaggcctga

SEQ ID NO: 3679207 - DNA, 18 bp, Homo sapiens
tgccccatcctccagcag

SEQ ID NO: 3679208 - DNA, 20 bp, Homo sapiens
tgccccatcctccagcaggg

SEQ ID NO: 3679209 - DNA, 12 bp, Homo sapiens
tgccccatgcct

SEQ ID NO: 3679210 - DNA, 13 bp, Homo sapiens
tgccccggagctg

SEQ ID NO: 3679211 - DNA, 20 bp, Homo sapiens
tgccccgtttttgagactga

SEQ ID NO: 3679212 - DNA, 16 bp, Homo sapiens
tgcccctcagagactg

SEQ ID NO: 3679213 - DNA, 14 bp, Homo sapiens
tgcccctccaagtc

SEQ ID NO: 3679214 - DNA, 21 bp, Homo sapiens
tgcccctcccagaacacactc

SEQ ID NO: 3679215 - DNA, 13 bp, Homo sapiens
tgcccctgctgct

SEQ ID NO: 3679216 - DNA, 12 bp, Homo sapiens
tgcccctgggat

SEQ ID NO: 3679217 - DNA, 21 bp, Homo sapiens
tgcccggagattggacggcct

SEQ ID NO: 3679218 - DNA, 23 bp, Homo sapiens
tgcccggagattggacggcctga

SEQ ID NO: 3679219 - DNA, 12 bp, Homo sapiens
tgccctcctctc

SEQ ID NO: 3679220 - DNA, 14 bp, Homo sapiens
tgccctcgggtctc

SEQ ID NO: 3679221 - DNA, 16 bp, Homo sapiens
tgccctggaggtggct

SEQ ID NO: 3679222 - DNA, 12 bp, Homo sapiens
tgcccttctgat

SEQ ID NO: 3679223 - DNA, 19 bp, Homo sapiens
tgcccttggaggccagcca

SEQ ID NO: 3679224 - DNA, 12 bp, Homo sapiens
tgccgagccagc

SEQ ID NO: 3679225 - DNA, 23 bp, Homo sapiens
tgccggacccggaggccgaggcc

SEQ ID NO: 3679226 - DNA, 14 bp, Homo sapiens
tgccggccctgggg

SEQ ID NO: 3679227 - DNA, 19 bp, Homo sapiens
tgccgtcagtgctgtgctg

SEQ ID NO: 3679228 - DNA, 16 bp, Homo sapiens
tgcctacgccaggaga

SEQ ID NO: 3679229 - DNA, 19 bp, Homo sapiens
tgcctagactgttactttg

SEQ ID NO: 3679230 - DNA, 15 bp, Homo sapiens
tgcctcaatgccagt

SEQ ID NO: 3679231 - DNA, 16 bp, Homo sapiens
tgcctcaatgccagta

SEQ ID NO: 3679232 - DNA, 18 bp, Homo sapiens
tgcctcactaatttttgt

SEQ ID NO: 3679233 - DNA, 19 bp, Homo sapiens
tgcctcatggccagcgccc

SEQ ID NO: 3679234 - DNA, 13 bp, Homo sapiens
tgcctccagcctg

SEQ ID NO: 3679235 - DNA, 14 bp, Homo sapiens
tgcctccaggaacc

SEQ ID NO: 3679236 - DNA, 20 bp, Homo sapiens
tgcctccaggaaccacacca

SEQ ID NO: 3679237 - DNA, 21 bp, Homo sapiens
tgcctccaggtgcagaggtac

SEQ ID NO: 3679238 - DNA, 20 bp, Homo sapiens
tgcctctactttgattctga

SEQ ID NO: 3679239 - DNA, 19 bp, Homo sapiens
tgcctcttaaattatatat

SEQ ID NO: 3679240 - DNA, 19 bp, Homo sapiens
tgcctgagggtgggctttt

SEQ ID NO: 3679241 - DNA, 20 bp, Homo sapiens
tgcctgcaaccttgcatcca

SEQ ID NO: 3679242 - DNA, 17 bp, Homo sapiens
tgcctgcagggccatgg

SEQ ID NO: 3679243 - DNA, 16 bp, Homo sapiens
tgcctgccagctgcac

SEQ ID NO: 3679244 - DNA, 23 bp, Homo sapiens
tgcctggagtgtatgactgcaca

SEQ ID NO: 3679245 - DNA, 20 bp, Homo sapiens
tgcctgtccagcctgggcag

SEQ ID NO: 3679246 - DNA, 11 bp, Homo sapiens
tgcctgtggcg

SEQ ID NO: 3679247 - DNA, 21 bp, Homo sapiens
tgcctgtggcgccgtctccag

SEQ ID NO: 3679248 - DNA, 23 bp, Homo sapiens
tgcctgtggcgccgtctccaggg

SEQ ID NO: 3679249 - DNA, 21 bp, Homo sapiens
tgcctgtgtccatgcgctcag

SEQ ID NO: 3679250 - DNA, 22 bp, Homo sapiens
tgcctgtgtccatgcgctcagg

SEQ ID NO: 3679251 - DNA, 12 bp, Homo sapiens
tgcctgtgtgcg

SEQ ID NO: 3679252 - DNA, 14 bp, Homo sapiens
tgccttatcttgca

SEQ ID NO: 3679253 - DNA, 16 bp, Homo sapiens
tgccttcgcttcttgc

SEQ ID NO: 3679254 - DNA, 17 bp, Homo sapiens
tgccttcgcttcttgcc

SEQ ID NO: 3679255 - DNA, 16 bp, Homo sapiens
tgccttctaaaggtgt

SEQ ID NO: 3679256 - DNA, 12 bp, Homo sapiens
tgccttgaataa

SEQ ID NO: 3679257 - DNA, 15 bp, Homo sapiens
tgccttgaataataa

SEQ ID NO: 3679258 - DNA, 19 bp, Homo sapiens
tgcctttgcaccacgggac

SEQ ID NO: 3679259 - DNA, 16 bp, Homo sapiens
tgccttttaattttta

SEQ ID NO: 3679260 - DNA, 19 bp, Homo sapiens
tgcgaaaggatgaaagtga

SEQ ID NO: 3679261 - DNA, 15 bp, Homo sapiens
tgcgaccctgggggc

SEQ ID NO: 3679262 - DNA, 15 bp, Homo sapiens
tgcgactttctgcct

SEQ ID NO: 3679263 - DNA, 17 bp, Homo sapiens
tgcgactttctgcctgg

SEQ ID NO: 3679264 - DNA, 18 bp, Homo sapiens
tgcgactttctgcctgga

SEQ ID NO: 3679265 - DNA, 14 bp, Homo sapiens
tgcgcctgtgacca

SEQ ID NO: 3679266 - DNA, 18 bp, Homo sapiens
tgcgcctgtgatgctggg

SEQ ID NO: 3679267 - DNA, 13 bp, Homo sapiens
tgcgctcagggcc

SEQ ID NO: 3679268 - DNA, 14 bp, Homo sapiens
tgcgctcagggcca

SEQ ID NO: 3679269 - DNA, 22 bp, Homo sapiens
tgcgctcagggccatgctgagg

SEQ ID NO: 3679270 - DNA, 16 bp, Homo sapiens
tgcgggagctctgtat

SEQ ID NO: 3679271 - DNA, 23 bp, Homo sapiens
tgcgggtggggcttggggctcac

SEQ ID NO: 3679272 - DNA, 17 bp, Homo sapiens
tgcgtgaaggctctcag

SEQ ID NO: 3679273 - DNA, 21 bp, Homo sapiens
tgcgtgtcagttactttttta

SEQ ID NO: 3679274 - DNA, 16 bp, Homo sapiens
tgcgttggcttctccc

SEQ ID NO: 3679275 - DNA, 18 bp, Homo sapiens
tgcgttggcttctccctg

SEQ ID NO: 3679276 - DNA, 14 bp, Homo sapiens
tgctaaaattcttc

SEQ ID NO: 3679277 - DNA, 15 bp, Homo sapiens
tgctaaatgtgaatg

SEQ ID NO: 3679278 - DNA, 15 bp, Homo sapiens
tgctacctctgagaa

SEQ ID NO: 3679279 - DNA, 16 bp, Homo sapiens
tgctacctctgagaag

SEQ ID NO: 3679280 - DNA, 15 bp, Homo sapiens
tgctagaaattttca

SEQ ID NO: 3679281 - DNA, 14 bp, Homo sapiens
tgctatagcctggg

SEQ ID NO: 3679282 - DNA, 13 bp, Homo sapiens
tgctatagtattt

SEQ ID NO: 3679283 - DNA, 13 bp, Homo sapiens
tgctatttttgta

SEQ ID NO: 3679284 - DNA, 22 bp, Homo sapiens
tgctatttttgtaaagtttccg

SEQ ID NO: 3679285 - DNA, 22 bp, Homo sapiens
tgctcacctggggtgtgggagg

SEQ ID NO: 3679286 - DNA, 23 bp, Homo sapiens
tgctcacctggggtgtgggaggc

SEQ ID NO: 3679287 - DNA, 17 bp, Homo sapiens
tgctcagaggccttgct

SEQ ID NO: 3679288 - DNA, 15 bp, Homo sapiens
tgctcagctgcgccc

SEQ ID NO: 3679289 - DNA, 20 bp, Homo sapiens
tgctcagcttctcctgtgtg

SEQ ID NO: 3679290 - DNA, 14 bp, Homo sapiens
tgctcatctgctgg

SEQ ID NO: 3679291 - DNA, 23 bp, Homo sapiens
tgctccacccttggcctgtctca

SEQ ID NO: 3679292 - DNA, 14 bp, Homo sapiens
tgctccagacctga

SEQ ID NO: 3679293 - DNA, 21 bp, Homo sapiens
tgctccagacctgatcctgga

SEQ ID NO: 3679294 - DNA, 16 bp, Homo sapiens
tgctccctaccacctc

SEQ ID NO: 3679295 - DNA, 13 bp, Homo sapiens
tgctccctcccct

SEQ ID NO: 3679296 - DNA, 14 bp, Homo sapiens
tgctccctcccctg

SEQ ID NO: 3679297 - DNA, 15 bp, Homo sapiens
tgctccctcccctgc

SEQ ID NO: 3679298 - DNA, 17 bp, Homo sapiens
tgctccctcccctgccc

SEQ ID NO: 3679299 - DNA, 18 bp, Homo sapiens
tgctccctcccctgccct

SEQ ID NO: 3679300 - DNA, 15 bp, Homo sapiens
tgctccctgagggcg

SEQ ID NO: 3679301 - DNA, 13 bp, Homo sapiens
tgctccgtgcttg

SEQ ID NO: 3679302 - DNA, 21 bp, Homo sapiens
tgctccttccaacaggagctg

SEQ ID NO: 3679303 - DNA, 21 bp, Homo sapiens
tgctcgcgaaggtcccacagc

SEQ ID NO: 3679304 - DNA, 14 bp, Homo sapiens
tgctctcactgttt

SEQ ID NO: 3679305 - DNA, 22 bp, Homo sapiens
tgctctcactgtttgtttttat

SEQ ID NO: 3679306 - DNA, 13 bp, Homo sapiens
tgctctttctctg

SEQ ID NO: 3679307 - DNA, 17 bp, Homo sapiens
tgctctttctctgccag

SEQ ID NO: 3679308 - DNA, 22 bp, Homo sapiens
tgctctttgtagctaacagtga

SEQ ID NO: 3679309 - DNA, 23 bp, Homo sapiens
tgctgaatacagaggcaactgca

SEQ ID NO: 3679310 - DNA, 14 bp, Homo sapiens
tgctgacagctgct

SEQ ID NO: 3679311 - DNA, 16 bp, Homo sapiens
tgctgacagctgctcc

SEQ ID NO: 3679312 - DNA, 15 bp, Homo sapiens
tgctgacctccacag

SEQ ID NO: 3679313 - DNA, 16 bp, Homo sapiens
tgctgacctccacagc

SEQ ID NO: 3679314 - DNA, 15 bp, Homo sapiens
tgctgacggccaggg

SEQ ID NO: 3679315 - DNA, 17 bp, Homo sapiens
tgctgacggccagggag

SEQ ID NO: 3679316 - DNA, 20 bp, Homo sapiens
tgctgacggccagggagaag

SEQ ID NO: 3679317 - DNA, 22 bp, Homo sapiens
tgctgacggccagggagaagct

SEQ ID NO: 3679318 - DNA, 24 bp, Homo sapiens
tgctgactgttttctcttgagagg

SEQ ID NO: 3679319 - DNA, 10 bp, Homo sapiens
tgctgagctg

SEQ ID NO: 3679320 - DNA, 20 bp, Homo sapiens
tgctgagctgcccctgctgc

SEQ ID NO: 3679321 - DNA, 13 bp, Homo sapiens
tgctgaggcctgg

SEQ ID NO: 3679322 - DNA, 15 bp, Homo sapiens
tgctgaggcctgggc

SEQ ID NO: 3679323 - DNA, 15 bp, Homo sapiens
tgctgagttggtgtt

SEQ ID NO: 3679324 - DNA, 22 bp, Homo sapiens
tgctgatgtcaaagtgtaacag

SEQ ID NO: 3679325 - DNA, 18 bp, Homo sapiens
tgctgcattgatccagga

SEQ ID NO: 3679326 - DNA, 17 bp, Homo sapiens
tgctgcgccccaggccc

SEQ ID NO: 3679327 - DNA, 17 bp, Homo sapiens
tgctgctgcctctttcc

SEQ ID NO: 3679328 - DNA, 17 bp, Homo sapiens
tgctgcttaagtgcatg

SEQ ID NO: 3679329 - DNA, 19 bp, Homo sapiens
tgctgcttgaggcaactca

SEQ ID NO: 3679330 - DNA, 19 bp, Homo sapiens
tgctggaacctgcaaaaaa

SEQ ID NO: 3679331 - DNA, 18 bp, Homo sapiens
tgctggaagacagagaaa

SEQ ID NO: 3679332 - DNA, 13 bp, Homo sapiens
tgctggatttgat

SEQ ID NO: 3679333 - DNA, 14 bp, Homo sapiens
tgctggcccagggc

SEQ ID NO: 3679334 - DNA, 18 bp, Homo sapiens
tgctggcccagggcccag

SEQ ID NO: 3679335 - DNA, 19 bp, Homo sapiens
tgctggcccagggcccaga

SEQ ID NO: 3679336 - DNA, 22 bp, Homo sapiens
tgctggcccagggcccagagcc

SEQ ID NO: 3679337 - DNA, 23 bp, Homo sapiens
tgctggcccagggcccagagccc

SEQ ID NO: 3679338 - DNA, 15 bp, Homo sapiens
tgctgggaagcccgg

SEQ ID NO: 3679339 - DNA, 18 bp, Homo sapiens
tgctgggactcagccttc

SEQ ID NO: 3679340 - DNA, 22 bp, Homo sapiens
tgctgggactcagccttcagac

SEQ ID NO: 3679341 - DNA, 19 bp, Homo sapiens
tgctggggtcaaggcagta

SEQ ID NO: 3679342 - DNA, 16 bp, Homo sapiens
tgctggtccgtgggac

SEQ ID NO: 3679343 - DNA, 13 bp, Homo sapiens
tgctggtctcatt

SEQ ID NO: 3679344 - DNA, 13 bp, Homo sapiens
tgctgtgaggctg

SEQ ID NO: 3679345 - DNA, 18 bp, Homo sapiens
tgctgtgaggctgtcctg

SEQ ID NO: 3679346 - DNA, 13 bp, Homo sapiens
tgctgtgtatatg

SEQ ID NO: 3679347 - DNA, 22 bp, Homo sapiens
tgctgttgaagatttgaggact

SEQ ID NO: 3679348 - DNA, 14 bp, Homo sapiens
tgctgttttcctcc

SEQ ID NO: 3679349 - DNA, 17 bp, Homo sapiens
tgctgttttcctccctt

SEQ ID NO: 3679350 - DNA, 21 bp, Homo sapiens
tgctgttttcctcccttctgc

SEQ ID NO: 3679351 - DNA, 20 bp, Homo sapiens
tgcttaataaaagaacatgc

SEQ ID NO: 3679352 - DNA, 21 bp, Homo sapiens
tgcttatggtaccagatgcag

SEQ ID NO: 3679353 - DNA, 17 bp, Homo sapiens
tgcttcaaactgagaca

SEQ ID NO: 3679354 - DNA, 15 bp, Homo sapiens
tgcttccccttttgc

SEQ ID NO: 3679355 - DNA, 15 bp, Homo sapiens
tgcttccctaatcta

SEQ ID NO: 3679356 - DNA, 18 bp, Homo sapiens
tgcttccctgcagctgac

SEQ ID NO: 3679357 - DNA, 12 bp, Homo sapiens
tgcttcctcctg

SEQ ID NO: 3679358 - DNA, 15 bp, Homo sapiens
tgcttcctcctggaa

SEQ ID NO: 3679359 - DNA, 18 bp, Homo sapiens
tgcttcctcgtgccaatt

SEQ ID NO: 3679360 - DNA, 12 bp, Homo sapiens
tgcttctctgac

SEQ ID NO: 3679361 - DNA, 20 bp, Homo sapiens
tgcttgcctgcagggccatg

SEQ ID NO: 3679362 - DNA, 19 bp, Homo sapiens
tgcttgtaggtatgtctgt

SEQ ID NO: 3679363 - DNA, 22 bp, Homo sapiens
tgcttgtaggtatgtctgtgcc

SEQ ID NO: 3679364 - DNA, 11 bp, Homo sapiens
tgctttcacat

SEQ ID NO: 3679365 - DNA, 23 bp, Homo sapiens
tgctttcagaagtgcccttcctg

SEQ ID NO: 3679366 - DNA, 12 bp, Homo sapiens
tgctttctgctc

SEQ ID NO: 3679367 - DNA, 13 bp, Homo sapiens
tgctttctgctca

SEQ ID NO: 3679368 - DNA, 14 bp, Homo sapiens
tgctttctgctcag

SEQ ID NO: 3679369 - DNA, 15 bp, Homo sapiens
tgctttctgctcagc

SEQ ID NO: 3679370 - DNA, 13 bp, Homo sapiens
tgctttgctttct

SEQ ID NO: 3679371 - DNA, 18 bp, Homo sapiens
tgctttggacctaaatgg

SEQ ID NO: 3679372 - DNA, 19 bp, Homo sapiens
tgcttttggcaaaactcta

SEQ ID NO: 3679373 - DNA, 21 bp, Homo sapiens
tgcttttggcaaaactctact

SEQ ID NO: 3679374 - DNA, 11 bp, Homo sapiens
tggaaaataaa

SEQ ID NO: 3679375 - DNA, 14 bp, Homo sapiens
tggaaaatcagtga

SEQ ID NO: 3679376 - DNA, 18 bp, Homo sapiens
tggaaacattttttaaaa

SEQ ID NO: 3679377 - DNA, 18 bp, Homo sapiens
tggaaagatagagattgt

SEQ ID NO: 3679378 - DNA, 21 bp, Homo sapiens
tggaaattcccgtgttgcttc

SEQ ID NO: 3679379 - DNA, 12 bp, Homo sapiens
tggaacccagac

SEQ ID NO: 3679380 - DNA, 20 bp, Homo sapiens
tggaaccgcaggaagctgct

SEQ ID NO: 3679381 - DNA, 19 bp, Homo sapiens
tggaacctcagcctggcca

SEQ ID NO: 3679382 - DNA, 23 bp, Homo sapiens
tggaacctcagcctggccagaca

SEQ ID NO: 3679383 - DNA, 17 bp, Homo sapiens
tggaacctggaccccag

SEQ ID NO: 3679384 - DNA, 21 bp, Homo sapiens
tggaacctggaccccagcctt

SEQ ID NO: 3679385 - DNA, 21 bp, Homo sapiens
tggaagaaaaaaaccacacaa

SEQ ID NO: 3679386 - DNA, 13 bp, Homo sapiens
tggaagatcctgc

SEQ ID NO: 3679387 - DNA, 19 bp, Homo sapiens
tggaagtgggccagtcctg

SEQ ID NO: 3679388 - DNA, 21 bp, Homo sapiens
tggaagtgggccagtcctggt

SEQ ID NO: 3679389 - DNA, 23 bp, Homo sapiens
tggaatcaggaatattttccaaa

SEQ ID NO: 3679390 - DNA, 15 bp, Homo sapiens
tggaatgcatggggc

SEQ ID NO: 3679391 - DNA, 16 bp, Homo sapiens
tggaatggtttgggaa

SEQ ID NO: 3679392 - DNA, 21 bp, Homo sapiens
tggaattatgctggcttctga

SEQ ID NO: 3679393 - DNA, 15 bp, Homo sapiens
tggacaaagaacctt

SEQ ID NO: 3679394 - DNA, 18 bp, Homo sapiens
tggacagaggcggggcta

SEQ ID NO: 3679395 - DNA, 15 bp, Homo sapiens
tggacagtgctgttg

SEQ ID NO: 3679396 - DNA, 16 bp, Homo sapiens
tggaccccagccttgg

SEQ ID NO: 3679397 - DNA, 17 bp, Homo sapiens
tggaccccagccttggt

SEQ ID NO: 3679398 - DNA, 23 bp, Homo sapiens
tggacctgtatatttgtaaagct

SEQ ID NO: 3679399 - DNA, 12 bp, Homo sapiens
tggacggggcgg

SEQ ID NO: 3679400 - DNA, 23 bp, Homo sapiens
tggacggggcgggccctgcctga

SEQ ID NO: 3679401 - DNA, 17 bp, Homo sapiens
tggactatctgtctggt

SEQ ID NO: 3679402 - DNA, 23 bp, Homo sapiens
tggactatctgtctggtggcccc

SEQ ID NO: 3679403 - DNA, 19 bp, Homo sapiens
tggactggctagagtcctc

SEQ ID NO: 3679404 - DNA, 20 bp, Homo sapiens
tggactggctagagtcctca

SEQ ID NO: 3679405 - DNA, 11 bp, Homo sapiens
tggagaagcac

SEQ ID NO: 3679406 - DNA, 13 bp, Homo sapiens
tggagaagcggct

SEQ ID NO: 3679407 - DNA, 22 bp, Homo sapiens
tggagaagcggctggcagccca

SEQ ID NO: 3679408 - DNA, 21 bp, Homo sapiens
tggagaagctccctgaagtaa

SEQ ID NO: 3679409 - DNA, 21 bp, Homo sapiens
tggagacttagggcaccaggg

SEQ ID NO: 3679410 - DNA, 11 bp, Homo sapiens
tggagagctgg

SEQ ID NO: 3679411 - DNA, 16 bp, Homo sapiens
tggagagtttcctgaa

SEQ ID NO: 3679412 - DNA, 17 bp, Homo sapiens
tggagagtttcctgaaa

SEQ ID NO: 3679413 - DNA, 20 bp, Homo sapiens
tggagcaggactcccaccta

SEQ ID NO: 3679414 - DNA, 16 bp, Homo sapiens
tggagctgactgttct

SEQ ID NO: 3679415 - DNA, 19 bp, Homo sapiens
tggaggaacacttgatgga

SEQ ID NO: 3679416 - DNA, 19 bp, Homo sapiens
tggaggagctcaggacact

SEQ ID NO: 3679417 - DNA, 17 bp, Homo sapiens
tggaggatcagtttttt

SEQ ID NO: 3679418 - DNA, 14 bp, Homo sapiens
tggaggccagccag

SEQ ID NO: 3679419 - DNA, 12 bp, Homo sapiens
tggaggcccagt

SEQ ID NO: 3679420 - DNA, 13 bp, Homo sapiens
tggaggctcctgt

SEQ ID NO: 3679421 - DNA, 16 bp, Homo sapiens
tggaggctcctgtggt

SEQ ID NO: 3679422 - DNA, 14 bp, Homo sapiens
tggagggaggcccc

SEQ ID NO: 3679423 - DNA, 14 bp, Homo sapiens
tggaggtggggaag

SEQ ID NO: 3679424 - DNA, 17 bp, Homo sapiens
tggaggtggggaaggct

SEQ ID NO: 3679425 - DNA, 20 bp, Homo sapiens
tggaggttaaggctgaggaa

SEQ ID NO: 3679426 - DNA, 24 bp, Homo sapiens
tggaggttaaggctgaggaaaggc

SEQ ID NO: 3679427 - DNA, 15 bp, Homo sapiens
tggagtacccagcct

SEQ ID NO: 3679428 - DNA, 18 bp, Homo sapiens
tggagtgttatgtatttc

SEQ ID NO: 3679429 - DNA, 15 bp, Homo sapiens
tggagttgatctgga

SEQ ID NO: 3679430 - DNA, 19 bp, Homo sapiens
tggagttgatctggaaccc

SEQ ID NO: 3679431 - DNA, 17 bp, Homo sapiens
tggagttttttgtacca

SEQ ID NO: 3679432 - DNA, 18 bp, Homo sapiens
tggagttttttgtaccaa

SEQ ID NO: 3679433 - DNA, 14 bp, Homo sapiens
tggatgaggcttct

SEQ ID NO: 3679434 - DNA, 19 bp, Homo sapiens
tggatgaggcttcttcctg

SEQ ID NO: 3679435 - DNA, 18 bp, Homo sapiens
tggatgcggccattcaag

SEQ ID NO: 3679436 - DNA, 14 bp, Homo sapiens
tggatggccccagc

SEQ ID NO: 3679437 - DNA, 15 bp, Homo sapiens
tggatggccccagca

SEQ ID NO: 3679438 - DNA, 16 bp, Homo sapiens
tggatggccccagcac

SEQ ID NO: 3679439 - DNA, 17 bp, Homo sapiens
tggatggggcagagctt

SEQ ID NO: 3679440 - DNA, 19 bp, Homo sapiens
tggatggggcagagcttct

SEQ ID NO: 3679441 - DNA, 22 bp, Homo sapiens
tggatggggcagagcttctcct

SEQ ID NO: 3679442 - DNA, 17 bp, Homo sapiens
tggattgcacgtggcct

SEQ ID NO: 3679443 - DNA, 14 bp, Homo sapiens
tggattggggtccc

SEQ ID NO: 3679444 - DNA, 20 bp, Homo sapiens
tggcaaaacactatgtatag

SEQ ID NO: 3679445 - DNA, 20 bp, Homo sapiens
tggcaaaactctacttaatc

SEQ ID NO: 3679446 - DNA, 16 bp, Homo sapiens
tggcaacagatctgga

SEQ ID NO: 3679447 - DNA, 17 bp, Homo sapiens
tggcaacagatctggaa

SEQ ID NO: 3679448 - DNA, 20 bp, Homo sapiens
tggcaacagatctggaacct

SEQ ID NO: 3679449 - DNA, 15 bp, Homo sapiens
tggcaatttcctggc

SEQ ID NO: 3679450 - DNA, 18 bp, Homo sapiens
tggcaatttcctggccct

SEQ ID NO: 3679451 - DNA, 20 bp, Homo sapiens
tggcacagcccaaagaagga

SEQ ID NO: 3679452 - DNA, 16 bp, Homo sapiens
tggcaccagacaccca

SEQ ID NO: 3679453 - DNA, 17 bp, Homo sapiens
tggcaccagacacccag

SEQ ID NO: 3679454 - DNA, 21 bp, Homo sapiens
tggcaccagacacccaggact

SEQ ID NO: 3679455 - DNA, 16 bp, Homo sapiens
tggcaccgcctcccca

SEQ ID NO: 3679456 - DNA, 22 bp, Homo sapiens
tggcagaatggggtgcatgaag

SEQ ID NO: 3679457 - DNA, 14 bp, Homo sapiens
tggcagcagagtgt

SEQ ID NO: 3679458 - DNA, 20 bp, Homo sapiens
tggcagcagagtgtggcctt

SEQ ID NO: 3679459 - DNA, 21 bp, Homo sapiens
tggcagctctggacagcccca

SEQ ID NO: 3679460 - DNA, 20 bp, Homo sapiens
tggcaggcaggctcccaggg

SEQ ID NO: 3679461 - DNA, 12 bp, Homo sapiens
tggcaggctggc

SEQ ID NO: 3679462 - DNA, 18 bp, Homo sapiens
tggcaggggacaggagtc

SEQ ID NO: 3679463 - DNA, 23 bp, Homo sapiens
tggcatcaccttaggcagggaag

SEQ ID NO: 3679464 - DNA, 22 bp, Homo sapiens
tggcatcgcaccattctgactc

SEQ ID NO: 3679465 - DNA, 19 bp, Homo sapiens
tggccaaggagctgctata

SEQ ID NO: 3679466 - DNA, 16 bp, Homo sapiens
tggccacatggcggag

SEQ ID NO: 3679467 - DNA, 22 bp, Homo sapiens
tggccaccaggtgcctttcaaa

SEQ ID NO: 3679468 - DNA, 19 bp, Homo sapiens
tggccactaagcagaggag

SEQ ID NO: 3679469 - DNA, 14 bp, Homo sapiens
tggccactccgaga

SEQ ID NO: 3679470 - DNA, 17 bp, Homo sapiens
tggccactgagctggct

SEQ ID NO: 3679471 - DNA, 18 bp, Homo sapiens
tggccagaggtgtcaccc

SEQ ID NO: 3679472 - DNA, 16 bp, Homo sapiens
tggccagcctggcatc

SEQ ID NO: 3679473 - DNA, 17 bp, Homo sapiens
tggccagcctggcatca

SEQ ID NO: 3679474 - DNA, 12 bp, Homo sapiens
tggccagctgca

SEQ ID NO: 3679475 - DNA, 15 bp, Homo sapiens
tggccaggagctctt

SEQ ID NO: 3679476 - DNA, 17 bp, Homo sapiens
tggccaggcagatctgt

SEQ ID NO: 3679477 - DNA, 14 bp, Homo sapiens
tggccagtccaggc

SEQ ID NO: 3679478 - DNA, 16 bp, Homo sapiens
tggccagtccaggctg

SEQ ID NO: 3679479 - DNA, 23 bp, Homo sapiens
tggccagtccaggctgccgtggg

SEQ ID NO: 3679480 - DNA, 12 bp, Homo sapiens
tggcccaaggct

SEQ ID NO: 3679481 - DNA, 16 bp, Homo sapiens
tggcccaaggctggca

SEQ ID NO: 3679482 - DNA, 20 bp, Homo sapiens
tggcccagggcccagagccc

SEQ ID NO: 3679483 - DNA, 21 bp, Homo sapiens
tggcccagggcccagagccca

SEQ ID NO: 3679484 - DNA, 13 bp, Homo sapiens
tggccccaccctg

SEQ ID NO: 3679485 - DNA, 16 bp, Homo sapiens
tggccccaccctgggc

SEQ ID NO: 3679486 - DNA, 22 bp, Homo sapiens
tggccccaccctgggccctggg

SEQ ID NO: 3679487 - DNA, 12 bp, Homo sapiens
tggccccagcac

SEQ ID NO: 3679488 - DNA, 17 bp, Homo sapiens
tggccccagcacagctt

SEQ ID NO: 3679489 - DNA, 19 bp, Homo sapiens
tggccccagcacagcttga

SEQ ID NO: 3679490 - DNA, 17 bp, Homo sapiens
tggccgctgagtggcag

SEQ ID NO: 3679491 - DNA, 19 bp, Homo sapiens
tggccgctgagtggcaggg

SEQ ID NO: 3679492 - DNA, 13 bp, Homo sapiens
tggccggctctgg

SEQ ID NO: 3679493 - DNA, 14 bp, Homo sapiens
tggccggctctggt

SEQ ID NO: 3679494 - DNA, 23 bp, Homo sapiens
tggccgggcgcggtggctcacgc

SEQ ID NO: 3679495 - DNA, 21 bp, Homo sapiens
tggcctaaacctcagttatta

SEQ ID NO: 3679496 - DNA, 13 bp, Homo sapiens
tggcctcagctgc

SEQ ID NO: 3679497 - DNA, 14 bp, Homo sapiens
tggcctcagctgcc

SEQ ID NO: 3679498 - DNA, 18 bp, Homo sapiens
tggcctcagctgcctcac

SEQ ID NO: 3679499 - DNA, 13 bp, Homo sapiens
tggcctcatgtgg

SEQ ID NO: 3679500 - DNA, 15 bp, Homo sapiens
tggcctcatgtggct

SEQ ID NO: 3679501 - DNA, 20 bp, Homo sapiens
tggcctcatgtggctggaag

SEQ ID NO: 3679502 - DNA, 21 bp, Homo sapiens
tggcctcatgtggctggaaga

SEQ ID NO: 3679503 - DNA, 17 bp, Homo sapiens
tggcctcttgagcagtg

SEQ ID NO: 3679504 - DNA, 19 bp, Homo sapiens
tggcctcttgagcagtggc

SEQ ID NO: 3679505 - DNA, 20 bp, Homo sapiens
tggcctgcataggctccttc

SEQ ID NO: 3679506 - DNA, 13 bp, Homo sapiens
tggcctggccagg

SEQ ID NO: 3679507 - DNA, 21 bp, Homo sapiens
tggcctggccaggagctcttc

SEQ ID NO: 3679508 - DNA, 12 bp, Homo sapiens
tggcctgtctca

SEQ ID NO: 3679509 - DNA, 20 bp, Homo sapiens
tggcctgtctcatccccagg

SEQ ID NO: 3679510 - DNA, 19 bp, Homo sapiens
ggtacaaaaataaatttat

SEQ ID NO: 3679511 - DNA, 14 bp, Homo sapiens
ggtaccagatgcag

SEQ ID NO: 3679512 - DNA, 11 bp, Homo sapiens
ggtaccctggg

SEQ ID NO: 3679513 - DNA, 19 bp, Homo sapiens
ggtacttcttgaaggtgct

SEQ ID NO: 3679514 - DNA, 18 bp, Homo sapiens
ggtagatgagaaaacagg

SEQ ID NO: 3679515 - DNA, 19 bp, Homo sapiens
ggtagctgcccctggctct

SEQ ID NO: 3679516 - DNA, 16 bp, Homo sapiens
ggtaggaagagaggtc

SEQ ID NO: 3679517 - DNA, 15 bp, Homo sapiens
ggtaggttcagccaa

SEQ ID NO: 3679518 - DNA, 13 bp, Homo sapiens
ggtagtcctccca

SEQ ID NO: 3679519 - DNA, 21 bp, Homo sapiens
ggtagtcctcccaagctgtgc

SEQ ID NO: 3679520 - DNA, 23 bp, Homo sapiens
ggtatagttcatgtctgctatca

SEQ ID NO: 3679521 - DNA, 21 bp, Homo sapiens
ggtatggaagggtttgtggct

SEQ ID NO: 3679522 - DNA, 16 bp, Homo sapiens
ggtatgtctgtgccat

SEQ ID NO: 3679523 - DNA, 17 bp, Homo sapiens
ggtattagcaaagcaaa

SEQ ID NO: 3679524 - DNA, 19 bp, Homo sapiens
ggtattagtgtttgaaaaa

SEQ ID NO: 3679525 - DNA, 15 bp, Homo sapiens
ggtatttattggtca

SEQ ID NO: 3679526 - DNA, 22 bp, Homo sapiens
ggtcaacagttttcctatgctt

SEQ ID NO: 3679527 - DNA, 23 bp, Homo sapiens
ggtcacacaaaggcatgctggag

SEQ ID NO: 3679528 - DNA, 13 bp, Homo sapiens
ggtcagagccact

SEQ ID NO: 3679529 - DNA, 16 bp, Homo sapiens
ggtcagagtgccactg

SEQ ID NO: 3679530 - DNA, 13 bp, Homo sapiens
ggtcatatggaaa

SEQ ID NO: 3679531 - DNA, 13 bp, Homo sapiens
ggtccaaatgttt

SEQ ID NO: 3679532 - DNA, 14 bp, Homo sapiens
ggtccaccccatgt

SEQ ID NO: 3679533 - DNA, 14 bp, Homo sapiens
ggtccagctctgga

SEQ ID NO: 3679534 - DNA, 16 bp, Homo sapiens
ggtccagctctgtggg

SEQ ID NO: 3679535 - DNA, 16 bp, Homo sapiens
ggtccgctttcctgga

SEQ ID NO: 3679536 - DNA, 18 bp, Homo sapiens
ggtccgctttcctggagc

SEQ ID NO: 3679537 - DNA, 23 bp, Homo sapiens
ggtcctagaaattccccaccctg

SEQ ID NO: 3679538 - DNA, 12 bp, Homo sapiens
ggtcctggccat

SEQ ID NO: 3679539 - DNA, 16 bp, Homo sapiens
ggtcctggccatccca

SEQ ID NO: 3679540 - DNA, 21 bp, Homo sapiens
ggtcctggccatcccacaagt

SEQ ID NO: 3679541 - DNA, 14 bp, Homo sapiens
ggtcctggctcctg

SEQ ID NO: 3679542 - DNA, 15 bp, Homo sapiens
ggtcctggctcctga

SEQ ID NO: 3679543 - DNA, 16 bp, Homo sapiens
ggtcctggctcctgag

SEQ ID NO: 3679544 - DNA, 23 bp, Homo sapiens
ggtcctttctggaagtttctggt

SEQ ID NO: 3679545 - DNA, 13 bp, Homo sapiens
ggtcgctcctgcc

SEQ ID NO: 3679546 - DNA, 15 bp, Homo sapiens
ggtctccccacctgc

SEQ ID NO: 3679547 - DNA, 23 bp, Homo sapiens
ggtctgcaggcagggctgactct

SEQ ID NO: 3679548 - DNA, 16 bp, Homo sapiens
ggtctgctctttctct

SEQ ID NO: 3679549 - DNA, 22 bp, Homo sapiens
ggtctgctctttctctgccagt

SEQ ID NO: 3679550 - DNA, 22 bp, Homo sapiens
ggtctgggcggcgggcggctgg

SEQ ID NO: 3679551 - DNA, 19 bp, Homo sapiens
ggtctgttggcaggctggc

SEQ ID NO: 3679552 - DNA, 12 bp, Homo sapiens
ggtcttgctctg

SEQ ID NO: 3679553 - DNA, 14 bp, Homo sapiens
ggtgaaagggagct

SEQ ID NO: 3679554 - DNA, 21 bp, Homo sapiens
ggtgagaacctgggttgcaga

SEQ ID NO: 3679555 - DNA, 15 bp, Homo sapiens
ggtgagaagcagagg

SEQ ID NO: 3679556 - DNA, 13 bp, Homo sapiens
ggtgcaaggaaaa

SEQ ID NO: 3679557 - DNA, 22 bp, Homo sapiens
ggtgcagaggtaccctgggtgt

SEQ ID NO: 3679558 - DNA, 22 bp, Homo sapiens
ggtgccatttctgaactgttac

SEQ ID NO: 3679559 - DNA, 18 bp, Homo sapiens
ggtgcccaagccagaggc

SEQ ID NO: 3679560 - DNA, 21 bp, Homo sapiens
ggtgcccaagccagaggctgg

SEQ ID NO: 3679561 - DNA, 13 bp, Homo sapiens
ggtgccccaggac

SEQ ID NO: 3679562 - DNA, 14 bp, Homo sapiens
ggtgccccaggacc

SEQ ID NO: 3679563 - DNA, 15 bp, Homo sapiens
ggtgccccaggacca

SEQ ID NO: 3679564 - DNA, 17 bp, Homo sapiens
ggtgccccaggaccagc

SEQ ID NO: 3679565 - DNA, 22 bp, Homo sapiens
ggtgccccaggaccagctcagg

SEQ ID NO: 3679566 - DNA, 18 bp, Homo sapiens
ggtgcccttggaggccag

SEQ ID NO: 3679567 - DNA, 22 bp, Homo sapiens
ggtgcggggagaagaagcggcc

SEQ ID NO: 3679568 - DNA, 20 bp, Homo sapiens
ggtgctgtgaggcttgccca

SEQ ID NO: 3679569 - DNA, 22 bp, Homo sapiens
ggtgctgtgaggcttgcccagg

SEQ ID NO: 3679570 - DNA, 17 bp, Homo sapiens
ggtggatctccttgaga

SEQ ID NO: 3679571 - DNA, 12 bp, Homo sapiens
ggtggcaagtgc

SEQ ID NO: 3679572 - DNA, 17 bp, Homo sapiens
ggtggccactgagctgg

SEQ ID NO: 3679573 - DNA, 19 bp, Homo sapiens
ggtggccactgagctggct

SEQ ID NO: 3679574 - DNA, 13 bp, Homo sapiens
ggtggctgggctg

SEQ ID NO: 3679575 - DNA, 16 bp, Homo sapiens
ggtggctgggctgctc

SEQ ID NO: 3679576 - DNA, 14 bp, Homo sapiens
ggtgggccaggctg

SEQ ID NO: 3679577 - DNA, 12 bp, Homo sapiens
ggtggggctcct

SEQ ID NO: 3679578 - DNA, 13 bp, Homo sapiens
ggtggggctccta

SEQ ID NO: 3679579 - DNA, 13 bp, Homo sapiens
ggtggggcttctc

SEQ ID NO: 3679580 - DNA, 16 bp, Homo sapiens
ggtgggggagcctctg

SEQ ID NO: 3679581 - DNA, 14 bp, Homo sapiens
ggtggtaaccctgg

SEQ ID NO: 3679582 - DNA, 17 bp, Homo sapiens
ggtggtctgcaggcagg

SEQ ID NO: 3679583 - DNA, 21 bp, Homo sapiens
ggtggtctgttggcaggctgg

SEQ ID NO: 3679584 - DNA, 22 bp, Homo sapiens
ggtggtctgttggcaggctggc

SEQ ID NO: 3679585 - DNA, 14 bp, Homo sapiens
ggtggttctctggg

SEQ ID NO: 3679586 - DNA, 21 bp, Homo sapiens
ggtggttgctgttttcctccc

SEQ ID NO: 3679587 - DNA, 15 bp, Homo sapiens
ggtgtgagccactgc

SEQ ID NO: 3679588 - DNA, 19 bp, Homo sapiens
ggtgtgctgggagctccac

SEQ ID NO: 3679589 - DNA, 22 bp, Homo sapiens
ggtgtgctgggagctccactct

SEQ ID NO: 3679590 - DNA, 22 bp, Homo sapiens
ggtgtggaggctcctgtggtag

SEQ ID NO: 3679591 - DNA, 21 bp, Homo sapiens
ggtgttgccaaatatgtcctg

SEQ ID NO: 3679592 - DNA, 15 bp, Homo sapiens
ggttaaggctgagga

SEQ ID NO: 3679593 - DNA, 15 bp, Homo sapiens
ggttacctcactttt

SEQ ID NO: 3679594 - DNA, 13 bp, Homo sapiens
ggttcatatttat

SEQ ID NO: 3679595 - DNA, 21 bp, Homo sapiens
ggttctaggcatctctgtact

SEQ ID NO: 3679596 - DNA, 19 bp, Homo sapiens
ggttctccgttagctcctg

SEQ ID NO: 3679597 - DNA, 16 bp, Homo sapiens
ggttctgcctgctttg

SEQ ID NO: 3679598 - DNA, 14 bp, Homo sapiens
ggttgcagacagga

SEQ ID NO: 3679599 - DNA, 19 bp, Homo sapiens
ggttgtctgaacccaggca

SEQ ID NO: 3679600 - DNA, 17 bp, Homo sapiens
ggtttaggctggtggcc

SEQ ID NO: 3679601 - DNA, 19 bp, Homo sapiens
ggtttccttaaaattttta

SEQ ID NO: 3679602 - DNA, 15 bp, Homo sapiens
ggtttgaatataaac

SEQ ID NO: 3679603 - DNA, 14 bp, Homo sapiens
ggtttgtgttcttc

SEQ ID NO: 3679604 - DNA, 18 bp, Homo sapiens
ggttttaggtagaaaaac

SEQ ID NO: 3679605 - DNA, 17 bp, Homo sapiens
ggttttataaggctgat

SEQ ID NO: 3679606 - DNA, 12 bp, Homo sapiens
ggttttgagaaa

SEQ ID NO: 3679607 - DNA, 18 bp, Homo sapiens
ggtttttaaattttgtaa

SEQ ID NO: 3679608 - DNA, 23 bp, Homo sapiens
gtaaaaaaaccaccaaaaacaaa

SEQ ID NO: 3679609 - DNA, 14 bp, Homo sapiens
gtaaaacaaaattt

SEQ ID NO: 3679610 - DNA, 19 bp, Homo sapiens
gtaaaatcctacagtgaaa

SEQ ID NO: 3679611 - DNA, 20 bp, Homo sapiens
gtaaacgctgtccctagtaa

SEQ ID NO: 3679612 - DNA, 12 bp, Homo sapiens
gtaaagccatgc

SEQ ID NO: 3679613 - DNA, 20 bp, Homo sapiens
gtaaagctatttatgggccc

SEQ ID NO: 3679614 - DNA, 18 bp, Homo sapiens
gtaaaggaaataagagca

SEQ ID NO: 3679615 - DNA, 21 bp, Homo sapiens
gtaaagtttccgtgcgtggca

SEQ ID NO: 3679616 - DNA, 13 bp, Homo sapiens
gtaaatgatttta

SEQ ID NO: 3679617 - DNA, 22 bp, Homo sapiens
gtaaattattaatttatgcaga

SEQ ID NO: 3679618 - DNA, 21 bp, Homo sapiens
gtaaccctggtggttgctgtt

SEQ ID NO: 3679619 - DNA, 17 bp, Homo sapiens
gtaacgcgtcttcctga

SEQ ID NO: 3679620 - DNA, 23 bp, Homo sapiens
gtaactgtcaggctgaaaacaat

SEQ ID NO: 3679621 - DNA, 20 bp, Homo sapiens
gtaagaaacacactgaggca

SEQ ID NO: 3679622 - DNA, 19 bp, Homo sapiens
gtaagggcgtggctctggg

SEQ ID NO: 3679623 - DNA, 21 bp, Homo sapiens
gtaaggggttggtatctcagg

SEQ ID NO: 3679624 - DNA, 16 bp, Homo sapiens
gtaagtgggcccaccc

SEQ ID NO: 3679625 - DNA, 16 bp, Homo sapiens
gtaataaactgtgttt

SEQ ID NO: 3679626 - DNA, 15 bp, Homo sapiens
gtaataaactttaat

SEQ ID NO: 3679627 - DNA, 18 bp, Homo sapiens
gtaatcatttgtttacat

SEQ ID NO: 3679628 - DNA, 22 bp, Homo sapiens
gtaatctatgaattctaagtga

SEQ ID NO: 3679629 - DNA, 18 bp, Homo sapiens
gtaatgatgtcgtttgaa

SEQ ID NO: 3679630 - DNA, 19 bp, Homo sapiens
gtaatgttttctttgcaaa

SEQ ID NO: 3679631 - DNA, 12 bp, Homo sapiens
gtacaaaaataa

SEQ ID NO: 3679632 - DNA, 14 bp, Homo sapiens
gtacatttctataa

SEQ ID NO: 3679633 - DNA, 21 bp, Homo sapiens
gtacatttctataaatagatg

SEQ ID NO: 3679634 - DNA, 16 bp, Homo sapiens
gtaccaatgggaagca

SEQ ID NO: 3679635 - DNA, 17 bp, Homo sapiens
gtaccagatgcagctca

SEQ ID NO: 3679636 - DNA, 22 bp, Homo sapiens
gtaccttttttgttttttcaaa

SEQ ID NO: 3679637 - DNA, 14 bp, Homo sapiens
gtactagtgttctg

SEQ ID NO: 3679638 - DNA, 21 bp, Homo sapiens
gtactcgcacctcttggcttt

SEQ ID NO: 3679639 - DNA, 18 bp, Homo sapiens
gtactgttactgggccct

SEQ ID NO: 3679640 - DNA, 22 bp, Homo sapiens
gtagaacacaaggtcatttgct

SEQ ID NO: 3679641 - DNA, 19 bp, Homo sapiens
gtagaccttgttacttctg

SEQ ID NO: 3679642 - DNA, 20 bp, Homo sapiens
gtagaccttgttacttctga

SEQ ID NO: 3679643 - DNA, 15 bp, Homo sapiens
gtagagtgggagctg

SEQ ID NO: 3679644 - DNA, 14 bp, Homo sapiens
gtagatgagaaaac

SEQ ID NO: 3679645 - DNA, 20 bp, Homo sapiens
gtagattaggtcttgctgga

SEQ ID NO: 3679646 - DNA, 19 bp, Homo sapiens
gtagcagggtcgggaaagg

SEQ ID NO: 3679647 - DNA, 13 bp, Homo sapiens
gtagccacaccag

SEQ ID NO: 3679648 - DNA, 17 bp, Homo sapiens
gtagctctcaaatgtgt

SEQ ID NO: 3679649 - DNA, 12 bp, Homo sapiens
gtagctgcccct

SEQ ID NO: 3679650 - DNA, 16 bp, Homo sapiens
gtagctgcccctggct

SEQ ID NO: 3679651 - DNA, 21 bp, Homo sapiens
gtagctgggattacaggtgtg

SEQ ID NO: 3679652 - DNA, 16 bp, Homo sapiens
gtaggctgctccctga

SEQ ID NO: 3679653 - DNA, 15 bp, Homo sapiens
gtaggcttctacctg

SEQ ID NO: 3679654 - DNA, 13 bp, Homo sapiens
gtagggagggcgg

SEQ ID NO: 3679655 - DNA, 12 bp, Homo sapiens
gtagggctgact

SEQ ID NO: 3679656 - DNA, 19 bp, Homo sapiens
gtagggtttgacatttcat

SEQ ID NO: 3679657 - DNA, 19 bp, Homo sapiens
gtaggttccgtatctccct

SEQ ID NO: 3679658 - DNA, 23 bp, Homo sapiens
gtagtccgtgctgacagctgctc

SEQ ID NO: 3679659 - DNA, 17 bp, Homo sapiens
gtagttatataattgtt

SEQ ID NO: 3679660 - DNA, 12 bp, Homo sapiens
gtataatatttt

SEQ ID NO: 3679661 - DNA, 18 bp, Homo sapiens
gtatagcatgcatctgtt

SEQ ID NO: 3679662 - DNA, 19 bp, Homo sapiens
gtatatacttaagaataca

SEQ ID NO: 3679663 - DNA, 19 bp, Homo sapiens
gtatatggtatatatacat

SEQ ID NO: 3679664 - DNA, 15 bp, Homo sapiens
gtatattatcctaag

SEQ ID NO: 3679665 - DNA, 14 bp, Homo sapiens
gtatcacttttctg

SEQ ID NO: 3679666 - DNA, 22 bp, Homo sapiens
gtatcctcatttggggtagcta

SEQ ID NO: 3679667 - DNA, 16 bp, Homo sapiens
gtatctcaggtctgaa

SEQ ID NO: 3679668 - DNA, 18 bp, Homo sapiens
gtatctccctggagaagc

SEQ ID NO: 3679669 - DNA, 19 bp, Homo sapiens
gtatctgggtaagaagaaa

SEQ ID NO: 3679670 - DNA, 17 bp, Homo sapiens
gtatggaagttttccta

SEQ ID NO: 3679671 - DNA, 18 bp, Homo sapiens
gtatggactatctgtctg

SEQ ID NO: 3679672 - DNA, 17 bp, Homo sapiens
gtatgtaggagctgcag

SEQ ID NO: 3679673 - DNA, 21 bp, Homo sapiens
gtatgttgactttttaaaatt

SEQ ID NO: 3679674 - DNA, 22 bp, Homo sapiens
gtattagctgtattatccattt

SEQ ID NO: 3679675 - DNA, 19 bp, Homo sapiens
gtattcccattagaccaag

SEQ ID NO: 3679676 - DNA, 17 bp, Homo sapiens
gtattgggcagcagact

SEQ ID NO: 3679677 - DNA, 13 bp, Homo sapiens
gtattgtaaatta

SEQ ID NO: 3679678 - DNA, 12 bp, Homo sapiens
gtatttgctttt

SEQ ID NO: 3679679 - DNA, 15 bp, Homo sapiens
gtcaaacgtgaaaat

SEQ ID NO: 3679680 - DNA, 21 bp, Homo sapiens
gtcaagctcctcctccctgca

SEQ ID NO: 3679681 - DNA, 16 bp, Homo sapiens
gtcaagtgaaaaagga

SEQ ID NO: 3679682 - DNA, 20 bp, Homo sapiens
gtcaatacagtacaggcagc

SEQ ID NO: 3679683 - DNA, 18 bp, Homo sapiens
gtcaatcaagtctgttta

SEQ ID NO: 3679684 - DNA, 11 bp, Homo sapiens
gtcacaaagag

SEQ ID NO: 3679685 - DNA, 19 bp, Homo sapiens
gtcacacaaaggcatgctg

SEQ ID NO: 3679686 - DNA, 21 bp, Homo sapiens
gtcacacaaaggcatgctgga

SEQ ID NO: 3679687 - DNA, 16 bp, Homo sapiens
gtcaccggatcctggg

SEQ ID NO: 3679688 - DNA, 23 bp, Homo sapiens
gtcaccggatcctgggtggtctg

SEQ ID NO: 3679689 - DNA, 16 bp, Homo sapiens
gtcacctagcaagctg

SEQ ID NO: 3679690 - DNA, 13 bp, Homo sapiens
gtcagagccactc

SEQ ID NO: 3679691 - DNA, 13 bp, Homo sapiens
gtcagagtgccac

SEQ ID NO: 3679692 - DNA, 15 bp, Homo sapiens
gtcagagtgccactg

SEQ ID NO: 3679693 - DNA, 12 bp, Homo sapiens
gtcagctccagc

SEQ ID NO: 3679694 - DNA, 17 bp, Homo sapiens
gtcaggtactcctgcca

SEQ ID NO: 3679695 - DNA, 23 bp, Homo sapiens
gtcagtgctgtgctgtgctatgg

SEQ ID NO: 3679696 - DNA, 18 bp, Homo sapiens
gtcagtttttttttgtat

SEQ ID NO: 3679697 - DNA, 21 bp, Homo sapiens
gtcatatggaaaaaatgtatg

SEQ ID NO: 3679698 - DNA, 23 bp, Homo sapiens
gtcatctagcgcaattgaaggat

SEQ ID NO: 3679699 - DNA, 17 bp, Homo sapiens
gtcatctgattggacag

SEQ ID NO: 3679700 - DNA, 19 bp, Homo sapiens
gtcatctgattggacaggc

SEQ ID NO: 3679701 - DNA, 18 bp, Homo sapiens
gtcatgccctcctctccc

SEQ ID NO: 3679702 - DNA, 22 bp, Homo sapiens
gtcatggagaaccacctacccc

SEQ ID NO: 3679703 - DNA, 16 bp, Homo sapiens
gtccaaaggaggctgg

SEQ ID NO: 3679704 - DNA, 22 bp, Homo sapiens
gtccaaatgtcctccagaagcc

SEQ ID NO: 3679705 - DNA, 22 bp, Homo sapiens
gtccacaagaaggggtgtttat

SEQ ID NO: 3679706 - DNA, 13 bp, Homo sapiens
gtccacagcccct

SEQ ID NO: 3679707 - DNA, 16 bp, Homo sapiens
gtccaccctgcctgcc

SEQ ID NO: 3679708 - DNA, 19 bp, Homo sapiens
gtccagcaccttgtgcctg

SEQ ID NO: 3679709 - DNA, 22 bp, Homo sapiens
gtccagccgccattgccaccag

SEQ ID NO: 3679710 - DNA, 13 bp, Homo sapiens
gtccagcctgggc

SEQ ID NO: 3679711 - DNA, 16 bp, Homo sapiens
gtccagctctggaggg

SEQ ID NO: 3679712 - DNA, 14 bp, Homo sapiens
gtccagctctgtgg

SEQ ID NO: 3679713 - DNA, 20 bp, Homo sapiens
gtccaggctgccgtggggcc

SEQ ID NO: 3679714 - DNA, 18 bp, Homo sapiens
gtccagggctagtgactt

SEQ ID NO: 3679715 - DNA, 18 bp, Homo sapiens
gtcccacagccctgagat

SEQ ID NO: 3679716 - DNA, 14 bp, Homo sapiens
gtcccagccacccc

SEQ ID NO: 3679717 - DNA, 12 bp, Homo sapiens
gtcccagtgccg

SEQ ID NO: 3679718 - DNA, 17 bp, Homo sapiens
gtcccatccagctacca

SEQ ID NO: 3679719 - DNA, 20 bp, Homo sapiens
gtccccaggccccaggaagc

SEQ ID NO: 3679720 - DNA, 13 bp, Homo sapiens
gtccccccaccct

SEQ ID NO: 3679721 - DNA, 22 bp, Homo sapiens
gtccccccaccctcattctact

SEQ ID NO: 3679722 - DNA, 15 bp, Homo sapiens
gtccctagcagccca

SEQ ID NO: 3679723 - DNA, 21 bp, Homo sapiens
gtccctagcagcccaccctgc

SEQ ID NO: 3679724 - DNA, 12 bp, Homo sapiens
gtcccttcccct

SEQ ID NO: 3679725 - DNA, 14 bp, Homo sapiens
gtcccttcccctcc

SEQ ID NO: 3679726 - DNA, 22 bp, Homo sapiens
gtcccttgcttgcctgcagggc

SEQ ID NO: 3679727 - DNA, 18 bp, Homo sapiens
gtccgctttcctggagcc

SEQ ID NO: 3679728 - DNA, 15 bp, Homo sapiens
gtccgtgctgacagc

SEQ ID NO: 3679729 - DNA, 20 bp, Homo sapiens
gtccgtgctgacagctgctc

SEQ ID NO: 3679730 - DNA, 14 bp, Homo sapiens
gtcctccagaagcc

SEQ ID NO: 3679731 - DNA, 19 bp, Homo sapiens
gtcctccagaagcctctgg

SEQ ID NO: 3679732 - DNA, 20 bp, Homo sapiens
gtcctccagaagcctctggc

SEQ ID NO: 3679733 - DNA, 13 bp, Homo sapiens
gtcctcccaagct

SEQ ID NO: 3679734 - DNA, 17 bp, Homo sapiens
gtcctctgtggccagct

SEQ ID NO: 3679735 - DNA, 14 bp, Homo sapiens
gtcctgcctgtggc

SEQ ID NO: 3679736 - DNA, 17 bp, Homo sapiens
gtcctggccatcccaca

SEQ ID NO: 3679737 - DNA, 19 bp, Homo sapiens
gtcctggctcctgaggggc

SEQ ID NO: 3679738 - DNA, 17 bp, Homo sapiens
gtcctggttgtctgaac

SEQ ID NO: 3679739 - DNA, 20 bp, Homo sapiens
gtcctggttgtctgaaccca

SEQ ID NO: 3679740 - DNA, 21 bp, Homo sapiens
gtcctggttgtctgaacccag

SEQ ID NO: 3679741 - DNA, 18 bp, Homo sapiens
gtcctttgcgcctgtgac

SEQ ID NO: 3679742 - DNA, 19 bp, Homo sapiens
gtcgagctgggaaggttcc

SEQ ID NO: 3679743 - DNA, 12 bp, Homo sapiens
gtcgaggcagga

SEQ ID NO: 3679744 - DNA, 17 bp, Homo sapiens
gtcggctgaccatgctc

SEQ ID NO: 3679745 - DNA, 18 bp, Homo sapiens
gtcggctgaccatgctca

SEQ ID NO: 3679746 - DNA, 18 bp, Homo sapiens
gtcgggcaccagccagcg

SEQ ID NO: 3679747 - DNA, 21 bp, Homo sapiens
gtctaatctagatatcgactt

SEQ ID NO: 3679748 - DNA, 12 bp, Homo sapiens
gtctacatttct

SEQ ID NO: 3679749 - DNA, 13 bp, Homo sapiens
gtctagagaggga

SEQ ID NO: 3679750 - DNA, 16 bp, Homo sapiens
gtctagagagggaggc

SEQ ID NO: 3679751 - DNA, 15 bp, Homo sapiens
gtctagatggctcct

SEQ ID NO: 3679752 - DNA, 17 bp, Homo sapiens
gtctagatggctcctct

SEQ ID NO: 3679753 - DNA, 21 bp, Homo sapiens
gtctagatggctcctctcagt

SEQ ID NO: 3679754 - DNA, 11 bp, Homo sapiens
gtctcagaaga

SEQ ID NO: 3679755 - DNA, 13 bp, Homo sapiens
gtctcagaagagg

SEQ ID NO: 3679756 - DNA, 16 bp, Homo sapiens
gtctccaggggctgct

SEQ ID NO: 3679757 - DNA, 19 bp, Homo sapiens
gtctccaggggctgcttcc

SEQ ID NO: 3679758 - DNA, 23 bp, Homo sapiens
gtctccaggggctgcttcctcct

SEQ ID NO: 3679759 - DNA, 22 bp, Homo sapiens
gtctcctatatatttctattat

SEQ ID NO: 3679760 - DNA, 12 bp, Homo sapiens
gtctctagagca

SEQ ID NO: 3679761 - DNA, 17 bp, Homo sapiens
gtctctgctctgctcag

SEQ ID NO: 3679762 - DNA, 21 bp, Homo sapiens
gtctcttcttggggcccagtg

SEQ ID NO: 3679763 - DNA, 23 bp, Homo sapiens
gtctcttcttggggcccagtgca

SEQ ID NO: 3679764 - DNA, 13 bp, Homo sapiens
gtctgaacccagg

SEQ ID NO: 3679765 - DNA, 14 bp, Homo sapiens
gtctgaacccaggc

SEQ ID NO: 3679766 - DNA, 15 bp, Homo sapiens
gtctgaacccaggca

SEQ ID NO: 3679767 - DNA, 18 bp, Homo sapiens
gtctgaacccaggcagct

SEQ ID NO: 3679768 - DNA, 23 bp, Homo sapiens
gtctgaacccaggcagctggcag

SEQ ID NO: 3679769 - DNA, 14 bp, Homo sapiens
gtctgaagcagatg

SEQ ID NO: 3679770 - DNA, 14 bp, Homo sapiens
gtctgaccccagcc

SEQ ID NO: 3679771 - DNA, 19 bp, Homo sapiens
gtctgaccccagcccagac

SEQ ID NO: 3679772 - DNA, 12 bp, Homo sapiens
gtctgcaggcag

SEQ ID NO: 3679773 - DNA, 13 bp, Homo sapiens
gtctgcaggcagg

SEQ ID NO: 3679774 - DNA, 20 bp, Homo sapiens
gtctgcatttcggtggctag

SEQ ID NO: 3679775 - DNA, 17 bp, Homo sapiens
gtctgctctttctctgc

SEQ ID NO: 3679776 - DNA, 20 bp, Homo sapiens
gtctgctgatcaaaagcatt

SEQ ID NO: 3679777 - DNA, 15 bp, Homo sapiens
gtctggcttcacaga

SEQ ID NO: 3679778 - DNA, 22 bp, Homo sapiens
gtctgggcagctgtcccttgct

SEQ ID NO: 3679779 - DNA, 22 bp, Homo sapiens
gtctgtagtgtcactcaaggcg

SEQ ID NO: 3679780 - DNA, 23 bp, Homo sapiens
gtctgtatagtctagactttaaa

SEQ ID NO: 3679781 - DNA, 16 bp, Homo sapiens
gtctgtcgtgatgggg

SEQ ID NO: 3679782 - DNA, 16 bp, Homo sapiens
gtctgtctacatttct

SEQ ID NO: 3679783 - DNA, 21 bp, Homo sapiens
gtctgtctacatttctgcaga

SEQ ID NO: 3679784 - DNA, 21 bp, Homo sapiens
gtctgttggcaggctggccag

SEQ ID NO: 3679785 - DNA, 21 bp, Homo sapiens
gtcttaaaaagtggaaaaata

SEQ ID NO: 3679786 - DNA, 16 bp, Homo sapiens
gtcttcagtaagccgt

SEQ ID NO: 3679787 - DNA, 16 bp, Homo sapiens
gtcttccctacctcag

SEQ ID NO: 3679788 - DNA, 17 bp, Homo sapiens
gtcttctttgcccacaa

SEQ ID NO: 3679789 - DNA, 20 bp, Homo sapiens
gtcttctttgcccacaatgc

SEQ ID NO: 3679790 - DNA, 17 bp, Homo sapiens
gtctttaaatgctgctt

SEQ ID NO: 3679791 - DNA, 22 bp, Homo sapiens
gtctttcagtacttttttaaat

SEQ ID NO: 3679792 - DNA, 20 bp, Homo sapiens
gtctttcccatggggaggga

SEQ ID NO: 3679793 - DNA, 13 bp, Homo sapiens
gtcttttaaaatg

SEQ ID NO: 3679794 - DNA, 15 bp, Homo sapiens
gtcttttttttcctg

SEQ ID NO: 3679795 - DNA, 16 bp, Homo sapiens
gtgaactgcagtgatg

SEQ ID NO: 3679796 - DNA, 17 bp, Homo sapiens
gtgaactggaagaaagc

SEQ ID NO: 3679797 - DNA, 14 bp, Homo sapiens
gtgaagacagaagt

SEQ ID NO: 3679798 - DNA, 15 bp, Homo sapiens
gtgaaggctctcaga

SEQ ID NO: 3679799 - DNA, 15 bp, Homo sapiens
gtgaatgctgggact

SEQ ID NO: 3679800 - DNA, 16 bp, Homo sapiens
gtgacaattctgtttt

SEQ ID NO: 3679801 - DNA, 19 bp, Homo sapiens
gtgacaattctgtttttaa

SEQ ID NO: 3679802 - DNA, 14 bp, Homo sapiens
gtgacacaaacaca

SEQ ID NO: 3679803 - DNA, 18 bp, Homo sapiens
gtgacacccaagagggct

SEQ ID NO: 3679804 - DNA, 23 bp, Homo sapiens
gtgacacccagagggagtagaat

SEQ ID NO: 3679805 - DNA, 21 bp, Homo sapiens
gtgaccggacttttctgcaaa

SEQ ID NO: 3679806 - DNA, 17 bp, Homo sapiens
gtgactaatggcatgag

SEQ ID NO: 3679807 - DNA, 17 bp, Homo sapiens
gtgacttgtgtcccatg

SEQ ID NO: 3679808 - DNA, 23 bp, Homo sapiens
gtgacttgtgtcccatgatccct

SEQ ID NO: 3679809 - DNA, 14 bp, Homo sapiens
gtgagaaaaatgta

SEQ ID NO: 3679810 - DNA, 22 bp, Homo sapiens
gtgagaacctgggttgcagaca

SEQ ID NO: 3679811 - DNA, 21 bp, Homo sapiens
gtgagaagtgaatgctgggac

SEQ ID NO: 3679812 - DNA, 17 bp, Homo sapiens
gtgagacccccacacct

SEQ ID NO: 3679813 - DNA, 16 bp, Homo sapiens
gtgagaggaagggtgg

SEQ ID NO: 3679814 - DNA, 14 bp, Homo sapiens
gtgaggagctgctg

SEQ ID NO: 3679815 - DNA, 18 bp, Homo sapiens
gtgaggagctgctggctt

SEQ ID NO: 3679816 - DNA, 13 bp, Homo sapiens
gtgaggagctggg

SEQ ID NO: 3679817 - DNA, 17 bp, Homo sapiens
gtgaggccggagaggag

SEQ ID NO: 3679818 - DNA, 16 bp, Homo sapiens
gtgaggctgtcctgta

SEQ ID NO: 3679819 - DNA, 16 bp, Homo sapiens
gtgaggcttgcccagg

SEQ ID NO: 3679820 - DNA, 22 bp, Homo sapiens
gtgatgctaaaggttgtattgc

SEQ ID NO: 3679821 - DNA, 13 bp, Homo sapiens
gtgatgtatacat

SEQ ID NO: 3679822 - DNA, 19 bp, Homo sapiens
gtgatttcagactgcagag

SEQ ID NO: 3679823 - DNA, 12 bp, Homo sapiens
gtgattttcatt

SEQ ID NO: 3679824 - DNA, 19 bp, Homo sapiens
gtgcaataaatctgaccca

SEQ ID NO: 3679825 - DNA, 18 bp, Homo sapiens
gtgcacgtggagagctgg

SEQ ID NO: 3679826 - DNA, 13 bp, Homo sapiens
gtgcactttgtaa

SEQ ID NO: 3679827 - DNA, 15 bp, Homo sapiens
gtgcatggtggccag

SEQ ID NO: 3679828 - DNA, 16 bp, Homo sapiens
gtgcatggtggccaga

SEQ ID NO: 3679829 - DNA, 16 bp, Homo sapiens
gtgccaacttcccctc

SEQ ID NO: 3679830 - DNA, 22 bp, Homo sapiens
gtgccaccccttcctcagcctg

SEQ ID NO: 3679831 - DNA, 23 bp, Homo sapiens
gtgccaccccttcctcagcctgg

SEQ ID NO: 3679832 - DNA, 12 bp, Homo sapiens
gtgcccaagcca

SEQ ID NO: 3679833 - DNA, 19 bp, Homo sapiens
gtgcccccactgaccagaa

SEQ ID NO: 3679834 - DNA, 20 bp, Homo sapiens
gtgcccttcctgctgcgcag

SEQ ID NO: 3679835 - DNA, 16 bp, Homo sapiens
gtgcccttggaggcca

SEQ ID NO: 3679836 - DNA, 14 bp, Homo sapiens
gtgccgagccagca

SEQ ID NO: 3679837 - DNA, 13 bp, Homo sapiens
gtgccgtggcacc

SEQ ID NO: 3679838 - DNA, 14 bp, Homo sapiens
gtgccgtggcacca

SEQ ID NO: 3679839 - DNA, 16 bp, Homo sapiens
gtgcctagactgttac

SEQ ID NO: 3679840 - DNA, 18 bp, Homo sapiens
gtgcctagactgttactt

SEQ ID NO: 3679841 - DNA, 15 bp, Homo sapiens
gtgcctcgcatccta

SEQ ID NO: 3679842 - DNA, 18 bp, Homo sapiens
gtgctactccatgcaggg

SEQ ID NO: 3679843 - DNA, 16 bp, Homo sapiens
gtgctatggtgctctg

SEQ ID NO: 3679844 - DNA, 18 bp, Homo sapiens
gtgctccatggctgccat

SEQ ID NO: 3679845 - DNA, 22 bp, Homo sapiens
gtgctccatggctgccatctca

SEQ ID NO: 3679846 - DNA, 15 bp, Homo sapiens
gtgctccctaccacc

SEQ ID NO: 3679847 - DNA, 21 bp, Homo sapiens
gtgctgaacagtggaggaaga

SEQ ID NO: 3679848 - DNA, 16 bp, Homo sapiens
gtgctgacagctgctc

SEQ ID NO: 3679849 - DNA, 17 bp, Homo sapiens
gtgctgacagctgctcc

SEQ ID NO: 3679850 - DNA, 15 bp, Homo sapiens
gtgctgacggccagg

SEQ ID NO: 3679851 - DNA, 16 bp, Homo sapiens
gtgctgacggccaggg

SEQ ID NO: 3679852 - DNA, 23 bp, Homo sapiens
gtgctgggagctccactctgctt

SEQ ID NO: 3679853 - DNA, 14 bp, Homo sapiens
gtgctgttgaagat

SEQ ID NO: 3679854 - DNA, 21 bp, Homo sapiens
gtgcttgtttgctcacctggg

SEQ ID NO: 3679855 - DNA, 17 bp, Homo sapiens
gtggaagacacttgctg

SEQ ID NO: 3679856 - DNA, 20 bp, Homo sapiens
gtggacaatgagtggaatac

SEQ ID NO: 3679857 - DNA, 12 bp, Homo sapiens
gtggagagctgg

SEQ ID NO: 3679858 - DNA, 14 bp, Homo sapiens
gtggagagctggtg

SEQ ID NO: 3679859 - DNA, 17 bp, Homo sapiens
gtggagagctggtgccc

SEQ ID NO: 3679860 - DNA, 19 bp, Homo sapiens
gtggagcaggactcccacc

SEQ ID NO: 3679861 - DNA, 16 bp, Homo sapiens
gtggaggagctcagga

SEQ ID NO: 3679862 - DNA, 20 bp, Homo sapiens
gtggaggagctcaggacact

SEQ ID NO: 3679863 - DNA, 21 bp, Homo sapiens
gtggaggttaaggctgaggaa

SEQ ID NO: 3679864 - DNA, 22 bp, Homo sapiens
gtggaggttaaggctgaggaaa

SEQ ID NO: 3679865 - DNA, 22 bp, Homo sapiens
gtggatgaggcttcttcctgga

SEQ ID NO: 3679866 - DNA, 13 bp, Homo sapiens
gtggatggcccca

SEQ ID NO: 3679867 - DNA, 22 bp, Homo sapiens
gtggcaaagccttcattgcctt

SEQ ID NO: 3679868 - DNA, 16 bp, Homo sapiens
gtggcaatctgtgggc

SEQ ID NO: 3679869 - DNA, 14 bp, Homo sapiens
gtggcaccagcagc

SEQ ID NO: 3679870 - DNA, 19 bp, Homo sapiens
gtggcaccagcagcctgga

SEQ ID NO: 3679871 - DNA, 22 bp, Homo sapiens
gtggcatcaccttaggcaggga

SEQ ID NO: 3679872 - DNA, 15 bp, Homo sapiens
gtggccaaggagctg

SEQ ID NO: 3679873 - DNA, 17 bp, Homo sapiens
gtggccactgagctggc

SEQ ID NO: 3679874 - DNA, 21 bp, Homo sapiens
gtggccactgagctggctgac

SEQ ID NO: 3679875 - DNA, 13 bp, Homo sapiens
gtggcccaggacc

SEQ ID NO: 3679876 - DNA, 23 bp, Homo sapiens
gtggccccgtttctggtggtctg

SEQ ID NO: 3679877 - DNA, 13 bp, Homo sapiens
gtggcctcagaat

SEQ ID NO: 3679878 - DNA, 20 bp, Homo sapiens
gtggcctgcataggctcctt

SEQ ID NO: 3679879 - DNA, 13 bp, Homo sapiens
gtggcctggccag

SEQ ID NO: 3679880 - DNA, 13 bp, Homo sapiens
gtggcctgtggct

SEQ ID NO: 3679881 - DNA, 21 bp, Homo sapiens
gtggcgccgtctccaggggct

SEQ ID NO: 3679882 - DNA, 18 bp, Homo sapiens
gtggcgtgggagccagcc

SEQ ID NO: 3679883 - DNA, 18 bp, Homo sapiens
gtggctagtcaagctcct

SEQ ID NO: 3679884 - DNA, 21 bp, Homo sapiens
gtggctagtcaagctcctcct

SEQ ID NO: 3679885 - DNA, 14 bp, Homo sapiens
gtggctcacgcctg

SEQ ID NO: 3679886 - DNA, 13 bp, Homo sapiens
gtggctctgggtg

SEQ ID NO: 3679887 - DNA, 14 bp, Homo sapiens
gtggctctgggtgg

SEQ ID NO: 3679888 - DNA, 15 bp, Homo sapiens
gtggctgagcccctg

SEQ ID NO: 3679889 - DNA, 15 bp, Homo sapiens
gtggctggtccaggg

SEQ ID NO: 3679890 - DNA, 21 bp, Homo sapiens
gtggctgttgacgcacctgtg

SEQ ID NO: 3679891 - DNA, 18 bp, Homo sapiens
gtgggacagggcttctcc

SEQ ID NO: 3679892 - DNA, 17 bp, Homo sapiens
gtgggactcttccctgg

SEQ ID NO: 3679893 - DNA, 15 bp, Homo sapiens
gtgggagtcatctca

SEQ ID NO: 3679894 - DNA, 20 bp, Homo sapiens
gtgggcattgatggggaagg

SEQ ID NO: 3679895 - DNA, 13 bp, Homo sapiens
gtgggccagtcct

SEQ ID NO: 3679896 - DNA, 15 bp, Homo sapiens
gtgggccagtcctgg

SEQ ID NO: 3679897 - DNA, 18 bp, Homo sapiens
gtgggccagtcctggttg

SEQ ID NO: 3679898 - DNA, 18 bp, Homo sapiens
gtgggccagtctgtggat

SEQ ID NO: 3679899 - DNA, 12 bp, Homo sapiens
gtgggcccaccc

SEQ ID NO: 3679900 - DNA, 13 bp, Homo sapiens
gtgggccctaccc

SEQ ID NO: 3679901 - DNA, 16 bp, Homo sapiens
gtgggccctaccctcc

SEQ ID NO: 3679902 - DNA, 23 bp, Homo sapiens
gtgggccctaccctcctgctgag

SEQ ID NO: 3679903 - DNA, 16 bp, Homo sapiens
gtgggctacatgctgg

SEQ ID NO: 3679904 - DNA, 12 bp, Homo sapiens
gtggggctccta

SEQ ID NO: 3679905 - DNA, 15 bp, Homo sapiens
gtggggctcctacct

SEQ ID NO: 3679906 - DNA, 17 bp, Homo sapiens
gtggggctcctacctgg

SEQ ID NO: 3679907 - DNA, 22 bp, Homo sapiens
gtggggctcctacctgggggca

SEQ ID NO: 3679908 - DNA, 16 bp, Homo sapiens
gtggggcttctctggg

SEQ ID NO: 3679909 - DNA, 12 bp, Homo sapiens
gtggggcttggg

SEQ ID NO: 3679910 - DNA, 19 bp, Homo sapiens
gtggggtgtgctgggagct

SEQ ID NO: 3679911 - DNA, 13 bp, Homo sapiens
gtggtctgttggc

SEQ ID NO: 3679912 - DNA, 17 bp, Homo sapiens
gtggtctgttggcaggc

SEQ ID NO: 3679913 - DNA, 14 bp, Homo sapiens
gtggttgaagagca

SEQ ID NO: 3679914 - DNA, 14 bp, Homo sapiens
gtgtaatatgaaat

SEQ ID NO: 3679915 - DNA, 16 bp, Homo sapiens
gtgtcaagacatttct

SEQ ID NO: 3679916 - DNA, 15 bp, Homo sapiens
gtgtcactcaaggcg

SEQ ID NO: 3679917 - DNA, 22 bp, Homo sapiens
gtgtcactcaaggcggtgcttg

SEQ ID NO: 3679918 - DNA, 16 bp, Homo sapiens
gtgtcagcatagaagt

SEQ ID NO: 3679919 - DNA, 19 bp, Homo sapiens
gtgtccatgcgctcagggc

SEQ ID NO: 3679920 - DNA, 20 bp, Homo sapiens
gtgtcccctcacgcaagtgc

SEQ ID NO: 3679921 - DNA, 14 bp, Homo sapiens
gtgtccggtccctg

SEQ ID NO: 3679922 - DNA, 16 bp, Homo sapiens
gtgtcctctccctgcc

SEQ ID NO: 3679923 - DNA, 16 bp, Homo sapiens
gtgtctccccgtgtcc

SEQ ID NO: 3679924 - DNA, 16 bp, Homo sapiens
gtgtctgagcccaacc

SEQ ID NO: 3679925 - DNA, 19 bp, Homo sapiens
gtgtctttaaatgctgctt

SEQ ID NO: 3679926 - DNA, 14 bp, Homo sapiens
gtgtcttttgacat

SEQ ID NO: 3679927 - DNA, 17 bp, Homo sapiens
gtgtgactactccccca

SEQ ID NO: 3679928 - DNA, 12 bp, Homo sapiens
gtgtgctgggag

SEQ ID NO: 3679929 - DNA, 17 bp, Homo sapiens
gtgtgggtacctgtatt

SEQ ID NO: 3679930 - DNA, 14 bp, Homo sapiens
gtgtgtcccaggca

SEQ ID NO: 3679931 - DNA, 17 bp, Homo sapiens
gtgtgttcctgcttttc

SEQ ID NO: 3679932 - DNA, 13 bp, Homo sapiens
gtgttatgtattt

SEQ ID NO: 3679933 - DNA, 14 bp, Homo sapiens
gtgttgtcccttct

SEQ ID NO: 3679934 - DNA, 15 bp, Homo sapiens
gtgtttattcttcca

SEQ ID NO: 3679935 - DNA, 21 bp, Homo sapiens
gtgtttcgtgaactgcagtga

SEQ ID NO: 3679936 - DNA, 12 bp, Homo sapiens
gttaaagatgca

SEQ ID NO: 3679937 - DNA, 20 bp, Homo sapiens
gttaacacaatgtgaatttc

SEQ ID NO: 3679938 - DNA, 15 bp, Homo sapiens
gttaacttggtcaga

SEQ ID NO: 3679939 - DNA, 16 bp, Homo sapiens
gttaacttggtcagag

SEQ ID NO: 3679940 - DNA, 13 bp, Homo sapiens
gttaagacaacag

SEQ ID NO: 3679941 - DNA, 13 bp, Homo sapiens
gttaagacctggc

SEQ ID NO: 3679942 - DNA, 22 bp, Homo sapiens
gttaagttgatggtgatgaaat

SEQ ID NO: 3679943 - DNA, 14 bp, Homo sapiens
gttaagttttcttg

SEQ ID NO: 3679944 - DNA, 21 bp, Homo sapiens
gttaccatgggtgtggatggc

SEQ ID NO: 3679945 - DNA, 22 bp, Homo sapiens
gttaccatgggtgtggatggca

SEQ ID NO: 3679946 - DNA, 21 bp, Homo sapiens
gttaccatttttctggattta

SEQ ID NO: 3679947 - DNA, 12 bp, Homo sapiens
gttactttggca

SEQ ID NO: 3679948 - DNA, 12 bp, Homo sapiens
gttagctcctgt

SEQ ID NO: 3679949 - DNA, 20 bp, Homo sapiens
gttagctcctgtggccccac

SEQ ID NO: 3679950 - DNA, 13 bp, Homo sapiens
gttagggaatggc

SEQ ID NO: 3679951 - DNA, 13 bp, Homo sapiens
gttagtggcaccg

SEQ ID NO: 3679952 - DNA, 20 bp, Homo sapiens
gttatagaatagcctgaggt

SEQ ID NO: 3679953 - DNA, 17 bp, Homo sapiens
gttatattatttacatt

SEQ ID NO: 3679954 - DNA, 15 bp, Homo sapiens
gttatatttcagatg

SEQ ID NO: 3679955 - DNA, 21 bp, Homo sapiens
gttatatttcagatgtaatgt

SEQ ID NO: 3679956 - DNA, 20 bp, Homo sapiens
gttatcttatactgtacaat

SEQ ID NO: 3679957 - DNA, 17 bp, Homo sapiens
gttatgtactagtgttc

SEQ ID NO: 3679958 - DNA, 12 bp, Homo sapiens
gttatgtatttc

SEQ ID NO: 3679959 - DNA, 14 bp, Homo sapiens
gttatgttttacat

SEQ ID NO: 3679960 - DNA, 13 bp, Homo sapiens
gttattagatgtt

SEQ ID NO: 3679961 - DNA, 14 bp, Homo sapiens
gttattgttttgtt

SEQ ID NO: 3679962 - DNA, 15 bp, Homo sapiens
gttcaacccacagct

SEQ ID NO: 3679963 - DNA, 14 bp, Homo sapiens
gttcaacttattaa

SEQ ID NO: 3679964 - DNA, 19 bp, Homo sapiens
gttcagataattgaataag

SEQ ID NO: 3679965 - DNA, 18 bp, Homo sapiens
gttcagcactgtcccttg

SEQ ID NO: 3679966 - DNA, 12 bp, Homo sapiens
gttcagccaagg

SEQ ID NO: 3679967 - DNA, 20 bp, Homo sapiens
gttcagcggttgaggagaat

SEQ ID NO: 3679968 - DNA, 19 bp, Homo sapiens
gttcaggaacccttctcca

SEQ ID NO: 3679969 - DNA, 20 bp, Homo sapiens
gttcaggggactcagccctg

SEQ ID NO: 3679970 - DNA, 13 bp, Homo sapiens
gttcaggtagctg

SEQ ID NO: 3679971 - DNA, 13 bp, Homo sapiens
gttcatagcccag

SEQ ID NO: 3679972 - DNA, 13 bp, Homo sapiens
gttcatttgtgta

SEQ ID NO: 3679973 - DNA, 16 bp, Homo sapiens
gttccagctctttgaa

SEQ ID NO: 3679974 - DNA, 17 bp, Homo sapiens
gttccagggtccctctg

SEQ ID NO: 3679975 - DNA, 20 bp, Homo sapiens
gttccccactgtatctaggc

SEQ ID NO: 3679976 - DNA, 12 bp, Homo sapiens
gttccccagaga

SEQ ID NO: 3679977 - DNA, 12 bp, Homo sapiens
gttcccttggcc

SEQ ID NO: 3679978 - DNA, 15 bp, Homo sapiens
gttcccttggcctca

SEQ ID NO: 3679979 - DNA, 18 bp, Homo sapiens
gttcccttggcctcagaa

SEQ ID NO: 3679980 - DNA, 19 bp, Homo sapiens
gttcccttggcctcagaat

SEQ ID NO: 3679981 - DNA, 15 bp, Homo sapiens
gttctatgcttcctc

SEQ ID NO: 3679982 - DNA, 22 bp, Homo sapiens
gttctatgcttcctcgtgccaa

SEQ ID NO: 3679983 - DNA, 18 bp, Homo sapiens
gttctccgttagctcctg

SEQ ID NO: 3679984 - DNA, 13 bp, Homo sapiens
gttctgcctgcca

SEQ ID NO: 3679985 - DNA, 19 bp, Homo sapiens
gttctgcctgccagctgca

SEQ ID NO: 3679986 - DNA, 22 bp, Homo sapiens
gttctgcctgccagctgcactg

SEQ ID NO: 3679987 - DNA, 23 bp, Homo sapiens
gttctgctcagaggccttgctgt

SEQ ID NO: 3679988 - DNA, 16 bp, Homo sapiens
gttctggggggaccca

SEQ ID NO: 3679989 - DNA, 20 bp, Homo sapiens
gttctggggggacccagtgc

SEQ ID NO: 3679990 - DNA, 16 bp, Homo sapiens
gttctgtgacccatct

SEQ ID NO: 3679991 - DNA, 22 bp, Homo sapiens
gttctgtgacccatctgtagta

SEQ ID NO: 3679992 - DNA, 21 bp, Homo sapiens
gttcttaggctccatcctgtt

SEQ ID NO: 3679993 - DNA, 20 bp, Homo sapiens
gttcttatttaatctccatt

SEQ ID NO: 3679994 - DNA, 13 bp, Homo sapiens
gttcttcctgcaa

SEQ ID NO: 3679995 - DNA, 21 bp, Homo sapiens
gttcttcctgcaaccactctg

SEQ ID NO: 3679996 - DNA, 23 bp, Homo sapiens
gttctttaaaatgtaaagccatg

SEQ ID NO: 3679997 - DNA, 17 bp, Homo sapiens
gttctttttaagttaat

SEQ ID NO: 3679998 - DNA, 17 bp, Homo sapiens
gttgacatatttaatgt

SEQ ID NO: 3679999 - DNA, 18 bp, Homo sapiens
gttgacatatttaatgtt

SEQ ID NO: 3680000 - DNA, 20 bp, Homo sapiens
gttgacatatttaatgtttt

SEQ ID NO: 3680001 - DNA, 22 bp, Homo sapiens
gttgacttccaggcacggtttg

SEQ ID NO: 3680002 - DNA, 22 bp, Homo sapiens
gttgagttcaggtagctgcccc

SEQ ID NO: 3680003 - DNA, 22 bp, Homo sapiens
gttgatcatgtactttttagta

SEQ ID NO: 3680004 - DNA, 17 bp, Homo sapiens
gttgatctggaacccag

SEQ ID NO: 3680005 - DNA, 22 bp, Homo sapiens
gttgatctggaacccagactca

SEQ ID NO: 3680006 - DNA, 16 bp, Homo sapiens
gttgattacagtgcag

SEQ ID NO: 3680007 - DNA, 19 bp, Homo sapiens
gttgccaaatatgtcctgg

SEQ ID NO: 3680008 - DNA, 20 bp, Homo sapiens
gttgcctcatggccagcgcc

SEQ ID NO: 3680009 - DNA, 20 bp, Homo sapiens
gttgctggttataagcagca

SEQ ID NO: 3680010 - DNA, 15 bp, Homo sapiens
gttgctgtttcacaa

SEQ ID NO: 3680011 - DNA, 18 bp, Homo sapiens
gttgctgttttcctccct

SEQ ID NO: 3680012 - DNA, 18 bp, Homo sapiens
gttggcaaaaaggcagga

SEQ ID NO: 3680013 - DNA, 17 bp, Homo sapiens
gttggcaggctggccag

SEQ ID NO: 3680014 - DNA, 15 bp, Homo sapiens
gttggcttctccctg

SEQ ID NO: 3680015 - DNA, 22 bp, Homo sapiens
gttggcttctccctggggacgg

SEQ ID NO: 3680016 - DNA, 18 bp, Homo sapiens
gttggtatctcaggtctg

SEQ ID NO: 3680017 - DNA, 12 bp, Homo sapiens
gttgtcagctga

SEQ ID NO: 3680018 - DNA, 23 bp, Homo sapiens
gttgtctgaacccaggcagctgg

SEQ ID NO: 3680019 - DNA, 17 bp, Homo sapiens
gttgtttgtaaatgcct

SEQ ID NO: 3680020 - DNA, 20 bp, Homo sapiens
gttgttttttcctttgctct

SEQ ID NO: 3680021 - DNA, 18 bp, Homo sapiens
gtttacaaccttgtgagc

SEQ ID NO: 3680022 - DNA, 11 bp, Homo sapiens
gtttacagaat

SEQ ID NO: 3680023 - DNA, 13 bp, Homo sapiens
gtttagtaagttt

SEQ ID NO: 3680024 - DNA, 18 bp, Homo sapiens
gtttatgagatgctggtt

SEQ ID NO: 3680025 - DNA, 14 bp, Homo sapiens
gtttatggcctcag

SEQ ID NO: 3680026 - DNA, 14 bp, Homo sapiens
gtttatgtcttgtt

SEQ ID NO: 3680027 - DNA, 23 bp, Homo sapiens
gtttcaaaataaaaaccaagaag

SEQ ID NO: 3680028 - DNA, 17 bp, Homo sapiens
gtttcctgacattgtct

SEQ ID NO: 3680029 - DNA, 18 bp, Homo sapiens
gtttcgtgaactgcagtg

SEQ ID NO: 3680030 - DNA, 15 bp, Homo sapiens
gtttcgtggggaggt

SEQ ID NO: 3680031 - DNA, 15 bp, Homo sapiens
gtttcgttatattaa

SEQ ID NO: 3680032 - DNA, 21 bp, Homo sapiens
gtttctgaaaattaacactgc

SEQ ID NO: 3680033 - DNA, 23 bp, Homo sapiens
gtttctgcatctttttgaccctc

SEQ ID NO: 3680034 - DNA, 18 bp, Homo sapiens
gtttctggtggtctgttg

SEQ ID NO: 3680035 - DNA, 17 bp, Homo sapiens
gtttgaatataaacact

SEQ ID NO: 3680036 - DNA, 17 bp, Homo sapiens
gtttgagatcagcctgg

SEQ ID NO: 3680037 - DNA, 14 bp, Homo sapiens
gtttgcaaggaagc

SEQ ID NO: 3680038 - DNA, 17 bp, Homo sapiens
gtttgcactatctttca

SEQ ID NO: 3680039 - DNA, 11 bp, Homo sapiens
gtttgctttct

SEQ ID NO: 3680040 - DNA, 14 bp, Homo sapiens
gtttgtggcctcag

SEQ ID NO: 3680041 - DNA, 20 bp, Homo sapiens
gtttgtgtgttgtctcttga

SEQ ID NO: 3680042 - DNA, 18 bp, Homo sapiens
gttttaaaactggacctg

SEQ ID NO: 3680043 - DNA, 14 bp, Homo sapiens
gttttaaatgtaca

SEQ ID NO: 3680044 - DNA, 15 bp, Homo sapiens
gttttactgcagctt

SEQ ID NO: 3680045 - DNA, 16 bp, Homo sapiens
gttttactgcagcttt

SEQ ID NO: 3680046 - DNA, 21 bp, Homo sapiens
gttttatgagaaagccttctt

SEQ ID NO: 3680047 - DNA, 19 bp, Homo sapiens
gttttcagaacctcttccc

SEQ ID NO: 3680048 - DNA, 20 bp, Homo sapiens
gttttccaggtttaagctgt

SEQ ID NO: 3680049 - DNA, 21 bp, Homo sapiens
gttttcctatgctttgaaaca

SEQ ID NO: 3680050 - DNA, 15 bp, Homo sapiens
gttttcctcccttct

SEQ ID NO: 3680051 - DNA, 12 bp, Homo sapiens
gttttctcttga

SEQ ID NO: 3680052 - DNA, 19 bp, Homo sapiens
gttttctcttgagagggtg

SEQ ID NO: 3680053 - DNA, 14 bp, Homo sapiens
gttttcttgtttct

SEQ ID NO: 3680054 - DNA, 15 bp, Homo sapiens
gttttcttgtttctg

SEQ ID NO: 3680055 - DNA, 20 bp, Homo sapiens
gttttcttgtttctgcatct

SEQ ID NO: 3680056 - DNA, 20 bp, Homo sapiens
gttttctttgcaaagtattg

SEQ ID NO: 3680057 - DNA, 21 bp, Homo sapiens
gttttgatgtttgtggcctca

SEQ ID NO: 3680058 - DNA, 22 bp, Homo sapiens
gttttggctgaaattctcctgg

SEQ ID NO: 3680059 - DNA, 19 bp, Homo sapiens
gttttgtggaggagctcag

SEQ ID NO: 3680060 - DNA, 20 bp, Homo sapiens
gtttttaaattttgtaatga

SEQ ID NO: 3680061 - DNA, 15 bp, Homo sapiens
gtttttaactcaata

SEQ ID NO: 3680062 - DNA, 19 bp, Homo sapiens
gtttttaactcaatatttt

SEQ ID NO: 3680063 - DNA, 17 bp, Homo sapiens
gtttttacaagatgtat

SEQ ID NO: 3680064 - DNA, 11 bp, Homo sapiens
gtttttacagc

SEQ ID NO: 3680065 - DNA, 17 bp, Homo sapiens
gtttttacagctgtgtt

SEQ ID NO: 3680066 - DNA, 14 bp, Homo sapiens
gtttttctgccagg

SEQ ID NO: 3680067 - DNA, 17 bp, Homo sapiens
gtttttctgccagggag

SEQ ID NO: 3680068 - DNA, 15 bp, Homo sapiens
gtttttgcacatgtt

SEQ ID NO: 3680069 - DNA, 16 bp, Homo sapiens
gtttttgtcttaaaaa

SEQ ID NO: 3680070 - DNA, 14 bp, Homo sapiens
gtttttttttgtat

SEQ ID NO: 3680071 - DNA, 12 bp, Homo sapiens
taaaaaaaccac

SEQ ID NO: 3680072 - DNA, 22 bp, Homo sapiens
taaaaaaaccaccaaaaacaaa

SEQ ID NO: 3680073 - DNA, 18 bp, Homo sapiens
taaaaaattgaaaagatt

SEQ ID NO: 3680074 - DNA, 19 bp, Homo sapiens
taaaaacattgcctttgaa

SEQ ID NO: 3680075 - DNA, 21 bp, Homo sapiens
taaaaacattgcctttgaatg

SEQ ID NO: 3680076 - DNA, 17 bp, Homo sapiens
taaaacaaaatttgact

SEQ ID NO: 3680077 - DNA, 21 bp, Homo sapiens
taaaacaaaatttgactaatt

SEQ ID NO: 3680078 - DNA, 13 bp, Homo sapiens
taaaacccaagtg

SEQ ID NO: 3680079 - DNA, 15 bp, Homo sapiens
taaaagaacatgctt

SEQ ID NO: 3680080 - DNA, 12 bp, Homo sapiens
taaaagatgctt

SEQ ID NO: 3680081 - DNA, 20 bp, Homo sapiens
taaaagttctcaaatattgg

SEQ ID NO: 3680082 - DNA, 15 bp, Homo sapiens
taaaatgcaatgtaa

SEQ ID NO: 3680083 - DNA, 16 bp, Homo sapiens
taaaatggtttgtcct

SEQ ID NO: 3680084 - DNA, 18 bp, Homo sapiens
taaaatgtaaagccatgc

SEQ ID NO: 3680085 - DNA, 18 bp, Homo sapiens
taaaattacttggctttt

SEQ ID NO: 3680086 - DNA, 19 bp, Homo sapiens
taaacaaatgtatgattac

SEQ ID NO: 3680087 - DNA, 12 bp, Homo sapiens
taaacacacaga

SEQ ID NO: 3680088 - DNA, 14 bp, Homo sapiens
taaacacacagata

SEQ ID NO: 3680089 - DNA, 21 bp, Homo sapiens
taaacacacagatacacacac

SEQ ID NO: 3680090 - DNA, 16 bp, Homo sapiens
taaacacttgcaacct

SEQ ID NO: 3680091 - DNA, 20 bp, Homo sapiens
taaacccgaatcattgtttt

SEQ ID NO: 3680092 - DNA, 15 bp, Homo sapiens
taaactctgttgcaa

SEQ ID NO: 3680093 - DNA, 20 bp, Homo sapiens
taaacttcctattttcttga

SEQ ID NO: 3680094 - DNA, 11 bp, Homo sapiens
taaagaagaag

SEQ ID NO: 3680095 - DNA, 17 bp, Homo sapiens
taaagaagttgaagttt

SEQ ID NO: 3680096 - DNA, 19 bp, Homo sapiens
taaagaatatgacttttta

SEQ ID NO: 3680097 - DNA, 15 bp, Homo sapiens
taaagacacctggtt

SEQ ID NO: 3680098 - DNA, 18 bp, Homo sapiens
taaagatgatattaagaa

SEQ ID NO: 3680099 - DNA, 19 bp, Homo sapiens
taaagcttatttttctgtg

SEQ ID NO: 3680100 - DNA, 20 bp, Homo sapiens
taaaggaagcactctgtata

SEQ ID NO: 3680101 - DNA, 19 bp, Homo sapiens
taaagtgactaatggcatg

SEQ ID NO: 3680102 - DNA, 24 bp, Homo sapiens
taaagtggaattggcaaactagaa

SEQ ID NO: 3680103 - DNA, 12 bp, Homo sapiens
taaataggattt

SEQ ID NO: 3680104 - DNA, 16 bp, Homo sapiens
taaatattatgctgct

SEQ ID NO: 3680105 - DNA, 18 bp, Homo sapiens
taaatattatgctgcttt

SEQ ID NO: 3680106 - DNA, 13 bp, Homo sapiens
taaatattttcta

SEQ ID NO: 3680107 - DNA, 14 bp, Homo sapiens
taaatattttctat

SEQ ID NO: 3680108 - DNA, 16 bp, Homo sapiens
taaatattttctattt

SEQ ID NO: 3680109 - DNA, 16 bp, Homo sapiens
taaatcatgatgctag

SEQ ID NO: 3680110 - DNA, 14 bp, Homo sapiens
taaatctgacccag

SEQ ID NO: 3680111 - DNA, 18 bp, Homo sapiens
taaatcttaatacttgaa

SEQ ID NO: 3680112 - DNA, 15 bp, Homo sapiens
taaatgcctcttaaa

SEQ ID NO: 3680113 - DNA, 19 bp, Homo sapiens
taaatgcctcttaaattat

SEQ ID NO: 3680114 - DNA, 16 bp, Homo sapiens
taaattacaattttat

SEQ ID NO: 3680115 - DNA, 17 bp, Homo sapiens
taaattacaattttatc

SEQ ID NO: 3680116 - DNA, 20 bp, Homo sapiens
taaattccacagattatcaa

SEQ ID NO: 3680117 - DNA, 18 bp, Homo sapiens
taaattccatatgctcca

SEQ ID NO: 3680118 - DNA, 12 bp, Homo sapiens
taaattcctctt

SEQ ID NO: 3680119 - DNA, 16 bp, Homo sapiens
taacaaaggcagctgt

SEQ ID NO: 3680120 - DNA, 19 bp, Homo sapiens
taacaaaggcagctgtgtc

SEQ ID NO: 3680121 - DNA, 21 bp, Homo sapiens
taacaaaggcagctgtgtctg

SEQ ID NO: 3680122 - DNA, 17 bp, Homo sapiens
taacaaatttttcaaat

SEQ ID NO: 3680123 - DNA, 21 bp, Homo sapiens
taacaactatgatttggaaaa

SEQ ID NO: 3680124 - DNA, 22 bp, Homo sapiens
taacaactatgatttggaaaat

SEQ ID NO: 3680125 - DNA, 16 bp, Homo sapiens
taacaactatttttgt

SEQ ID NO: 3680126 - DNA, 19 bp, Homo sapiens
taacaataatatttcaagt

SEQ ID NO: 3680127 - DNA, 23 bp, Homo sapiens
taacaataatatttcaagtgcct

SEQ ID NO: 3680128 - DNA, 20 bp, Homo sapiens
taacaattaggcagactctt

SEQ ID NO: 3680129 - DNA, 16 bp, Homo sapiens
taacagtggagctgaa

SEQ ID NO: 3680130 - DNA, 16 bp, Homo sapiens
taacatttaaattcca

SEQ ID NO: 3680131 - DNA, 18 bp, Homo sapiens
taacatttaaattccaca

SEQ ID NO: 3680132 - DNA, 16 bp, Homo sapiens
taaccacttcagctga

SEQ ID NO: 3680133 - DNA, 16 bp, Homo sapiens
taacgcgtcttcctga

SEQ ID NO: 3680134 - DNA, 14 bp, Homo sapiens
taactacagaaaag

SEQ ID NO: 3680135 - DNA, 22 bp, Homo sapiens
taactcaatattttccatgaaa

SEQ ID NO: 3680136 - DNA, 17 bp, Homo sapiens
taactggtgcactttgt

SEQ ID NO: 3680137 - DNA, 14 bp, Homo sapiens
taacttcatagaaa

SEQ ID NO: 3680138 - DNA, 16 bp, Homo sapiens
taacttttattatctt

SEQ ID NO: 3680139 - DNA, 20 bp, Homo sapiens
taagaaacacactgaggcag

SEQ ID NO: 3680140 - DNA, 23 bp, Homo sapiens
taagaaacacactgaggcaggga

SEQ ID NO: 3680141 - DNA, 14 bp, Homo sapiens
taagaagaaagcaa

SEQ ID NO: 3680142 - DNA, 11 bp, Homo sapiens
taagacctggc

SEQ ID NO: 3680143 - DNA, 20 bp, Homo sapiens
taagactaacaaaggcagct

SEQ ID NO: 3680144 - DNA, 14 bp, Homo sapiens
taagagcagtcaca

SEQ ID NO: 3680145 - DNA, 22 bp, Homo sapiens
taagcagctaaattttctgaaa

SEQ ID NO: 3680146 - DNA, 18 bp, Homo sapiens
taagcatactttgtaaat

SEQ ID NO: 3680147 - DNA, 19 bp, Homo sapiens
taagcatactttgtaaata

SEQ ID NO: 3680148 - DNA, 22 bp, Homo sapiens
taagctgttactgtcttcagta

SEQ ID NO: 3680149 - DNA, 22 bp, Homo sapiens
taagctgttcctgttcagtaat

SEQ ID NO: 3680150 - DNA, 13 bp, Homo sapiens
taaggaagacaat

SEQ ID NO: 3680151 - DNA, 20 bp, Homo sapiens
taaggaggggaaaaaaatgt

SEQ ID NO: 3680152 - DNA, 22 bp, Homo sapiens
taaggaggggaaaaaaatgttg

SEQ ID NO: 3680153 - DNA, 13 bp, Homo sapiens
taaggctgaggaa

SEQ ID NO: 3680154 - DNA, 23 bp, Homo sapiens
taagggcgtggctctgggtgggc

SEQ ID NO: 3680155 - DNA, 13 bp, Homo sapiens
taaggtgtagcca

SEQ ID NO: 3680156 - DNA, 19 bp, Homo sapiens
taaggtgtagccacaccag

SEQ ID NO: 3680157 - DNA, 20 bp, Homo sapiens
taagtaacctctacaggcat

SEQ ID NO: 3680158 - DNA, 21 bp, Homo sapiens
taagtaccaatgggaagcagg

SEQ ID NO: 3680159 - DNA, 17 bp, Homo sapiens
taagtgaagtaaaactt

SEQ ID NO: 3680160 - DNA, 22 bp, Homo sapiens
taagtgcatgcattgagctgcc

SEQ ID NO: 3680161 - DNA, 13 bp, Homo sapiens
taataaaaaggca

SEQ ID NO: 3680162 - DNA, 14 bp, Homo sapiens
taataaaagaacat

SEQ ID NO: 3680163 - DNA, 14 bp, Homo sapiens
taataaactgtgtt

SEQ ID NO: 3680164 - DNA, 17 bp, Homo sapiens
taataaactttaatata

SEQ ID NO: 3680165 - DNA, 18 bp, Homo sapiens
taatacaaagaaaaagcc

SEQ ID NO: 3680166 - DNA, 14 bp, Homo sapiens
taatactgctgaga

SEQ ID NO: 3680167 - DNA, 22 bp, Homo sapiens
taatagattttttcagacttgt

SEQ ID NO: 3680168 - DNA, 15 bp, Homo sapiens
taatagggaatatat

SEQ ID NO: 3680169 - DNA, 16 bp, Homo sapiens
taatatctaaagttat

SEQ ID NO: 3680170 - DNA, 18 bp, Homo sapiens
taatattaactacagaaa

SEQ ID NO: 3680171 - DNA, 19 bp, Homo sapiens
taatattaactacagaaaa

SEQ ID NO: 3680172 - DNA, 20 bp, Homo sapiens
taatattaaggaagacaatg

SEQ ID NO: 3680173 - DNA, 14 bp, Homo sapiens
taatatttcaagtg

SEQ ID NO: 3680174 - DNA, 17 bp, Homo sapiens
taatatttcaagtgcct

SEQ ID NO: 3680175 - DNA, 18 bp, Homo sapiens
taatatttcaagtgccta

SEQ ID NO: 3680176 - DNA, 13 bp, Homo sapiens
taatcattttcat

SEQ ID NO: 3680177 - DNA, 14 bp, Homo sapiens
taatcattttcatt

SEQ ID NO: 3680178 - DNA, 17 bp, Homo sapiens
taatcccgattcaccct

SEQ ID NO: 3680179 - DNA, 22 bp, Homo sapiens
taatctactccttgtaaagact

SEQ ID NO: 3680180 - DNA, 13 bp, Homo sapiens
taatctgttatgt

SEQ ID NO: 3680181 - DNA, 23 bp, Homo sapiens
taatgaggagagaaaatatatgt

SEQ ID NO: 3680182 - DNA, 17 bp, Homo sapiens
taatgatgtcgtttgaa

SEQ ID NO: 3680183 - DNA, 22 bp, Homo sapiens
taatggggtcctggccatccca

SEQ ID NO: 3680184 - DNA, 21 bp, Homo sapiens
taatggttaagttttcttgtt

SEQ ID NO: 3680185 - DNA, 15 bp, Homo sapiens
taatgtttaaaacat

SEQ ID NO: 3680186 - DNA, 15 bp, Homo sapiens
taatgttttaaatgt

SEQ ID NO: 3680187 - DNA, 18 bp, Homo sapiens
taatgttttctttgcaaa

SEQ ID NO: 3680188 - DNA, 19 bp, Homo sapiens
taatgttttctttgcaaag

SEQ ID NO: 3680189 - DNA, 20 bp, Homo sapiens
taatgttttctttgcaaagt

SEQ ID NO: 3680190 - DNA, 19 bp, Homo sapiens
taattaaccttactaatta

SEQ ID NO: 3680191 - DNA, 23 bp, Homo sapiens
taattagttcctcattagcattt

SEQ ID NO: 3680192 - DNA, 14 bp, Homo sapiens
taattgctttgcca

SEQ ID NO: 3680193 - DNA, 22 bp, Homo sapiens
taattgtactaaagccaaacat

SEQ ID NO: 3680194 - DNA, 21 bp, Homo sapiens
taatttacaggttcttaggct

SEQ ID NO: 3680195 - DNA, 19 bp, Homo sapiens
taatttatttagtttttaa

SEQ ID NO: 3680196 - DNA, 17 bp, Homo sapiens
taatttctttttttcct

SEQ ID NO: 3680197 - DNA, 17 bp, Homo sapiens
taatttgatgaggtatt

SEQ ID NO: 3680198 - DNA, 21 bp, Homo sapiens
taattttacatgtttataaat

SEQ ID NO: 3680199 - DNA, 16 bp, Homo sapiens
taattttattcaagaa

SEQ ID NO: 3680200 - DNA, 21 bp, Homo sapiens
taatttttgtattatttttgt

SEQ ID NO: 3680201 - DNA, 15 bp, Homo sapiens
taattttttggtaca

SEQ ID NO: 3680202 - DNA, 18 bp, Homo sapiens
taattttttggtacaaaa

SEQ ID NO: 3680203 - DNA, 20 bp, Homo sapiens
tacaaaaagcataaaaatta

SEQ ID NO: 3680204 - DNA, 15 bp, Homo sapiens
tacaaaaataaattt

SEQ ID NO: 3680205 - DNA, 15 bp, Homo sapiens
tacaacggaggcctg

SEQ ID NO: 3680206 - DNA, 19 bp, Homo sapiens
tacaagagcagcctgtggc

SEQ ID NO: 3680207 - DNA, 13 bp, Homo sapiens
tacaataaagtct

SEQ ID NO: 3680208 - DNA, 18 bp, Homo sapiens
tacaattttatctgtttc

SEQ ID NO: 3680209 - DNA, 21 bp, Homo sapiens
tacacaatggtttttaaattt

SEQ ID NO: 3680210 - DNA, 22 bp, Homo sapiens
tacacagatcacagcttcagcc

SEQ ID NO: 3680211 - DNA, 18 bp, Homo sapiens
tacaccagcattcctttt

SEQ ID NO: 3680212 - DNA, 20 bp, Homo sapiens
tacaccagcattccttttga

SEQ ID NO: 3680213 - DNA, 20 bp, Homo sapiens
tacaccttgccttgctgttt

SEQ ID NO: 3680214 - DNA, 13 bp, Homo sapiens
tacagacatattt

SEQ ID NO: 3680215 - DNA, 16 bp, Homo sapiens
tacagattgggcgggg

SEQ ID NO: 3680216 - DNA, 21 bp, Homo sapiens
tacagattgggcggggcttct

SEQ ID NO: 3680217 - DNA, 13 bp, Homo sapiens
tacagatttaata

SEQ ID NO: 3680218 - DNA, 12 bp, Homo sapiens
tacagctgtgtt

SEQ ID NO: 3680219 - DNA, 17 bp, Homo sapiens
tacagtagattttccaa

SEQ ID NO: 3680220 - DNA, 14 bp, Homo sapiens
tacagtattgttac

SEQ ID NO: 3680221 - DNA, 17 bp, Homo sapiens
tacagttgaaaaacagc

SEQ ID NO: 3680222 - DNA, 19 bp, Homo sapiens
tacagttgaaaaacagctg

SEQ ID NO: 3680223 - DNA, 19 bp, Homo sapiens
tacagttgaaataactgga

SEQ ID NO: 3680224 - DNA, 15 bp, Homo sapiens
tacataaacttaaaa

SEQ ID NO: 3680225 - DNA, 15 bp, Homo sapiens
tacataattcactct

SEQ ID NO: 3680226 - DNA, 14 bp, Homo sapiens
tacatacaccagca

SEQ ID NO: 3680227 - DNA, 20 bp, Homo sapiens
tacatacaccagcattcctt

SEQ ID NO: 3680228 - DNA, 20 bp, Homo sapiens
tacatacagaattactgtaa

SEQ ID NO: 3680229 - DNA, 11 bp, Homo sapiens
tacatatatat

SEQ ID NO: 3680230 - DNA, 20 bp, Homo sapiens
tacatggcagtgttttagtt

SEQ ID NO: 3680231 - DNA, 13 bp, Homo sapiens
tacatgtaatttg

SEQ ID NO: 3680232 - DNA, 13 bp, Homo sapiens
tacatgtttataa

SEQ ID NO: 3680233 - DNA, 17 bp, Homo sapiens
tacatgtttataaatct

SEQ ID NO: 3680234 - DNA, 13 bp, Homo sapiens
tacatttactgaa

SEQ ID NO: 3680235 - DNA, 17 bp, Homo sapiens
taccaaagtgtcttttg

SEQ ID NO: 3680236 - DNA, 17 bp, Homo sapiens
taccacaagcctgagaa

SEQ ID NO: 3680237 - DNA, 18 bp, Homo sapiens
taccagagccttcaagtg

SEQ ID NO: 3680238 - DNA, 21 bp, Homo sapiens
taccagagccttcaagtgcca

SEQ ID NO: 3680239 - DNA, 17 bp, Homo sapiens
taccatcactgagtttt

SEQ ID NO: 3680240 - DNA, 20 bp, Homo sapiens
taccatcactgagttttcca

SEQ ID NO: 3680241 - DNA, 17 bp, Homo sapiens
taccatgggtgtggatg

SEQ ID NO: 3680242 - DNA, 16 bp, Homo sapiens
taccatttttctggat

SEQ ID NO: 3680243 - DNA, 12 bp, Homo sapiens
tacccagcctat

SEQ ID NO: 3680244 - DNA, 16 bp, Homo sapiens
taccccctaagagcca

SEQ ID NO: 3680245 - DNA, 17 bp, Homo sapiens
taccccgcagacacctt

SEQ ID NO: 3680246 - DNA, 19 bp, Homo sapiens
tacccctgacttctgttta

SEQ ID NO: 3680247 - DNA, 19 bp, Homo sapiens
taccccttagcctccctga

SEQ ID NO: 3680248 - DNA, 13 bp, Homo sapiens
taccctcccaccc

SEQ ID NO: 3680249 - DNA, 14 bp, Homo sapiens
taccctcctgctga

SEQ ID NO: 3680250 - DNA, 18 bp, Homo sapiens
taccctcctgctgagctg

SEQ ID NO: 3680251 - DNA, 20 bp, Homo sapiens
taccctcctgctgagctgcc

SEQ ID NO: 3680252 - DNA, 13 bp, Homo sapiens
tacctctgagaag

SEQ ID NO: 3680253 - DNA, 17 bp, Homo sapiens
tacctctgagaagacac

SEQ ID NO: 3680254 - DNA, 17 bp, Homo sapiens
tacctgaaggcagggct

SEQ ID NO: 3680255 - DNA, 17 bp, Homo sapiens
tacctgcaggcggggct

SEQ ID NO: 3680256 - DNA, 19 bp, Homo sapiens
tacctgcaggcggggctcc

SEQ ID NO: 3680257 - DNA, 22 bp, Homo sapiens
tacctggggaaagcctgaaggg

SEQ ID NO: 3680258 - DNA, 13 bp, Homo sapiens
tacctgggggcag

SEQ ID NO: 3680259 - DNA, 22 bp, Homo sapiens
tacctgtgaccctctttgctga

SEQ ID NO: 3680260 - DNA, 21 bp, Homo sapiens
tacctgttgagcatcacagaa

SEQ ID NO: 3680261 - DNA, 23 bp, Homo sapiens
taccttttttgttttttcaaaat

SEQ ID NO: 3680262 - DNA, 24 bp, Homo sapiens
tacgctccatcgctgtcatctcag

SEQ ID NO: 3680263 - DNA, 13 bp, Homo sapiens
tacgtatgagacg

SEQ ID NO: 3680264 - DNA, 19 bp, Homo sapiens
tacgtgggcattgtctttt

SEQ ID NO: 3680265 - DNA, 14 bp, Homo sapiens
tacgttaccaggca

SEQ ID NO: 3680266 - DNA, 23 bp, Homo sapiens
tacgtttctttaaccttgtataa

SEQ ID NO: 3680267 - DNA, 14 bp, Homo sapiens
tactaaagccaaac

SEQ ID NO: 3680268 - DNA, 14 bp, Homo sapiens
tactagtgttctgt

SEQ ID NO: 3680269 - DNA, 13 bp, Homo sapiens
tactataaagaga

SEQ ID NO: 3680270 - DNA, 20 bp, Homo sapiens
tactatcatgtcaaacgtga

SEQ ID NO: 3680271 - DNA, 12 bp, Homo sapiens
tactattaaaaa

SEQ ID NO: 3680272 - DNA, 13 bp, Homo sapiens
tactcctccctgg

SEQ ID NO: 3680273 - DNA, 21 bp, Homo sapiens
tactcctccctgggggcggga

SEQ ID NO: 3680274 - DNA, 13 bp, Homo sapiens
tactcctgccagg

SEQ ID NO: 3680275 - DNA, 15 bp, Homo sapiens
tactcctgccaggga

SEQ ID NO: 3680276 - DNA, 22 bp, Homo sapiens
tactctaccctcttagaaaaac

SEQ ID NO: 3680277 - DNA, 21 bp, Homo sapiens
tactgccatgtactagtttta

SEQ ID NO: 3680278 - DNA, 12 bp, Homo sapiens
tactgcgacttt

SEQ ID NO: 3680279 - DNA, 24 bp, Homo sapiens
tactgcttggagctgagcaaatca

SEQ ID NO: 3680280 - DNA, 16 bp, Homo sapiens
tactgtgtgatcagga

SEQ ID NO: 3680281 - DNA, 13 bp, Homo sapiens
tactgttactggg

SEQ ID NO: 3680282 - DNA, 16 bp, Homo sapiens
tactgttttgaggaat

SEQ ID NO: 3680283 - DNA, 24 bp, Homo sapiens
tacttagggaagaaaaagcaagtg

SEQ ID NO: 3680284 - DNA, 20 bp, Homo sapiens
tacttctgaaataaatgttc

SEQ ID NO: 3680285 - DNA, 22 bp, Homo sapiens
tacttgaactgttgcccttctg

SEQ ID NO: 3680286 - DNA, 20 bp, Homo sapiens
tacttgaagggccagagcca

SEQ ID NO: 3680287 - DNA, 17 bp, Homo sapiens
tacttgctcaggtactt

SEQ ID NO: 3680288 - DNA, 20 bp, Homo sapiens
tacttggtttgtgttcttct

SEQ ID NO: 3680289 - DNA, 14 bp, Homo sapiens
tactttaagtgata

SEQ ID NO: 3680290 - DNA, 16 bp, Homo sapiens
tactttggcaatttcc

SEQ ID NO: 3680291 - DNA, 13 bp, Homo sapiens
tactttgtaaata

SEQ ID NO: 3680292 - DNA, 23 bp, Homo sapiens
tactttgtaaataggatttttag

SEQ ID NO: 3680293 - DNA, 18 bp, Homo sapiens
tacttttttaaatatttt

SEQ ID NO: 3680294 - DNA, 22 bp, Homo sapiens
tacttttttaaatattttctat

SEQ ID NO: 3680295 - DNA, 23 bp, Homo sapiens
tacttttttaaatattttctatt

SEQ ID NO: 3680296 - DNA, 18 bp, Homo sapiens
tagaaaaatagcaacttg

SEQ ID NO: 3680297 - DNA, 20 bp, Homo sapiens
tagaaaaattcagcaaacca

SEQ ID NO: 3680298 - DNA, 18 bp, Homo sapiens
tagaaacctctctatttt

SEQ ID NO: 3680299 - DNA, 17 bp, Homo sapiens
tagaaagacagagctgg

SEQ ID NO: 3680300 - DNA, 21 bp, Homo sapiens
tagaaagctgacattgccaaa

SEQ ID NO: 3680301 - DNA, 18 bp, Homo sapiens
tagaacatccctgccagc

SEQ ID NO: 3680302 - DNA, 22 bp, Homo sapiens
tagaacgtccagggtttacatt

SEQ ID NO: 3680303 - DNA, 16 bp, Homo sapiens
tagaactccaggccct

SEQ ID NO: 3680304 - DNA, 22 bp, Homo sapiens
tagaagcactacaccttgcctt

SEQ ID NO: 3680305 - DNA, 19 bp, Homo sapiens
tagaagggccagtcctgcc

SEQ ID NO: 3680306 - DNA, 17 bp, Homo sapiens
tagaataatcttgctca

SEQ ID NO: 3680307 - DNA, 17 bp, Homo sapiens
tagaatgcatctcatca

SEQ ID NO: 3680308 - DNA, 16 bp, Homo sapiens
tagaatgccggttaaa

SEQ ID NO: 3680309 - DNA, 22 bp, Homo sapiens
tagaatgccggttaaattccat

SEQ ID NO: 3680310 - DNA, 14 bp, Homo sapiens
tagaccaagcttgt

SEQ ID NO: 3680311 - DNA, 19 bp, Homo sapiens
tagaccttgttacttctga

SEQ ID NO: 3680312 - DNA, 21 bp, Homo sapiens
tagactaagaataagaagcat

SEQ ID NO: 3680313 - DNA, 20 bp, Homo sapiens
tagactattccttttctgta

SEQ ID NO: 3680314 - DNA, 19 bp, Homo sapiens
tagactgttactttggcaa

SEQ ID NO: 3680315 - DNA, 21 bp, Homo sapiens
tagagaggacaatactggggt

SEQ ID NO: 3680316 - DNA, 11 bp, Homo sapiens
tagagcactgc

SEQ ID NO: 3680317 - DNA, 14 bp, Homo sapiens
tagagcactgccac

SEQ ID NO: 3680318 - DNA, 17 bp, Homo sapiens
tagagcactgccaccag

SEQ ID NO: 3680319 - DNA, 14 bp, Homo sapiens
tagagtcctcactc

SEQ ID NO: 3680320 - DNA, 20 bp, Homo sapiens
tagagtcctcactcccagtc

SEQ ID NO: 3680321 - DNA, 12 bp, Homo sapiens
tagagtgggagc

SEQ ID NO: 3680322 - DNA, 16 bp, Homo sapiens
tagatattggacaaag

SEQ ID NO: 3680323 - DNA, 13 bp, Homo sapiens
tagatctccagcg

SEQ ID NO: 3680324 - DNA, 21 bp, Homo sapiens
tagatgctggcccagggccca

SEQ ID NO: 3680325 - DNA, 22 bp, Homo sapiens
tagattaggtcttgctggaaga

SEQ ID NO: 3680326 - DNA, 22 bp, Homo sapiens
tagattttagaccctattgctg

SEQ ID NO: 3680327 - DNA, 15 bp, Homo sapiens
tagcaaagcaaaagg

SEQ ID NO: 3680328 - DNA, 23 bp, Homo sapiens
tagcaaagcaaaaggctgagaag

SEQ ID NO: 3680329 - DNA, 18 bp, Homo sapiens
tagcaactgctggggaga

SEQ ID NO: 3680330 - DNA, 20 bp, Homo sapiens
tagcaagggacaattgtatc

SEQ ID NO: 3680331 - DNA, 16 bp, Homo sapiens
tagcagcccaccctgc

SEQ ID NO: 3680332 - DNA, 13 bp, Homo sapiens
tagcctgatgaga

SEQ ID NO: 3680333 - DNA, 14 bp, Homo sapiens
tagcctggggtggg

SEQ ID NO: 3680334 - DNA, 13 bp, Homo sapiens
tagctaacagtga

SEQ ID NO: 3680335 - DNA, 20 bp, Homo sapiens
tagctacaggaagcacccca

SEQ ID NO: 3680336 - DNA, 14 bp, Homo sapiens
tagctagaggaacc

SEQ ID NO: 3680337 - DNA, 14 bp, Homo sapiens
tagctcctgtggcc

SEQ ID NO: 3680338 - DNA, 20 bp, Homo sapiens
taggaagagaggtccagccc

SEQ ID NO: 3680339 - DNA, 22 bp, Homo sapiens
taggaccaagcatcttgggggg

SEQ ID NO: 3680340 - DNA, 21 bp, Homo sapiens
taggacctttccaccacagcc

SEQ ID NO: 3680341 - DNA, 17 bp, Homo sapiens
taggagaaccaaatctg

SEQ ID NO: 3680342 - DNA, 16 bp, Homo sapiens
taggagaagccaggaa

SEQ ID NO: 3680343 - DNA, 16 bp, Homo sapiens
taggatggttctgtga

SEQ ID NO: 3680344 - DNA, 17 bp, Homo sapiens
taggatggttctgtgac

SEQ ID NO: 3680345 - DNA, 21 bp, Homo sapiens
taggattttttttaatgttta

SEQ ID NO: 3680346 - DNA, 12 bp, Homo sapiens
taggcaacatag

SEQ ID NO: 3680347 - DNA, 22 bp, Homo sapiens
taggcagactctttatgcttgc

SEQ ID NO: 3680348 - DNA, 16 bp, Homo sapiens
taggcattaacacaaa

SEQ ID NO: 3680349 - DNA, 16 bp, Homo sapiens
taggctggagcccagg

SEQ ID NO: 3680350 - DNA, 19 bp, Homo sapiens
taggctggagcccagggag

SEQ ID NO: 3680351 - DNA, 15 bp, Homo sapiens
taggctggtggccca

SEQ ID NO: 3680352 - DNA, 16 bp, Homo sapiens
taggctggtggcccag

SEQ ID NO: 3680353 - DNA, 17 bp, Homo sapiens
taggcttctacctgcag

SEQ ID NO: 3680354 - DNA, 21 bp, Homo sapiens
tagggaaaaaccagcgtgtga

SEQ ID NO: 3680355 - DNA, 12 bp, Homo sapiens
tagggagccatg

SEQ ID NO: 3680356 - DNA, 15 bp, Homo sapiens
tagggattcaggctg

SEQ ID NO: 3680357 - DNA, 16 bp, Homo sapiens
tagggattcaggctgc

SEQ ID NO: 3680358 - DNA, 12 bp, Homo sapiens
tagggtggccct

SEQ ID NO: 3680359 - DNA, 12 bp, Homo sapiens
tagggtttgaca

SEQ ID NO: 3680360 - DNA, 16 bp, Homo sapiens
taggtattagtgtttg

SEQ ID NO: 3680361 - DNA, 19 bp, Homo sapiens
taggtgcccttggaggcca

SEQ ID NO: 3680362 - DNA, 13 bp, Homo sapiens
taggtgtggggga

SEQ ID NO: 3680363 - DNA, 17 bp, Homo sapiens
taggtgtgggggaagca

SEQ ID NO: 3680364 - DNA, 14 bp, Homo sapiens
taggttcagccaag

SEQ ID NO: 3680365 - DNA, 13 bp, Homo sapiens
tagtaaaaataaa

SEQ ID NO: 3680366 - DNA, 16 bp, Homo sapiens
tagtaaaaataaaatt

SEQ ID NO: 3680367 - DNA, 21 bp, Homo sapiens
tagtaagaaatttgcagtttt

SEQ ID NO: 3680368 - DNA, 14 bp, Homo sapiens
tagtaatttctttt

SEQ ID NO: 3680369 - DNA, 14 bp, Homo sapiens
tagtagtttttaca

SEQ ID NO: 3680370 - DNA, 17 bp, Homo sapiens
tagtatttgattcaaaa

SEQ ID NO: 3680371 - DNA, 20 bp, Homo sapiens
tagtatttgattcaaaatat

SEQ ID NO: 3680372 - DNA, 15 bp, Homo sapiens
tagtcaatcaagtct

SEQ ID NO: 3680373 - DNA, 21 bp, Homo sapiens
tagtcaatcaagtctgtttac

SEQ ID NO: 3680374 - DNA, 15 bp, Homo sapiens
tagtcccttcccctc

SEQ ID NO: 3680375 - DNA, 22 bp, Homo sapiens
tagtccgtgctgacagctgctc

SEQ ID NO: 3680376 - DNA, 12 bp, Homo sapiens
tagtcctgggag

SEQ ID NO: 3680377 - DNA, 13 bp, Homo sapiens
tagtcctgggaga

SEQ ID NO: 3680378 - DNA, 17 bp, Homo sapiens
tagtcctgggagaggac

SEQ ID NO: 3680379 - DNA, 12 bp, Homo sapiens
tagtcctgtgaa

SEQ ID NO: 3680380 - DNA, 18 bp, Homo sapiens
tagtctagatggctcctc

SEQ ID NO: 3680381 - DNA, 20 bp, Homo sapiens
tagtctagatggctcctctc

SEQ ID NO: 3680382 - DNA, 15 bp, Homo sapiens
tagtcttttgctttt

SEQ ID NO: 3680383 - DNA, 14 bp, Homo sapiens
tagtgaacttgaaa

SEQ ID NO: 3680384 - DNA, 17 bp, Homo sapiens
tagttcatgtctgctat

SEQ ID NO: 3680385 - DNA, 20 bp, Homo sapiens
tagttcctcattagcatttt

SEQ ID NO: 3680386 - DNA, 18 bp, Homo sapiens
tagtttgtactcagtgga

SEQ ID NO: 3680387 - DNA, 19 bp, Homo sapiens
tagtttgtgtgttgtctct

SEQ ID NO: 3680388 - DNA, 20 bp, Homo sapiens
tataaattcctctttgcttt

SEQ ID NO: 3680389 - DNA, 21 bp, Homo sapiens
tataaattcctctttgctttg

SEQ ID NO: 3680390 - DNA, 19 bp, Homo sapiens
tataactatgttgataaaa

SEQ ID NO: 3680391 - DNA, 11 bp, Homo sapiens
tatacatctta

SEQ ID NO: 3680392 - DNA, 23 bp, Homo sapiens
tatactgcttggagctgagcaaa

SEQ ID NO: 3680393 - DNA, 15 bp, Homo sapiens
tatactgtacaataa

SEQ ID NO: 3680394 - DNA, 12 bp, Homo sapiens
tatacttaagaa

SEQ ID NO: 3680395 - DNA, 22 bp, Homo sapiens
tatagaaaaataaaaatctctt

SEQ ID NO: 3680396 - DNA, 16 bp, Homo sapiens
tatagacccgaggaaa

SEQ ID NO: 3680397 - DNA, 21 bp, Homo sapiens
tatagctgagactacaagtgt

SEQ ID NO: 3680398 - DNA, 13 bp, Homo sapiens
tatagtttgacag

SEQ ID NO: 3680399 - DNA, 18 bp, Homo sapiens
tatataacatatatggaa

SEQ ID NO: 3680400 - DNA, 13 bp, Homo sapiens
tatataatatcta

SEQ ID NO: 3680401 - DNA, 15 bp, Homo sapiens
tatatacatatatat

SEQ ID NO: 3680402 - DNA, 16 bp, Homo sapiens
tatatataacatatat

SEQ ID NO: 3680403 - DNA, 13 bp, Homo sapiens
tatatatatataa

SEQ ID NO: 3680404 - DNA, 17 bp, Homo sapiens
tatatatttctattatt

SEQ ID NO: 3680405 - DNA, 17 bp, Homo sapiens
tatatggaagaggaaaa

SEQ ID NO: 3680406 - DNA, 18 bp, Homo sapiens
tatatggtatatatacat

SEQ ID NO: 3680407 - DNA, 22 bp, Homo sapiens
tatatggtatatatacatatat

SEQ ID NO: 3680408 - DNA, 20 bp, Homo sapiens
tatattatcctaagggaaga

SEQ ID NO: 3680409 - DNA, 20 bp, Homo sapiens
tatatttaagcaacatcttt

SEQ ID NO: 3680410 - DNA, 12 bp, Homo sapiens
tatatttaggaa

SEQ ID NO: 3680411 - DNA, 15 bp, Homo sapiens
tatatttaggaaaac

SEQ ID NO: 3680412 - DNA, 19 bp, Homo sapiens
tatatttcagatgtaatgt

SEQ ID NO: 3680413 - DNA, 13 bp, Homo sapiens
tatatttctatta

SEQ ID NO: 3680414 - DNA, 22 bp, Homo sapiens
tatatttgtgctatagtatttg

SEQ ID NO: 3680415 - DNA, 17 bp, Homo sapiens
tatcacacttctgtgag

SEQ ID NO: 3680416 - DNA, 16 bp, Homo sapiens
tatcacctcattctga

SEQ ID NO: 3680417 - DNA, 20 bp, Homo sapiens
tatccaggtgtgcccctcca

SEQ ID NO: 3680418 - DNA, 22 bp, Homo sapiens
tatccaggtgtgcccctccaag

SEQ ID NO: 3680419 - DNA, 15 bp, Homo sapiens
tatccatgtacttgt

SEQ ID NO: 3680420 - DNA, 20 bp, Homo sapiens
tatccattttttttactgtt

SEQ ID NO: 3680421 - DNA, 22 bp, Homo sapiens
tatcctcctgttctgaaacctt

SEQ ID NO: 3680422 - DNA, 16 bp, Homo sapiens
tatccttctacttgtc

SEQ ID NO: 3680423 - DNA, 23 bp, Homo sapiens
tatctaaaccatatgaacatata

SEQ ID NO: 3680424 - DNA, 14 bp, Homo sapiens
tatctaaagttata

SEQ ID NO: 3680425 - DNA, 23 bp, Homo sapiens
tatctcccgaagtcctctgtggc

SEQ ID NO: 3680426 - DNA, 18 bp, Homo sapiens
tatctcctcgcaagctgg

SEQ ID NO: 3680427 - DNA, 13 bp, Homo sapiens
tatctcctggaac

SEQ ID NO: 3680428 - DNA, 16 bp, Homo sapiens
tatctctatttgagaa

SEQ ID NO: 3680429 - DNA, 16 bp, Homo sapiens
tatctgttcccttcct

SEQ ID NO: 3680430 - DNA, 15 bp, Homo sapiens
tatctttacatctat

SEQ ID NO: 3680431 - DNA, 15 bp, Homo sapiens
tatgaagaagagagt

SEQ ID NO: 3680432 - DNA, 16 bp, Homo sapiens
tatgagttggacttca

SEQ ID NO: 3680433 - DNA, 11 bp, Homo sapiens
tatgcaaaagg

SEQ ID NO: 3680434 - DNA, 22 bp, Homo sapiens
tatgcatggtgccccaggacca

SEQ ID NO: 3680435 - DNA, 18 bp, Homo sapiens
tatgctctcactgtttgt

SEQ ID NO: 3680436 - DNA, 18 bp, Homo sapiens
tatgctgctttaacagtg

SEQ ID NO: 3680437 - DNA, 23 bp, Homo sapiens
tatgctgctttaacagtggagct

SEQ ID NO: 3680438 - DNA, 15 bp, Homo sapiens
tatgctttgaaacag

SEQ ID NO: 3680439 - DNA, 22 bp, Homo sapiens
tatggaagggtttgtggctggg

SEQ ID NO: 3680440 - DNA, 17 bp, Homo sapiens
tatggactatctgtctg

SEQ ID NO: 3680441 - DNA, 13 bp, Homo sapiens
tatggcagtgtct

SEQ ID NO: 3680442 - DNA, 12 bp, Homo sapiens
tatggcctcagc

SEQ ID NO: 3680443 - DNA, 15 bp, Homo sapiens
tatgggcccctggca

SEQ ID NO: 3680444 - DNA, 16 bp, Homo sapiens
tatggtaccagatgca

SEQ ID NO: 3680445 - DNA, 15 bp, Homo sapiens
tatggtgctctgtct

SEQ ID NO: 3680446 - DNA, 23 bp, Homo sapiens
tatggtgctctgtctacttgctc

SEQ ID NO: 3680447 - DNA, 10 bp, Homo sapiens
tatgtatttt

SEQ ID NO: 3680448 - DNA, 13 bp, Homo sapiens
tatgtctgtgcca

SEQ ID NO: 3680449 - DNA, 15 bp, Homo sapiens
tatgtgtgaggagct

SEQ ID NO: 3680450 - DNA, 17 bp, Homo sapiens
tatgttagattttgcat

SEQ ID NO: 3680451 - DNA, 14 bp, Homo sapiens
tatgttgataaaag

SEQ ID NO: 3680452 - DNA, 19 bp, Homo sapiens
tatgtttaatctgttatgt

SEQ ID NO: 3680453 - DNA, 14 bp, Homo sapiens
tattaattgctttg

SEQ ID NO: 3680454 - DNA, 18 bp, Homo sapiens
tattacatgtaatttgat

SEQ ID NO: 3680455 - DNA, 12 bp, Homo sapiens
tattagagaaga

SEQ ID NO: 3680456 - DNA, 23 bp, Homo sapiens
tattagctgtattatccattttt

SEQ ID NO: 3680457 - DNA, 21 bp, Homo sapiens
tattatatttgacatgggtat

SEQ ID NO: 3680458 - DNA, 14 bp, Homo sapiens
tattatgagatgct

SEQ ID NO: 3680459 - DNA, 15 bp, Homo sapiens
tattatgagatgctg

SEQ ID NO: 3680460 - DNA, 17 bp, Homo sapiens
tattatgagatgctggc

SEQ ID NO: 3680461 - DNA, 18 bp, Homo sapiens
tattatgctgctttaaca

SEQ ID NO: 3680462 - DNA, 22 bp, Homo sapiens
tattcacatcgcttctgtgtat

SEQ ID NO: 3680463 - DNA, 14 bp, Homo sapiens
tattcactggcccc

SEQ ID NO: 3680464 - DNA, 21 bp, Homo sapiens
tattccaaaaaggttgctgtt

SEQ ID NO: 3680465 - DNA, 15 bp, Homo sapiens
tattccttttctgta

SEQ ID NO: 3680466 - DNA, 22 bp, Homo sapiens
tattcgatactgcgactttctg

SEQ ID NO: 3680467 - DNA, 22 bp, Homo sapiens
tattgcatttggattggggtcc

SEQ ID NO: 3680468 - DNA, 15 bp, Homo sapiens
tattgcctctacttt

SEQ ID NO: 3680469 - DNA, 13 bp, Homo sapiens
tattgtaaattat

SEQ ID NO: 3680470 - DNA, 16 bp, Homo sapiens
tattgttatgttctcc

SEQ ID NO: 3680471 - DNA, 15 bp, Homo sapiens
tatttaaaaatgtct

SEQ ID NO: 3680472 - DNA, 17 bp, Homo sapiens
tatttaaaaatgtcttg

SEQ ID NO: 3680473 - DNA, 15 bp, Homo sapiens
tatttaactggtgca

SEQ ID NO: 3680474 - DNA, 20 bp, Homo sapiens
tatttaagcaacatcttttt

SEQ ID NO: 3680475 - DNA, 21 bp, Homo sapiens
tatttaagcaacatcttttta

SEQ ID NO: 3680476 - DNA, 16 bp, Homo sapiens
tatttaatgttttaaa

SEQ ID NO: 3680477 - DNA, 19 bp, Homo sapiens
tatttagcttgggaaaggt

SEQ ID NO: 3680478 - DNA, 15 bp, Homo sapiens
tatttaggaagtgtt

SEQ ID NO: 3680479 - DNA, 15 bp, Homo sapiens
tatttcaagtgccta

SEQ ID NO: 3680480 - DNA, 22 bp, Homo sapiens
tatttcaatttccaagagctga

SEQ ID NO: 3680481 - DNA, 19 bp, Homo sapiens
tatttcagatgtaatgttt

SEQ ID NO: 3680482 - DNA, 20 bp, Homo sapiens
tatttcatctgttctatgct

SEQ ID NO: 3680483 - DNA, 19 bp, Homo sapiens
tatttccaaacctggttca

SEQ ID NO: 3680484 - DNA, 13 bp, Homo sapiens
tatttctattatt

SEQ ID NO: 3680485 - DNA, 21 bp, Homo sapiens
tatttctattattaattgcaa

SEQ ID NO: 3680486 - DNA, 12 bp, Homo sapiens
tatttgaaactt

SEQ ID NO: 3680487 - DNA, 21 bp, Homo sapiens
tatttgattcaaaatatttaa

SEQ ID NO: 3680488 - DNA, 11 bp, Homo sapiens
tatttgcagtc

SEQ ID NO: 3680489 - DNA, 23 bp, Homo sapiens
tatttgcagtcatggagaaccac

SEQ ID NO: 3680490 - DNA, 23 bp, Homo sapiens
tatttgggcctgctccagacctg

SEQ ID NO: 3680491 - DNA, 14 bp, Homo sapiens
tatttgtaaagcta

SEQ ID NO: 3680492 - DNA, 12 bp, Homo sapiens
tatttgtgaata

SEQ ID NO: 3680493 - DNA, 17 bp, Homo sapiens
tatttgtgctatagtat

SEQ ID NO: 3680494 - DNA, 21 bp, Homo sapiens
tatttgtgctatagtatttga

SEQ ID NO: 3680495 - DNA, 22 bp, Homo sapiens
tatttgttaatggtttgaatat

SEQ ID NO: 3680496 - DNA, 19 bp, Homo sapiens
tattttctattttaagact

SEQ ID NO: 3680497 - DNA, 20 bp, Homo sapiens
tattttctctgtacttttca

SEQ ID NO: 3680498 - DNA, 12 bp, Homo sapiens
tattttgtgtaa

SEQ ID NO: 3680499 - DNA, 16 bp, Homo sapiens
tattttgtgtaaaaaa

SEQ ID NO: 3680500 - DNA, 17 bp, Homo sapiens
tatttttaattaaataa

SEQ ID NO: 3680501 - DNA, 22 bp, Homo sapiens
tatttttatataatatctaaag

SEQ ID NO: 3680502 - DNA, 17 bp, Homo sapiens
tatttttatttgtttgt

SEQ ID NO: 3680503 - DNA, 16 bp, Homo sapiens
tatttttgtaaagttt

SEQ ID NO: 3680504 - DNA, 14 bp, Homo sapiens
tcaaaaaaagaaaa

SEQ ID NO: 3680505 - DNA, 22 bp, Homo sapiens
tcaaaacggttttactgcagct

SEQ ID NO: 3680506 - DNA, 13 bp, Homo sapiens
tcaaaatatttaa

SEQ ID NO: 3680507 - DNA, 14 bp, Homo sapiens
tcaaaatatttaaa

SEQ ID NO: 3680508 - DNA, 19 bp, Homo sapiens
tcaaaatatttaaaaatgt

SEQ ID NO: 3680509 - DNA, 23 bp, Homo sapiens
tcaaaatatttaaaaatgtcttg

SEQ ID NO: 3680510 - DNA, 16 bp, Homo sapiens
tcaaacaaagccagaa

SEQ ID NO: 3680511 - DNA, 14 bp, Homo sapiens
tcaaactcttaaaa

SEQ ID NO: 3680512 - DNA, 17 bp, Homo sapiens
tcaaactttcacctcag

SEQ ID NO: 3680513 - DNA, 17 bp, Homo sapiens
tcaaagaagctgtcttg

SEQ ID NO: 3680514 - DNA, 12 bp, Homo sapiens
tcaaagaggttt

SEQ ID NO: 3680515 - DNA, 23 bp, Homo sapiens
tcaaagaggttttaaaaaaatcc

SEQ ID NO: 3680516 - DNA, 14 bp, Homo sapiens
tcaaatcattcctt

SEQ ID NO: 3680517 - DNA, 22 bp, Homo sapiens
tcaaatgtgtgttcctgctttt

SEQ ID NO: 3680518 - DNA, 18 bp, Homo sapiens
tcaacaaatattcactgg

SEQ ID NO: 3680519 - DNA, 18 bp, Homo sapiens
tcaacaataaaatttttt

SEQ ID NO: 3680520 - DNA, 14 bp, Homo sapiens
tcaacagttttcct

SEQ ID NO: 3680521 - DNA, 22 bp, Homo sapiens
tcaacagttttcctatgctttg

SEQ ID NO: 3680522 - DNA, 13 bp, Homo sapiens
tcaaccatcctgg

SEQ ID NO: 3680523 - DNA, 21 bp, Homo sapiens
tcaacctcgcgcttgctggcc

SEQ ID NO: 3680524 - DNA, 19 bp, Homo sapiens
tcaactgccaaaatgctct

SEQ ID NO: 3680525 - DNA, 14 bp, Homo sapiens
tcaagaagaaaaag

SEQ ID NO: 3680526 - DNA, 13 bp, Homo sapiens
tcaagacatttct

SEQ ID NO: 3680527 - DNA, 16 bp, Homo sapiens
tcaagcagtcgtgcct

SEQ ID NO: 3680528 - DNA, 18 bp, Homo sapiens
tcaagcagtcgtgcctgt

SEQ ID NO: 3680529 - DNA, 19 bp, Homo sapiens
tcaagcagtcgtgcctgtg

SEQ ID NO: 3680530 - DNA, 23 bp, Homo sapiens
tcaagcagtcgtgcctgtgtcca

SEQ ID NO: 3680531 - DNA, 20 bp, Homo sapiens
tcaagccaagcagccaagct

SEQ ID NO: 3680532 - DNA, 18 bp, Homo sapiens
tcaagcctgtgcaaaaaa

SEQ ID NO: 3680533 - DNA, 19 bp, Homo sapiens
tcaagcctgtgcaaaaaaa

SEQ ID NO: 3680534 - DNA, 13 bp, Homo sapiens
tcaagctcctcct

SEQ ID NO: 3680535 - DNA, 14 bp, Homo sapiens
tcaagctcctcctc

SEQ ID NO: 3680536 - DNA, 14 bp, Homo sapiens
tcaaggaatcggct

SEQ ID NO: 3680537 - DNA, 19 bp, Homo sapiens
tcaaggactgaattgtttt

SEQ ID NO: 3680538 - DNA, 19 bp, Homo sapiens
tcaaggagaccatgtatgt

SEQ ID NO: 3680539 - DNA, 16 bp, Homo sapiens
tcaaggcggtgcttga

SEQ ID NO: 3680540 - DNA, 22 bp, Homo sapiens
tcaagtaccaccaagggatctg

SEQ ID NO: 3680541 - DNA, 21 bp, Homo sapiens
tcaagtgcctagactgttact

SEQ ID NO: 3680542 - DNA, 21 bp, Homo sapiens
tcaagttttgggtatgtttaa

SEQ ID NO: 3680543 - DNA, 17 bp, Homo sapiens
tcaatacagtacaggca

SEQ ID NO: 3680544 - DNA, 20 bp, Homo sapiens
tcaatacagtacaggcagca

SEQ ID NO: 3680545 - DNA, 15 bp, Homo sapiens
tcaatattttccatg

SEQ ID NO: 3680546 - DNA, 16 bp, Homo sapiens
tcaatattttccatga

SEQ ID NO: 3680547 - DNA, 18 bp, Homo sapiens
tcaatattttccatgaaa

SEQ ID NO: 3680548 - DNA, 16 bp, Homo sapiens
tcaatgaagccagctc

SEQ ID NO: 3680549 - DNA, 21 bp, Homo sapiens
tcaatgaagccagctcacagt

SEQ ID NO: 3680550 - DNA, 17 bp, Homo sapiens
tcaatggtttgcaagga

SEQ ID NO: 3680551 - DNA, 18 bp, Homo sapiens
tcaatggtttgcaaggaa

SEQ ID NO: 3680552 - DNA, 19 bp, Homo sapiens
tcaatggtttgcaaggaag

SEQ ID NO: 3680553 - DNA, 13 bp, Homo sapiens
tcaattgctttgt

SEQ ID NO: 3680554 - DNA, 13 bp, Homo sapiens
tcaattttgactt

SEQ ID NO: 3680555 - DNA, 12 bp, Homo sapiens
tcacaaagccca

SEQ ID NO: 3680556 - DNA, 16 bp, Homo sapiens
tcacaaagcccaaggg

SEQ ID NO: 3680557 - DNA, 15 bp, Homo sapiens
tcacacgtaaaagaa

SEQ ID NO: 3680558 - DNA, 16 bp, Homo sapiens
tcacacttctgtgaga

SEQ ID NO: 3680559 - DNA, 22 bp, Homo sapiens
tcacacttctgtgagaccccca

SEQ ID NO: 3680560 - DNA, 23 bp, Homo sapiens
tcacacttctgtgagacccccac

SEQ ID NO: 3680561 - DNA, 12 bp, Homo sapiens
tcacagggtggg

SEQ ID NO: 3680562 - DNA, 17 bp, Homo sapiens
tcacagggtgggcctcg

SEQ ID NO: 3680563 - DNA, 20 bp, Homo sapiens
tcacagtctcagttctcttg

SEQ ID NO: 3680564 - DNA, 17 bp, Homo sapiens
tcacagtgggagccagg

SEQ ID NO: 3680565 - DNA, 12 bp, Homo sapiens
tcacattagaag

SEQ ID NO: 3680566 - DNA, 21 bp, Homo sapiens
tcacattcttggcttaatcat

SEQ ID NO: 3680567 - DNA, 18 bp, Homo sapiens
tcacattgtttgctgcta

SEQ ID NO: 3680568 - DNA, 12 bp, Homo sapiens
tcaccacaaact

SEQ ID NO: 3680569 - DNA, 19 bp, Homo sapiens
tcacccaatcccagttctt

SEQ ID NO: 3680570 - DNA, 20 bp, Homo sapiens
tcacccatgcaagcagagga

SEQ ID NO: 3680571 - DNA, 15 bp, Homo sapiens
tcaccggatcctggg

SEQ ID NO: 3680572 - DNA, 14 bp, Homo sapiens
tcacctcattctga

SEQ ID NO: 3680573 - DNA, 18 bp, Homo sapiens
tcacctctggactggcta

SEQ ID NO: 3680574 - DNA, 18 bp, Homo sapiens
tcaccttaggcagggaag

SEQ ID NO: 3680575 - DNA, 16 bp, Homo sapiens
tcacgcacctcccatc

SEQ ID NO: 3680576 - DNA, 21 bp, Homo sapiens
tcactaggcccccacttgcct

SEQ ID NO: 3680577 - DNA, 12 bp, Homo sapiens
tcactcaaggcg

SEQ ID NO: 3680578 - DNA, 20 bp, Homo sapiens
tcactcgggtttctctgtgg

SEQ ID NO: 3680579 - DNA, 20 bp, Homo sapiens
tcactctgagtgttttatga

SEQ ID NO: 3680580 - DNA, 21 bp, Homo sapiens
tcactgagttttccatggcag

SEQ ID NO: 3680581 - DNA, 18 bp, Homo sapiens
tcactgatgggaaaactg

SEQ ID NO: 3680582 - DNA, 18 bp, Homo sapiens
tcactgtgacctccgcct

SEQ ID NO: 3680583 - DNA, 16 bp, Homo sapiens
tcacttacatttttgt

SEQ ID NO: 3680584 - DNA, 21 bp, Homo sapiens
tcacttagaacctttctgtgt

SEQ ID NO: 3680585 - DNA, 19 bp, Homo sapiens
tcacttatcccaagagaat

SEQ ID NO: 3680586 - DNA, 17 bp, Homo sapiens
tcacttcctacaagagc

SEQ ID NO: 3680587 - DNA, 21 bp, Homo sapiens
tcactttcccttgtgtcaaga

SEQ ID NO: 3680588 - DNA, 16 bp, Homo sapiens
tcagaacctcttcccc

SEQ ID NO: 3680589 - DNA, 22 bp, Homo sapiens
tcagactcccattcctgaagaa

SEQ ID NO: 3680590 - DNA, 20 bp, Homo sapiens
tcagactctttagttgattt

SEQ ID NO: 3680591 - DNA, 13 bp, Homo sapiens
tcagactgcagag

SEQ ID NO: 3680592 - DNA, 16 bp, Homo sapiens
tcagagatgcaccacc

SEQ ID NO: 3680593 - DNA, 23 bp, Homo sapiens
tcagagccactctatgagttgga

SEQ ID NO: 3680594 - DNA, 17 bp, Homo sapiens
tcagaggccttgctgtg

SEQ ID NO: 3680595 - DNA, 19 bp, Homo sapiens
tcagaggccttgctgtgga

SEQ ID NO: 3680596 - DNA, 22 bp, Homo sapiens
tcagataaggtaaaatgccatg

SEQ ID NO: 3680597 - DNA, 15 bp, Homo sapiens
tcagatgtaatgttt

SEQ ID NO: 3680598 - DNA, 20 bp, Homo sapiens
tcagcaaaccatttttaaag

SEQ ID NO: 3680599 - DNA, 15 bp, Homo sapiens
tcagcaccaccctag

SEQ ID NO: 3680600 - DNA, 22 bp, Homo sapiens
tcagccaaggttttataaggct

SEQ ID NO: 3680601 - DNA, 14 bp, Homo sapiens
tcagccagagaagc

SEQ ID NO: 3680602 - DNA, 19 bp, Homo sapiens
tcagccaggagctgggcag

SEQ ID NO: 3680603 - DNA, 23 bp, Homo sapiens
tcagccgtgtaaccatggaccca

SEQ ID NO: 3680604 - DNA, 14 bp, Homo sapiens
tcagcctctgccac

SEQ ID NO: 3680605 - DNA, 16 bp, Homo sapiens
tcagcctgctccagct

SEQ ID NO: 3680606 - DNA, 18 bp, Homo sapiens
tcagcctggccagacaca

SEQ ID NO: 3680607 - DNA, 12 bp, Homo sapiens
tcagcctgggca

SEQ ID NO: 3680608 - DNA, 12 bp, Homo sapiens
tcagcctggggt

SEQ ID NO: 3680609 - DNA, 14 bp, Homo sapiens
tcagccttgccaga

SEQ ID NO: 3680610 - DNA, 16 bp, Homo sapiens
tcagccttgccagaga

SEQ ID NO: 3680611 - DNA, 18 bp, Homo sapiens
tcagcggttgaggagaat

SEQ ID NO: 3680612 - DNA, 12 bp, Homo sapiens
tcagctccagct

SEQ ID NO: 3680613 - DNA, 18 bp, Homo sapiens
tcagcttatgtaggtaaa

SEQ ID NO: 3680614 - DNA, 18 bp, Homo sapiens
tcaggagaattagatttc

SEQ ID NO: 3680615 - DNA, 21 bp, Homo sapiens
tcaggcaggaagggcaggaag

SEQ ID NO: 3680616 - DNA, 17 bp, Homo sapiens
tcaggcaggtgggatgg

SEQ ID NO: 3680617 - DNA, 14 bp, Homo sapiens
tcaggccagagcca

SEQ ID NO: 3680618 - DNA, 18 bp, Homo sapiens
tcaggcctccctctctct

SEQ ID NO: 3680619 - DNA, 16 bp, Homo sapiens
tcaggcctgatgaggg

SEQ ID NO: 3680620 - DNA, 15 bp, Homo sapiens
tcaggctgaaaacaa

SEQ ID NO: 3680621 - DNA, 16 bp, Homo sapiens
tcagggacccctgccc

SEQ ID NO: 3680622 - DNA, 19 bp, Homo sapiens
tcagggaggccctgtgccc

SEQ ID NO: 3680623 - DNA, 17 bp, Homo sapiens
tcagggccatgctgagg

SEQ ID NO: 3680624 - DNA, 19 bp, Homo sapiens
tcagggccatgctgaggcc

SEQ ID NO: 3680625 - DNA, 23 bp, Homo sapiens
tcagggccatgctgaggcctggg

SEQ ID NO: 3680626 - DNA, 16 bp, Homo sapiens
tcaggggactcagccc

SEQ ID NO: 3680627 - DNA, 12 bp, Homo sapiens
tcaggggtgtgc

SEQ ID NO: 3680628 - DNA, 14 bp, Homo sapiens
tcaggtactcctgc

SEQ ID NO: 3680629 - DNA, 13 bp, Homo sapiens
tcaggtagctgcc

SEQ ID NO: 3680630 - DNA, 16 bp, Homo sapiens
tcaggtgagaagcaga

SEQ ID NO: 3680631 - DNA, 14 bp, Homo sapiens
tcaggtgttgccaa

SEQ ID NO: 3680632 - DNA, 13 bp, Homo sapiens
tcagtaagccgtg

SEQ ID NO: 3680633 - DNA, 19 bp, Homo sapiens
tcagtaataaactgtgttt

SEQ ID NO: 3680634 - DNA, 20 bp, Homo sapiens
tcagtatccatgctcttgac

SEQ ID NO: 3680635 - DNA, 16 bp, Homo sapiens
tcagtgcatttgtgct

SEQ ID NO: 3680636 - DNA, 19 bp, Homo sapiens
tcagtggacagtgctgttg

SEQ ID NO: 3680637 - DNA, 18 bp, Homo sapiens
tcagtgggctgtttctgc

SEQ ID NO: 3680638 - DNA, 14 bp, Homo sapiens
tcagttaattctta

SEQ ID NO: 3680639 - DNA, 18 bp, Homo sapiens
tcagttaattcttagata

SEQ ID NO: 3680640 - DNA, 21 bp, Homo sapiens
tcagttcagcggttgaggaga

SEQ ID NO: 3680641 - DNA, 16 bp, Homo sapiens
tcagttcccttggcct

SEQ ID NO: 3680642 - DNA, 19 bp, Homo sapiens
tcagttcccttggcctcag

SEQ ID NO: 3680643 - DNA, 17 bp, Homo sapiens
tcagttgattttctgga

SEQ ID NO: 3680644 - DNA, 17 bp, Homo sapiens
tcagtttaggccttggc

SEQ ID NO: 3680645 - DNA, 18 bp, Homo sapiens
tcagtttaggccttggct

SEQ ID NO: 3680646 - DNA, 19 bp, Homo sapiens
tcagtttaggccttggctt

SEQ ID NO: 3680647 - DNA, 18 bp, Homo sapiens
tcagttttttgttttaca

SEQ ID NO: 3680648 - DNA, 20 bp, Homo sapiens
tcagttttttgttttacaat

SEQ ID NO: 3680649 - DNA, 22 bp, Homo sapiens
tcataagtttgtttaaacactt

SEQ ID NO: 3680650 - DNA, 20 bp, Homo sapiens
tcatagactcctttgctaat

SEQ ID NO: 3680651 - DNA, 14 bp, Homo sapiens
tcatagcccagtag

SEQ ID NO: 3680652 - DNA, 14 bp, Homo sapiens
tcatagtagttttt

SEQ ID NO: 3680653 - DNA, 18 bp, Homo sapiens
tcatagtagtttttacag

SEQ ID NO: 3680654 - DNA, 19 bp, Homo sapiens
tcatatggaaaaaatgtat

SEQ ID NO: 3680655 - DNA, 14 bp, Homo sapiens
tcatatttatactt

SEQ ID NO: 3680656 - DNA, 20 bp, Homo sapiens
tcatcaagtagcgttggaga

SEQ ID NO: 3680657 - DNA, 13 bp, Homo sapiens
tcatcctgaccaa

SEQ ID NO: 3680658 - DNA, 15 bp, Homo sapiens
tcatcctgaccaaga

SEQ ID NO: 3680659 - DNA, 14 bp, Homo sapiens
tcatctctctgccc

SEQ ID NO: 3680660 - DNA, 16 bp, Homo sapiens
tcatctgcatgtctac

SEQ ID NO: 3680661 - DNA, 17 bp, Homo sapiens
tcatctgcatgtctact

SEQ ID NO: 3680662 - DNA, 13 bp, Homo sapiens
tcatctgctggtc

SEQ ID NO: 3680663 - DNA, 22 bp, Homo sapiens
tcatcttgaccaagcaggaagc

SEQ ID NO: 3680664 - DNA, 15 bp, Homo sapiens
tcatgccctcctctc

SEQ ID NO: 3680665 - DNA, 16 bp, Homo sapiens
tcatgcccttctgatt

SEQ ID NO: 3680666 - DNA, 20 bp, Homo sapiens
tcatggagtcatcttgcaca

SEQ ID NO: 3680667 - DNA, 18 bp, Homo sapiens
tcatggtcctttctggaa

SEQ ID NO: 3680668 - DNA, 23 bp, Homo sapiens
tcatggtgggttcaggggactca

SEQ ID NO: 3680669 - DNA, 16 bp, Homo sapiens
tcatggtgtgttacac

SEQ ID NO: 3680670 - DNA, 13 bp, Homo sapiens
tcatgtacttttt

SEQ ID NO: 3680671 - DNA, 15 bp, Homo sapiens
tcatgtactttttag

SEQ ID NO: 3680672 - DNA, 13 bp, Homo sapiens
tcatgtggctgga

SEQ ID NO: 3680673 - DNA, 16 bp, Homo sapiens
tcatgtggctggaaga

SEQ ID NO: 3680674 - DNA, 21 bp, Homo sapiens
tcatgtggctggaagatcctg

SEQ ID NO: 3680675 - DNA, 14 bp, Homo sapiens
tcattaatgtaata

SEQ ID NO: 3680676 - DNA, 23 bp, Homo sapiens
tcattgccttaactggagcccca

SEQ ID NO: 3680677 - DNA, 16 bp, Homo sapiens
tcatttacaactgaaa

SEQ ID NO: 3680678 - DNA, 16 bp, Homo sapiens
tcatttgggggcgttc

SEQ ID NO: 3680679 - DNA, 18 bp, Homo sapiens
tcatttgtttacatttga

SEQ ID NO: 3680680 - DNA, 19 bp, Homo sapiens
tcattttccccccactctc

SEQ ID NO: 3680681 - DNA, 21 bp, Homo sapiens
tccaaaagaagcccccagcta

SEQ ID NO: 3680682 - DNA, 22 bp, Homo sapiens
tccaaacctggttcatatttat

SEQ ID NO: 3680683 - DNA, 19 bp, Homo sapiens
tccaaactaccttccagtt

SEQ ID NO: 3680684 - DNA, 20 bp, Homo sapiens
tccaaactgcctaagccctc

SEQ ID NO: 3680685 - DNA, 15 bp, Homo sapiens
tccaaaggaggctgg

SEQ ID NO: 3680686 - DNA, 15 bp, Homo sapiens
tccaaaggcagcgtg

SEQ ID NO: 3680687 - DNA, 17 bp, Homo sapiens
tccaaaggcagcgtgcc

SEQ ID NO: 3680688 - DNA, 13 bp, Homo sapiens
tccaaatgcttct

SEQ ID NO: 3680689 - DNA, 16 bp, Homo sapiens
tccaaatgtccctcca

SEQ ID NO: 3680690 - DNA, 17 bp, Homo sapiens
tccaaatgtcctccaga

SEQ ID NO: 3680691 - DNA, 16 bp, Homo sapiens
tccaacaggagctggg

SEQ ID NO: 3680692 - DNA, 15 bp, Homo sapiens
tccaacttggctgca

SEQ ID NO: 3680693 - DNA, 14 bp, Homo sapiens
tccaagcgcctggc

SEQ ID NO: 3680694 - DNA, 18 bp, Homo sapiens
tccaagctgttagttgct

SEQ ID NO: 3680695 - DNA, 17 bp, Homo sapiens
tccaagtcacaaagaga

SEQ ID NO: 3680696 - DNA, 23 bp, Homo sapiens
tccaagtcacaaagagatgtcct

SEQ ID NO: 3680697 - DNA, 17 bp, Homo sapiens
tccacccttggcctgtc

SEQ ID NO: 3680698 - DNA, 19 bp, Homo sapiens
tccacccttggcctgtctc

SEQ ID NO: 3680699 - DNA, 15 bp, Homo sapiens
tccacttgcttaagt

SEQ ID NO: 3680700 - DNA, 19 bp, Homo sapiens
tccactttgtttcgtgggg

SEQ ID NO: 3680701 - DNA, 13 bp, Homo sapiens
tccagaaaacaaa

SEQ ID NO: 3680702 - DNA, 17 bp, Homo sapiens
tccagaagcctctggct

SEQ ID NO: 3680703 - DNA, 22 bp, Homo sapiens
tccagaagtttgagatcagcct

SEQ ID NO: 3680704 - DNA, 13 bp, Homo sapiens
tccagacctgatc

SEQ ID NO: 3680705 - DNA, 18 bp, Homo sapiens
tccagacctgatcctgga

SEQ ID NO: 3680706 - DNA, 21 bp, Homo sapiens
tccagagagaaatcaggcctg

SEQ ID NO: 3680707 - DNA, 18 bp, Homo sapiens
tccagcaccttgtgcctg

SEQ ID NO: 3680708 - DNA, 21 bp, Homo sapiens
tccagcaccttgtgcctgggg

SEQ ID NO: 3680709 - DNA, 17 bp, Homo sapiens
tccagcagaagacaaaa

SEQ ID NO: 3680710 - DNA, 20 bp, Homo sapiens
tccagcatttagctggccac

SEQ ID NO: 3680711 - DNA, 15 bp, Homo sapiens
tccagccccccaggc

SEQ ID NO: 3680712 - DNA, 16 bp, Homo sapiens
tccagccccccaggct

SEQ ID NO: 3680713 - DNA, 21 bp, Homo sapiens
tccagccccccaggctgccca

SEQ ID NO: 3680714 - DNA, 18 bp, Homo sapiens
tccagccgccattgccac

SEQ ID NO: 3680715 - DNA, 21 bp, Homo sapiens
tccagccgccattgccaccag

SEQ ID NO: 3680716 - DNA, 16 bp, Homo sapiens
tccagcctgccccgga

SEQ ID NO: 3680717 - DNA, 12 bp, Homo sapiens
tccagcctgggc

SEQ ID NO: 3680718 - DNA, 13 bp, Homo sapiens
tccagcctgggtg

SEQ ID NO: 3680719 - DNA, 11 bp, Homo sapiens
tccagcctggt

SEQ ID NO: 3680720 - DNA, 13 bp, Homo sapiens
tccagcctggtgg

SEQ ID NO: 3680721 - DNA, 18 bp, Homo sapiens
tccagcctggtggcccag

SEQ ID NO: 3680722 - DNA, 20 bp, Homo sapiens
tccagcctggtggcccagct

SEQ ID NO: 3680723 - DNA, 14 bp, Homo sapiens
tccagctctgtggg

SEQ ID NO: 3680724 - DNA, 15 bp, Homo sapiens
tccagctctgtgggc

SEQ ID NO: 3680725 - DNA, 16 bp, Homo sapiens
tccagctttctgccat

SEQ ID NO: 3680726 - DNA, 21 bp, Homo sapiens
tccaggatctttgactgaaaa

SEQ ID NO: 3680727 - DNA, 14 bp, Homo sapiens
tccaggatggggag

SEQ ID NO: 3680728 - DNA, 15 bp, Homo sapiens
tccaggatggggagg

SEQ ID NO: 3680729 - DNA, 21 bp, Homo sapiens
tccaggatggggaggggctct

SEQ ID NO: 3680730 - DNA, 22 bp, Homo sapiens
tccaggatggggaggggctctg

SEQ ID NO: 3680731 - DNA, 14 bp, Homo sapiens
tccaggcagatcca

SEQ ID NO: 3680732 - DNA, 15 bp, Homo sapiens
tccaggcagatccag

SEQ ID NO: 3680733 - DNA, 21 bp, Homo sapiens
tccaggcagatccaggactat

SEQ ID NO: 3680734 - DNA, 16 bp, Homo sapiens
tccaggctgccgtggg

SEQ ID NO: 3680735 - DNA, 18 bp, Homo sapiens
tccagggaagctggccga

SEQ ID NO: 3680736 - DNA, 15 bp, Homo sapiens
tccagggacagaggc

SEQ ID NO: 3680737 - DNA, 19 bp, Homo sapiens
tccagggacagaggcccca

SEQ ID NO: 3680738 - DNA, 21 bp, Homo sapiens
tccagggacagaggccccagc

SEQ ID NO: 3680739 - DNA, 11 bp, Homo sapiens
tccagggaggg

SEQ ID NO: 3680740 - DNA, 17 bp, Homo sapiens
tccaggggatgggaggt

SEQ ID NO: 3680741 - DNA, 21 bp, Homo sapiens
tccaggggctgcttcctcctg

SEQ ID NO: 3680742 - DNA, 20 bp, Homo sapiens
tccagggtatgacctaggga

SEQ ID NO: 3680743 - DNA, 22 bp, Homo sapiens
tccaggtgtgcccctccaagtc

SEQ ID NO: 3680744 - DNA, 17 bp, Homo sapiens
tccaggtttaagctgtt

SEQ ID NO: 3680745 - DNA, 23 bp, Homo sapiens
tccagttggagttttttgtacca

SEQ ID NO: 3680746 - DNA, 21 bp, Homo sapiens
tccatacccacaatctgagca

SEQ ID NO: 3680747 - DNA, 22 bp, Homo sapiens
tccatcagcttaggggctgctg

SEQ ID NO: 3680748 - DNA, 15 bp, Homo sapiens
tccatccacccctgc

SEQ ID NO: 3680749 - DNA, 20 bp, Homo sapiens
tccatctgggctaccccacc

SEQ ID NO: 3680750 - DNA, 20 bp, Homo sapiens
tccatgcctgtagctttcct

SEQ ID NO: 3680751 - DNA, 16 bp, Homo sapiens
tccatggttaccatgg

SEQ ID NO: 3680752 - DNA, 22 bp, Homo sapiens
tccatggttaccatgggtgtgg

SEQ ID NO: 3680753 - DNA, 22 bp, Homo sapiens
tccattcacagttctttgggcc

SEQ ID NO: 3680754 - DNA, 14 bp, Homo sapiens
tccatttctactgt

SEQ ID NO: 3680755 - DNA, 14 bp, Homo sapiens
tcccaagctgtgct

SEQ ID NO: 3680756 - DNA, 15 bp, Homo sapiens
tcccaagctgtgctg

SEQ ID NO: 3680757 - DNA, 16 bp, Homo sapiens
tcccaagctgtgctgg

SEQ ID NO: 3680758 - DNA, 16 bp, Homo sapiens
tcccaagtagaatctc

SEQ ID NO: 3680759 - DNA, 17 bp, Homo sapiens
tcccaagtagaatctca

SEQ ID NO: 3680760 - DNA, 17 bp, Homo sapiens
tcccaatttcagactcc

SEQ ID NO: 3680761 - DNA, 23 bp, Homo sapiens
tcccaatttcagactcccattcc

SEQ ID NO: 3680762 - DNA, 16 bp, Homo sapiens
tcccacaagtggtggt

SEQ ID NO: 3680763 - DNA, 16 bp, Homo sapiens
tcccacagccctgaga

SEQ ID NO: 3680764 - DNA, 19 bp, Homo sapiens
tcccacccccttctctgct

SEQ ID NO: 3680765 - DNA, 11 bp, Homo sapiens
tcccaggaccc

SEQ ID NO: 3680766 - DNA, 14 bp, Homo sapiens
tcccaggaccctga

SEQ ID NO: 3680767 - DNA, 19 bp, Homo sapiens
tcccaggaccctgaagggg

SEQ ID NO: 3680768 - DNA, 17 bp, Homo sapiens
tcccaggatcagcagaa

SEQ ID NO: 3680769 - DNA, 15 bp, Homo sapiens
tcccaggcagggaga

SEQ ID NO: 3680770 - DNA, 16 bp, Homo sapiens
tcccaggctggagagc

SEQ ID NO: 3680771 - DNA, 22 bp, Homo sapiens
tcccaggctggagagcactgcc

SEQ ID NO: 3680772 - DNA, 16 bp, Homo sapiens
tcccaggtgcatttct

SEQ ID NO: 3680773 - DNA, 16 bp, Homo sapiens
tcccagttcttcctgc

SEQ ID NO: 3680774 - DNA, 20 bp, Homo sapiens
tcccagttcttcctgcaacc

SEQ ID NO: 3680775 - DNA, 15 bp, Homo sapiens
tcccataagctatag

SEQ ID NO: 3680776 - DNA, 22 bp, Homo sapiens
tcccataattgctttgccaaaa

SEQ ID NO: 3680777 - DNA, 17 bp, Homo sapiens
tcccatccagctaccac

SEQ ID NO: 3680778 - DNA, 16 bp, Homo sapiens
tcccatgatccctgtg

SEQ ID NO: 3680779 - DNA, 14 bp, Homo sapiens
tcccattcctgaag

SEQ ID NO: 3680780 - DNA, 17 bp, Homo sapiens
tcccattggctttctct

SEQ ID NO: 3680781 - DNA, 17 bp, Homo sapiens
tcccattgtccctctgc

SEQ ID NO: 3680782 - DNA, 15 bp, Homo sapiens
tccccaacccgtgcc

SEQ ID NO: 3680783 - DNA, 22 bp, Homo sapiens
tccccaaccgtgtctgtctggc

SEQ ID NO: 3680784 - DNA, 14 bp, Homo sapiens
tccccacctccagg

SEQ ID NO: 3680785 - DNA, 22 bp, Homo sapiens
tccccacctgcactccatccag

SEQ ID NO: 3680786 - DNA, 15 bp, Homo sapiens
tccccactgtatcta

SEQ ID NO: 3680787 - DNA, 13 bp, Homo sapiens
tccccagcccaga

SEQ ID NO: 3680788 - DNA, 16 bp, Homo sapiens
tccccagcccagagac

SEQ ID NO: 3680789 - DNA, 20 bp, Homo sapiens
tccccaggccccaggaagcc

SEQ ID NO: 3680790 - DNA, 21 bp, Homo sapiens
tccccaggccccaggaagccg

SEQ ID NO: 3680791 - DNA, 15 bp, Homo sapiens
tccccaggtccagct

SEQ ID NO: 3680792 - DNA, 17 bp, Homo sapiens
tccccaggtccagctct

SEQ ID NO: 3680793 - DNA, 13 bp, Homo sapiens
tccccatctcagg

SEQ ID NO: 3680794 - DNA, 12 bp, Homo sapiens
tccccccactct

SEQ ID NO: 3680795 - DNA, 15 bp, Homo sapiens
tccccccatcttgct

SEQ ID NO: 3680796 - DNA, 22 bp, Homo sapiens
tccccccatcttgcttccctaa

SEQ ID NO: 3680797 - DNA, 13 bp, Homo sapiens
tcccccccatgca

SEQ ID NO: 3680798 - DNA, 16 bp, Homo sapiens
tccccgctgctgtgca

SEQ ID NO: 3680799 - DNA, 17 bp, Homo sapiens
tccccgctgctgtgcaa

SEQ ID NO: 3680800 - DNA, 19 bp, Homo sapiens
tccccgtgtcctctccctg

SEQ ID NO: 3680801 - DNA, 22 bp, Homo sapiens
tccccgtgtcctctccctgcca

SEQ ID NO: 3680802 - DNA, 20 bp, Homo sapiens
tcccctcacgcaagtgccag

SEQ ID NO: 3680803 - DNA, 15 bp, Homo sapiens
tcccctccctggctc

SEQ ID NO: 3680804 - DNA, 20 bp, Homo sapiens
tcccctccgccaggcgagat

SEQ ID NO: 3680805 - DNA, 14 bp, Homo sapiens
tcccctgccaccag

SEQ ID NO: 3680806 - DNA, 19 bp, Homo sapiens
tcccctgccccttccttta

SEQ ID NO: 3680807 - DNA, 23 bp, Homo sapiens
tcccgaaccccaaggagggagat

SEQ ID NO: 3680808 - DNA, 19 bp, Homo sapiens
tcccgattcaccctgtcca

SEQ ID NO: 3680809 - DNA, 15 bp, Homo sapiens
tcccggctccagagc

SEQ ID NO: 3680810 - DNA, 12 bp, Homo sapiens
tcccgtccctcc

SEQ ID NO: 3680811 - DNA, 14 bp, Homo sapiens
tcccgtgttgcttc

SEQ ID NO: 3680812 - DNA, 18 bp, Homo sapiens
tccctaaaaacacagaca

SEQ ID NO: 3680813 - DNA, 23 bp, Homo sapiens
tccctaatctatggtcgggagac

SEQ ID NO: 3680814 - DNA, 13 bp, Homo sapiens
tccctaccacctc

SEQ ID NO: 3680815 - DNA, 19 bp, Homo sapiens
tccctaccccctaagagcc

SEQ ID NO: 3680816 - DNA, 20 bp, Homo sapiens
tccctaccccctaagagcca

SEQ ID NO: 3680817 - DNA, 15 bp, Homo sapiens
gcttcaggtccaggc

SEQ ID NO: 3680818 - DNA, 21 bp, Homo sapiens
gcttcaggtccaggctgtgtt

SEQ ID NO: 3680819 - DNA, 15 bp, Homo sapiens
gcttcattctccttg

SEQ ID NO: 3680820 - DNA, 22 bp, Homo sapiens
gcttccagattgacgacaagtg

SEQ ID NO: 3680821 - DNA, 18 bp, Homo sapiens
gcttcccctctctcctcc

SEQ ID NO: 3680822 - DNA, 18 bp, Homo sapiens
gcttccccttttgccaat

SEQ ID NO: 3680823 - DNA, 13 bp, Homo sapiens
gcttccctaatct

SEQ ID NO: 3680824 - DNA, 13 bp, Homo sapiens
gcttccctgcagc

SEQ ID NO: 3680825 - DNA, 20 bp, Homo sapiens
gcttcctcccaacaagcagc

SEQ ID NO: 3680826 - DNA, 15 bp, Homo sapiens
gcttctccctgggga

SEQ ID NO: 3680827 - DNA, 23 bp, Homo sapiens
gcttctcctgaccagggcaaggc

SEQ ID NO: 3680828 - DNA, 15 bp, Homo sapiens
gcttctcctgcgggg

SEQ ID NO: 3680829 - DNA, 23 bp, Homo sapiens
gcttctcctgcgggggcgaggcc

SEQ ID NO: 3680830 - DNA, 21 bp, Homo sapiens
gcttctctgggaccaggctcc

SEQ ID NO: 3680831 - DNA, 20 bp, Homo sapiens
gcttctggaatttgttcaag

SEQ ID NO: 3680832 - DNA, 14 bp, Homo sapiens
gcttctggccagga

SEQ ID NO: 3680833 - DNA, 14 bp, Homo sapiens
gcttcttcctggat

SEQ ID NO: 3680834 - DNA, 16 bp, Homo sapiens
gcttcttcctggatgg

SEQ ID NO: 3680835 - DNA, 14 bp, Homo sapiens
gcttcttgcctctg

SEQ ID NO: 3680836 - DNA, 15 bp, Homo sapiens
gcttcttgcctctgt

SEQ ID NO: 3680837 - DNA, 20 bp, Homo sapiens
gcttcttgcctctgtgctgt

SEQ ID NO: 3680838 - DNA, 21 bp, Homo sapiens
gcttcttgcctctgtgctgtg

SEQ ID NO: 3680839 - DNA, 14 bp, Homo sapiens
gcttgacctgaggc

SEQ ID NO: 3680840 - DNA, 20 bp, Homo sapiens
gcttgatgggattctggaca

SEQ ID NO: 3680841 - DNA, 22 bp, Homo sapiens
gcttgcccaggagcaagtgagg

SEQ ID NO: 3680842 - DNA, 22 bp, Homo sapiens
gcttgcctgcagggccatggct

SEQ ID NO: 3680843 - DNA, 18 bp, Homo sapiens
gcttggaaactggatgag

SEQ ID NO: 3680844 - DNA, 22 bp, Homo sapiens
gcttgtaggtatgtctgtgcca

SEQ ID NO: 3680845 - DNA, 19 bp, Homo sapiens
gcttgtttgctcacctggg

SEQ ID NO: 3680846 - DNA, 15 bp, Homo sapiens
gctttcagaagtgcc

SEQ ID NO: 3680847 - DNA, 18 bp, Homo sapiens
gctttcagggaggccctg

SEQ ID NO: 3680848 - DNA, 22 bp, Homo sapiens
gctttcccacttcccaccctgc

SEQ ID NO: 3680849 - DNA, 14 bp, Homo sapiens
gctttcctgcccca

SEQ ID NO: 3680850 - DNA, 17 bp, Homo sapiens
gctttcctgccccaggc

SEQ ID NO: 3680851 - DNA, 14 bp, Homo sapiens
gctttcctggagcc

SEQ ID NO: 3680852 - DNA, 15 bp, Homo sapiens
gctttcctggagcca

SEQ ID NO: 3680853 - DNA, 16 bp, Homo sapiens
gctttctctccttggc

SEQ ID NO: 3680854 - DNA, 17 bp, Homo sapiens
gctttctgatcaaggcc

SEQ ID NO: 3680855 - DNA, 17 bp, Homo sapiens
gctttgcatttcttgtg

SEQ ID NO: 3680856 - DNA, 12 bp, Homo sapiens
gctttgccaaaa

SEQ ID NO: 3680857 - DNA, 18 bp, Homo sapiens
gctttgctgctgaaggct

SEQ ID NO: 3680858 - DNA, 22 bp, Homo sapiens
gctttggacctaaatggcctca

SEQ ID NO: 3680859 - DNA, 14 bp, Homo sapiens
gcttttacttaaac

SEQ ID NO: 3680860 - DNA, 21 bp, Homo sapiens
gcttttagtattttagtgaac

SEQ ID NO: 3680861 - DNA, 14 bp, Homo sapiens
gcttttccttgggg

SEQ ID NO: 3680862 - DNA, 21 bp, Homo sapiens
gcttttccttggggcaggcag

SEQ ID NO: 3680863 - DNA, 20 bp, Homo sapiens
gcttttgtctaattaaaaca

SEQ ID NO: 3680864 - DNA, 16 bp, Homo sapiens
ggaaaaggctggtaca

SEQ ID NO: 3680865 - DNA, 15 bp, Homo sapiens
ggaaaatcagcctgc

SEQ ID NO: 3680866 - DNA, 20 bp, Homo sapiens
ggaaaatgcagcagggatgc

SEQ ID NO: 3680867 - DNA, 18 bp, Homo sapiens
ggaaactcacactcccct

SEQ ID NO: 3680868 - DNA, 20 bp, Homo sapiens
ggaaagcctgaagggcctcc

SEQ ID NO: 3680869 - DNA, 20 bp, Homo sapiens
ggaaaggccagctggcagca

SEQ ID NO: 3680870 - DNA, 22 bp, Homo sapiens
ggaaaggccagctggcagcaga

SEQ ID NO: 3680871 - DNA, 20 bp, Homo sapiens
ggaaaggggtcggctgacca

SEQ ID NO: 3680872 - DNA, 16 bp, Homo sapiens
ggaaaggtggtgtttc

SEQ ID NO: 3680873 - DNA, 15 bp, Homo sapiens
ggaacaaattatttt

SEQ ID NO: 3680874 - DNA, 20 bp, Homo sapiens
ggaacactagacaagccaga

SEQ ID NO: 3680875 - DNA, 13 bp, Homo sapiens
ggaacactataga

SEQ ID NO: 3680876 - DNA, 18 bp, Homo sapiens
ggaacatgcataagaaat

SEQ ID NO: 3680877 - DNA, 13 bp, Homo sapiens
ggaaccgccctcc

SEQ ID NO: 3680878 - DNA, 13 bp, Homo sapiens
ggaacctcagcct

SEQ ID NO: 3680879 - DNA, 14 bp, Homo sapiens
ggaacctcagcctg

SEQ ID NO: 3680880 - DNA, 19 bp, Homo sapiens
ggaacctcagcctggccag

SEQ ID NO: 3680881 - DNA, 20 bp, Homo sapiens
ggaacctcagcctggccaga

SEQ ID NO: 3680882 - DNA, 15 bp, Homo sapiens
ggaacctgcaaaaaa

SEQ ID NO: 3680883 - DNA, 16 bp, Homo sapiens
ggaacctgcaaaaaat

SEQ ID NO: 3680884 - DNA, 21 bp, Homo sapiens
ggaacctggaccccagccttg

SEQ ID NO: 3680885 - DNA, 16 bp, Homo sapiens
ggaactcagatccagg

SEQ ID NO: 3680886 - DNA, 11 bp, Homo sapiens
ggaagaaaaag

SEQ ID NO: 3680887 - DNA, 14 bp, Homo sapiens
ggaagaaaaagcaa

SEQ ID NO: 3680888 - DNA, 14 bp, Homo sapiens
ggaagacaatgtga

SEQ ID NO: 3680889 - DNA, 19 bp, Homo sapiens
ggaagacacttgctgagtg

SEQ ID NO: 3680890 - DNA, 12 bp, Homo sapiens
ggaagacagaga

SEQ ID NO: 3680891 - DNA, 13 bp, Homo sapiens
ggaagagaaaaaa

SEQ ID NO: 3680892 - DNA, 15 bp, Homo sapiens
ggaagagaaaaaata

SEQ ID NO: 3680893 - DNA, 18 bp, Homo sapiens
ggaagaggaaaaggctgg

SEQ ID NO: 3680894 - DNA, 15 bp, Homo sapiens
ggaagagggacagat

SEQ ID NO: 3680895 - DNA, 12 bp, Homo sapiens
ggaagatcctgc

SEQ ID NO: 3680896 - DNA, 14 bp, Homo sapiens
ggaagcagggaatt

SEQ ID NO: 3680897 - DNA, 22 bp, Homo sapiens
ggaagccaaaatgtaggcttag

SEQ ID NO: 3680898 - DNA, 20 bp, Homo sapiens
ggaagcccctgagtcctgag

SEQ ID NO: 3680899 - DNA, 22 bp, Homo sapiens
ggaagcgtgaaggccgagaagc

SEQ ID NO: 3680900 - DNA, 18 bp, Homo sapiens
ggaagctggccgagggtc

SEQ ID NO: 3680901 - DNA, 16 bp, Homo sapiens
ggaaggagagcctgct

SEQ ID NO: 3680902 - DNA, 19 bp, Homo sapiens
ggaaggcttgttgtgcttt

SEQ ID NO: 3680903 - DNA, 21 bp, Homo sapiens
ggaagggcaggaaggagagcc

SEQ ID NO: 3680904 - DNA, 15 bp, Homo sapiens
ggaaggggtgctgtg

SEQ ID NO: 3680905 - DNA, 17 bp, Homo sapiens
ggaaggggtgctgtgag

SEQ ID NO: 3680906 - DNA, 18 bp, Homo sapiens
ggaagtccccaggcccca

SEQ ID NO: 3680907 - DNA, 23 bp, Homo sapiens
ggaatcccggctccagagcagga

SEQ ID NO: 3680908 - DNA, 12 bp, Homo sapiens
ggaatgaatggg

SEQ ID NO: 3680909 - DNA, 16 bp, Homo sapiens
ggaatttcccaggacc

SEQ ID NO: 3680910 - DNA, 17 bp, Homo sapiens
ggaatttcccaggaccc

SEQ ID NO: 3680911 - DNA, 19 bp, Homo sapiens
ggaatttcccaggaccctg

SEQ ID NO: 3680912 - DNA, 21 bp, Homo sapiens
ggaatttgttcaagttttggg

SEQ ID NO: 3680913 - DNA, 13 bp, Homo sapiens
ggacaaagaacct

SEQ ID NO: 3680914 - DNA, 16 bp, Homo sapiens
ggacaacgaggaagcc

SEQ ID NO: 3680915 - DNA, 22 bp, Homo sapiens
ggacactcaaaagctgggcagg

SEQ ID NO: 3680916 - DNA, 14 bp, Homo sapiens
ggacagaagaaggc

SEQ ID NO: 3680917 - DNA, 14 bp, Homo sapiens
ggacagaggcccca

SEQ ID NO: 3680918 - DNA, 23 bp, Homo sapiens
ggacagaggccccagcctccctg

SEQ ID NO: 3680919 - DNA, 22 bp, Homo sapiens
ggacagaggcggggctacagat

SEQ ID NO: 3680920 - DNA, 15 bp, Homo sapiens
ggacagccccaccct

SEQ ID NO: 3680921 - DNA, 12 bp, Homo sapiens
ggacagggcttc

SEQ ID NO: 3680922 - DNA, 13 bp, Homo sapiens
ggacatcctcctc

SEQ ID NO: 3680923 - DNA, 18 bp, Homo sapiens
ggacatttccaagctgtt

SEQ ID NO: 3680924 - DNA, 20 bp, Homo sapiens
ggaccacaactattttcaga

SEQ ID NO: 3680925 - DNA, 16 bp, Homo sapiens
ggaccagctcaggaca

SEQ ID NO: 3680926 - DNA, 18 bp, Homo sapiens
ggaccagctcaggacaga

SEQ ID NO: 3680927 - DNA, 15 bp, Homo sapiens
ggaccaggctccaat

SEQ ID NO: 3680928 - DNA, 17 bp, Homo sapiens
ggacccaccactggaag

SEQ ID NO: 3680929 - DNA, 13 bp, Homo sapiens
ggacccagtgcag

SEQ ID NO: 3680930 - DNA, 16 bp, Homo sapiens
ggacccagtgcagaat

SEQ ID NO: 3680931 - DNA, 16 bp, Homo sapiens
ggaccccagccttggt

SEQ ID NO: 3680932 - DNA, 22 bp, Homo sapiens
ggacctttccaccacagccagc

SEQ ID NO: 3680933 - DNA, 14 bp, Homo sapiens
ggacggcggcagta

SEQ ID NO: 3680934 - DNA, 21 bp, Homo sapiens
ggacggggcgggccctgcctg

SEQ ID NO: 3680935 - DNA, 19 bp, Homo sapiens
ggacggggctcccctggac

SEQ ID NO: 3680936 - DNA, 15 bp, Homo sapiens
gcgggtcctagctgt

SEQ ID NO: 3680937 - DNA, 22 bp, Homo sapiens
gcgggtgggactcttccctggg

SEQ ID NO: 3680938 - DNA, 19 bp, Homo sapiens
gcggtcccctccgccaggc

SEQ ID NO: 3680939 - DNA, 17 bp, Homo sapiens
gcggtgcttgatagaaa

SEQ ID NO: 3680940 - DNA, 18 bp, Homo sapiens
gcgtagctctcaaatgtg

SEQ ID NO: 3680941 - DNA, 16 bp, Homo sapiens
gcgtctgttccccctt

SEQ ID NO: 3680942 - DNA, 14 bp, Homo sapiens
gcgtcttcctgagt

SEQ ID NO: 3680943 - DNA, 14 bp, Homo sapiens
gcgtgccgagccag

SEQ ID NO: 3680944 - DNA, 15 bp, Homo sapiens
gcgtgccgtggcacc

SEQ ID NO: 3680945 - DNA, 16 bp, Homo sapiens
gcgtggagggaggccc

SEQ ID NO: 3680946 - DNA, 15 bp, Homo sapiens
gcgtggcccaaggct

SEQ ID NO: 3680947 - DNA, 19 bp, Homo sapiens
gcgtggctctgggtgggcg

SEQ ID NO: 3680948 - DNA, 17 bp, Homo sapiens
gcgtggcttctgcagga

SEQ ID NO: 3680949 - DNA, 16 bp, Homo sapiens
gctaaatgtgaatgat

SEQ ID NO: 3680950 - DNA, 14 bp, Homo sapiens
gctaacagtgaaga

SEQ ID NO: 3680951 - DNA, 21 bp, Homo sapiens
gctaactagcttggaaactgg

SEQ ID NO: 3680952 - DNA, 16 bp, Homo sapiens
gctaactgtaaatcat

SEQ ID NO: 3680953 - DNA, 23 bp, Homo sapiens
gctaagaacctggaacttgggga

SEQ ID NO: 3680954 - DNA, 19 bp, Homo sapiens
gctaagagtgtcctaggag

SEQ ID NO: 3680955 - DNA, 15 bp, Homo sapiens
gctaatttaaagaga

SEQ ID NO: 3680956 - DNA, 21 bp, Homo sapiens
gctacaggaagcaccccatgc

SEQ ID NO: 3680957 - DNA, 20 bp, Homo sapiens
gctagaggaaccaaccccca

SEQ ID NO: 3680958 - DNA, 18 bp, Homo sapiens
gctagaggccagccccac

SEQ ID NO: 3680959 - DNA, 19 bp, Homo sapiens
gctagaggccagccccacc

SEQ ID NO: 3680960 - DNA, 21 bp, Homo sapiens
gctagaggccagccccaccca

SEQ ID NO: 3680961 - DNA, 23 bp, Homo sapiens
gctagcagaaatctagaagactg

SEQ ID NO: 3680962 - DNA, 18 bp, Homo sapiens
gctagtcaagctcctcct

SEQ ID NO: 3680963 - DNA, 23 bp, Homo sapiens
gctagtcaagctcctcctccctg

SEQ ID NO: 3680964 - DNA, 19 bp, Homo sapiens
gctagtcttgaatttctga

SEQ ID NO: 3680965 - DNA, 17 bp, Homo sapiens
gctatagcctggggtgg

SEQ ID NO: 3680966 - DNA, 18 bp, Homo sapiens
gctatagctacaggaagc

SEQ ID NO: 3680967 - DNA, 14 bp, Homo sapiens
gctatagtatttga

SEQ ID NO: 3680968 - DNA, 20 bp, Homo sapiens
gctatagtatttgattcaaa

SEQ ID NO: 3680969 - DNA, 13 bp, Homo sapiens
gctatatccactg

SEQ ID NO: 3680970 - DNA, 19 bp, Homo sapiens
gctatccagctatttttat

SEQ ID NO: 3680971 - DNA, 20 bp, Homo sapiens
gctatgcaaaaaattcttta

SEQ ID NO: 3680972 - DNA, 21 bp, Homo sapiens
gctatgggagccccagggtct

SEQ ID NO: 3680973 - DNA, 18 bp, Homo sapiens
gctatggtgctctgtcta

SEQ ID NO: 3680974 - DNA, 19 bp, Homo sapiens
gctattggaggatcagttt

SEQ ID NO: 3680975 - DNA, 18 bp, Homo sapiens
gctatttatgggcccctg

SEQ ID NO: 3680976 - DNA, 15 bp, Homo sapiens
gctatttttgtaaag

SEQ ID NO: 3680977 - DNA, 12 bp, Homo sapiens
gctcaaaggcac

SEQ ID NO: 3680978 - DNA, 21 bp, Homo sapiens
gctcaaaggcacagtgaaggc

SEQ ID NO: 3680979 - DNA, 11 bp, Homo sapiens
gctcacctggg

SEQ ID NO: 3680980 - DNA, 15 bp, Homo sapiens
gctcagctgcgcccc

SEQ ID NO: 3680981 - DNA, 18 bp, Homo sapiens
gctcagctgcgccccctt

SEQ ID NO: 3680982 - DNA, 20 bp, Homo sapiens
gctcagctgcgcccccttct

SEQ ID NO: 3680983 - DNA, 23 bp, Homo sapiens
gctcagggccatgctgaggcctg

SEQ ID NO: 3680984 - DNA, 12 bp, Homo sapiens
gctcagggtggt

SEQ ID NO: 3680985 - DNA, 15 bp, Homo sapiens
gctcatctgctggtc

SEQ ID NO: 3680986 - DNA, 21 bp, Homo sapiens
gctcatctgctggtccgtggg

SEQ ID NO: 3680987 - DNA, 23 bp, Homo sapiens
gctcatctgctggtccgtgggac

SEQ ID NO: 3680988 - DNA, 17 bp, Homo sapiens
gctcatgtgtgcaacag

SEQ ID NO: 3680989 - DNA, 21 bp, Homo sapiens
gctccaacctgcaaagatctg

SEQ ID NO: 3680990 - DNA, 18 bp, Homo sapiens
gctccaatggggcggggc

SEQ ID NO: 3680991 - DNA, 23 bp, Homo sapiens
gctccaatggggcggggcttctc

SEQ ID NO: 3680992 - DNA, 12 bp, Homo sapiens
gctccaccacat

SEQ ID NO: 3680993 - DNA, 11 bp, Homo sapiens
gctccaccctt

SEQ ID NO: 3680994 - DNA, 14 bp, Homo sapiens
gctccacccttggc

SEQ ID NO: 3680995 - DNA, 23 bp, Homo sapiens
gctccacccttggcctgtctcat

SEQ ID NO: 3680996 - DNA, 13 bp, Homo sapiens
gctccactctgct

SEQ ID NO: 3680997 - DNA, 21 bp, Homo sapiens
gctccactctgcttctctgac

SEQ ID NO: 3680998 - DNA, 23 bp, Homo sapiens
gctccactctgcttctctgactt

SEQ ID NO: 3680999 - DNA, 12 bp, Homo sapiens
gctccagacctg

SEQ ID NO: 3681000 - DNA, 13 bp, Homo sapiens
gctccagacctga

SEQ ID NO: 3681001 - DNA, 22 bp, Homo sapiens
gctccagacctgatcctggagg

SEQ ID NO: 3681002 - DNA, 20 bp, Homo sapiens
gctccagctgttcagctggt

SEQ ID NO: 3681003 - DNA, 17 bp, Homo sapiens
gctccagctttctgcca

SEQ ID NO: 3681004 - DNA, 16 bp, Homo sapiens
gctccaggatctttga

SEQ ID NO: 3681005 - DNA, 14 bp, Homo sapiens
gctccaggcgcgcc

SEQ ID NO: 3681006 - DNA, 20 bp, Homo sapiens
gctccatttcaattgctttg

SEQ ID NO: 3681007 - DNA, 22 bp, Homo sapiens
gctcccagggacacctgggaga

SEQ ID NO: 3681008 - DNA, 17 bp, Homo sapiens
gctccctcccctgccct

SEQ ID NO: 3681009 - DNA, 18 bp, Homo sapiens
gctccctgagggcggagc

SEQ ID NO: 3681010 - DNA, 13 bp, Homo sapiens
gctcctacctggg

SEQ ID NO: 3681011 - DNA, 20 bp, Homo sapiens
gctcctacctgggggcagaa

SEQ ID NO: 3681012 - DNA, 21 bp, Homo sapiens
gctcctacctgggggcagaac

SEQ ID NO: 3681013 - DNA, 19 bp, Homo sapiens
gctcctagagggaggggcc

SEQ ID NO: 3681014 - DNA, 16 bp, Homo sapiens
gctcctccctggagct

SEQ ID NO: 3681015 - DNA, 16 bp, Homo sapiens
gctcctctccccagcc

SEQ ID NO: 3681016 - DNA, 19 bp, Homo sapiens
gctcctctccccagcccag

SEQ ID NO: 3681017 - DNA, 18 bp, Homo sapiens
gctcctgaggggcatctg

SEQ ID NO: 3681018 - DNA, 23 bp, Homo sapiens
gctcctgaggggcatctgcccct

SEQ ID NO: 3681019 - DNA, 20 bp, Homo sapiens
gctcctggcccactgcatcg

SEQ ID NO: 3681020 - DNA, 13 bp, Homo sapiens
gctcctgtggccc

SEQ ID NO: 3681021 - DNA, 21 bp, Homo sapiens
gctcctgtggtagtcctccca

SEQ ID NO: 3681022 - DNA, 13 bp, Homo sapiens
gctccttcctgtg

SEQ ID NO: 3681023 - DNA, 14 bp, Homo sapiens
gctccttcctgtgg

SEQ ID NO: 3681024 - DNA, 22 bp, Homo sapiens
gctccttcctgtgggtggggct

SEQ ID NO: 3681025 - DNA, 14 bp, Homo sapiens
gctccttgggaggc

SEQ ID NO: 3681026 - DNA, 15 bp, Homo sapiens
gctctaggatggggc

SEQ ID NO: 3681027 - DNA, 19 bp, Homo sapiens
gctctatcgcccaggctgg

SEQ ID NO: 3681028 - DNA, 18 bp, Homo sapiens
gctctcaagttatcaggg

SEQ ID NO: 3681029 - DNA, 14 bp, Homo sapiens
gctctcctgacttt

SEQ ID NO: 3681030 - DNA, 17 bp, Homo sapiens
gctctgcgttggcttct

SEQ ID NO: 3681031 - DNA, 16 bp, Homo sapiens
gctctggacagcccca

SEQ ID NO: 3681032 - DNA, 22 bp, Homo sapiens
gctctggacagccccaccctgg

SEQ ID NO: 3681033 - DNA, 13 bp, Homo sapiens
gctctggagggga

SEQ ID NO: 3681034 - DNA, 13 bp, Homo sapiens
gctctgggtgggc

SEQ ID NO: 3681035 - DNA, 17 bp, Homo sapiens
gctctggtggccactga

SEQ ID NO: 3681036 - DNA, 20 bp, Homo sapiens
gctctggtggccactgagct

SEQ ID NO: 3681037 - DNA, 24 bp, Homo sapiens
gctctggtggccactgagctggct

SEQ ID NO: 3681038 - DNA, 13 bp, Homo sapiens
gctctgtctactt

SEQ ID NO: 3681039 - DNA, 21 bp, Homo sapiens
gctctgtctacttgctcaggt

SEQ ID NO: 3681040 - DNA, 17 bp, Homo sapiens
gctctgtgggccctacc

SEQ ID NO: 3681041 - DNA, 19 bp, Homo sapiens
gctcttagcagcttccaga

SEQ ID NO: 3681042 - DNA, 15 bp, Homo sapiens
gctctttctctgcca

SEQ ID NO: 3681043 - DNA, 23 bp, Homo sapiens
gctctttgaaatagtctgtgtga

SEQ ID NO: 3681044 - DNA, 15 bp, Homo sapiens
gctgaaattctcctg

SEQ ID NO: 3681045 - DNA, 16 bp, Homo sapiens
gctgaaattctcctgg

SEQ ID NO: 3681046 - DNA, 13 bp, Homo sapiens
gctgaacagtgga

SEQ ID NO: 3681047 - DNA, 13 bp, Homo sapiens
gctgaacccaccc

SEQ ID NO: 3681048 - DNA, 14 bp, Homo sapiens
gctgaacccacccg

SEQ ID NO: 3681049 - DNA, 17 bp, Homo sapiens
gctgaattttctggaaa

SEQ ID NO: 3681050 - DNA, 17 bp, Homo sapiens
gctgacagctgctccta

SEQ ID NO: 3681051 - DNA, 18 bp, Homo sapiens
gctgacagctgctcctag

SEQ ID NO: 3681052 - DNA, 14 bp, Homo sapiens
gctgacctccacag

SEQ ID NO: 3681053 - DNA, 15 bp, Homo sapiens
gctgacggccaggga

SEQ ID NO: 3681054 - DNA, 18 bp, Homo sapiens
ggactatattgggactgg

SEQ ID NO: 3681055 - DNA, 20 bp, Homo sapiens
ggactatatttgggcctgct

SEQ ID NO: 3681056 - DNA, 13 bp, Homo sapiens
ggactcagccctg

SEQ ID NO: 3681057 - DNA, 16 bp, Homo sapiens
ggactcagccctgagg

SEQ ID NO: 3681058 - DNA, 15 bp, Homo sapiens
ggactcagccttcag

SEQ ID NO: 3681059 - DNA, 17 bp, Homo sapiens
ggactcagccttcagac

SEQ ID NO: 3681060 - DNA, 20 bp, Homo sapiens
ggactccctcctcacctctg

SEQ ID NO: 3681061 - DNA, 22 bp, Homo sapiens
ggactccctcctcacctctgga

SEQ ID NO: 3681062 - DNA, 18 bp, Homo sapiens
ggactcctccctgggggt

SEQ ID NO: 3681063 - DNA, 15 bp, Homo sapiens
ggactcttccctggg

SEQ ID NO: 3681064 - DNA, 16 bp, Homo sapiens
ggactcttccctggga

SEQ ID NO: 3681065 - DNA, 23 bp, Homo sapiens
ggactgaccaaatcacccaatcc

SEQ ID NO: 3681066 - DNA, 20 bp, Homo sapiens
ggactggctagagtcctcac

SEQ ID NO: 3681067 - DNA, 17 bp, Homo sapiens
ggactgggacttctggg

SEQ ID NO: 3681068 - DNA, 18 bp, Homo sapiens
ggactgtagggagggcgg

SEQ ID NO: 3681069 - DNA, 20 bp, Homo sapiens
ggactgtagggagggcggca

SEQ ID NO: 3681070 - DNA, 16 bp, Homo sapiens
ggactttgcagccggc

SEQ ID NO: 3681071 - DNA, 13 bp, Homo sapiens
ggagaagccagga

SEQ ID NO: 3681072 - DNA, 18 bp, Homo sapiens
ggagaagcccgtgtgaga

SEQ ID NO: 3681073 - DNA, 16 bp, Homo sapiens
ggagagaaaatatatg

SEQ ID NO: 3681074 - DNA, 17 bp, Homo sapiens
ggagagcactgccagga

SEQ ID NO: 3681075 - DNA, 22 bp, Homo sapiens
ggagagcgcctgcccctcccag

SEQ ID NO: 3681076 - DNA, 15 bp, Homo sapiens
ggagagctagcagca

SEQ ID NO: 3681077 - DNA, 17 bp, Homo sapiens
ggagagctagcagcagg

SEQ ID NO: 3681078 - DNA, 18 bp, Homo sapiens
ggagaggagttcaggaac

SEQ ID NO: 3681079 - DNA, 13 bp, Homo sapiens
ggagatcctcctg

SEQ ID NO: 3681080 - DNA, 15 bp, Homo sapiens
ggagatcctcctgca

SEQ ID NO: 3681081 - DNA, 14 bp, Homo sapiens
ggagattcagactg

SEQ ID NO: 3681082 - DNA, 14 bp, Homo sapiens
ggagcaagtgaggc

SEQ ID NO: 3681083 - DNA, 13 bp, Homo sapiens
ggagccagggctg

SEQ ID NO: 3681084 - DNA, 12 bp, Homo sapiens
ggagcccactgt

SEQ ID NO: 3681085 - DNA, 14 bp, Homo sapiens
ggagcccactgtcc

SEQ ID NO: 3681086 - DNA, 12 bp, Homo sapiens
ggagccccaggg

SEQ ID NO: 3681087 - DNA, 20 bp, Homo sapiens
ggagccccagggtcttccct

SEQ ID NO: 3681088 - DNA, 16 bp, Homo sapiens
ggagcggaaagcagct

SEQ ID NO: 3681089 - DNA, 17 bp, Homo sapiens
ggagctcttcaggcctc

SEQ ID NO: 3681090 - DNA, 22 bp, Homo sapiens
ggagctgcagttcttgtggaag

SEQ ID NO: 3681091 - DNA, 23 bp, Homo sapiens
ggagctgcagttcttgtggaaga

SEQ ID NO: 3681092 - DNA, 20 bp, Homo sapiens
ggagctgttctctgtcgtga

SEQ ID NO: 3681093 - DNA, 23 bp, Homo sapiens
ggaggatcacttgagtccagaag

SEQ ID NO: 3681094 - DNA, 20 bp, Homo sapiens
ggaggatcttttgaacccag

SEQ ID NO: 3681095 - DNA, 20 bp, Homo sapiens
ggaggcagaggttgcagtga

SEQ ID NO: 3681096 - DNA, 15 bp, Homo sapiens
ggaggccagaggaga

SEQ ID NO: 3681097 - DNA, 13 bp, Homo sapiens
ggaggccagccag

SEQ ID NO: 3681098 - DNA, 19 bp, Homo sapiens
ggaggcccagttcaccctg

SEQ ID NO: 3681099 - DNA, 23 bp, Homo sapiens
ggaggccctgtgccccttgacaa

SEQ ID NO: 3681100 - DNA, 18 bp, Homo sapiens
ggaggccgaggccatgtg

SEQ ID NO: 3681101 - DNA, 19 bp, Homo sapiens
ggaggcctgcgaccctggg

SEQ ID NO: 3681102 - DNA, 20 bp, Homo sapiens
ggaggcctgcgaccctgggg

SEQ ID NO: 3681103 - DNA, 21 bp, Homo sapiens
ggaggcctgcgaccctggggg

SEQ ID NO: 3681104 - DNA, 18 bp, Homo sapiens
ggaggcgtctcgggagag

SEQ ID NO: 3681105 - DNA, 14 bp, Homo sapiens
ggaggctcctgtgg

SEQ ID NO: 3681106 - DNA, 21 bp, Homo sapiens
ggaggctcctgtggtagtcct

SEQ ID NO: 3681107 - DNA, 13 bp, Homo sapiens
ggaggggaggggg

SEQ ID NO: 3681108 - DNA, 13 bp, Homo sapiens
ggaggggcctagg

SEQ ID NO: 3681109 - DNA, 15 bp, Homo sapiens
ggaggggcctaggcc

SEQ ID NO: 3681110 - DNA, 14 bp, Homo sapiens
ggaggtcgaggcag

SEQ ID NO: 3681111 - DNA, 18 bp, Homo sapiens
ggaggtgtggagccgagg

SEQ ID NO: 3681112 - DNA, 21 bp, Homo sapiens
ggaggttaaggctgaggaaag

SEQ ID NO: 3681113 - DNA, 12 bp, Homo sapiens
ggagtacccagc

SEQ ID NO: 3681114 - DNA, 14 bp, Homo sapiens
ggagtctgaagcag

SEQ ID NO: 3681115 - DNA, 20 bp, Homo sapiens
ggagtgtatgactgcacatg

SEQ ID NO: 3681116 - DNA, 22 bp, Homo sapiens
ggagttgatctggaacccagac

SEQ ID NO: 3681117 - DNA, 16 bp, Homo sapiens
ggagttttttgtacca

SEQ ID NO: 3681118 - DNA, 20 bp, Homo sapiens
ggatagatgctggcccaggg

SEQ ID NO: 3681119 - DNA, 18 bp, Homo sapiens
ggatagctaactgtaaat

SEQ ID NO: 3681120 - DNA, 19 bp, Homo sapiens
ggatagctaactgtaaatc

SEQ ID NO: 3681121 - DNA, 24 bp, Homo sapiens
ggatatgtattgggcagcagactg

SEQ ID NO: 3681122 - DNA, 16 bp, Homo sapiens
ggatcacagcctctga

SEQ ID NO: 3681123 - DNA, 12 bp, Homo sapiens
ggatcagttttt

SEQ ID NO: 3681124 - DNA, 19 bp, Homo sapiens
ggatccgactgctttggac

SEQ ID NO: 3681125 - DNA, 15 bp, Homo sapiens
ggatccgagggcccc

SEQ ID NO: 3681126 - DNA, 21 bp, Homo sapiens
ggatctccttgagatcctgat

SEQ ID NO: 3681127 - DNA, 18 bp, Homo sapiens
ggatctgaggagtggagg

SEQ ID NO: 3681128 - DNA, 16 bp, Homo sapiens
ggatctttgtggccaa

SEQ ID NO: 3681129 - DNA, 13 bp, Homo sapiens
ggatgcagcatta

SEQ ID NO: 3681130 - DNA, 18 bp, Homo sapiens
ggatgccctggaggtggc

SEQ ID NO: 3681131 - DNA, 16 bp, Homo sapiens
ggatgctccatttcaa

SEQ ID NO: 3681132 - DNA, 13 bp, Homo sapiens
ggatggccccagc

SEQ ID NO: 3681133 - DNA, 15 bp, Homo sapiens
ggatggttctgtgac

SEQ ID NO: 3681134 - DNA, 23 bp, Homo sapiens
ggatgttcagcactgtcccttgc

SEQ ID NO: 3681135 - DNA, 15 bp, Homo sapiens
ggattcaggctgctt

SEQ ID NO: 3681136 - DNA, 20 bp, Homo sapiens
ggattctcatgggaagggga

SEQ ID NO: 3681137 - DNA, 18 bp, Homo sapiens
ggattctggttccagggt

SEQ ID NO: 3681138 - DNA, 15 bp, Homo sapiens
ggattgcacgtggcc

SEQ ID NO: 3681139 - DNA, 17 bp, Homo sapiens
ggattgcacgtggcctc

SEQ ID NO: 3681140 - DNA, 15 bp, Homo sapiens
ggcaaaaaggcagga

SEQ ID NO: 3681141 - DNA, 10 bp, Homo sapiens
ggcaaaataa

SEQ ID NO: 3681142 - DNA, 18 bp, Homo sapiens
ggcaaattcttttgaatt

SEQ ID NO: 3681143 - DNA, 14 bp, Homo sapiens
ggcaacagatctgg

SEQ ID NO: 3681144 - DNA, 15 bp, Homo sapiens
ggcaacagatctgga

SEQ ID NO: 3681145 - DNA, 23 bp, Homo sapiens
ggcaacttgggaactagactccc

SEQ ID NO: 3681146 - DNA, 15 bp, Homo sapiens
ggcaaggccccttcc

SEQ ID NO: 3681147 - DNA, 14 bp, Homo sapiens
ggcaatttcctggc

SEQ ID NO: 3681148 - DNA, 23 bp, Homo sapiens
ggcacaagtcctggatgttgtgt

SEQ ID NO: 3681149 - DNA, 17 bp, Homo sapiens
ggcacaccgccatcctc

SEQ ID NO: 3681150 - DNA, 16 bp, Homo sapiens
ggcacaggaggcaggc

SEQ ID NO: 3681151 - DNA, 12 bp, Homo sapiens
ggcacagggtct

SEQ ID NO: 3681152 - DNA, 19 bp, Homo sapiens
ggcacagggtctgctcttt

SEQ ID NO: 3681153 - DNA, 19 bp, Homo sapiens
ggcaccagacacccaggac

SEQ ID NO: 3681154 - DNA, 16 bp, Homo sapiens
ggcaccagcagcctgg

SEQ ID NO: 3681155 - DNA, 13 bp, Homo sapiens
ggcaccagccagc

SEQ ID NO: 3681156 - DNA, 17 bp, Homo sapiens
ggcacctaatccaggca

SEQ ID NO: 3681157 - DNA, 18 bp, Homo sapiens
ggcacctaatccaggcag

SEQ ID NO: 3681158 - DNA, 19 bp, Homo sapiens
ggcacctaatccaggcaga

SEQ ID NO: 3681159 - DNA, 16 bp, Homo sapiens
ggcagaactcctacct

SEQ ID NO: 3681160 - DNA, 17 bp, Homo sapiens
ggcagaactcctacctg

SEQ ID NO: 3681161 - DNA, 18 bp, Homo sapiens
ggcagaactcctacctga

SEQ ID NO: 3681162 - DNA, 20 bp, Homo sapiens
ggcagactctttatgcttgc

SEQ ID NO: 3681163 - DNA, 14 bp, Homo sapiens
ggcagagaataaaa

SEQ ID NO: 3681164 - DNA, 21 bp, Homo sapiens
ggcagaggttgcagtgagccg

SEQ ID NO: 3681165 - DNA, 14 bp, Homo sapiens
ggcagatccaggac

SEQ ID NO: 3681166 - DNA, 18 bp, Homo sapiens
ggcagatctgtgccccat

SEQ ID NO: 3681167 - DNA, 14 bp, Homo sapiens
ggcagcacagagac

SEQ ID NO: 3681168 - DNA, 20 bp, Homo sapiens
ggcagcagactgtgtttcgt

SEQ ID NO: 3681169 - DNA, 20 bp, Homo sapiens
ggcagcgtgccgagccagca

SEQ ID NO: 3681170 - DNA, 12 bp, Homo sapiens
ggcagctggcag

SEQ ID NO: 3681171 - DNA, 13 bp, Homo sapiens
ggcagctgtgtct

SEQ ID NO: 3681172 - DNA, 12 bp, Homo sapiens
ggcaggctggcc

SEQ ID NO: 3681173 - DNA, 12 bp, Homo sapiens
ggcagggctcct

SEQ ID NO: 3681174 - DNA, 17 bp, Homo sapiens
ggcagggctcctccctg

SEQ ID NO: 3681175 - DNA, 18 bp, Homo sapiens
ggcagggctcctccctgg

SEQ ID NO: 3681176 - DNA, 15 bp, Homo sapiens
ggcagggctgactct

SEQ ID NO: 3681177 - DNA, 14 bp, Homo sapiens
ggcaggggacagga

SEQ ID NO: 3681178 - DNA, 15 bp, Homo sapiens
ggcaggttggtgggg

SEQ ID NO: 3681179 - DNA, 17 bp, Homo sapiens
ggcagtactcctccctg

SEQ ID NO: 3681180 - DNA, 22 bp, Homo sapiens
ggcagtactcctccctgggggc

SEQ ID NO: 3681181 - DNA, 18 bp, Homo sapiens
ggcagtgatgctggatgc

SEQ ID NO: 3681182 - DNA, 12 bp, Homo sapiens
ggcagtggaggt

SEQ ID NO: 3681183 - DNA, 15 bp, Homo sapiens
ggcagttctgggtgc

SEQ ID NO: 3681184 - DNA, 19 bp, Homo sapiens
ggcataggtctctttgctt

SEQ ID NO: 3681185 - DNA, 17 bp, Homo sapiens
ggcatcaaccccccgac

SEQ ID NO: 3681186 - DNA, 19 bp, Homo sapiens
ggcatcagtttaggccttg

SEQ ID NO: 3681187 - DNA, 16 bp, Homo sapiens
ggcatctgcccctccc

SEQ ID NO: 3681188 - DNA, 16 bp, Homo sapiens
ggcatctttgccttgg

SEQ ID NO: 3681189 - DNA, 22 bp, Homo sapiens
ggcatctttgccttgggctgct

SEQ ID NO: 3681190 - DNA, 23 bp, Homo sapiens
ggcatctttgccttgggctgctc

SEQ ID NO: 3681191 - DNA, 16 bp, Homo sapiens
ggcatggccctgggcg

SEQ ID NO: 3681192 - DNA, 23 bp, Homo sapiens
ggcatgttagcccttcctccaat

SEQ ID NO: 3681193 - DNA, 22 bp, Homo sapiens
ggccaaccctcctccaatggaa

SEQ ID NO: 3681194 - DNA, 16 bp, Homo sapiens
ggccacctccccagca

SEQ ID NO: 3681195 - DNA, 21 bp, Homo sapiens
ggccactaagcagaggagggg

SEQ ID NO: 3681196 - DNA, 13 bp, Homo sapiens
ggccactgagctg

SEQ ID NO: 3681197 - DNA, 14 bp, Homo sapiens
ggccactgagctgg

SEQ ID NO: 3681198 - DNA, 16 bp, Homo sapiens
ggccactgagctggct

SEQ ID NO: 3681199 - DNA, 15 bp, Homo sapiens
ggccacttttgacta

SEQ ID NO: 3681200 - DNA, 15 bp, Homo sapiens
ggccagacatgccac

SEQ ID NO: 3681201 - DNA, 11 bp, Homo sapiens
ggccagagcca

SEQ ID NO: 3681202 - DNA, 18 bp, Homo sapiens
ggccagaggcccccagcc

SEQ ID NO: 3681203 - DNA, 14 bp, Homo sapiens
ggccagagtggcct

SEQ ID NO: 3681204 - DNA, 19 bp, Homo sapiens
ggccagagtggcctggcca

SEQ ID NO: 3681205 - DNA, 20 bp, Homo sapiens
ggccagagtggcctggccag

SEQ ID NO: 3681206 - DNA, 12 bp, Homo sapiens
ggccagatccag

SEQ ID NO: 3681207 - DNA, 15 bp, Homo sapiens
ggccagccatgtctg

SEQ ID NO: 3681208 - DNA, 16 bp, Homo sapiens
ggccagccccacccag

SEQ ID NO: 3681209 - DNA, 20 bp, Homo sapiens
ggccagccccacccaggagg

SEQ ID NO: 3681210 - DNA, 11 bp, Homo sapiens
ggccagcctgg

SEQ ID NO: 3681211 - DNA, 14 bp, Homo sapiens
ggccagcctggcat

SEQ ID NO: 3681212 - DNA, 15 bp, Homo sapiens
ggccagcctggcatc

SEQ ID NO: 3681213 - DNA, 14 bp, Homo sapiens
ggccagctggcagc

SEQ ID NO: 3681214 - DNA, 16 bp, Homo sapiens
ggccagctggcagcag

SEQ ID NO: 3681215 - DNA, 17 bp, Homo sapiens
ggccagctggcagcaga

SEQ ID NO: 3681216 - DNA, 18 bp, Homo sapiens
ggccagctggcagcagag

SEQ ID NO: 3681217 - DNA, 22 bp, Homo sapiens
ggccaggcggggcgccccaaga

SEQ ID NO: 3681218 - DNA, 17 bp, Homo sapiens
ggccagggagaagctcc

SEQ ID NO: 3681219 - DNA, 18 bp, Homo sapiens
ggccagggagaagctcct

SEQ ID NO: 3681220 - DNA, 21 bp, Homo sapiens
ggccagtccaggctgccgtgg

SEQ ID NO: 3681221 - DNA, 16 bp, Homo sapiens
ggccagtcctgcctgg

SEQ ID NO: 3681222 - DNA, 12 bp, Homo sapiens
ggccagtcctgg

SEQ ID NO: 3681223 - DNA, 13 bp, Homo sapiens
ggccagtgctcca

SEQ ID NO: 3681224 - DNA, 14 bp, Homo sapiens
ggccatcccacaag

SEQ ID NO: 3681225 - DNA, 22 bp, Homo sapiens
ggccatgatggcaacagatctg

SEQ ID NO: 3681226 - DNA, 12 bp, Homo sapiens
ggcccagagccc

SEQ ID NO: 3681227 - DNA, 19 bp, Homo sapiens
ggcccagagcccagctcca

SEQ ID NO: 3681228 - DNA, 22 bp, Homo sapiens
ggcccagatctggtcccttgca

SEQ ID NO: 3681229 - DNA, 14 bp, Homo sapiens
ggcccagggcccag

SEQ ID NO: 3681230 - DNA, 21 bp, Homo sapiens
ggcccagggcccagagcccag

SEQ ID NO: 3681231 - DNA, 15 bp, Homo sapiens
ggcccatatccctgg

SEQ ID NO: 3681232 - DNA, 12 bp, Homo sapiens
ggccccactggg

SEQ ID NO: 3681233 - DNA, 18 bp, Homo sapiens
ggccccagcacagcttga

SEQ ID NO: 3681234 - DNA, 13 bp, Homo sapiens
ggccccaggaagc

SEQ ID NO: 3681235 - DNA, 14 bp, Homo sapiens
ggcccccagcccag

SEQ ID NO: 3681236 - DNA, 18 bp, Homo sapiens
ggccccgtttctggtggt

SEQ ID NO: 3681237 - DNA, 19 bp, Homo sapiens
ggcccctcaccctgcctta

SEQ ID NO: 3681238 - DNA, 23 bp, Homo sapiens
ggcccctcccacacccaaagctg

SEQ ID NO: 3681239 - DNA, 21 bp, Homo sapiens
ggcccctctccaagcgcctgg

SEQ ID NO: 3681240 - DNA, 21 bp, Homo sapiens
ggcccgccctgcccgggctcc

SEQ ID NO: 3681241 - DNA, 12 bp, Homo sapiens
ggcccggccagc

SEQ ID NO: 3681242 - DNA, 11 bp, Homo sapiens
ggccctacctg

SEQ ID NO: 3681243 - DNA, 13 bp, Homo sapiens
ggccctacctggg

SEQ ID NO: 3681244 - DNA, 15 bp, Homo sapiens
ggccctacctgggga

SEQ ID NO: 3681245 - DNA, 16 bp, Homo sapiens
ggccctacctggggaa

SEQ ID NO: 3681246 - DNA, 18 bp, Homo sapiens
ggccctcccaaagaggcc

SEQ ID NO: 3681247 - DNA, 20 bp, Homo sapiens
ggccctccctgttccccaga

SEQ ID NO: 3681248 - DNA, 22 bp, Homo sapiens
ggccctccctgttccccagaga

SEQ ID NO: 3681249 - DNA, 14 bp, Homo sapiens
ggccctctggagtg

SEQ ID NO: 3681250 - DNA, 18 bp, Homo sapiens
ggccctctggagtggcca

SEQ ID NO: 3681251 - DNA, 19 bp, Homo sapiens
ggccctctggagtggccac

SEQ ID NO: 3681252 - DNA, 19 bp, Homo sapiens
ggccctgagtctgggcagc

SEQ ID NO: 3681253 - DNA, 14 bp, Homo sapiens
ggccctgggctgga

SEQ ID NO: 3681254 - DNA, 21 bp, Homo sapiens
ggcccttgcagttcagcacca

SEQ ID NO: 3681255 - DNA, 15 bp, Homo sapiens
ggccgagaagcaaga

SEQ ID NO: 3681256 - DNA, 22 bp, Homo sapiens
ggccgctgccacccacctccct

SEQ ID NO: 3681257 - DNA, 23 bp, Homo sapiens
ggccgctgccacccacctccctg

SEQ ID NO: 3681258 - DNA, 17 bp, Homo sapiens
ggccggcccccttcctg

SEQ ID NO: 3681259 - DNA, 12 bp, Homo sapiens
ggccggccctgt

SEQ ID NO: 3681260 - DNA, 16 bp, Homo sapiens
ggcctaccccgcagac

SEQ ID NO: 3681261 - DNA, 23 bp, Homo sapiens
ggcctaccccgcagacaccttgg

SEQ ID NO: 3681262 - DNA, 22 bp, Homo sapiens
ggcctcagctgcctcacttcct

SEQ ID NO: 3681263 - DNA, 15 bp, Homo sapiens
ggcctcatgtggctg

SEQ ID NO: 3681264 - DNA, 17 bp, Homo sapiens
ggcctcccctgccacca

SEQ ID NO: 3681265 - DNA, 19 bp, Homo sapiens
ggcctcccctgccaccagg

SEQ ID NO: 3681266 - DNA, 20 bp, Homo sapiens
ggcctcggtgtggagaagcg

SEQ ID NO: 3681267 - DNA, 18 bp, Homo sapiens
ggcctcttgagcagtggc

SEQ ID NO: 3681268 - DNA, 23 bp, Homo sapiens
ggcctgaaagaggctgaggcctg

SEQ ID NO: 3681269 - DNA, 15 bp, Homo sapiens
ggcctgatgctccct

SEQ ID NO: 3681270 - DNA, 18 bp, Homo sapiens
ggcctgatgctccctccc

SEQ ID NO: 3681271 - DNA, 20 bp, Homo sapiens
ggcctgatgctccctcccct

SEQ ID NO: 3681272 - DNA, 22 bp, Homo sapiens
ggcctgatgctccctcccctgc

SEQ ID NO: 3681273 - DNA, 13 bp, Homo sapiens
ggcctgctccaga

SEQ ID NO: 3681274 - DNA, 14 bp, Homo sapiens
ggcctgctccagac

SEQ ID NO: 3681275 - DNA, 16 bp, Homo sapiens
ggcctgctccagacct

SEQ ID NO: 3681276 - DNA, 11 bp, Homo sapiens
ggcctggagat

SEQ ID NO: 3681277 - DNA, 14 bp, Homo sapiens
ggcctggagatcct

SEQ ID NO: 3681278 - DNA, 20 bp, Homo sapiens
ggcctggagatcctcctgca

SEQ ID NO: 3681279 - DNA, 23 bp, Homo sapiens
ggcctggccaggagctcttcagg

SEQ ID NO: 3681280 - DNA, 17 bp, Homo sapiens
ggcctgtctcatcccca

SEQ ID NO: 3681281 - DNA, 18 bp, Homo sapiens
ggcctgtctcatccccag

SEQ ID NO: 3681282 - DNA, 15 bp, Homo sapiens
ggcctgtggctgtcg

SEQ ID NO: 3681283 - DNA, 20 bp, Homo sapiens
ggcctgtttgaaagtaaaaa

SEQ ID NO: 3681284 - DNA, 12 bp, Homo sapiens
ggcctttcctgg

SEQ ID NO: 3681285 - DNA, 13 bp, Homo sapiens
ggcctttcctgga

SEQ ID NO: 3681286 - DNA, 13 bp, Homo sapiens
ggcctttggcttc

SEQ ID NO: 3681287 - DNA, 19 bp, Homo sapiens
ggcgagacaagcatggaaa

SEQ ID NO: 3681288 - DNA, 21 bp, Homo sapiens
ggcgctgcccacctgccggcc

SEQ ID NO: 3681289 - DNA, 13 bp, Homo sapiens
ggcggagccggcc

SEQ ID NO: 3681290 - DNA, 20 bp, Homo sapiens
ggcggatcatctaattctct

SEQ ID NO: 3681291 - DNA, 14 bp, Homo sapiens
ggcggggctcctcc

SEQ ID NO: 3681292 - DNA, 14 bp, Homo sapiens
ggcgggtcctagct

SEQ ID NO: 3681293 - DNA, 15 bp, Homo sapiens
ggcgggtcctagctg

SEQ ID NO: 3681294 - DNA, 16 bp, Homo sapiens
ggcgtggcccaaggct

SEQ ID NO: 3681295 - DNA, 13 bp, Homo sapiens
ggcgtggcctgca

SEQ ID NO: 3681296 - DNA, 16 bp, Homo sapiens
ggcgtggctctgggtg

SEQ ID NO: 3681297 - DNA, 19 bp, Homo sapiens
ggctaagagtgtcctagga

SEQ ID NO: 3681298 - DNA, 22 bp, Homo sapiens
ggctacagattgggcggggctt

SEQ ID NO: 3681299 - DNA, 18 bp, Homo sapiens
ggctagaggccagcccca

SEQ ID NO: 3681300 - DNA, 20 bp, Homo sapiens
ggctagaggccagccccacc

SEQ ID NO: 3681301 - DNA, 19 bp, Homo sapiens
ggctagtcaagctcctcct

SEQ ID NO: 3681302 - DNA, 17 bp, Homo sapiens
ggctcacgcctgtaatc

SEQ ID NO: 3681303 - DNA, 12 bp, Homo sapiens
ggctccagagca

SEQ ID NO: 3681304 - DNA, 12 bp, Homo sapiens
ggctcctacctg

SEQ ID NO: 3681305 - DNA, 16 bp, Homo sapiens
ggctcctacctggggg

SEQ ID NO: 3681306 - DNA, 13 bp, Homo sapiens
ggctcctcctgaa

SEQ ID NO: 3681307 - DNA, 14 bp, Homo sapiens
ggctcctcctgaag

SEQ ID NO: 3681308 - DNA, 18 bp, Homo sapiens
ggctcctcctgaaggagg

SEQ ID NO: 3681309 - DNA, 12 bp, Homo sapiens
ggctcctgtggt

SEQ ID NO: 3681310 - DNA, 20 bp, Homo sapiens
ggctccttcctgtgggtggg

SEQ ID NO: 3681311 - DNA, 22 bp, Homo sapiens
ggctccttcctgtgggtggggc

SEQ ID NO: 3681312 - DNA, 23 bp, Homo sapiens
ggctccttcctgtgggtggggct

SEQ ID NO: 3681313 - DNA, 15 bp, Homo sapiens
ggctctgagcgcctc

SEQ ID NO: 3681314 - DNA, 21 bp, Homo sapiens
ggctctggggtaggctgctcc

SEQ ID NO: 3681315 - DNA, 20 bp, Homo sapiens
ggctcttagcagcttccaga

SEQ ID NO: 3681316 - DNA, 21 bp, Homo sapiens
ggctcttctccttggaggaca

SEQ ID NO: 3681317 - DNA, 20 bp, Homo sapiens
ggctgactaagccccgtctg

SEQ ID NO: 3681318 - DNA, 24 bp, Homo sapiens
ggctgactagaagggccagtcctg

SEQ ID NO: 3681319 - DNA, 10 bp, Homo sapiens
ggctgagaag

SEQ ID NO: 3681320 - DNA, 15 bp, Homo sapiens
ggctgaggtgggagg

SEQ ID NO: 3681321 - DNA, 18 bp, Homo sapiens
ggctgatgtcaatttctg

SEQ ID NO: 3681322 - DNA, 22 bp, Homo sapiens
ggctgcaaggtttaggctggtg

SEQ ID NO: 3681323 - DNA, 17 bp, Homo sapiens
ggctgccaaggccagag

SEQ ID NO: 3681324 - DNA, 21 bp, Homo sapiens
ggctgccatctcacctcctgc

SEQ ID NO: 3681325 - DNA, 13 bp, Homo sapiens
ggctgcccagagc

SEQ ID NO: 3681326 - DNA, 15 bp, Homo sapiens
ggctgcccagagctg

SEQ ID NO: 3681327 - DNA, 17 bp, Homo sapiens
ggctgcccagagctgct

SEQ ID NO: 3681328 - DNA, 14 bp, Homo sapiens
ggctgctccctgag

SEQ ID NO: 3681329 - DNA, 15 bp, Homo sapiens
ggctgctccctgagg

SEQ ID NO: 3681330 - DNA, 16 bp, Homo sapiens
ggctgctcctgaatga

SEQ ID NO: 3681331 - DNA, 19 bp, Homo sapiens
ggctgctcctgaatgaggc

SEQ ID NO: 3681332 - DNA, 16 bp, Homo sapiens
ggctgctgacctccac

SEQ ID NO: 3681333 - DNA, 21 bp, Homo sapiens
ggctgctgacctccacagctt

SEQ ID NO: 3681334 - DNA, 13 bp, Homo sapiens
ggctgcttcctcc

SEQ ID NO: 3681335 - DNA, 17 bp, Homo sapiens
ggctgcttcctcctgga

SEQ ID NO: 3681336 - DNA, 18 bp, Homo sapiens
ggctgcttcctcctggaa

SEQ ID NO: 3681337 - DNA, 19 bp, Homo sapiens
ggctgcttcctcctggaaa

SEQ ID NO: 3681338 - DNA, 20 bp, Homo sapiens
ggctggccagtccaggctgc

SEQ ID NO: 3681339 - DNA, 18 bp, Homo sapiens
ggctgggggcaggagggc

SEQ ID NO: 3681340 - DNA, 23 bp, Homo sapiens
ggctggtccagggctagtgactt

SEQ ID NO: 3681341 - DNA, 16 bp, Homo sapiens
ggctggtggcccagga

SEQ ID NO: 3681342 - DNA, 13 bp, Homo sapiens
ggctgtcctgtac

SEQ ID NO: 3681343 - DNA, 16 bp, Homo sapiens
ggctgtcggtgggacc

SEQ ID NO: 3681344 - DNA, 15 bp, Homo sapiens
ggctgtggtcacagc

SEQ ID NO: 3681345 - DNA, 14 bp, Homo sapiens
ggcttaatcatttt

SEQ ID NO: 3681346 - DNA, 12 bp, Homo sapiens
ggcttcacagat

SEQ ID NO: 3681347 - DNA, 16 bp, Homo sapiens
ggcttctacctgcagg

SEQ ID NO: 3681348 - DNA, 23 bp, Homo sapiens
ggcttctcctgcgggggcgaggc

SEQ ID NO: 3681349 - DNA, 17 bp, Homo sapiens
ggcttctcttgggtggg

SEQ ID NO: 3681350 - DNA, 14 bp, Homo sapiens
ggcttcttcctgga

SEQ ID NO: 3681351 - DNA, 22 bp, Homo sapiens
ggcttcttcctggatggggcag

SEQ ID NO: 3681352 - DNA, 16 bp, Homo sapiens
ggcttgcccaggagca

SEQ ID NO: 3681353 - DNA, 13 bp, Homo sapiens
ggctttctctcct

SEQ ID NO: 3681354 - DNA, 13 bp, Homo sapiens
ggctttggcttct

SEQ ID NO: 3681355 - DNA, 12 bp, Homo sapiens
ggctttttccaa

SEQ ID NO: 3681356 - DNA, 22 bp, Homo sapiens
gggaaaactgccaatatagaaa

SEQ ID NO: 3681357 - DNA, 13 bp, Homo sapiens
gggaaaatcagcc

SEQ ID NO: 3681358 - DNA, 23 bp, Homo sapiens
gggaaaatcagcctgctccagct

SEQ ID NO: 3681359 - DNA, 12 bp, Homo sapiens
gggaaagcctga

SEQ ID NO: 3681360 - DNA, 14 bp, Homo sapiens
gggaacctgtgtcc

SEQ ID NO: 3681361 - DNA, 12 bp, Homo sapiens
gggaagaaaaag

SEQ ID NO: 3681362 - DNA, 18 bp, Homo sapiens
gggaagaagctctctcct

SEQ ID NO: 3681363 - DNA, 14 bp, Homo sapiens
gggaaggggaggac

SEQ ID NO: 3681364 - DNA, 22 bp, Homo sapiens
gggaatggcacagcccaaagaa

SEQ ID NO: 3681365 - DNA, 15 bp, Homo sapiens
gggaattcctggaac

SEQ ID NO: 3681366 - DNA, 20 bp, Homo sapiens
gggaattcctggaacctgga

SEQ ID NO: 3681367 - DNA, 13 bp, Homo sapiens
gggacaagggatt

SEQ ID NO: 3681368 - DNA, 21 bp, Homo sapiens
gggacagaggccccagcctcc

SEQ ID NO: 3681369 - DNA, 19 bp, Homo sapiens
gggacagggcttctcctgc

SEQ ID NO: 3681370 - DNA, 18 bp, Homo sapiens
gggacatcacagggtggg

SEQ ID NO: 3681371 - DNA, 22 bp, Homo sapiens
gggacatcacagggtgggcctc

SEQ ID NO: 3681372 - DNA, 16 bp, Homo sapiens
gggaccaactgggccc

SEQ ID NO: 3681373 - DNA, 12 bp, Homo sapiens
gggaccaggctc

SEQ ID NO: 3681374 - DNA, 15 bp, Homo sapiens
gggacccagtgcaga

SEQ ID NO: 3681375 - DNA, 14 bp, Homo sapiens
gggacggggctccc

SEQ ID NO: 3681376 - DNA, 17 bp, Homo sapiens
gggacggtgcccaagcc

SEQ ID NO: 3681377 - DNA, 16 bp, Homo sapiens
gggacgtgagagaagg

SEQ ID NO: 3681378 - DNA, 17 bp, Homo sapiens
gggactcagccctgagg

SEQ ID NO: 3681379 - DNA, 12 bp, Homo sapiens
gggactcctccc

SEQ ID NO: 3681380 - DNA, 13 bp, Homo sapiens
gggactcctccct

SEQ ID NO: 3681381 - DNA, 14 bp, Homo sapiens
gggactcctccctg

SEQ ID NO: 3681382 - DNA, 21 bp, Homo sapiens
gggactgctacctctgagaag

SEQ ID NO: 3681383 - DNA, 18 bp, Homo sapiens
gggagacggtttccaggg

SEQ ID NO: 3681384 - DNA, 20 bp, Homo sapiens
gggagacggtttccagggag

SEQ ID NO: 3681385 - DNA, 21 bp, Homo sapiens
gggagacggtttccagggagg

SEQ ID NO: 3681386 - DNA, 23 bp, Homo sapiens
gggagcatgcttccctgcagctg

SEQ ID NO: 3681387 - DNA, 11 bp, Homo sapiens
gggagccagcc

SEQ ID NO: 3681388 - DNA, 12 bp, Homo sapiens
gggagccccagg

SEQ ID NO: 3681389 - DNA, 14 bp, Homo sapiens
gggagccccagggt

SEQ ID NO: 3681390 - DNA, 23 bp, Homo sapiens
gggagctccactctgcttctctg

SEQ ID NO: 3681391 - DNA, 13 bp, Homo sapiens
gggagctctgtat

SEQ ID NO: 3681392 - DNA, 13 bp, Homo sapiens
gggagctgggccc

SEQ ID NO: 3681393 - DNA, 21 bp, Homo sapiens
gggagggcggcaggggcctgg

SEQ ID NO: 3681394 - DNA, 17 bp, Homo sapiens
gggaggggccggccctg

SEQ ID NO: 3681395 - DNA, 13 bp, Homo sapiens
gggaggggctctg

SEQ ID NO: 3681396 - DNA, 18 bp, Homo sapiens
gggaggtcaaggctgcag

SEQ ID NO: 3681397 - DNA, 15 bp, Homo sapiens
gggaggtcgaggcag

SEQ ID NO: 3681398 - DNA, 17 bp, Homo sapiens
gggaggtcgaggcagga

SEQ ID NO: 3681399 - DNA, 19 bp, Homo sapiens
gggaggtcgaggcaggagg

SEQ ID NO: 3681400 - DNA, 14 bp, Homo sapiens
gggaggtggctggg

SEQ ID NO: 3681401 - DNA, 17 bp, Homo sapiens
gggagtctgaagcagat

SEQ ID NO: 3681402 - DNA, 17 bp, Homo sapiens
gggatccgactgctttg

SEQ ID NO: 3681403 - DNA, 22 bp, Homo sapiens
gggatccgagggcccctctcca

SEQ ID NO: 3681404 - DNA, 23 bp, Homo sapiens
gggatctggtcctacccatcccc

SEQ ID NO: 3681405 - DNA, 22 bp, Homo sapiens
gggatgttcagcactgtccctt

SEQ ID NO: 3681406 - DNA, 16 bp, Homo sapiens
gggattaacctctgca

SEQ ID NO: 3681407 - DNA, 20 bp, Homo sapiens
gggcaaggccccttccacgg

SEQ ID NO: 3681408 - DNA, 20 bp, Homo sapiens
gggcaccaggggtttctcgc

SEQ ID NO: 3681409 - DNA, 15 bp, Homo sapiens
gggcacggctctggg

SEQ ID NO: 3681410 - DNA, 19 bp, Homo sapiens
gggcactaggtaggcttct

SEQ ID NO: 3681411 - DNA, 17 bp, Homo sapiens
gggcagaactcctacct

SEQ ID NO: 3681412 - DNA, 19 bp, Homo sapiens
gggcagagctggctctgag

SEQ ID NO: 3681413 - DNA, 19 bp, Homo sapiens
gggcagagcttctcctgac

SEQ ID NO: 3681414 - DNA, 19 bp, Homo sapiens
gggcaggaaggagagcctg

SEQ ID NO: 3681415 - DNA, 19 bp, Homo sapiens
gggcagggagctgggcccg

SEQ ID NO: 3681416 - DNA, 14 bp, Homo sapiens
gggcatctgcccct

SEQ ID NO: 3681417 - DNA, 17 bp, Homo sapiens
gggcatctgcccctccc

SEQ ID NO: 3681418 - DNA, 14 bp, Homo sapiens
gggccagatccagc

SEQ ID NO: 3681419 - DNA, 14 bp, Homo sapiens
gggccagtcctggt

SEQ ID NO: 3681420 - DNA, 18 bp, Homo sapiens
gggccagtgctccagcca

SEQ ID NO: 3681421 - DNA, 23 bp, Homo sapiens
gggccatgatggcaacagatctg

SEQ ID NO: 3681422 - DNA, 15 bp, Homo sapiens
gggccatttggccgg

SEQ ID NO: 3681423 - DNA, 16 bp, Homo sapiens
gggccatttggccggc

SEQ ID NO: 3681424 - DNA, 12 bp, Homo sapiens
gggcccagagcc

SEQ ID NO: 3681425 - DNA, 19 bp, Homo sapiens
gggcccagagcccagctcc

SEQ ID NO: 3681426 - DNA, 20 bp, Homo sapiens
gggcccagagcccagctcca

SEQ ID NO: 3681427 - DNA, 19 bp, Homo sapiens
gggcccctcaccctgcctt

SEQ ID NO: 3681428 - DNA, 18 bp, Homo sapiens
gggcccgacatggctccg

SEQ ID NO: 3681429 - DNA, 16 bp, Homo sapiens
gggcccggccagccat

SEQ ID NO: 3681430 - DNA, 12 bp, Homo sapiens
gggccctacctg

SEQ ID NO: 3681431 - DNA, 15 bp, Homo sapiens
gggccctgggctgga

SEQ ID NO: 3681432 - DNA, 17 bp, Homo sapiens
gggccgccgcctctttc

SEQ ID NO: 3681433 - DNA, 12 bp, Homo sapiens
gggccgctgcca

SEQ ID NO: 3681434 - DNA, 13 bp, Homo sapiens
gggccgctgccac

SEQ ID NO: 3681435 - DNA, 19 bp, Homo sapiens
gggccggccctgtgtgcag

SEQ ID NO: 3681436 - DNA, 17 bp, Homo sapiens
gggcctaggcctcagcc

SEQ ID NO: 3681437 - DNA, 12 bp, Homo sapiens
gggcctggagat

SEQ ID NO: 3681438 - DNA, 18 bp, Homo sapiens
gggcctggtcgttttcaa

SEQ ID NO: 3681439 - DNA, 16 bp, Homo sapiens
gggcgcggtggctcac

SEQ ID NO: 3681440 - DNA, 21 bp, Homo sapiens
gggcggcaggggcctggagat

SEQ ID NO: 3681441 - DNA, 15 bp, Homo sapiens
gggcgggccctgcct

SEQ ID NO: 3681442 - DNA, 16 bp, Homo sapiens
gggcgggccctgcctg

SEQ ID NO: 3681443 - DNA, 14 bp, Homo sapiens
gggctcacacacct

SEQ ID NO: 3681444 - DNA, 22 bp, Homo sapiens
gggctcagcaaaagatgcttct

SEQ ID NO: 3681445 - DNA, 14 bp, Homo sapiens
gggctcctacctgg

SEQ ID NO: 3681446 - DNA, 14 bp, Homo sapiens
gggctcctccctgg

SEQ ID NO: 3681447 - DNA, 18 bp, Homo sapiens
gggctctaggatggggca

SEQ ID NO: 3681448 - DNA, 19 bp, Homo sapiens
gggctctctgctgtacata

SEQ ID NO: 3681449 - DNA, 16 bp, Homo sapiens
gggctgaggtgggagg

SEQ ID NO: 3681450 - DNA, 20 bp, Homo sapiens
gggctgctcctgaatgaggc

SEQ ID NO: 3681451 - DNA, 17 bp, Homo sapiens
gggctgcttcctcctgg

SEQ ID NO: 3681452 - DNA, 19 bp, Homo sapiens
gggctgcttcctcctggaa

SEQ ID NO: 3681453 - DNA, 20 bp, Homo sapiens
gggctgcttcctcctggaaa

SEQ ID NO: 3681454 - DNA, 19 bp, Homo sapiens
gggctgtggctctgggtgg

SEQ ID NO: 3681455 - DNA, 15 bp, Homo sapiens
gggcttctcctgcgg

SEQ ID NO: 3681456 - DNA, 20 bp, Homo sapiens
gggcttctctccgcgggtgg

SEQ ID NO: 3681457 - DNA, 12 bp, Homo sapiens
gggcttctctgg

SEQ ID NO: 3681458 - DNA, 17 bp, Homo sapiens
gggcttctcttgggtgg

SEQ ID NO: 3681459 - DNA, 19 bp, Homo sapiens
gggcttctcttgggtggga

SEQ ID NO: 3681460 - DNA, 15 bp, Homo sapiens
gggcttttccctggg

SEQ ID NO: 3681461 - DNA, 18 bp, Homo sapiens
gggcttttccctgggtgg

SEQ ID NO: 3681462 - DNA, 12 bp, Homo sapiens
ggggaatctaag

SEQ ID NO: 3681463 - DNA, 13 bp, Homo sapiens
ggggacccagtgc

SEQ ID NO: 3681464 - DNA, 15 bp, Homo sapiens
ggggacggggctccc

SEQ ID NO: 3681465 - DNA, 13 bp, Homo sapiens
ggggactcagccc

SEQ ID NO: 3681466 - DNA, 14 bp, Homo sapiens
ggggactcagccct

SEQ ID NO: 3681467 - DNA, 17 bp, Homo sapiens
ggggactcccaggctgg

SEQ ID NO: 3681468 - DNA, 21 bp, Homo sapiens
ggggagccttctgtgctgtga

SEQ ID NO: 3681469 - DNA, 23 bp, Homo sapiens
ggggagccttctgtgctgtgagt

SEQ ID NO: 3681470 - DNA, 17 bp, Homo sapiens
ggggagtctgaagcaga

SEQ ID NO: 3681471 - DNA, 21 bp, Homo sapiens
ggggagttaagacctggcagc

SEQ ID NO: 3681472 - DNA, 19 bp, Homo sapiens
ggggcactaggtaggcttc

SEQ ID NO: 3681473 - DNA, 15 bp, Homo sapiens
ggggcagaactccta

SEQ ID NO: 3681474 - DNA, 22 bp, Homo sapiens
ggggcagagcttctcctgacca

SEQ ID NO: 3681475 - DNA, 16 bp, Homo sapiens
ggggcaggagggccct

SEQ ID NO: 3681476 - DNA, 13 bp, Homo sapiens
ggggcagggagct

SEQ ID NO: 3681477 - DNA, 17 bp, Homo sapiens
ggggcagggagctgggc

SEQ ID NO: 3681478 - DNA, 21 bp, Homo sapiens
ggggcagtactcctccctggg

SEQ ID NO: 3681479 - DNA, 14 bp, Homo sapiens
ggggccagatccag

SEQ ID NO: 3681480 - DNA, 18 bp, Homo sapiens
ggggccatttggccggct

SEQ ID NO: 3681481 - DNA, 21 bp, Homo sapiens
ggggccatttggccggctctg

SEQ ID NO: 3681482 - DNA, 14 bp, Homo sapiens
ggggcccagtgcat

SEQ ID NO: 3681483 - DNA, 14 bp, Homo sapiens
ggggccctgccctg

SEQ ID NO: 3681484 - DNA, 23 bp, Homo sapiens
ggggcctaggcctcagccagaga

SEQ ID NO: 3681485 - DNA, 14 bp, Homo sapiens
ggggcgaggcccct

SEQ ID NO: 3681486 - DNA, 17 bp, Homo sapiens
ggggcgggccctgcctg

SEQ ID NO: 3681487 - DNA, 14 bp, Homo sapiens
ggggctcctacctg

SEQ ID NO: 3681488 - DNA, 17 bp, Homo sapiens
ggggctgaggtgggagg

SEQ ID NO: 3681489 - DNA, 16 bp, Homo sapiens
ggggctgtggctctgg

SEQ ID NO: 3681490 - DNA, 17 bp, Homo sapiens
ggggctgtggctctggg

SEQ ID NO: 3681491 - DNA, 21 bp, Homo sapiens
ggggcttctctgggaccaggc

SEQ ID NO: 3681492 - DNA, 23 bp, Homo sapiens
ggggcttctctgggaccaggctc

SEQ ID NO: 3681493 - DNA, 19 bp, Homo sapiens
ggggcttctcttgggtggg

SEQ ID NO: 3681494 - DNA, 20 bp, Homo sapiens
ggggcttctcttgggtggga

SEQ ID NO: 3681495 - DNA, 23 bp, Homo sapiens
ggggcttctcttgggtgggacag

SEQ ID NO: 3681496 - DNA, 17 bp, Homo sapiens
gggggaactcagatcca

SEQ ID NO: 3681497 - DNA, 22 bp, Homo sapiens
gggggagtctgaagcagatgca

SEQ ID NO: 3681498 - DNA, 23 bp, Homo sapiens
gggggtggccgctgagtggcagg

SEQ ID NO: 3681499 - DNA, 16 bp, Homo sapiens
ggggtccctagcagcc

SEQ ID NO: 3681500 - DNA, 14 bp, Homo sapiens
ggggtcctggccat

SEQ ID NO: 3681501 - DNA, 14 bp, Homo sapiens
ggggtgaggagctg

SEQ ID NO: 3681502 - DNA, 17 bp, Homo sapiens
ggggtgggccaggctga

SEQ ID NO: 3681503 - DNA, 15 bp, Homo sapiens
ggggtggggctccta

SEQ ID NO: 3681504 - DNA, 20 bp, Homo sapiens
ggggtggggctcctacctgg

SEQ ID NO: 3681505 - DNA, 19 bp, Homo sapiens
gggtcagcccaagattctt

SEQ ID NO: 3681506 - DNA, 19 bp, Homo sapiens
gggtcagtgcagcagagga

SEQ ID NO: 3681507 - DNA, 21 bp, Homo sapiens
gggtcatcctgtgctcggagg

SEQ ID NO: 3681508 - DNA, 19 bp, Homo sapiens
gggtccaggggatgggagg

SEQ ID NO: 3681509 - DNA, 16 bp, Homo sapiens
gggtcccagccacccc

SEQ ID NO: 3681510 - DNA, 13 bp, Homo sapiens
gggtcctggctcc

SEQ ID NO: 3681511 - DNA, 20 bp, Homo sapiens
gggtcggctgaccatgctca

SEQ ID NO: 3681512 - DNA, 19 bp, Homo sapiens
gggtctgctctttctctgc

SEQ ID NO: 3681513 - DNA, 19 bp, Homo sapiens
gggtgacagagcaagtgag

SEQ ID NO: 3681514 - DNA, 15 bp, Homo sapiens
gggtgaggagctggg

SEQ ID NO: 3681515 - DNA, 24 bp, Homo sapiens
gggtgctgtgaggcttgcccagga

SEQ ID NO: 3681516 - DNA, 13 bp, Homo sapiens
gggtggagcagga

SEQ ID NO: 3681517 - DNA, 15 bp, Homo sapiens
gggtggcaccagcag

SEQ ID NO: 3681518 - DNA, 21 bp, Homo sapiens
gggtggccgctgagtggcagg

SEQ ID NO: 3681519 - DNA, 14 bp, Homo sapiens
gggtgggacagggc

SEQ ID NO: 3681520 - DNA, 11 bp, Homo sapiens
gggtgggcctc

SEQ ID NO: 3681521 - DNA, 14 bp, Homo sapiens
gggtggggctccta

SEQ ID NO: 3681522 - DNA, 17 bp, Homo sapiens
gggtggggtagggctga

SEQ ID NO: 3681523 - DNA, 15 bp, Homo sapiens
gggtggttctctggg

SEQ ID NO: 3681524 - DNA, 21 bp, Homo sapiens
gggtgtcttgggcagagctgg

SEQ ID NO: 3681525 - DNA, 21 bp, Homo sapiens
gggttaacttggtcagagcca

SEQ ID NO: 3681526 - DNA, 20 bp, Homo sapiens
gggttctgcctgccagctgc

SEQ ID NO: 3681527 - DNA, 13 bp, Homo sapiens
ggtaaaatgccat

SEQ ID NO: 3681528 - DNA, 18 bp, Homo sapiens
ggtaactagggaagataa

SEQ ID NO: 3681529 - DNA, 13 bp, Homo sapiens
ggtaagaagaaag

SEQ ID NO: 3681530 - DNA, 17 bp, Homo sapiens
gccagtcaagaagaaaa

SEQ ID NO: 3681531 - DNA, 14 bp, Homo sapiens
gccagtccaggctg

SEQ ID NO: 3681532 - DNA, 18 bp, Homo sapiens
gccagtcctgcctggcca

SEQ ID NO: 3681533 - DNA, 12 bp, Homo sapiens
gccagtcctggt

SEQ ID NO: 3681534 - DNA, 12 bp, Homo sapiens
gccagtctgtgg

SEQ ID NO: 3681535 - DNA, 13 bp, Homo sapiens
gccagtgacagac

SEQ ID NO: 3681536 - DNA, 17 bp, Homo sapiens
gccagtgacctgaggaa

SEQ ID NO: 3681537 - DNA, 20 bp, Homo sapiens
gccagtgatgctaaaggttg

SEQ ID NO: 3681538 - DNA, 21 bp, Homo sapiens
gccatcattgatgatcactgt

SEQ ID NO: 3681539 - DNA, 23 bp, Homo sapiens
gccatcattgatgatcactgtga

SEQ ID NO: 3681540 - DNA, 20 bp, Homo sapiens
gccatctcacctcctgctgg

SEQ ID NO: 3681541 - DNA, 19 bp, Homo sapiens
gccatgatgcctctgtctt

SEQ ID NO: 3681542 - DNA, 19 bp, Homo sapiens
gccatgatggcaacagatc

SEQ ID NO: 3681543 - DNA, 19 bp, Homo sapiens
gccatgccagcttatctca

SEQ ID NO: 3681544 - DNA, 14 bp, Homo sapiens
gccatgctgaggcc

SEQ ID NO: 3681545 - DNA, 18 bp, Homo sapiens
gccatggacagaagaagg

SEQ ID NO: 3681546 - DNA, 19 bp, Homo sapiens
gccatgttggccaggctgg

SEQ ID NO: 3681547 - DNA, 18 bp, Homo sapiens
gccattctcaagccctgc

SEQ ID NO: 3681548 - DNA, 16 bp, Homo sapiens
gccattgggaccctcc

SEQ ID NO: 3681549 - DNA, 20 bp, Homo sapiens
gccatttctgaactgttaca

SEQ ID NO: 3681550 - DNA, 16 bp, Homo sapiens
gcccaacccttccctc

SEQ ID NO: 3681551 - DNA, 19 bp, Homo sapiens
gcccaagacagatgcccca

SEQ ID NO: 3681552 - DNA, 13 bp, Homo sapiens
gcccaagattctt

SEQ ID NO: 3681553 - DNA, 15 bp, Homo sapiens
gcccaagattcttca

SEQ ID NO: 3681554 - DNA, 21 bp, Homo sapiens
gcccaagccagaggctgggtt

SEQ ID NO: 3681555 - DNA, 18 bp, Homo sapiens
gcccaagggatctggtcc

SEQ ID NO: 3681556 - DNA, 19 bp, Homo sapiens
gcccaccctgctgctggtg

SEQ ID NO: 3681557 - DNA, 22 bp, Homo sapiens
gcccaccctgctgctggtgcac

SEQ ID NO: 3681558 - DNA, 14 bp, Homo sapiens
gcccacctgcccat

SEQ ID NO: 3681559 - DNA, 15 bp, Homo sapiens
gcccacctgccggcc

SEQ ID NO: 3681560 - DNA, 22 bp, Homo sapiens
gcccacctgtcaaacaaagcca

SEQ ID NO: 3681561 - DNA, 18 bp, Homo sapiens
gcccactgtcctgggcct

SEQ ID NO: 3681562 - DNA, 23 bp, Homo sapiens
gcccactgtcctgggcctgcaga

SEQ ID NO: 3681563 - DNA, 15 bp, Homo sapiens
gcccagacagcaagg

SEQ ID NO: 3681564 - DNA, 19 bp, Homo sapiens
gcccagacagcaaggtgtg

SEQ ID NO: 3681565 - DNA, 15 bp, Homo sapiens
gcccagagcccagct

SEQ ID NO: 3681566 - DNA, 15 bp, Homo sapiens
gcccagagctgctgg

SEQ ID NO: 3681567 - DNA, 18 bp, Homo sapiens
gcccagagctgctggtct

SEQ ID NO: 3681568 - DNA, 22 bp, Homo sapiens
gcccagctattaccacacttgg

SEQ ID NO: 3681569 - DNA, 18 bp, Homo sapiens
gcccaggaccatcatcct

SEQ ID NO: 3681570 - DNA, 19 bp, Homo sapiens
gcccaggagcaagtgaggc

SEQ ID NO: 3681571 - DNA, 16 bp, Homo sapiens
gcccaggcactgcaaa

SEQ ID NO: 3681572 - DNA, 23 bp, Homo sapiens
gcccagggagcggaaagcagctc

SEQ ID NO: 3681573 - DNA, 15 bp, Homo sapiens
gcccagggcccagag

SEQ ID NO: 3681574 - DNA, 15 bp, Homo sapiens
gcccagggctcctgc

SEQ ID NO: 3681575 - DNA, 18 bp, Homo sapiens
gcccagggctcctgcact

SEQ ID NO: 3681576 - DNA, 21 bp, Homo sapiens
gcccatcacagggttgggccc

SEQ ID NO: 3681577 - DNA, 22 bp, Homo sapiens
gcccatcacagggttgggccca

SEQ ID NO: 3681578 - DNA, 13 bp, Homo sapiens
gcccatgaatttg

SEQ ID NO: 3681579 - DNA, 12 bp, Homo sapiens
gccccacccagg

SEQ ID NO: 3681580 - DNA, 19 bp, Homo sapiens
gccccaccctgggccctgg

SEQ ID NO: 3681581 - DNA, 24 bp, Homo sapiens
gccccaccctgggccctgggctgg

SEQ ID NO: 3681582 - DNA, 21 bp, Homo sapiens
gccccagcctccctgaagcct

SEQ ID NO: 3681583 - DNA, 14 bp, Homo sapiens
gccccaggaccagc

SEQ ID NO: 3681584 - DNA, 15 bp, Homo sapiens
gccccaggaccagct

SEQ ID NO: 3681585 - DNA, 16 bp, Homo sapiens
gccccaggaccagctc

SEQ ID NO: 3681586 - DNA, 17 bp, Homo sapiens
gccccaggaccagctca

SEQ ID NO: 3681587 - DNA, 22 bp, Homo sapiens
gccccaggaccagctcaggaca

SEQ ID NO: 3681588 - DNA, 21 bp, Homo sapiens
gccccagggtcttccctacct

SEQ ID NO: 3681589 - DNA, 14 bp, Homo sapiens
gccccatcctccag

SEQ ID NO: 3681590 - DNA, 16 bp, Homo sapiens
gccccatcctccagca

SEQ ID NO: 3681591 - DNA, 17 bp, Homo sapiens
gccccatcctccagcag

SEQ ID NO: 3681592 - DNA, 14 bp, Homo sapiens
gccccatgcctgtc

SEQ ID NO: 3681593 - DNA, 17 bp, Homo sapiens
gccccatgcctgtccag

SEQ ID NO: 3681594 - DNA, 16 bp, Homo sapiens
gcccccaaccccaaga

SEQ ID NO: 3681595 - DNA, 17 bp, Homo sapiens
gcccccactgaccagaa

SEQ ID NO: 3681596 - DNA, 17 bp, Homo sapiens
gcccccagcccagggct

SEQ ID NO: 3681597 - DNA, 23 bp, Homo sapiens
gcccccagctaagaacctggaac

SEQ ID NO: 3681598 - DNA, 19 bp, Homo sapiens
gccccccaggctgcccaga

SEQ ID NO: 3681599 - DNA, 17 bp, Homo sapiens
gcccccccccacccctg

SEQ ID NO: 3681600 - DNA, 18 bp, Homo sapiens
gccccctccgccctgcca

SEQ ID NO: 3681601 - DNA, 22 bp, Homo sapiens
gccccctccgccctgccactca

SEQ ID NO: 3681602 - DNA, 15 bp, Homo sapiens
gcccccttcctggcc

SEQ ID NO: 3681603 - DNA, 20 bp, Homo sapiens
gcccccttcctggcccctca

SEQ ID NO: 3681604 - DNA, 23 bp, Homo sapiens
gcccccttctttgcagctgccca

SEQ ID NO: 3681605 - DNA, 19 bp, Homo sapiens
gccccgcccgtctctgctc

SEQ ID NO: 3681606 - DNA, 24 bp, Homo sapiens
gccccgcccgtctctgctctgctc

SEQ ID NO: 3681607 - DNA, 18 bp, Homo sapiens
gccccggtcacctagcaa

SEQ ID NO: 3681608 - DNA, 14 bp, Homo sapiens
gccccgtctgaccc

SEQ ID NO: 3681609 - DNA, 18 bp, Homo sapiens
gcccctcaccctgcctta

SEQ ID NO: 3681610 - DNA, 15 bp, Homo sapiens
gcccctcagcctctg

SEQ ID NO: 3681611 - DNA, 18 bp, Homo sapiens
gcccctcagcctctgcca

SEQ ID NO: 3681612 - DNA, 22 bp, Homo sapiens
gcccctcagcctctgccactgt

SEQ ID NO: 3681613 - DNA, 21 bp, Homo sapiens
gcccctcccacacccaaagct

SEQ ID NO: 3681614 - DNA, 22 bp, Homo sapiens
gcccctcccagtaagggcgtgg

SEQ ID NO: 3681615 - DNA, 21 bp, Homo sapiens
gcccctcccccaacccccacc

SEQ ID NO: 3681616 - DNA, 22 bp, Homo sapiens
gcccctcccccaacccccaccc

SEQ ID NO: 3681617 - DNA, 23 bp, Homo sapiens
gcccctcccccaacccccacccc

SEQ ID NO: 3681618 - DNA, 13 bp, Homo sapiens
gcccctcctgact

SEQ ID NO: 3681619 - DNA, 19 bp, Homo sapiens
gcccctctccaagcgcctg

SEQ ID NO: 3681620 - DNA, 22 bp, Homo sapiens
gcccctctccaagcgcctggct

SEQ ID NO: 3681621 - DNA, 22 bp, Homo sapiens
gcccctctggtcgctcctgccc

SEQ ID NO: 3681622 - DNA, 21 bp, Homo sapiens
gcccctcttccaaaggcagcg

SEQ ID NO: 3681623 - DNA, 12 bp, Homo sapiens
gcccctggcact

SEQ ID NO: 3681624 - DNA, 20 bp, Homo sapiens
gcccctgggatccgagggcc

SEQ ID NO: 3681625 - DNA, 21 bp, Homo sapiens
gcccctgggatccgagggccc

SEQ ID NO: 3681626 - DNA, 17 bp, Homo sapiens
gccccttccacgggggc

SEQ ID NO: 3681627 - DNA, 14 bp, Homo sapiens
gccccttcctttaa

SEQ ID NO: 3681628 - DNA, 14 bp, Homo sapiens
gcccggactgacca

SEQ ID NO: 3681629 - DNA, 12 bp, Homo sapiens
gcccggccagcc

SEQ ID NO: 3681630 - DNA, 15 bp, Homo sapiens
gcccggcccctcctg

SEQ ID NO: 3681631 - DNA, 13 bp, Homo sapiens
gcccgggctccca

SEQ ID NO: 3681632 - DNA, 18 bp, Homo sapiens
gcccgtcctgcctgtggc

SEQ ID NO: 3681633 - DNA, 23 bp, Homo sapiens
gcccgtgtagtccccaaccgtgt

SEQ ID NO: 3681634 - DNA, 16 bp, Homo sapiens
gccctaccctcctgct

SEQ ID NO: 3681635 - DNA, 17 bp, Homo sapiens
gccctaccctcctgctg

SEQ ID NO: 3681636 - DNA, 22 bp, Homo sapiens
gccctaccctcctgctgagctg

SEQ ID NO: 3681637 - DNA, 13 bp, Homo sapiens
gccctacctgggg

SEQ ID NO: 3681638 - DNA, 12 bp, Homo sapiens
gccctcccaaag

SEQ ID NO: 3681639 - DNA, 18 bp, Homo sapiens
gccctccctgttccccag

SEQ ID NO: 3681640 - DNA, 20 bp, Homo sapiens
gccctccctgttccccagag

SEQ ID NO: 3681641 - DNA, 16 bp, Homo sapiens
gccctctggagtggcc

SEQ ID NO: 3681642 - DNA, 17 bp, Homo sapiens
gccctctggagtggcca

SEQ ID NO: 3681643 - DNA, 19 bp, Homo sapiens
gccctctggagtggccact

SEQ ID NO: 3681644 - DNA, 21 bp, Homo sapiens
gccctgaggtgaaagggagct

SEQ ID NO: 3681645 - DNA, 22 bp, Homo sapiens
gccctgaggtgaaagggagcta

SEQ ID NO: 3681646 - DNA, 19 bp, Homo sapiens
gccctgccactcactaggc

SEQ ID NO: 3681647 - DNA, 17 bp, Homo sapiens
gccctgcccgggctccc

SEQ ID NO: 3681648 - DNA, 17 bp, Homo sapiens
gccctgccctggcaggg

SEQ ID NO: 3681649 - DNA, 14 bp, Homo sapiens
gccctggaggtggc

SEQ ID NO: 3681650 - DNA, 21 bp, Homo sapiens
gccctggcagggtcatcctgt

SEQ ID NO: 3681651 - DNA, 14 bp, Homo sapiens
gccctggcctcccc

SEQ ID NO: 3681652 - DNA, 11 bp, Homo sapiens
gccctgggctg

SEQ ID NO: 3681653 - DNA, 16 bp, Homo sapiens
gccctgggctggaatc

SEQ ID NO: 3681654 - DNA, 13 bp, Homo sapiens
gccctggtccagg

SEQ ID NO: 3681655 - DNA, 14 bp, Homo sapiens
gccctggtccaggg

SEQ ID NO: 3681656 - DNA, 16 bp, Homo sapiens
gccctggtccagggaa

SEQ ID NO: 3681657 - DNA, 20 bp, Homo sapiens
gccctgtgccccttgacaac

SEQ ID NO: 3681658 - DNA, 15 bp, Homo sapiens
gccgaaccaaaagaa

SEQ ID NO: 3681659 - DNA, 13 bp, Homo sapiens
gccgacgcctgtg

SEQ ID NO: 3681660 - DNA, 17 bp, Homo sapiens
gccgagattgcaccact

SEQ ID NO: 3681661 - DNA, 12 bp, Homo sapiens
gccgagccagca

SEQ ID NO: 3681662 - DNA, 14 bp, Homo sapiens
gccgagccagcaag

SEQ ID NO: 3681663 - DNA, 20 bp, Homo sapiens
gccgagggtcctggctcctg

SEQ ID NO: 3681664 - DNA, 21 bp, Homo sapiens
gccgatagagggacggccaag

SEQ ID NO: 3681665 - DNA, 15 bp, Homo sapiens
gccgccatgctcctg

SEQ ID NO: 3681666 - DNA, 16 bp, Homo sapiens
gccgccatgctcctgg

SEQ ID NO: 3681667 - DNA, 13 bp, Homo sapiens
gccgccgcctctt

SEQ ID NO: 3681668 - DNA, 16 bp, Homo sapiens
gccgcggctccccctg

SEQ ID NO: 3681669 - DNA, 18 bp, Homo sapiens
gccgcggctccccctgga

SEQ ID NO: 3681670 - DNA, 14 bp, Homo sapiens
gccgctgccaccca

SEQ ID NO: 3681671 - DNA, 16 bp, Homo sapiens
gccggcccccttcctg

SEQ ID NO: 3681672 - DNA, 15 bp, Homo sapiens
gccggctctggtggc

SEQ ID NO: 3681673 - DNA, 21 bp, Homo sapiens
gccgtctaggattgggcctcc

SEQ ID NO: 3681674 - DNA, 12 bp, Homo sapiens
gcctacgccagg

SEQ ID NO: 3681675 - DNA, 16 bp, Homo sapiens
gcctacgccaggagaa

SEQ ID NO: 3681676 - DNA, 13 bp, Homo sapiens
gcctaggcctcag

SEQ ID NO: 3681677 - DNA, 17 bp, Homo sapiens
gcctaggcctcagccag

SEQ ID NO: 3681678 - DNA, 19 bp, Homo sapiens
gcctatcaggtgcccctct

SEQ ID NO: 3681679 - DNA, 19 bp, Homo sapiens
gcctcactaatttttgtat

SEQ ID NO: 3681680 - DNA, 16 bp, Homo sapiens
gcctcagctgcctcac

SEQ ID NO: 3681681 - DNA, 14 bp, Homo sapiens
gcctcatggccagc

SEQ ID NO: 3681682 - DNA, 22 bp, Homo sapiens
gcctcatggccagcgcccctca

SEQ ID NO: 3681683 - DNA, 15 bp, Homo sapiens
gcctcatgtggctgg

SEQ ID NO: 3681684 - DNA, 19 bp, Homo sapiens
gcctcatgtggctggaaga

SEQ ID NO: 3681685 - DNA, 16 bp, Homo sapiens
gcctccaggtgcagag

SEQ ID NO: 3681686 - DNA, 14 bp, Homo sapiens
gcctcccctgccac

SEQ ID NO: 3681687 - DNA, 15 bp, Homo sapiens
gcctcccctgccacc

SEQ ID NO: 3681688 - DNA, 16 bp, Homo sapiens
gcctcccctgccacca

SEQ ID NO: 3681689 - DNA, 23 bp, Homo sapiens
gcctccctctctcttctgctcca

SEQ ID NO: 3681690 - DNA, 18 bp, Homo sapiens
gcctccctgaagcctttg

SEQ ID NO: 3681691 - DNA, 13 bp, Homo sapiens
gcctcctccagcc

SEQ ID NO: 3681692 - DNA, 18 bp, Homo sapiens
gcctcggcccctcccaca

SEQ ID NO: 3681693 - DNA, 20 bp, Homo sapiens
gcctctccccaggtccagct

SEQ ID NO: 3681694 - DNA, 16 bp, Homo sapiens
gcctctggaatgcatg

SEQ ID NO: 3681695 - DNA, 20 bp, Homo sapiens
gcctctggaatgcatggggc

SEQ ID NO: 3681696 - DNA, 23 bp, Homo sapiens
gcctctggctagaggccagcccc

SEQ ID NO: 3681697 - DNA, 12 bp, Homo sapiens
gcctctttccct

SEQ ID NO: 3681698 - DNA, 23 bp, Homo sapiens
gcctgaaagaggctgaggcctgg

SEQ ID NO: 3681699 - DNA, 13 bp, Homo sapiens
gcctgaagggcct

SEQ ID NO: 3681700 - DNA, 21 bp, Homo sapiens
gcctgaagggcctcccagccc

SEQ ID NO: 3681701 - DNA, 17 bp, Homo sapiens
gcctgaaggggcgtctg

SEQ ID NO: 3681702 - DNA, 18 bp, Homo sapiens
gcctgaaggggcgtctgt

SEQ ID NO: 3681703 - DNA, 20 bp, Homo sapiens
gcctgacaaccactggtctg

SEQ ID NO: 3681704 - DNA, 21 bp, Homo sapiens
gcctgacaaccactggtctgt

SEQ ID NO: 3681705 - DNA, 19 bp, Homo sapiens
gcctgactagggagccatg

SEQ ID NO: 3681706 - DNA, 20 bp, Homo sapiens
gcctgactagggagccatgt

SEQ ID NO: 3681707 - DNA, 16 bp, Homo sapiens
gcctgatgagggggaa

SEQ ID NO: 3681708 - DNA, 17 bp, Homo sapiens
gcctgatgctccctccc

SEQ ID NO: 3681709 - DNA, 22 bp, Homo sapiens
gcctgcagggaagccccacatg

SEQ ID NO: 3681710 - DNA, 14 bp, Homo sapiens
gcctgccagctgca

SEQ ID NO: 3681711 - DNA, 15 bp, Homo sapiens
gcctgcccctcccag

SEQ ID NO: 3681712 - DNA, 16 bp, Homo sapiens
gcctgcctcttctcta

SEQ ID NO: 3681713 - DNA, 12 bp, Homo sapiens
gcctgctccaga

SEQ ID NO: 3681714 - DNA, 15 bp, Homo sapiens
gcctgctccagctgt

SEQ ID NO: 3681715 - DNA, 18 bp, Homo sapiens
gcctgctccagctgttca

SEQ ID NO: 3681716 - DNA, 19 bp, Homo sapiens
gcctgctgcgccccaggcc

SEQ ID NO: 3681717 - DNA, 14 bp, Homo sapiens
gcctggaccctgtg

SEQ ID NO: 3681718 - DNA, 20 bp, Homo sapiens
gcctggagatcctcctgcag

SEQ ID NO: 3681719 - DNA, 16 bp, Homo sapiens
gcctggccagacacag

SEQ ID NO: 3681720 - DNA, 20 bp, Homo sapiens
gcctggccagacacaggccc

SEQ ID NO: 3681721 - DNA, 15 bp, Homo sapiens
gcctggccaggagct

SEQ ID NO: 3681722 - DNA, 14 bp, Homo sapiens
gcctggccaggcag

SEQ ID NO: 3681723 - DNA, 15 bp, Homo sapiens
gcctggccaggcaga

SEQ ID NO: 3681724 - DNA, 21 bp, Homo sapiens
gcctgggaggtcaaggctgca

SEQ ID NO: 3681725 - DNA, 17 bp, Homo sapiens
gcctgggccgctgccac

SEQ ID NO: 3681726 - DNA, 17 bp, Homo sapiens
gcctggtggcccagcta

SEQ ID NO: 3681727 - DNA, 18 bp, Homo sapiens
gcctggtggcccagctat

SEQ ID NO: 3681728 - DNA, 19 bp, Homo sapiens
gcctgtggcgccgtctcca

SEQ ID NO: 3681729 - DNA, 21 bp, Homo sapiens
gcctgtggcgccgtctccagg

SEQ ID NO: 3681730 - DNA, 23 bp, Homo sapiens
gcctgtggcgccgtctccagggg

SEQ ID NO: 3681731 - DNA, 20 bp, Homo sapiens
gcctgtgtccatgcgctcag

SEQ ID NO: 3681732 - DNA, 22 bp, Homo sapiens
gcctgtgtctttaaatgctgct

SEQ ID NO: 3681733 - DNA, 23 bp, Homo sapiens
gccttcagacagagaggactgta

SEQ ID NO: 3681734 - DNA, 20 bp, Homo sapiens
gccttcgcttcttgcctctg

SEQ ID NO: 3681735 - DNA, 22 bp, Homo sapiens
gccttcgcttcttgcctctgtg

SEQ ID NO: 3681736 - DNA, 21 bp, Homo sapiens
gccttcttttctcccttttaa

SEQ ID NO: 3681737 - DNA, 13 bp, Homo sapiens
gccttgccagaga

SEQ ID NO: 3681738 - DNA, 17 bp, Homo sapiens
gccttgccagagatcca

SEQ ID NO: 3681739 - DNA, 14 bp, Homo sapiens
gccttgggctgctc

SEQ ID NO: 3681740 - DNA, 15 bp, Homo sapiens
gccttgggctgctcc

SEQ ID NO: 3681741 - DNA, 22 bp, Homo sapiens
gccttggtgggggagcctctgg

SEQ ID NO: 3681742 - DNA, 15 bp, Homo sapiens
gcctttcctggaagc

SEQ ID NO: 3681743 - DNA, 14 bp, Homo sapiens
gccttttaattttt

SEQ ID NO: 3681744 - DNA, 14 bp, Homo sapiens
gcgaaaacaggaga

SEQ ID NO: 3681745 - DNA, 22 bp, Homo sapiens
gcgaaggtcccacagccctgag

SEQ ID NO: 3681746 - DNA, 19 bp, Homo sapiens
gcgaccctgggggcacagg

SEQ ID NO: 3681747 - DNA, 19 bp, Homo sapiens
gcgactccgttggccactc

SEQ ID NO: 3681748 - DNA, 20 bp, Homo sapiens
gcgactccgttggccactcc

SEQ ID NO: 3681749 - DNA, 14 bp, Homo sapiens
gcgactttctgcct

SEQ ID NO: 3681750 - DNA, 12 bp, Homo sapiens
gcgaggcccctc

SEQ ID NO: 3681751 - DNA, 22 bp, Homo sapiens
gcgccgtctccaggggctgctt

SEQ ID NO: 3681752 - DNA, 19 bp, Homo sapiens
gcgcctccttaggagtggg

SEQ ID NO: 3681753 - DNA, 16 bp, Homo sapiens
gcgcctttcccaactc

SEQ ID NO: 3681754 - DNA, 16 bp, Homo sapiens
gcgctcagggccatgc

SEQ ID NO: 3681755 - DNA, 13 bp, Homo sapiens
gcgcttgctggcc

SEQ ID NO: 3681756 - DNA, 18 bp, Homo sapiens
gcggagctccaggatggg

SEQ ID NO: 3681757 - DNA, 15 bp, Homo sapiens
gcggcaggggcctgg

SEQ ID NO: 3681758 - DNA, 15 bp, Homo sapiens
gcggccaggcggggc

SEQ ID NO: 3681759 - DNA, 18 bp, Homo sapiens
gcggccaggcggggcgcc

SEQ ID NO: 3681760 - DNA, 11 bp, Homo sapiens
gcgggactcct

SEQ ID NO: 3681761 - DNA, 15 bp, Homo sapiens
gcgggagctctgtat

SEQ ID NO: 3681762 - DNA, 23 bp, Homo sapiens
gcgggccctgcctgagggtgggc

SEQ ID NO: 3681763 - DNA, 17 bp, Homo sapiens
gcggggctcctcctgaa

SEQ ID NO: 3681764 - DNA, 11 bp, Homo sapiens
gcggggcttct

SEQ ID NO: 3681765 - DNA, 17 bp, Homo sapiens
gcggggcttctcttggg

SEQ ID NO: 3681766 - DNA, 15 bp, Homo sapiens
gaggagctgctggct

SEQ ID NO: 3681767 - DNA, 17 bp, Homo sapiens
gaggaggggccgctgcc

SEQ ID NO: 3681768 - DNA, 14 bp, Homo sapiens
gaggatcagttttt

SEQ ID NO: 3681769 - DNA, 16 bp, Homo sapiens
gaggatctcttgagcc

SEQ ID NO: 3681770 - DNA, 19 bp, Homo sapiens
gaggatctcttgagcctgg

SEQ ID NO: 3681771 - DNA, 20 bp, Homo sapiens
gaggattgcttgagctcagg

SEQ ID NO: 3681772 - DNA, 14 bp, Homo sapiens
gaggcagggaagtc

SEQ ID NO: 3681773 - DNA, 17 bp, Homo sapiens
gaggccaaaggctggtg

SEQ ID NO: 3681774 - DNA, 13 bp, Homo sapiens
gaggccagcccca

SEQ ID NO: 3681775 - DNA, 14 bp, Homo sapiens
gaggccagccccac

SEQ ID NO: 3681776 - DNA, 18 bp, Homo sapiens
gaggccagccccacccag

SEQ ID NO: 3681777 - DNA, 18 bp, Homo sapiens
gaggcccagttcaccctg

SEQ ID NO: 3681778 - DNA, 24 bp, Homo sapiens
gaggcccatcccccacctgccagc

SEQ ID NO: 3681779 - DNA, 19 bp, Homo sapiens
gaggccccagcctccctga

SEQ ID NO: 3681780 - DNA, 22 bp, Homo sapiens
gaggccccagcctccctgaagc

SEQ ID NO: 3681781 - DNA, 14 bp, Homo sapiens
gaggcccccagccc

SEQ ID NO: 3681782 - DNA, 17 bp, Homo sapiens
gaggcccccagcccagg

SEQ ID NO: 3681783 - DNA, 24 bp, Homo sapiens
gaggcccctatgtagtccgtgctg

SEQ ID NO: 3681784 - DNA, 20 bp, Homo sapiens
gaggcccgcatgcggcccag

SEQ ID NO: 3681785 - DNA, 20 bp, Homo sapiens
gaggccctcccaaagaggcc

SEQ ID NO: 3681786 - DNA, 19 bp, Homo sapiens
gaggccctctggagtggcc

SEQ ID NO: 3681787 - DNA, 22 bp, Homo sapiens
gaggccctgtgccccttgacaa

SEQ ID NO: 3681788 - DNA, 13 bp, Homo sapiens
gaggcctggactt

SEQ ID NO: 3681789 - DNA, 14 bp, Homo sapiens
gaggcctgggccgc

SEQ ID NO: 3681790 - DNA, 16 bp, Homo sapiens
gaggcggagctccagg

SEQ ID NO: 3681791 - DNA, 12 bp, Homo sapiens
gaggctcctgtg

SEQ ID NO: 3681792 - DNA, 14 bp, Homo sapiens
gaggctcctgtggt

SEQ ID NO: 3681793 - DNA, 15 bp, Homo sapiens
gaggctcctgtggta

SEQ ID NO: 3681794 - DNA, 17 bp, Homo sapiens
gaggctcctgtggtagt

SEQ ID NO: 3681795 - DNA, 22 bp, Homo sapiens
gaggctcctgtggtagtcctcc

SEQ ID NO: 3681796 - DNA, 19 bp, Homo sapiens
gaggctgacgtgtgaggga

SEQ ID NO: 3681797 - DNA, 12 bp, Homo sapiens
gaggctggcagg

SEQ ID NO: 3681798 - DNA, 23 bp, Homo sapiens
gaggctgtggtcacagcggaggt

SEQ ID NO: 3681799 - DNA, 19 bp, Homo sapiens
gaggcttcttcctggatgg

SEQ ID NO: 3681800 - DNA, 14 bp, Homo sapiens
gaggcttgcccagg

SEQ ID NO: 3681801 - DNA, 15 bp, Homo sapiens
gagggacggccaaga

SEQ ID NO: 3681802 - DNA, 17 bp, Homo sapiens
gagggaggcaagccctg

SEQ ID NO: 3681803 - DNA, 16 bp, Homo sapiens
gagggaggccccaggg

SEQ ID NO: 3681804 - DNA, 17 bp, Homo sapiens
gagggaggccccagggg

SEQ ID NO: 3681805 - DNA, 13 bp, Homo sapiens
gagggagggggct

SEQ ID NO: 3681806 - DNA, 18 bp, Homo sapiens
gagggattctggttccag

SEQ ID NO: 3681807 - DNA, 21 bp, Homo sapiens
gagggattctggttccagggt

SEQ ID NO: 3681808 - DNA, 22 bp, Homo sapiens
gagggcacaccgccatcctctg

SEQ ID NO: 3681809 - DNA, 17 bp, Homo sapiens
gagggcagactggggca

SEQ ID NO: 3681810 - DNA, 23 bp, Homo sapiens
gagggcagactggggcatcctgt

SEQ ID NO: 3681811 - DNA, 15 bp, Homo sapiens
gagggcaggtccagc

SEQ ID NO: 3681812 - DNA, 21 bp, Homo sapiens
gagggcaggtccagctctgtg

SEQ ID NO: 3681813 - DNA, 15 bp, Homo sapiens
gagggccctacctga

SEQ ID NO: 3681814 - DNA, 13 bp, Homo sapiens
gagggcggcaggg

SEQ ID NO: 3681815 - DNA, 17 bp, Homo sapiens
gaggggccggccctgtg

SEQ ID NO: 3681816 - DNA, 17 bp, Homo sapiens
gagggggaattcctgga

SEQ ID NO: 3681817 - DNA, 18 bp, Homo sapiens
gagggggaattcctggaa

SEQ ID NO: 3681818 - DNA, 15 bp, Homo sapiens
gagggtcctggctcc

SEQ ID NO: 3681819 - DNA, 22 bp, Homo sapiens
gaggtcccctcgtcccatccag

SEQ ID NO: 3681820 - DNA, 15 bp, Homo sapiens
gaggtcgaggcagga

SEQ ID NO: 3681821 - DNA, 23 bp, Homo sapiens
gaggtcggtaggttcagccaagg

SEQ ID NO: 3681822 - DNA, 13 bp, Homo sapiens
gaggtgattccag

SEQ ID NO: 3681823 - DNA, 21 bp, Homo sapiens
gaggtgggccagtctgtggat

SEQ ID NO: 3681824 - DNA, 19 bp, Homo sapiens
gaggttaaggctgaggaaa

SEQ ID NO: 3681825 - DNA, 16 bp, Homo sapiens
gaggttgtgcactgtt

SEQ ID NO: 3681826 - DNA, 17 bp, Homo sapiens
gagtagaaagacagagc

SEQ ID NO: 3681827 - DNA, 21 bp, Homo sapiens
gagtattctcggatagttgct

SEQ ID NO: 3681828 - DNA, 18 bp, Homo sapiens
gagtcgtggggtgtgctg

SEQ ID NO: 3681829 - DNA, 21 bp, Homo sapiens
gagtcgtggggtgtgctggga

SEQ ID NO: 3681830 - DNA, 19 bp, Homo sapiens
gagtctaatagtctttgcc

SEQ ID NO: 3681831 - DNA, 20 bp, Homo sapiens
gagtgacacccaagagggct

SEQ ID NO: 3681832 - DNA, 20 bp, Homo sapiens
gagtgcttccgctgcggtga

SEQ ID NO: 3681833 - DNA, 10 bp, Homo sapiens
gagtggcctg

SEQ ID NO: 3681834 - DNA, 13 bp, Homo sapiens
gagtggcctggcc

SEQ ID NO: 3681835 - DNA, 15 bp, Homo sapiens
gagtggcctggccag

SEQ ID NO: 3681836 - DNA, 18 bp, Homo sapiens
gagtggcctggccaggag

SEQ ID NO: 3681837 - DNA, 20 bp, Homo sapiens
gagtggcctggccaggagct

SEQ ID NO: 3681838 - DNA, 23 bp, Homo sapiens
gagtgtcctaggagtatcctcat

SEQ ID NO: 3681839 - DNA, 13 bp, Homo sapiens
gagttaagacctg

SEQ ID NO: 3681840 - DNA, 17 bp, Homo sapiens
gagttaagacctggcag

SEQ ID NO: 3681841 - DNA, 21 bp, Homo sapiens
gagttcaggtagctgcccctg

SEQ ID NO: 3681842 - DNA, 17 bp, Homo sapiens
gagttgatctggaaccc

SEQ ID NO: 3681843 - DNA, 20 bp, Homo sapiens
gagttgatctggaacccaga

SEQ ID NO: 3681844 - DNA, 18 bp, Homo sapiens
gagttgattcagctctgc

SEQ ID NO: 3681845 - DNA, 23 bp, Homo sapiens
gagttggacttcagtcttgccta

SEQ ID NO: 3681846 - DNA, 22 bp, Homo sapiens
gataaagatgcaaggaccagga

SEQ ID NO: 3681847 - DNA, 14 bp, Homo sapiens
gataaagcacagct

SEQ ID NO: 3681848 - DNA, 15 bp, Homo sapiens
gataaagcacagctg

SEQ ID NO: 3681849 - DNA, 17 bp, Homo sapiens
gataaggtaaaatgcca

SEQ ID NO: 3681850 - DNA, 21 bp, Homo sapiens
gatacatacaccagcattcct

SEQ ID NO: 3681851 - DNA, 14 bp, Homo sapiens
gatacatacagaat

SEQ ID NO: 3681852 - DNA, 18 bp, Homo sapiens
gatacggggtcttgctct

SEQ ID NO: 3681853 - DNA, 20 bp, Homo sapiens
gatacggggtcttgctctgt

SEQ ID NO: 3681854 - DNA, 18 bp, Homo sapiens
gatactgcgactttctgc

SEQ ID NO: 3681855 - DNA, 20 bp, Homo sapiens
gatagatgctggcccagggc

SEQ ID NO: 3681856 - DNA, 16 bp, Homo sapiens
gatagtattgtgcata

SEQ ID NO: 3681857 - DNA, 23 bp, Homo sapiens
gatagtcttttgcttttggcaaa

SEQ ID NO: 3681858 - DNA, 15 bp, Homo sapiens
gatagttgctatttt

SEQ ID NO: 3681859 - DNA, 21 bp, Homo sapiens
gatatactatgggatgtatat

SEQ ID NO: 3681860 - DNA, 23 bp, Homo sapiens
gatcaaggccttattggaaagca

SEQ ID NO: 3681861 - DNA, 14 bp, Homo sapiens
gatcagcagaagat

SEQ ID NO: 3681862 - DNA, 13 bp, Homo sapiens
gatcagccatggc

SEQ ID NO: 3681863 - DNA, 12 bp, Homo sapiens
gatcagcctggg

SEQ ID NO: 3681864 - DNA, 19 bp, Homo sapiens
gatcatgtactttttagta

SEQ ID NO: 3681865 - DNA, 14 bp, Homo sapiens
gatcattttccccc

SEQ ID NO: 3681866 - DNA, 16 bp, Homo sapiens
gatccaaaagaagccc

SEQ ID NO: 3681867 - DNA, 13 bp, Homo sapiens
gatccagcctggg

SEQ ID NO: 3681868 - DNA, 21 bp, Homo sapiens
gatccagcctggggtctggag

SEQ ID NO: 3681869 - DNA, 12 bp, Homo sapiens
gatccagggaca

SEQ ID NO: 3681870 - DNA, 14 bp, Homo sapiens
gatccagggacaga

SEQ ID NO: 3681871 - DNA, 22 bp, Homo sapiens
gatccagtgtaaacttccgttc

SEQ ID NO: 3681872 - DNA, 15 bp, Homo sapiens
gatcccacacaggct

SEQ ID NO: 3681873 - DNA, 13 bp, Homo sapiens
gatccctcccccc

SEQ ID NO: 3681874 - DNA, 23 bp, Homo sapiens
gatccctcccccccatgcactgt

SEQ ID NO: 3681875 - DNA, 20 bp, Homo sapiens
gatccctgtgttgtctctag

SEQ ID NO: 3681876 - DNA, 14 bp, Homo sapiens
gatccgactgcttt

SEQ ID NO: 3681877 - DNA, 18 bp, Homo sapiens
gatcctaagggctcaccg

SEQ ID NO: 3681878 - DNA, 16 bp, Homo sapiens
gatcctcctgcagacc

SEQ ID NO: 3681879 - DNA, 16 bp, Homo sapiens
gatcctgatagcctgt

SEQ ID NO: 3681880 - DNA, 17 bp, Homo sapiens
gatcctgcgggtggggc

SEQ ID NO: 3681881 - DNA, 12 bp, Homo sapiens
gatcctggaggc

SEQ ID NO: 3681882 - DNA, 16 bp, Homo sapiens
gatcctggaggcccag

SEQ ID NO: 3681883 - DNA, 13 bp, Homo sapiens
gatcgcagtttgc

SEQ ID NO: 3681884 - DNA, 19 bp, Homo sapiens
gcaggtggatctccttgag

SEQ ID NO: 3681885 - DNA, 21 bp, Homo sapiens
gcaggtggatctccttgagat

SEQ ID NO: 3681886 - DNA, 17 bp, Homo sapiens
gcagtactcctccctgg

SEQ ID NO: 3681887 - DNA, 21 bp, Homo sapiens
gcagtcatggagaaccaccta

SEQ ID NO: 3681888 - DNA, 15 bp, Homo sapiens
gcagtcgtgcctgtg

SEQ ID NO: 3681889 - DNA, 18 bp, Homo sapiens
gcagtcgtgcctgtgtcc

SEQ ID NO: 3681890 - DNA, 15 bp, Homo sapiens
gcagtgagcactgaa

SEQ ID NO: 3681891 - DNA, 21 bp, Homo sapiens
gcagtgatgtatacatcttat

SEQ ID NO: 3681892 - DNA, 13 bp, Homo sapiens
gcagtgctctttg

SEQ ID NO: 3681893 - DNA, 19 bp, Homo sapiens
gcagtggcgcattctaggc

SEQ ID NO: 3681894 - DNA, 15 bp, Homo sapiens
gcagtggctggtcca

SEQ ID NO: 3681895 - DNA, 18 bp, Homo sapiens
gcagtggctggtccaggg

SEQ ID NO: 3681896 - DNA, 19 bp, Homo sapiens
gcagtggctggtccagggc

SEQ ID NO: 3681897 - DNA, 16 bp, Homo sapiens
gcagtgtggggagggc

SEQ ID NO: 3681898 - DNA, 19 bp, Homo sapiens
gcagttctgggtgctccct

SEQ ID NO: 3681899 - DNA, 21 bp, Homo sapiens
gcagtttgcctggtgcagtgg

SEQ ID NO: 3681900 - DNA, 15 bp, Homo sapiens
gcataaaaattagcc

SEQ ID NO: 3681901 - DNA, 19 bp, Homo sapiens
gcataggacctttccacca

SEQ ID NO: 3681902 - DNA, 17 bp, Homo sapiens
gcataggtctctttgct

SEQ ID NO: 3681903 - DNA, 13 bp, Homo sapiens
gcatagtttcttt

SEQ ID NO: 3681904 - DNA, 23 bp, Homo sapiens
gcatcagtttaggccttggcttg

SEQ ID NO: 3681905 - DNA, 12 bp, Homo sapiens
gcatccctgaga

SEQ ID NO: 3681906 - DNA, 13 bp, Homo sapiens
gcatccctgagac

SEQ ID NO: 3681907 - DNA, 16 bp, Homo sapiens
gcatcctgtgccacta

SEQ ID NO: 3681908 - DNA, 18 bp, Homo sapiens
gcatcgcaccattctgac

SEQ ID NO: 3681909 - DNA, 17 bp, Homo sapiens
gcatcggggccatttgg

SEQ ID NO: 3681910 - DNA, 14 bp, Homo sapiens
gcatctctgtactt

SEQ ID NO: 3681911 - DNA, 17 bp, Homo sapiens
gcatctctgtactttgc

SEQ ID NO: 3681912 - DNA, 14 bp, Homo sapiens
gcatctgcccctcc

SEQ ID NO: 3681913 - DNA, 18 bp, Homo sapiens
gcatctgcccctccccca

SEQ ID NO: 3681914 - DNA, 23 bp, Homo sapiens
gcatcttgcctccaggtgcagag

SEQ ID NO: 3681915 - DNA, 23 bp, Homo sapiens
gcatctttgccttgggctgctcc

SEQ ID NO: 3681916 - DNA, 18 bp, Homo sapiens
gcatgaataacatttaaa

SEQ ID NO: 3681917 - DNA, 14 bp, Homo sapiens
gcatgagaaataca

SEQ ID NO: 3681918 - DNA, 17 bp, Homo sapiens
gcatgcattgagctgcc

SEQ ID NO: 3681919 - DNA, 18 bp, Homo sapiens
gcatgcattgagctgcct

SEQ ID NO: 3681920 - DNA, 19 bp, Homo sapiens
gcatgcattgagctgcctc

SEQ ID NO: 3681921 - DNA, 20 bp, Homo sapiens
gcatgcattgagctgcctcc

SEQ ID NO: 3681922 - DNA, 22 bp, Homo sapiens
gcatgcattgagctgcctccag

SEQ ID NO: 3681923 - DNA, 22 bp, Homo sapiens
gcatgctggagtacccagccta

SEQ ID NO: 3681924 - DNA, 17 bp, Homo sapiens
gcatgcttccctgcagc

SEQ ID NO: 3681925 - DNA, 19 bp, Homo sapiens
gcatgcttccctgcagctg

SEQ ID NO: 3681926 - DNA, 21 bp, Homo sapiens
gcatgcttccctgcagctgac

SEQ ID NO: 3681927 - DNA, 17 bp, Homo sapiens
gcatggaaaatcagtga

SEQ ID NO: 3681928 - DNA, 21 bp, Homo sapiens
gcatggggcgggtcctagctg

SEQ ID NO: 3681929 - DNA, 15 bp, Homo sapiens
gcatggtgccccagg

SEQ ID NO: 3681930 - DNA, 16 bp, Homo sapiens
gcatggtggccagagg

SEQ ID NO: 3681931 - DNA, 21 bp, Homo sapiens
gcatgttactacagaggaaag

SEQ ID NO: 3681932 - DNA, 20 bp, Homo sapiens
gcattgagctgcctccagcc

SEQ ID NO: 3681933 - DNA, 17 bp, Homo sapiens
gcattgatggggaagga

SEQ ID NO: 3681934 - DNA, 22 bp, Homo sapiens
gcatttcacaaaacagcctttg

SEQ ID NO: 3681935 - DNA, 17 bp, Homo sapiens
gcatttgctgaatacag

SEQ ID NO: 3681936 - DNA, 16 bp, Homo sapiens
gcatttggattggggt

SEQ ID NO: 3681937 - DNA, 17 bp, Homo sapiens
gcatttgtgctagaaat

SEQ ID NO: 3681938 - DNA, 22 bp, Homo sapiens
gcattttgctaaatgtgaatga

SEQ ID NO: 3681939 - DNA, 14 bp, Homo sapiens
gcatttttgtaaat

SEQ ID NO: 3681940 - DNA, 13 bp, Homo sapiens
gccaaaaaggata

SEQ ID NO: 3681941 - DNA, 18 bp, Homo sapiens
gccaaaataccagagcct

SEQ ID NO: 3681942 - DNA, 17 bp, Homo sapiens
gccaaaattcatttcta

SEQ ID NO: 3681943 - DNA, 23 bp, Homo sapiens
gccaaacaaaaaggttctcaggt

SEQ ID NO: 3681944 - DNA, 19 bp, Homo sapiens
gccaaagcctcctccagcc

SEQ ID NO: 3681945 - DNA, 16 bp, Homo sapiens
gccaaagctagggtgg

SEQ ID NO: 3681946 - DNA, 16 bp, Homo sapiens
gccaacttcccctcta

SEQ ID NO: 3681947 - DNA, 12 bp, Homo sapiens
gccaagaatgta

SEQ ID NO: 3681948 - DNA, 14 bp, Homo sapiens
gccaaggagctgct

SEQ ID NO: 3681949 - DNA, 16 bp, Homo sapiens
gccaaggagctgctat

SEQ ID NO: 3681950 - DNA, 21 bp, Homo sapiens
gccaaggagctgctatagcct

SEQ ID NO: 3681951 - DNA, 23 bp, Homo sapiens
gccaaggagctgctatagcctgg

SEQ ID NO: 3681952 - DNA, 15 bp, Homo sapiens
gccaaggtgggagga

SEQ ID NO: 3681953 - DNA, 20 bp, Homo sapiens
gccaaggttttataaggctg

SEQ ID NO: 3681954 - DNA, 13 bp, Homo sapiens
gccaattgctacc

SEQ ID NO: 3681955 - DNA, 14 bp, Homo sapiens
gccacaaggacttc

SEQ ID NO: 3681956 - DNA, 19 bp, Homo sapiens
gccaccccgggctctctgc

SEQ ID NO: 3681957 - DNA, 19 bp, Homo sapiens
gccaccccttcctcagcct

SEQ ID NO: 3681958 - DNA, 20 bp, Homo sapiens
gccaccccttcctcagcctg

SEQ ID NO: 3681959 - DNA, 14 bp, Homo sapiens
gccactaagcagag

SEQ ID NO: 3681960 - DNA, 15 bp, Homo sapiens
gccactaagcagagg

SEQ ID NO: 3681961 - DNA, 16 bp, Homo sapiens
gccactaagcagagga

SEQ ID NO: 3681962 - DNA, 20 bp, Homo sapiens
gccactaagcagaggagggg

SEQ ID NO: 3681963 - DNA, 15 bp, Homo sapiens
gccactcactaggcc

SEQ ID NO: 3681964 - DNA, 19 bp, Homo sapiens
gccactcactaggccccca

SEQ ID NO: 3681965 - DNA, 21 bp, Homo sapiens
gccactccgagaggtgggcca

SEQ ID NO: 3681966 - DNA, 14 bp, Homo sapiens
gccactgagctggc

SEQ ID NO: 3681967 - DNA, 15 bp, Homo sapiens
gccactgagctggct

SEQ ID NO: 3681968 - DNA, 20 bp, Homo sapiens
gccactgtgaaccggctccc

SEQ ID NO: 3681969 - DNA, 21 bp, Homo sapiens
gccactgtgaaccggctccca

SEQ ID NO: 3681970 - DNA, 16 bp, Homo sapiens
gccagagatccaaaag

SEQ ID NO: 3681971 - DNA, 22 bp, Homo sapiens
gccagagccaaggggcttcagg

SEQ ID NO: 3681972 - DNA, 14 bp, Homo sapiens
gccagagccagggg

SEQ ID NO: 3681973 - DNA, 12 bp, Homo sapiens
gccagaggctgg

SEQ ID NO: 3681974 - DNA, 13 bp, Homo sapiens
gccagaggctggg

SEQ ID NO: 3681975 - DNA, 19 bp, Homo sapiens
gccagagtggcctggccag

SEQ ID NO: 3681976 - DNA, 17 bp, Homo sapiens
gccagatccagcctggg

SEQ ID NO: 3681977 - DNA, 20 bp, Homo sapiens
gccagatccagcctggggtc

SEQ ID NO: 3681978 - DNA, 14 bp, Homo sapiens
gccagatttgtctt

SEQ ID NO: 3681979 - DNA, 17 bp, Homo sapiens
gccagcaagaggaaggg

SEQ ID NO: 3681980 - DNA, 23 bp, Homo sapiens
gccagcaagaggaaggggtgctg

SEQ ID NO: 3681981 - DNA, 19 bp, Homo sapiens
gccagccagtgacctgagg

SEQ ID NO: 3681982 - DNA, 19 bp, Homo sapiens
gccagccccacccaggagg

SEQ ID NO: 3681983 - DNA, 20 bp, Homo sapiens
gccagcctggcatcagttta

SEQ ID NO: 3681984 - DNA, 19 bp, Homo sapiens
gccagcgcccctcagcctc

SEQ ID NO: 3681985 - DNA, 17 bp, Homo sapiens
gccagctggcagcagag

SEQ ID NO: 3681986 - DNA, 22 bp, Homo sapiens
gccaggaagctttggtgagaac

SEQ ID NO: 3681987 - DNA, 20 bp, Homo sapiens
gccaggaatttcccaggacc

SEQ ID NO: 3681988 - DNA, 20 bp, Homo sapiens
gccaggagctcttcaggcct

SEQ ID NO: 3681989 - DNA, 22 bp, Homo sapiens
gccaggagctcttcaggcctcc

SEQ ID NO: 3681990 - DNA, 13 bp, Homo sapiens
gccaggagctggg

SEQ ID NO: 3681991 - DNA, 23 bp, Homo sapiens
gccaggagctgggcagaaggcca

SEQ ID NO: 3681992 - DNA, 14 bp, Homo sapiens
gccaggcagatctg

SEQ ID NO: 3681993 - DNA, 15 bp, Homo sapiens
gccaggcagatctgt

SEQ ID NO: 3681994 - DNA, 23 bp, Homo sapiens
gccaggcagatctgtgccccatg

SEQ ID NO: 3681995 - DNA, 18 bp, Homo sapiens
gccaggcccccaagcctg

SEQ ID NO: 3681996 - DNA, 21 bp, Homo sapiens
gccaggcggggcgccccaaga

SEQ ID NO: 3681997 - DNA, 14 bp, Homo sapiens
gccaggctgccaag

SEQ ID NO: 3681998 - DNA, 19 bp, Homo sapiens
gccagggaactggcctgct

SEQ ID NO: 3681999 - DNA, 16 bp, Homo sapiens
gccagggagaagctcc

SEQ ID NO: 3682000 - DNA, 20 bp, Homo sapiens
gccagggagaagctcctctc

SEQ ID NO: 3682001 - DNA, 11 bp, Homo sapiens
gccagggagct

SEQ ID NO: 3682002 - DNA, 18 bp, Homo sapiens
gctgagcaaatcaccaca

SEQ ID NO: 3682003 - DNA, 12 bp, Homo sapiens
gctgagcctgca

SEQ ID NO: 3682004 - DNA, 16 bp, Homo sapiens
gctgagcctgcaggga

SEQ ID NO: 3682005 - DNA, 20 bp, Homo sapiens
gctgagcctgcagggaagcc

SEQ ID NO: 3682006 - DNA, 11 bp, Homo sapiens
gctgagctgcc

SEQ ID NO: 3682007 - DNA, 15 bp, Homo sapiens
gctgagctgcccctg

SEQ ID NO: 3682008 - DNA, 19 bp, Homo sapiens
gctgagctgcccctgctgc

SEQ ID NO: 3682009 - DNA, 16 bp, Homo sapiens
gctgaggaaaggccag

SEQ ID NO: 3682010 - DNA, 17 bp, Homo sapiens
gctgaggaaaggccagc

SEQ ID NO: 3682011 - DNA, 23 bp, Homo sapiens
gctgaggaaaggccagctggcag

SEQ ID NO: 3682012 - DNA, 14 bp, Homo sapiens
gctgaggcctggac

SEQ ID NO: 3682013 - DNA, 15 bp, Homo sapiens
gctgaggcctgggcc

SEQ ID NO: 3682014 - DNA, 17 bp, Homo sapiens
gctgaggcctgggccgc

SEQ ID NO: 3682015 - DNA, 20 bp, Homo sapiens
gctgaggcctgggccgctgc

SEQ ID NO: 3682016 - DNA, 18 bp, Homo sapiens
gctgagggtgagtgggtg

SEQ ID NO: 3682017 - DNA, 17 bp, Homo sapiens
gctgatgtcaatttctg

SEQ ID NO: 3682018 - DNA, 12 bp, Homo sapiens
gctgcaaggttt

SEQ ID NO: 3682019 - DNA, 15 bp, Homo sapiens
gctgcaccctcaggc

SEQ ID NO: 3682020 - DNA, 19 bp, Homo sapiens
gctgcaccctcaggcaggt

SEQ ID NO: 3682021 - DNA, 23 bp, Homo sapiens
gctgcagcaccgaggggcctttg

SEQ ID NO: 3682022 - DNA, 15 bp, Homo sapiens
gctgccaaggccaga

SEQ ID NO: 3682023 - DNA, 23 bp, Homo sapiens
gctgccaaggccagagtggcctg

SEQ ID NO: 3682024 - DNA, 19 bp, Homo sapiens
gctgccacccacctccctg

SEQ ID NO: 3682025 - DNA, 23 bp, Homo sapiens
gctgccacccacctccctgcctc

SEQ ID NO: 3682026 - DNA, 22 bp, Homo sapiens
gctgccatctcacctcctgctg

SEQ ID NO: 3682027 - DNA, 16 bp, Homo sapiens
gctgcccagcccctcc

SEQ ID NO: 3682028 - DNA, 22 bp, Homo sapiens
gctgcccagcccctcctccctg

SEQ ID NO: 3682029 - DNA, 22 bp, Homo sapiens
gctgcccctcatctctctgccc

SEQ ID NO: 3682030 - DNA, 12 bp, Homo sapiens
gctgcccctgct

SEQ ID NO: 3682031 - DNA, 14 bp, Homo sapiens
gctgcccctgctgc

SEQ ID NO: 3682032 - DNA, 13 bp, Homo sapiens
gctgccgtggggc

SEQ ID NO: 3682033 - DNA, 17 bp, Homo sapiens
gctgcctccagcctggt

SEQ ID NO: 3682034 - DNA, 19 bp, Homo sapiens
gctgcctccagcctggtgg

SEQ ID NO: 3682035 - DNA, 16 bp, Homo sapiens
gctgcgccccaggccc

SEQ ID NO: 3682036 - DNA, 15 bp, Homo sapiens
gctgcgcccccttct

SEQ ID NO: 3682037 - DNA, 15 bp, Homo sapiens
gctgctatagcctgg

SEQ ID NO: 3682038 - DNA, 17 bp, Homo sapiens
gctgctatagcctgggg

SEQ ID NO: 3682039 - DNA, 13 bp, Homo sapiens
gctgctccctgag

SEQ ID NO: 3682040 - DNA, 15 bp, Homo sapiens
gctgctccctgaggg

SEQ ID NO: 3682041 - DNA, 13 bp, Homo sapiens
gctgctccctggc

SEQ ID NO: 3682042 - DNA, 16 bp, Homo sapiens
gctgctcctagaggga

SEQ ID NO: 3682043 - DNA, 23 bp, Homo sapiens
gctgctcctagagggaggggcct

SEQ ID NO: 3682044 - DNA, 22 bp, Homo sapiens
gctgctcctgaatgaggcggag

SEQ ID NO: 3682045 - DNA, 18 bp, Homo sapiens
gctgctgacctccacagc

SEQ ID NO: 3682046 - DNA, 11 bp, Homo sapiens
gctgctggctt

SEQ ID NO: 3682047 - DNA, 22 bp, Homo sapiens
gctgctgtgcaacggtctcctg

SEQ ID NO: 3682048 - DNA, 11 bp, Homo sapiens
gctgcttccca

SEQ ID NO: 3682049 - DNA, 15 bp, Homo sapiens
gctgcttcctcctgg

SEQ ID NO: 3682050 - DNA, 17 bp, Homo sapiens
gctggaaaataatactg

SEQ ID NO: 3682051 - DNA, 14 bp, Homo sapiens
gctggaagatcctg

SEQ ID NO: 3682052 - DNA, 22 bp, Homo sapiens
gctggagcccagggagcggaaa

SEQ ID NO: 3682053 - DNA, 14 bp, Homo sapiens
gctggagtacccag

SEQ ID NO: 3682054 - DNA, 15 bp, Homo sapiens
gctggagtacccagc

SEQ ID NO: 3682055 - DNA, 17 bp, Homo sapiens
gctggagtacccagcct

SEQ ID NO: 3682056 - DNA, 17 bp, Homo sapiens
gctggatttgatgagtt

SEQ ID NO: 3682057 - DNA, 13 bp, Homo sapiens
gctggcagcagag

SEQ ID NO: 3682058 - DNA, 22 bp, Homo sapiens
gctggccagtccaccctgcctg

SEQ ID NO: 3682059 - DNA, 15 bp, Homo sapiens
gctggccagtccagg

SEQ ID NO: 3682060 - DNA, 15 bp, Homo sapiens
gctggcccagggccc

SEQ ID NO: 3682061 - DNA, 16 bp, Homo sapiens
gctggcccagggccca

SEQ ID NO: 3682062 - DNA, 20 bp, Homo sapiens
gctggcccagggcccagagc

SEQ ID NO: 3682063 - DNA, 24 bp, Homo sapiens
gctggccgagggtcctggctcctg

SEQ ID NO: 3682064 - DNA, 16 bp, Homo sapiens
gctggctctgagcgcc

SEQ ID NO: 3682065 - DNA, 15 bp, Homo sapiens
gctgggactcagcct

SEQ ID NO: 3682066 - DNA, 16 bp, Homo sapiens
gctgggactcagcctt

SEQ ID NO: 3682067 - DNA, 22 bp, Homo sapiens
gctgggactcagccttcagaca

SEQ ID NO: 3682068 - DNA, 18 bp, Homo sapiens
gctgggagctccactctg

SEQ ID NO: 3682069 - DNA, 23 bp, Homo sapiens
gctgggctaggcataggtctctt

SEQ ID NO: 3682070 - DNA, 14 bp, Homo sapiens
gctgggctgctcct

SEQ ID NO: 3682071 - DNA, 15 bp, Homo sapiens
gctgggctgctcctg

SEQ ID NO: 3682072 - DNA, 16 bp, Homo sapiens
gctgggctgctcctga

SEQ ID NO: 3682073 - DNA, 17 bp, Homo sapiens
gctgggctgctcctgaa

SEQ ID NO: 3682074 - DNA, 15 bp, Homo sapiens
gctgggggtgggcca

SEQ ID NO: 3682075 - DNA, 21 bp, Homo sapiens
gctgggtggcaccagcagcct

SEQ ID NO: 3682076 - DNA, 14 bp, Homo sapiens
gctggtccagggct

SEQ ID NO: 3682077 - DNA, 17 bp, Homo sapiens
gctggtctttgagcgag

SEQ ID NO: 3682078 - DNA, 12 bp, Homo sapiens
gctggtgcacag

SEQ ID NO: 3682079 - DNA, 13 bp, Homo sapiens
gctggtgcccgga

SEQ ID NO: 3682080 - DNA, 14 bp, Homo sapiens
gctggtgcccggag

SEQ ID NO: 3682081 - DNA, 12 bp, Homo sapiens
gctggtggccca

SEQ ID NO: 3682082 - DNA, 15 bp, Homo sapiens
gctggtggcccagga

SEQ ID NO: 3682083 - DNA, 20 bp, Homo sapiens
gctgtcaatgggacctgtgg

SEQ ID NO: 3682084 - DNA, 21 bp, Homo sapiens
gctgtcatggtcctttctgga

SEQ ID NO: 3682085 - DNA, 14 bp, Homo sapiens
gctgtgaggctgtc

SEQ ID NO: 3682086 - DNA, 17 bp, Homo sapiens
gctgtgaggctgtcctg

SEQ ID NO: 3682087 - DNA, 15 bp, Homo sapiens
gctgtgaggcttgcc

SEQ ID NO: 3682088 - DNA, 18 bp, Homo sapiens
gctgtgaggcttgcccag

SEQ ID NO: 3682089 - DNA, 20 bp, Homo sapiens
gctgtgaggcttgcccagga

SEQ ID NO: 3682090 - DNA, 16 bp, Homo sapiens
gctgtgctatggtgct

SEQ ID NO: 3682091 - DNA, 17 bp, Homo sapiens
gctgtgcttatggtacc

SEQ ID NO: 3682092 - DNA, 18 bp, Homo sapiens
gctgtggagctccactgc

SEQ ID NO: 3682093 - DNA, 13 bp, Homo sapiens
gctgtggctctgg

SEQ ID NO: 3682094 - DNA, 17 bp, Homo sapiens
gctgtggctctgggtgg

SEQ ID NO: 3682095 - DNA, 20 bp, Homo sapiens
gctgtggctctgggtgggcg

SEQ ID NO: 3682096 - DNA, 16 bp, Homo sapiens
gctgtgtgtcccaggc

SEQ ID NO: 3682097 - DNA, 18 bp, Homo sapiens
gctgtgtgtcccaggcag

SEQ ID NO: 3682098 - DNA, 20 bp, Homo sapiens
gctgtgtgtcccaggcaggg

SEQ ID NO: 3682099 - DNA, 19 bp, Homo sapiens
gctgtgttggtgtggccca

SEQ ID NO: 3682100 - DNA, 13 bp, Homo sapiens
gctgttcagctgg

SEQ ID NO: 3682101 - DNA, 14 bp, Homo sapiens
gctgttgacatatt

SEQ ID NO: 3682102 - DNA, 17 bp, Homo sapiens
gctgttgacatatttaa

SEQ ID NO: 3682103 - DNA, 22 bp, Homo sapiens
gctgtttatggcctcagctgcc

SEQ ID NO: 3682104 - DNA, 17 bp, Homo sapiens
gctgtttgtcctgagat

SEQ ID NO: 3682105 - DNA, 18 bp, Homo sapiens
gctgttttcctcccttct

SEQ ID NO: 3682106 - DNA, 21 bp, Homo sapiens
gcttaagtgcatgcattgagc

SEQ ID NO: 3682107 - DNA, 16 bp, Homo sapiens
gcttaataaaagaaca

SEQ ID NO: 3682108 - DNA, 18 bp, Homo sapiens
gcttagcaactgctgggg

SEQ ID NO: 3682109 - DNA, 13 bp, Homo sapiens
gcttagtcctggg

SEQ ID NO: 3682110 - DNA, 22 bp, Homo sapiens
gcttagtcctgggagaggacag

SEQ ID NO: 3682111 - DNA, 12 bp, Homo sapiens
gcttagtttgtg

SEQ ID NO: 3682112 - DNA, 16 bp, Homo sapiens
gcttagtttgtgtgtt

SEQ ID NO: 3682113 - DNA, 21 bp, Homo sapiens
gcttagtttgtgtgttgtctc

SEQ ID NO: 3682114 - DNA, 19 bp, Homo sapiens
gcttatctcaggggtgtgc

SEQ ID NO: 3682115 - DNA, 15 bp, Homo sapiens
gcttatggtaccaga

SEQ ID NO: 3682116 - DNA, 15 bp, Homo sapiens
gcttatttcatctgt

SEQ ID NO: 3682117 - DNA, 15 bp, Homo sapiens
gcttcacggaagagc

SEQ ID NO: 3682118 - DNA, 14 bp, Homo sapiens
gcttcagccaggag

SEQ ID NO: 3682119 - DNA, 15 bp, Homo sapiens
gcttcagccaggagc

SEQ ID NO: 3682120 - DNA, 19 bp, Homo sapiens
gcttcagccaggagctggg

SEQ ID NO: 3682121 - DNA, 16 bp, Homo sapiens
gcacacactttcatgc

SEQ ID NO: 3682122 - DNA, 16 bp, Homo sapiens
gcacaccgccatcctc

SEQ ID NO: 3682123 - DNA, 22 bp, Homo sapiens
gcacaccgccatcctctgcctc

SEQ ID NO: 3682124 - DNA, 18 bp, Homo sapiens
gcacagcttgacctgagg

SEQ ID NO: 3682125 - DNA, 22 bp, Homo sapiens
gcacagcttgacctgaggctgt

SEQ ID NO: 3682126 - DNA, 20 bp, Homo sapiens
gcacaggaggcaggcatggc

SEQ ID NO: 3682127 - DNA, 12 bp, Homo sapiens
gcacagggtctg

SEQ ID NO: 3682128 - DNA, 19 bp, Homo sapiens
gcacatccgcgtgtgcctg

SEQ ID NO: 3682129 - DNA, 23 bp, Homo sapiens
gcacatccgcgtgtgcctgtgtg

SEQ ID NO: 3682130 - DNA, 14 bp, Homo sapiens
gcaccaccaagcca

SEQ ID NO: 3682131 - DNA, 11 bp, Homo sapiens
gcaccacccta

SEQ ID NO: 3682132 - DNA, 20 bp, Homo sapiens
gcaccaccctagtcccttcc

SEQ ID NO: 3682133 - DNA, 22 bp, Homo sapiens
gcaccaccctagtcccttcccc

SEQ ID NO: 3682134 - DNA, 15 bp, Homo sapiens
gcaccagacacccag

SEQ ID NO: 3682135 - DNA, 17 bp, Homo sapiens
gcaccagacacccagga

SEQ ID NO: 3682136 - DNA, 19 bp, Homo sapiens
gcaccagacacccaggact

SEQ ID NO: 3682137 - DNA, 20 bp, Homo sapiens
gcaccagacacccaggactt

SEQ ID NO: 3682138 - DNA, 14 bp, Homo sapiens
gcaccagcagcctg

SEQ ID NO: 3682139 - DNA, 16 bp, Homo sapiens
gcaccagcagcctgga

SEQ ID NO: 3682140 - DNA, 11 bp, Homo sapiens
gcaccagccag

SEQ ID NO: 3682141 - DNA, 21 bp, Homo sapiens
gcacccccctgggctgagaga

SEQ ID NO: 3682142 - DNA, 22 bp, Homo sapiens
gcaccctgcctacgccaggaga

SEQ ID NO: 3682143 - DNA, 22 bp, Homo sapiens
gcaccgcggcgcttcccagcac

SEQ ID NO: 3682144 - DNA, 15 bp, Homo sapiens
gcacctaatccaggc

SEQ ID NO: 3682145 - DNA, 17 bp, Homo sapiens
gcacctaatccaggcag

SEQ ID NO: 3682146 - DNA, 18 bp, Homo sapiens
gcacctaatccaggcaga

SEQ ID NO: 3682147 - DNA, 22 bp, Homo sapiens
gcacctaatccaggcagatcca

SEQ ID NO: 3682148 - DNA, 23 bp, Homo sapiens
gcacctaatccaggcagatccag

SEQ ID NO: 3682149 - DNA, 19 bp, Homo sapiens
gcacctagtaagtgcctgc

SEQ ID NO: 3682150 - DNA, 11 bp, Homo sapiens
gcacctcccat

SEQ ID NO: 3682151 - DNA, 17 bp, Homo sapiens
gcacctcccatcctaat

SEQ ID NO: 3682152 - DNA, 18 bp, Homo sapiens
gcacctggcatcgcacca

SEQ ID NO: 3682153 - DNA, 14 bp, Homo sapiens
gcaccttgtgcctg

SEQ ID NO: 3682154 - DNA, 14 bp, Homo sapiens
gcactaaggggccc

SEQ ID NO: 3682155 - DNA, 23 bp, Homo sapiens
gcactaaggggcccggccagcca

SEQ ID NO: 3682156 - DNA, 17 bp, Homo sapiens
gcactactgacatgtgg

SEQ ID NO: 3682157 - DNA, 21 bp, Homo sapiens
gcactaggtaggcttctacct

SEQ ID NO: 3682158 - DNA, 19 bp, Homo sapiens
gcactatctttcagctcca

SEQ ID NO: 3682159 - DNA, 14 bp, Homo sapiens
gcactccagcctgg

SEQ ID NO: 3682160 - DNA, 17 bp, Homo sapiens
gcactccagcctgggtg

SEQ ID NO: 3682161 - DNA, 15 bp, Homo sapiens
gcactccatccagct

SEQ ID NO: 3682162 - DNA, 14 bp, Homo sapiens
gcactctgcagtga

SEQ ID NO: 3682163 - DNA, 17 bp, Homo sapiens
gcactctgtatatttga

SEQ ID NO: 3682164 - DNA, 18 bp, Homo sapiens
gcactcttgttcccacac

SEQ ID NO: 3682165 - DNA, 16 bp, Homo sapiens
gcactgaaacattatt

SEQ ID NO: 3682166 - DNA, 19 bp, Homo sapiens
gcactgatgctgcccctca

SEQ ID NO: 3682167 - DNA, 17 bp, Homo sapiens
gcactgtcccttgcctc

SEQ ID NO: 3682168 - DNA, 18 bp, Homo sapiens
gcactgtcccttgcctca

SEQ ID NO: 3682169 - DNA, 23 bp, Homo sapiens
gcacttctttttctcgctgtcct

SEQ ID NO: 3682170 - DNA, 21 bp, Homo sapiens
gcacttgtctcaggactctga

SEQ ID NO: 3682171 - DNA, 21 bp, Homo sapiens
gcagaactcctacctgaaggc

SEQ ID NO: 3682172 - DNA, 19 bp, Homo sapiens
gcagaatgtaagtgggccc

SEQ ID NO: 3682173 - DNA, 22 bp, Homo sapiens
gcagaatgtaagtgggcccacc

SEQ ID NO: 3682174 - DNA, 20 bp, Homo sapiens
gcagactggggcatcctgtg

SEQ ID NO: 3682175 - DNA, 12 bp, Homo sapiens
gcagagctggct

SEQ ID NO: 3682176 - DNA, 11 bp, Homo sapiens
gcagagcttct

SEQ ID NO: 3682177 - DNA, 21 bp, Homo sapiens
gcagaggacagtctggagaag

SEQ ID NO: 3682178 - DNA, 17 bp, Homo sapiens
gcagaggaccagggcct

SEQ ID NO: 3682179 - DNA, 14 bp, Homo sapiens
gcagaggaggggcc

SEQ ID NO: 3682180 - DNA, 15 bp, Homo sapiens
gcagaggccagaggc

SEQ ID NO: 3682181 - DNA, 14 bp, Homo sapiens
gcagaggtaccctg

SEQ ID NO: 3682182 - DNA, 17 bp, Homo sapiens
gcagaggtaccctgggt

SEQ ID NO: 3682183 - DNA, 14 bp, Homo sapiens
gcagatccaggact

SEQ ID NO: 3682184 - DNA, 15 bp, Homo sapiens
gcagatccaggacta

SEQ ID NO: 3682185 - DNA, 13 bp, Homo sapiens
gcagatctgtgcc

SEQ ID NO: 3682186 - DNA, 14 bp, Homo sapiens
gcagatctgtgccc

SEQ ID NO: 3682187 - DNA, 23 bp, Homo sapiens
gcagatcttccgtggtcagagtg

SEQ ID NO: 3682188 - DNA, 18 bp, Homo sapiens
gcagatgcaaagaggcaa

SEQ ID NO: 3682189 - DNA, 14 bp, Homo sapiens
gcagcaaattttca

SEQ ID NO: 3682190 - DNA, 23 bp, Homo sapiens
gcagcagaggacagtctggagaa

SEQ ID NO: 3682191 - DNA, 17 bp, Homo sapiens
gcagcagggatgccctg

SEQ ID NO: 3682192 - DNA, 20 bp, Homo sapiens
gcagcagggatgccctggag

SEQ ID NO: 3682193 - DNA, 20 bp, Homo sapiens
gcagccaagctccttgggag

SEQ ID NO: 3682194 - DNA, 13 bp, Homo sapiens
gcagccaggctgc

SEQ ID NO: 3682195 - DNA, 13 bp, Homo sapiens
gcagcccaccctg

SEQ ID NO: 3682196 - DNA, 17 bp, Homo sapiens
gcagcccaccctgctgc

SEQ ID NO: 3682197 - DNA, 14 bp, Homo sapiens
gcagcctggaccct

SEQ ID NO: 3682198 - DNA, 13 bp, Homo sapiens
gcagcgagggcgg

SEQ ID NO: 3682199 - DNA, 15 bp, Homo sapiens
gcagcgtgccgagcc

SEQ ID NO: 3682200 - DNA, 14 bp, Homo sapiens
gcagctagttttct

SEQ ID NO: 3682201 - DNA, 16 bp, Homo sapiens
gcagctcaagagatcc

SEQ ID NO: 3682202 - DNA, 13 bp, Homo sapiens
gcagctggcagga

SEQ ID NO: 3682203 - DNA, 18 bp, Homo sapiens
gcagctggcaggagtggg

SEQ ID NO: 3682204 - DNA, 13 bp, Homo sapiens
gcagctgtgtctg

SEQ ID NO: 3682205 - DNA, 20 bp, Homo sapiens
gcagctgtgtctgagcccaa

SEQ ID NO: 3682206 - DNA, 22 bp, Homo sapiens
gcagctgtgtctgagcccaacc

SEQ ID NO: 3682207 - DNA, 14 bp, Homo sapiens
gcaggaagctcaga

SEQ ID NO: 3682208 - DNA, 17 bp, Homo sapiens
gcaggaagctcagactg

SEQ ID NO: 3682209 - DNA, 18 bp, Homo sapiens
gcaggaagctcagactgg

SEQ ID NO: 3682210 - DNA, 16 bp, Homo sapiens
gcaggaaggagagcct

SEQ ID NO: 3682211 - DNA, 11 bp, Homo sapiens
gcaggaaggct

SEQ ID NO: 3682212 - DNA, 14 bp, Homo sapiens
gcaggaagggaagc

SEQ ID NO: 3682213 - DNA, 20 bp, Homo sapiens
gcaggaatcccggctccaga

SEQ ID NO: 3682214 - DNA, 21 bp, Homo sapiens
gcaggaatcccggctccagag

SEQ ID NO: 3682215 - DNA, 23 bp, Homo sapiens
gcaggaatcccggctccagagca

SEQ ID NO: 3682216 - DNA, 19 bp, Homo sapiens
gcaggacaacgaggaagcc

SEQ ID NO: 3682217 - DNA, 20 bp, Homo sapiens
gcaggaggatcacttgagtc

SEQ ID NO: 3682218 - DNA, 23 bp, Homo sapiens
gcaggaggatcacttgagtccag

SEQ ID NO: 3682219 - DNA, 18 bp, Homo sapiens
gcaggagggccctacctg

SEQ ID NO: 3682220 - DNA, 16 bp, Homo sapiens
gcaggcatggccctgg

SEQ ID NO: 3682221 - DNA, 14 bp, Homo sapiens
gcaggccctggcct

SEQ ID NO: 3682222 - DNA, 16 bp, Homo sapiens
gcaggccctggcctcc

SEQ ID NO: 3682223 - DNA, 13 bp, Homo sapiens
gcaggcggggctc

SEQ ID NO: 3682224 - DNA, 21 bp, Homo sapiens
gcaggcggggctcctcctgaa

SEQ ID NO: 3682225 - DNA, 22 bp, Homo sapiens
gcaggctcccagggacacctgg

SEQ ID NO: 3682226 - DNA, 23 bp, Homo sapiens
gcaggctcccagggacacctggg

SEQ ID NO: 3682227 - DNA, 21 bp, Homo sapiens
gcagggaagtgtaagaaacac

SEQ ID NO: 3682228 - DNA, 16 bp, Homo sapiens
gcagggagctgggccc

SEQ ID NO: 3682229 - DNA, 18 bp, Homo sapiens
gcagggagggcagttttc

SEQ ID NO: 3682230 - DNA, 13 bp, Homo sapiens
gcaggggcctgga

SEQ ID NO: 3682231 - DNA, 14 bp, Homo sapiens
gcaggggcctggag

SEQ ID NO: 3682232 - DNA, 19 bp, Homo sapiens
gcaggggtcagtgcagcag

SEQ ID NO: 3682233 - DNA, 22 bp, Homo sapiens
gcaggggtcagtgcagcagagg

SEQ ID NO: 3682234 - DNA, 14 bp, Homo sapiens
gcaggtccagctct

SEQ ID NO: 3682235 - DNA, 16 bp, Homo sapiens
gcaggtccagctctgt

SEQ ID NO: 3682236 - DNA, 17 bp, Homo sapiens
gcaggtccagctctgtg

SEQ ID NO: 3682237 - DNA, 18 bp, Homo sapiens
gcaggtccagctctgtgg

SEQ ID NO: 3682238 - DNA, 21 bp, Homo sapiens
gcaggtccagctctgtgggcc

SEQ ID NO: 3682239 - DNA, 20 bp, Homo sapiens
cttgtggaagacacttgctg

SEQ ID NO: 3682240 - DNA, 19 bp, Homo sapiens
cttgtgtcaagacatttct

SEQ ID NO: 3682241 - DNA, 22 bp, Homo sapiens
cttgtgtttttaactcaatatt

SEQ ID NO: 3682242 - DNA, 16 bp, Homo sapiens
cttgtttgctcacctg

SEQ ID NO: 3682243 - DNA, 19 bp, Homo sapiens
cttgtttgctcacctgggg

SEQ ID NO: 3682244 - DNA, 20 bp, Homo sapiens
cttgtttgctcacctggggt

SEQ ID NO: 3682245 - DNA, 12 bp, Homo sapiens
cttgtttttgca

SEQ ID NO: 3682246 - DNA, 16 bp, Homo sapiens
cttgtttttgcacatg

SEQ ID NO: 3682247 - DNA, 22 bp, Homo sapiens
ctttaaaagagagagagagaaa

SEQ ID NO: 3682248 - DNA, 18 bp, Homo sapiens
ctttaaaagatgctttta

SEQ ID NO: 3682249 - DNA, 16 bp, Homo sapiens
ctttaaaatgtaaagc

SEQ ID NO: 3682250 - DNA, 10 bp, Homo sapiens
ctttaaagaa

SEQ ID NO: 3682251 - DNA, 23 bp, Homo sapiens
ctttaaagtgactaatggcatga

SEQ ID NO: 3682252 - DNA, 15 bp, Homo sapiens
ctttaaccttgtata

SEQ ID NO: 3682253 - DNA, 19 bp, Homo sapiens
ctttaagcctgcattctta

SEQ ID NO: 3682254 - DNA, 13 bp, Homo sapiens
ctttagagattat

SEQ ID NO: 3682255 - DNA, 14 bp, Homo sapiens
ctttagagattata

SEQ ID NO: 3682256 - DNA, 19 bp, Homo sapiens
ctttatcacctcattctga

SEQ ID NO: 3682257 - DNA, 14 bp, Homo sapiens
ctttattttgtgta

SEQ ID NO: 3682258 - DNA, 16 bp, Homo sapiens
ctttattttgtgtaaa

SEQ ID NO: 3682259 - DNA, 21 bp, Homo sapiens
ctttcaaatttagaaactaat

SEQ ID NO: 3682260 - DNA, 20 bp, Homo sapiens
ctttcaagcagtcgtgcctg

SEQ ID NO: 3682261 - DNA, 22 bp, Homo sapiens
ctttcacattgtttgctgctat

SEQ ID NO: 3682262 - DNA, 21 bp, Homo sapiens
ctttcagaagtgcccttcctg

SEQ ID NO: 3682263 - DNA, 14 bp, Homo sapiens
ctttcagtactttt

SEQ ID NO: 3682264 - DNA, 20 bp, Homo sapiens
ctttcatgcagtgctctttg

SEQ ID NO: 3682265 - DNA, 22 bp, Homo sapiens
ctttccaaatgcccagcttaaa

SEQ ID NO: 3682266 - DNA, 22 bp, Homo sapiens
ctttccaccacagccagcacct

SEQ ID NO: 3682267 - DNA, 18 bp, Homo sapiens
ctttcccttgtgtcaaga

SEQ ID NO: 3682268 - DNA, 17 bp, Homo sapiens
ctttcctaaggctgcaa

SEQ ID NO: 3682269 - DNA, 20 bp, Homo sapiens
ctttcctaaggctgcaaggt

SEQ ID NO: 3682270 - DNA, 19 bp, Homo sapiens
ctttcctatctttacatct

SEQ ID NO: 3682271 - DNA, 14 bp, Homo sapiens
ctttcctccgcctg

SEQ ID NO: 3682272 - DNA, 13 bp, Homo sapiens
ctttcctcgcctg

SEQ ID NO: 3682273 - DNA, 13 bp, Homo sapiens
ctttcctggaagc

SEQ ID NO: 3682274 - DNA, 19 bp, Homo sapiens
ctttcctggagccaatggc

SEQ ID NO: 3682275 - DNA, 23 bp, Homo sapiens
ctttcctggagccaatggcccgg

SEQ ID NO: 3682276 - DNA, 18 bp, Homo sapiens
ctttctacttttttcatt

SEQ ID NO: 3682277 - DNA, 16 bp, Homo sapiens
ctttctctgccagtga

SEQ ID NO: 3682278 - DNA, 18 bp, Homo sapiens
ctttctctgccagtgaca

SEQ ID NO: 3682279 - DNA, 14 bp, Homo sapiens
ctttctcttctaat

SEQ ID NO: 3682280 - DNA, 15 bp, Homo sapiens
ctttctgatcaaggc

SEQ ID NO: 3682281 - DNA, 16 bp, Homo sapiens
ctttctgatcaaggcc

SEQ ID NO: 3682282 - DNA, 20 bp, Homo sapiens
ctttctgattccgcaccctg

SEQ ID NO: 3682283 - DNA, 11 bp, Homo sapiens
ctttctgcctg

SEQ ID NO: 3682284 - DNA, 14 bp, Homo sapiens
ctttctgcctggag

SEQ ID NO: 3682285 - DNA, 19 bp, Homo sapiens
ctttctgctcagcttctcc

SEQ ID NO: 3682286 - DNA, 16 bp, Homo sapiens
ctttcttattctgtat

SEQ ID NO: 3682287 - DNA, 14 bp, Homo sapiens
ctttgaatgttaat

SEQ ID NO: 3682288 - DNA, 22 bp, Homo sapiens
ctttgagctactgccgtcagtg

SEQ ID NO: 3682289 - DNA, 20 bp, Homo sapiens
ctttgcaaagtattgtaaat

SEQ ID NO: 3682290 - DNA, 19 bp, Homo sapiens
ctttgcagctgcccagccc

SEQ ID NO: 3682291 - DNA, 13 bp, Homo sapiens
ctttgcatttctt

SEQ ID NO: 3682292 - DNA, 16 bp, Homo sapiens
ctttgccaaaatacca

SEQ ID NO: 3682293 - DNA, 11 bp, Homo sapiens
ctttgccacaa

SEQ ID NO: 3682294 - DNA, 19 bp, Homo sapiens
ctttgccagtcattcagca

SEQ ID NO: 3682295 - DNA, 23 bp, Homo sapiens
ctttgccttgggctgctcctcat

SEQ ID NO: 3682296 - DNA, 13 bp, Homo sapiens
ctttgctgaagaa

SEQ ID NO: 3682297 - DNA, 19 bp, Homo sapiens
ctttgctgctgaaggctca

SEQ ID NO: 3682298 - DNA, 17 bp, Homo sapiens
ctttgctgtgaggctgt

SEQ ID NO: 3682299 - DNA, 22 bp, Homo sapiens
ctttgctgtgaggctgtcctgt

SEQ ID NO: 3682300 - DNA, 12 bp, Homo sapiens
ctttgctttctg

SEQ ID NO: 3682301 - DNA, 11 bp, Homo sapiens
ctttgctttgc

SEQ ID NO: 3682302 - DNA, 15 bp, Homo sapiens
ctttggaatgctcca

SEQ ID NO: 3682303 - DNA, 14 bp, Homo sapiens
ctttggaggcccct

SEQ ID NO: 3682304 - DNA, 16 bp, Homo sapiens
ctttggcaatttcctg

SEQ ID NO: 3682305 - DNA, 17 bp, Homo sapiens
ctttggcaatttcctgg

SEQ ID NO: 3682306 - DNA, 21 bp, Homo sapiens
ctttgggccagacatgccaca

SEQ ID NO: 3682307 - DNA, 20 bp, Homo sapiens
ctttggggcttttacaccag

SEQ ID NO: 3682308 - DNA, 19 bp, Homo sapiens
ctttggtgagaacctgggt

SEQ ID NO: 3682309 - DNA, 23 bp, Homo sapiens
ctttggtgccaactggtgtttga

SEQ ID NO: 3682310 - DNA, 18 bp, Homo sapiens
ctttgtagctaacagtga

SEQ ID NO: 3682311 - DNA, 19 bp, Homo sapiens
ctttgtagctaacagtgaa

SEQ ID NO: 3682312 - DNA, 20 bp, Homo sapiens
ctttgtagctaacagtgaag

SEQ ID NO: 3682313 - DNA, 21 bp, Homo sapiens
ctttgtgacttcttcttcttt

SEQ ID NO: 3682314 - DNA, 18 bp, Homo sapiens
ctttgtttcgtggggagg

SEQ ID NO: 3682315 - DNA, 19 bp, Homo sapiens
ctttgttttgatgtttgtg

SEQ ID NO: 3682316 - DNA, 23 bp, Homo sapiens
ctttgttttgatgtttgtggcct

SEQ ID NO: 3682317 - DNA, 15 bp, Homo sapiens
ctttgtttttttaaa

SEQ ID NO: 3682318 - DNA, 13 bp, Homo sapiens
cttttaggtgagg

SEQ ID NO: 3682319 - DNA, 18 bp, Homo sapiens
cttttatgcaaaaggttt

SEQ ID NO: 3682320 - DNA, 15 bp, Homo sapiens
cttttctggcaccgc

SEQ ID NO: 3682321 - DNA, 23 bp, Homo sapiens
cttttctgtccgagctttgaaaa

SEQ ID NO: 3682322 - DNA, 11 bp, Homo sapiens
cttttgacatt

SEQ ID NO: 3682323 - DNA, 15 bp, Homo sapiens
cttttgacattttat

SEQ ID NO: 3682324 - DNA, 16 bp, Homo sapiens
cttttgacattttatt

SEQ ID NO: 3682325 - DNA, 20 bp, Homo sapiens
ctttttaataaaaaggcacc

SEQ ID NO: 3682326 - DNA, 19 bp, Homo sapiens
ctttttccaaatgcttcta

SEQ ID NO: 3682327 - DNA, 23 bp, Homo sapiens
ctttttccaacttggctgcagga

SEQ ID NO: 3682328 - DNA, 13 bp, Homo sapiens
ctttttctaatga

SEQ ID NO: 3682329 - DNA, 17 bp, Homo sapiens
ctttttgttgtaaaaca

SEQ ID NO: 3682330 - DNA, 21 bp, Homo sapiens
ctttttgttgtaaaacaaaat

SEQ ID NO: 3682331 - DNA, 22 bp, Homo sapiens
cttttttaaatattttctattt

SEQ ID NO: 3682332 - DNA, 22 bp, Homo sapiens
cttttttcccagcccaaattct

SEQ ID NO: 3682333 - DNA, 16 bp, Homo sapiens
cttttttgttttttca

SEQ ID NO: 3682334 - DNA, 18 bp, Homo sapiens
gaaaaaaaccacacaaag

SEQ ID NO: 3682335 - DNA, 15 bp, Homo sapiens
gaaaaaatgtatgtg

SEQ ID NO: 3682336 - DNA, 11 bp, Homo sapiens
gaaaaagaaaa

SEQ ID NO: 3682337 - DNA, 16 bp, Homo sapiens
gaaaaagaaaaaatat

SEQ ID NO: 3682338 - DNA, 19 bp, Homo sapiens
gaaaaagccaaaattgtca

SEQ ID NO: 3682339 - DNA, 15 bp, Homo sapiens
gaaaaaggaggaaga

SEQ ID NO: 3682340 - DNA, 16 bp, Homo sapiens
gaaaaataacaactat

SEQ ID NO: 3682341 - DNA, 16 bp, Homo sapiens
gaaaaatagcaacttg

SEQ ID NO: 3682342 - DNA, 16 bp, Homo sapiens
gaaaaatgagcctggc

SEQ ID NO: 3682343 - DNA, 20 bp, Homo sapiens
gaaaaattcagcaaaccatt

SEQ ID NO: 3682344 - DNA, 18 bp, Homo sapiens
gaaaagaaaaatgagcct

SEQ ID NO: 3682345 - DNA, 20 bp, Homo sapiens
gaaaagacaaacagtagaga

SEQ ID NO: 3682346 - DNA, 21 bp, Homo sapiens
gaaaagggagattcagactgt

SEQ ID NO: 3682347 - DNA, 15 bp, Homo sapiens
gaaaatatatgtatt

SEQ ID NO: 3682348 - DNA, 17 bp, Homo sapiens
gaaaatatatgtatttt

SEQ ID NO: 3682349 - DNA, 20 bp, Homo sapiens
gaaaatcagcctgctccagc

SEQ ID NO: 3682350 - DNA, 23 bp, Homo sapiens
gaaaatcagtgacatctgattgg

SEQ ID NO: 3682351 - DNA, 14 bp, Homo sapiens
gaaaatgcagcagg

SEQ ID NO: 3682352 - DNA, 19 bp, Homo sapiens
gaaacacactgaggcaggg

SEQ ID NO: 3682353 - DNA, 11 bp, Homo sapiens
gaaacagaaaa

SEQ ID NO: 3682354 - DNA, 22 bp, Homo sapiens
gaaacagaaaaatatgtaccaa

SEQ ID NO: 3682355 - DNA, 16 bp, Homo sapiens
gaaacagcctgtgtct

SEQ ID NO: 3682356 - DNA, 19 bp, Homo sapiens
gaaacctactgcccaggca

SEQ ID NO: 3682357 - DNA, 18 bp, Homo sapiens
gaaacctaggaagcccct

SEQ ID NO: 3682358 - DNA, 15 bp, Homo sapiens
gaaactagtgtacat

SEQ ID NO: 3682359 - DNA, 22 bp, Homo sapiens
gaaagaggctgaggcctggact

SEQ ID NO: 3682360 - DNA, 14 bp, Homo sapiens
gaaagataactagg

SEQ ID NO: 3682361 - DNA, 23 bp, Homo sapiens
gaaagatttgtgaactggaagaa

SEQ ID NO: 3682362 - DNA, 12 bp, Homo sapiens
gaaagcaacttt

SEQ ID NO: 3682363 - DNA, 19 bp, Homo sapiens
gaaagcagctcaaaggcac

SEQ ID NO: 3682364 - DNA, 13 bp, Homo sapiens
gaaagcccaaggt

SEQ ID NO: 3682365 - DNA, 19 bp, Homo sapiens
gaaagcccaaggtgctgat

SEQ ID NO: 3682366 - DNA, 17 bp, Homo sapiens
gaaagccctgagctttc

SEQ ID NO: 3682367 - DNA, 21 bp, Homo sapiens
gaaagccctgagctttctgct

SEQ ID NO: 3682368 - DNA, 17 bp, Homo sapiens
gaaagccctgtgctcca

SEQ ID NO: 3682369 - DNA, 17 bp, Homo sapiens
gaaagctcactgtagct

SEQ ID NO: 3682370 - DNA, 16 bp, Homo sapiens
gaaaggccagctggca

SEQ ID NO: 3682371 - DNA, 22 bp, Homo sapiens
gaaaggccagctggcagcagag

SEQ ID NO: 3682372 - DNA, 13 bp, Homo sapiens
gaaaggggagccc

SEQ ID NO: 3682373 - DNA, 18 bp, Homo sapiens
gaaaggtaggaagagagg

SEQ ID NO: 3682374 - DNA, 17 bp, Homo sapiens
gaaaggtggtgtttctg

SEQ ID NO: 3682375 - DNA, 13 bp, Homo sapiens
gaaagtttttctg

SEQ ID NO: 3682376 - DNA, 12 bp, Homo sapiens
gaaataaaatta

SEQ ID NO: 3682377 - DNA, 17 bp, Homo sapiens
gaaatagtctgtgtgaa

SEQ ID NO: 3682378 - DNA, 15 bp, Homo sapiens
gaaatatcctgcttg

SEQ ID NO: 3682379 - DNA, 15 bp, Homo sapiens
gaaatcaacttgctt

SEQ ID NO: 3682380 - DNA, 13 bp, Homo sapiens
gaaatcaggcctg

SEQ ID NO: 3682381 - DNA, 20 bp, Homo sapiens
gaaatcaggcctgatgaggg

SEQ ID NO: 3682382 - DNA, 24 bp, Homo sapiens
gaaatgaccttcattctgagacca

SEQ ID NO: 3682383 - DNA, 14 bp, Homo sapiens
gaaatggaaatttt

SEQ ID NO: 3682384 - DNA, 22 bp, Homo sapiens
gaaatggtccgctttcctggag

SEQ ID NO: 3682385 - DNA, 21 bp, Homo sapiens
gaaattttcaagagtctaata

SEQ ID NO: 3682386 - DNA, 13 bp, Homo sapiens
gaaattttgctat

SEQ ID NO: 3682387 - DNA, 19 bp, Homo sapiens
gaacactagacaagccaga

SEQ ID NO: 3682388 - DNA, 22 bp, Homo sapiens
gaacagctatgggagccccagg

SEQ ID NO: 3682389 - DNA, 16 bp, Homo sapiens
gaacaggtggttttta

SEQ ID NO: 3682390 - DNA, 14 bp, Homo sapiens
gaacatccctgcca

SEQ ID NO: 3682391 - DNA, 15 bp, Homo sapiens
gaacatccctgccag

SEQ ID NO: 3682392 - DNA, 15 bp, Homo sapiens
gaacatgcataagaa

SEQ ID NO: 3682393 - DNA, 17 bp, Homo sapiens
gaacatgcataagaaat

SEQ ID NO: 3682394 - DNA, 19 bp, Homo sapiens
gaacattggagctgactgt

SEQ ID NO: 3682395 - DNA, 12 bp, Homo sapiens
gaaccaagtgac

SEQ ID NO: 3682396 - DNA, 16 bp, Homo sapiens
gaaccattaaccagat

SEQ ID NO: 3682397 - DNA, 14 bp, Homo sapiens
gaacccaggcagct

SEQ ID NO: 3682398 - DNA, 16 bp, Homo sapiens
gaacccaggcagctgg

SEQ ID NO: 3682399 - DNA, 19 bp, Homo sapiens
gaacccaggcagctggcag

SEQ ID NO: 3682400 - DNA, 17 bp, Homo sapiens
gaaccccaaggagggag

SEQ ID NO: 3682401 - DNA, 14 bp, Homo sapiens
gaaccgccctcctg

SEQ ID NO: 3682402 - DNA, 18 bp, Homo sapiens
gaacctcacgcacctccc

SEQ ID NO: 3682403 - DNA, 17 bp, Homo sapiens
gaacctcagcctggcca

SEQ ID NO: 3682404 - DNA, 18 bp, Homo sapiens
gaacctcagcctggccag

SEQ ID NO: 3682405 - DNA, 19 bp, Homo sapiens
gaacctcagcctggccaga

SEQ ID NO: 3682406 - DNA, 17 bp, Homo sapiens
gaaccttgtcccagcca

SEQ ID NO: 3682407 - DNA, 24 bp, Homo sapiens
gaaccttgtcccagccagtgagga

SEQ ID NO: 3682408 - DNA, 19 bp, Homo sapiens
gaacgcccccccccacccc

SEQ ID NO: 3682409 - DNA, 20 bp, Homo sapiens
gaacgcccccccccacccct

SEQ ID NO: 3682410 - DNA, 16 bp, Homo sapiens
gaactaaaaagagact

SEQ ID NO: 3682411 - DNA, 19 bp, Homo sapiens
gaactcaaatggggccaga

SEQ ID NO: 3682412 - DNA, 23 bp, Homo sapiens
gaactcaaatggggccagatcca

SEQ ID NO: 3682413 - DNA, 16 bp, Homo sapiens
gaactcctaaatcaag

SEQ ID NO: 3682414 - DNA, 13 bp, Homo sapiens
gaactcctacctg

SEQ ID NO: 3682415 - DNA, 14 bp, Homo sapiens
gaactcctacctga

SEQ ID NO: 3682416 - DNA, 18 bp, Homo sapiens
gaactgaattttgggact

SEQ ID NO: 3682417 - DNA, 14 bp, Homo sapiens
gaactgcaggccct

SEQ ID NO: 3682418 - DNA, 16 bp, Homo sapiens
gaactgcaggccctgg

SEQ ID NO: 3682419 - DNA, 17 bp, Homo sapiens
gaactgcaggccctggc

SEQ ID NO: 3682420 - DNA, 18 bp, Homo sapiens
gaactgcaggccctggcc

SEQ ID NO: 3682421 - DNA, 21 bp, Homo sapiens
gaactgcaggccctggcctcc

SEQ ID NO: 3682422 - DNA, 14 bp, Homo sapiens
gaactgcagtgatg

SEQ ID NO: 3682423 - DNA, 13 bp, Homo sapiens
gaactggaagaaa

SEQ ID NO: 3682424 - DNA, 17 bp, Homo sapiens
gaagaaattaaggaaca

SEQ ID NO: 3682425 - DNA, 13 bp, Homo sapiens
gaagaaccagtcc

SEQ ID NO: 3682426 - DNA, 22 bp, Homo sapiens
gaagaacgttttttcctcagtg

SEQ ID NO: 3682427 - DNA, 13 bp, Homo sapiens
gaagaactgcagg

SEQ ID NO: 3682428 - DNA, 14 bp, Homo sapiens
gaagaactgcaggc

SEQ ID NO: 3682429 - DNA, 19 bp, Homo sapiens
gaagaactgcaggccctgg

SEQ ID NO: 3682430 - DNA, 14 bp, Homo sapiens
gaagaagctctctc

SEQ ID NO: 3682431 - DNA, 20 bp, Homo sapiens
gaagacaaaaagacaaacat

SEQ ID NO: 3682432 - DNA, 23 bp, Homo sapiens
gaagacaatgtgaaaagaaaaat

SEQ ID NO: 3682433 - DNA, 15 bp, Homo sapiens
gaagacacttgctga

SEQ ID NO: 3682434 - DNA, 18 bp, Homo sapiens
gaagacacttgctgagtg

SEQ ID NO: 3682435 - DNA, 17 bp, Homo sapiens
gaagacagaagtttgca

SEQ ID NO: 3682436 - DNA, 17 bp, Homo sapiens
gaagaggaaaaggctgg

SEQ ID NO: 3682437 - DNA, 22 bp, Homo sapiens
gaagaggttgggcttccatgcc

SEQ ID NO: 3682438 - DNA, 15 bp, Homo sapiens
gaagatgtttcaaaa

SEQ ID NO: 3682439 - DNA, 16 bp, Homo sapiens
gaagcaccccatgcca

SEQ ID NO: 3682440 - DNA, 21 bp, Homo sapiens
gaagcagatgcaaagaggcaa

SEQ ID NO: 3682441 - DNA, 23 bp, Homo sapiens
gaagcagatgcaaagaggcaaga

SEQ ID NO: 3682442 - DNA, 22 bp, Homo sapiens
gaagcatgaataacatttaaat

SEQ ID NO: 3682443 - DNA, 10 bp, Homo sapiens
gaagccagct

SEQ ID NO: 3682444 - DNA, 19 bp, Homo sapiens
gaagccaggaatttcccag

SEQ ID NO: 3682445 - DNA, 18 bp, Homo sapiens
gaagccccacatgtccag

SEQ ID NO: 3682446 - DNA, 23 bp, Homo sapiens
gaagccccacatgtccagcacct

SEQ ID NO: 3682447 - DNA, 19 bp, Homo sapiens
gaagccgtgccctgccccc

SEQ ID NO: 3682448 - DNA, 17 bp, Homo sapiens
gaagccgtgcctgtagc

SEQ ID NO: 3682449 - DNA, 13 bp, Homo sapiens
gaagcctctggct

SEQ ID NO: 3682450 - DNA, 17 bp, Homo sapiens
gaagcctctggctagag

SEQ ID NO: 3682451 - DNA, 20 bp, Homo sapiens
gaagcgtatatacttaagaa

SEQ ID NO: 3682452 - DNA, 14 bp, Homo sapiens
gaagctcagactgg

SEQ ID NO: 3682453 - DNA, 17 bp, Homo sapiens
gaagctcctctccccag

SEQ ID NO: 3682454 - DNA, 19 bp, Homo sapiens
gaagctcctctccccagcc

SEQ ID NO: 3682455 - DNA, 17 bp, Homo sapiens
gaagctggccgagggtc

SEQ ID NO: 3682456 - DNA, 23 bp, Homo sapiens
gaaggaaagatttgtgaactgga

SEQ ID NO: 3682457 - DNA, 13 bp, Homo sapiens
gaaggagagcctg

SEQ ID NO: 3682458 - DNA, 15 bp, Homo sapiens
gaaggagagcctgct

SEQ ID NO: 3682459 - DNA, 16 bp, Homo sapiens
gaaggagagcctgctg

SEQ ID NO: 3682460 - DNA, 17 bp, Homo sapiens
gaaggcagcaggtggca

SEQ ID NO: 3682461 - DNA, 14 bp, Homo sapiens
gaaggcagggctcc

SEQ ID NO: 3682462 - DNA, 23 bp, Homo sapiens
gaaggcagggctcctccctggag

SEQ ID NO: 3682463 - DNA, 15 bp, Homo sapiens
gaaggccacttgtgt

SEQ ID NO: 3682464 - DNA, 22 bp, Homo sapiens
gaaggccgagaagcaagaaaga

SEQ ID NO: 3682465 - DNA, 17 bp, Homo sapiens
gaaggctgtccttaccc

SEQ ID NO: 3682466 - DNA, 13 bp, Homo sapiens
gaagggaggtggc

SEQ ID NO: 3682467 - DNA, 22 bp, Homo sapiens
gaagggcaggaaggagagcctg

SEQ ID NO: 3682468 - DNA, 18 bp, Homo sapiens
gaagggccagagccaggg

SEQ ID NO: 3682469 - DNA, 19 bp, Homo sapiens
gaagggccagtcctgcctg

SEQ ID NO: 3682470 - DNA, 20 bp, Homo sapiens
gaagggccagtcctgcctgg

SEQ ID NO: 3682471 - DNA, 15 bp, Homo sapiens
gaaggggtgctgtga

SEQ ID NO: 3682472 - DNA, 21 bp, Homo sapiens
gaaggggtgctgtgaggcttg

SEQ ID NO: 3682473 - DNA, 22 bp, Homo sapiens
gaagggtggctttgcatttctt

SEQ ID NO: 3682474 - DNA, 15 bp, Homo sapiens
gaagggtttgtggct

SEQ ID NO: 3682475 - DNA, 21 bp, Homo sapiens
gaagggtttgtggctgggggc

SEQ ID NO: 3682476 - DNA, 16 bp, Homo sapiens
gaaggtcccacagccc

SEQ ID NO: 3682477 - DNA, 19 bp, Homo sapiens
gaaggtgctgacggccagg

SEQ ID NO: 3682478 - DNA, 17 bp, Homo sapiens
gaagtccccaggcccca

SEQ ID NO: 3682479 - DNA, 23 bp, Homo sapiens
gaagtcctctgtggccagctgca

SEQ ID NO: 3682480 - DNA, 16 bp, Homo sapiens
gaagtgaatgctggga

SEQ ID NO: 3682481 - DNA, 17 bp, Homo sapiens
gaagtgaatgctgggac

SEQ ID NO: 3682482 - DNA, 16 bp, Homo sapiens
gaataataagcaggat

SEQ ID NO: 3682483 - DNA, 17 bp, Homo sapiens
gaataatacagtatctc

SEQ ID NO: 3682484 - DNA, 21 bp, Homo sapiens
gaatacagaggcaactgcatt

SEQ ID NO: 3682485 - DNA, 13 bp, Homo sapiens
gaatataaacact

SEQ ID NO: 3682486 - DNA, 14 bp, Homo sapiens
gaatataaacacta

SEQ ID NO: 3682487 - DNA, 21 bp, Homo sapiens
gaatataaacactatatggca

SEQ ID NO: 3682488 - DNA, 20 bp, Homo sapiens
gaatatatctctatttgaga

SEQ ID NO: 3682489 - DNA, 16 bp, Homo sapiens
gaatatatttaagcaa

SEQ ID NO: 3682490 - DNA, 16 bp, Homo sapiens
gaatatccatgtactt

SEQ ID NO: 3682491 - DNA, 19 bp, Homo sapiens
gaatatccatgtacttgtt

SEQ ID NO: 3682492 - DNA, 15 bp, Homo sapiens
gaatatgtatgtata

SEQ ID NO: 3682493 - DNA, 19 bp, Homo sapiens
gaatcctttggtgccaact

SEQ ID NO: 3682494 - DNA, 23 bp, Homo sapiens
gaatctcagttgattttctggat

SEQ ID NO: 3682495 - DNA, 13 bp, Homo sapiens
gaatctctgtgcc

SEQ ID NO: 3682496 - DNA, 22 bp, Homo sapiens
gaatcttaaggtgtagccacac

SEQ ID NO: 3682497 - DNA, 21 bp, Homo sapiens
gaatgccactgccttcgcttc

SEQ ID NO: 3682498 - DNA, 17 bp, Homo sapiens
gaatggcacagcccaaa

SEQ ID NO: 3682499 - DNA, 22 bp, Homo sapiens
gaatggcacagcccaaagaagg

SEQ ID NO: 3682500 - DNA, 14 bp, Homo sapiens
gaatgtacgtccag

SEQ ID NO: 3682501 - DNA, 18 bp, Homo sapiens
gaattcagaagtggagat

SEQ ID NO: 3682502 - DNA, 13 bp, Homo sapiens
gaattcctggaac

SEQ ID NO: 3682503 - DNA, 18 bp, Homo sapiens
gaattcctggaacctgga

SEQ ID NO: 3682504 - DNA, 14 bp, Homo sapiens
gaattgaagcagga

SEQ ID NO: 3682505 - DNA, 22 bp, Homo sapiens
gaatttcccaggaccctgaagg

SEQ ID NO: 3682506 - DNA, 13 bp, Homo sapiens
gacaaagaacctt

SEQ ID NO: 3682507 - DNA, 18 bp, Homo sapiens
gacaaatctcagaacctt

SEQ ID NO: 3682508 - DNA, 15 bp, Homo sapiens
gacaaccactggtct

SEQ ID NO: 3682509 - DNA, 14 bp, Homo sapiens
gacaacgaggaagc

SEQ ID NO: 3682510 - DNA, 16 bp, Homo sapiens
gacaagccagaacttg

SEQ ID NO: 3682511 - DNA, 15 bp, Homo sapiens
gacaatactggggtt

SEQ ID NO: 3682512 - DNA, 21 bp, Homo sapiens
gacaatgagtggaatactaaa

SEQ ID NO: 3682513 - DNA, 22 bp, Homo sapiens
gacacaaggtgatttcagactg

SEQ ID NO: 3682514 - DNA, 20 bp, Homo sapiens
gacacaatctcagctcactg

SEQ ID NO: 3682515 - DNA, 23 bp, Homo sapiens
gacacaatctcagctcactgtga

SEQ ID NO: 3682516 - DNA, 17 bp, Homo sapiens
gacacaggccctccctg

SEQ ID NO: 3682517 - DNA, 15 bp, Homo sapiens
gacacatatgagggg

SEQ ID NO: 3682518 - DNA, 16 bp, Homo sapiens
gacacatatgaggggg

SEQ ID NO: 3682519 - DNA, 14 bp, Homo sapiens
gacaccttggacat

SEQ ID NO: 3682520 - DNA, 19 bp, Homo sapiens
gacaccttttttcaacagt

SEQ ID NO: 3682521 - DNA, 16 bp, Homo sapiens
gacacttgctgagtga

SEQ ID NO: 3682522 - DNA, 13 bp, Homo sapiens
gacagaacactgt

SEQ ID NO: 3682523 - DNA, 15 bp, Homo sapiens
gacagagaggactgt

SEQ ID NO: 3682524 - DNA, 18 bp, Homo sapiens
gacagaggccccagcctc

SEQ ID NO: 3682525 - DNA, 23 bp, Homo sapiens
gacagatctctgctttggaaatc

SEQ ID NO: 3682526 - DNA, 19 bp, Homo sapiens
gacagatgaatgccgtgga

SEQ ID NO: 3682527 - DNA, 15 bp, Homo sapiens
gacagatgaggcttt

SEQ ID NO: 3682528 - DNA, 23 bp, Homo sapiens
gacagcaaggtgtggaggctcct

SEQ ID NO: 3682529 - DNA, 19 bp, Homo sapiens
gacagcctcttctgtccca

SEQ ID NO: 3682530 - DNA, 22 bp, Homo sapiens
gacagcctcttctgtcccaagt

SEQ ID NO: 3682531 - DNA, 18 bp, Homo sapiens
gacagctacacagagctt

SEQ ID NO: 3682532 - DNA, 11 bp, Homo sapiens
gacagctgctc

SEQ ID NO: 3682533 - DNA, 17 bp, Homo sapiens
gacagctgctcctagag

SEQ ID NO: 3682534 - DNA, 20 bp, Homo sapiens
gacagctgctcctagaggga

SEQ ID NO: 3682535 - DNA, 15 bp, Homo sapiens
gacagctttgctgct

SEQ ID NO: 3682536 - DNA, 18 bp, Homo sapiens
gacaggctcttagcagct

SEQ ID NO: 3682537 - DNA, 19 bp, Homo sapiens
gacaggctcttagcagctt

SEQ ID NO: 3682538 - DNA, 10 bp, Homo sapiens
gacagggctt

SEQ ID NO: 3682539 - DNA, 17 bp, Homo sapiens
gacagggcttctcctgc

SEQ ID NO: 3682540 - DNA, 13 bp, Homo sapiens
gacagtctggaga

SEQ ID NO: 3682541 - DNA, 23 bp, Homo sapiens
gacataatatattctatttttat

SEQ ID NO: 3682542 - DNA, 14 bp, Homo sapiens
gacatacttgaagg

SEQ ID NO: 3682543 - DNA, 19 bp, Homo sapiens
gacatacttgaagggccag

SEQ ID NO: 3682544 - DNA, 11 bp, Homo sapiens
gacatatttaa

SEQ ID NO: 3682545 - DNA, 15 bp, Homo sapiens
gacatcacagggtgg

SEQ ID NO: 3682546 - DNA, 19 bp, Homo sapiens
gacatcacagggtgggcct

SEQ ID NO: 3682547 - DNA, 22 bp, Homo sapiens
gacatgggtattttataatgtt

SEQ ID NO: 3682548 - DNA, 14 bp, Homo sapiens
gacattctgccagg

SEQ ID NO: 3682549 - DNA, 22 bp, Homo sapiens
gacattctgccaggcccccaag

SEQ ID NO: 3682550 - DNA, 15 bp, Homo sapiens
gacattttagggaca

SEQ ID NO: 3682551 - DNA, 12 bp, Homo sapiens
gacatttttgtc

SEQ ID NO: 3682552 - DNA, 21 bp, Homo sapiens
gaccaaatcacccaatcccag

SEQ ID NO: 3682553 - DNA, 14 bp, Homo sapiens
gaccaactgggccc

SEQ ID NO: 3682554 - DNA, 17 bp, Homo sapiens
gaccaagcaggaagctc

SEQ ID NO: 3682555 - DNA, 15 bp, Homo sapiens
gaccaagcatcttgg

SEQ ID NO: 3682556 - DNA, 20 bp, Homo sapiens
gaccaagcttagtcctggga

SEQ ID NO: 3682557 - DNA, 12 bp, Homo sapiens
gaccacccacct

SEQ ID NO: 3682558 - DNA, 17 bp, Homo sapiens
gaccaggactccctcct

SEQ ID NO: 3682559 - DNA, 13 bp, Homo sapiens
gaccaggctccaa

SEQ ID NO: 3682560 - DNA, 14 bp, Homo sapiens
gaccaggctgtgtc

SEQ ID NO: 3682561 - DNA, 18 bp, Homo sapiens
gaccaggggccctacctg

SEQ ID NO: 3682562 - DNA, 19 bp, Homo sapiens
gaccaggggccctacctgg

SEQ ID NO: 3682563 - DNA, 20 bp, Homo sapiens
gaccaggggccctacctggg

SEQ ID NO: 3682564 - DNA, 17 bp, Homo sapiens
gacccaccactggaagc

SEQ ID NO: 3682565 - DNA, 12 bp, Homo sapiens
gacccagtgcag

SEQ ID NO: 3682566 - DNA, 14 bp, Homo sapiens
gaccccagcccaga

SEQ ID NO: 3682567 - DNA, 18 bp, Homo sapiens
gaccccagcccagacagc

SEQ ID NO: 3682568 - DNA, 19 bp, Homo sapiens
gaccccagcccagacagca

SEQ ID NO: 3682569 - DNA, 12 bp, Homo sapiens
gaccccagcctt

SEQ ID NO: 3682570 - DNA, 20 bp, Homo sapiens
gaccctctttgctgaagaat

SEQ ID NO: 3682571 - DNA, 16 bp, Homo sapiens
gaccctgagctgacca

SEQ ID NO: 3682572 - DNA, 17 bp, Homo sapiens
gaccgaggccctcccaa

SEQ ID NO: 3682573 - DNA, 19 bp, Homo sapiens
gacctcaggtgagaagcag

SEQ ID NO: 3682574 - DNA, 13 bp, Homo sapiens
gacctgaggaagc

SEQ ID NO: 3682575 - DNA, 14 bp, Homo sapiens
gacctgaggctgtg

SEQ ID NO: 3682576 - DNA, 17 bp, Homo sapiens
gacctgaggctgtggtc

SEQ ID NO: 3682577 - DNA, 18 bp, Homo sapiens
gaccttcatgcccttctg

SEQ ID NO: 3682578 - DNA, 16 bp, Homo sapiens
gaccttgttacttctg

SEQ ID NO: 3682579 - DNA, 21 bp, Homo sapiens
gacgacaagtgctgaacagtg

SEQ ID NO: 3682580 - DNA, 13 bp, Homo sapiens
gacgctttgtctg

SEQ ID NO: 3682581 - DNA, 23 bp, Homo sapiens
gacggcctgatgctccctcccct

SEQ ID NO: 3682582 - DNA, 18 bp, Homo sapiens
gacgtcccttttttctct

SEQ ID NO: 3682583 - DNA, 24 bp, Homo sapiens
gactaacaaaggcagctgtgtctg

SEQ ID NO: 3682584 - DNA, 15 bp, Homo sapiens
gactaattttacatg

SEQ ID NO: 3682585 - DNA, 18 bp, Homo sapiens
gactaattttacatgttt

SEQ ID NO: 3682586 - DNA, 23 bp, Homo sapiens
gactaattttacatgtttataaa

SEQ ID NO: 3682587 - DNA, 19 bp, Homo sapiens
gactacggaactgcacact

SEQ ID NO: 3682588 - DNA, 15 bp, Homo sapiens
gactagaagggccag

SEQ ID NO: 3682589 - DNA, 21 bp, Homo sapiens
gactagggattcaggctgctt

SEQ ID NO: 3682590 - DNA, 15 bp, Homo sapiens
gactatattgggact

SEQ ID NO: 3682591 - DNA, 18 bp, Homo sapiens
gactatattgtacacacc

SEQ ID NO: 3682592 - DNA, 18 bp, Homo sapiens
gactattccttttctgta

SEQ ID NO: 3682593 - DNA, 15 bp, Homo sapiens
gactcagccttcaga

SEQ ID NO: 3682594 - DNA, 13 bp, Homo sapiens
gactcatccgcct

SEQ ID NO: 3682595 - DNA, 19 bp, Homo sapiens
gactcatggtgtgttacac

SEQ ID NO: 3682596 - DNA, 22 bp, Homo sapiens
gactcccattcctgaagaacca

SEQ ID NO: 3682597 - DNA, 11 bp, Homo sapiens
gactcctccct

SEQ ID NO: 3682598 - DNA, 19 bp, Homo sapiens
gactctaggtgcccttgga

SEQ ID NO: 3682599 - DNA, 15 bp, Homo sapiens
gactcttccctggga

SEQ ID NO: 3682600 - DNA, 23 bp, Homo sapiens
gactgaaaaaaaaaaagaagaag

SEQ ID NO: 3682601 - DNA, 24 bp, Homo sapiens
gactgaagccgtgcctgtagcctt

SEQ ID NO: 3682602 - DNA, 13 bp, Homo sapiens
gactgaccaaatc

SEQ ID NO: 3682603 - DNA, 22 bp, Homo sapiens
gactgaccaaatcacccaatcc

SEQ ID NO: 3682604 - DNA, 16 bp, Homo sapiens
gactgatctcgatgca

SEQ ID NO: 3682605 - DNA, 20 bp, Homo sapiens
gactgatctcgatgcaggtg

SEQ ID NO: 3682606 - DNA, 13 bp, Homo sapiens
gactgattttaat

SEQ ID NO: 3682607 - DNA, 15 bp, Homo sapiens
gactgcccggcaggg

SEQ ID NO: 3682608 - DNA, 17 bp, Homo sapiens
gactgccctcttactgt

SEQ ID NO: 3682609 - DNA, 21 bp, Homo sapiens
gactgctttggacctaaatgg

SEQ ID NO: 3682610 - DNA, 21 bp, Homo sapiens
gactggctagagtcctcactc

SEQ ID NO: 3682611 - DNA, 23 bp, Homo sapiens
gactggctagagtcctcactccc

SEQ ID NO: 3682612 - DNA, 17 bp, Homo sapiens
gactgtgccatggtgag

SEQ ID NO: 3682613 - DNA, 20 bp, Homo sapiens
gactgtgccatggtgagaaa

SEQ ID NO: 3682614 - DNA, 16 bp, Homo sapiens
gactgttttctcttga

SEQ ID NO: 3682615 - DNA, 14 bp, Homo sapiens
gacttaatgtgatt

SEQ ID NO: 3682616 - DNA, 15 bp, Homo sapiens
gacttaatgtgatta

SEQ ID NO: 3682617 - DNA, 17 bp, Homo sapiens
gacttcaaagcaagctg

SEQ ID NO: 3682618 - DNA, 16 bp, Homo sapiens
gacttctgcctggaga

SEQ ID NO: 3682619 - DNA, 16 bp, Homo sapiens
gacttgacagaacact

SEQ ID NO: 3682620 - DNA, 15 bp, Homo sapiens
gacttgtttttgcac

SEQ ID NO: 3682621 - DNA, 16 bp, Homo sapiens
gacttgtttttgcaca

SEQ ID NO: 3682622 - DNA, 14 bp, Homo sapiens
gactttagtgaaag

SEQ ID NO: 3682623 - DNA, 14 bp, Homo sapiens
gactttctgcctgg

SEQ ID NO: 3682624 - DNA, 18 bp, Homo sapiens
gactttctgcctggagtg

SEQ ID NO: 3682625 - DNA, 13 bp, Homo sapiens
gacttttctgcaa

SEQ ID NO: 3682626 - DNA, 14 bp, Homo sapiens
gacttttctgcaaa

SEQ ID NO: 3682627 - DNA, 23 bp, Homo sapiens
gactttttaaaattctgagtgat

SEQ ID NO: 3682628 - DNA, 13 bp, Homo sapiens
gactttttataaa

SEQ ID NO: 3682629 - DNA, 16 bp, Homo sapiens
gagaaaatatatgtat

SEQ ID NO: 3682630 - DNA, 12 bp, Homo sapiens
gagaaatcaggc

SEQ ID NO: 3682631 - DNA, 21 bp, Homo sapiens
gagaaatcaggcctgatgagg

SEQ ID NO: 3682632 - DNA, 12 bp, Homo sapiens
gagaaccaccta

SEQ ID NO: 3682633 - DNA, 22 bp, Homo sapiens
gagaagccaggaatttcccagg

SEQ ID NO: 3682634 - DNA, 17 bp, Homo sapiens
gagaagttgaggggagc

SEQ ID NO: 3682635 - DNA, 20 bp, Homo sapiens
gagaagttgaggggagcatg

SEQ ID NO: 3682636 - DNA, 22 bp, Homo sapiens
gagaagttgaggggagcatgct

SEQ ID NO: 3682637 - DNA, 18 bp, Homo sapiens
gagacatacttgaagggc

SEQ ID NO: 3682638 - DNA, 17 bp, Homo sapiens
gagaccaggctgtgtcc

SEQ ID NO: 3682639 - DNA, 15 bp, Homo sapiens
gagacccccacacct

SEQ ID NO: 3682640 - DNA, 16 bp, Homo sapiens
gagactcagtgcagat

SEQ ID NO: 3682641 - DNA, 23 bp, Homo sapiens
gagactcagtgcagatggagaga

SEQ ID NO: 3682642 - DNA, 22 bp, Homo sapiens
gagactgtgccatggtgagaaa

SEQ ID NO: 3682643 - DNA, 23 bp, Homo sapiens
gagactgtgccatggtgagaaaa

SEQ ID NO: 3682644 - DNA, 21 bp, Homo sapiens
gagacttagggcaccaggggt

SEQ ID NO: 3682645 - DNA, 17 bp, Homo sapiens
gagagaaatcaggcctg

SEQ ID NO: 3682646 - DNA, 15 bp, Homo sapiens
gagagcaagaaggaa

SEQ ID NO: 3682647 - DNA, 22 bp, Homo sapiens
gagagcgcctgcccctcccaga

SEQ ID NO: 3682648 - DNA, 21 bp, Homo sapiens
gagagctagcagcagggaggg

SEQ ID NO: 3682649 - DNA, 18 bp, Homo sapiens
gagaggccaaaggctggt

SEQ ID NO: 3682650 - DNA, 14 bp, Homo sapiens
gagaggtccagccc

SEQ ID NO: 3682651 - DNA, 16 bp, Homo sapiens
gagaggtccagccccc

SEQ ID NO: 3682652 - DNA, 22 bp, Homo sapiens
gagaggtgggccagtctgtgga

SEQ ID NO: 3682653 - DNA, 23 bp, Homo sapiens
gagaggtgggccagtctgtggat

SEQ ID NO: 3682654 - DNA, 14 bp, Homo sapiens
gagagtttcctgaa

SEQ ID NO: 3682655 - DNA, 16 bp, Homo sapiens
gagatcagcctgggca

SEQ ID NO: 3682656 - DNA, 22 bp, Homo sapiens
gagatccaaaagaagcccccag

SEQ ID NO: 3682657 - DNA, 13 bp, Homo sapiens
gagatcctcctgc

SEQ ID NO: 3682658 - DNA, 18 bp, Homo sapiens
gagatcgtgccattgcac

SEQ ID NO: 3682659 - DNA, 18 bp, Homo sapiens
gagattgcaccactgcac

SEQ ID NO: 3682660 - DNA, 21 bp, Homo sapiens
gagattgcaccactgcactcc

SEQ ID NO: 3682661 - DNA, 19 bp, Homo sapiens
gagatttttaaaaaatatt

SEQ ID NO: 3682662 - DNA, 18 bp, Homo sapiens
gagcagcctgtggcatct

SEQ ID NO: 3682663 - DNA, 19 bp, Homo sapiens
gagcagtgagcactgaaac

SEQ ID NO: 3682664 - DNA, 17 bp, Homo sapiens
gagcatgcttccctgca

SEQ ID NO: 3682665 - DNA, 19 bp, Homo sapiens
gagcatgcttccctgcagc

SEQ ID NO: 3682666 - DNA, 23 bp, Homo sapiens
gagcatgcttccctgcagctgac

SEQ ID NO: 3682667 - DNA, 20 bp, Homo sapiens
gagcattttgataccagaag

SEQ ID NO: 3682668 - DNA, 12 bp, Homo sapiens
gagccacctcac

SEQ ID NO: 3682669 - DNA, 17 bp, Homo sapiens
gagccatgcgccccctc

SEQ ID NO: 3682670 - DNA, 11 bp, Homo sapiens
gagcccactgt

SEQ ID NO: 3682671 - DNA, 12 bp, Homo sapiens
gagccccagggt

SEQ ID NO: 3682672 - DNA, 14 bp, Homo sapiens
gagccccagggtct

SEQ ID NO: 3682673 - DNA, 19 bp, Homo sapiens
gagccccagggtcttccct

SEQ ID NO: 3682674 - DNA, 22 bp, Homo sapiens
gagcccctgtctagagagggag

SEQ ID NO: 3682675 - DNA, 20 bp, Homo sapiens
gagccggggactcccaggct

SEQ ID NO: 3682676 - DNA, 10 bp, Homo sapiens
gagcctggca

SEQ ID NO: 3682677 - DNA, 13 bp, Homo sapiens
gagcctgggaggt

SEQ ID NO: 3682678 - DNA, 21 bp, Homo sapiens
gagcgagacttggtttcaaaa

SEQ ID NO: 3682679 - DNA, 13 bp, Homo sapiens
gagcgcctgcccc

SEQ ID NO: 3682680 - DNA, 16 bp, Homo sapiens
gagcgcctgcccctcc

SEQ ID NO: 3682681 - DNA, 20 bp, Homo sapiens
gagcgcctgcccctcccaga

SEQ ID NO: 3682682 - DNA, 15 bp, Homo sapiens
gagcggaaagcagct

SEQ ID NO: 3682683 - DNA, 13 bp, Homo sapiens
gagcggtggggga

SEQ ID NO: 3682684 - DNA, 17 bp, Homo sapiens
gagctagcagcagggag

SEQ ID NO: 3682685 - DNA, 14 bp, Homo sapiens
gagctcaggacact

SEQ ID NO: 3682686 - DNA, 13 bp, Homo sapiens
gagctccactctg

SEQ ID NO: 3682687 - DNA, 16 bp, Homo sapiens
gagctccactctgctt

SEQ ID NO: 3682688 - DNA, 21 bp, Homo sapiens
gagctccactctgcttctctg

SEQ ID NO: 3682689 - DNA, 22 bp, Homo sapiens
gagctccactctgcttctctga

SEQ ID NO: 3682690 - DNA, 14 bp, Homo sapiens
gagctccaggatgg

SEQ ID NO: 3682691 - DNA, 17 bp, Homo sapiens
gagctccaggatgggga

SEQ ID NO: 3682692 - DNA, 19 bp, Homo sapiens
gagctccaggatggggagg

SEQ ID NO: 3682693 - DNA, 18 bp, Homo sapiens
gagctctgtatggtcagg

SEQ ID NO: 3682694 - DNA, 17 bp, Homo sapiens
gagctcttcaggcctcc

SEQ ID NO: 3682695 - DNA, 17 bp, Homo sapiens
gagctgaattttctgga

SEQ ID NO: 3682696 - DNA, 17 bp, Homo sapiens
gagctgcccctgctgct

SEQ ID NO: 3682697 - DNA, 15 bp, Homo sapiens
gagctgcctccagcc

SEQ ID NO: 3682698 - DNA, 19 bp, Homo sapiens
gagctgcctccagcctggt

SEQ ID NO: 3682699 - DNA, 20 bp, Homo sapiens
gagctgctatagcctggggt

SEQ ID NO: 3682700 - DNA, 16 bp, Homo sapiens
gagctgctggcttgca

SEQ ID NO: 3682701 - DNA, 12 bp, Homo sapiens
gagctggctctg

SEQ ID NO: 3682702 - DNA, 16 bp, Homo sapiens
gagctgggcccgacat

SEQ ID NO: 3682703 - DNA, 19 bp, Homo sapiens
gagctgggcccgacatggc

SEQ ID NO: 3682704 - DNA, 20 bp, Homo sapiens
gagctgggcccgacatggct

SEQ ID NO: 3682705 - DNA, 17 bp, Homo sapiens
gagctggtgcccggaga

SEQ ID NO: 3682706 - DNA, 19 bp, Homo sapiens
gagctgtttatggcctcag

SEQ ID NO: 3682707 - DNA, 19 bp, Homo sapiens
gagcttctcctgaccaggg

SEQ ID NO: 3682708 - DNA, 13 bp, Homo sapiens
gaggaaaggccag

SEQ ID NO: 3682709 - DNA, 23 bp, Homo sapiens
gaggaacatgcataagaaatgta

SEQ ID NO: 3682710 - DNA, 20 bp, Homo sapiens
gaggaagcgtgaaggccgag

SEQ ID NO: 3682711 - DNA, 15 bp, Homo sapiens
gaggacagtctggag

SEQ ID NO: 3682712 - DNA, 18 bp, Homo sapiens
gaggagctcaggacacta

SEQ ID NO: 3682713 - DNA, 18 bp, Homo sapiens
gatctagaataatcttgc

SEQ ID NO: 3682714 - DNA, 21 bp, Homo sapiens
gatctcgatgcaggtggatct

SEQ ID NO: 3682715 - DNA, 17 bp, Homo sapiens
gatctcttgagcctggg

SEQ ID NO: 3682716 - DNA, 19 bp, Homo sapiens
gatctcttgagcctgggag

SEQ ID NO: 3682717 - DNA, 14 bp, Homo sapiens
gatctggaacccag

SEQ ID NO: 3682718 - DNA, 17 bp, Homo sapiens
gatctggaacccagact

SEQ ID NO: 3682719 - DNA, 12 bp, Homo sapiens
gatctggaacct

SEQ ID NO: 3682720 - DNA, 17 bp, Homo sapiens
gatctggaacctcagcc

SEQ ID NO: 3682721 - DNA, 18 bp, Homo sapiens
gatctggaacctcagcct

SEQ ID NO: 3682722 - DNA, 14 bp, Homo sapiens
gatctgtcctcagc

SEQ ID NO: 3682723 - DNA, 14 bp, Homo sapiens
gatctgtgccccat

SEQ ID NO: 3682724 - DNA, 13 bp, Homo sapiens
gatctttgactga

SEQ ID NO: 3682725 - DNA, 16 bp, Homo sapiens
gatgaaatgtaaatac

SEQ ID NO: 3682726 - DNA, 16 bp, Homo sapiens
gatgaatgccgtggat

SEQ ID NO: 3682727 - DNA, 13 bp, Homo sapiens
gatgaggcttctt

SEQ ID NO: 3682728 - DNA, 20 bp, Homo sapiens
gatgaggcttcttcctggat

SEQ ID NO: 3682729 - DNA, 21 bp, Homo sapiens
gatgaggcttcttcctggatg

SEQ ID NO: 3682730 - DNA, 23 bp, Homo sapiens
gatgagggggaattcctggaacc

SEQ ID NO: 3682731 - DNA, 23 bp, Homo sapiens
gatgagtggttttctttttcctt

SEQ ID NO: 3682732 - DNA, 15 bp, Homo sapiens
gatgatattaagaac

SEQ ID NO: 3682733 - DNA, 22 bp, Homo sapiens
gatgatattaagaactgctgtt

SEQ ID NO: 3682734 - DNA, 14 bp, Homo sapiens
gatgcaaggaccag

SEQ ID NO: 3682735 - DNA, 23 bp, Homo sapiens
gatgcaggtggatctccttgaga

SEQ ID NO: 3682736 - DNA, 16 bp, Homo sapiens
gatgcatgtcttttaa

SEQ ID NO: 3682737 - DNA, 19 bp, Homo sapiens
gatgccctggaggtggctg

SEQ ID NO: 3682738 - DNA, 15 bp, Homo sapiens
gatgctccatttcaa

SEQ ID NO: 3682739 - DNA, 23 bp, Homo sapiens
gatgctccctcccctgccctggt

SEQ ID NO: 3682740 - DNA, 13 bp, Homo sapiens
gatgctggcccag

SEQ ID NO: 3682741 - DNA, 14 bp, Homo sapiens
gatgctggcccagg

SEQ ID NO: 3682742 - DNA, 16 bp, Homo sapiens
gatgctggcccagggc

SEQ ID NO: 3682743 - DNA, 21 bp, Homo sapiens
gatgctggcccagggcccaga

SEQ ID NO: 3682744 - DNA, 23 bp, Homo sapiens
gatgctgggcacttcatctgatc

SEQ ID NO: 3682745 - DNA, 17 bp, Homo sapiens
gatgctgtgtatatggt

SEQ ID NO: 3682746 - DNA, 23 bp, Homo sapiens
gatgcttctcactgccatgccag

SEQ ID NO: 3682747 - DNA, 14 bp, Homo sapiens
gatgcttttaacag

SEQ ID NO: 3682748 - DNA, 15 bp, Homo sapiens
gatgcttttaacaga

SEQ ID NO: 3682749 - DNA, 16 bp, Homo sapiens
gatggaaaaataacaa

SEQ ID NO: 3682750 - DNA, 20 bp, Homo sapiens
gatggaagtgggccagtcct

SEQ ID NO: 3682751 - DNA, 21 bp, Homo sapiens
gatggaagtgggccagtcctg

SEQ ID NO: 3682752 - DNA, 23 bp, Homo sapiens
gatggaagtgggccagtcctggt

SEQ ID NO: 3682753 - DNA, 21 bp, Homo sapiens
gatggcaacagatctggaacc

SEQ ID NO: 3682754 - DNA, 19 bp, Homo sapiens
gatggcagtgtggggaggg

SEQ ID NO: 3682755 - DNA, 14 bp, Homo sapiens
gatggccccagcac

SEQ ID NO: 3682756 - DNA, 14 bp, Homo sapiens
gatggctcctctca

SEQ ID NO: 3682757 - DNA, 16 bp, Homo sapiens
gatgggcccaattctt

SEQ ID NO: 3682758 - DNA, 19 bp, Homo sapiens
gatgggccggcccccttcc

SEQ ID NO: 3682759 - DNA, 14 bp, Homo sapiens
gatggggaaggagg

SEQ ID NO: 3682760 - DNA, 16 bp, Homo sapiens
gatgggggaactcaga

SEQ ID NO: 3682761 - DNA, 19 bp, Homo sapiens
gatgggggaactcagatcc

SEQ ID NO: 3682762 - DNA, 22 bp, Homo sapiens
gatggtatctgggtaagaagaa

SEQ ID NO: 3682763 - DNA, 20 bp, Homo sapiens
gatgtaaattgaagaagcct

SEQ ID NO: 3682764 - DNA, 23 bp, Homo sapiens
gatgtggccctggctgccggcac

SEQ ID NO: 3682765 - DNA, 23 bp, Homo sapiens
gatgtgtttacatttactgaaat

SEQ ID NO: 3682766 - DNA, 14 bp, Homo sapiens
gatgtgtttgcttt

SEQ ID NO: 3682767 - DNA, 13 bp, Homo sapiens
gatgtttgtggcc

SEQ ID NO: 3682768 - DNA, 18 bp, Homo sapiens
gatgtttgtggcctcaga

SEQ ID NO: 3682769 - DNA, 12 bp, Homo sapiens
gattaacatttg

SEQ ID NO: 3682770 - DNA, 15 bp, Homo sapiens
gattaagatgtatat

SEQ ID NO: 3682771 - DNA, 19 bp, Homo sapiens
gattaaggcgtggcttctg

SEQ ID NO: 3682772 - DNA, 21 bp, Homo sapiens
gattaaggcgtggcttctgca

SEQ ID NO: 3682773 - DNA, 22 bp, Homo sapiens
gattcaaaatatttaaaaatgt

SEQ ID NO: 3682774 - DNA, 15 bp, Homo sapiens
gattcagctctgcaa

SEQ ID NO: 3682775 - DNA, 16 bp, Homo sapiens
gattcaggctgcttgg

SEQ ID NO: 3682776 - DNA, 18 bp, Homo sapiens
gattccattttggaaaat

SEQ ID NO: 3682777 - DNA, 20 bp, Homo sapiens
gattccccatctcaggccag

SEQ ID NO: 3682778 - DNA, 14 bp, Homo sapiens
gattccgcaccctg

SEQ ID NO: 3682779 - DNA, 17 bp, Homo sapiens
gattccgcaccctgcct

SEQ ID NO: 3682780 - DNA, 17 bp, Homo sapiens
gattctggttccagggt

SEQ ID NO: 3682781 - DNA, 22 bp, Homo sapiens
gattctggttccagggtccctc

SEQ ID NO: 3682782 - DNA, 16 bp, Homo sapiens
gattgaatgtgtgatg

SEQ ID NO: 3682783 - DNA, 17 bp, Homo sapiens
gattgacagctttgctg

SEQ ID NO: 3682784 - DNA, 16 bp, Homo sapiens
gattgcaccactgcac

SEQ ID NO: 3682785 - DNA, 23 bp, Homo sapiens
gattgcaccactgcactccagcc

SEQ ID NO: 3682786 - DNA, 19 bp, Homo sapiens
gattgcacgtggcctcttg

SEQ ID NO: 3682787 - DNA, 23 bp, Homo sapiens
gattggcagatgagcttatttca

SEQ ID NO: 3682788 - DNA, 15 bp, Homo sapiens
gatttaaacacacag

SEQ ID NO: 3682789 - DNA, 23 bp, Homo sapiens
gatttgatgagttaactgtgaaa

SEQ ID NO: 3682790 - DNA, 23 bp, Homo sapiens
gattttaatagggaatatatctc

SEQ ID NO: 3682791 - DNA, 21 bp, Homo sapiens
gatttttaaaaaatattttct

SEQ ID NO: 3682792 - DNA, 15 bp, Homo sapiens
gatttttagaattaa

SEQ ID NO: 3682793 - DNA, 21 bp, Homo sapiens
gcaaaaaagtccaattttaat

SEQ ID NO: 3682794 - DNA, 21 bp, Homo sapiens
gcaaaaaatactttttctaat

SEQ ID NO: 3682795 - DNA, 18 bp, Homo sapiens
gcaaaacactatgtatag

SEQ ID NO: 3682796 - DNA, 17 bp, Homo sapiens
gcaaaactctacttaat

SEQ ID NO: 3682797 - DNA, 20 bp, Homo sapiens
gcaaaagcaagggaccttca

SEQ ID NO: 3682798 - DNA, 13 bp, Homo sapiens
gcaaaaggctgag

SEQ ID NO: 3682799 - DNA, 16 bp, Homo sapiens
gcaaaaggctgagaag

SEQ ID NO: 3682800 - DNA, 16 bp, Homo sapiens
gcaaaccatttttaaa

SEQ ID NO: 3682801 - DNA, 14 bp, Homo sapiens
gcaaagaggcaaga

SEQ ID NO: 3682802 - DNA, 18 bp, Homo sapiens
gcaaagaggcaagaggct

SEQ ID NO: 3682803 - DNA, 22 bp, Homo sapiens
gcaaagatctgtcctcagcctt

SEQ ID NO: 3682804 - DNA, 17 bp, Homo sapiens
gcaaaggagtagaaaga

SEQ ID NO: 3682805 - DNA, 16 bp, Homo sapiens
gcaaagtattgtaaat

SEQ ID NO: 3682806 - DNA, 20 bp, Homo sapiens
gcaaagtattgtaaattata

SEQ ID NO: 3682807 - DNA, 21 bp, Homo sapiens
gcaaagtattgtaaattatat

SEQ ID NO: 3682808 - DNA, 16 bp, Homo sapiens
gcaaatgtttaaacat

SEQ ID NO: 3682809 - DNA, 16 bp, Homo sapiens
gcaaattcttttgaat

SEQ ID NO: 3682810 - DNA, 17 bp, Homo sapiens
gcaaattcttttgaatt

SEQ ID NO: 3682811 - DNA, 20 bp, Homo sapiens
gcaaattcttttgaattgtt

SEQ ID NO: 3682812 - DNA, 16 bp, Homo sapiens
gcaacagatctggaac

SEQ ID NO: 3682813 - DNA, 17 bp, Homo sapiens
gcaacagatctggaacc

SEQ ID NO: 3682814 - DNA, 20 bp, Homo sapiens
gcaacagatctggaacctca

SEQ ID NO: 3682815 - DNA, 20 bp, Homo sapiens
gcaaccactctgtggccagc

SEQ ID NO: 3682816 - DNA, 22 bp, Homo sapiens
gcaacggtctcctgactggtgc

SEQ ID NO: 3682817 - DNA, 22 bp, Homo sapiens
gcaagaggaaggggtgctgtga

SEQ ID NO: 3682818 - DNA, 12 bp, Homo sapiens
gcaagcagagga

SEQ ID NO: 3682819 - DNA, 13 bp, Homo sapiens
gcaagcagaggac

SEQ ID NO: 3682820 - DNA, 16 bp, Homo sapiens
gcaagcagaggaccag

SEQ ID NO: 3682821 - DNA, 15 bp, Homo sapiens
gcaaggaccaggact

SEQ ID NO: 3682822 - DNA, 13 bp, Homo sapiens
gcaagggaccttc

SEQ ID NO: 3682823 - DNA, 22 bp, Homo sapiens
gcaaggtgtggaggctcctgtg

SEQ ID NO: 3682824 - DNA, 24 bp, Homo sapiens
gcaaggtttaggctggtggcccag

SEQ ID NO: 3682825 - DNA, 17 bp, Homo sapiens
gcaagtgaggccggaga

SEQ ID NO: 3682826 - DNA, 18 bp, Homo sapiens
gcaataaatctgacccag

SEQ ID NO: 3682827 - DNA, 19 bp, Homo sapiens
gcaataaatctgacccagt

SEQ ID NO: 3682828 - DNA, 17 bp, Homo sapiens
gcaatgtaagcatactt

SEQ ID NO: 3682829 - DNA, 14 bp, Homo sapiens
gcaatgtgataaaa

SEQ ID NO: 3682830 - DNA, 14 bp, Homo sapiens
gcacaagctgcacc

SEQ ID NO: 3682831 - DNA, 9 bp, Homo sapiens
aaaaaatag

SEQ ID NO: 3682832 - DNA, 13 bp, Homo sapiens
aaaaaatgttgtt

SEQ ID NO: 3682833 - DNA, 13 bp, Homo sapiens
aaaaacattgttt

SEQ ID NO: 3682834 - DNA, 20 bp, Homo sapiens
aaaaactgtctttaaaagag

SEQ ID NO: 3682835 - DNA, 21 bp, Homo sapiens
aaaaacttagtgacaaaatag

SEQ ID NO: 3682836 - DNA, 20 bp, Homo sapiens
aaaaagtccaattttaattt

SEQ ID NO: 3682837 - DNA, 23 bp, Homo sapiens
aaaaagtccaattttaatttagt

SEQ ID NO: 3682838 - DNA, 17 bp, Homo sapiens
aaaaatacaaaaatttg

SEQ ID NO: 3682839 - DNA, 14 bp, Homo sapiens
aaaaatagcaactt

SEQ ID NO: 3682840 - DNA, 15 bp, Homo sapiens
aaaaatagcaacttg

SEQ ID NO: 3682841 - DNA, 13 bp, Homo sapiens
aaaaatattttct

SEQ ID NO: 3682842 - DNA, 22 bp, Homo sapiens
aaaaatattttctctgtacttt

SEQ ID NO: 3682843 - DNA, 22 bp, Homo sapiens
aaaaatctgaccaaaacaaaca

SEQ ID NO: 3682844 - DNA, 12 bp, Homo sapiens
aaaaatgtacat

SEQ ID NO: 3682845 - DNA, 21 bp, Homo sapiens
aaaaatgtcttgctgttgaca

SEQ ID NO: 3682846 - DNA, 21 bp, Homo sapiens
aaaaattgttaatttttccta

SEQ ID NO: 3682847 - DNA, 15 bp, Homo sapiens
aaaacaaaactgcat

SEQ ID NO: 3682848 - DNA, 12 bp, Homo sapiens
aaaacaaaattt

SEQ ID NO: 3682849 - DNA, 23 bp, Homo sapiens
aaaacacagacattctgccaggc

SEQ ID NO: 3682850 - DNA, 23 bp, Homo sapiens
aaaacatagaaatggaaattttg

SEQ ID NO: 3682851 - DNA, 19 bp, Homo sapiens
aaaacatattcttgtgctt

SEQ ID NO: 3682852 - DNA, 21 bp, Homo sapiens
aaaaccaatgttctctcttct

SEQ ID NO: 3682853 - DNA, 12 bp, Homo sapiens
aaaaccacacaa

SEQ ID NO: 3682854 - DNA, 18 bp, Homo sapiens
aaaactctacttaatcca

SEQ ID NO: 3682855 - DNA, 22 bp, Homo sapiens
aaaactgctgactgttttctct

SEQ ID NO: 3682856 - DNA, 23 bp, Homo sapiens
aaaactgctgactgttttctctt

SEQ ID NO: 3682857 - DNA, 14 bp, Homo sapiens
aaaactttcctcgc

SEQ ID NO: 3682858 - DNA, 20 bp, Homo sapiens
aaaactttcctcgcctgaca

SEQ ID NO: 3682859 - DNA, 11 bp, Homo sapiens
aaaagaacatg

SEQ ID NO: 3682860 - DNA, 13 bp, Homo sapiens
aaaagatcgcagt

SEQ ID NO: 3682861 - DNA, 13 bp, Homo sapiens
aaaagatgctttt

SEQ ID NO: 3682862 - DNA, 19 bp, Homo sapiens
aaaagatgcttttaacaga

SEQ ID NO: 3682863 - DNA, 18 bp, Homo sapiens
aaaaggaacggcttcctc

SEQ ID NO: 3682864 - DNA, 22 bp, Homo sapiens
aaaagtccaattttaatttagt

SEQ ID NO: 3682865 - DNA, 12 bp, Homo sapiens
aaaataaattta

SEQ ID NO: 3682866 - DNA, 16 bp, Homo sapiens
aaaataatactgctga

SEQ ID NO: 3682867 - DNA, 16 bp, Homo sapiens
aaaatacaaaaatttg

SEQ ID NO: 3682868 - DNA, 12 bp, Homo sapiens
aaaatagaaaag

SEQ ID NO: 3682869 - DNA, 12 bp, Homo sapiens
aaaatagcctgc

SEQ ID NO: 3682870 - DNA, 15 bp, Homo sapiens
aaaatatatgtattt

SEQ ID NO: 3682871 - DNA, 12 bp, Homo sapiens
aaaatatcttgg

SEQ ID NO: 3682872 - DNA, 16 bp, Homo sapiens
aaaatatttaaaaatg

SEQ ID NO: 3682873 - DNA, 13 bp, Homo sapiens
aaaatattttctc

SEQ ID NO: 3682874 - DNA, 18 bp, Homo sapiens
aaaatctgagaaactcta

SEQ ID NO: 3682875 - DNA, 22 bp, Homo sapiens
aaaatctgagaaactctacatg

SEQ ID NO: 3682876 - DNA, 12 bp, Homo sapiens
aaaatctgtcca

SEQ ID NO: 3682877 - DNA, 16 bp, Homo sapiens
aaaatctgtggtggtc

SEQ ID NO: 3682878 - DNA, 21 bp, Homo sapiens
aaaatgctgtattagtcacag

SEQ ID NO: 3682879 - DNA, 23 bp, Homo sapiens
aaaatgctgtattagtcacagag

SEQ ID NO: 3682880 - DNA, 20 bp, Homo sapiens
aaaatggaagccaacacatc

SEQ ID NO: 3682881 - DNA, 14 bp, Homo sapiens
aaaatgtaaagcca

SEQ ID NO: 3682882 - DNA, 14 bp, Homo sapiens
aaaattaacactgc

SEQ ID NO: 3682883 - DNA, 16 bp, Homo sapiens
aaaattacttggcttt

SEQ ID NO: 3682884 - DNA, 13 bp, Homo sapiens
aaaattcatttct

SEQ ID NO: 3682885 - DNA, 14 bp, Homo sapiens
aaaattcatttcta

SEQ ID NO: 3682886 - DNA, 13 bp, Homo sapiens
aaaattctttaga

SEQ ID NO: 3682887 - DNA, 13 bp, Homo sapiens
aaacaaaatttga

SEQ ID NO: 3682888 - DNA, 13 bp, Homo sapiens
aaacaaagccaga

SEQ ID NO: 3682889 - DNA, 15 bp, Homo sapiens
aaacacactgaggca

SEQ ID NO: 3682890 - DNA, 17 bp, Homo sapiens
aaacacactgaggcagg

SEQ ID NO: 3682891 - DNA, 21 bp, Homo sapiens
aaacacagacattctgccagg

SEQ ID NO: 3682892 - DNA, 14 bp, Homo sapiens
aaacactttcaaaa

SEQ ID NO: 3682893 - DNA, 15 bp, Homo sapiens
aaacagcctgtgtct

SEQ ID NO: 3682894 - DNA, 23 bp, Homo sapiens
aaacatgagcgctactcttggat

SEQ ID NO: 3682895 - DNA, 19 bp, Homo sapiens
aaacattgcctttgaatgt

SEQ ID NO: 3682896 - DNA, 17 bp, Homo sapiens
aaacattgttttgtgta

SEQ ID NO: 3682897 - DNA, 22 bp, Homo sapiens
aaaccaacctaatatattgtat

SEQ ID NO: 3682898 - DNA, 17 bp, Homo sapiens
aaaccatatgaacatat

SEQ ID NO: 3682899 - DNA, 17 bp, Homo sapiens
aaaccatttttaaagta

SEQ ID NO: 3682900 - DNA, 16 bp, Homo sapiens
aaacccgacagaggga

SEQ ID NO: 3682901 - DNA, 18 bp, Homo sapiens
aaacccgacagagggaag

SEQ ID NO: 3682902 - DNA, 16 bp, Homo sapiens
aaaccctattggtaaa

SEQ ID NO: 3682903 - DNA, 21 bp, Homo sapiens
aaacctggttcatatttatac

SEQ ID NO: 3682904 - DNA, 21 bp, Homo sapiens
aaactacaaccaatggaatgt

SEQ ID NO: 3682905 - DNA, 20 bp, Homo sapiens
aaactctgttgcaagtgcaa

SEQ ID NO: 3682906 - DNA, 11 bp, Homo sapiens
aaactcttcag

SEQ ID NO: 3682907 - DNA, 21 bp, Homo sapiens
aaactcttcagttaattctta

SEQ ID NO: 3682908 - DNA, 18 bp, Homo sapiens
aaactgaagcagcctctc

SEQ ID NO: 3682909 - DNA, 13 bp, Homo sapiens
aaactggctttgg

SEQ ID NO: 3682910 - DNA, 18 bp, Homo sapiens
aaactgtctttaaaagag

SEQ ID NO: 3682911 - DNA, 15 bp, Homo sapiens
aaacttaagatattt

SEQ ID NO: 3682912 - DNA, 24 bp, Homo sapiens
aaacttggctcgaatctctgtgcc

SEQ ID NO: 3682913 - DNA, 20 bp, Homo sapiens
aaagaaacccgacagaggga

SEQ ID NO: 3682914 - DNA, 23 bp, Homo sapiens
aaagaaacccgacagagggaaga

SEQ ID NO: 3682915 - DNA, 20 bp, Homo sapiens
aaagaaggtttcagaaagaa

SEQ ID NO: 3682916 - DNA, 15 bp, Homo sapiens
aaagaatatgacttt

SEQ ID NO: 3682917 - DNA, 16 bp, Homo sapiens
aaagagatgtccttgt

SEQ ID NO: 3682918 - DNA, 20 bp, Homo sapiens
aaagaggctgaggcctggac

SEQ ID NO: 3682919 - DNA, 19 bp, Homo sapiens
aaagagtgtggcaaaataa

SEQ ID NO: 3682920 - DNA, 22 bp, Homo sapiens
aaagatagagattgtttttaga

SEQ ID NO: 3682921 - DNA, 20 bp, Homo sapiens
aaagatctgtcctcagcctt

SEQ ID NO: 3682922 - DNA, 21 bp, Homo sapiens
aaagatctgtcctcagccttg

SEQ ID NO: 3682923 - DNA, 19 bp, Homo sapiens
aaagatgcttttaacagag

SEQ ID NO: 3682924 - DNA, 20 bp, Homo sapiens
aaagatttgtgaactggaag

SEQ ID NO: 3682925 - DNA, 16 bp, Homo sapiens
aaagcaaaagcaaggg

SEQ ID NO: 3682926 - DNA, 19 bp, Homo sapiens
aaagcaagtgttcactgct

SEQ ID NO: 3682927 - DNA, 16 bp, Homo sapiens
aaagcatcacttggga

SEQ ID NO: 3682928 - DNA, 15 bp, Homo sapiens
aaagccaaacatata

SEQ ID NO: 3682929 - DNA, 13 bp, Homo sapiens
aaagccatgctgg

SEQ ID NO: 3682930 - DNA, 23 bp, Homo sapiens
aaagcccaagggatctggtccta

SEQ ID NO: 3682931 - DNA, 14 bp, Homo sapiens
aaagccctgtgctc

SEQ ID NO: 3682932 - DNA, 16 bp, Homo sapiens
aaagcctcctccagcc

SEQ ID NO: 3682933 - DNA, 17 bp, Homo sapiens
aaagcgtccaattgact

SEQ ID NO: 3682934 - DNA, 12 bp, Homo sapiens
aaagctgaaaac

SEQ ID NO: 3682935 - DNA, 15 bp, Homo sapiens
aaagctgacattgcc

SEQ ID NO: 3682936 - DNA, 18 bp, Homo sapiens
aaagctgacattgccaaa

SEQ ID NO: 3682937 - DNA, 13 bp, Homo sapiens
aaagctgagcctg

SEQ ID NO: 3682938 - DNA, 18 bp, Homo sapiens
aaagcttatttttctgtg

SEQ ID NO: 3682939 - DNA, 13 bp, Homo sapiens
aaagctttcctgc

SEQ ID NO: 3682940 - DNA, 22 bp, Homo sapiens
aaagctttcctgccccaggcct

SEQ ID NO: 3682941 - DNA, 13 bp, Homo sapiens
aaaggaacatttt

SEQ ID NO: 3682942 - DNA, 23 bp, Homo sapiens
aaaggcagctgtgtctgagccca

SEQ ID NO: 3682943 - DNA, 16 bp, Homo sapiens
aaagtattgtaaatta

SEQ ID NO: 3682944 - DNA, 15 bp, Homo sapiens
aaagtcaaactttca

SEQ ID NO: 3682945 - DNA, 15 bp, Homo sapiens
aaagtcagaatatta

SEQ ID NO: 3682946 - DNA, 19 bp, Homo sapiens
aaagtgactaatggcatga

SEQ ID NO: 3682947 - DNA, 20 bp, Homo sapiens
aaagtgtcttttgacatttt

SEQ ID NO: 3682948 - DNA, 22 bp, Homo sapiens
aaagtgtcttttgacattttat

SEQ ID NO: 3682949 - DNA, 22 bp, Homo sapiens
aaagttatatttcagatgtaat

SEQ ID NO: 3682950 - DNA, 16 bp, Homo sapiens
aaataaatttatatga

SEQ ID NO: 3682951 - DNA, 15 bp, Homo sapiens
aaatacaaaaatact

SEQ ID NO: 3682952 - DNA, 14 bp, Homo sapiens
aaataccacaagcc

SEQ ID NO: 3682953 - DNA, 13 bp, Homo sapiens
aaataccagagcc

SEQ ID NO: 3682954 - DNA, 22 bp, Homo sapiens
aaataccagagccttcaagtgc

SEQ ID NO: 3682955 - DNA, 17 bp, Homo sapiens
aaatagaaaagttatta

SEQ ID NO: 3682956 - DNA, 22 bp, Homo sapiens
aaatagatgctgtgtatatggt

SEQ ID NO: 3682957 - DNA, 18 bp, Homo sapiens
aaatagcgctgtttttgt

SEQ ID NO: 3682958 - DNA, 14 bp, Homo sapiens
aaataggattttta

SEQ ID NO: 3682959 - DNA, 13 bp, Homo sapiens
aaatagtaaaaat

SEQ ID NO: 3682960 - DNA, 17 bp, Homo sapiens
aaatatacataaactta

SEQ ID NO: 3682961 - DNA, 11 bp, Homo sapiens
aaatatatgta

SEQ ID NO: 3682962 - DNA, 14 bp, Homo sapiens
aaatatatgtattt

SEQ ID NO: 3682963 - DNA, 14 bp, Homo sapiens
aaatatcttggcct

SEQ ID NO: 3682964 - DNA, 13 bp, Homo sapiens
aaatatgtaccaa

SEQ ID NO: 3682965 - DNA, 13 bp, Homo sapiens
aaatattttctat

SEQ ID NO: 3682966 - DNA, 14 bp, Homo sapiens
aaatattttctatt

SEQ ID NO: 3682967 - DNA, 17 bp, Homo sapiens
aaatcaagcaagcctct

SEQ ID NO: 3682968 - DNA, 19 bp, Homo sapiens
aaatcaatgctataactat

SEQ ID NO: 3682969 - DNA, 23 bp, Homo sapiens
aaatcagcctgctccagctgttc

SEQ ID NO: 3682970 - DNA, 15 bp, Homo sapiens
aaatcccatttaaaa

SEQ ID NO: 3682971 - DNA, 18 bp, Homo sapiens
aaatcccttacctcggtg

SEQ ID NO: 3682972 - DNA, 18 bp, Homo sapiens
aaatctggcttctggcca

SEQ ID NO: 3682973 - DNA, 16 bp, Homo sapiens
aaatctgtcaagagta

SEQ ID NO: 3682974 - DNA, 22 bp, Homo sapiens
aaatctgtccaaaggaggctgg

SEQ ID NO: 3682975 - DNA, 16 bp, Homo sapiens
aaatcttaatacttga

SEQ ID NO: 3682976 - DNA, 21 bp, Homo sapiens
aaatgagcagcccttacagta

SEQ ID NO: 3682977 - DNA, 17 bp, Homo sapiens
aaatgcctcttaaatta

SEQ ID NO: 3682978 - DNA, 14 bp, Homo sapiens
aaatgcgctcttta

SEQ ID NO: 3682979 - DNA, 22 bp, Homo sapiens
aaatggcctcatgtggctggaa

SEQ ID NO: 3682980 - DNA, 19 bp, Homo sapiens
aaatggctgtaatcatttg

SEQ ID NO: 3682981 - DNA, 21 bp, Homo sapiens
aaatggggccagatccagcct

SEQ ID NO: 3682982 - DNA, 22 bp, Homo sapiens
aaatggtccgctttcctggagc

SEQ ID NO: 3682983 - DNA, 15 bp, Homo sapiens
aaatgtaaacatttt

SEQ ID NO: 3682984 - DNA, 13 bp, Homo sapiens
aaatgtaaagcca

SEQ ID NO: 3682985 - DNA, 20 bp, Homo sapiens
aaatgtaggcttagtttgtg

SEQ ID NO: 3682986 - DNA, 13 bp, Homo sapiens
aaatgtccctcca

SEQ ID NO: 3682987 - DNA, 22 bp, Homo sapiens
aaatgtcctccagaagcctctg

SEQ ID NO: 3682988 - DNA, 19 bp, Homo sapiens
aaatgtctagttgtaacac

SEQ ID NO: 3682989 - DNA, 20 bp, Homo sapiens
aaatgttatcttatactgta

SEQ ID NO: 3682990 - DNA, 17 bp, Homo sapiens
aaatgtttaaacatttt

SEQ ID NO: 3682991 - DNA, 15 bp, Homo sapiens
aaattacaattttat

SEQ ID NO: 3682992 - DNA, 16 bp, Homo sapiens
aaattacttggctttt

SEQ ID NO: 3682993 - DNA, 18 bp, Homo sapiens
aaattatatttgtgctat

SEQ ID NO: 3682994 - DNA, 18 bp, Homo sapiens
aaattattaatttatgca

SEQ ID NO: 3682995 - DNA, 16 bp, Homo sapiens
aaattcatttctaatt

SEQ ID NO: 3682996 - DNA, 16 bp, Homo sapiens
aaattccccaccctga

SEQ ID NO: 3682997 - DNA, 19 bp, Homo sapiens
aaattcccgtgttgcttca

SEQ ID NO: 3682998 - DNA, 18 bp, Homo sapiens
aaattcctctttgctttg

SEQ ID NO: 3682999 - DNA, 19 bp, Homo sapiens
aaattcctctttgctttgc

SEQ ID NO: 3683000 - DNA, 15 bp, Homo sapiens
aaattctacaacaca

SEQ ID NO: 3683001 - DNA, 13 bp, Homo sapiens
aaattctcctgga

SEQ ID NO: 3683002 - DNA, 22 bp, Homo sapiens
aaattgaccaagtgatgtgttt

SEQ ID NO: 3683003 - DNA, 13 bp, Homo sapiens
aaatttagaaact

SEQ ID NO: 3683004 - DNA, 17 bp, Homo sapiens
aaatttagaaactaatt

SEQ ID NO: 3683005 - DNA, 15 bp, Homo sapiens
aaattttgtaatgaa

SEQ ID NO: 3683006 - DNA, 14 bp, Homo sapiens
aacaaagattgaga

SEQ ID NO: 3683007 - DNA, 11 bp, Homo sapiens
aacaaagccag

SEQ ID NO: 3683008 - DNA, 15 bp, Homo sapiens
aacaaaggcagctgt

SEQ ID NO: 3683009 - DNA, 14 bp, Homo sapiens
aacaataaaatttt

SEQ ID NO: 3683010 - DNA, 15 bp, Homo sapiens
aacaataatatttca

SEQ ID NO: 3683011 - DNA, 19 bp, Homo sapiens
aacaataatatttcaagtg

SEQ ID NO: 3683012 - DNA, 20 bp, Homo sapiens
aacaataatatttcaagtgc

SEQ ID NO: 3683013 - DNA, 17 bp, Homo sapiens
aacaatctggaagaaaa

SEQ ID NO: 3683014 - DNA, 20 bp, Homo sapiens
aacaatctggaagaaaaaaa

SEQ ID NO: 3683015 - DNA, 16 bp, Homo sapiens
aacaatggagtattct

SEQ ID NO: 3683016 - DNA, 19 bp, Homo sapiens
aacacagacattctgccag

SEQ ID NO: 3683017 - DNA, 20 bp, Homo sapiens
aacacagacattctgccagg

SEQ ID NO: 3683018 - DNA, 12 bp, Homo sapiens
aacacatttcac

SEQ ID NO: 3683019 - DNA, 14 bp, Homo sapiens
aacactatatggca

SEQ ID NO: 3683020 - DNA, 20 bp, Homo sapiens
aacactatatggcagtgtct

SEQ ID NO: 3683021 - DNA, 13 bp, Homo sapiens
aacactatgtata

SEQ ID NO: 3683022 - DNA, 14 bp, Homo sapiens
aacactgcttgtgt

SEQ ID NO: 3683023 - DNA, 17 bp, Homo sapiens
aacactgcttgtgtttt

SEQ ID NO: 3683024 - DNA, 18 bp, Homo sapiens
aacacttatcttctggat

SEQ ID NO: 3683025 - DNA, 15 bp, Homo sapiens
aacagagtgaaaaat

SEQ ID NO: 3683026 - DNA, 13 bp, Homo sapiens
aacagatctggaa

SEQ ID NO: 3683027 - DNA, 13 bp, Homo sapiens
aacagctgtggct

SEQ ID NO: 3683028 - DNA, 12 bp, Homo sapiens
aacagtgaagat

SEQ ID NO: 3683029 - DNA, 15 bp, Homo sapiens
aacagtggagctgaa

SEQ ID NO: 3683030 - DNA, 17 bp, Homo sapiens
aacagttaagacaacag

SEQ ID NO: 3683031 - DNA, 16 bp, Homo sapiens
aacagtttggaaaagt

SEQ ID NO: 3683032 - DNA, 12 bp, Homo sapiens
aacagttttcct

SEQ ID NO: 3683033 - DNA, 21 bp, Homo sapiens
aacagttttcctatgctttga

SEQ ID NO: 3683034 - DNA, 13 bp, Homo sapiens
aacatagaaaaat

SEQ ID NO: 3683035 - DNA, 23 bp, Homo sapiens
aacatagaaatggaaattttgct

SEQ ID NO: 3683036 - DNA, 20 bp, Homo sapiens
aacatgtaaccggcatgttt

SEQ ID NO: 3683037 - DNA, 18 bp, Homo sapiens
aacattgcctttgaatgt

SEQ ID NO: 3683038 - DNA, 19 bp, Homo sapiens
aacattggagctgactgtt

SEQ ID NO: 3683039 - DNA, 12 bp, Homo sapiens
aacattgtatta

SEQ ID NO: 3683040 - DNA, 15 bp, Homo sapiens
aacattgttttgtgt

SEQ ID NO: 3683041 - DNA, 12 bp, Homo sapiens
aacatttaaatt

SEQ ID NO: 3683042 - DNA, 13 bp, Homo sapiens
aacatttaaattc

SEQ ID NO: 3683043 - DNA, 15 bp, Homo sapiens
aaccacacaaagaca

SEQ ID NO: 3683044 - DNA, 23 bp, Homo sapiens
aaccagatctagtcaatcaagtc

SEQ ID NO: 3683045 - DNA, 17 bp, Homo sapiens
aaccattaaccagatct

SEQ ID NO: 3683046 - DNA, 22 bp, Homo sapiens
aacccaaggtgggtagatcacg

SEQ ID NO: 3683047 - DNA, 14 bp, Homo sapiens
aacccagactcaga

SEQ ID NO: 3683048 - DNA, 15 bp, Homo sapiens
aacccagactcagac

SEQ ID NO: 3683049 - DNA, 16 bp, Homo sapiens
aacccagactcagaca

SEQ ID NO: 3683050 - DNA, 15 bp, Homo sapiens
aacccaggcagctgg

SEQ ID NO: 3683051 - DNA, 11 bp, Homo sapiens
aacccccaccc

SEQ ID NO: 3683052 - DNA, 12 bp, Homo sapiens
aacccccacccc

SEQ ID NO: 3683053 - DNA, 15 bp, Homo sapiens
aacccccaccccaca

SEQ ID NO: 3683054 - DNA, 18 bp, Homo sapiens
aaccccctgtaaggttcc

SEQ ID NO: 3683055 - DNA, 20 bp, Homo sapiens
aacccgacagagggaagaaa

SEQ ID NO: 3683056 - DNA, 15 bp, Homo sapiens
aacccgaggcccgca

SEQ ID NO: 3683057 - DNA, 23 bp, Homo sapiens
aacccttaccccttagcctccct

SEQ ID NO: 3683058 - DNA, 14 bp, Homo sapiens
aacccttattccat

SEQ ID NO: 3683059 - DNA, 23 bp, Homo sapiens
aacccttctccatacccacaatc

SEQ ID NO: 3683060 - DNA, 13 bp, Homo sapiens
aaccgcaggaagc

SEQ ID NO: 3683061 - DNA, 14 bp, Homo sapiens
aaccgcaggaagct

SEQ ID NO: 3683062 - DNA, 15 bp, Homo sapiens
aacctcaaagtgact

SEQ ID NO: 3683063 - DNA, 20 bp, Homo sapiens
aacctcagcctggccagaca

SEQ ID NO: 3683064 - DNA, 11 bp, Homo sapiens
aacctcttccc

SEQ ID NO: 3683065 - DNA, 16 bp, Homo sapiens
aacctgcaaaatctgt

SEQ ID NO: 3683066 - DNA, 17 bp, Homo sapiens
aacctggaccccagcct

SEQ ID NO: 3683067 - DNA, 19 bp, Homo sapiens
aacctggaccccagccttg

SEQ ID NO: 3683068 - DNA, 20 bp, Homo sapiens
aacctggaccccagccttgg

SEQ ID NO: 3683069 - DNA, 17 bp, Homo sapiens
aacctgggttgcagaca

SEQ ID NO: 3683070 - DNA, 19 bp, Homo sapiens
aacctgggttgcagacagg

SEQ ID NO: 3683071 - DNA, 20 bp, Homo sapiens
aacctgggttgcagacagga

SEQ ID NO: 3683072 - DNA, 22 bp, Homo sapiens
aacctggttcatatttatactt

SEQ ID NO: 3683073 - DNA, 16 bp, Homo sapiens
aaccttgtataaatta

SEQ ID NO: 3683074 - DNA, 15 bp, Homo sapiens
aacctttaagaattt

SEQ ID NO: 3683075 - DNA, 13 bp, Homo sapiens
aacgtggcccaga

SEQ ID NO: 3683076 - DNA, 21 bp, Homo sapiens
aactaaaaagagactgtgcca

SEQ ID NO: 3683077 - DNA, 15 bp, Homo sapiens
aactaccaggtggca

SEQ ID NO: 3683078 - DNA, 18 bp, Homo sapiens
aactagcttggaaactgg

SEQ ID NO: 3683079 - DNA, 16 bp, Homo sapiens
aactatgatttggaaa

SEQ ID NO: 3683080 - DNA, 20 bp, Homo sapiens
aactattttcagatgtgaac

SEQ ID NO: 3683081 - DNA, 17 bp, Homo sapiens
aactcaaactcttaaaa

SEQ ID NO: 3683082 - DNA, 22 bp, Homo sapiens
aactcaaatggggccagatcca

SEQ ID NO: 3683083 - DNA, 13 bp, Homo sapiens
aactcagatccag

SEQ ID NO: 3683084 - DNA, 16 bp, Homo sapiens
aactccaggccctcct

SEQ ID NO: 3683085 - DNA, 17 bp, Homo sapiens
aactcttcactcttcaa

SEQ ID NO: 3683086 - DNA, 23 bp, Homo sapiens
aactcttcactcttcaaatgcct

SEQ ID NO: 3683087 - DNA, 19 bp, Homo sapiens
aactgaaacctaggaagcc

SEQ ID NO: 3683088 - DNA, 17 bp, Homo sapiens
aactgattacctgccaa

SEQ ID NO: 3683089 - DNA, 18 bp, Homo sapiens
aactgccaaaatgctcta

SEQ ID NO: 3683090 - DNA, 23 bp, Homo sapiens
aactgctgactgttttctcttga

SEQ ID NO: 3683091 - DNA, 13 bp, Homo sapiens
aactgctgtttca

SEQ ID NO: 3683092 - DNA, 10 bp, Homo sapiens
aactggacag

SEQ ID NO: 3683093 - DNA, 15 bp, Homo sapiens
aactggacagcctct

SEQ ID NO: 3683094 - DNA, 18 bp, Homo sapiens
aactgtctttaaaagaga

SEQ ID NO: 3683095 - DNA, 20 bp, Homo sapiens
aactgttacaacttgtattt

SEQ ID NO: 3683096 - DNA, 18 bp, Homo sapiens
aacttgaccctgagctga

SEQ ID NO: 3683097 - DNA, 13 bp, Homo sapiens
aacttgcctttca

SEQ ID NO: 3683098 - DNA, 22 bp, Homo sapiens
aacttggctcgaatctctgtgc

SEQ ID NO: 3683099 - DNA, 19 bp, Homo sapiens
aacttggctgcaggaatct

SEQ ID NO: 3683100 - DNA, 14 bp, Homo sapiens
aacttgtatttcca

SEQ ID NO: 3683101 - DNA, 15 bp, Homo sapiens
aactttcacctcaga

SEQ ID NO: 3683102 - DNA, 14 bp, Homo sapiens
aactttcctcgcct

SEQ ID NO: 3683103 - DNA, 13 bp, Homo sapiens
aagaaaaagaaaa

SEQ ID NO: 3683104 - DNA, 21 bp, Homo sapiens
aagaaacctactgcccaggca

SEQ ID NO: 3683105 - DNA, 12 bp, Homo sapiens
aagaaagcaact

SEQ ID NO: 3683106 - DNA, 14 bp, Homo sapiens
aagaaagcaacttt

SEQ ID NO: 3683107 - DNA, 15 bp, Homo sapiens
aagaaatttgcagtt

SEQ ID NO: 3683108 - DNA, 20 bp, Homo sapiens
aagaaccagtccccccaccc

SEQ ID NO: 3683109 - DNA, 14 bp, Homo sapiens
aagaacctggaact

SEQ ID NO: 3683110 - DNA, 21 bp, Homo sapiens
aagaacgttttttcctcagtg

SEQ ID NO: 3683111 - DNA, 23 bp, Homo sapiens
aagaactgcaggccctggcctcc

SEQ ID NO: 3683112 - DNA, 16 bp, Homo sapiens
aagaagaaagcaaaag

SEQ ID NO: 3683113 - DNA, 15 bp, Homo sapiens
aagaagaagaagaag

SEQ ID NO: 3683114 - DNA, 14 bp, Homo sapiens
aagaaggagagcaa

SEQ ID NO: 3683115 - DNA, 20 bp, Homo sapiens
aagaatcttggtttgccttc

SEQ ID NO: 3683116 - DNA, 21 bp, Homo sapiens
aagaatcttggtttgccttcc

SEQ ID NO: 3683117 - DNA, 22 bp, Homo sapiens
aagacaagtgattttcattgta

SEQ ID NO: 3683118 - DNA, 14 bp, Homo sapiens
aagacacttgctga

SEQ ID NO: 3683119 - DNA, 15 bp, Homo sapiens
aagacacttgctgag

SEQ ID NO: 3683120 - DNA, 16 bp, Homo sapiens
aagacagaagtttgca

SEQ ID NO: 3683121 - DNA, 18 bp, Homo sapiens
aagacagaagtttgcact

SEQ ID NO: 3683122 - DNA, 16 bp, Homo sapiens
aagacagatgccccag

SEQ ID NO: 3683123 - DNA, 22 bp, Homo sapiens
aagacagatgccccagagctgt

SEQ ID NO: 3683124 - DNA, 23 bp, Homo sapiens
aagaccaagcttagtcctgggag

SEQ ID NO: 3683125 - DNA, 14 bp, Homo sapiens
aagactaacaaagg

SEQ ID NO: 3683126 - DNA, 19 bp, Homo sapiens
aagactaacaaaggcagct

SEQ ID NO: 3683127 - DNA, 21 bp, Homo sapiens
aagactaacaaaggcagctgt

SEQ ID NO: 3683128 - DNA, 22 bp, Homo sapiens
aagactaacaaaggcagctgtg

SEQ ID NO: 3683129 - DNA, 13 bp, Homo sapiens
aagagacactcca

SEQ ID NO: 3683130 - DNA, 14 bp, Homo sapiens
aagagactgtgcca

SEQ ID NO: 3683131 - DNA, 16 bp, Homo sapiens
aagagcagcctgtggc

SEQ ID NO: 3683132 - DNA, 20 bp, Homo sapiens
aagaggaaggggtgctgtga

SEQ ID NO: 3683133 - DNA, 15 bp, Homo sapiens
aagaggctgaggcct

SEQ ID NO: 3683134 - DNA, 20 bp, Homo sapiens
aagaggctgaggcctggact

SEQ ID NO: 3683135 - DNA, 23 bp, Homo sapiens
aagaggttgggcttccatgcctg

SEQ ID NO: 3683136 - DNA, 22 bp, Homo sapiens
aagagtctaaaccccagattct

SEQ ID NO: 3683137 - DNA, 12 bp, Homo sapiens
aagagtgtggca

SEQ ID NO: 3683138 - DNA, 18 bp, Homo sapiens
aagataacccttattcca

SEQ ID NO: 3683139 - DNA, 16 bp, Homo sapiens
aagatagatcctttta

SEQ ID NO: 3683140 - DNA, 20 bp, Homo sapiens
aagatctgtcctcagccttg

SEQ ID NO: 3683141 - DNA, 15 bp, Homo sapiens
aagatgcaaggacca

SEQ ID NO: 3683142 - DNA, 16 bp, Homo sapiens
aagatgtcaaagatat

SEQ ID NO: 3683143 - DNA, 10 bp, Homo sapiens
aagattcttc

SEQ ID NO: 3683144 - DNA, 23 bp, Homo sapiens
aagatttacctcgttctgctcag

SEQ ID NO: 3683145 - DNA, 16 bp, Homo sapiens
aagatttgtgaactgg

SEQ ID NO: 3683146 - DNA, 20 bp, Homo sapiens
aagcaaaaggctgagaagga

SEQ ID NO: 3683147 - DNA, 22 bp, Homo sapiens
aagcaaagactttcctcttagt

SEQ ID NO: 3683148 - DNA, 15 bp, Homo sapiens
aagcaagaaagaaac

SEQ ID NO: 3683149 - DNA, 12 bp, Homo sapiens
aagcagaggagg

SEQ ID NO: 3683150 - DNA, 14 bp, Homo sapiens
aagcagaggagggg

SEQ ID NO: 3683151 - DNA, 22 bp, Homo sapiens
aagcagaggaggggccgctgcc

SEQ ID NO: 3683152 - DNA, 23 bp, Homo sapiens
aagcagatgcaaagaggcaagag

SEQ ID NO: 3683153 - DNA, 14 bp, Homo sapiens
aagcagccaagctc

SEQ ID NO: 3683154 - DNA, 16 bp, Homo sapiens
aagcagccaagctcct

SEQ ID NO: 3683155 - DNA, 22 bp, Homo sapiens
aagcagcctctccccaggtcca

SEQ ID NO: 3683156 - DNA, 13 bp, Homo sapiens
aagcagctcaaag

SEQ ID NO: 3683157 - DNA, 16 bp, Homo sapiens
aagcagctcaaaggca

SEQ ID NO: 3683158 - DNA, 19 bp, Homo sapiens
aagcagctcaaaggcacag

SEQ ID NO: 3683159 - DNA, 12 bp, Homo sapiens
aagcaggaagct

SEQ ID NO: 3683160 - DNA, 16 bp, Homo sapiens
aagcaggatggagctg

SEQ ID NO: 3683161 - DNA, 19 bp, Homo sapiens
aagcagtcgtgcctgtgtc

SEQ ID NO: 3683162 - DNA, 17 bp, Homo sapiens
aagcatactttgtaaat

SEQ ID NO: 3683163 - DNA, 20 bp, Homo sapiens
aagcatcttgggggggtggc

SEQ ID NO: 3683164 - DNA, 22 bp, Homo sapiens
aagcatgaataacatttaaatt

SEQ ID NO: 3683165 - DNA, 14 bp, Homo sapiens
aagccaagaaagat

SEQ ID NO: 3683166 - DNA, 13 bp, Homo sapiens
aagccaagcagcc

SEQ ID NO: 3683167 - DNA, 18 bp, Homo sapiens
aagccaagggaacctgtg

SEQ ID NO: 3683168 - DNA, 14 bp, Homo sapiens
aagccagaggctgg

SEQ ID NO: 3683169 - DNA, 20 bp, Homo sapiens
aagccaggaatttcccagga

SEQ ID NO: 3683170 - DNA, 21 bp, Homo sapiens
aagccaggaatttcccaggac

SEQ ID NO: 3683171 - DNA, 24 bp, Homo sapiens
aagccaggaatttcccaggaccct

SEQ ID NO: 3683172 - DNA, 13 bp, Homo sapiens
aagccatgctgga

SEQ ID NO: 3683173 - DNA, 21 bp, Homo sapiens
aagccatgctggaaaataata

SEQ ID NO: 3683174 - DNA, 18 bp, Homo sapiens
aagccatgtactcaagta

SEQ ID NO: 3683175 - DNA, 13 bp, Homo sapiens
aagccccacatgt

SEQ ID NO: 3683176 - DNA, 16 bp, Homo sapiens
aagcccccagctaaga

SEQ ID NO: 3683177 - DNA, 21 bp, Homo sapiens
aagcccccagctaagaacctg

SEQ ID NO: 3683178 - DNA, 18 bp, Homo sapiens
aagcccctgagtcctgag

SEQ ID NO: 3683179 - DNA, 21 bp, Homo sapiens
aagccctgtgctccatggctg

SEQ ID NO: 3683180 - DNA, 14 bp, Homo sapiens
aagccgtgccctgc

SEQ ID NO: 3683181 - DNA, 22 bp, Homo sapiens
aagcctcaaagagagaaagttt

SEQ ID NO: 3683182 - DNA, 21 bp, Homo sapiens
aagcctcacacgtaaaagaaa

SEQ ID NO: 3683183 - DNA, 16 bp, Homo sapiens
aagcctcccacgactg

SEQ ID NO: 3683184 - DNA, 16 bp, Homo sapiens
aagcctgaagggcctc

SEQ ID NO: 3683185 - DNA, 15 bp, Homo sapiens
aagcctgcattctta

SEQ ID NO: 3683186 - DNA, 14 bp, Homo sapiens
aagcggctggcagc

SEQ ID NO: 3683187 - DNA, 14 bp, Homo sapiens
aagcgtatttaatg

SEQ ID NO: 3683188 - DNA, 20 bp, Homo sapiens
aagctatagacccgaggaaa

SEQ ID NO: 3683189 - DNA, 22 bp, Homo sapiens
aagctatttatgggcccctggc

SEQ ID NO: 3683190 - DNA, 19 bp, Homo sapiens
aagctcaagtgttcacaac

SEQ ID NO: 3683191 - DNA, 17 bp, Homo sapiens
aagctcagactggttga

SEQ ID NO: 3683192 - DNA, 19 bp, Homo sapiens
aagctcctcctccctgcat

SEQ ID NO: 3683193 - DNA, 21 bp, Homo sapiens
aagctcctctccccagcccag

SEQ ID NO: 3683194 - DNA, 22 bp, Homo sapiens
aagctgcaccctcaggcaggtg

SEQ ID NO: 3683195 - DNA, 13 bp, Homo sapiens
aagctgggcaggt

SEQ ID NO: 3683196 - DNA, 21 bp, Homo sapiens
aagctgtgctgggaagcccgg

SEQ ID NO: 3683197 - DNA, 21 bp, Homo sapiens
aagcttcattctccttgttgt

SEQ ID NO: 3683198 - DNA, 12 bp, Homo sapiens
aagctttcctgc

SEQ ID NO: 3683199 - DNA, 16 bp, Homo sapiens
aagctttcctgcccca

SEQ ID NO: 3683200 - DNA, 16 bp, Homo sapiens
aaggaacggcttcctc

SEQ ID NO: 3683201 - DNA, 22 bp, Homo sapiens
aaggaagggtggctttgcattt

SEQ ID NO: 3683202 - DNA, 12 bp, Homo sapiens
aaggaaggtgga

SEQ ID NO: 3683203 - DNA, 18 bp, Homo sapiens
aaggaaggtggatggccc

SEQ ID NO: 3683204 - DNA, 23 bp, Homo sapiens
aaggacttcctgtccagctccaa

SEQ ID NO: 3683205 - DNA, 14 bp, Homo sapiens
aaggagagcaagaa

SEQ ID NO: 3683206 - DNA, 21 bp, Homo sapiens
aaggagctgctatagcctggg

SEQ ID NO: 3683207 - DNA, 14 bp, Homo sapiens
aaggaggctggcag

SEQ ID NO: 3683208 - DNA, 18 bp, Homo sapiens
aaggaggggaaaaaaatg

SEQ ID NO: 3683209 - DNA, 20 bp, Homo sapiens
aaggaggggaaaaaaatgtt

SEQ ID NO: 3683210 - DNA, 21 bp, Homo sapiens
aaggaggggaaaaaaatgttg

SEQ ID NO: 3683211 - DNA, 19 bp, Homo sapiens
aaggatagatgctggccca

SEQ ID NO: 3683212 - DNA, 16 bp, Homo sapiens
aaggcagctgtgtctg

SEQ ID NO: 3683213 - DNA, 20 bp, Homo sapiens
aaggcagggagcgagggaga

SEQ ID NO: 3683214 - DNA, 12 bp, Homo sapiens
aaggcagggctc

SEQ ID NO: 3683215 - DNA, 19 bp, Homo sapiens
aaggccaagaggctgttcc

SEQ ID NO: 3683216 - DNA, 21 bp, Homo sapiens
aaggccagagtggcctggcca

SEQ ID NO: 3683217 - DNA, 23 bp, Homo sapiens
aaggccagagtggcctggccagg

SEQ ID NO: 3683218 - DNA, 14 bp, Homo sapiens
aaggccgagaagca

SEQ ID NO: 3683219 - DNA, 17 bp, Homo sapiens
aaggccgagaagcaaga

SEQ ID NO: 3683220 - DNA, 14 bp, Homo sapiens
aaggctgagaagga

SEQ ID NO: 3683221 - DNA, 17 bp, Homo sapiens
aaggctgaggaaaggcc

SEQ ID NO: 3683222 - DNA, 23 bp, Homo sapiens
aaggctgaggaaaggccagctgg

SEQ ID NO: 3683223 - DNA, 14 bp, Homo sapiens
aaggctgggggaag

SEQ ID NO: 3683224 - DNA, 19 bp, Homo sapiens
aaggctgggggaagaagct

SEQ ID NO: 3683225 - DNA, 22 bp, Homo sapiens
aaggctgggggaagaagctctc

SEQ ID NO: 3683226 - DNA, 15 bp, Homo sapiens
aagggccagagccag

SEQ ID NO: 3683227 - DNA, 14 bp, Homo sapiens
aagggccagtcctg

SEQ ID NO: 3683228 - DNA, 16 bp, Homo sapiens
aagggccagtcctgcc

SEQ ID NO: 3683229 - DNA, 20 bp, Homo sapiens
aaggggcggtgcccacaccg

SEQ ID NO: 3683230 - DNA, 17 bp, Homo sapiens
aaggggtgctgtgaggc

SEQ ID NO: 3683231 - DNA, 21 bp, Homo sapiens
aagggtggctttgcatttctt

SEQ ID NO: 3683232 - DNA, 18 bp, Homo sapiens
aaggtaaaatgccatgat

SEQ ID NO: 3683233 - DNA, 19 bp, Homo sapiens
aaggtctttcagtactttt

SEQ ID NO: 3683234 - DNA, 11 bp, Homo sapiens
aaggtgggagg

SEQ ID NO: 3683235 - DNA, 20 bp, Homo sapiens
aaggtgtagccacaccagga

SEQ ID NO: 3683236 - DNA, 18 bp, Homo sapiens
aaggtgtggaggctcctg

SEQ ID NO: 3683237 - DNA, 21 bp, Homo sapiens
aaggtgtggaggctcctgtgg

SEQ ID NO: 3683238 - DNA, 22 bp, Homo sapiens
aaggtgtggaggctcctgtggt

SEQ ID NO: 3683239 - DNA, 21 bp, Homo sapiens
aaggttctcaggtgttgccaa

SEQ ID NO: 3683240 - DNA, 17 bp, Homo sapiens
aaggttgtattgcatat

SEQ ID NO: 3683241 - DNA, 20 bp, Homo sapiens
aaggtttaggctggtggccc

SEQ ID NO: 3683242 - DNA, 23 bp, Homo sapiens
aaggtttcagaaagaagtgggga

SEQ ID NO: 3683243 - DNA, 19 bp, Homo sapiens
aagtaacctctacaggcat

SEQ ID NO: 3683244 - DNA, 20 bp, Homo sapiens
aagtaatggttaagttttct

SEQ ID NO: 3683245 - DNA, 20 bp, Homo sapiens
aagtacttaactatctgttc

SEQ ID NO: 3683246 - DNA, 17 bp, Homo sapiens
aagtacttatctttatt

SEQ ID NO: 3683247 - DNA, 12 bp, Homo sapiens
aagtattgtaaa

SEQ ID NO: 3683248 - DNA, 14 bp, Homo sapiens
aagtccccaggccc

SEQ ID NO: 3683249 - DNA, 23 bp, Homo sapiens
aagtccccaggccccaggaagcc

SEQ ID NO: 3683250 - DNA, 22 bp, Homo sapiens
aagtcctctgtggccagctgca

SEQ ID NO: 3683251 - DNA, 13 bp, Homo sapiens
aagtctcagaaga

SEQ ID NO: 3683252 - DNA, 14 bp, Homo sapiens
aagtgaaaatctta

SEQ ID NO: 3683253 - DNA, 16 bp, Homo sapiens
aagtgcatttttgtaa

SEQ ID NO: 3683254 - DNA, 11 bp, Homo sapiens
aagtgccaaac

SEQ ID NO: 3683255 - DNA, 14 bp, Homo sapiens
aagtgccaaacaga

SEQ ID NO: 3683256 - DNA, 15 bp, Homo sapiens
aagtgccagggctgg

SEQ ID NO: 3683257 - DNA, 16 bp, Homo sapiens
aagtgggccagtcctg

SEQ ID NO: 3683258 - DNA, 18 bp, Homo sapiens
aagtgggccagtcctggt

SEQ ID NO: 3683259 - DNA, 13 bp, Homo sapiens
aagtgggcccacc

SEQ ID NO: 3683260 - DNA, 17 bp, Homo sapiens
aagtggtggtaaccctg

SEQ ID NO: 3683261 - DNA, 19 bp, Homo sapiens
aagtgtcttttgacatttt

SEQ ID NO: 3683262 - DNA, 18 bp, Homo sapiens
aagtgttcactgctcctt

SEQ ID NO: 3683263 - DNA, 22 bp, Homo sapiens
aagtgttgggattggttaaggt

SEQ ID NO: 3683264 - DNA, 14 bp, Homo sapiens
aagttatatttcag

SEQ ID NO: 3683265 - DNA, 23 bp, Homo sapiens
aagttgaggggagcatgcttccc

SEQ ID NO: 3683266 - DNA, 18 bp, Homo sapiens
aagttgatggtgatgaaa

SEQ ID NO: 3683267 - DNA, 13 bp, Homo sapiens
aagtttatatata

SEQ ID NO: 3683268 - DNA, 20 bp, Homo sapiens
aagtttgagatcagcctggg

SEQ ID NO: 3683269 - DNA, 16 bp, Homo sapiens
aagttttcttgtttct

SEQ ID NO: 3683270 - DNA, 17 bp, Homo sapiens
aagttttcttgtttctg

SEQ ID NO: 3683271 - DNA, 23 bp, Homo sapiens
aagttttgggtatgtttaatctg

SEQ ID NO: 3683272 - DNA, 13 bp, Homo sapiens
aagtttttttgct

SEQ ID NO: 3683273 - DNA, 22 bp, Homo sapiens
aataaaaaccaagaagatgtct

SEQ ID NO: 3683274 - DNA, 17 bp, Homo sapiens
aataaactgtgtttact

SEQ ID NO: 3683275 - DNA, 13 bp, Homo sapiens
aataaagataacc

SEQ ID NO: 3683276 - DNA, 20 bp, Homo sapiens
aataaatctgacccagtgcc

SEQ ID NO: 3683277 - DNA, 15 bp, Homo sapiens
aataaatgccctctt

SEQ ID NO: 3683278 - DNA, 16 bp, Homo sapiens
aataaatgccctcttc

SEQ ID NO: 3683279 - DNA, 14 bp, Homo sapiens
aataagcaggatgt

SEQ ID NO: 3683280 - DNA, 21 bp, Homo sapiens
aataaggacaagcctaacttc

SEQ ID NO: 3683281 - DNA, 22 bp, Homo sapiens
aataaggacaagcctaacttca

SEQ ID NO: 3683282 - DNA, 16 bp, Homo sapiens
aataataaatgccctc

SEQ ID NO: 3683283 - DNA, 15 bp, Homo sapiens
aataatatttcaagt

SEQ ID NO: 3683284 - DNA, 22 bp, Homo sapiens
aataatatttcaagtgcctaga

SEQ ID NO: 3683285 - DNA, 18 bp, Homo sapiens
aatacagtacaggcagca

SEQ ID NO: 3683286 - DNA, 13 bp, Homo sapiens
aataccagagcct

SEQ ID NO: 3683287 - DNA, 22 bp, Homo sapiens
aataccagagccttcaagtgcc

SEQ ID NO: 3683288 - DNA, 20 bp, Homo sapiens
aatactctaccctcttagaa

SEQ ID NO: 3683289 - DNA, 19 bp, Homo sapiens
aatagaaaagttattagtg

SEQ ID NO: 3683290 - DNA, 20 bp, Homo sapiens
aatagcctgcctcttctcta

SEQ ID NO: 3683291 - DNA, 20 bp, Homo sapiens
aatagtctagatggctcctc

SEQ ID NO: 3683292 - DNA, 13 bp, Homo sapiens
aatagtctgtgtg

SEQ ID NO: 3683293 - DNA, 13 bp, Homo sapiens
aatataaacacta

SEQ ID NO: 3683294 - DNA, 16 bp, Homo sapiens
aatatatgaacattag

SEQ ID NO: 3683295 - DNA, 22 bp, Homo sapiens
aatatatgtatttttatataat

SEQ ID NO: 3683296 - DNA, 14 bp, Homo sapiens
aatatcaaatgcag

SEQ ID NO: 3683297 - DNA, 21 bp, Homo sapiens
aatatcaaatgcagtatattt

SEQ ID NO: 3683298 - DNA, 14 bp, Homo sapiens
aatatctaaagtta

SEQ ID NO: 3683299 - DNA, 14 bp, Homo sapiens
aatattatgagatg

SEQ ID NO: 3683300 - DNA, 18 bp, Homo sapiens
aatattatgagatgctgg

SEQ ID NO: 3683301 - DNA, 22 bp, Homo sapiens
aatattatgagatgctggcttg

SEQ ID NO: 3683302 - DNA, 14 bp, Homo sapiens
aatatttaaaaatg

SEQ ID NO: 3683303 - DNA, 23 bp, Homo sapiens
aatatttcaagtgcctagactgt

SEQ ID NO: 3683304 - DNA, 21 bp, Homo sapiens
aatattttccatgaaaatgca

SEQ ID NO: 3683305 - DNA, 13 bp, Homo sapiens
aatattttctatt

SEQ ID NO: 3683306 - DNA, 19 bp, Homo sapiens
aatattttctctgtacttt

SEQ ID NO: 3683307 - DNA, 17 bp, Homo sapiens
aatcaacttgcttatca

SEQ ID NO: 3683308 - DNA, 18 bp, Homo sapiens
aatcaacttgcttatcaa

SEQ ID NO: 3683309 - DNA, 16 bp, Homo sapiens
aatcaagcaagcctct

SEQ ID NO: 3683310 - DNA, 17 bp, Homo sapiens
aatcaagtctgtttact

SEQ ID NO: 3683311 - DNA, 20 bp, Homo sapiens
aatcacataatttgttttgt

SEQ ID NO: 3683312 - DNA, 19 bp, Homo sapiens
aatcacattcgagtgtttc

SEQ ID NO: 3683313 - DNA, 23 bp, Homo sapiens
aatcagaactcaaatggggccag

SEQ ID NO: 3683314 - DNA, 19 bp, Homo sapiens
aatcagcctgctccagctg

SEQ ID NO: 3683315 - DNA, 20 bp, Homo sapiens
aatcaggaatattttccaaa

SEQ ID NO: 3683316 - DNA, 16 bp, Homo sapiens
aatcatctggattttt

SEQ ID NO: 3683317 - DNA, 22 bp, Homo sapiens
aatcatgttgatcatgtacttt

SEQ ID NO: 3683318 - DNA, 16 bp, Homo sapiens
aatcatttgtttacat

SEQ ID NO: 3683319 - DNA, 22 bp, Homo sapiens
aatcatttgtttacatttgatg

SEQ ID NO: 3683320 - DNA, 18 bp, Homo sapiens
aatcattttcattcctaa

SEQ ID NO: 3683321 - DNA, 20 bp, Homo sapiens
aatccaggcagatccaggac

SEQ ID NO: 3683322 - DNA, 16 bp, Homo sapiens
aatcccagttcttcct

SEQ ID NO: 3683323 - DNA, 22 bp, Homo sapiens
aatcccagttcttcctgcaacc

SEQ ID NO: 3683324 - DNA, 14 bp, Homo sapiens
aatcccggctccag

SEQ ID NO: 3683325 - DNA, 17 bp, Homo sapiens
aatcccggctccagagc

SEQ ID NO: 3683326 - DNA, 18 bp, Homo sapiens
aatcccggctccagagca

SEQ ID NO: 3683327 - DNA, 11 bp, Homo sapiens
aatcctggctg

SEQ ID NO: 3683328 - DNA, 13 bp, Homo sapiens
aatcgatggggga

SEQ ID NO: 3683329 - DNA, 18 bp, Homo sapiens
aatctaacaataatattt

SEQ ID NO: 3683330 - DNA, 21 bp, Homo sapiens
aatctatggtcgggagacagc

SEQ ID NO: 3683331 - DNA, 21 bp, Homo sapiens
aatctcagaaccttgtcccag

SEQ ID NO: 3683332 - DNA, 22 bp, Homo sapiens
aatctcagttgattttctggat

SEQ ID NO: 3683333 - DNA, 12 bp, Homo sapiens
aatctgacccag

SEQ ID NO: 3683334 - DNA, 13 bp, Homo sapiens
aatctgacccagt

SEQ ID NO: 3683335 - DNA, 15 bp, Homo sapiens
aatctgacccagtgc

SEQ ID NO: 3683336 - DNA, 17 bp, Homo sapiens
aatctggcttagtgcca

SEQ ID NO: 3683337 - DNA, 21 bp, Homo sapiens
aatctggcttctggccaggaa

SEQ ID NO: 3683338 - DNA, 20 bp, Homo sapiens
aatctgtcaagagtagttat

SEQ ID NO: 3683339 - DNA, 20 bp, Homo sapiens
aatcttaaggtgtagccaca

SEQ ID NO: 3683340 - DNA, 20 bp, Homo sapiens
aatcttcaccatctttctga

SEQ ID NO: 3683341 - DNA, 14 bp, Homo sapiens
aatcttccttttat

SEQ ID NO: 3683342 - DNA, 16 bp, Homo sapiens
aatgaattcctagaat

SEQ ID NO: 3683343 - DNA, 22 bp, Homo sapiens
aatgaccttcattctgagacca

SEQ ID NO: 3683344 - DNA, 21 bp, Homo sapiens
aatgagcagcccttacagtat

SEQ ID NO: 3683345 - DNA, 14 bp, Homo sapiens
aatgagcctggcaa

SEQ ID NO: 3683346 - DNA, 15 bp, Homo sapiens
aatgagcctggcaag

SEQ ID NO: 3683347 - DNA, 17 bp, Homo sapiens
aatgatcttttcaagtt

SEQ ID NO: 3683348 - DNA, 21 bp, Homo sapiens
aatgatggcagtggtttgaaa

SEQ ID NO: 3683349 - DNA, 20 bp, Homo sapiens
aatgcagcagggatgccctg

SEQ ID NO: 3683350 - DNA, 15 bp, Homo sapiens
aatgcagtatatttc

SEQ ID NO: 3683351 - DNA, 21 bp, Homo sapiens
aatgccatggacagaagaagg

SEQ ID NO: 3683352 - DNA, 18 bp, Homo sapiens
aatgccggttaaattcca

SEQ ID NO: 3683353 - DNA, 20 bp, Homo sapiens
aatgcctcttaaattatata

SEQ ID NO: 3683354 - DNA, 16 bp, Homo sapiens
aatgctatttgaacaa

SEQ ID NO: 3683355 - DNA, 15 bp, Homo sapiens
aatggaaattttgct

SEQ ID NO: 3683356 - DNA, 14 bp, Homo sapiens
aatggatagctcat

SEQ ID NO: 3683357 - DNA, 23 bp, Homo sapiens
aatggatattttaaattcattca

SEQ ID NO: 3683358 - DNA, 17 bp, Homo sapiens
aatggatgccttgaata

SEQ ID NO: 3683359 - DNA, 17 bp, Homo sapiens
aatggcacagcccaaag

SEQ ID NO: 3683360 - DNA, 20 bp, Homo sapiens
aatggcacagcccaaagaag

SEQ ID NO: 3683361 - DNA, 19 bp, Homo sapiens
aatggcccggcccctcctg

SEQ ID NO: 3683362 - DNA, 21 bp, Homo sapiens
aatggcccggcccctcctgac

SEQ ID NO: 3683363 - DNA, 20 bp, Homo sapiens
aatgggccactgaaatctgt

SEQ ID NO: 3683364 - DNA, 14 bp, Homo sapiens
aatggggccagatc

SEQ ID NO: 3683365 - DNA, 17 bp, Homo sapiens
aatggggccagatccag

SEQ ID NO: 3683366 - DNA, 21 bp, Homo sapiens
aatggggtccacttccccctc

SEQ ID NO: 3683367 - DNA, 16 bp, Homo sapiens
aatgggtttttccctg

SEQ ID NO: 3683368 - DNA, 14 bp, Homo sapiens
aatggtttgaatat

SEQ ID NO: 3683369 - DNA, 17 bp, Homo sapiens
aatggtttgaatataaa

SEQ ID NO: 3683370 - DNA, 16 bp, Homo sapiens
aatggtttttaaattt

SEQ ID NO: 3683371 - DNA, 16 bp, Homo sapiens
aatgtaaatgatttta

SEQ ID NO: 3683372 - DNA, 15 bp, Homo sapiens
aatgtaagtgggccc

SEQ ID NO: 3683373 - DNA, 16 bp, Homo sapiens
aatgtacagacatatt

SEQ ID NO: 3683374 - DNA, 17 bp, Homo sapiens
aatgtacagacatattt

SEQ ID NO: 3683375 - DNA, 18 bp, Homo sapiens
aatgtacgtccagcctgc

SEQ ID NO: 3683376 - DNA, 22 bp, Homo sapiens
aatgtaggcttagtttgtgtgt

SEQ ID NO: 3683377 - DNA, 23 bp, Homo sapiens
aatgtatgtgtctcccaggtgca

SEQ ID NO: 3683378 - DNA, 19 bp, Homo sapiens
aatgtcatatactgccatg

SEQ ID NO: 3683379 - DNA, 18 bp, Homo sapiens
aatgtcctccagaagcct

SEQ ID NO: 3683380 - DNA, 19 bp, Homo sapiens
aatgtcttgctgttgacat

SEQ ID NO: 3683381 - DNA, 22 bp, Homo sapiens
aatgtcttgctgttgacatatt

SEQ ID NO: 3683382 - DNA, 17 bp, Homo sapiens
aatgtgattactgctct

SEQ ID NO: 3683383 - DNA, 13 bp, Homo sapiens
aatgttaattttt

SEQ ID NO: 3683384 - DNA, 21 bp, Homo sapiens
aatgttaattttttggtacaa

SEQ ID NO: 3683385 - DNA, 22 bp, Homo sapiens
aatgttatcttatactgtacaa

SEQ ID NO: 3683386 - DNA, 12 bp, Homo sapiens
aatgttgtttcc

SEQ ID NO: 3683387 - DNA, 16 bp, Homo sapiens
aatgttttaaatgtac

SEQ ID NO: 3683388 - DNA, 13 bp, Homo sapiens
aattaaaacactt

SEQ ID NO: 3683389 - DNA, 19 bp, Homo sapiens
aattaaggaacataaatct

SEQ ID NO: 3683390 - DNA, 20 bp, Homo sapiens
aattaaggaacataaatctt

SEQ ID NO: 3683391 - DNA, 18 bp, Homo sapiens
aattaatatctcctggaa

SEQ ID NO: 3683392 - DNA, 15 bp, Homo sapiens
aattacaattttatc

SEQ ID NO: 3683393 - DNA, 12 bp, Homo sapiens
aattatatattt

SEQ ID NO: 3683394 - DNA, 23 bp, Homo sapiens
aattatatttgtgctatagtatt

SEQ ID NO: 3683395 - DNA, 18 bp, Homo sapiens
aattcagatccagtgtaa

SEQ ID NO: 3683396 - DNA, 15 bp, Homo sapiens
aattcagcaaaccat

SEQ ID NO: 3683397 - DNA, 18 bp, Homo sapiens
aattccacagattatcaa

SEQ ID NO: 3683398 - DNA, 19 bp, Homo sapiens
aattccatatgctccagga

SEQ ID NO: 3683399 - DNA, 14 bp, Homo sapiens
aattccctggggaa

SEQ ID NO: 3683400 - DNA, 17 bp, Homo sapiens
aattcctagaattaaac

SEQ ID NO: 3683401 - DNA, 14 bp, Homo sapiens
aattctaacttttt

SEQ ID NO: 3683402 - DNA, 21 bp, Homo sapiens
aattctgtttttaatgctatt

SEQ ID NO: 3683403 - DNA, 14 bp, Homo sapiens
aattcttttgaatt

SEQ ID NO: 3683404 - DNA, 14 bp, Homo sapiens
aattgctttgccaa

SEQ ID NO: 3683405 - DNA, 21 bp, Homo sapiens
aattgttgaacaggtgttttt

SEQ ID NO: 3683406 - DNA, 14 bp, Homo sapiens
aattgttgacaaat

SEQ ID NO: 3683407 - DNA, 18 bp, Homo sapiens
aatttagaaactaattga

SEQ ID NO: 3683408 - DNA, 16 bp, Homo sapiens
aatttagtaaatgtta

SEQ ID NO: 3683409 - DNA, 18 bp, Homo sapiens
aatttattaattgctttg

SEQ ID NO: 3683410 - DNA, 23 bp, Homo sapiens
aatttcagactcccattcctgaa

SEQ ID NO: 3683411 - DNA, 15 bp, Homo sapiens
aatttcccaggaccc

SEQ ID NO: 3683412 - DNA, 22 bp, Homo sapiens
aatttcccaggaccctgaaggg

SEQ ID NO: 3683413 - DNA, 11 bp, Homo sapiens
aatttcctggc

SEQ ID NO: 3683414 - DNA, 17 bp, Homo sapiens
aatttgactaattttac

SEQ ID NO: 3683415 - DNA, 19 bp, Homo sapiens
aattttatctgtttcctga

SEQ ID NO: 3683416 - DNA, 12 bp, Homo sapiens
aattttcagcat

SEQ ID NO: 3683417 - DNA, 16 bp, Homo sapiens
aattttttggtacaaa

SEQ ID NO: 3683418 - DNA, 21 bp, Homo sapiens
aattttttggtacaaaaataa

SEQ ID NO: 3683419 - DNA, 18 bp, Homo sapiens
acaaaaaccaaatgttta

SEQ ID NO: 3683420 - DNA, 20 bp, Homo sapiens
acaaaaaggttctcaggtgt

SEQ ID NO: 3683421 - DNA, 14 bp, Homo sapiens
acaaaacttttcta

SEQ ID NO: 3683422 - DNA, 13 bp, Homo sapiens
acaaaatttgact

SEQ ID NO: 3683423 - DNA, 20 bp, Homo sapiens
acaaaatttgactaatttta

SEQ ID NO: 3683424 - DNA, 17 bp, Homo sapiens
acaaacacacacaaaag

SEQ ID NO: 3683425 - DNA, 16 bp, Homo sapiens
acaaactgtaatacaa

SEQ ID NO: 3683426 - DNA, 15 bp, Homo sapiens
acaaagagatgtcct

SEQ ID NO: 3683427 - DNA, 20 bp, Homo sapiens
acaaagcccaagggatctgg

SEQ ID NO: 3683428 - DNA, 23 bp, Homo sapiens
acaaagctaggatggttctgtga

SEQ ID NO: 3683429 - DNA, 16 bp, Homo sapiens
acaaaggcagctgtgt

SEQ ID NO: 3683430 - DNA, 12 bp, Homo sapiens
acaaatctcaga

SEQ ID NO: 3683431 - DNA, 16 bp, Homo sapiens
acaaatctcagaacct

SEQ ID NO: 3683432 - DNA, 16 bp, Homo sapiens
acaaatggaggcctgt

SEQ ID NO: 3683433 - DNA, 17 bp, Homo sapiens
acaaatgtaaacatttt

SEQ ID NO: 3683434 - DNA, 15 bp, Homo sapiens
acaaatttttcaaat

SEQ ID NO: 3683435 - DNA, 12 bp, Homo sapiens
acaacaggcatt

SEQ ID NO: 3683436 - DNA, 14 bp, Homo sapiens
acaacatgtataat

SEQ ID NO: 3683437 - DNA, 22 bp, Homo sapiens
acaacatgtataatatttttaa

SEQ ID NO: 3683438 - DNA, 16 bp, Homo sapiens
acaaccaatggaatgt

SEQ ID NO: 3683439 - DNA, 15 bp, Homo sapiens
acaaccactggtctg

SEQ ID NO: 3683440 - DNA, 22 bp, Homo sapiens
acaacggaggcctgcgaccctg

SEQ ID NO: 3683441 - DNA, 18 bp, Homo sapiens
acaactatgatttggaaa

SEQ ID NO: 3683442 - DNA, 11 bp, Homo sapiens
acaactgaaac

SEQ ID NO: 3683443 - DNA, 16 bp, Homo sapiens
acaactggcaggcagg

SEQ ID NO: 3683444 - DNA, 16 bp, Homo sapiens
acaacttgtatttcca

SEQ ID NO: 3683445 - DNA, 14 bp, Homo sapiens
acaagagcagcctg

SEQ ID NO: 3683446 - DNA, 15 bp, Homo sapiens
acaagagcagcctgt

SEQ ID NO: 3683447 - DNA, 19 bp, Homo sapiens
acaagagcagcctgtggca

SEQ ID NO: 3683448 - DNA, 21 bp, Homo sapiens
acaagctgcaccctcaggcag

SEQ ID NO: 3683449 - DNA, 16 bp, Homo sapiens
acaaggatagatgctg

SEQ ID NO: 3683450 - DNA, 20 bp, Homo sapiens
acaagtcctggatgttgtgt

SEQ ID NO: 3683451 - DNA, 18 bp, Homo sapiens
acaagtgccgcaaattgt

SEQ ID NO: 3683452 - DNA, 20 bp, Homo sapiens
acaagtgccgcaaattgtac

SEQ ID NO: 3683453 - DNA, 23 bp, Homo sapiens
acaagtgccgcaaattgtacctt

SEQ ID NO: 3683454 - DNA, 13 bp, Homo sapiens
acaagtggtggta

SEQ ID NO: 3683455 - DNA, 13 bp, Homo sapiens
acaataatatttc

SEQ ID NO: 3683456 - DNA, 15 bp, Homo sapiens
acaataatatttcaa

SEQ ID NO: 3683457 - DNA, 18 bp, Homo sapiens
acaataatatttcaagtg

SEQ ID NO: 3683458 - DNA, 22 bp, Homo sapiens
acaataatatttcaagtgccta

SEQ ID NO: 3683459 - DNA, 18 bp, Homo sapiens
acaatctaacaataatat

SEQ ID NO: 3683460 - DNA, 20 bp, Homo sapiens
acaatctcagctcactgtga

SEQ ID NO: 3683461 - DNA, 14 bp, Homo sapiens
acaatctgagcacg

SEQ ID NO: 3683462 - DNA, 15 bp, Homo sapiens
acaatggagtattct

SEQ ID NO: 3683463 - DNA, 22 bp, Homo sapiens
acaatggtgttatttgaaactt

SEQ ID NO: 3683464 - DNA, 14 bp, Homo sapiens
acaatgtgtattca

SEQ ID NO: 3683465 - DNA, 14 bp, Homo sapiens
acaattaatattaa

SEQ ID NO: 3683466 - DNA, 17 bp, Homo sapiens
acaattctgtttttaat

SEQ ID NO: 3683467 - DNA, 14 bp, Homo sapiens
acacaaaggcatgc

SEQ ID NO: 3683468 - DNA, 16 bp, Homo sapiens
acacaaaggcatgctg

SEQ ID NO: 3683469 - DNA, 18 bp, Homo sapiens
acacaaaggcatgctgga

SEQ ID NO: 3683470 - DNA, 19 bp, Homo sapiens
acacaaggatagatgctgg

SEQ ID NO: 3683471 - DNA, 22 bp, Homo sapiens
acacaatggtttttaaattttg

SEQ ID NO: 3683472 - DNA, 19 bp, Homo sapiens
acacacagatacacacaca

SEQ ID NO: 3683473 - DNA, 20 bp, Homo sapiens
acacacctgtagcacttact

SEQ ID NO: 3683474 - DNA, 15 bp, Homo sapiens
acacactgaggcagg

SEQ ID NO: 3683475 - DNA, 13 bp, Homo sapiens
acacaggccctcc

SEQ ID NO: 3683476 - DNA, 16 bp, Homo sapiens
acacaggccctccctg

SEQ ID NO: 3683477 - DNA, 12 bp, Homo sapiens
acacaggctggc

SEQ ID NO: 3683478 - DNA, 17 bp, Homo sapiens
acacatttcacttttct

SEQ ID NO: 3683479 - DNA, 16 bp, Homo sapiens
acaccagcattccttt

SEQ ID NO: 3683480 - DNA, 13 bp, Homo sapiens
acacccaaagctg

SEQ ID NO: 3683481 - DNA, 14 bp, Homo sapiens
acacccaaagctga

SEQ ID NO: 3683482 - DNA, 19 bp, Homo sapiens
acacccaaagctgagcctg

SEQ ID NO: 3683483 - DNA, 13 bp, Homo sapiens
acaccgccatcct

SEQ ID NO: 3683484 - DNA, 18 bp, Homo sapiens
acaccgccatcctctgcc

SEQ ID NO: 3683485 - DNA, 18 bp, Homo sapiens
acacctcagttcccttgg

SEQ ID NO: 3683486 - DNA, 19 bp, Homo sapiens
acacgtaaaagaaatgtat

SEQ ID NO: 3683487 - DNA, 17 bp, Homo sapiens
acacgtgacacaaacac

SEQ ID NO: 3683488 - DNA, 15 bp, Homo sapiens
acactaacctgggtt

SEQ ID NO: 3683489 - DNA, 20 bp, Homo sapiens
acactgttctgaaagtgact

SEQ ID NO: 3683490 - DNA, 20 bp, Homo sapiens
acacttctgtgagaccccca

SEQ ID NO: 3683491 - DNA, 11 bp, Homo sapiens
acacttgctga

SEQ ID NO: 3683492 - DNA, 21 bp, Homo sapiens
acacttgctgagtgaaggaaa

SEQ ID NO: 3683493 - DNA, 19 bp, Homo sapiens
acacttgttccagctcttt

SEQ ID NO: 3683494 - DNA, 12 bp, Homo sapiens
acagaacactgt

SEQ ID NO: 3683495 - DNA, 20 bp, Homo sapiens
acagaagaaggcagcaggtg

SEQ ID NO: 3683496 - DNA, 19 bp, Homo sapiens
acagaatcttccttttatt

SEQ ID NO: 3683497 - DNA, 10 bp, Homo sapiens
acagagctgg

SEQ ID NO: 3683498 - DNA, 14 bp, Homo sapiens
acagagctgggatg

SEQ ID NO: 3683499 - DNA, 18 bp, Homo sapiens
acagagctgggatgtttc

SEQ ID NO: 3683500 - DNA, 21 bp, Homo sapiens
acagagctgggatgtttctgt

SEQ ID NO: 3683501 - DNA, 16 bp, Homo sapiens
acagaggccccagcct

SEQ ID NO: 3683502 - DNA, 15 bp, Homo sapiens
acagaggcggggcta

SEQ ID NO: 3683503 - DNA, 14 bp, Homo sapiens
acagagtgaaaaat

SEQ ID NO: 3683504 - DNA, 12 bp, Homo sapiens
acagatctggaa

SEQ ID NO: 3683505 - DNA, 16 bp, Homo sapiens
acagatctggaacctc

SEQ ID NO: 3683506 - DNA, 21 bp, Homo sapiens
acagatctggaacctcagcct

SEQ ID NO: 3683507 - DNA, 16 bp, Homo sapiens
acagatgccccagagc

SEQ ID NO: 3683508 - DNA, 18 bp, Homo sapiens
acagatgccccagagctg

SEQ ID NO: 3683509 - DNA, 21 bp, Homo sapiens
acagatgccccagagctgttt

SEQ ID NO: 3683510 - DNA, 22 bp, Homo sapiens
acagattgggcggggcttctct

SEQ ID NO: 3683511 - DNA, 18 bp, Homo sapiens
acagcaaggtgtggaggc

SEQ ID NO: 3683512 - DNA, 20 bp, Homo sapiens
acagcaaggtgtggaggctc

SEQ ID NO: 3683513 - DNA, 21 bp, Homo sapiens
acagcacttcaaagaagctgt

SEQ ID NO: 3683514 - DNA, 13 bp, Homo sapiens
acagcatcagggt

SEQ ID NO: 3683515 - DNA, 16 bp, Homo sapiens
acagccactccccggc

SEQ ID NO: 3683516 - DNA, 16 bp, Homo sapiens
acagcccaaagaagga

SEQ ID NO: 3683517 - DNA, 17 bp, Homo sapiens
acagcccaaagaaggaa

SEQ ID NO: 3683518 - DNA, 14 bp, Homo sapiens
acagccccaccctg

SEQ ID NO: 3683519 - DNA, 15 bp, Homo sapiens
acagccccaccctgg

SEQ ID NO: 3683520 - DNA, 12 bp, Homo sapiens
acagccctgaga

SEQ ID NO: 3683521 - DNA, 21 bp, Homo sapiens
acagcctcttctgtcccaagt

SEQ ID NO: 3683522 - DNA, 23 bp, Homo sapiens
acagcctgtgtctttaaatgctg

SEQ ID NO: 3683523 - DNA, 18 bp, Homo sapiens
acagcggagtctgtcctg

SEQ ID NO: 3683524 - DNA, 17 bp, Homo sapiens
acagctatgggagcccc

SEQ ID NO: 3683525 - DNA, 21 bp, Homo sapiens
acagctatgggagccccaggg

SEQ ID NO: 3683526 - DNA, 22 bp, Homo sapiens
acagctgctcctagagggaggg

SEQ ID NO: 3683527 - DNA, 14 bp, Homo sapiens
acagctttgaggaa

SEQ ID NO: 3683528 - DNA, 11 bp, Homo sapiens
acagctttgct

SEQ ID NO: 3683529 - DNA, 21 bp, Homo sapiens
acagctttgctgctgaaggct

SEQ ID NO: 3683530 - DNA, 21 bp, Homo sapiens
acaggaggcaggcatggccct

SEQ ID NO: 3683531 - DNA, 19 bp, Homo sapiens
acaggatgtgtttgctttc

SEQ ID NO: 3683532 - DNA, 17 bp, Homo sapiens
acaggcagcacagagac

SEQ ID NO: 3683533 - DNA, 21 bp, Homo sapiens
acaggcatgggtgcaaggaaa

SEQ ID NO: 3683534 - DNA, 21 bp, Homo sapiens
acaggccctccctgttcccca

SEQ ID NO: 3683535 - DNA, 15 bp, Homo sapiens
acaggctcttagcag

SEQ ID NO: 3683536 - DNA, 19 bp, Homo sapiens
acaggctcttagcagcttc

SEQ ID NO: 3683537 - DNA, 14 bp, Homo sapiens
acagggtgggcctc

SEQ ID NO: 3683538 - DNA, 16 bp, Homo sapiens
acagggtgttggaaga

SEQ ID NO: 3683539 - DNA, 14 bp, Homo sapiens
acagggttgggccc

SEQ ID NO: 3683540 - DNA, 23 bp, Homo sapiens
acaggtcaatacagtacaggcag

SEQ ID NO: 3683541 - DNA, 12 bp, Homo sapiens
acagtacaggca

SEQ ID NO: 3683542 - DNA, 13 bp, Homo sapiens
acagtacaggcag

SEQ ID NO: 3683543 - DNA, 14 bp, Homo sapiens
acagtacaggcagc

SEQ ID NO: 3683544 - DNA, 20 bp, Homo sapiens
acagtacaggcagcacagag

SEQ ID NO: 3683545 - DNA, 23 bp, Homo sapiens
acagtagttagaattatatcact

SEQ ID NO: 3683546 - DNA, 15 bp, Homo sapiens
acagtcaacaagcct

SEQ ID NO: 3683547 - DNA, 16 bp, Homo sapiens
acagtctaaagaagag

SEQ ID NO: 3683548 - DNA, 17 bp, Homo sapiens
acagtgaaatgagcagc

SEQ ID NO: 3683549 - DNA, 14 bp, Homo sapiens
acagtgaagacaga

SEQ ID NO: 3683550 - DNA, 13 bp, Homo sapiens
acagtgctgtgtg

SEQ ID NO: 3683551 - DNA, 17 bp, Homo sapiens
acagtgctgttgaagat

SEQ ID NO: 3683552 - DNA, 14 bp, Homo sapiens
acagtgggagccag

SEQ ID NO: 3683553 - DNA, 19 bp, Homo sapiens
acagttacataattcactc

SEQ ID NO: 3683554 - DNA, 17 bp, Homo sapiens
acagttctttgggccag

SEQ ID NO: 3683555 - DNA, 20 bp, Homo sapiens
acagttctttgggccagaca

SEQ ID NO: 3683556 - DNA, 16 bp, Homo sapiens
acagttgaaaaacagc

SEQ ID NO: 3683557 - DNA, 20 bp, Homo sapiens
acagttttcctatgctttga

SEQ ID NO: 3683558 - DNA, 20 bp, Homo sapiens
acataatgggccactgaaat

SEQ ID NO: 3683559 - DNA, 18 bp, Homo sapiens
acataattcactctgagt

SEQ ID NO: 3683560 - DNA, 15 bp, Homo sapiens
acatacacaaatggg

SEQ ID NO: 3683561 - DNA, 19 bp, Homo sapiens
acatacagaattactgtaa

SEQ ID NO: 3683562 - DNA, 15 bp, Homo sapiens
acatacttgaagggc

SEQ ID NO: 3683563 - DNA, 13 bp, Homo sapiens
acatatttaactg

SEQ ID NO: 3683564 - DNA, 12 bp, Homo sapiens
acatatttaatg

SEQ ID NO: 3683565 - DNA, 15 bp, Homo sapiens
acatcattactataa

SEQ ID NO: 3683566 - DNA, 13 bp, Homo sapiens
accctcctgctga

SEQ ID NO: 3683567 - DNA, 16 bp, Homo sapiens
accctcctgctgagct

SEQ ID NO: 3683568 - DNA, 17 bp, Homo sapiens
accctcctgctgagctg

SEQ ID NO: 3683569 - DNA, 14 bp, Homo sapiens
accctcttagaaaa

SEQ ID NO: 3683570 - DNA, 13 bp, Homo sapiens
accctcttcatgg

SEQ ID NO: 3683571 - DNA, 17 bp, Homo sapiens
accctgaaggggccatg

SEQ ID NO: 3683572 - DNA, 23 bp, Homo sapiens
accctgatttaggagaagccagg

SEQ ID NO: 3683573 - DNA, 17 bp, Homo sapiens
accctgcccctcagaga

SEQ ID NO: 3683574 - DNA, 20 bp, Homo sapiens
accctgcctacgccaggaga

SEQ ID NO: 3683575 - DNA, 16 bp, Homo sapiens
accctgctgctggtgc

SEQ ID NO: 3683576 - DNA, 19 bp, Homo sapiens
accctgctgctggtgcaca

SEQ ID NO: 3683577 - DNA, 14 bp, Homo sapiens
accctgggccctgg

SEQ ID NO: 3683578 - DNA, 17 bp, Homo sapiens
accctgggccctgggct

SEQ ID NO: 3683579 - DNA, 17 bp, Homo sapiens
accctggtggttgctgt

SEQ ID NO: 3683580 - DNA, 18 bp, Homo sapiens
acccttaccccttagcct

SEQ ID NO: 3683581 - DNA, 13 bp, Homo sapiens
acccttggcctgt

SEQ ID NO: 3683582 - DNA, 17 bp, Homo sapiens
acccttggcctgtctca

SEQ ID NO: 3683583 - DNA, 19 bp, Homo sapiens
accctttcgctggctttcc

SEQ ID NO: 3683584 - DNA, 12 bp, Homo sapiens
accgaaacagcg

SEQ ID NO: 3683585 - DNA, 17 bp, Homo sapiens
accgaaacagcgctggg

SEQ ID NO: 3683586 - DNA, 14 bp, Homo sapiens
accgaggggccttt

SEQ ID NO: 3683587 - DNA, 16 bp, Homo sapiens
accgcaggaagctgct

SEQ ID NO: 3683588 - DNA, 17 bp, Homo sapiens
accgccaaggctggggg

SEQ ID NO: 3683589 - DNA, 20 bp, Homo sapiens
acctaatccaggcagatcca

SEQ ID NO: 3683590 - DNA, 22 bp, Homo sapiens
acctaatccaggcagatccagg

SEQ ID NO: 3683591 - DNA, 17 bp, Homo sapiens
acctacctgttgagcat

SEQ ID NO: 3683592 - DNA, 24 bp, Homo sapiens
acctacctgttgagcatcacagaa

SEQ ID NO: 3683593 - DNA, 23 bp, Homo sapiens
acctatttcttaaacacttgcaa

SEQ ID NO: 3683594 - DNA, 17 bp, Homo sapiens
acctcacgcacctccca

SEQ ID NO: 3683595 - DNA, 19 bp, Homo sapiens
acctcagcctggccagaca

SEQ ID NO: 3683596 - DNA, 21 bp, Homo sapiens
acctcagcctggccagacaca

SEQ ID NO: 3683597 - DNA, 18 bp, Homo sapiens
acctcagttcccttggcc

SEQ ID NO: 3683598 - DNA, 21 bp, Homo sapiens
acctcagttcccttggcctca

SEQ ID NO: 3683599 - DNA, 21 bp, Homo sapiens
acctcatggagtcatcttgca

SEQ ID NO: 3683600 - DNA, 13 bp, Homo sapiens
acctcattctgaa

SEQ ID NO: 3683601 - DNA, 12 bp, Homo sapiens
acctccacagct

SEQ ID NO: 3683602 - DNA, 13 bp, Homo sapiens
acctccacagctt

SEQ ID NO: 3683603 - DNA, 21 bp, Homo sapiens
acctccccagcattccagccc

SEQ ID NO: 3683604 - DNA, 13 bp, Homo sapiens
acctcctgctggg

SEQ ID NO: 3683605 - DNA, 14 bp, Homo sapiens
acctcctgctgggc

SEQ ID NO: 3683606 - DNA, 13 bp, Homo sapiens
acctcctgctgtg

SEQ ID NO: 3683607 - DNA, 17 bp, Homo sapiens
acctcggtgccttcctc

SEQ ID NO: 3683608 - DNA, 15 bp, Homo sapiens
acctcgttctgctca

SEQ ID NO: 3683609 - DNA, 14 bp, Homo sapiens
acctctacaggcat

SEQ ID NO: 3683610 - DNA, 12 bp, Homo sapiens
acctctgcacaa

SEQ ID NO: 3683611 - DNA, 16 bp, Homo sapiens
acctctgcacaagctg

SEQ ID NO: 3683612 - DNA, 14 bp, Homo sapiens
acctctggactggc

SEQ ID NO: 3683613 - DNA, 22 bp, Homo sapiens
acctcttccccagaaaggagac

SEQ ID NO: 3683614 - DNA, 21 bp, Homo sapiens
acctgaagtttttttgctgct

SEQ ID NO: 3683615 - DNA, 18 bp, Homo sapiens
acctgaccaggggcccta

SEQ ID NO: 3683616 - DNA, 12 bp, Homo sapiens
acctgcactcca

SEQ ID NO: 3683617 - DNA, 15 bp, Homo sapiens
acctgcactccatcc

SEQ ID NO: 3683618 - DNA, 21 bp, Homo sapiens
acctgccagcggtttcctggt

SEQ ID NO: 3683619 - DNA, 17 bp, Homo sapiens
acctggaccccagcctt

SEQ ID NO: 3683620 - DNA, 14 bp, Homo sapiens
acctggcagctctg

SEQ ID NO: 3683621 - DNA, 21 bp, Homo sapiens
acctggcatcgcaccattctg

SEQ ID NO: 3683622 - DNA, 20 bp, Homo sapiens
acctggggaaagcctgaagg

SEQ ID NO: 3683623 - DNA, 21 bp, Homo sapiens
acctgggtaactagggaagat

SEQ ID NO: 3683624 - DNA, 15 bp, Homo sapiens
acctggttcatattt

SEQ ID NO: 3683625 - DNA, 16 bp, Homo sapiens
acctgtaatcccagca

SEQ ID NO: 3683626 - DNA, 19 bp, Homo sapiens
acctgtaatcccagcactt

SEQ ID NO: 3683627 - DNA, 20 bp, Homo sapiens
acctgtatatttgtaaagct

SEQ ID NO: 3683628 - DNA, 21 bp, Homo sapiens
acctgtatatttgtaaagcta

SEQ ID NO: 3683629 - DNA, 13 bp, Homo sapiens
acctgtctcacca

SEQ ID NO: 3683630 - DNA, 21 bp, Homo sapiens
acctgttgagcatcacagaat

SEQ ID NO: 3683631 - DNA, 13 bp, Homo sapiens
accttactaatta

SEQ ID NO: 3683632 - DNA, 13 bp, Homo sapiens
accttaggcaggg

SEQ ID NO: 3683633 - DNA, 20 bp, Homo sapiens
accttcattctgagaccaaa

SEQ ID NO: 3683634 - DNA, 12 bp, Homo sapiens
accttctgcctt

SEQ ID NO: 3683635 - DNA, 18 bp, Homo sapiens
accttggacatcctcctc

SEQ ID NO: 3683636 - DNA, 17 bp, Homo sapiens
accttggcaccagacac

SEQ ID NO: 3683637 - DNA, 22 bp, Homo sapiens
accttggcaccagacacccagg

SEQ ID NO: 3683638 - DNA, 12 bp, Homo sapiens
accttgtgcctg

SEQ ID NO: 3683639 - DNA, 16 bp, Homo sapiens
accttgtgcctggggt

SEQ ID NO: 3683640 - DNA, 21 bp, Homo sapiens
acctttaagaattttaaatat

SEQ ID NO: 3683641 - DNA, 18 bp, Homo sapiens
accttttttcaacagtga

SEQ ID NO: 3683642 - DNA, 20 bp, Homo sapiens
accttttttgttttttcaaa

SEQ ID NO: 3683643 - DNA, 18 bp, Homo sapiens
acgaggggtgtcttgggc

SEQ ID NO: 3683644 - DNA, 20 bp, Homo sapiens
acgaggggtgtcttgggcag

SEQ ID NO: 3683645 - DNA, 19 bp, Homo sapiens
acgcacctcccatcctaat

SEQ ID NO: 3683646 - DNA, 15 bp, Homo sapiens
acgcagaactaccag

SEQ ID NO: 3683647 - DNA, 19 bp, Homo sapiens
acgccaggagaagttgagg

SEQ ID NO: 3683648 - DNA, 18 bp, Homo sapiens
acgccaggggaaaatcag

SEQ ID NO: 3683649 - DNA, 16 bp, Homo sapiens
acgcccccccccaccc

SEQ ID NO: 3683650 - DNA, 20 bp, Homo sapiens
acgcccgtcctgcctgtggc

SEQ ID NO: 3683651 - DNA, 13 bp, Homo sapiens
acgcctgtgccac

SEQ ID NO: 3683652 - DNA, 22 bp, Homo sapiens
acgcctgtgccaccccttcctc

SEQ ID NO: 3683653 - DNA, 12 bp, Homo sapiens
acgcgtatttac

SEQ ID NO: 3683654 - DNA, 18 bp, Homo sapiens
acgctactataaagagaa

SEQ ID NO: 3683655 - DNA, 12 bp, Homo sapiens
acgctcctctgt

SEQ ID NO: 3683656 - DNA, 16 bp, Homo sapiens
acgctcctctgtttgt

SEQ ID NO: 3683657 - DNA, 23 bp, Homo sapiens
acgctgtccctagtaaaaataca

SEQ ID NO: 3683658 - DNA, 13 bp, Homo sapiens
acggagagcgcct

SEQ ID NO: 3683659 - DNA, 21 bp, Homo sapiens
acggaggcctgcgaccctggg

SEQ ID NO: 3683660 - DNA, 21 bp, Homo sapiens
acggcaggacaacgaggaagc

SEQ ID NO: 3683661 - DNA, 16 bp, Homo sapiens
acggccaccactgcag

SEQ ID NO: 3683662 - DNA, 18 bp, Homo sapiens
acggccagggagaagctc

SEQ ID NO: 3683663 - DNA, 15 bp, Homo sapiens
acggcctgatgctcc

SEQ ID NO: 3683664 - DNA, 19 bp, Homo sapiens
acggcctgatgctccctcc

SEQ ID NO: 3683665 - DNA, 20 bp, Homo sapiens
acggcctgatgctccctccc

SEQ ID NO: 3683666 - DNA, 22 bp, Homo sapiens
acggcctgatgctccctcccct

SEQ ID NO: 3683667 - DNA, 17 bp, Homo sapiens
acggcttcctcattcct

SEQ ID NO: 3683668 - DNA, 21 bp, Homo sapiens
acggggcagtactcctccctg

SEQ ID NO: 3683669 - DNA, 19 bp, Homo sapiens
acggggcgggccctgcctg

SEQ ID NO: 3683670 - DNA, 23 bp, Homo sapiens
acgggggctgtggctctgggtgg

SEQ ID NO: 3683671 - DNA, 17 bp, Homo sapiens
acggtgttttgccatgt

SEQ ID NO: 3683672 - DNA, 20 bp, Homo sapiens
acgtgacacaaacacacaca

SEQ ID NO: 3683673 - DNA, 16 bp, Homo sapiens
acgtggcctcttgagc

SEQ ID NO: 3683674 - DNA, 11 bp, Homo sapiens
acgtgtttaaa

SEQ ID NO: 3683675 - DNA, 12 bp, Homo sapiens
actaaaagatcg

SEQ ID NO: 3683676 - DNA, 18 bp, Homo sapiens
actaaacacgtgacacaa

SEQ ID NO: 3683677 - DNA, 15 bp, Homo sapiens
actaacaaaggcagc

SEQ ID NO: 3683678 - DNA, 16 bp, Homo sapiens
actaacaaaggcagct

SEQ ID NO: 3683679 - DNA, 19 bp, Homo sapiens
actaacaaaggcagctgtg

SEQ ID NO: 3683680 - DNA, 15 bp, Homo sapiens
actaactatgcatgg

SEQ ID NO: 3683681 - DNA, 12 bp, Homo sapiens
actaagcagagg

SEQ ID NO: 3683682 - DNA, 22 bp, Homo sapiens
actaagcagaggaggggccgct

SEQ ID NO: 3683683 - DNA, 19 bp, Homo sapiens
actgtagcttttaggaata

SEQ ID NO: 3683684 - DNA, 13 bp, Homo sapiens
actgtagggaggg

SEQ ID NO: 3683685 - DNA, 12 bp, Homo sapiens
actgtcttcagt

SEQ ID NO: 3683686 - DNA, 17 bp, Homo sapiens
actgtctttaaaagaga

SEQ ID NO: 3683687 - DNA, 19 bp, Homo sapiens
actgtgaaaattgaccaag

SEQ ID NO: 3683688 - DNA, 21 bp, Homo sapiens
actgtgaaataccacaagcct

SEQ ID NO: 3683689 - DNA, 23 bp, Homo sapiens
actgttacaacttgtatttccaa

SEQ ID NO: 3683690 - DNA, 13 bp, Homo sapiens
actgttactttgg

SEQ ID NO: 3683691 - DNA, 17 bp, Homo sapiens
actgttactttggcaat

SEQ ID NO: 3683692 - DNA, 21 bp, Homo sapiens
actgttactttggcaatttcc

SEQ ID NO: 3683693 - DNA, 15 bp, Homo sapiens
actgttatttaattg

SEQ ID NO: 3683694 - DNA, 15 bp, Homo sapiens
actgttcttggtaac

SEQ ID NO: 3683695 - DNA, 19 bp, Homo sapiens
actgttgcccttctgtcca

SEQ ID NO: 3683696 - DNA, 23 bp, Homo sapiens
actgtttttcagggaggtggctg

SEQ ID NO: 3683697 - DNA, 20 bp, Homo sapiens
acttaagcaaaagaaaaaga

SEQ ID NO: 3683698 - DNA, 18 bp, Homo sapiens
acttagaacctttctgtg

SEQ ID NO: 3683699 - DNA, 18 bp, Homo sapiens
acttagggaagaaaaagc

SEQ ID NO: 3683700 - DNA, 14 bp, Homo sapiens
acttcaaagaagct

SEQ ID NO: 3683701 - DNA, 23 bp, Homo sapiens
acttcaaagaagctgtcttggaa

SEQ ID NO: 3683702 - DNA, 16 bp, Homo sapiens
acttcagctgactttt

SEQ ID NO: 3683703 - DNA, 14 bp, Homo sapiens
acttcattttcaga

SEQ ID NO: 3683704 - DNA, 19 bp, Homo sapiens
acttcattttcagagtgac

SEQ ID NO: 3683705 - DNA, 14 bp, Homo sapiens
acttcccaccctgc

SEQ ID NO: 3683706 - DNA, 20 bp, Homo sapiens
acttcccctctaactggaca

SEQ ID NO: 3683707 - DNA, 19 bp, Homo sapiens
acttctacccagatggaaa

SEQ ID NO: 3683708 - DNA, 19 bp, Homo sapiens
acttctgaaataaatgttc

SEQ ID NO: 3683709 - DNA, 19 bp, Homo sapiens
acttctgtgagacccccac

SEQ ID NO: 3683710 - DNA, 11 bp, Homo sapiens
acttcttcttc

SEQ ID NO: 3683711 - DNA, 15 bp, Homo sapiens
acttcttcttctttg

SEQ ID NO: 3683712 - DNA, 13 bp, Homo sapiens
acttcttgaaggt

SEQ ID NO: 3683713 - DNA, 20 bp, Homo sapiens
acttgaaatatcctgcttga

SEQ ID NO: 3683714 - DNA, 21 bp, Homo sapiens
acttgaagggccagagccagg

SEQ ID NO: 3683715 - DNA, 22 bp, Homo sapiens
acttgaatttggtctgtatagt

SEQ ID NO: 3683716 - DNA, 20 bp, Homo sapiens
acttgacagaacactgtctt

SEQ ID NO: 3683717 - DNA, 20 bp, Homo sapiens
acttgctcaggtacttgtaa

SEQ ID NO: 3683718 - DNA, 21 bp, Homo sapiens
acttgcttatcaacttcctaa

SEQ ID NO: 3683719 - DNA, 16 bp, Homo sapiens
acttgcttatttgaca

SEQ ID NO: 3683720 - DNA, 23 bp, Homo sapiens
acttggctttttccaaatgcttc

SEQ ID NO: 3683721 - DNA, 23 bp, Homo sapiens
acttggggggctgaggtgggagg

SEQ ID NO: 3683722 - DNA, 16 bp, Homo sapiens
acttggtcagagccac

SEQ ID NO: 3683723 - DNA, 20 bp, Homo sapiens
acttgtaaatgtggtaaaga

SEQ ID NO: 3683724 - DNA, 22 bp, Homo sapiens
acttgtatttccaaacctggtt

SEQ ID NO: 3683725 - DNA, 22 bp, Homo sapiens
acttgtcatagactcctttgct

SEQ ID NO: 3683726 - DNA, 19 bp, Homo sapiens
acttgtctcaggactctga

SEQ ID NO: 3683727 - DNA, 14 bp, Homo sapiens
actttatcaattaa

SEQ ID NO: 3683728 - DNA, 21 bp, Homo sapiens
actttcctcttagtcgagcca

SEQ ID NO: 3683729 - DNA, 16 bp, Homo sapiens
actttcttattctgta

SEQ ID NO: 3683730 - DNA, 14 bp, Homo sapiens
actttgattctgat

SEQ ID NO: 3683731 - DNA, 20 bp, Homo sapiens
actttgcaatccaaataaag

SEQ ID NO: 3683732 - DNA, 23 bp, Homo sapiens
actttgcagccggcacagggtct

SEQ ID NO: 3683733 - DNA, 19 bp, Homo sapiens
actttggcaatttcctggc

SEQ ID NO: 3683734 - DNA, 13 bp, Homo sapiens
actttgtaaatag

SEQ ID NO: 3683735 - DNA, 13 bp, Homo sapiens
actttgtaaattc

SEQ ID NO: 3683736 - DNA, 20 bp, Homo sapiens
actttgttaggattttcaca

SEQ ID NO: 3683737 - DNA, 20 bp, Homo sapiens
actttgtttcgtggggaggt

SEQ ID NO: 3683738 - DNA, 13 bp, Homo sapiens
acttttaattagt

SEQ ID NO: 3683739 - DNA, 18 bp, Homo sapiens
agaaaaaaaatagacttt

SEQ ID NO: 3683740 - DNA, 19 bp, Homo sapiens
agaaaaaatattttcccta

SEQ ID NO: 3683741 - DNA, 21 bp, Homo sapiens
agaaaaatgagcatacatctt

SEQ ID NO: 3683742 - DNA, 17 bp, Homo sapiens
agaaaaatgagcctggc

SEQ ID NO: 3683743 - DNA, 12 bp, Homo sapiens
agaaaacagaaa

SEQ ID NO: 3683744 - DNA, 16 bp, Homo sapiens
agaaaacagaaaacaa

SEQ ID NO: 3683745 - DNA, 19 bp, Homo sapiens
agaaacacactgaggcagg

SEQ ID NO: 3683746 - DNA, 16 bp, Homo sapiens
agaaacctactgccca

SEQ ID NO: 3683747 - DNA, 18 bp, Homo sapiens
agaaagacagagctggga

SEQ ID NO: 3683748 - DNA, 12 bp, Homo sapiens
agaaagatgtat

SEQ ID NO: 3683749 - DNA, 11 bp, Homo sapiens
agaaaggagac

SEQ ID NO: 3683750 - DNA, 14 bp, Homo sapiens
agaaaggggagccc

SEQ ID NO: 3683751 - DNA, 15 bp, Homo sapiens
agaaaggggagccca

SEQ ID NO: 3683752 - DNA, 16 bp, Homo sapiens
agaaaggggagcccac

SEQ ID NO: 3683753 - DNA, 20 bp, Homo sapiens
agaaaggtggactggaaggg

SEQ ID NO: 3683754 - DNA, 16 bp, Homo sapiens
agaaataagaaaatgg

SEQ ID NO: 3683755 - DNA, 23 bp, Homo sapiens
agaaatacaaaaatactcagata

SEQ ID NO: 3683756 - DNA, 17 bp, Homo sapiens
agaaatctggcttctgg

SEQ ID NO: 3683757 - DNA, 22 bp, Homo sapiens
agaaatgccaagcacttctttt

SEQ ID NO: 3683758 - DNA, 18 bp, Homo sapiens
agaacacggctcacgctt

SEQ ID NO: 3683759 - DNA, 18 bp, Homo sapiens
agaacatccctgccagct

SEQ ID NO: 3683760 - DNA, 20 bp, Homo sapiens
agaaccagtccccccaccct

SEQ ID NO: 3683761 - DNA, 22 bp, Homo sapiens
agaacctcacgcacctcccatc

SEQ ID NO: 3683762 - DNA, 13 bp, Homo sapiens
agaacctggaact

SEQ ID NO: 3683763 - DNA, 21 bp, Homo sapiens
agaacctgggttgcagacagg

SEQ ID NO: 3683764 - DNA, 15 bp, Homo sapiens
agaaccttgtcccag

SEQ ID NO: 3683765 - DNA, 22 bp, Homo sapiens
agaaccttgtcccagccagtga

SEQ ID NO: 3683766 - DNA, 23 bp, Homo sapiens
agaaccttgtcccagccagtgag

SEQ ID NO: 3683767 - DNA, 14 bp, Homo sapiens
agaacctttctgtg

SEQ ID NO: 3683768 - DNA, 16 bp, Homo sapiens
agaacgttttttcctc

SEQ ID NO: 3683769 - DNA, 20 bp, Homo sapiens
agaactcaaatggggccaga

SEQ ID NO: 3683770 - DNA, 16 bp, Homo sapiens
agaactccaggccctc

SEQ ID NO: 3683771 - DNA, 13 bp, Homo sapiens
agaactcctacct

SEQ ID NO: 3683772 - DNA, 19 bp, Homo sapiens
agaactcctacctgaaggc

SEQ ID NO: 3683773 - DNA, 20 bp, Homo sapiens
agaactcctacctgaaggca

SEQ ID NO: 3683774 - DNA, 14 bp, Homo sapiens
agaactcctagggt

SEQ ID NO: 3683775 - DNA, 19 bp, Homo sapiens
agaactgaattttgggact

SEQ ID NO: 3683776 - DNA, 12 bp, Homo sapiens
agaactgcaggc

SEQ ID NO: 3683777 - DNA, 13 bp, Homo sapiens
agaactgctgttt

SEQ ID NO: 3683778 - DNA, 22 bp, Homo sapiens
agaactgtcatgtaaacatacc

SEQ ID NO: 3683779 - DNA, 19 bp, Homo sapiens
agaagaaattaaggaacat

SEQ ID NO: 3683780 - DNA, 14 bp, Homo sapiens
agaagaaggcagca

SEQ ID NO: 3683781 - DNA, 21 bp, Homo sapiens
agaagaaggcagcaggtggca

SEQ ID NO: 3683782 - DNA, 21 bp, Homo sapiens
agaagagattgtggtttcatt

SEQ ID NO: 3683783 - DNA, 15 bp, Homo sapiens
agaagcaagaaagaa

SEQ ID NO: 3683784 - DNA, 15 bp, Homo sapiens
agaagcaccagcaat

SEQ ID NO: 3683785 - DNA, 12 bp, Homo sapiens
agaagccaggaa

SEQ ID NO: 3683786 - DNA, 20 bp, Homo sapiens
agaagccatgtactcaagta

SEQ ID NO: 3683787 - DNA, 14 bp, Homo sapiens
agaagcccccagct

SEQ ID NO: 3683788 - DNA, 12 bp, Homo sapiens
agaagcctctgg

SEQ ID NO: 3683789 - DNA, 20 bp, Homo sapiens
agaagctataaattcctctt

SEQ ID NO: 3683790 - DNA, 21 bp, Homo sapiens
agaagctataaattcctcttt

SEQ ID NO: 3683791 - DNA, 17 bp, Homo sapiens
agaagctcctctcccca

SEQ ID NO: 3683792 - DNA, 15 bp, Homo sapiens
agaagctgagcacca

SEQ ID NO: 3683793 - DNA, 16 bp, Homo sapiens
agaaggaaaaggcagg

SEQ ID NO: 3683794 - DNA, 17 bp, Homo sapiens
agaaggccaagaggctg

SEQ ID NO: 3683795 - DNA, 19 bp, Homo sapiens
agaagggccagtcctgcct

SEQ ID NO: 3683796 - DNA, 20 bp, Homo sapiens
agaagggccagtcctgcctg

SEQ ID NO: 3683797 - DNA, 20 bp, Homo sapiens
agaagtggggacagagcaga

SEQ ID NO: 3683798 - DNA, 17 bp, Homo sapiens
agaatgcatctcatcaa

SEQ ID NO: 3683799 - DNA, 22 bp, Homo sapiens
agataatattaaggaagacaat

SEQ ID NO: 3683800 - DNA, 16 bp, Homo sapiens
agatacatacagaatt

SEQ ID NO: 3683801 - DNA, 22 bp, Homo sapiens
agatacttggggggctgaggtg

SEQ ID NO: 3683802 - DNA, 17 bp, Homo sapiens
agatagaagcctctcgt

SEQ ID NO: 3683803 - DNA, 17 bp, Homo sapiens
agatatcagtgtctccc

SEQ ID NO: 3683804 - DNA, 16 bp, Homo sapiens
agatatcgacttgttt

SEQ ID NO: 3683805 - DNA, 17 bp, Homo sapiens
agatattggacaaagaa

SEQ ID NO: 3683806 - DNA, 19 bp, Homo sapiens
agatcattctccttgtaaa

SEQ ID NO: 3683807 - DNA, 21 bp, Homo sapiens
agatccaaaagaagcccccag

SEQ ID NO: 3683808 - DNA, 23 bp, Homo sapiens
agatccaaaagaagcccccagct

SEQ ID NO: 3683809 - DNA, 14 bp, Homo sapiens
agatccagcctggg

SEQ ID NO: 3683810 - DNA, 19 bp, Homo sapiens
agatccagggacagaggcc

SEQ ID NO: 3683811 - DNA, 16 bp, Homo sapiens
agatccagtgtaaact

SEQ ID NO: 3683812 - DNA, 17 bp, Homo sapiens
agatcctgcgggtgggg

SEQ ID NO: 3683813 - DNA, 18 bp, Homo sapiens
agatcctgcgggtggggc

SEQ ID NO: 3683814 - DNA, 12 bp, Homo sapiens
agatctccagcg

SEQ ID NO: 3683815 - DNA, 16 bp, Homo sapiens
agatctcggtttgcca

SEQ ID NO: 3683816 - DNA, 22 bp, Homo sapiens
agatctcggtttgccaaaattc

SEQ ID NO: 3683817 - DNA, 23 bp, Homo sapiens
agatctctgctttggaaatcaca

SEQ ID NO: 3683818 - DNA, 13 bp, Homo sapiens
agatctggaacct

SEQ ID NO: 3683819 - DNA, 17 bp, Homo sapiens
agatctggaacctcagc

SEQ ID NO: 3683820 - DNA, 14 bp, Homo sapiens
agatctgtgcccca

SEQ ID NO: 3683821 - DNA, 14 bp, Homo sapiens
agatgcaaagaggc

SEQ ID NO: 3683822 - DNA, 17 bp, Homo sapiens
agatgcaaagaggcaag

SEQ ID NO: 3683823 - DNA, 20 bp, Homo sapiens
agatgcaaggaccaggactc

SEQ ID NO: 3683824 - DNA, 18 bp, Homo sapiens
agatgcaccaccaagcca

SEQ ID NO: 3683825 - DNA, 19 bp, Homo sapiens
agatgctggcttgggcagc

SEQ ID NO: 3683826 - DNA, 15 bp, Homo sapiens
agatgctggttttct

SEQ ID NO: 3683827 - DNA, 16 bp, Homo sapiens
agatgctgtgtatatg

SEQ ID NO: 3683828 - DNA, 15 bp, Homo sapiens
agatgcttctcactg

SEQ ID NO: 3683829 - DNA, 14 bp, Homo sapiens
agatggctcctctc

SEQ ID NO: 3683830 - DNA, 17 bp, Homo sapiens
agatgtaaattgaagaa

SEQ ID NO: 3683831 - DNA, 18 bp, Homo sapiens
agatgtaaattgaagaag

SEQ ID NO: 3683832 - DNA, 17 bp, Homo sapiens
agattcaagtagttttg

SEQ ID NO: 3683833 - DNA, 17 bp, Homo sapiens
agattccattttggaaa

SEQ ID NO: 3683834 - DNA, 23 bp, Homo sapiens
agattcttcagtctggactatat

SEQ ID NO: 3683835 - DNA, 13 bp, Homo sapiens
agattgagaagcc

SEQ ID NO: 3683836 - DNA, 14 bp, Homo sapiens
agattgagaagcca

SEQ ID NO: 3683837 - DNA, 15 bp, Homo sapiens
agattgagaagccat

SEQ ID NO: 3683838 - DNA, 17 bp, Homo sapiens
agattgagaagccatgt

SEQ ID NO: 3683839 - DNA, 18 bp, Homo sapiens
agattgggcggggcttct

SEQ ID NO: 3683840 - DNA, 15 bp, Homo sapiens
agattttgtatattt

SEQ ID NO: 3683841 - DNA, 19 bp, Homo sapiens
agatttttaaaaaatattt

SEQ ID NO: 3683842 - DNA, 21 bp, Homo sapiens
agatttttaaaaaatattttc

SEQ ID NO: 3683843 - DNA, 16 bp, Homo sapiens
agattttttcagactt

SEQ ID NO: 3683844 - DNA, 22 bp, Homo sapiens
agcaaaaaagtccaattttaat

SEQ ID NO: 3683845 - DNA, 13 bp, Homo sapiens
agcaaaagaaaaa

SEQ ID NO: 3683846 - DNA, 18 bp, Homo sapiens
agcaaaagatgcttctca

SEQ ID NO: 3683847 - DNA, 16 bp, Homo sapiens
agcaaaaggctgagaa

SEQ ID NO: 3683848 - DNA, 20 bp, Homo sapiens
agcaaagcaaaaggctgaga

SEQ ID NO: 3683849 - DNA, 23 bp, Homo sapiens
agcaaaggagtagaaagacagag

SEQ ID NO: 3683850 - DNA, 11 bp, Homo sapiens
agcaaatcacc

SEQ ID NO: 3683851 - DNA, 21 bp, Homo sapiens
agcaaatcaccacaaactgta

SEQ ID NO: 3683852 - DNA, 19 bp, Homo sapiens
agcaaattctgtttttcta

SEQ ID NO: 3683853 - DNA, 15 bp, Homo sapiens
agcaaattttcagca

SEQ ID NO: 3683854 - DNA, 12 bp, Homo sapiens
agcaagaaagaa

SEQ ID NO: 3683855 - DNA, 19 bp, Homo sapiens
agcaagggaccttcatgcc

SEQ ID NO: 3683856 - DNA, 23 bp, Homo sapiens
agcaagggaccttcatgcccttc

SEQ ID NO: 3683857 - DNA, 17 bp, Homo sapiens
agcaaggtgtggaggct

SEQ ID NO: 3683858 - DNA, 19 bp, Homo sapiens
agcaaggtgtggaggctcc

SEQ ID NO: 3683859 - DNA, 24 bp, Homo sapiens
agcaaggtgtggaggctcctgtgg

SEQ ID NO: 3683860 - DNA, 20 bp, Homo sapiens
agcaagtgagaccctgtctc

SEQ ID NO: 3683861 - DNA, 21 bp, Homo sapiens
agcaagtgaggccggagagga

SEQ ID NO: 3683862 - DNA, 16 bp, Homo sapiens
agcaattctctttctt

SEQ ID NO: 3683863 - DNA, 14 bp, Homo sapiens
agcacagcttgacc

SEQ ID NO: 3683864 - DNA, 23 bp, Homo sapiens
agcaccaccctagtcccttcccc

SEQ ID NO: 3683865 - DNA, 22 bp, Homo sapiens
agcaccagcaattctctttctt

SEQ ID NO: 3683866 - DNA, 14 bp, Homo sapiens
agcaccgaggggcc

SEQ ID NO: 3683867 - DNA, 16 bp, Homo sapiens
agcaccttgtgcctgg

SEQ ID NO: 3683868 - DNA, 17 bp, Homo sapiens
agcaccttgtgcctggg

SEQ ID NO: 3683869 - DNA, 18 bp, Homo sapiens
agcaccttgtgcctgggg

SEQ ID NO: 3683870 - DNA, 19 bp, Homo sapiens
agcaccttgtgcctggggt

SEQ ID NO: 3683871 - DNA, 14 bp, Homo sapiens
agcactgaaacatt

SEQ ID NO: 3683872 - DNA, 12 bp, Homo sapiens
agcactgtccct

SEQ ID NO: 3683873 - DNA, 16 bp, Homo sapiens
agcactgtcccttgcc

SEQ ID NO: 3683874 - DNA, 22 bp, Homo sapiens
agcactgtcccttgcctcaatg

SEQ ID NO: 3683875 - DNA, 13 bp, Homo sapiens
agcagaggaccag

SEQ ID NO: 3683876 - DNA, 16 bp, Homo sapiens
agcagaggaccagggc

SEQ ID NO: 3683877 - DNA, 19 bp, Homo sapiens
agcagaggaggggccgctg

SEQ ID NO: 3683878 - DNA, 17 bp, Homo sapiens
agcagatgcaaagaggc

SEQ ID NO: 3683879 - DNA, 20 bp, Homo sapiens
agcagatgcaaagaggcaag

SEQ ID NO: 3683880 - DNA, 16 bp, Homo sapiens
agcagcagggagggct

SEQ ID NO: 3683881 - DNA, 12 bp, Homo sapiens
agcagcccaccc

SEQ ID NO: 3683882 - DNA, 13 bp, Homo sapiens
agcagcccaccct

SEQ ID NO: 3683883 - DNA, 13 bp, Homo sapiens
agcagcctgtggc

SEQ ID NO: 3683884 - DNA, 14 bp, Homo sapiens
agcagcgcctttcc

SEQ ID NO: 3683885 - DNA, 16 bp, Homo sapiens
agcagctcaaaggcac

SEQ ID NO: 3683886 - DNA, 19 bp, Homo sapiens
agcagctcaaaggcacagt

SEQ ID NO: 3683887 - DNA, 18 bp, Homo sapiens
agcaggaaattcagccca

SEQ ID NO: 3683888 - DNA, 19 bp, Homo sapiens
agcagggattaacctctgc

SEQ ID NO: 3683889 - DNA, 21 bp, Homo sapiens
agcagggattaacctctgcac

SEQ ID NO: 3683890 - DNA, 22 bp, Homo sapiens
agcagggattaacctctgcact

SEQ ID NO: 3683891 - DNA, 18 bp, Homo sapiens
agcagggtcgggaaaggc

SEQ ID NO: 3683892 - DNA, 21 bp, Homo sapiens
agcagtaattaatatctcctg

SEQ ID NO: 3683893 - DNA, 23 bp, Homo sapiens
agcagtaattaatatctcctgga

SEQ ID NO: 3683894 - DNA, 16 bp, Homo sapiens
agcagtcgtgcctgtg

SEQ ID NO: 3683895 - DNA, 12 bp, Homo sapiens
agcagtggctgg

SEQ ID NO: 3683896 - DNA, 13 bp, Homo sapiens
agcagtggctggt

SEQ ID NO: 3683897 - DNA, 18 bp, Homo sapiens
agcagtggctggtccagg

SEQ ID NO: 3683898 - DNA, 19 bp, Homo sapiens
agcagtggctggtccaggg

SEQ ID NO: 3683899 - DNA, 22 bp, Homo sapiens
agcagtggctggtccagggcta

SEQ ID NO: 3683900 - DNA, 13 bp, Homo sapiens
agcataaaaacat

SEQ ID NO: 3683901 - DNA, 19 bp, Homo sapiens
agcataaaaattagccaag

SEQ ID NO: 3683902 - DNA, 17 bp, Homo sapiens
agcatcacttgggatta

SEQ ID NO: 3683903 - DNA, 19 bp, Homo sapiens
agcatgaataacatttaaa

SEQ ID NO: 3683904 - DNA, 21 bp, Homo sapiens
agcatgctgtgattgtgccta

SEQ ID NO: 3683905 - DNA, 16 bp, Homo sapiens
agcatgcttccctgca

SEQ ID NO: 3683906 - DNA, 20 bp, Homo sapiens
agcatgcttccctgcagctg

SEQ ID NO: 3683907 - DNA, 19 bp, Homo sapiens
agcattccagcccctctgg

SEQ ID NO: 3683908 - DNA, 20 bp, Homo sapiens
agcattccagcccctctggt

SEQ ID NO: 3683909 - DNA, 18 bp, Homo sapiens
agcattgtcttaattttt

SEQ ID NO: 3683910 - DNA, 16 bp, Homo sapiens
agccaagaaagatgta

SEQ ID NO: 3683911 - DNA, 17 bp, Homo sapiens
agccaagaaagatgtat

SEQ ID NO: 3683912 - DNA, 13 bp, Homo sapiens
agccaagcagcca

SEQ ID NO: 3683913 - DNA, 16 bp, Homo sapiens
agccaagcagccaagc

SEQ ID NO: 3683914 - DNA, 15 bp, Homo sapiens
agccaagctccttgg

SEQ ID NO: 3683915 - DNA, 16 bp, Homo sapiens
agctatttatgggccc

SEQ ID NO: 3683916 - DNA, 22 bp, Homo sapiens
agctatttatgggcccctggca

SEQ ID NO: 3683917 - DNA, 13 bp, Homo sapiens
agctcaaaggcac

SEQ ID NO: 3683918 - DNA, 17 bp, Homo sapiens
agctcaggacagatgcc

SEQ ID NO: 3683919 - DNA, 13 bp, Homo sapiens
agctccaacctgc

SEQ ID NO: 3683920 - DNA, 14 bp, Homo sapiens
agctccaacctgca

SEQ ID NO: 3683921 - DNA, 15 bp, Homo sapiens
agctccaacctgcaa

SEQ ID NO: 3683922 - DNA, 22 bp, Homo sapiens
agctccaacctgcaaagatctg

SEQ ID NO: 3683923 - DNA, 12 bp, Homo sapiens
agctccactctg

SEQ ID NO: 3683924 - DNA, 16 bp, Homo sapiens
agctcctcctccctgc

SEQ ID NO: 3683925 - DNA, 23 bp, Homo sapiens
agctcctcctccctgcatctgac

SEQ ID NO: 3683926 - DNA, 18 bp, Homo sapiens
agctcctctccccagccc

SEQ ID NO: 3683927 - DNA, 19 bp, Homo sapiens
agctcctctccccagccca

SEQ ID NO: 3683928 - DNA, 20 bp, Homo sapiens
agctcctctccccagcccag

SEQ ID NO: 3683929 - DNA, 19 bp, Homo sapiens
agctctcttcaatgacata

SEQ ID NO: 3683930 - DNA, 17 bp, Homo sapiens
agctctggacagcccca

SEQ ID NO: 3683931 - DNA, 18 bp, Homo sapiens
agctctggacagccccac

SEQ ID NO: 3683932 - DNA, 13 bp, Homo sapiens
agctctgtgggcc

SEQ ID NO: 3683933 - DNA, 14 bp, Homo sapiens
agctctgtgggccc

SEQ ID NO: 3683934 - DNA, 22 bp, Homo sapiens
agctctgtgggccctaccctcc

SEQ ID NO: 3683935 - DNA, 20 bp, Homo sapiens
agctcttctgccggccctgg

SEQ ID NO: 3683936 - DNA, 21 bp, Homo sapiens
agctcttctgccggccctggg

SEQ ID NO: 3683937 - DNA, 22 bp, Homo sapiens
agctgaagtagaggggacgtga

SEQ ID NO: 3683938 - DNA, 16 bp, Homo sapiens
agctgacattgccaaa

SEQ ID NO: 3683939 - DNA, 19 bp, Homo sapiens
agctgaccagccgtgagca

SEQ ID NO: 3683940 - DNA, 13 bp, Homo sapiens
agctgactgttct

SEQ ID NO: 3683941 - DNA, 14 bp, Homo sapiens
agctgagcctgcag

SEQ ID NO: 3683942 - DNA, 17 bp, Homo sapiens
agctgagcctgcaggga

SEQ ID NO: 3683943 - DNA, 17 bp, Homo sapiens
agctgcaccctcaggca

SEQ ID NO: 3683944 - DNA, 22 bp, Homo sapiens
agctgcaccctcaggcaggtgg

SEQ ID NO: 3683945 - DNA, 11 bp, Homo sapiens
agctgcactga

SEQ ID NO: 3683946 - DNA, 17 bp, Homo sapiens
agctgcactgatgctgc

SEQ ID NO: 3683947 - DNA, 19 bp, Homo sapiens
agctgcactgatgctgccc

SEQ ID NO: 3683948 - DNA, 21 bp, Homo sapiens
agctgcagttcttgtggaaga

SEQ ID NO: 3683949 - DNA, 15 bp, Homo sapiens
agctgcatctgtctg

SEQ ID NO: 3683950 - DNA, 23 bp, Homo sapiens
agctgcccagcccctcctccctg

SEQ ID NO: 3683951 - DNA, 13 bp, Homo sapiens
agctgcccctgct

SEQ ID NO: 3683952 - DNA, 14 bp, Homo sapiens
agctgcccctgctg

SEQ ID NO: 3683953 - DNA, 17 bp, Homo sapiens
agctgcccctgctgctt

SEQ ID NO: 3683954 - DNA, 14 bp, Homo sapiens
agctgcctccagcc

SEQ ID NO: 3683955 - DNA, 15 bp, Homo sapiens
agctgcctccagcct

SEQ ID NO: 3683956 - DNA, 17 bp, Homo sapiens
agctgcctccagcctgg

SEQ ID NO: 3683957 - DNA, 19 bp, Homo sapiens
agctgcctccagcctggtg

SEQ ID NO: 3683958 - DNA, 17 bp, Homo sapiens
agctgctcctagaggga

SEQ ID NO: 3683959 - DNA, 16 bp, Homo sapiens
agctggctgactaagc

SEQ ID NO: 3683960 - DNA, 18 bp, Homo sapiens
agctgggattacaggtgt

SEQ ID NO: 3683961 - DNA, 14 bp, Homo sapiens
agctgggcaggttg

SEQ ID NO: 3683962 - DNA, 11 bp, Homo sapiens
agctgggcccg

SEQ ID NO: 3683963 - DNA, 16 bp, Homo sapiens
agctgggcccgacatg

SEQ ID NO: 3683964 - DNA, 18 bp, Homo sapiens
agctgggccgggacccag

SEQ ID NO: 3683965 - DNA, 15 bp, Homo sapiens
agctggggatccctc

SEQ ID NO: 3683966 - DNA, 17 bp, Homo sapiens
agctgggggtgggccag

SEQ ID NO: 3683967 - DNA, 21 bp, Homo sapiens
agctggtggtatctgagttga

SEQ ID NO: 3683968 - DNA, 15 bp, Homo sapiens
agctgtcacaacttg

SEQ ID NO: 3683969 - DNA, 12 bp, Homo sapiens
agctgtgtctga

SEQ ID NO: 3683970 - DNA, 14 bp, Homo sapiens
agctgtgtctgagc

SEQ ID NO: 3683971 - DNA, 19 bp, Homo sapiens
agctgtgtctgagcccaac

SEQ ID NO: 3683972 - DNA, 14 bp, Homo sapiens
agctgttactgtct

SEQ ID NO: 3683973 - DNA, 18 bp, Homo sapiens
agctgttagttgctgttt

SEQ ID NO: 3683974 - DNA, 18 bp, Homo sapiens
agctgtttatggcctcag

SEQ ID NO: 3683975 - DNA, 15 bp, Homo sapiens
agcttagtgagcagt

SEQ ID NO: 3683976 - DNA, 16 bp, Homo sapiens
agcttatttttctgtg

SEQ ID NO: 3683977 - DNA, 12 bp, Homo sapiens
agcttctcctgt

SEQ ID NO: 3683978 - DNA, 16 bp, Homo sapiens
agcttctcctgtgtga

SEQ ID NO: 3683979 - DNA, 21 bp, Homo sapiens
agcttctcctgtgtgattgac

SEQ ID NO: 3683980 - DNA, 22 bp, Homo sapiens
agcttgaaagttttcagaacct

SEQ ID NO: 3683981 - DNA, 17 bp, Homo sapiens
agcttggaaaggaccag

SEQ ID NO: 3683982 - DNA, 20 bp, Homo sapiens
agctttcctgccccaggcct

SEQ ID NO: 3683983 - DNA, 21 bp, Homo sapiens
agctttcctgccccaggcctg

SEQ ID NO: 3683984 - DNA, 23 bp, Homo sapiens
agctttcctgccccaggcctgaa

SEQ ID NO: 3683985 - DNA, 12 bp, Homo sapiens
agctttcctggt

SEQ ID NO: 3683986 - DNA, 18 bp, Homo sapiens
agctttcctggtccctca

SEQ ID NO: 3683987 - DNA, 21 bp, Homo sapiens
agctttctaagagaagcaatt

SEQ ID NO: 3683988 - DNA, 13 bp, Homo sapiens
agctttgctgctg

SEQ ID NO: 3683989 - DNA, 22 bp, Homo sapiens
agctttgctgctgaaggctcat

SEQ ID NO: 3683990 - DNA, 17 bp, Homo sapiens
agctttggtctgtgtgt

SEQ ID NO: 3683991 - DNA, 22 bp, Homo sapiens
agctttgtttgttgtcagctga

SEQ ID NO: 3683992 - DNA, 20 bp, Homo sapiens
aggaaaataatacttatctt

SEQ ID NO: 3683993 - DNA, 21 bp, Homo sapiens
aggaaataagagcagtcacaa

SEQ ID NO: 3683994 - DNA, 21 bp, Homo sapiens
aggaacagctatgggagcccc

SEQ ID NO: 3683995 - DNA, 13 bp, Homo sapiens
aggaacatttttt

SEQ ID NO: 3683996 - DNA, 15 bp, Homo sapiens
aggaaccacaccaca

SEQ ID NO: 3683997 - DNA, 16 bp, Homo sapiens
aggaacggcttcctca

SEQ ID NO: 3683998 - DNA, 15 bp, Homo sapiens
aggaagccacagctg

SEQ ID NO: 3683999 - DNA, 20 bp, Homo sapiens
aggaagccgtgccctgcccc

SEQ ID NO: 3684000 - DNA, 15 bp, Homo sapiens
aggaaggagaggaga

SEQ ID NO: 3684001 - DNA, 15 bp, Homo sapiens
aggaaggctgagagg

SEQ ID NO: 3684002 - DNA, 22 bp, Homo sapiens
aggaaggcttgttgtgctttta

SEQ ID NO: 3684003 - DNA, 20 bp, Homo sapiens
aggaaggggtgctgtgaggc

SEQ ID NO: 3684004 - DNA, 20 bp, Homo sapiens
aggaatattttccaaagagt

SEQ ID NO: 3684005 - DNA, 19 bp, Homo sapiens
aggaatcccggctccagag

SEQ ID NO: 3684006 - DNA, 23 bp, Homo sapiens
aggaatcctagcacttgtctcag

SEQ ID NO: 3684007 - DNA, 16 bp, Homo sapiens
aggaatcggctgggga

SEQ ID NO: 3684008 - DNA, 17 bp, Homo sapiens
aggaatcggctggggac

SEQ ID NO: 3684009 - DNA, 16 bp, Homo sapiens
aggaatctttaaaaga

SEQ ID NO: 3684010 - DNA, 17 bp, Homo sapiens
aggaatttcccaggacc

SEQ ID NO: 3684011 - DNA, 18 bp, Homo sapiens
aggaatttcccaggaccc

SEQ ID NO: 3684012 - DNA, 19 bp, Homo sapiens
aggaatttcccaggaccct

SEQ ID NO: 3684013 - DNA, 20 bp, Homo sapiens
aggaatttcccaggaccctg

SEQ ID NO: 3684014 - DNA, 14 bp, Homo sapiens
aggacaacgaggaa

SEQ ID NO: 3684015 - DNA, 17 bp, Homo sapiens
aggacaacgaggaagcc

SEQ ID NO: 3684016 - DNA, 16 bp, Homo sapiens
aggacaatactggggt

SEQ ID NO: 3684017 - DNA, 13 bp, Homo sapiens
aggacagtctgga

SEQ ID NO: 3684018 - DNA, 14 bp, Homo sapiens
aggacagtctggag

SEQ ID NO: 3684019 - DNA, 13 bp, Homo sapiens
aggacataatggg

SEQ ID NO: 3684020 - DNA, 15 bp, Homo sapiens
aggacataatggggt

SEQ ID NO: 3684021 - DNA, 24 bp, Homo sapiens
aggacataatggggtcctggccat

SEQ ID NO: 3684022 - DNA, 14 bp, Homo sapiens
aggaccagctcagg

SEQ ID NO: 3684023 - DNA, 23 bp, Homo sapiens
aggaccagctcaggacagatgcc

SEQ ID NO: 3684024 - DNA, 18 bp, Homo sapiens
aggaccaggactccctcc

SEQ ID NO: 3684025 - DNA, 19 bp, Homo sapiens
aggaccaggactccctcct

SEQ ID NO: 3684026 - DNA, 18 bp, Homo sapiens
aggacccaccactggaag

SEQ ID NO: 3684027 - DNA, 19 bp, Homo sapiens
aggacccaccactggaagc

SEQ ID NO: 3684028 - DNA, 13 bp, Homo sapiens
aggacctcaggtg

SEQ ID NO: 3684029 - DNA, 14 bp, Homo sapiens
aggacctcaggtga

SEQ ID NO: 3684030 - DNA, 22 bp, Homo sapiens
aggacctttccaccacagccag

SEQ ID NO: 3684031 - DNA, 16 bp, Homo sapiens
aggactccctcctcac

SEQ ID NO: 3684032 - DNA, 16 bp, Homo sapiens
aggtaaaatgccatga

SEQ ID NO: 3684033 - DNA, 14 bp, Homo sapiens
aggtaccctgggtg

SEQ ID NO: 3684034 - DNA, 23 bp, Homo sapiens
aggtactcctgccagggaactgg

SEQ ID NO: 3684035 - DNA, 14 bp, Homo sapiens
aggtagctgcccct

SEQ ID NO: 3684036 - DNA, 12 bp, Homo sapiens
aggtaggaagag

SEQ ID NO: 3684037 - DNA, 17 bp, Homo sapiens
aggtaggcttctacctg

SEQ ID NO: 3684038 - DNA, 18 bp, Homo sapiens
aggtaggcttctacctgc

SEQ ID NO: 3684039 - DNA, 22 bp, Homo sapiens
aggtatgaccttctaggaagct

SEQ ID NO: 3684040 - DNA, 17 bp, Homo sapiens
aggtatgtctgtgccat

SEQ ID NO: 3684041 - DNA, 21 bp, Homo sapiens
aggtcaaggctgcagtgagcc

SEQ ID NO: 3684042 - DNA, 23 bp, Homo sapiens
aggtcaatacagtacaggcagca

SEQ ID NO: 3684043 - DNA, 15 bp, Homo sapiens
aggtcaggagttcga

SEQ ID NO: 3684044 - DNA, 18 bp, Homo sapiens
aggtccagccccccaggc

SEQ ID NO: 3684045 - DNA, 14 bp, Homo sapiens
aggtccagctctgg

SEQ ID NO: 3684046 - DNA, 17 bp, Homo sapiens
aggtcccacagccctga

SEQ ID NO: 3684047 - DNA, 19 bp, Homo sapiens
aggtcccacagccctgaga

SEQ ID NO: 3684048 - DNA, 20 bp, Homo sapiens
aggtcccacagccctgagat

SEQ ID NO: 3684049 - DNA, 14 bp, Homo sapiens
aggtcgaggcagga

SEQ ID NO: 3684050 - DNA, 12 bp, Homo sapiens
aggtcttgctgg

SEQ ID NO: 3684051 - DNA, 16 bp, Homo sapiens
aggtgaaagggagcta

SEQ ID NO: 3684052 - DNA, 13 bp, Homo sapiens
aggtgagaaaaaa

SEQ ID NO: 3684053 - DNA, 14 bp, Homo sapiens
aggtgagaaaaaaa

SEQ ID NO: 3684054 - DNA, 21 bp, Homo sapiens
aggtgagaagcagaggaagga

SEQ ID NO: 3684055 - DNA, 17 bp, Homo sapiens
aggtgattccagtgaag

SEQ ID NO: 3684056 - DNA, 16 bp, Homo sapiens
aggtgatttcagactg

SEQ ID NO: 3684057 - DNA, 13 bp, Homo sapiens
aggtgcatttctt

SEQ ID NO: 3684058 - DNA, 19 bp, Homo sapiens
aggtgcccttggaggccag

SEQ ID NO: 3684059 - DNA, 18 bp, Homo sapiens
aggtgcctttcaaattta

SEQ ID NO: 3684060 - DNA, 13 bp, Homo sapiens
aggtgcggggaga

SEQ ID NO: 3684061 - DNA, 17 bp, Homo sapiens
aggtgctcccctgacag

SEQ ID NO: 3684062 - DNA, 20 bp, Homo sapiens
aggtgctgacggccagggag

SEQ ID NO: 3684063 - DNA, 15 bp, Homo sapiens
aggtggctgagcccc

SEQ ID NO: 3684064 - DNA, 19 bp, Homo sapiens
aggtggctgagcccctgtc

SEQ ID NO: 3684065 - DNA, 13 bp, Homo sapiens
aggtggtgtttct

SEQ ID NO: 3684066 - DNA, 19 bp, Homo sapiens
aggtgtagccacaccagga

SEQ ID NO: 3684067 - DNA, 20 bp, Homo sapiens
aggtgtagccacaccaggat

SEQ ID NO: 3684068 - DNA, 21 bp, Homo sapiens
aggtgtgagccactgcaccca

SEQ ID NO: 3684069 - DNA, 17 bp, Homo sapiens
aggtgtgaggaggaggc

SEQ ID NO: 3684070 - DNA, 13 bp, Homo sapiens
aggtgtggaggct

SEQ ID NO: 3684071 - DNA, 16 bp, Homo sapiens
aggtgtgtgagactac

SEQ ID NO: 3684072 - DNA, 12 bp, Homo sapiens
aggtgttgccaa

SEQ ID NO: 3684073 - DNA, 15 bp, Homo sapiens
aggtgttggtgacaa

SEQ ID NO: 3684074 - DNA, 17 bp, Homo sapiens
aggttaaggctgaggaa

SEQ ID NO: 3684075 - DNA, 24 bp, Homo sapiens
aggttaaggctgaggaaaggccag

SEQ ID NO: 3684076 - DNA, 13 bp, Homo sapiens
aggttcagccaag

SEQ ID NO: 3684077 - DNA, 21 bp, Homo sapiens
aggttctccgttagctcctgt

SEQ ID NO: 3684078 - DNA, 14 bp, Homo sapiens
aggttggtgggggc

SEQ ID NO: 3684079 - DNA, 14 bp, Homo sapiens
aggtttaagctgtt

SEQ ID NO: 3684080 - DNA, 21 bp, Homo sapiens
aggtttaggctggtggcccag

SEQ ID NO: 3684081 - DNA, 14 bp, Homo sapiens
aggtttctgaaaat

SEQ ID NO: 3684082 - DNA, 12 bp, Homo sapiens
agtaaaaataaa

SEQ ID NO: 3684083 - DNA, 15 bp, Homo sapiens
agtaaaaataaaatt

SEQ ID NO: 3684084 - DNA, 12 bp, Homo sapiens
agtaaaaataca

SEQ ID NO: 3684085 - DNA, 19 bp, Homo sapiens
agtaaacttcctattttct

SEQ ID NO: 3684086 - DNA, 22 bp, Homo sapiens
agtaaaggaaataagagcagtc

SEQ ID NO: 3684087 - DNA, 23 bp, Homo sapiens
agtaaaggaaataagagcagtca

SEQ ID NO: 3684088 - DNA, 23 bp, Homo sapiens
agtaaatgttatcttatactgta

SEQ ID NO: 3684089 - DNA, 20 bp, Homo sapiens
agtaacctctacaggcattt

SEQ ID NO: 3684090 - DNA, 17 bp, Homo sapiens
agtaacgcgtcttcctg

SEQ ID NO: 3684091 - DNA, 19 bp, Homo sapiens
agtaacgcgtcttcctgag

SEQ ID NO: 3684092 - DNA, 22 bp, Homo sapiens
agtaacgcgtcttcctgagtgg

SEQ ID NO: 3684093 - DNA, 17 bp, Homo sapiens
agtaacttacttaggtg

SEQ ID NO: 3684094 - DNA, 18 bp, Homo sapiens
agtaagatgtaaattgaa

SEQ ID NO: 3684095 - DNA, 19 bp, Homo sapiens
agtaagggcgtggctctgg

SEQ ID NO: 3684096 - DNA, 20 bp, Homo sapiens
agtaagggcgtggctctggg

SEQ ID NO: 3684097 - DNA, 22 bp, Homo sapiens
agtaagggcgtggctctgggtg

SEQ ID NO: 3684098 - DNA, 17 bp, Homo sapiens
agtaataaactgtgttt

SEQ ID NO: 3684099 - DNA, 23 bp, Homo sapiens
agtaattaatatctcctggaaca

SEQ ID NO: 3684100 - DNA, 17 bp, Homo sapiens
agtaccaatgggaagca

SEQ ID NO: 3684101 - DNA, 14 bp, Homo sapiens
agtacccagcctat

SEQ ID NO: 3684102 - DNA, 22 bp, Homo sapiens
agtactcactaaaagttctcaa

SEQ ID NO: 3684103 - DNA, 14 bp, Homo sapiens
agtactcctccctg

SEQ ID NO: 3684104 - DNA, 19 bp, Homo sapiens
agtactttggaggccccta

SEQ ID NO: 3684105 - DNA, 22 bp, Homo sapiens
agtactttggaggcccctatgt

SEQ ID NO: 3684106 - DNA, 23 bp, Homo sapiens
agtacttttttaaatattttcta

SEQ ID NO: 3684107 - DNA, 17 bp, Homo sapiens
agtagaagcatgtttgt

SEQ ID NO: 3684108 - DNA, 20 bp, Homo sapiens
agtagaccttgttacttctg

SEQ ID NO: 3684109 - DNA, 21 bp, Homo sapiens
agtagaccttgttacttctga

SEQ ID NO: 3684110 - DNA, 17 bp, Homo sapiens
agtagaggggacgtgag

SEQ ID NO: 3684111 - DNA, 15 bp, Homo sapiens
agtagattttccaaa

SEQ ID NO: 3684112 - DNA, 17 bp, Homo sapiens
agtaggcatttttacca

SEQ ID NO: 3684113 - DNA, 15 bp, Homo sapiens
agtagggtttgacat

SEQ ID NO: 3684114 - DNA, 13 bp, Homo sapiens
agtagtcctgtga

SEQ ID NO: 3684115 - DNA, 14 bp, Homo sapiens
agtagtcctgtgaa

SEQ ID NO: 3684116 - DNA, 21 bp, Homo sapiens
agtagtttttacagctgtgtt

SEQ ID NO: 3684117 - DNA, 14 bp, Homo sapiens
agtatcacttttct

SEQ ID NO: 3684118 - DNA, 14 bp, Homo sapiens
agtattgacactga

SEQ ID NO: 3684119 - DNA, 14 bp, Homo sapiens
agtattgtaaatta

SEQ ID NO: 3684120 - DNA, 15 bp, Homo sapiens
agtcaagaagaaaaa

SEQ ID NO: 3684121 - DNA, 16 bp, Homo sapiens
agtcaagctcctcctc

SEQ ID NO: 3684122 - DNA, 20 bp, Homo sapiens
agtcaagctcctcctccctg

SEQ ID NO: 3684123 - DNA, 20 bp, Homo sapiens
agtcaagtgaaaaaggagga

SEQ ID NO: 3684124 - DNA, 12 bp, Homo sapiens
agtcacatgccc

SEQ ID NO: 3684125 - DNA, 13 bp, Homo sapiens
agtcacctctgtc

SEQ ID NO: 3684126 - DNA, 18 bp, Homo sapiens
agtcagctttcatctttg

SEQ ID NO: 3684127 - DNA, 14 bp, Homo sapiens
agtcatcttgcaca

SEQ ID NO: 3684128 - DNA, 23 bp, Homo sapiens
agtcatcttgcacacactttcat

SEQ ID NO: 3684129 - DNA, 19 bp, Homo sapiens
agtcatggagaaccaccta

SEQ ID NO: 3684130 - DNA, 17 bp, Homo sapiens
agtccaattttaattta

SEQ ID NO: 3684131 - DNA, 19 bp, Homo sapiens
agtccaattttaatttagt

SEQ ID NO: 3684132 - DNA, 21 bp, Homo sapiens
agtccaattttaatttagtaa

SEQ ID NO: 3684133 - DNA, 14 bp, Homo sapiens
agtccaccctgcct

SEQ ID NO: 3684134 - DNA, 14 bp, Homo sapiens
agtccactttgttt

SEQ ID NO: 3684135 - DNA, 21 bp, Homo sapiens
agtccatatttcaatttccaa

SEQ ID NO: 3684136 - DNA, 20 bp, Homo sapiens
agtcccaggcccagtgcagt

SEQ ID NO: 3684137 - DNA, 16 bp, Homo sapiens
agtccccaggccccag

SEQ ID NO: 3684138 - DNA, 19 bp, Homo sapiens
agtccccaggccccaggaa

SEQ ID NO: 3684139 - DNA, 21 bp, Homo sapiens
agtccccaggccccaggaagc

SEQ ID NO: 3684140 - DNA, 13 bp, Homo sapiens
agtcctcccaagc

SEQ ID NO: 3684141 - DNA, 18 bp, Homo sapiens
agtcctcccaagctgtgc

SEQ ID NO: 3684142 - DNA, 13 bp, Homo sapiens
agtcctgcctggc

SEQ ID NO: 3684143 - DNA, 17 bp, Homo sapiens
agtcctgcctggccagg

SEQ ID NO: 3684144 - DNA, 20 bp, Homo sapiens
agtcctgcctggccaggcag

SEQ ID NO: 3684145 - DNA, 17 bp, Homo sapiens
agtcctggatgttgtgt

SEQ ID NO: 3684146 - DNA, 16 bp, Homo sapiens
agtcctggttgtctga

SEQ ID NO: 3684147 - DNA, 17 bp, Homo sapiens
agtcctggttgtctgaa

SEQ ID NO: 3684148 - DNA, 19 bp, Homo sapiens
agtcctgtgaatgccactg

SEQ ID NO: 3684149 - DNA, 21 bp, Homo sapiens
agtcctgtgaatgccactgcc

SEQ ID NO: 3684150 - DNA, 22 bp, Homo sapiens
agtcctgtgaatgccactgcct

SEQ ID NO: 3684151 - DNA, 13 bp, Homo sapiens
agtcgtgcctgtg

SEQ ID NO: 3684152 - DNA, 21 bp, Homo sapiens
agtcgtggggtgtgctgggag

SEQ ID NO: 3684153 - DNA, 19 bp, Homo sapiens
agtctagatggctcctctc

SEQ ID NO: 3684154 - DNA, 11 bp, Homo sapiens
agtctatggcc

SEQ ID NO: 3684155 - DNA, 13 bp, Homo sapiens
agtctcagaagag

SEQ ID NO: 3684156 - DNA, 18 bp, Homo sapiens
agtctcagttctcttgct

SEQ ID NO: 3684157 - DNA, 21 bp, Homo sapiens
agtctccagagagaaatcagg

SEQ ID NO: 3684158 - DNA, 13 bp, Homo sapiens
agtctgtcctgtg

SEQ ID NO: 3684159 - DNA, 16 bp, Homo sapiens
agtctgtcctgtgacg

SEQ ID NO: 3684160 - DNA, 12 bp, Homo sapiens
agtctgtctcag

SEQ ID NO: 3684161 - DNA, 12 bp, Homo sapiens
agtctgtgtgaa

SEQ ID NO: 3684162 - DNA, 15 bp, Homo sapiens
agtctgtgtgaaggt

SEQ ID NO: 3684163 - DNA, 12 bp, Homo sapiens
agtcttgcctag

SEQ ID NO: 3684164 - DNA, 23 bp, Homo sapiens
agtcttgggtactcgcacctctt

SEQ ID NO: 3684165 - DNA, 17 bp, Homo sapiens
agtctttgccagtcatt

SEQ ID NO: 3684166 - DNA, 22 bp, Homo sapiens
agtctttgccagtcattcagca

SEQ ID NO: 3684167 - DNA, 19 bp, Homo sapiens
agtcttttgcttttggcaa

SEQ ID NO: 3684168 - DNA, 11 bp, Homo sapiens
agtgaaaaagg

SEQ ID NO: 3684169 - DNA, 23 bp, Homo sapiens
agtgaaaaaggaggaagagaaaa

SEQ ID NO: 3684170 - DNA, 16 bp, Homo sapiens
agtgaacttgggccac

SEQ ID NO: 3684171 - DNA, 15 bp, Homo sapiens
agtgaaggaaatgaa

SEQ ID NO: 3684172 - DNA, 14 bp, Homo sapiens
agtgaatgctggga

SEQ ID NO: 3684173 - DNA, 19 bp, Homo sapiens
agtgacacccaagagggct

SEQ ID NO: 3684174 - DNA, 16 bp, Homo sapiens
agtgacacccagaggg

SEQ ID NO: 3684175 - DNA, 16 bp, Homo sapiens
agtgacagacaggctc

SEQ ID NO: 3684176 - DNA, 20 bp, Homo sapiens
agtgacataatatattctat

SEQ ID NO: 3684177 - DNA, 20 bp, Homo sapiens
agtgaccgactcatttacaa

SEQ ID NO: 3684178 - DNA, 16 bp, Homo sapiens
agtgactaatggcatg

SEQ ID NO: 3684179 - DNA, 17 bp, Homo sapiens
agtgactaatggcatga

SEQ ID NO: 3684180 - DNA, 17 bp, Homo sapiens
agtgagaccctgtctca

SEQ ID NO: 3684181 - DNA, 20 bp, Homo sapiens
agtgatagtcttttgctttt

SEQ ID NO: 3684182 - DNA, 21 bp, Homo sapiens
agtgatagtcttttgcttttg

SEQ ID NO: 3684183 - DNA, 21 bp, Homo sapiens
agtgatgtgtttacatttact

SEQ ID NO: 3684184 - DNA, 22 bp, Homo sapiens
agtgatgtgtttacatttactg

SEQ ID NO: 3684185 - DNA, 13 bp, Homo sapiens
agtgcagaatgta

SEQ ID NO: 3684186 - DNA, 14 bp, Homo sapiens
agtgcagaatgtaa

SEQ ID NO: 3684187 - DNA, 22 bp, Homo sapiens
agtgcagaatgtaagtgggccc

SEQ ID NO: 3684188 - DNA, 14 bp, Homo sapiens
agtgcagcagagga

SEQ ID NO: 3684189 - DNA, 15 bp, Homo sapiens
agtgcagcagaggac

SEQ ID NO: 3684190 - DNA, 14 bp, Homo sapiens
agtgcagtgacaca

SEQ ID NO: 3684191 - DNA, 19 bp, Homo sapiens
agtgcatgcattgagctgc

SEQ ID NO: 3684192 - DNA, 22 bp, Homo sapiens
agtgcatgcattgagctgcctc

SEQ ID NO: 3684193 - DNA, 16 bp, Homo sapiens
agtgcatggtggccag

SEQ ID NO: 3684194 - DNA, 20 bp, Homo sapiens
agtgcatttttgtaaatgtg

SEQ ID NO: 3684195 - DNA, 18 bp, Homo sapiens
agtgccaacttcccctct

SEQ ID NO: 3684196 - DNA, 20 bp, Homo sapiens
agtgccacccacctttgcca

SEQ ID NO: 3684197 - DNA, 14 bp, Homo sapiens
agtgcccccactga

SEQ ID NO: 3684198 - DNA, 18 bp, Homo sapiens
agtgcccccactgaccag

SEQ ID NO: 3684199 - DNA, 20 bp, Homo sapiens
agtgcccttcctgctgcgca

SEQ ID NO: 3684200 - DNA, 15 bp, Homo sapiens
agtgcctagactgtt

SEQ ID NO: 3684201 - DNA, 17 bp, Homo sapiens
agtgcctagactgttac

SEQ ID NO: 3684202 - DNA, 22 bp, Homo sapiens
agtgcctagactgttactttgg

SEQ ID NO: 3684203 - DNA, 14 bp, Homo sapiens
agtgctgaacagtg

SEQ ID NO: 3684204 - DNA, 20 bp, Homo sapiens
agtgctgggattacaggcgt

SEQ ID NO: 3684205 - DNA, 19 bp, Homo sapiens
agtgctgggattacaggct

SEQ ID NO: 3684206 - DNA, 17 bp, Homo sapiens
agtgctgtgctgtgcta

SEQ ID NO: 3684207 - DNA, 14 bp, Homo sapiens
agtgctgttgaaga

SEQ ID NO: 3684208 - DNA, 23 bp, Homo sapiens
agtgctgttgaagatttgaggac

SEQ ID NO: 3684209 - DNA, 14 bp, Homo sapiens
agtggacagtgaat

SEQ ID NO: 3684210 - DNA, 14 bp, Homo sapiens
agtggacagtgctg

SEQ ID NO: 3684211 - DNA, 18 bp, Homo sapiens
agtggcaccgcctcccca

SEQ ID NO: 3684212 - DNA, 13 bp, Homo sapiens
agtggcctggcca

SEQ ID NO: 3684213 - DNA, 14 bp, Homo sapiens
agtggcctggccag

SEQ ID NO: 3684214 - DNA, 19 bp, Homo sapiens
agtggcctggccaggagct

SEQ ID NO: 3684215 - DNA, 17 bp, Homo sapiens
agtgggccagtcctggt

SEQ ID NO: 3684216 - DNA, 20 bp, Homo sapiens
agtgggccagtcctggttgt

SEQ ID NO: 3684217 - DNA, 14 bp, Homo sapiens
agtgggctgtttct

SEQ ID NO: 3684218 - DNA, 20 bp, Homo sapiens
agtggtggtaaccctggtgg

SEQ ID NO: 3684219 - DNA, 18 bp, Homo sapiens
agtgtaacagatatcagt

SEQ ID NO: 3684220 - DNA, 16 bp, Homo sapiens
agtgtcactcaaggcg

SEQ ID NO: 3684221 - DNA, 17 bp, Homo sapiens
agtgtctccccgtgtcc

SEQ ID NO: 3684222 - DNA, 15 bp, Homo sapiens
agtgtctcctctctg

SEQ ID NO: 3684223 - DNA, 15 bp, Homo sapiens
agtgtcttttgacat

SEQ ID NO: 3684224 - DNA, 18 bp, Homo sapiens
agtgtggggagggcaggt

SEQ ID NO: 3684225 - DNA, 20 bp, Homo sapiens
agtgtggggagggcaggtcc

SEQ ID NO: 3684226 - DNA, 13 bp, Homo sapiens
agtgttatgtatt

SEQ ID NO: 3684227 - DNA, 14 bp, Homo sapiens
agtgttatgtattt

SEQ ID NO: 3684228 - DNA, 15 bp, Homo sapiens
agtgttatgtatttc

SEQ ID NO: 3684229 - DNA, 15 bp, Homo sapiens
agtgttcacaacctg

SEQ ID NO: 3684230 - DNA, 14 bp, Homo sapiens
agtgttcactgctc

SEQ ID NO: 3684231 - DNA, 19 bp, Homo sapiens
agttaagacaacaggcatt

SEQ ID NO: 3684232 - DNA, 13 bp, Homo sapiens
agttaagacctgg

SEQ ID NO: 3684233 - DNA, 21 bp, Homo sapiens
agttaattttttttgtattct

SEQ ID NO: 3684234 - DNA, 22 bp, Homo sapiens
agttacataattcactctgagt

SEQ ID NO: 3684235 - DNA, 13 bp, Homo sapiens
agttagtcgccct

SEQ ID NO: 3684236 - DNA, 18 bp, Homo sapiens
agttagtcgccctacaga

SEQ ID NO: 3684237 - DNA, 19 bp, Homo sapiens
agttatatttcagatgtaa

SEQ ID NO: 3684238 - DNA, 16 bp, Homo sapiens
agttatgttttacatg

SEQ ID NO: 3684239 - DNA, 19 bp, Homo sapiens
agttattaagttctttaaa

SEQ ID NO: 3684240 - DNA, 18 bp, Homo sapiens
agttcagcaccaccctag

SEQ ID NO: 3684241 - DNA, 19 bp, Homo sapiens
agttcagcggttgaggaga

SEQ ID NO: 3684242 - DNA, 17 bp, Homo sapiens
agttcaggaacccttct

SEQ ID NO: 3684243 - DNA, 19 bp, Homo sapiens
agttcaggtagctgcccct

SEQ ID NO: 3684244 - DNA, 21 bp, Homo sapiens
agttcaggtagctgcccctgg

SEQ ID NO: 3684245 - DNA, 17 bp, Homo sapiens
agttcccttggcctcag

SEQ ID NO: 3684246 - DNA, 19 bp, Homo sapiens
agttcctttccttttcttt

SEQ ID NO: 3684247 - DNA, 21 bp, Homo sapiens
agttcgatgggcccaattctt

SEQ ID NO: 3684248 - DNA, 17 bp, Homo sapiens
agttctgggtgctccct

SEQ ID NO: 3684249 - DNA, 19 bp, Homo sapiens
agttctgggtgctccctac

SEQ ID NO: 3684250 - DNA, 14 bp, Homo sapiens
agttcttgtggaag

SEQ ID NO: 3684251 - DNA, 18 bp, Homo sapiens
agttgaaaaacagctgag

SEQ ID NO: 3684252 - DNA, 22 bp, Homo sapiens
agttgacttgacagaacactgt

SEQ ID NO: 3684253 - DNA, 13 bp, Homo sapiens
agttgaggggagc

SEQ ID NO: 3684254 - DNA, 18 bp, Homo sapiens
agttgatctggaacccag

SEQ ID NO: 3684255 - DNA, 18 bp, Homo sapiens
agttgattcagctctgca

SEQ ID NO: 3684256 - DNA, 15 bp, Homo sapiens
agttgctatttttgt

SEQ ID NO: 3684257 - DNA, 20 bp, Homo sapiens
agttggagttttttgtacca

SEQ ID NO: 3684258 - DNA, 16 bp, Homo sapiens
agtttcatgtgagttt

SEQ ID NO: 3684259 - DNA, 20 bp, Homo sapiens
agtttctttattttgtgtaa

SEQ ID NO: 3684260 - DNA, 19 bp, Homo sapiens
agtttgagatcagcctggg

SEQ ID NO: 3684261 - DNA, 16 bp, Homo sapiens
agtttgtactcagtgg

SEQ ID NO: 3684262 - DNA, 15 bp, Homo sapiens
agttttagttttctc

SEQ ID NO: 3684263 - DNA, 17 bp, Homo sapiens
agttttcagaacctctt

SEQ ID NO: 3684264 - DNA, 18 bp, Homo sapiens
agttttcagaacctcttc

SEQ ID NO: 3684265 - DNA, 20 bp, Homo sapiens
agttttcagaacctcttccc

SEQ ID NO: 3684266 - DNA, 22 bp, Homo sapiens
atccactctaccctcccacccc

SEQ ID NO: 3684267 - DNA, 23 bp, Homo sapiens
atccactctaccctcccaccccc

SEQ ID NO: 3684268 - DNA, 17 bp, Homo sapiens
atccagcctggggtctg

SEQ ID NO: 3684269 - DNA, 22 bp, Homo sapiens
atccaggactatatttgggcct

SEQ ID NO: 3684270 - DNA, 12 bp, Homo sapiens
atccagggacag

SEQ ID NO: 3684271 - DNA, 14 bp, Homo sapiens
atccagggacagag

SEQ ID NO: 3684272 - DNA, 19 bp, Homo sapiens
atccagggacagaggcccc

SEQ ID NO: 3684273 - DNA, 16 bp, Homo sapiens
atccaggtgtgcccct

SEQ ID NO: 3684274 - DNA, 17 bp, Homo sapiens
atccaggtgtgcccctc

SEQ ID NO: 3684275 - DNA, 20 bp, Homo sapiens
atcccaagtagaatctcagt

SEQ ID NO: 3684276 - DNA, 13 bp, Homo sapiens
atcccacccacct

SEQ ID NO: 3684277 - DNA, 14 bp, Homo sapiens
atcccagttcttcc

SEQ ID NO: 3684278 - DNA, 14 bp, Homo sapiens
atccccaaccccct

SEQ ID NO: 3684279 - DNA, 19 bp, Homo sapiens
atccccaggggtcccagcc

SEQ ID NO: 3684280 - DNA, 22 bp, Homo sapiens
atccccgcagtgtgcactaagg

SEQ ID NO: 3684281 - DNA, 16 bp, Homo sapiens
atccccttgaactctt

SEQ ID NO: 3684282 - DNA, 15 bp, Homo sapiens
atcccgattcaccct

SEQ ID NO: 3684283 - DNA, 20 bp, Homo sapiens
atcccgattcaccctgtcca

SEQ ID NO: 3684284 - DNA, 16 bp, Homo sapiens
atcccggctccagagc

SEQ ID NO: 3684285 - DNA, 19 bp, Homo sapiens
atccctcccccccatgcac

SEQ ID NO: 3684286 - DNA, 14 bp, Homo sapiens
atccctgccagctc

SEQ ID NO: 3684287 - DNA, 18 bp, Homo sapiens
atccctggttgcctcatg

SEQ ID NO: 3684288 - DNA, 17 bp, Homo sapiens
atccgactgctttggac

SEQ ID NO: 3684289 - DNA, 18 bp, Homo sapiens
atccgagggcccctctcc

SEQ ID NO: 3684290 - DNA, 15 bp, Homo sapiens
atccgcctggcccgg

SEQ ID NO: 3684291 - DNA, 22 bp, Homo sapiens
atcctaagggaagataaagatg

SEQ ID NO: 3684292 - DNA, 14 bp, Homo sapiens
atcctacagtgaaa

SEQ ID NO: 3684293 - DNA, 11 bp, Homo sapiens
atcctcctccc

SEQ ID NO: 3684294 - DNA, 14 bp, Homo sapiens
atcctcctcccacc

SEQ ID NO: 3684295 - DNA, 16 bp, Homo sapiens
atcctcctgttctgaa

SEQ ID NO: 3684296 - DNA, 14 bp, Homo sapiens
atcctctgcctcaa

SEQ ID NO: 3684297 - DNA, 14 bp, Homo sapiens
atcctctttttcca

SEQ ID NO: 3684298 - DNA, 16 bp, Homo sapiens
atcctgcgggtggggc

SEQ ID NO: 3684299 - DNA, 12 bp, Homo sapiens
atcctgcttgat

SEQ ID NO: 3684300 - DNA, 14 bp, Homo sapiens
atcctggaggccca

SEQ ID NO: 3684301 - DNA, 16 bp, Homo sapiens
atcctggaggcccagt

SEQ ID NO: 3684302 - DNA, 19 bp, Homo sapiens
atcctggaggcccagttca

SEQ ID NO: 3684303 - DNA, 22 bp, Homo sapiens
atccttgatgcaagtgcaacct

SEQ ID NO: 3684304 - DNA, 13 bp, Homo sapiens
atctaaagttata

SEQ ID NO: 3684305 - DNA, 17 bp, Homo sapiens
atctaaagttatatttc

SEQ ID NO: 3684306 - DNA, 14 bp, Homo sapiens
atctagaattttta

SEQ ID NO: 3684307 - DNA, 16 bp, Homo sapiens
atctagatatcgactt

SEQ ID NO: 3684308 - DNA, 17 bp, Homo sapiens
atctagcgcaattgaag

SEQ ID NO: 3684309 - DNA, 18 bp, Homo sapiens
atctaggcaacatagtat

SEQ ID NO: 3684310 - DNA, 17 bp, Homo sapiens
atctagtcacaaagact

SEQ ID NO: 3684311 - DNA, 14 bp, Homo sapiens
atctatatatataa

SEQ ID NO: 3684312 - DNA, 15 bp, Homo sapiens
atctatgtgtatgtt

SEQ ID NO: 3684313 - DNA, 16 bp, Homo sapiens
atctcacctcctgctg

SEQ ID NO: 3684314 - DNA, 20 bp, Homo sapiens
atctcacctcctgctgggca

SEQ ID NO: 3684315 - DNA, 22 bp, Homo sapiens
atctcagaaccttgtcccagcc

SEQ ID NO: 3684316 - DNA, 14 bp, Homo sapiens
atctcagctcactg

SEQ ID NO: 3684317 - DNA, 17 bp, Homo sapiens
atctcaggccagagcca

SEQ ID NO: 3684318 - DNA, 18 bp, Homo sapiens
atctcaggccagagccaa

SEQ ID NO: 3684319 - DNA, 14 bp, Homo sapiens
atctcagggcctgg

SEQ ID NO: 3684320 - DNA, 14 bp, Homo sapiens
atctccctggagaa

SEQ ID NO: 3684321 - DNA, 17 bp, Homo sapiens
atctctctttaatataa

SEQ ID NO: 3684322 - DNA, 16 bp, Homo sapiens
atctctgctttggaaa

SEQ ID NO: 3684323 - DNA, 15 bp, Homo sapiens
atctctgtgccttcg

SEQ ID NO: 3684324 - DNA, 18 bp, Homo sapiens
atctcttgagcctgggag

SEQ ID NO: 3684325 - DNA, 18 bp, Homo sapiens
atctgaaggggcaaattc

SEQ ID NO: 3684326 - DNA, 15 bp, Homo sapiens
atctgaccagcagcg

SEQ ID NO: 3684327 - DNA, 12 bp, Homo sapiens
atctgacccagt

SEQ ID NO: 3684328 - DNA, 23 bp, Homo sapiens
atctgagaaacctgttgaagatt

SEQ ID NO: 3684329 - DNA, 15 bp, Homo sapiens
atctgcacccccctg

SEQ ID NO: 3684330 - DNA, 21 bp, Homo sapiens
atctgcacccccctgggctga

SEQ ID NO: 3684331 - DNA, 16 bp, Homo sapiens
atctgcccctccccca

SEQ ID NO: 3684332 - DNA, 18 bp, Homo sapiens
atctggaacccagactca

SEQ ID NO: 3684333 - DNA, 19 bp, Homo sapiens
atctggaacccagactcag

SEQ ID NO: 3684334 - DNA, 16 bp, Homo sapiens
atctggaacctcagcc

SEQ ID NO: 3684335 - DNA, 20 bp, Homo sapiens
atctggaacctcagcctggc

SEQ ID NO: 3684336 - DNA, 17 bp, Homo sapiens
atctggcttagtgccac

SEQ ID NO: 3684337 - DNA, 14 bp, Homo sapiens
atctggtcctaccc

SEQ ID NO: 3684338 - DNA, 21 bp, Homo sapiens
atctgtagtaatttattgtct

SEQ ID NO: 3684339 - DNA, 21 bp, Homo sapiens
atctgtcaagagtagttatat

SEQ ID NO: 3684340 - DNA, 17 bp, Homo sapiens
atctgtcctcagccttg

SEQ ID NO: 3684341 - DNA, 18 bp, Homo sapiens
atctgtcctcagccttgc

SEQ ID NO: 3684342 - DNA, 18 bp, Homo sapiens
atctgttcccttcctctg

SEQ ID NO: 3684343 - DNA, 22 bp, Homo sapiens
atctgttcccttcctctgtgcc

SEQ ID NO: 3684344 - DNA, 23 bp, Homo sapiens
atcttaagattccattttggaaa

SEQ ID NO: 3684345 - DNA, 22 bp, Homo sapiens
atcttacaacaggcttatgaat

SEQ ID NO: 3684346 - DNA, 13 bp, Homo sapiens
atcttatactgta

SEQ ID NO: 3684347 - DNA, 16 bp, Homo sapiens
atcttatactgtacaa

SEQ ID NO: 3684348 - DNA, 17 bp, Homo sapiens
atcttatactgtacaat

SEQ ID NO: 3684349 - DNA, 19 bp, Homo sapiens
atcttccaactcaaactct

SEQ ID NO: 3684350 - DNA, 13 bp, Homo sapiens
atcttctaaatgg

SEQ ID NO: 3684351 - DNA, 11 bp, Homo sapiens
atcttctggat

SEQ ID NO: 3684352 - DNA, 12 bp, Homo sapiens
atcttctggatt

SEQ ID NO: 3684353 - DNA, 17 bp, Homo sapiens
atcttgaccaagcagga

SEQ ID NO: 3684354 - DNA, 14 bp, Homo sapiens
atcttgcctccagg

SEQ ID NO: 3684355 - DNA, 23 bp, Homo sapiens
atcttgcttccctaatctatggt

SEQ ID NO: 3684356 - DNA, 20 bp, Homo sapiens
atcttggcctaaacctcagt

SEQ ID NO: 3684357 - DNA, 22 bp, Homo sapiens
atcttggctatgtaattcttgt

SEQ ID NO: 3684358 - DNA, 17 bp, Homo sapiens
atcttggtttgccttcc

SEQ ID NO: 3684359 - DNA, 20 bp, Homo sapiens
atcttggtttgccttccaga

SEQ ID NO: 3684360 - DNA, 13 bp, Homo sapiens
atctttgactgaa

SEQ ID NO: 3684361 - DNA, 14 bp, Homo sapiens
atctttgccttggg

SEQ ID NO: 3684362 - DNA, 13 bp, Homo sapiens
atctttgtggcca

SEQ ID NO: 3684363 - DNA, 15 bp, Homo sapiens
atctttttgaccctc

SEQ ID NO: 3684364 - DNA, 20 bp, Homo sapiens
atctttttgaccctcattct

SEQ ID NO: 3684365 - DNA, 23 bp, Homo sapiens
atctttttgaccctcattcttta

SEQ ID NO: 3684366 - DNA, 20 bp, Homo sapiens
atgaaaatgcaacaacatgt

SEQ ID NO: 3684367 - DNA, 14 bp, Homo sapiens
atgaacactcccca

SEQ ID NO: 3684368 - DNA, 17 bp, Homo sapiens
atgaactagctatgaaa

SEQ ID NO: 3684369 - DNA, 19 bp, Homo sapiens
atgaaggtttctgaaaatt

SEQ ID NO: 3684370 - DNA, 16 bp, Homo sapiens
atgaatctttgactga

SEQ ID NO: 3684371 - DNA, 18 bp, Homo sapiens
atgaatctttgactgaag

SEQ ID NO: 3684372 - DNA, 14 bp, Homo sapiens
atgacaaaaaatgt

SEQ ID NO: 3684373 - DNA, 16 bp, Homo sapiens
atgactcgggggtggg

SEQ ID NO: 3684374 - DNA, 13 bp, Homo sapiens
atgactgcacatg

SEQ ID NO: 3684375 - DNA, 14 bp, Homo sapiens
atgagaaagccttc

SEQ ID NO: 3684376 - DNA, 15 bp, Homo sapiens
atgagaaagccttct

SEQ ID NO: 3684377 - DNA, 15 bp, Homo sapiens
atgagaaatacaaaa

SEQ ID NO: 3684378 - DNA, 15 bp, Homo sapiens
atgagatgctggctt

SEQ ID NO: 3684379 - DNA, 11 bp, Homo sapiens
atgagcctggc

SEQ ID NO: 3684380 - DNA, 13 bp, Homo sapiens
atgagcctggcaa

SEQ ID NO: 3684381 - DNA, 19 bp, Homo sapiens
atgagcgctactcttggat

SEQ ID NO: 3684382 - DNA, 18 bp, Homo sapiens
atgaggagagaaaatata

SEQ ID NO: 3684383 - DNA, 19 bp, Homo sapiens
atgtaagcatactttgtaa

SEQ ID NO: 3684384 - DNA, 22 bp, Homo sapiens
atgtaagcatactttgtaaata

SEQ ID NO: 3684385 - DNA, 18 bp, Homo sapiens
atgtaagtgggcccaccc

SEQ ID NO: 3684386 - DNA, 16 bp, Homo sapiens
atgtaataaactttaa

SEQ ID NO: 3684387 - DNA, 23 bp, Homo sapiens
atgtaatgttttctttgcaaagt

SEQ ID NO: 3684388 - DNA, 19 bp, Homo sapiens
atgtacagacatatttaac

SEQ ID NO: 3684389 - DNA, 23 bp, Homo sapiens
atgtacagacatatttaactggt

SEQ ID NO: 3684390 - DNA, 16 bp, Homo sapiens
atgtacagttgaaata

SEQ ID NO: 3684391 - DNA, 19 bp, Homo sapiens
atgtacccagtagggtttg

SEQ ID NO: 3684392 - DNA, 20 bp, Homo sapiens
atgtacgtccagcctgcccc

SEQ ID NO: 3684393 - DNA, 15 bp, Homo sapiens
atgtactagtgttct

SEQ ID NO: 3684394 - DNA, 14 bp, Homo sapiens
atgtaggagctgca

SEQ ID NO: 3684395 - DNA, 23 bp, Homo sapiens
atgtatacatcttatagatgcaa

SEQ ID NO: 3684396 - DNA, 18 bp, Homo sapiens
atgtcaaagatatgttaa

SEQ ID NO: 3684397 - DNA, 19 bp, Homo sapiens
atgtcaccggatcctgggt

SEQ ID NO: 3684398 - DNA, 20 bp, Homo sapiens
atgtcaccggatcctgggtg

SEQ ID NO: 3684399 - DNA, 16 bp, Homo sapiens
atgtccagcaccttgt

SEQ ID NO: 3684400 - DNA, 21 bp, Homo sapiens
atgtccgatggtatctgggta

SEQ ID NO: 3684401 - DNA, 16 bp, Homo sapiens
atgtcctccagaagcc

SEQ ID NO: 3684402 - DNA, 19 bp, Homo sapiens
atgtcctccagaagcctct

SEQ ID NO: 3684403 - DNA, 23 bp, Homo sapiens
atgtcctccagaagcctctggct

SEQ ID NO: 3684404 - DNA, 13 bp, Homo sapiens
atgtctgtgccat

SEQ ID NO: 3684405 - DNA, 18 bp, Homo sapiens
atgtctgtgccatttctc

SEQ ID NO: 3684406 - DNA, 14 bp, Homo sapiens
atgtcttgttcttg

SEQ ID NO: 3684407 - DNA, 15 bp, Homo sapiens
atgtcttgttcttga

SEQ ID NO: 3684408 - DNA, 16 bp, Homo sapiens
atgtgaaaggaacatt

SEQ ID NO: 3684409 - DNA, 18 bp, Homo sapiens
atgtgaaaggaacatttt

SEQ ID NO: 3684410 - DNA, 22 bp, Homo sapiens
atgtgaaccattaaccagatct

SEQ ID NO: 3684411 - DNA, 20 bp, Homo sapiens
atgtgataaggaaatcaact

SEQ ID NO: 3684412 - DNA, 14 bp, Homo sapiens
atgtggctggaaga

SEQ ID NO: 3684413 - DNA, 16 bp, Homo sapiens
atgtggttgaagagca

SEQ ID NO: 3684414 - DNA, 22 bp, Homo sapiens
atgtgtgaggagctgctggctt

SEQ ID NO: 3684415 - DNA, 22 bp, Homo sapiens
atgtgtgcaacagggtatggac

SEQ ID NO: 3684416 - DNA, 22 bp, Homo sapiens
atgtgtttacatttactgaaat

SEQ ID NO: 3684417 - DNA, 17 bp, Homo sapiens
atgtgtttgctttctga

SEQ ID NO: 3684418 - DNA, 21 bp, Homo sapiens
atgttaagcagctaaattttc

SEQ ID NO: 3684419 - DNA, 12 bp, Homo sapiens
atgttaatttat

SEQ ID NO: 3684420 - DNA, 16 bp, Homo sapiens
atgttaatttatttag

SEQ ID NO: 3684421 - DNA, 17 bp, Homo sapiens
atgttaatttatttagt

SEQ ID NO: 3684422 - DNA, 19 bp, Homo sapiens
atgttaattttttggtaca

SEQ ID NO: 3684423 - DNA, 22 bp, Homo sapiens
atgttagactcatggtgtgtta

SEQ ID NO: 3684424 - DNA, 24 bp, Homo sapiens
atgttagactcatggtgtgttaca

SEQ ID NO: 3684425 - DNA, 18 bp, Homo sapiens
atgttgattacagtgcag

SEQ ID NO: 3684426 - DNA, 17 bp, Homo sapiens
atgttgctgttattata

SEQ ID NO: 3684427 - DNA, 19 bp, Homo sapiens
atgttgggaaacttggctc

SEQ ID NO: 3684428 - DNA, 23 bp, Homo sapiens
atgttgtttcctaatatcaaatg

SEQ ID NO: 3684429 - DNA, 14 bp, Homo sapiens
atgtttaaacattt

SEQ ID NO: 3684430 - DNA, 14 bp, Homo sapiens
atgtttaatctgtt

SEQ ID NO: 3684431 - DNA, 12 bp, Homo sapiens
atgtttccatgg

SEQ ID NO: 3684432 - DNA, 14 bp, Homo sapiens
atgtttcctctagt

SEQ ID NO: 3684433 - DNA, 23 bp, Homo sapiens
atgtttgggagactgctgagtca

SEQ ID NO: 3684434 - DNA, 10 bp, Homo sapiens
atgtttgtgg

SEQ ID NO: 3684435 - DNA, 13 bp, Homo sapiens
atgtttgtggcct

SEQ ID NO: 3684436 - DNA, 14 bp, Homo sapiens
atgtttgtggcctc

SEQ ID NO: 3684437 - DNA, 17 bp, Homo sapiens
atgtttgtggcctcaga

SEQ ID NO: 3684438 - DNA, 18 bp, Homo sapiens
atgtttgtggcctcagaa

SEQ ID NO: 3684439 - DNA, 13 bp, Homo sapiens
atgttttaaagaa

SEQ ID NO: 3684440 - DNA, 22 bp, Homo sapiens
atgttttaaagaatatgacttt

SEQ ID NO: 3684441 - DNA, 14 bp, Homo sapiens
atgttttaaatgta

SEQ ID NO: 3684442 - DNA, 15 bp, Homo sapiens
atgttttaaatgtac

SEQ ID NO: 3684443 - DNA, 18 bp, Homo sapiens
atgttttaaatgtacaga

SEQ ID NO: 3684444 - DNA, 22 bp, Homo sapiens
atgtttttctgccagggagctt

SEQ ID NO: 3684445 - DNA, 18 bp, Homo sapiens
attaaaaaagcatacttc

SEQ ID NO: 3684446 - DNA, 19 bp, Homo sapiens
attaaaaaagcatacttct

SEQ ID NO: 3684447 - DNA, 13 bp, Homo sapiens
attaaaatggatg

SEQ ID NO: 3684448 - DNA, 22 bp, Homo sapiens
attaaagcttatttttctgtga

SEQ ID NO: 3684449 - DNA, 18 bp, Homo sapiens
attaaaggaagcactctg

SEQ ID NO: 3684450 - DNA, 13 bp, Homo sapiens
attaacacaaagg

SEQ ID NO: 3684451 - DNA, 20 bp, Homo sapiens
attaaccacttcagctgact

SEQ ID NO: 3684452 - DNA, 13 bp, Homo sapiens
attaaggaagaca

SEQ ID NO: 3684453 - DNA, 13 bp, Homo sapiens
attaatgtatgta

SEQ ID NO: 3684454 - DNA, 23 bp, Homo sapiens
attaatgtatgtaggagctgcag

SEQ ID NO: 3684455 - DNA, 16 bp, Homo sapiens
attaatttatgcagaa

SEQ ID NO: 3684456 - DNA, 17 bp, Homo sapiens
attaatttatgcagaat

SEQ ID NO: 3684457 - DNA, 14 bp, Homo sapiens
attacacttggtaa

SEQ ID NO: 3684458 - DNA, 16 bp, Homo sapiens
attacaggtgtgagcc

SEQ ID NO: 3684459 - DNA, 14 bp, Homo sapiens
attaccacacttgg

SEQ ID NO: 3684460 - DNA, 12 bp, Homo sapiens
attacctgccaa

SEQ ID NO: 3684461 - DNA, 14 bp, Homo sapiens
attacttggctttt

SEQ ID NO: 3684462 - DNA, 22 bp, Homo sapiens
attagatgttacaagtttatat

SEQ ID NO: 3684463 - DNA, 22 bp, Homo sapiens
attagcaaagcaaaaggctgag

SEQ ID NO: 3684464 - DNA, 14 bp, Homo sapiens
attaggcagactct

SEQ ID NO: 3684465 - DNA, 19 bp, Homo sapiens
attaggtcttgctggaaga

SEQ ID NO: 3684466 - DNA, 20 bp, Homo sapiens
attaggtcttgctggaagac

SEQ ID NO: 3684467 - DNA, 16 bp, Homo sapiens
attattaatttatgca

SEQ ID NO: 3684468 - DNA, 15 bp, Homo sapiens
attattatttgcagt

SEQ ID NO: 3684469 - DNA, 12 bp, Homo sapiens
attcaaaatatt

SEQ ID NO: 3684470 - DNA, 22 bp, Homo sapiens
attcacagttctttgggccaga

SEQ ID NO: 3684471 - DNA, 23 bp, Homo sapiens
attcacagttctttgggccagac

SEQ ID NO: 3684472 - DNA, 21 bp, Homo sapiens
attcactctgagtgttttatg

SEQ ID NO: 3684473 - DNA, 13 bp, Homo sapiens
attcactggcccc

SEQ ID NO: 3684474 - DNA, 13 bp, Homo sapiens
attcagacagatg

SEQ ID NO: 3684475 - DNA, 19 bp, Homo sapiens
attcagcagcaaattttca

SEQ ID NO: 3684476 - DNA, 20 bp, Homo sapiens
attcagcagcaaattttcag

SEQ ID NO: 3684477 - DNA, 14 bp, Homo sapiens
attcagctctgcaa

SEQ ID NO: 3684478 - DNA, 11 bp, Homo sapiens
attcatttcta

SEQ ID NO: 3684479 - DNA, 19 bp, Homo sapiens
attccaactcgtatagcat

SEQ ID NO: 3684480 - DNA, 23 bp, Homo sapiens
attccaactcgtatagcatgcat

SEQ ID NO: 3684481 - DNA, 18 bp, Homo sapiens
attcctaaagaaaaatat

SEQ ID NO: 3684482 - DNA, 14 bp, Homo sapiens
attcctctttgctt

SEQ ID NO: 3684483 - DNA, 15 bp, Homo sapiens
attcctctttgcttt

SEQ ID NO: 3684484 - DNA, 16 bp, Homo sapiens
attcctctttgctttg

SEQ ID NO: 3684485 - DNA, 15 bp, Homo sapiens
attcctgaagaacca

SEQ ID NO: 3684486 - DNA, 19 bp, Homo sapiens
attcctgaagaaccagtcc

SEQ ID NO: 3684487 - DNA, 15 bp, Homo sapiens
attcctggaacctgg

SEQ ID NO: 3684488 - DNA, 14 bp, Homo sapiens
attccttgtcttga

SEQ ID NO: 3684489 - DNA, 22 bp, Homo sapiens
attcgtagatattggacaaaga

SEQ ID NO: 3684490 - DNA, 21 bp, Homo sapiens
attctatgtatgttaatttat

SEQ ID NO: 3684491 - DNA, 11 bp, Homo sapiens
attctcctctc

SEQ ID NO: 3684492 - DNA, 20 bp, Homo sapiens
attctgactcggtttctcca

SEQ ID NO: 3684493 - DNA, 14 bp, Homo sapiens
attctgagaccaaa

SEQ ID NO: 3684494 - DNA, 14 bp, Homo sapiens
attctgccaggccc

SEQ ID NO: 3684495 - DNA, 23 bp, Homo sapiens
attctgccaggcccccaagcctg

SEQ ID NO: 3684496 - DNA, 23 bp, Homo sapiens
attctggttccagggtccctctg

SEQ ID NO: 3684497 - DNA, 19 bp, Homo sapiens
attctgtttttaatgctat

SEQ ID NO: 3684498 - DNA, 17 bp, Homo sapiens
attcttaacaaactctt

SEQ ID NO: 3684499 - DNA, 22 bp, Homo sapiens
caagactgagccagcttagcaa

SEQ ID NO: 3684500 - DNA, 15 bp, Homo sapiens
caagagcagcctgtg

SEQ ID NO: 3684501 - DNA, 21 bp, Homo sapiens
caagagcagcctgtggcatct

SEQ ID NO: 3684502 - DNA, 22 bp, Homo sapiens
caagagcccaaaagagggcaca

SEQ ID NO: 3684503 - DNA, 22 bp, Homo sapiens
caagagtagttatataattgtt

SEQ ID NO: 3684504 - DNA, 23 bp, Homo sapiens
caagatggcgccaccgcactcca

SEQ ID NO: 3684505 - DNA, 11 bp, Homo sapiens
caagcagagga

SEQ ID NO: 3684506 - DNA, 19 bp, Homo sapiens
caagcagaggaccagggcc

SEQ ID NO: 3684507 - DNA, 20 bp, Homo sapiens
caagcagaggaccagggcct

SEQ ID NO: 3684508 - DNA, 13 bp, Homo sapiens
caagcagccaagc

SEQ ID NO: 3684509 - DNA, 17 bp, Homo sapiens
caagccaagaaagatgt

SEQ ID NO: 3684510 - DNA, 13 bp, Homo sapiens
caagccaagcagc

SEQ ID NO: 3684511 - DNA, 18 bp, Homo sapiens
caagccaagcagccaagc

SEQ ID NO: 3684512 - DNA, 13 bp, Homo sapiens
caagccagaactt

SEQ ID NO: 3684513 - DNA, 14 bp, Homo sapiens
caagcctgagaact

SEQ ID NO: 3684514 - DNA, 22 bp, Homo sapiens
caagcctgcagtcatcttgacc

SEQ ID NO: 3684515 - DNA, 20 bp, Homo sapiens
caagcgaccgaggccctccc

SEQ ID NO: 3684516 - DNA, 16 bp, Homo sapiens
caagcggatgctccat

SEQ ID NO: 3684517 - DNA, 13 bp, Homo sapiens
caagctccaagcc

SEQ ID NO: 3684518 - DNA, 15 bp, Homo sapiens
caagctcctcctccc

SEQ ID NO: 3684519 - DNA, 13 bp, Homo sapiens
caagctgcaccct

SEQ ID NO: 3684520 - DNA, 18 bp, Homo sapiens
caagctgcaccctcaggc

SEQ ID NO: 3684521 - DNA, 20 bp, Homo sapiens
caagctgcaccctcaggcag

SEQ ID NO: 3684522 - DNA, 14 bp, Homo sapiens
caagctgtgctggg

SEQ ID NO: 3684523 - DNA, 20 bp, Homo sapiens
caaggaccaggactccctcc

SEQ ID NO: 3684524 - DNA, 21 bp, Homo sapiens
caaggacttcctgtccagctc

SEQ ID NO: 3684525 - DNA, 23 bp, Homo sapiens
caaggacttcctgtccagctcca

SEQ ID NO: 3684526 - DNA, 15 bp, Homo sapiens
caaggactttgcagc

SEQ ID NO: 3684527 - DNA, 13 bp, Homo sapiens
caaggagctgcta

SEQ ID NO: 3684528 - DNA, 22 bp, Homo sapiens
caaggagctgctatagcctggg

SEQ ID NO: 3684529 - DNA, 21 bp, Homo sapiens
caaggatagatgctggcccag

SEQ ID NO: 3684530 - DNA, 23 bp, Homo sapiens
caaggatagatgctggcccaggg

SEQ ID NO: 3684531 - DNA, 20 bp, Homo sapiens
caaggccagagtggcctggc

SEQ ID NO: 3684532 - DNA, 17 bp, Homo sapiens
caaggctgcagtgagcc

SEQ ID NO: 3684533 - DNA, 22 bp, Homo sapiens
caaggctgcagtgagccgagat

SEQ ID NO: 3684534 - DNA, 21 bp, Homo sapiens
caaggctgggggaagaagctc

SEQ ID NO: 3684535 - DNA, 15 bp, Homo sapiens
caagggaacctgtgt

SEQ ID NO: 3684536 - DNA, 13 bp, Homo sapiens
caagggaccttca

SEQ ID NO: 3684537 - DNA, 23 bp, Homo sapiens
caaggtgggaggattgcttgagc

SEQ ID NO: 3684538 - DNA, 21 bp, Homo sapiens
caaggtgtggaggctcctgtg

SEQ ID NO: 3684539 - DNA, 17 bp, Homo sapiens
caagtcaagtgaaaaag

SEQ ID NO: 3684540 - DNA, 15 bp, Homo sapiens
caagtcagctccagc

SEQ ID NO: 3684541 - DNA, 14 bp, Homo sapiens
caagtctcagaaga

SEQ ID NO: 3684542 - DNA, 15 bp, Homo sapiens
caagtctcagaagag

SEQ ID NO: 3684543 - DNA, 14 bp, Homo sapiens
caagtctgtttact

SEQ ID NO: 3684544 - DNA, 20 bp, Homo sapiens
caagtctgtttactgcaagg

SEQ ID NO: 3684545 - DNA, 19 bp, Homo sapiens
caagtgaaaaaggaggaag

SEQ ID NO: 3684546 - DNA, 19 bp, Homo sapiens
caagtgagaccctgtctca

SEQ ID NO: 3684547 - DNA, 17 bp, Homo sapiens
caagtgatgtgtttaca

SEQ ID NO: 3684548 - DNA, 17 bp, Homo sapiens
caagtgccgcaaattgt

SEQ ID NO: 3684549 - DNA, 20 bp, Homo sapiens
caagtgcctagactgttact

SEQ ID NO: 3684550 - DNA, 14 bp, Homo sapiens
caagtgctgaacag

SEQ ID NO: 3684551 - DNA, 17 bp, Homo sapiens
caagtgctgaacagtgg

SEQ ID NO: 3684552 - DNA, 18 bp, Homo sapiens
caagtggtggtaaccctg

SEQ ID NO: 3684553 - DNA, 19 bp, Homo sapiens
caagtggtggtaaccctgg

SEQ ID NO: 3684554 - DNA, 22 bp, Homo sapiens
caagtgtggtagagtgtgcctg

SEQ ID NO: 3684555 - DNA, 15 bp, Homo sapiens
caagtgttcactgct

SEQ ID NO: 3684556 - DNA, 23 bp, Homo sapiens
caagtgttcactgctccttgctg

SEQ ID NO: 3684557 - DNA, 17 bp, Homo sapiens
caataaatctgacccag

SEQ ID NO: 3684558 - DNA, 14 bp, Homo sapiens
caataatatttcaa

SEQ ID NO: 3684559 - DNA, 19 bp, Homo sapiens
caataatatttcaagtgcc

SEQ ID NO: 3684560 - DNA, 20 bp, Homo sapiens
caataatatttcaagtgcct

SEQ ID NO: 3684561 - DNA, 15 bp, Homo sapiens
caatagatctccagc

SEQ ID NO: 3684562 - DNA, 21 bp, Homo sapiens
caatataatctttgaatttct

SEQ ID NO: 3684563 - DNA, 12 bp, Homo sapiens
caatatagcaag

SEQ ID NO: 3684564 - DNA, 13 bp, Homo sapiens
caatatagcaaga

SEQ ID NO: 3684565 - DNA, 19 bp, Homo sapiens
caatattcaatcaaaattt

SEQ ID NO: 3684566 - DNA, 13 bp, Homo sapiens
caatattttccat

SEQ ID NO: 3684567 - DNA, 15 bp, Homo sapiens
caatattttccatga

SEQ ID NO: 3684568 - DNA, 22 bp, Homo sapiens
caatcacagtctcagttctctt

SEQ ID NO: 3684569 - DNA, 13 bp, Homo sapiens
caatcccagttct

SEQ ID NO: 3684570 - DNA, 19 bp, Homo sapiens
caatcccagttcttcctgc

SEQ ID NO: 3684571 - DNA, 21 bp, Homo sapiens
caatctaacaataatatttca

SEQ ID NO: 3684572 - DNA, 23 bp, Homo sapiens
caatggaaattcccgtgttgctt

SEQ ID NO: 3684573 - DNA, 16 bp, Homo sapiens
caatgggaagcaggga

SEQ ID NO: 3684574 - DNA, 17 bp, Homo sapiens
caatgggacctgtggct

SEQ ID NO: 3684575 - DNA, 13 bp, Homo sapiens
caatggggcgggg

SEQ ID NO: 3684576 - DNA, 17 bp, Homo sapiens
caatggggcggggcttc

SEQ ID NO: 3684577 - DNA, 20 bp, Homo sapiens
caatggtgttatttgaaact

SEQ ID NO: 3684578 - DNA, 21 bp, Homo sapiens
caatggtgttatttgaaactt

SEQ ID NO: 3684579 - DNA, 17 bp, Homo sapiens
caatgtaagcatacttt

SEQ ID NO: 3684580 - DNA, 21 bp, Homo sapiens
caatgtcatatactgccatgt

SEQ ID NO: 3684581 - DNA, 15 bp, Homo sapiens
caatgtgataaaacc

SEQ ID NO: 3684582 - DNA, 19 bp, Homo sapiens
caatgtgtggctgaagact

SEQ ID NO: 3684583 - DNA, 14 bp, Homo sapiens
caatgttctctctt

SEQ ID NO: 3684584 - DNA, 14 bp, Homo sapiens
caattctgttttta

SEQ ID NO: 3684585 - DNA, 22 bp, Homo sapiens
caattgactgccctcttactgt

SEQ ID NO: 3684586 - DNA, 13 bp, Homo sapiens
caatttcctggcc

SEQ ID NO: 3684587 - DNA, 15 bp, Homo sapiens
caatttctgtgttgc

SEQ ID NO: 3684588 - DNA, 23 bp, Homo sapiens
caatttgcacatcttggctatgt

SEQ ID NO: 3684589 - DNA, 19 bp, Homo sapiens
caattttaatttagtaaat

SEQ ID NO: 3684590 - DNA, 21 bp, Homo sapiens
caattttaatttagtaaatgt

SEQ ID NO: 3684591 - DNA, 22 bp, Homo sapiens
caattttaatttagtaaatgtt

SEQ ID NO: 3684592 - DNA, 17 bp, Homo sapiens
cacaaaccttctgcctt

SEQ ID NO: 3684593 - DNA, 17 bp, Homo sapiens
cacaaacgggctcagca

SEQ ID NO: 3684594 - DNA, 13 bp, Homo sapiens
cacaaaggagagc

SEQ ID NO: 3684595 - DNA, 17 bp, Homo sapiens
cacaaaggcatgctgga

SEQ ID NO: 3684596 - DNA, 19 bp, Homo sapiens
cacaacaaacctattgtag

SEQ ID NO: 3684597 - DNA, 20 bp, Homo sapiens
cacaagaaggggtgtttatt

SEQ ID NO: 3684598 - DNA, 19 bp, Homo sapiens
cacaagcctgagaactgaa

SEQ ID NO: 3684599 - DNA, 17 bp, Homo sapiens
cacaagctgcaccctca

SEQ ID NO: 3684600 - DNA, 18 bp, Homo sapiens
cacaaggatagatgctgg

SEQ ID NO: 3684601 - DNA, 21 bp, Homo sapiens
cacaagtcctggatgttgtgt

SEQ ID NO: 3684602 - DNA, 21 bp, Homo sapiens
cacaagtgccgcaaattgtac

SEQ ID NO: 3684603 - DNA, 13 bp, Homo sapiens
cacaagtggtggt

SEQ ID NO: 3684604 - DNA, 13 bp, Homo sapiens
cacaatctgagca

SEQ ID NO: 3684605 - DNA, 17 bp, Homo sapiens
cacaatggtttttaaat

SEQ ID NO: 3684606 - DNA, 22 bp, Homo sapiens
cacaatggtttttaaattttgt

SEQ ID NO: 3684607 - DNA, 19 bp, Homo sapiens
cacacaaggatagatgctg

SEQ ID NO: 3684608 - DNA, 14 bp, Homo sapiens
cacacacaaacctt

SEQ ID NO: 3684609 - DNA, 12 bp, Homo sapiens
cacacacacaca

SEQ ID NO: 3684610 - DNA, 15 bp, Homo sapiens
cacacacacacacaa

SEQ ID NO: 3684611 - DNA, 16 bp, Homo sapiens
cacacacacacacaca

SEQ ID NO: 3684612 - DNA, 22 bp, Homo sapiens
cacacagacccctcgcaactgt

SEQ ID NO: 3684613 - DNA, 17 bp, Homo sapiens
cacacagatacacacac

SEQ ID NO: 3684614 - DNA, 22 bp, Homo sapiens
cacacccaaagctgagcctgca

SEQ ID NO: 3684615 - DNA, 18 bp, Homo sapiens
cagagccttcaagtgcca

SEQ ID NO: 3684616 - DNA, 21 bp, Homo sapiens
cagagcggatgggcacacaca

SEQ ID NO: 3684617 - DNA, 21 bp, Homo sapiens
cagagctgtttatggcctcag

SEQ ID NO: 3684618 - DNA, 16 bp, Homo sapiens
cagagcttctcctgac

SEQ ID NO: 3684619 - DNA, 20 bp, Homo sapiens
cagagcttctcctgaccagg

SEQ ID NO: 3684620 - DNA, 17 bp, Homo sapiens
cagagctttggtctgtg

SEQ ID NO: 3684621 - DNA, 15 bp, Homo sapiens
cagaggaccagggcc

SEQ ID NO: 3684622 - DNA, 20 bp, Homo sapiens
cagaggaggggccgctgcca

SEQ ID NO: 3684623 - DNA, 17 bp, Homo sapiens
cagaggcccccagccca

SEQ ID NO: 3684624 - DNA, 24 bp, Homo sapiens
cagaggcccccagcccagggctcc

SEQ ID NO: 3684625 - DNA, 15 bp, Homo sapiens
cagagggagtagaat

SEQ ID NO: 3684626 - DNA, 14 bp, Homo sapiens
cagaggtaccctgg

SEQ ID NO: 3684627 - DNA, 17 bp, Homo sapiens
cagaggttgcagtgtgg

SEQ ID NO: 3684628 - DNA, 15 bp, Homo sapiens
cagagtcggaacgga

SEQ ID NO: 3684629 - DNA, 18 bp, Homo sapiens
cagagtcggaacggagaa

SEQ ID NO: 3684630 - DNA, 22 bp, Homo sapiens
cagagtgacacccaagagggct

SEQ ID NO: 3684631 - DNA, 14 bp, Homo sapiens
cagagtgccactgc

SEQ ID NO: 3684632 - DNA, 15 bp, Homo sapiens
cagagtgccactgcg

SEQ ID NO: 3684633 - DNA, 12 bp, Homo sapiens
cagagtggcctg

SEQ ID NO: 3684634 - DNA, 16 bp, Homo sapiens
cagagtggcctggcca

SEQ ID NO: 3684635 - DNA, 18 bp, Homo sapiens
cagagtggcctggccagg

SEQ ID NO: 3684636 - DNA, 21 bp, Homo sapiens
cagagtggcctggccaggagc

SEQ ID NO: 3684637 - DNA, 14 bp, Homo sapiens
cagatacacacaca

SEQ ID NO: 3684638 - DNA, 17 bp, Homo sapiens
cagatcaaagtatgtat

SEQ ID NO: 3684639 - DNA, 13 bp, Homo sapiens
cagatccaggact

SEQ ID NO: 3684640 - DNA, 15 bp, Homo sapiens
cagatccagggacag

SEQ ID NO: 3684641 - DNA, 21 bp, Homo sapiens
cagatctggaacctcagcctg

SEQ ID NO: 3684642 - DNA, 18 bp, Homo sapiens
cagatctgtgccccatgc

SEQ ID NO: 3684643 - DNA, 16 bp, Homo sapiens
cagatgaggctttcca

SEQ ID NO: 3684644 - DNA, 17 bp, Homo sapiens
cagatgcaaagaggcaa

SEQ ID NO: 3684645 - DNA, 15 bp, Homo sapiens
cagatgccccagagc

SEQ ID NO: 3684646 - DNA, 16 bp, Homo sapiens
cagatgccccagagct

SEQ ID NO: 3684647 - DNA, 18 bp, Homo sapiens
cagatggaaaaactgagg

SEQ ID NO: 3684648 - DNA, 19 bp, Homo sapiens
cagatggaaccgcaggaag

SEQ ID NO: 3684649 - DNA, 12 bp, Homo sapiens
cagatgtaatgt

SEQ ID NO: 3684650 - DNA, 16 bp, Homo sapiens
cagatgtaatgttttc

SEQ ID NO: 3684651 - DNA, 14 bp, Homo sapiens
cagatgtgaaccat

SEQ ID NO: 3684652 - DNA, 17 bp, Homo sapiens
cagatgtgaaccattaa

SEQ ID NO: 3684653 - DNA, 21 bp, Homo sapiens
cagattgggcggggcttctct

SEQ ID NO: 3684654 - DNA, 14 bp, Homo sapiens
cagatttgtctttt

SEQ ID NO: 3684655 - DNA, 24 bp, Homo sapiens
cagatttgtctttttgttgtaaaa

SEQ ID NO: 3684656 - DNA, 18 bp, Homo sapiens
cagcaaaagatgcttctc

SEQ ID NO: 3684657 - DNA, 24 bp, Homo sapiens
cagcaaaccatttttaaagtagaa

SEQ ID NO: 3684658 - DNA, 14 bp, Homo sapiens
cagcaaattttcag

SEQ ID NO: 3684659 - DNA, 21 bp, Homo sapiens
cagcaaggtgtggaggctcct

SEQ ID NO: 3684660 - DNA, 20 bp, Homo sapiens
cagcacagcttgacctgagg

SEQ ID NO: 3684661 - DNA, 21 bp, Homo sapiens
cagcacagcttgacctgaggc

SEQ ID NO: 3684662 - DNA, 21 bp, Homo sapiens
cagcaccaccctagtcccttc

SEQ ID NO: 3684663 - DNA, 22 bp, Homo sapiens
cagcaccaccctagtcccttcc

SEQ ID NO: 3684664 - DNA, 17 bp, Homo sapiens
cagcaccgaggggcctt

SEQ ID NO: 3684665 - DNA, 15 bp, Homo sapiens
cagcaccttgtgcct

SEQ ID NO: 3684666 - DNA, 12 bp, Homo sapiens
cagcactgtccc

SEQ ID NO: 3684667 - DNA, 15 bp, Homo sapiens
cagcacttcaaagaa

SEQ ID NO: 3684668 - DNA, 14 bp, Homo sapiens
cagcagaggacagt

SEQ ID NO: 3684669 - DNA, 23 bp, Homo sapiens
cagcagaggacagtctggagaag

SEQ ID NO: 3684670 - DNA, 12 bp, Homo sapiens
cagcagcctgga

SEQ ID NO: 3684671 - DNA, 14 bp, Homo sapiens
cagcagcctggacc

SEQ ID NO: 3684672 - DNA, 22 bp, Homo sapiens
cagcagcctggaccctgtggat

SEQ ID NO: 3684673 - DNA, 21 bp, Homo sapiens
cagcagggatgccctggaggt

SEQ ID NO: 3684674 - DNA, 13 bp, Homo sapiens
cagcatcagggtt

SEQ ID NO: 3684675 - DNA, 16 bp, Homo sapiens
cagcattccagcccct

SEQ ID NO: 3684676 - DNA, 18 bp, Homo sapiens
cagcatttagctggccac

SEQ ID NO: 3684677 - DNA, 21 bp, Homo sapiens
cagcatttagctggccacatg

SEQ ID NO: 3684678 - DNA, 21 bp, Homo sapiens
cagccaaagcctcctccagcc

SEQ ID NO: 3684679 - DNA, 21 bp, Homo sapiens
cagccaccccgggctctctgc

SEQ ID NO: 3684680 - DNA, 22 bp, Homo sapiens
cagccaccccgggctctctgct

SEQ ID NO: 3684681 - DNA, 11 bp, Homo sapiens
cagccaggagc

SEQ ID NO: 3684682 - DNA, 20 bp, Homo sapiens
cagccagtgacctgaggaag

SEQ ID NO: 3684683 - DNA, 22 bp, Homo sapiens
cagccagtgacctgaggaagcg

SEQ ID NO: 3684684 - DNA, 17 bp, Homo sapiens
cagccatgtctgcattt

SEQ ID NO: 3684685 - DNA, 13 bp, Homo sapiens
cagcccagacagc

SEQ ID NO: 3684686 - DNA, 12 bp, Homo sapiens
cagcccagagac

SEQ ID NO: 3684687 - DNA, 16 bp, Homo sapiens
cagcccagggctcctg

SEQ ID NO: 3684688 - DNA, 18 bp, Homo sapiens
cagcccagggctcctgca

SEQ ID NO: 3684689 - DNA, 21 bp, Homo sapiens
cagcccatgcccacctgccca

SEQ ID NO: 3684690 - DNA, 13 bp, Homo sapiens
cagccccacccag

SEQ ID NO: 3684691 - DNA, 15 bp, Homo sapiens
cagccccccaggctg

SEQ ID NO: 3684692 - DNA, 17 bp, Homo sapiens
cagccccccaggctgcc

SEQ ID NO: 3684693 - DNA, 22 bp, Homo sapiens
cagccccccaggctgcccagag

SEQ ID NO: 3684694 - DNA, 23 bp, Homo sapiens
cagccccccaggctgcccagagc

SEQ ID NO: 3684695 - DNA, 22 bp, Homo sapiens
cagccctgaggtgaaagggagc

SEQ ID NO: 3684696 - DNA, 17 bp, Homo sapiens
cagccgccattgccacc

SEQ ID NO: 3684697 - DNA, 22 bp, Homo sapiens
cagccgccattgccaccaggag

SEQ ID NO: 3684698 - DNA, 13 bp, Homo sapiens
cagccggcacagg

SEQ ID NO: 3684699 - DNA, 17 bp, Homo sapiens
cagccggcacagggtct

SEQ ID NO: 3684700 - DNA, 15 bp, Homo sapiens
cagccgggggctggc

SEQ ID NO: 3684701 - DNA, 17 bp, Homo sapiens
cagccgtgagcatgttt

SEQ ID NO: 3684702 - DNA, 16 bp, Homo sapiens
cagcctctccccaggt

SEQ ID NO: 3684703 - DNA, 20 bp, Homo sapiens
cagcctctccccaggtccag

SEQ ID NO: 3684704 - DNA, 17 bp, Homo sapiens
cagcctcttctgtccca

SEQ ID NO: 3684705 - DNA, 20 bp, Homo sapiens
cagcctcttctgtcccaagt

SEQ ID NO: 3684706 - DNA, 16 bp, Homo sapiens
cagcctgctccagctg

SEQ ID NO: 3684707 - DNA, 19 bp, Homo sapiens
cagcctggaccctgtggat

SEQ ID NO: 3684708 - DNA, 13 bp, Homo sapiens
cagcctggcatca

SEQ ID NO: 3684709 - DNA, 14 bp, Homo sapiens
cagcctggcatcag

SEQ ID NO: 3684710 - DNA, 20 bp, Homo sapiens
cagcctggccaacatgctga

SEQ ID NO: 3684711 - DNA, 17 bp, Homo sapiens
cagcctggccagacaca

SEQ ID NO: 3684712 - DNA, 20 bp, Homo sapiens
cagcctgggcagccaggctg

SEQ ID NO: 3684713 - DNA, 23 bp, Homo sapiens
cagcctggggtttgaccacccac

SEQ ID NO: 3684714 - DNA, 14 bp, Homo sapiens
cagcctggtggccc

SEQ ID NO: 3684715 - DNA, 17 bp, Homo sapiens
cagcctggtggcccagc

SEQ ID NO: 3684716 - DNA, 12 bp, Homo sapiens
cagcctgtggca

SEQ ID NO: 3684717 - DNA, 15 bp, Homo sapiens
cagcctgtggcatct

SEQ ID NO: 3684718 - DNA, 19 bp, Homo sapiens
cagcctgtggcatctttgc

SEQ ID NO: 3684719 - DNA, 23 bp, Homo sapiens
cagcctgtgtctttaaatgctgc

SEQ ID NO: 3684720 - DNA, 23 bp, Homo sapiens
cagccttcagacagagaggactg

SEQ ID NO: 3684721 - DNA, 14 bp, Homo sapiens
cagccttgccagag

SEQ ID NO: 3684722 - DNA, 16 bp, Homo sapiens
cagccttgccagagat

SEQ ID NO: 3684723 - DNA, 21 bp, Homo sapiens
cagccttggtgggggagcctc

SEQ ID NO: 3684724 - DNA, 22 bp, Homo sapiens
cagcctttgatcaggtggggag

SEQ ID NO: 3684725 - DNA, 21 bp, Homo sapiens
cagcgactccgttggccactc

SEQ ID NO: 3684726 - DNA, 14 bp, Homo sapiens
cagcgcccctcagc

SEQ ID NO: 3684727 - DNA, 20 bp, Homo sapiens
cagcgcccctcagcctctgc

SEQ ID NO: 3684728 - DNA, 13 bp, Homo sapiens
cagcgcctttccc

SEQ ID NO: 3684729 - DNA, 22 bp, Homo sapiens
cagcgtgggaactcactttccc

SEQ ID NO: 3684730 - DNA, 18 bp, Homo sapiens
cagctaaattttctgaaa

SEQ ID NO: 3684731 - DNA, 13 bp, Homo sapiens
cagggcccagagc

SEQ ID NO: 3684732 - DNA, 16 bp, Homo sapiens
cagggcccagagccca

SEQ ID NO: 3684733 - DNA, 19 bp, Homo sapiens
cagggcccagagcccagct

SEQ ID NO: 3684734 - DNA, 15 bp, Homo sapiens
cagggccttaaaatt

SEQ ID NO: 3684735 - DNA, 16 bp, Homo sapiens
cagggctcctccctgg

SEQ ID NO: 3684736 - DNA, 17 bp, Homo sapiens
cagggctcctccctgga

SEQ ID NO: 3684737 - DNA, 20 bp, Homo sapiens
cagggctcctccctggagct

SEQ ID NO: 3684738 - DNA, 12 bp, Homo sapiens
cagggctcctgc

SEQ ID NO: 3684739 - DNA, 14 bp, Homo sapiens
cagggcttctcctg

SEQ ID NO: 3684740 - DNA, 20 bp, Homo sapiens
caggggaaaatcagcctgct

SEQ ID NO: 3684741 - DNA, 22 bp, Homo sapiens
caggggacaggagtccactttg

SEQ ID NO: 3684742 - DNA, 18 bp, Homo sapiens
caggggactcagccctga

SEQ ID NO: 3684743 - DNA, 17 bp, Homo sapiens
caggggccctacctggg

SEQ ID NO: 3684744 - DNA, 14 bp, Homo sapiens
caggggcctggaga

SEQ ID NO: 3684745 - DNA, 13 bp, Homo sapiens
caggggctgcttc

SEQ ID NO: 3684746 - DNA, 16 bp, Homo sapiens
caggggctgcttcctc

SEQ ID NO: 3684747 - DNA, 20 bp, Homo sapiens
caggggctgcttcctcctgg

SEQ ID NO: 3684748 - DNA, 13 bp, Homo sapiens
caggggtcagtgc

SEQ ID NO: 3684749 - DNA, 14 bp, Homo sapiens
caggggtcagtgca

SEQ ID NO: 3684750 - DNA, 15 bp, Homo sapiens
caggggtcagtgcag

SEQ ID NO: 3684751 - DNA, 18 bp, Homo sapiens
caggggtcccagccaccc

SEQ ID NO: 3684752 - DNA, 20 bp, Homo sapiens
caggggtcccagccaccccg

SEQ ID NO: 3684753 - DNA, 14 bp, Homo sapiens
cagggtctgctctt

SEQ ID NO: 3684754 - DNA, 21 bp, Homo sapiens
cagggtctgctctttctctgc

SEQ ID NO: 3684755 - DNA, 21 bp, Homo sapiens
cagggtcttccctacctcagg

SEQ ID NO: 3684756 - DNA, 13 bp, Homo sapiens
cagggtgggcctc

SEQ ID NO: 3684757 - DNA, 21 bp, Homo sapiens
cagggtgtgggatctgaggag

SEQ ID NO: 3684758 - DNA, 13 bp, Homo sapiens
cagggttgggccc

SEQ ID NO: 3684759 - DNA, 15 bp, Homo sapiens
cagggttgggcccag

SEQ ID NO: 3684760 - DNA, 13 bp, Homo sapiens
caggtactcctgc

SEQ ID NO: 3684761 - DNA, 21 bp, Homo sapiens
caggtacttgtaaattattaa

SEQ ID NO: 3684762 - DNA, 23 bp, Homo sapiens
caggtagctgcccctggctctga

SEQ ID NO: 3684763 - DNA, 21 bp, Homo sapiens
caggtattttcatcaagtagc

SEQ ID NO: 3684764 - DNA, 16 bp, Homo sapiens
caggtccagctctgga

SEQ ID NO: 3684765 - DNA, 23 bp, Homo sapiens
caggtccagctctggaggggagg

SEQ ID NO: 3684766 - DNA, 19 bp, Homo sapiens
caggtccagctctgtgggc

SEQ ID NO: 3684767 - DNA, 13 bp, Homo sapiens
caggtccaggctg

SEQ ID NO: 3684768 - DNA, 16 bp, Homo sapiens
caggtccaggctgtgt

SEQ ID NO: 3684769 - DNA, 13 bp, Homo sapiens
caggtctttccta

SEQ ID NO: 3684770 - DNA, 14 bp, Homo sapiens
caggtctttcctaa

SEQ ID NO: 3684771 - DNA, 19 bp, Homo sapiens
caggtctttcctaaggctg

SEQ ID NO: 3684772 - DNA, 13 bp, Homo sapiens
caggtgagaagca

SEQ ID NO: 3684773 - DNA, 20 bp, Homo sapiens
caggtgagaagcagaggaag

SEQ ID NO: 3684774 - DNA, 21 bp, Homo sapiens
caggtgagaagcagaggaagg

SEQ ID NO: 3684775 - DNA, 13 bp, Homo sapiens
caggtgcagaggt

SEQ ID NO: 3684776 - DNA, 23 bp, Homo sapiens
caggtgcagaggtaccctgggtg

SEQ ID NO: 3684777 - DNA, 13 bp, Homo sapiens
caggtgcatttct

SEQ ID NO: 3684778 - DNA, 13 bp, Homo sapiens
caggtgcccctct

SEQ ID NO: 3684779 - DNA, 14 bp, Homo sapiens
caggtgcgaaagga

SEQ ID NO: 3684780 - DNA, 23 bp, Homo sapiens
caggtgctcccctgacagtccct

SEQ ID NO: 3684781 - DNA, 18 bp, Homo sapiens
caggtggttatggagagg

SEQ ID NO: 3684782 - DNA, 17 bp, Homo sapiens
caggtgtgagccactgc

SEQ ID NO: 3684783 - DNA, 15 bp, Homo sapiens
caggtgtgcccctcc

SEQ ID NO: 3684784 - DNA, 14 bp, Homo sapiens
caggtgtttttcca

SEQ ID NO: 3684785 - DNA, 17 bp, Homo sapiens
caggttcaacccacagc

SEQ ID NO: 3684786 - DNA, 19 bp, Homo sapiens
caggttcaacccacagcta

SEQ ID NO: 3684787 - DNA, 14 bp, Homo sapiens
caggttggtggggg

SEQ ID NO: 3684788 - DNA, 14 bp, Homo sapiens
caggtttaagctgt

SEQ ID NO: 3684789 - DNA, 18 bp, Homo sapiens
cagtaacgcgtcttcctg

SEQ ID NO: 3684790 - DNA, 22 bp, Homo sapiens
cagtaagggcgtggctctgggt

SEQ ID NO: 3684791 - DNA, 19 bp, Homo sapiens
cagtacaggcagcacagag

SEQ ID NO: 3684792 - DNA, 20 bp, Homo sapiens
cagtacaggcagcacagaga

SEQ ID NO: 3684793 - DNA, 17 bp, Homo sapiens
cagtactcctccctggg

SEQ ID NO: 3684794 - DNA, 15 bp, Homo sapiens
cagtacttttttaaa

SEQ ID NO: 3684795 - DNA, 22 bp, Homo sapiens
cagtagaactccaggccctcct

SEQ ID NO: 3684796 - DNA, 12 bp, Homo sapiens
cagtagagaaca

SEQ ID NO: 3684797 - DNA, 17 bp, Homo sapiens
cagtagggtttgacatt

SEQ ID NO: 3684798 - DNA, 24 bp, Homo sapiens
cagtatccatgctcttgaccttgt

SEQ ID NO: 3684799 - DNA, 15 bp, Homo sapiens
cagtcaacaagcctg

SEQ ID NO: 3684800 - DNA, 17 bp, Homo sapiens
cagtcacaacagagtga

SEQ ID NO: 3684801 - DNA, 22 bp, Homo sapiens
cagtcatcttgaccaagcagga

SEQ ID NO: 3684802 - DNA, 24 bp, Homo sapiens
cagtcatcttgaccaagcaggaag

SEQ ID NO: 3684803 - DNA, 22 bp, Homo sapiens
cagtcatggagaaccacctacc

SEQ ID NO: 3684804 - DNA, 17 bp, Homo sapiens
cagtccaaatgtcctcc

SEQ ID NO: 3684805 - DNA, 21 bp, Homo sapiens
cagtccaaatgtcctccagaa

SEQ ID NO: 3684806 - DNA, 23 bp, Homo sapiens
cagtccaaatgtcctccagaagc

SEQ ID NO: 3684807 - DNA, 20 bp, Homo sapiens
cagtccccccaccctcattc

SEQ ID NO: 3684808 - DNA, 17 bp, Homo sapiens
cagtcctgcctggccag

SEQ ID NO: 3684809 - DNA, 18 bp, Homo sapiens
cagtcctgcctggccagg

SEQ ID NO: 3684810 - DNA, 19 bp, Homo sapiens
cagtcctggttgtctgaac

SEQ ID NO: 3684811 - DNA, 19 bp, Homo sapiens
cagtctcagttctcttgct

SEQ ID NO: 3684812 - DNA, 15 bp, Homo sapiens
cagtctggagaaggt

SEQ ID NO: 3684813 - DNA, 13 bp, Homo sapiens
cagtcttgcctag

SEQ ID NO: 3684814 - DNA, 16 bp, Homo sapiens
cagtgaagatttacct

SEQ ID NO: 3684815 - DNA, 18 bp, Homo sapiens
cagtgacacccagaggga

SEQ ID NO: 3684816 - DNA, 15 bp, Homo sapiens
cagtgacagacaggc

SEQ ID NO: 3684817 - DNA, 18 bp, Homo sapiens
cagtgaggatgacagtga

SEQ ID NO: 3684818 - DNA, 20 bp, Homo sapiens
cagtgatgctggatgctcct

SEQ ID NO: 3684819 - DNA, 19 bp, Homo sapiens
cagtgatgtatacatctta

SEQ ID NO: 3684820 - DNA, 14 bp, Homo sapiens
cagtgcagaatgta

SEQ ID NO: 3684821 - DNA, 14 bp, Homo sapiens
cagtgcatggtggc

SEQ ID NO: 3684822 - DNA, 15 bp, Homo sapiens
cagtgcatggtggcc

SEQ ID NO: 3684823 - DNA, 20 bp, Homo sapiens
cagtgcatggtggccagagg

SEQ ID NO: 3684824 - DNA, 23 bp, Homo sapiens
cagtgcccccactgaccagaact

SEQ ID NO: 3684825 - DNA, 24 bp, Homo sapiens
cagtgcgcgtgcacgtggagagct

SEQ ID NO: 3684826 - DNA, 16 bp, Homo sapiens
cagtgctgtgctgtgc

SEQ ID NO: 3684827 - DNA, 16 bp, Homo sapiens
cagtgctgttgaagat

SEQ ID NO: 3684828 - DNA, 16 bp, Homo sapiens
cagtggacagtgctgt

SEQ ID NO: 3684829 - DNA, 17 bp, Homo sapiens
cagtggacagtgctgtt

SEQ ID NO: 3684830 - DNA, 23 bp, Homo sapiens
cagtggagctgaattttctggaa

SEQ ID NO: 3684831 - DNA, 20 bp, Homo sapiens
cagtggcgcattctaggctc

SEQ ID NO: 3684832 - DNA, 20 bp, Homo sapiens
cagtggctggtccagggcta

SEQ ID NO: 3684833 - DNA, 15 bp, Homo sapiens
cagtgggaactggag

SEQ ID NO: 3684834 - DNA, 17 bp, Homo sapiens
cagtgggaactggaggg

SEQ ID NO: 3684835 - DNA, 13 bp, Homo sapiens
cagtgggagccag

SEQ ID NO: 3684836 - DNA, 17 bp, Homo sapiens
cagtgggagccagggct

SEQ ID NO: 3684837 - DNA, 15 bp, Homo sapiens
cagtgtgcactaagg

SEQ ID NO: 3684838 - DNA, 20 bp, Homo sapiens
cagtgtggggagggcaggtc

SEQ ID NO: 3684839 - DNA, 19 bp, Homo sapiens
cagttaagacaacaggcat

SEQ ID NO: 3684840 - DNA, 17 bp, Homo sapiens
cagttcagcaccaccct

SEQ ID NO: 3684841 - DNA, 15 bp, Homo sapiens
cagttcccttggcct

SEQ ID NO: 3684842 - DNA, 19 bp, Homo sapiens
cagttcccttggcctcaga

SEQ ID NO: 3684843 - DNA, 16 bp, Homo sapiens
cagttctcttgctttc

SEQ ID NO: 3684844 - DNA, 17 bp, Homo sapiens
cagttctgggtgctccc

SEQ ID NO: 3684845 - DNA, 18 bp, Homo sapiens
cagttctgtcatatgtta

SEQ ID NO: 3684846 - DNA, 17 bp, Homo sapiens
cagttctttgggccaga

SEQ ID NO: 3684847 - DNA, 20 bp, Homo sapiens
catgggtatagttcatgtct

SEQ ID NO: 3684848 - DNA, 19 bp, Homo sapiens
catgggtgtggatggcagt

SEQ ID NO: 3684849 - DNA, 22 bp, Homo sapiens
catgggtgtggatggcagtgtg

SEQ ID NO: 3684850 - DNA, 19 bp, Homo sapiens
catggtcctttctggaagt

SEQ ID NO: 3684851 - DNA, 19 bp, Homo sapiens
catggtgccccaggaccag

SEQ ID NO: 3684852 - DNA, 20 bp, Homo sapiens
catggtgccccaggaccagc

SEQ ID NO: 3684853 - DNA, 22 bp, Homo sapiens
catggtgccccaggaccagctc

SEQ ID NO: 3684854 - DNA, 18 bp, Homo sapiens
catgtaactatttcttca

SEQ ID NO: 3684855 - DNA, 13 bp, Homo sapiens
catgtacttgttt

SEQ ID NO: 3684856 - DNA, 22 bp, Homo sapiens
catgtactttttagtaatttct

SEQ ID NO: 3684857 - DNA, 19 bp, Homo sapiens
catgtccagcaccttgtgc

SEQ ID NO: 3684858 - DNA, 20 bp, Homo sapiens
catgtccagcaccttgtgcc

SEQ ID NO: 3684859 - DNA, 18 bp, Homo sapiens
catgtcttatcttgtttc

SEQ ID NO: 3684860 - DNA, 15 bp, Homo sapiens
catgtgcatagtttc

SEQ ID NO: 3684861 - DNA, 16 bp, Homo sapiens
catgtgcatagtttct

SEQ ID NO: 3684862 - DNA, 15 bp, Homo sapiens
catgtggggccaggt

SEQ ID NO: 3684863 - DNA, 20 bp, Homo sapiens
catgttactacagaggaaag

SEQ ID NO: 3684864 - DNA, 16 bp, Homo sapiens
catgttagcccttcct

SEQ ID NO: 3684865 - DNA, 17 bp, Homo sapiens
catgttgatcatgtact

SEQ ID NO: 3684866 - DNA, 13 bp, Homo sapiens
catgtttataaat

SEQ ID NO: 3684867 - DNA, 21 bp, Homo sapiens
catgtttcctctagttctttg

SEQ ID NO: 3684868 - DNA, 15 bp, Homo sapiens
catgttttcaactgc

SEQ ID NO: 3684869 - DNA, 18 bp, Homo sapiens
catgtttttaaagggcta

SEQ ID NO: 3684870 - DNA, 22 bp, Homo sapiens
cattaatgtgaagcaaaacaca

SEQ ID NO: 3684871 - DNA, 22 bp, Homo sapiens
cattaggtagatgagaaaacag

SEQ ID NO: 3684872 - DNA, 19 bp, Homo sapiens
cattattttttaatgttta

SEQ ID NO: 3684873 - DNA, 19 bp, Homo sapiens
cattcagcagcaaattttc

SEQ ID NO: 3684874 - DNA, 16 bp, Homo sapiens
cattcatcctgaccaa

SEQ ID NO: 3684875 - DNA, 21 bp, Homo sapiens
cattccaactcgtatagcatg

SEQ ID NO: 3684876 - DNA, 13 bp, Homo sapiens
cattccagcccct

SEQ ID NO: 3684877 - DNA, 18 bp, Homo sapiens
cattccagcccctctggt

SEQ ID NO: 3684878 - DNA, 19 bp, Homo sapiens
cattccagcccctctggtc

SEQ ID NO: 3684879 - DNA, 17 bp, Homo sapiens
cattctcaagccctgca

SEQ ID NO: 3684880 - DNA, 15 bp, Homo sapiens
cattctccttgttgt

SEQ ID NO: 3684881 - DNA, 19 bp, Homo sapiens
cattctgactcggtttctc

SEQ ID NO: 3684882 - DNA, 21 bp, Homo sapiens
cattctgactcggtttctcca

SEQ ID NO: 3684883 - DNA, 18 bp, Homo sapiens
cattcttaacaaactctt

SEQ ID NO: 3684884 - DNA, 19 bp, Homo sapiens
cattcttggcttaatcatt

SEQ ID NO: 3684885 - DNA, 17 bp, Homo sapiens
cattctttagagatgct

SEQ ID NO: 3684886 - DNA, 13 bp, Homo sapiens
cattgagctgcct

SEQ ID NO: 3684887 - DNA, 19 bp, Homo sapiens
cattgatgatcactgtgaa

SEQ ID NO: 3684888 - DNA, 14 bp, Homo sapiens
cattgccaccagga

SEQ ID NO: 3684889 - DNA, 15 bp, Homo sapiens
cattgccaccaggag

SEQ ID NO: 3684890 - DNA, 17 bp, Homo sapiens
cattgcctttgaatgtt

SEQ ID NO: 3684891 - DNA, 20 bp, Homo sapiens
cattggcacctaatccaggc

SEQ ID NO: 3684892 - DNA, 23 bp, Homo sapiens
cattgggaccctccagtgctgga

SEQ ID NO: 3684893 - DNA, 13 bp, Homo sapiens
cattgtccctctg

SEQ ID NO: 3684894 - DNA, 14 bp, Homo sapiens
cattgtccctctgc

SEQ ID NO: 3684895 - DNA, 15 bp, Homo sapiens
cattgtccctctgcc

SEQ ID NO: 3684896 - DNA, 18 bp, Homo sapiens
cattgtccctctgcccca

SEQ ID NO: 3684897 - DNA, 21 bp, Homo sapiens
cattgtctcctatatatttct

SEQ ID NO: 3684898 - DNA, 14 bp, Homo sapiens
cattgtctttttag

SEQ ID NO: 3684899 - DNA, 20 bp, Homo sapiens
cattgtctttttagatgccc

SEQ ID NO: 3684900 - DNA, 16 bp, Homo sapiens
cattgtttgctgctat

SEQ ID NO: 3684901 - DNA, 17 bp, Homo sapiens
catttaaattccacaga

SEQ ID NO: 3684902 - DNA, 15 bp, Homo sapiens
catttacaactgaaa

SEQ ID NO: 3684903 - DNA, 13 bp, Homo sapiens
catttactgaaat

SEQ ID NO: 3684904 - DNA, 15 bp, Homo sapiens
catttcaattgcttt

SEQ ID NO: 3684905 - DNA, 16 bp, Homo sapiens
catttcaattgctttg

SEQ ID NO: 3684906 - DNA, 20 bp, Homo sapiens
catttcacaaaacagccttt

SEQ ID NO: 3684907 - DNA, 21 bp, Homo sapiens
catttcattagccatgcaaca

SEQ ID NO: 3684908 - DNA, 21 bp, Homo sapiens
catttcggtggctagtcaagc

SEQ ID NO: 3684909 - DNA, 20 bp, Homo sapiens
catttctctaactcctgcca

SEQ ID NO: 3684910 - DNA, 21 bp, Homo sapiens
catttctctaactcctgccat

SEQ ID NO: 3684911 - DNA, 16 bp, Homo sapiens
catttgatgcatgtct

SEQ ID NO: 3684912 - DNA, 22 bp, Homo sapiens
catttgatgcatgtcttttaaa

SEQ ID NO: 3684913 - DNA, 20 bp, Homo sapiens
catttgctaactagcttgga

SEQ ID NO: 3684914 - DNA, 17 bp, Homo sapiens
catttggccggctctgg

SEQ ID NO: 3684915 - DNA, 12 bp, Homo sapiens
catttgggggcg

SEQ ID NO: 3684916 - DNA, 21 bp, Homo sapiens
catttgtgctagaaattttca

SEQ ID NO: 3684917 - DNA, 20 bp, Homo sapiens
catttgtttacatttgatgc

SEQ ID NO: 3684918 - DNA, 13 bp, Homo sapiens
cattttcagagtg

SEQ ID NO: 3684919 - DNA, 22 bp, Homo sapiens
cattttccccccactctcccca

SEQ ID NO: 3684920 - DNA, 20 bp, Homo sapiens
cattttggagagtttcctga

SEQ ID NO: 3684921 - DNA, 22 bp, Homo sapiens
cattttggagagtttcctgaaa

SEQ ID NO: 3684922 - DNA, 12 bp, Homo sapiens
catttttgtaaa

SEQ ID NO: 3684923 - DNA, 17 bp, Homo sapiens
catttttgtctgtccta

SEQ ID NO: 3684924 - DNA, 20 bp, Homo sapiens
ccaaaaaattctacaacaca

SEQ ID NO: 3684925 - DNA, 22 bp, Homo sapiens
ccaaaaaggttgctgtttcaca

SEQ ID NO: 3684926 - DNA, 21 bp, Homo sapiens
ccaaaacatcgtctaaacttt

SEQ ID NO: 3684927 - DNA, 20 bp, Homo sapiens
ccaaaataccagagccttca

SEQ ID NO: 3684928 - DNA, 12 bp, Homo sapiens
ccaaactgccta

SEQ ID NO: 3684929 - DNA, 17 bp, Homo sapiens
ccaaagccaagaaagaa

SEQ ID NO: 3684930 - DNA, 20 bp, Homo sapiens
ccaaagctgagcctgcaggg

SEQ ID NO: 3684931 - DNA, 19 bp, Homo sapiens
ccaaagctttcctgcccca

SEQ ID NO: 3684932 - DNA, 15 bp, Homo sapiens
ccaaaggaggctggc

SEQ ID NO: 3684933 - DNA, 16 bp, Homo sapiens
ccaaaggaggctggca

SEQ ID NO: 3684934 - DNA, 15 bp, Homo sapiens
ccaaaggcagcgtgc

SEQ ID NO: 3684935 - DNA, 13 bp, Homo sapiens
ccaaaggctggtg

SEQ ID NO: 3684936 - DNA, 13 bp, Homo sapiens
ccaaatgtccctc

SEQ ID NO: 3684937 - DNA, 14 bp, Homo sapiens
ccaaatgtttattt

SEQ ID NO: 3684938 - DNA, 20 bp, Homo sapiens
ccaaattttatgatttttct

SEQ ID NO: 3684939 - DNA, 19 bp, Homo sapiens
ccaacaaagaacactaact

SEQ ID NO: 3684940 - DNA, 23 bp, Homo sapiens
ccaacacatttcacttttctgta

SEQ ID NO: 3684941 - DNA, 17 bp, Homo sapiens
ccaacccccaccccaca

SEQ ID NO: 3684942 - DNA, 15 bp, Homo sapiens
ccaacccgaggcccg

SEQ ID NO: 3684943 - DNA, 19 bp, Homo sapiens
ccaacccgtgcccctggga

SEQ ID NO: 3684944 - DNA, 21 bp, Homo sapiens
ccaacggccctgcagccagct

SEQ ID NO: 3684945 - DNA, 14 bp, Homo sapiens
ccaactctagctgg

SEQ ID NO: 3684946 - DNA, 15 bp, Homo sapiens
ccaacttcccctcta

SEQ ID NO: 3684947 - DNA, 21 bp, Homo sapiens
ccaacttcccctctaactgga

SEQ ID NO: 3684948 - DNA, 17 bp, Homo sapiens
ccaacttggctgcagga

SEQ ID NO: 3684949 - DNA, 11 bp, Homo sapiens
ccaagaatgta

SEQ ID NO: 3684950 - DNA, 12 bp, Homo sapiens
ccaagaatgtac

SEQ ID NO: 3684951 - DNA, 17 bp, Homo sapiens
ccaagaatgtacgtcca

SEQ ID NO: 3684952 - DNA, 21 bp, Homo sapiens
ccaagaatgtacgtccagcct

SEQ ID NO: 3684953 - DNA, 18 bp, Homo sapiens
ccaagacagatgccccag

SEQ ID NO: 3684954 - DNA, 23 bp, Homo sapiens
ccaagacagatgccccagagctg

SEQ ID NO: 3684955 - DNA, 18 bp, Homo sapiens
ccaagcagccaagctcct

SEQ ID NO: 3684956 - DNA, 14 bp, Homo sapiens
ccaagcaggaagct

SEQ ID NO: 3684957 - DNA, 20 bp, Homo sapiens
ccaagcaggaagctcagact

SEQ ID NO: 3684958 - DNA, 13 bp, Homo sapiens
ccaagcatcttgg

SEQ ID NO: 3684959 - DNA, 23 bp, Homo sapiens
ccaagcatcttgggggggtggcc

SEQ ID NO: 3684960 - DNA, 18 bp, Homo sapiens
ccaagccaagggaacctg

SEQ ID NO: 3684961 - DNA, 16 bp, Homo sapiens
ccaagccagaggctgg

SEQ ID NO: 3684962 - DNA, 13 bp, Homo sapiens
ccaagcgcctggc

SEQ ID NO: 3684963 - DNA, 24 bp, Homo sapiens
ccagagctgtttatggcctcagct

SEQ ID NO: 3684964 - DNA, 14 bp, Homo sapiens
ccagaggcccccag

SEQ ID NO: 3684965 - DNA, 18 bp, Homo sapiens
ccagaggcccccagccca

SEQ ID NO: 3684966 - DNA, 15 bp, Homo sapiens
ccagaggctgggttc

SEQ ID NO: 3684967 - DNA, 17 bp, Homo sapiens
ccagaggttgtgcactg

SEQ ID NO: 3684968 - DNA, 13 bp, Homo sapiens
ccagagtggcctg

SEQ ID NO: 3684969 - DNA, 14 bp, Homo sapiens
ccagagtggcctgg

SEQ ID NO: 3684970 - DNA, 15 bp, Homo sapiens
ccagagtggcctggc

SEQ ID NO: 3684971 - DNA, 16 bp, Homo sapiens
ccagagtggcctggcc

SEQ ID NO: 3684972 - DNA, 22 bp, Homo sapiens
ccagagtggcctggccaggagc

SEQ ID NO: 3684973 - DNA, 15 bp, Homo sapiens
ccagatccagcctgg

SEQ ID NO: 3684974 - DNA, 16 bp, Homo sapiens
ccagatccagcctggg

SEQ ID NO: 3684975 - DNA, 16 bp, Homo sapiens
ccagatgcagctcaag

SEQ ID NO: 3684976 - DNA, 21 bp, Homo sapiens
ccagattgacgacaagtgctg

SEQ ID NO: 3684977 - DNA, 17 bp, Homo sapiens
ccagcaagaggaagggg

SEQ ID NO: 3684978 - DNA, 18 bp, Homo sapiens
ccagcaccttgtgcctgg

SEQ ID NO: 3684979 - DNA, 15 bp, Homo sapiens
ccagcagaagacaaa

SEQ ID NO: 3684980 - DNA, 22 bp, Homo sapiens
ccagcagaagacaaaaagacaa

SEQ ID NO: 3684981 - DNA, 13 bp, Homo sapiens
ccagcagcctgga

SEQ ID NO: 3684982 - DNA, 15 bp, Homo sapiens
ccagcagcctggacc

SEQ ID NO: 3684983 - DNA, 19 bp, Homo sapiens
ccagcagcctggaccctgt

SEQ ID NO: 3684984 - DNA, 22 bp, Homo sapiens
ccagcattccagcccctctggt

SEQ ID NO: 3684985 - DNA, 13 bp, Homo sapiens
ccagcattccttt

SEQ ID NO: 3684986 - DNA, 14 bp, Homo sapiens
ccagcattcctttt

SEQ ID NO: 3684987 - DNA, 18 bp, Homo sapiens
ccagcatttagctggcca

SEQ ID NO: 3684988 - DNA, 21 bp, Homo sapiens
ccagccaccccgggctctctg

SEQ ID NO: 3684989 - DNA, 22 bp, Homo sapiens
ccagccaccccgggctctctgc

SEQ ID NO: 3684990 - DNA, 22 bp, Homo sapiens
ccagccagtgacctgaggaagc

SEQ ID NO: 3684991 - DNA, 17 bp, Homo sapiens
ccagccatgtctgcatt

SEQ ID NO: 3684992 - DNA, 14 bp, Homo sapiens
ccagcccagacagc

SEQ ID NO: 3684993 - DNA, 12 bp, Homo sapiens
ccagcccagaga

SEQ ID NO: 3684994 - DNA, 22 bp, Homo sapiens
ccagcccagagacatacttgaa

SEQ ID NO: 3684995 - DNA, 15 bp, Homo sapiens
ccagcccagggctcc

SEQ ID NO: 3684996 - DNA, 14 bp, Homo sapiens
ccagccccacccag

SEQ ID NO: 3684997 - DNA, 17 bp, Homo sapiens
ccagcccctcctccctg

SEQ ID NO: 3684998 - DNA, 14 bp, Homo sapiens
ccagccgccatgct

SEQ ID NO: 3684999 - DNA, 12 bp, Homo sapiens
ccagcctggcat

SEQ ID NO: 3685000 - DNA, 15 bp, Homo sapiens
ccagcctggcatcag

SEQ ID NO: 3685001 - DNA, 18 bp, Homo sapiens
ccagcctggcatcagttt

SEQ ID NO: 3685002 - DNA, 11 bp, Homo sapiens
ccagcctggcc

SEQ ID NO: 3685003 - DNA, 14 bp, Homo sapiens
ccagcctggtggcc

SEQ ID NO: 3685004 - DNA, 18 bp, Homo sapiens
ccagcctggtggcccagc

SEQ ID NO: 3685005 - DNA, 23 bp, Homo sapiens
ccagccttggtgggggagcctct

SEQ ID NO: 3685006 - DNA, 20 bp, Homo sapiens
ccagcctttgatcaggtggg

SEQ ID NO: 3685007 - DNA, 17 bp, Homo sapiens
ccagcggtttcctggtg

SEQ ID NO: 3685008 - DNA, 13 bp, Homo sapiens
ccagctaagaacc

SEQ ID NO: 3685009 - DNA, 14 bp, Homo sapiens
ccagctaagaacct

SEQ ID NO: 3685010 - DNA, 17 bp, Homo sapiens
ccagctaagaacctgga

SEQ ID NO: 3685011 - DNA, 19 bp, Homo sapiens
ccagctaagaacctggaac

SEQ ID NO: 3685012 - DNA, 19 bp, Homo sapiens
ccagctcaggacagatgcc

SEQ ID NO: 3685013 - DNA, 14 bp, Homo sapiens
ccagctctggaggg

SEQ ID NO: 3685014 - DNA, 12 bp, Homo sapiens
ccagctctgtgg

SEQ ID NO: 3685015 - DNA, 17 bp, Homo sapiens
ccagctctgtgggccct

SEQ ID NO: 3685016 - DNA, 19 bp, Homo sapiens
ccagctgggccgggaccca

SEQ ID NO: 3685017 - DNA, 14 bp, Homo sapiens
ccagctgtgcttat

SEQ ID NO: 3685018 - DNA, 21 bp, Homo sapiens
ccagctgtgcttatggtacca

SEQ ID NO: 3685019 - DNA, 22 bp, Homo sapiens
ccagcttagcaactgctgggga

SEQ ID NO: 3685020 - DNA, 24 bp, Homo sapiens
ccaggaaccacaccacatctaagc

SEQ ID NO: 3685021 - DNA, 20 bp, Homo sapiens
ccaggaatattgtcatcctt

SEQ ID NO: 3685022 - DNA, 17 bp, Homo sapiens
ccaggaatttcccagga

SEQ ID NO: 3685023 - DNA, 18 bp, Homo sapiens
ccaggaatttcccaggac

SEQ ID NO: 3685024 - DNA, 20 bp, Homo sapiens
ccaggaatttcccaggaccc

SEQ ID NO: 3685025 - DNA, 16 bp, Homo sapiens
ccaggaccagctcagg

SEQ ID NO: 3685026 - DNA, 17 bp, Homo sapiens
ccaggacccaccactgg

SEQ ID NO: 3685027 - DNA, 19 bp, Homo sapiens
ccaggacccaccactggaa

SEQ ID NO: 3685028 - DNA, 19 bp, Homo sapiens
ccaggaccctgaaggggcc

SEQ ID NO: 3685029 - DNA, 23 bp, Homo sapiens
ccaggagaaccactacatgcagc

SEQ ID NO: 3685030 - DNA, 17 bp, Homo sapiens
ccaggagcaagtgaggc

SEQ ID NO: 3685031 - DNA, 13 bp, Homo sapiens
ccaggagctcttc

SEQ ID NO: 3685032 - DNA, 18 bp, Homo sapiens
ccaggagctcttcaggcc

SEQ ID NO: 3685033 - DNA, 16 bp, Homo sapiens
ccaggagctgggcaga

SEQ ID NO: 3685034 - DNA, 18 bp, Homo sapiens
ccaggatagagactggaa

SEQ ID NO: 3685035 - DNA, 13 bp, Homo sapiens
ccaggatctttga

SEQ ID NO: 3685036 - DNA, 16 bp, Homo sapiens
ccaggatctttgactg

SEQ ID NO: 3685037 - DNA, 19 bp, Homo sapiens
ccaggatctttgactgaaa

SEQ ID NO: 3685038 - DNA, 16 bp, Homo sapiens
ccaggcacggtttgga

SEQ ID NO: 3685039 - DNA, 13 bp, Homo sapiens
ccaggcactgcaa

SEQ ID NO: 3685040 - DNA, 15 bp, Homo sapiens
ccaggcagatccagg

SEQ ID NO: 3685041 - DNA, 18 bp, Homo sapiens
ccaggcagatccaggact

SEQ ID NO: 3685042 - DNA, 18 bp, Homo sapiens
ccaggcagatctgtgccc

SEQ ID NO: 3685043 - DNA, 14 bp, Homo sapiens
ccaggcagctggca

SEQ ID NO: 3685044 - DNA, 13 bp, Homo sapiens
ccaggccacctcc

SEQ ID NO: 3685045 - DNA, 16 bp, Homo sapiens
ccaggccccaggaagc

SEQ ID NO: 3685046 - DNA, 20 bp, Homo sapiens
ccaggcccccaagcctgcag

SEQ ID NO: 3685047 - DNA, 21 bp, Homo sapiens
ccaggcggggcgccccaagag

SEQ ID NO: 3685048 - DNA, 13 bp, Homo sapiens
ccaggctgccaag

SEQ ID NO: 3685049 - DNA, 17 bp, Homo sapiens
ccaggctgcccagagct

SEQ ID NO: 3685050 - DNA, 23 bp, Homo sapiens
ccaggctgtgtttggctttcagg

SEQ ID NO: 3685051 - DNA, 18 bp, Homo sapiens
ccagggaactggcctgct

SEQ ID NO: 3685052 - DNA, 20 bp, Homo sapiens
ccagggacacctgggagaaa

SEQ ID NO: 3685053 - DNA, 13 bp, Homo sapiens
ccagggacagagg

SEQ ID NO: 3685054 - DNA, 21 bp, Homo sapiens
ccagggacagaggccccagcc

SEQ ID NO: 3685055 - DNA, 22 bp, Homo sapiens
ccagggacagaggccccagcct

SEQ ID NO: 3685056 - DNA, 13 bp, Homo sapiens
ccagggagaagct

SEQ ID NO: 3685057 - DNA, 15 bp, Homo sapiens
ccagggagaagctcc

SEQ ID NO: 3685058 - DNA, 18 bp, Homo sapiens
ccagggagcggaaagcag

SEQ ID NO: 3685059 - DNA, 20 bp, Homo sapiens
ccagggagcggaaagcagct

SEQ ID NO: 3685060 - DNA, 19 bp, Homo sapiens
ccagggagggtatttattg

SEQ ID NO: 3685061 - DNA, 20 bp, Homo sapiens
ccagggagggtatttattgg

SEQ ID NO: 3685062 - DNA, 18 bp, Homo sapiens
ccagggcaaggccccttc

SEQ ID NO: 3685063 - DNA, 16 bp, Homo sapiens
ccagggcccagagccc

SEQ ID NO: 3685064 - DNA, 13 bp, Homo sapiens
ccagggccctcgg

SEQ ID NO: 3685065 - DNA, 20 bp, Homo sapiens
ccagggccttttctggcacc

SEQ ID NO: 3685066 - DNA, 19 bp, Homo sapiens
ccaggggaaaatcagcctg

SEQ ID NO: 3685067 - DNA, 20 bp, Homo sapiens
ccaggggaaaatcagcctgc

SEQ ID NO: 3685068 - DNA, 21 bp, Homo sapiens
ccaggggaaaatcagcctgct

SEQ ID NO: 3685069 - DNA, 17 bp, Homo sapiens
ccaggggccctacctgg

SEQ ID NO: 3685070 - DNA, 21 bp, Homo sapiens
ccaggggctgcttcctcctgg

SEQ ID NO: 3685071 - DNA, 17 bp, Homo sapiens
ccaggggggtgaggagc

SEQ ID NO: 3685072 - DNA, 19 bp, Homo sapiens
ccaggggggtgaggagctg

SEQ ID NO: 3685073 - DNA, 20 bp, Homo sapiens
ccaggggggtgaggagctgg

SEQ ID NO: 3685074 - DNA, 18 bp, Homo sapiens
ccaggggtcccagccacc

SEQ ID NO: 3685075 - DNA, 13 bp, Homo sapiens
ccaggggtttctc

SEQ ID NO: 3685076 - DNA, 17 bp, Homo sapiens
ccagggtccctctgtgt

SEQ ID NO: 3685077 - DNA, 14 bp, Homo sapiens
ccagggtcttccct

SEQ ID NO: 3685078 - DNA, 23 bp, Homo sapiens
ccagggtcttccctacctcaggc

SEQ ID NO: 3685079 - DNA, 16 bp, Homo sapiens
ccaggtccagctctgg

SEQ ID NO: 3685080 - DNA, 21 bp, Homo sapiens
cccctcatggcgggactggag

SEQ ID NO: 3685081 - DNA, 18 bp, Homo sapiens
cccctcccccaaccccca

SEQ ID NO: 3685082 - DNA, 12 bp, Homo sapiens
cccctccctggc

SEQ ID NO: 3685083 - DNA, 18 bp, Homo sapiens
cccctcgcaactgtccac

SEQ ID NO: 3685084 - DNA, 16 bp, Homo sapiens
cccctctaactggaca

SEQ ID NO: 3685085 - DNA, 23 bp, Homo sapiens
cccctctggtcgctcctgcccac

SEQ ID NO: 3685086 - DNA, 17 bp, Homo sapiens
cccctgcgtcgagctgg

SEQ ID NO: 3685087 - DNA, 19 bp, Homo sapiens
cccctgcgtcgagctggga

SEQ ID NO: 3685088 - DNA, 22 bp, Homo sapiens
cccctgctgcttaagtgcatgc

SEQ ID NO: 3685089 - DNA, 22 bp, Homo sapiens
cccctggacagaggcggggcta

SEQ ID NO: 3685090 - DNA, 16 bp, Homo sapiens
cccctggacggggcgg

SEQ ID NO: 3685091 - DNA, 19 bp, Homo sapiens
cccctgggggctctcatgt

SEQ ID NO: 3685092 - DNA, 14 bp, Homo sapiens
ccccttcacaaagc

SEQ ID NO: 3685093 - DNA, 13 bp, Homo sapiens
ccccttctctgct

SEQ ID NO: 3685094 - DNA, 14 bp, Homo sapiens
ccccttctctgctc

SEQ ID NO: 3685095 - DNA, 18 bp, Homo sapiens
ccccttgacaactggcag

SEQ ID NO: 3685096 - DNA, 12 bp, Homo sapiens
cccgacagaggg

SEQ ID NO: 3685097 - DNA, 12 bp, Homo sapiens
cccgaggcccgc

SEQ ID NO: 3685098 - DNA, 13 bp, Homo sapiens
cccgaggcccgca

SEQ ID NO: 3685099 - DNA, 19 bp, Homo sapiens
cccgaggccgcgtgcgtga

SEQ ID NO: 3685100 - DNA, 16 bp, Homo sapiens
cccgcagacaccttgg

SEQ ID NO: 3685101 - DNA, 19 bp, Homo sapiens
cccgcagtgtgcactaagg

SEQ ID NO: 3685102 - DNA, 12 bp, Homo sapiens
cccgctgctgtg

SEQ ID NO: 3685103 - DNA, 21 bp, Homo sapiens
cccggaggccgaggccatgtg

SEQ ID NO: 3685104 - DNA, 20 bp, Homo sapiens
cccggcatgagactcagtgc

SEQ ID NO: 3685105 - DNA, 11 bp, Homo sapiens
cccggccagcc

SEQ ID NO: 3685106 - DNA, 15 bp, Homo sapiens
cccggcccctcctga

SEQ ID NO: 3685107 - DNA, 23 bp, Homo sapiens
cccgggaggcagaggttgcagtg

SEQ ID NO: 3685108 - DNA, 20 bp, Homo sapiens
cccggtgggacccccgtggg

SEQ ID NO: 3685109 - DNA, 13 bp, Homo sapiens
cccgtcctgcctg

SEQ ID NO: 3685110 - DNA, 16 bp, Homo sapiens
cccgtcctgcctgtgg

SEQ ID NO: 3685111 - DNA, 21 bp, Homo sapiens
cccgtgaggatgtcactcaga

SEQ ID NO: 3685112 - DNA, 17 bp, Homo sapiens
cccgtgcccctgggatc

SEQ ID NO: 3685113 - DNA, 20 bp, Homo sapiens
ccctaaggcatgtgtgaaac

SEQ ID NO: 3685114 - DNA, 15 bp, Homo sapiens
ccctaccctcctgct

SEQ ID NO: 3685115 - DNA, 12 bp, Homo sapiens
ccctacctgggg

SEQ ID NO: 3685116 - DNA, 13 bp, Homo sapiens
ccctacctgggga

SEQ ID NO: 3685117 - DNA, 19 bp, Homo sapiens
ccctagcagcccaccctgc

SEQ ID NO: 3685118 - DNA, 15 bp, Homo sapiens
ccctagtaaaaatac

SEQ ID NO: 3685119 - DNA, 16 bp, Homo sapiens
ccctagtcccttcccc

SEQ ID NO: 3685120 - DNA, 23 bp, Homo sapiens
ccctatactgcttggagctgagc

SEQ ID NO: 3685121 - DNA, 13 bp, Homo sapiens
ccctcaccctgcc

SEQ ID NO: 3685122 - DNA, 12 bp, Homo sapiens
ccctcagcctct

SEQ ID NO: 3685123 - DNA, 17 bp, Homo sapiens
ccctcatctctctgccc

SEQ ID NO: 3685124 - DNA, 12 bp, Homo sapiens
ccctccaacaca

SEQ ID NO: 3685125 - DNA, 18 bp, Homo sapiens
ccctccagtgctggattt

SEQ ID NO: 3685126 - DNA, 13 bp, Homo sapiens
ccctcccaaagag

SEQ ID NO: 3685127 - DNA, 19 bp, Homo sapiens
ccctcccacacccaaagct

SEQ ID NO: 3685128 - DNA, 16 bp, Homo sapiens
ccctcccccaaccccc

SEQ ID NO: 3685129 - DNA, 15 bp, Homo sapiens
ccctcccccccatgc

SEQ ID NO: 3685130 - DNA, 14 bp, Homo sapiens
ccctccgccctgcc

SEQ ID NO: 3685131 - DNA, 15 bp, Homo sapiens
ccctccgccctgcca

SEQ ID NO: 3685132 - DNA, 16 bp, Homo sapiens
ccctccgccctgccac

SEQ ID NO: 3685133 - DNA, 18 bp, Homo sapiens
ccctccgtggcatcacct

SEQ ID NO: 3685134 - DNA, 17 bp, Homo sapiens
ccctcctcacctctgga

SEQ ID NO: 3685135 - DNA, 18 bp, Homo sapiens
ccctcctgctgagctgcc

SEQ ID NO: 3685136 - DNA, 23 bp, Homo sapiens
ccctcctgctgagctgcccctgc

SEQ ID NO: 3685137 - DNA, 21 bp, Homo sapiens
ccctcgggtctccccacctgc

SEQ ID NO: 3685138 - DNA, 18 bp, Homo sapiens
ccctctaactggacagcc

SEQ ID NO: 3685139 - DNA, 21 bp, Homo sapiens
ccctctccaagcgcctggctt

SEQ ID NO: 3685140 - DNA, 15 bp, Homo sapiens
ccctctgccccatcc

SEQ ID NO: 3685141 - DNA, 22 bp, Homo sapiens
ccctctggagtggccactaagc

SEQ ID NO: 3685142 - DNA, 20 bp, Homo sapiens
ccctctgtgtatttgctttt

SEQ ID NO: 3685143 - DNA, 21 bp, Homo sapiens
ccctcttccaaaggcagcgtg

SEQ ID NO: 3685144 - DNA, 22 bp, Homo sapiens
ccctcttccaaaggcagcgtgc

SEQ ID NO: 3685145 - DNA, 16 bp, Homo sapiens
ccctgaaagccctgag

SEQ ID NO: 3685146 - DNA, 17 bp, Homo sapiens
ccctgaaggggccatga

SEQ ID NO: 3685147 - DNA, 23 bp, Homo sapiens
ccctgagacaaatggaggcctgt

SEQ ID NO: 3685148 - DNA, 16 bp, Homo sapiens
ccctgagctttctgct

SEQ ID NO: 3685149 - DNA, 12 bp, Homo sapiens
ccctgcagctga

SEQ ID NO: 3685150 - DNA, 14 bp, Homo sapiens
ccctgcagctgacc

SEQ ID NO: 3685151 - DNA, 16 bp, Homo sapiens
ccctgcatctgaccag

SEQ ID NO: 3685152 - DNA, 13 bp, Homo sapiens
ccctgccactcac

SEQ ID NO: 3685153 - DNA, 19 bp, Homo sapiens
ccctgccactcactaggcc

SEQ ID NO: 3685154 - DNA, 15 bp, Homo sapiens
ccctgccctcgggtc

SEQ ID NO: 3685155 - DNA, 18 bp, Homo sapiens
ccctgccctggtccaggg

SEQ ID NO: 3685156 - DNA, 19 bp, Homo sapiens
ccctgcctacgccaggaga

SEQ ID NO: 3685157 - DNA, 15 bp, Homo sapiens
ccctgcctgccgtct

SEQ ID NO: 3685158 - DNA, 15 bp, Homo sapiens
ccctgcgcctgtgat

SEQ ID NO: 3685159 - DNA, 22 bp, Homo sapiens
ccctgcgcctgtgatgctgggc

SEQ ID NO: 3685160 - DNA, 21 bp, Homo sapiens
ccctggagaggccctctggag

SEQ ID NO: 3685161 - DNA, 11 bp, Homo sapiens
ccctggcctcc

SEQ ID NO: 3685162 - DNA, 20 bp, Homo sapiens
ccctggcctcccctgccacc

SEQ ID NO: 3685163 - DNA, 15 bp, Homo sapiens
ccctggctcccatga

SEQ ID NO: 3685164 - DNA, 21 bp, Homo sapiens
ccctgggaaccgccctcctga

SEQ ID NO: 3685165 - DNA, 13 bp, Homo sapiens
ccctgggccctgg

SEQ ID NO: 3685166 - DNA, 12 bp, Homo sapiens
ccctggggacgg

SEQ ID NO: 3685167 - DNA, 18 bp, Homo sapiens
ccctgggggcgggactcc

SEQ ID NO: 3685168 - DNA, 20 bp, Homo sapiens
ccctgggggcgggactcctc

SEQ ID NO: 3685169 - DNA, 20 bp, Homo sapiens
ccctgggggtggggctccta

SEQ ID NO: 3685170 - DNA, 11 bp, Homo sapiens
ccctgggtgga

SEQ ID NO: 3685171 - DNA, 16 bp, Homo sapiens
ccctggtccagggaag

SEQ ID NO: 3685172 - DNA, 18 bp, Homo sapiens
ccctggtccagggaagct

SEQ ID NO: 3685173 - DNA, 13 bp, Homo sapiens
ccctggttgcctc

SEQ ID NO: 3685174 - DNA, 14 bp, Homo sapiens
ccctgtaaggttcc

SEQ ID NO: 3685175 - DNA, 21 bp, Homo sapiens
ccctgtccaaactgcctaagc

SEQ ID NO: 3685176 - DNA, 16 bp, Homo sapiens
ccctgtctagagaggg

SEQ ID NO: 3685177 - DNA, 20 bp, Homo sapiens
cccttctctgctccaccaca

SEQ ID NO: 3685178 - DNA, 13 bp, Homo sapiens
cccttctgtccaa

SEQ ID NO: 3685179 - DNA, 21 bp, Homo sapiens
cccttgacaactggcaggcag

SEQ ID NO: 3685180 - DNA, 23 bp, Homo sapiens
cccttgcagttcagcaccaccct

SEQ ID NO: 3685181 - DNA, 19 bp, Homo sapiens
cccttgcttgcctgcaggg

SEQ ID NO: 3685182 - DNA, 15 bp, Homo sapiens
cccttggaggccagc

SEQ ID NO: 3685183 - DNA, 18 bp, Homo sapiens
cccttggaggccagccag

SEQ ID NO: 3685184 - DNA, 12 bp, Homo sapiens
cccttggcctgt

SEQ ID NO: 3685185 - DNA, 13 bp, Homo sapiens
ccgacagagggaa

SEQ ID NO: 3685186 - DNA, 17 bp, Homo sapiens
ccgacgcctgtgccacc

SEQ ID NO: 3685187 - DNA, 14 bp, Homo sapiens
ccgactgctttgga

SEQ ID NO: 3685188 - DNA, 16 bp, Homo sapiens
ccgactgctttggacc

SEQ ID NO: 3685189 - DNA, 17 bp, Homo sapiens
ccgactgctttggacct

SEQ ID NO: 3685190 - DNA, 15 bp, Homo sapiens
ccgagaggtgggcca

SEQ ID NO: 3685191 - DNA, 19 bp, Homo sapiens
ccgagaggtgggccagtct

SEQ ID NO: 3685192 - DNA, 20 bp, Homo sapiens
ccgagatcgtgccattgcac

SEQ ID NO: 3685193 - DNA, 13 bp, Homo sapiens
ccgagccagcaag

SEQ ID NO: 3685194 - DNA, 19 bp, Homo sapiens
ccgagctttgaaaattcag

SEQ ID NO: 3685195 - DNA, 14 bp, Homo sapiens
ccgaggaaactcag

SEQ ID NO: 3685196 - DNA, 18 bp, Homo sapiens
ccgaggccctcccaaaga

SEQ ID NO: 3685197 - DNA, 17 bp, Homo sapiens
ccgagggtcctggctcc

SEQ ID NO: 3685198 - DNA, 19 bp, Homo sapiens
ccgagggtcctggctcctg

SEQ ID NO: 3685199 - DNA, 23 bp, Homo sapiens
ccgagggtcctggctcctgaggg

SEQ ID NO: 3685200 - DNA, 17 bp, Homo sapiens
ccgatagagggacggcc

SEQ ID NO: 3685201 - DNA, 11 bp, Homo sapiens
ccgcaccctgc

SEQ ID NO: 3685202 - DNA, 14 bp, Homo sapiens
ccgcaccctgccta

SEQ ID NO: 3685203 - DNA, 14 bp, Homo sapiens
ccgcagacaccttg

SEQ ID NO: 3685204 - DNA, 14 bp, Homo sapiens
ccgcaggaagctgc

SEQ ID NO: 3685205 - DNA, 15 bp, Homo sapiens
ccgcagtgtgcacta

SEQ ID NO: 3685206 - DNA, 16 bp, Homo sapiens
ccgccatcctctgcct

SEQ ID NO: 3685207 - DNA, 15 bp, Homo sapiens
ccgcccgtctctgct

SEQ ID NO: 3685208 - DNA, 12 bp, Homo sapiens
ccgccctgccac

SEQ ID NO: 3685209 - DNA, 16 bp, Homo sapiens
ccgccctgcccgggct

SEQ ID NO: 3685210 - DNA, 16 bp, Homo sapiens
ccgcctgtccacagcc

SEQ ID NO: 3685211 - DNA, 12 bp, Homo sapiens
ccgcgggtggga

SEQ ID NO: 3685212 - DNA, 14 bp, Homo sapiens
ccgcgtgtgcctgt

SEQ ID NO: 3685213 - DNA, 17 bp, Homo sapiens
ccgcgtgtgcctgtgtg

SEQ ID NO: 3685214 - DNA, 14 bp, Homo sapiens
ccgctgccacccac

SEQ ID NO: 3685215 - DNA, 15 bp, Homo sapiens
ccgctgccacccacc

SEQ ID NO: 3685216 - DNA, 16 bp, Homo sapiens
ccgctgccacccacct

SEQ ID NO: 3685217 - DNA, 23 bp, Homo sapiens
ccgctgccacccacctccctgcc

SEQ ID NO: 3685218 - DNA, 14 bp, Homo sapiens
ccgctttcctggag

SEQ ID NO: 3685219 - DNA, 16 bp, Homo sapiens
ccgctttcctggagcc

SEQ ID NO: 3685220 - DNA, 15 bp, Homo sapiens
ccggacttttctgca

SEQ ID NO: 3685221 - DNA, 16 bp, Homo sapiens
ccggacttttctgcaa

SEQ ID NO: 3685222 - DNA, 18 bp, Homo sapiens
ccggagaggagttcagga

SEQ ID NO: 3685223 - DNA, 20 bp, Homo sapiens
ccggagattggacggcctga

SEQ ID NO: 3685224 - DNA, 18 bp, Homo sapiens
ccggcagggtcctagaaa

SEQ ID NO: 3685225 - DNA, 22 bp, Homo sapiens
ccggcagttctgggtgctccct

SEQ ID NO: 3685226 - DNA, 20 bp, Homo sapiens
ccggcatgagactcagtgca

SEQ ID NO: 3685227 - DNA, 13 bp, Homo sapiens
ccggcccccttcc

SEQ ID NO: 3685228 - DNA, 16 bp, Homo sapiens
ccggcccctcctgact

SEQ ID NO: 3685229 - DNA, 15 bp, Homo sapiens
ccggccctgtgtgca

SEQ ID NO: 3685230 - DNA, 17 bp, Homo sapiens
ccggccctgtgtgcagg

SEQ ID NO: 3685231 - DNA, 18 bp, Homo sapiens
ccggccgcggctccccct

SEQ ID NO: 3685232 - DNA, 23 bp, Homo sapiens
ccggccgcggctccccctggacg

SEQ ID NO: 3685233 - DNA, 14 bp, Homo sapiens
ccggctccagagca

SEQ ID NO: 3685234 - DNA, 15 bp, Homo sapiens
ccggctgcagaggcc

SEQ ID NO: 3685235 - DNA, 14 bp, Homo sapiens
ccggggactcccag

SEQ ID NO: 3685236 - DNA, 16 bp, Homo sapiens
ccggggactcccaggc

SEQ ID NO: 3685237 - DNA, 19 bp, Homo sapiens
ccggttaaattccatatgc

SEQ ID NO: 3685238 - DNA, 13 bp, Homo sapiens
ccgtatctccctg

SEQ ID NO: 3685239 - DNA, 14 bp, Homo sapiens
ccgtcctgcctgtg

SEQ ID NO: 3685240 - DNA, 18 bp, Homo sapiens
ccgtctaggattgggcct

SEQ ID NO: 3685241 - DNA, 16 bp, Homo sapiens
ccgtctctgctctgct

SEQ ID NO: 3685242 - DNA, 15 bp, Homo sapiens
ccgtgagcatgtttg

SEQ ID NO: 3685243 - DNA, 14 bp, Homo sapiens
ccgtgaggatgtca

SEQ ID NO: 3685244 - DNA, 14 bp, Homo sapiens
ccgtgctgacagct

SEQ ID NO: 3685245 - DNA, 22 bp, Homo sapiens
ccgtggattgcacgtggcctct

SEQ ID NO: 3685246 - DNA, 23 bp, Homo sapiens
ccgtggattgcacgtggcctctt

SEQ ID NO: 3685247 - DNA, 23 bp, Homo sapiens
ccgtggcatcaccttaggcaggg

SEQ ID NO: 3685248 - DNA, 19 bp, Homo sapiens
ccgtggtcagagtgccact

SEQ ID NO: 3685249 - DNA, 21 bp, Homo sapiens
ccgtggtcagagtgccactgc

SEQ ID NO: 3685250 - DNA, 13 bp, Homo sapiens
ccgtgttgcttca

SEQ ID NO: 3685251 - DNA, 13 bp, Homo sapiens
ccgttagctcctg

SEQ ID NO: 3685252 - DNA, 14 bp, Homo sapiens
cctaaaaacacaga

SEQ ID NO: 3685253 - DNA, 20 bp, Homo sapiens
cctaagactaacaaaggcag

SEQ ID NO: 3685254 - DNA, 22 bp, Homo sapiens
cctaaggcatgtgtgaaacata

SEQ ID NO: 3685255 - DNA, 20 bp, Homo sapiens
cctaatccaggcagatccag

SEQ ID NO: 3685256 - DNA, 21 bp, Homo sapiens
cctacaagagcagcctgtggc

SEQ ID NO: 3685257 - DNA, 20 bp, Homo sapiens
cctacagaaaacccagctag

SEQ ID NO: 3685258 - DNA, 11 bp, Homo sapiens
cctaccctcct

SEQ ID NO: 3685259 - DNA, 17 bp, Homo sapiens
cctaccctcctgctgag

SEQ ID NO: 3685260 - DNA, 18 bp, Homo sapiens
cctaccctcctgctgagc

SEQ ID NO: 3685261 - DNA, 15 bp, Homo sapiens
cctacctcaggcagg

SEQ ID NO: 3685262 - DNA, 14 bp, Homo sapiens
cctacctgggggca

SEQ ID NO: 3685263 - DNA, 21 bp, Homo sapiens
cctacctgggggcagaactcc

SEQ ID NO: 3685264 - DNA, 22 bp, Homo sapiens
cctacttagggaagaaaaagca

SEQ ID NO: 3685265 - DNA, 18 bp, Homo sapiens
cctacttcattttcagag

SEQ ID NO: 3685266 - DNA, 20 bp, Homo sapiens
cctacttcattttcagagtg

SEQ ID NO: 3685267 - DNA, 18 bp, Homo sapiens
cctagagggaggggccta

SEQ ID NO: 3685268 - DNA, 15 bp, Homo sapiens
cctagcagcccaccc

SEQ ID NO: 3685269 - DNA, 19 bp, Homo sapiens
cctaggcctcagccagaga

SEQ ID NO: 3685270 - DNA, 13 bp, Homo sapiens
cctatactgcttg

SEQ ID NO: 3685271 - DNA, 22 bp, Homo sapiens
cctatactgcttggagctgagc

SEQ ID NO: 3685272 - DNA, 17 bp, Homo sapiens
cctatgcttaataaaag

SEQ ID NO: 3685273 - DNA, 12 bp, Homo sapiens
cctatgctttga

SEQ ID NO: 3685274 - DNA, 18 bp, Homo sapiens
cctatgtagtccgtgctg

SEQ ID NO: 3685275 - DNA, 17 bp, Homo sapiens
cctattagagaagagat

SEQ ID NO: 3685276 - DNA, 16 bp, Homo sapiens
cctcaacacctctgca

SEQ ID NO: 3685277 - DNA, 18 bp, Homo sapiens
cctcaatagatctccagc

SEQ ID NO: 3685278 - DNA, 21 bp, Homo sapiens
cctcaccaaaacgatgaagtt

SEQ ID NO: 3685279 - DNA, 14 bp, Homo sapiens
cctcaccctgcctt

SEQ ID NO: 3685280 - DNA, 15 bp, Homo sapiens
cctcaccctgcctta

SEQ ID NO: 3685281 - DNA, 20 bp, Homo sapiens
cctcacctctggactggcta

SEQ ID NO: 3685282 - DNA, 22 bp, Homo sapiens
cctcacctctggactggctaga

SEQ ID NO: 3685283 - DNA, 22 bp, Homo sapiens
cctcactcgggtttctctgtgg

SEQ ID NO: 3685284 - DNA, 16 bp, Homo sapiens
cctcagccagagaagc

SEQ ID NO: 3685285 - DNA, 17 bp, Homo sapiens
cctcagcctctgccact

SEQ ID NO: 3685286 - DNA, 18 bp, Homo sapiens
cctcagcctctgccactg

SEQ ID NO: 3685287 - DNA, 12 bp, Homo sapiens
cctcagcctggc

SEQ ID NO: 3685288 - DNA, 14 bp, Homo sapiens
cctcagcctggcca

SEQ ID NO: 3685289 - DNA, 18 bp, Homo sapiens
cctcagcctggccagaca

SEQ ID NO: 3685290 - DNA, 19 bp, Homo sapiens
cctcagcctggccagacac

SEQ ID NO: 3685291 - DNA, 19 bp, Homo sapiens
cctcagccttgccagagat

SEQ ID NO: 3685292 - DNA, 21 bp, Homo sapiens
cctcagccttgccagagatcc

SEQ ID NO: 3685293 - DNA, 22 bp, Homo sapiens
cctcagccttgccagagatcca

SEQ ID NO: 3685294 - DNA, 17 bp, Homo sapiens
cctgtgcaaaaaaatta

SEQ ID NO: 3685295 - DNA, 13 bp, Homo sapiens
cctgtgccacccc

SEQ ID NO: 3685296 - DNA, 17 bp, Homo sapiens
cctgtggccccaccctg

SEQ ID NO: 3685297 - DNA, 22 bp, Homo sapiens
cctgtggccccaccctgggccc

SEQ ID NO: 3685298 - DNA, 21 bp, Homo sapiens
cctgtggcgccgtctccaggg

SEQ ID NO: 3685299 - DNA, 19 bp, Homo sapiens
cctgtgggtggggcttctc

SEQ ID NO: 3685300 - DNA, 24 bp, Homo sapiens
cctgtgggtggggcttctctggga

SEQ ID NO: 3685301 - DNA, 23 bp, Homo sapiens
cctgtggtagtcctcccaagctg

SEQ ID NO: 3685302 - DNA, 19 bp, Homo sapiens
cctgtgtccatgcgctcag

SEQ ID NO: 3685303 - DNA, 18 bp, Homo sapiens
cctgtgtgattgacagct

SEQ ID NO: 3685304 - DNA, 17 bp, Homo sapiens
cctgtgtgtgtcccctc

SEQ ID NO: 3685305 - DNA, 16 bp, Homo sapiens
cctgtgttgtctctag

SEQ ID NO: 3685306 - DNA, 23 bp, Homo sapiens
cctgttccccagagaaaggggag

SEQ ID NO: 3685307 - DNA, 21 bp, Homo sapiens
cctgttgaagattatttcatt

SEQ ID NO: 3685308 - DNA, 19 bp, Homo sapiens
ccttaaaattacttggctt

SEQ ID NO: 3685309 - DNA, 20 bp, Homo sapiens
ccttaaaattacttggcttt

SEQ ID NO: 3685310 - DNA, 23 bp, Homo sapiens
ccttaactggagccccatcagct

SEQ ID NO: 3685311 - DNA, 14 bp, Homo sapiens
ccttagcctccctg

SEQ ID NO: 3685312 - DNA, 13 bp, Homo sapiens
ccttaggcaggga

SEQ ID NO: 3685313 - DNA, 16 bp, Homo sapiens
ccttcaagtgccaaac

SEQ ID NO: 3685314 - DNA, 12 bp, Homo sapiens
ccttccatccct

SEQ ID NO: 3685315 - DNA, 18 bp, Homo sapiens
ccttcccctccctggctc

SEQ ID NO: 3685316 - DNA, 23 bp, Homo sapiens
ccttccctcaccttggcaccaga

SEQ ID NO: 3685317 - DNA, 16 bp, Homo sapiens
ccttcccttgagccct

SEQ ID NO: 3685318 - DNA, 15 bp, Homo sapiens
ccttcctcagcctgg

SEQ ID NO: 3685319 - DNA, 15 bp, Homo sapiens
ccttcctctgtgcca

SEQ ID NO: 3685320 - DNA, 16 bp, Homo sapiens
ccttcctctgtgccac

SEQ ID NO: 3685321 - DNA, 10 bp, Homo sapiens
ccttcctggc

SEQ ID NO: 3685322 - DNA, 19 bp, Homo sapiens
ccttcgcttcttgcctctg

SEQ ID NO: 3685323 - DNA, 17 bp, Homo sapiens
ccttcgtctttcccatg

SEQ ID NO: 3685324 - DNA, 22 bp, Homo sapiens
ccttctaaaggtgttgtccctt

SEQ ID NO: 3685325 - DNA, 16 bp, Homo sapiens
ccttctctgctccacc

SEQ ID NO: 3685326 - DNA, 22 bp, Homo sapiens
ccttctctgctccaccacatcc

SEQ ID NO: 3685327 - DNA, 21 bp, Homo sapiens
ccttctttgcagctgcccagc

SEQ ID NO: 3685328 - DNA, 18 bp, Homo sapiens
ccttgaagaactgcaggc

SEQ ID NO: 3685329 - DNA, 15 bp, Homo sapiens
ccttgacaactggca

SEQ ID NO: 3685330 - DNA, 22 bp, Homo sapiens
ccttgagttgattcagctctgc

SEQ ID NO: 3685331 - DNA, 19 bp, Homo sapiens
ccttgcagttcagcaccac

SEQ ID NO: 3685332 - DNA, 15 bp, Homo sapiens
ccttgcctcaatgcc

SEQ ID NO: 3685333 - DNA, 19 bp, Homo sapiens
ccttgctgtttgtcctgag

SEQ ID NO: 3685334 - DNA, 21 bp, Homo sapiens
ccttgctgtttgtcctgagat

SEQ ID NO: 3685335 - DNA, 12 bp, Homo sapiens
ccttggaggaca

SEQ ID NO: 3685336 - DNA, 15 bp, Homo sapiens
ccttggaggacagtg

SEQ ID NO: 3685337 - DNA, 17 bp, Homo sapiens
ccttggaggacagtggg

SEQ ID NO: 3685338 - DNA, 16 bp, Homo sapiens
ccttggaggccagcca

SEQ ID NO: 3685339 - DNA, 14 bp, Homo sapiens
ccttggcctcagaa

SEQ ID NO: 3685340 - DNA, 22 bp, Homo sapiens
ccttggcctgtctcatccccag

SEQ ID NO: 3685341 - DNA, 18 bp, Homo sapiens
ccttggcctttcctggaa

SEQ ID NO: 3685342 - DNA, 16 bp, Homo sapiens
ccttggggcaggcagt

SEQ ID NO: 3685343 - DNA, 22 bp, Homo sapiens
ccttggtgggggagcctctgga

SEQ ID NO: 3685344 - DNA, 12 bp, Homo sapiens
ccttgtgcctgg

SEQ ID NO: 3685345 - DNA, 15 bp, Homo sapiens
ccttgtgcctggggt

SEQ ID NO: 3685346 - DNA, 16 bp, Homo sapiens
ccttgttacttctgag

SEQ ID NO: 3685347 - DNA, 19 bp, Homo sapiens
ccttgttacttctgaggta

SEQ ID NO: 3685348 - DNA, 19 bp, Homo sapiens
cctttaagcctgcattctt

SEQ ID NO: 3685349 - DNA, 22 bp, Homo sapiens
cctttatcacctcattctgaac

SEQ ID NO: 3685350 - DNA, 12 bp, Homo sapiens
cctttcaaagct

SEQ ID NO: 3685351 - DNA, 14 bp, Homo sapiens
cctttcaaatttag

SEQ ID NO: 3685352 - DNA, 22 bp, Homo sapiens
cctttcctccgcctgtccacag

SEQ ID NO: 3685353 - DNA, 11 bp, Homo sapiens
cctttcctgga

SEQ ID NO: 3685354 - DNA, 14 bp, Homo sapiens
cctttcctggaagc

SEQ ID NO: 3685355 - DNA, 19 bp, Homo sapiens
cctttctagagcactgcca

SEQ ID NO: 3685356 - DNA, 22 bp, Homo sapiens
cctttctggaagtttctggtgc

SEQ ID NO: 3685357 - DNA, 18 bp, Homo sapiens
cctttgtcctttttcagg

SEQ ID NO: 3685358 - DNA, 20 bp, Homo sapiens
cctttgtctgtcaatcacag

SEQ ID NO: 3685359 - DNA, 13 bp, Homo sapiens
cctttgttctggg

SEQ ID NO: 3685360 - DNA, 23 bp, Homo sapiens
ccttttgaacgcccccccccacc

SEQ ID NO: 3685361 - DNA, 12 bp, Homo sapiens
ccttttgccaat

SEQ ID NO: 3685362 - DNA, 11 bp, Homo sapiens
cctttttaagg

SEQ ID NO: 3685363 - DNA, 14 bp, Homo sapiens
ccttttttgtagtt

SEQ ID NO: 3685364 - DNA, 22 bp, Homo sapiens
ccttttttgttttttcaaaata

SEQ ID NO: 3685365 - DNA, 22 bp, Homo sapiens
cgacagagggaagaaaagagct

SEQ ID NO: 3685366 - DNA, 17 bp, Homo sapiens
cgaccctgggggcacag

SEQ ID NO: 3685367 - DNA, 16 bp, Homo sapiens
cgactccgttggccac

SEQ ID NO: 3685368 - DNA, 16 bp, Homo sapiens
cgactttctgcctgga

SEQ ID NO: 3685369 - DNA, 17 bp, Homo sapiens
cgagaaacagcctgtgt

SEQ ID NO: 3685370 - DNA, 23 bp, Homo sapiens
cgagaggtgggccagtctgtgga

SEQ ID NO: 3685371 - DNA, 20 bp, Homo sapiens
cgagccagcaagaggaaggg

SEQ ID NO: 3685372 - DNA, 17 bp, Homo sapiens
cgaggcctaccccgcag

SEQ ID NO: 3685373 - DNA, 23 bp, Homo sapiens
cgaggcctaccccgcagacacct

SEQ ID NO: 3685374 - DNA, 19 bp, Homo sapiens
cgaggggtgtcttgggcag

SEQ ID NO: 3685375 - DNA, 22 bp, Homo sapiens
cgatactgcgactttctgcctg

SEQ ID NO: 3685376 - DNA, 14 bp, Homo sapiens
cgatcccacacagg

SEQ ID NO: 3685377 - DNA, 14 bp, Homo sapiens
cgcaccattctgac

SEQ ID NO: 3685378 - DNA, 14 bp, Homo sapiens
cgcaccctgcctac

SEQ ID NO: 3685379 - DNA, 18 bp, Homo sapiens
cgcacctcccatcctaat

SEQ ID NO: 3685380 - DNA, 16 bp, Homo sapiens
cgcatcttgcctccag

SEQ ID NO: 3685381 - DNA, 16 bp, Homo sapiens
cgcatgcggcccagga

SEQ ID NO: 3685382 - DNA, 13 bp, Homo sapiens
cgccacccgcagc

SEQ ID NO: 3685383 - DNA, 19 bp, Homo sapiens
cgccaggagaagttgaggg

SEQ ID NO: 3685384 - DNA, 23 bp, Homo sapiens
cgccaggggaaaatcagcctgct

SEQ ID NO: 3685385 - DNA, 15 bp, Homo sapiens
cgccatgctcctggc

SEQ ID NO: 3685386 - DNA, 17 bp, Homo sapiens
cgccattgccaccagga

SEQ ID NO: 3685387 - DNA, 20 bp, Homo sapiens
cgccccctccgccctgccac

SEQ ID NO: 3685388 - DNA, 14 bp, Homo sapiens
cgcccgtcctgcct

SEQ ID NO: 3685389 - DNA, 17 bp, Homo sapiens
cgcccgtcctgcctgtg

SEQ ID NO: 3685390 - DNA, 23 bp, Homo sapiens
cgcccgtctctgctctgctcagc

SEQ ID NO: 3685391 - DNA, 12 bp, Homo sapiens
cgccctcctgat

SEQ ID NO: 3685392 - DNA, 16 bp, Homo sapiens
cgccctgcccgggctc

SEQ ID NO: 3685393 - DNA, 16 bp, Homo sapiens
cgcctccatccaaggc

SEQ ID NO: 3685394 - DNA, 18 bp, Homo sapiens
cgcctccatccaaggcca

SEQ ID NO: 3685395 - DNA, 18 bp, Homo sapiens
cgcctccccacctccagg

SEQ ID NO: 3685396 - DNA, 17 bp, Homo sapiens
cgcctgtgatgctgggc

SEQ ID NO: 3685397 - DNA, 21 bp, Homo sapiens
cgcctgtgccaccccttcctc

SEQ ID NO: 3685398 - DNA, 14 bp, Homo sapiens
cgcgatcccacaca

SEQ ID NO: 3685399 - DNA, 17 bp, Homo sapiens
cgcgccgacgcctgtgc

SEQ ID NO: 3685400 - DNA, 19 bp, Homo sapiens
cgcggtggctcacgcctgt

SEQ ID NO: 3685401 - DNA, 19 bp, Homo sapiens
cgcgtgcacgtggagagct

SEQ ID NO: 3685402 - DNA, 16 bp, Homo sapiens
cgctactataaagaga

SEQ ID NO: 3685403 - DNA, 20 bp, Homo sapiens
cgctcagggccatgctgagg

SEQ ID NO: 3685404 - DNA, 17 bp, Homo sapiens
cgctcctctgtttgttt

SEQ ID NO: 3685405 - DNA, 14 bp, Homo sapiens
cgctgaacccaccc

SEQ ID NO: 3685406 - DNA, 16 bp, Homo sapiens
cgctgccacccacctc

SEQ ID NO: 3685407 - DNA, 17 bp, Homo sapiens
cgctgtcctttctagag

SEQ ID NO: 3685408 - DNA, 21 bp, Homo sapiens
cgctgtttttgttgtgtgtgc

SEQ ID NO: 3685409 - DNA, 20 bp, Homo sapiens
cggaaagcagctcaaaggca

SEQ ID NO: 3685410 - DNA, 17 bp, Homo sapiens
ctatggtcgggagacag

SEQ ID NO: 3685411 - DNA, 14 bp, Homo sapiens
ctatgtatgttaat

SEQ ID NO: 3685412 - DNA, 15 bp, Homo sapiens
ctattagagaagaga

SEQ ID NO: 3685413 - DNA, 17 bp, Homo sapiens
ctattccttttctgtat

SEQ ID NO: 3685414 - DNA, 16 bp, Homo sapiens
ctattgctgcttgagg

SEQ ID NO: 3685415 - DNA, 21 bp, Homo sapiens
ctattggaggatcagtttttt

SEQ ID NO: 3685416 - DNA, 11 bp, Homo sapiens
ctattggtaaa

SEQ ID NO: 3685417 - DNA, 23 bp, Homo sapiens
ctattttaagactgattttaata

SEQ ID NO: 3685418 - DNA, 19 bp, Homo sapiens
ctcaaaaaacattgttttg

SEQ ID NO: 3685419 - DNA, 16 bp, Homo sapiens
ctcaaatggggccaga

SEQ ID NO: 3685420 - DNA, 19 bp, Homo sapiens
ctcaaatggggccagatcc

SEQ ID NO: 3685421 - DNA, 16 bp, Homo sapiens
ctcaagccaagcagcc

SEQ ID NO: 3685422 - DNA, 16 bp, Homo sapiens
ctcaatagatctccag

SEQ ID NO: 3685423 - DNA, 13 bp, Homo sapiens
ctcaatattttcc

SEQ ID NO: 3685424 - DNA, 23 bp, Homo sapiens
ctcacacggacactcaaaagctg

SEQ ID NO: 3685425 - DNA, 14 bp, Homo sapiens
ctcacctctggact

SEQ ID NO: 3685426 - DNA, 21 bp, Homo sapiens
ctcacctctggactggctaga

SEQ ID NO: 3685427 - DNA, 22 bp, Homo sapiens
ctcacctctggactggctagag

SEQ ID NO: 3685428 - DNA, 12 bp, Homo sapiens
ctcacctggggt

SEQ ID NO: 3685429 - DNA, 15 bp, Homo sapiens
ctcacgcacctccca

SEQ ID NO: 3685430 - DNA, 15 bp, Homo sapiens
ctcactaatttttgt

SEQ ID NO: 3685431 - DNA, 23 bp, Homo sapiens
ctcactaggcccccacttgcctc

SEQ ID NO: 3685432 - DNA, 15 bp, Homo sapiens
ctcactcccttccca

SEQ ID NO: 3685433 - DNA, 21 bp, Homo sapiens
ctcactcccttcccataagct

SEQ ID NO: 3685434 - DNA, 12 bp, Homo sapiens
ctcactgtgacc

SEQ ID NO: 3685435 - DNA, 18 bp, Homo sapiens
ctcagaaccttgtcccag

SEQ ID NO: 3685436 - DNA, 17 bp, Homo sapiens
ctcagacattggcacct

SEQ ID NO: 3685437 - DNA, 18 bp, Homo sapiens
ctcagagtcggaacggag

SEQ ID NO: 3685438 - DNA, 21 bp, Homo sapiens
ctcagataaggtaaaatgcca

SEQ ID NO: 3685439 - DNA, 22 bp, Homo sapiens
ctcagataaggtaaaatgccat

SEQ ID NO: 3685440 - DNA, 22 bp, Homo sapiens
ctcagatggaaccgcaggaagc

SEQ ID NO: 3685441 - DNA, 20 bp, Homo sapiens
ctcagcaaaagatgcttctc

SEQ ID NO: 3685442 - DNA, 14 bp, Homo sapiens
ctcagcatttgatt

SEQ ID NO: 3685443 - DNA, 11 bp, Homo sapiens
ctcagccctga

SEQ ID NO: 3685444 - DNA, 14 bp, Homo sapiens
ctcagccctgaggt

SEQ ID NO: 3685445 - DNA, 15 bp, Homo sapiens
ctcagcctctgccac

SEQ ID NO: 3685446 - DNA, 13 bp, Homo sapiens
ctcagcctggcca

SEQ ID NO: 3685447 - DNA, 15 bp, Homo sapiens
ctcagcctggccaga

SEQ ID NO: 3685448 - DNA, 16 bp, Homo sapiens
ctcagcctggccagac

SEQ ID NO: 3685449 - DNA, 17 bp, Homo sapiens
ctcagcctggccagaca

SEQ ID NO: 3685450 - DNA, 19 bp, Homo sapiens
ctcagcctggccagacaca

SEQ ID NO: 3685451 - DNA, 12 bp, Homo sapiens
ctcagcctgggg

SEQ ID NO: 3685452 - DNA, 14 bp, Homo sapiens
ctcagcctggggtt

SEQ ID NO: 3685453 - DNA, 16 bp, Homo sapiens
ctcagcctggggtttg

SEQ ID NO: 3685454 - DNA, 16 bp, Homo sapiens
ctcagccttcagacag

SEQ ID NO: 3685455 - DNA, 19 bp, Homo sapiens
ctcagccttcagacagaga

SEQ ID NO: 3685456 - DNA, 17 bp, Homo sapiens
ctcagccttgccagaga

SEQ ID NO: 3685457 - DNA, 20 bp, Homo sapiens
ctcagccttgccagagatcc

SEQ ID NO: 3685458 - DNA, 14 bp, Homo sapiens
ctcagctcactgtg

SEQ ID NO: 3685459 - DNA, 17 bp, Homo sapiens
ctcagctcactgtgacc

SEQ ID NO: 3685460 - DNA, 14 bp, Homo sapiens
ctcaggacagatgc

SEQ ID NO: 3685461 - DNA, 14 bp, Homo sapiens
ctcaggactctgaa

SEQ ID NO: 3685462 - DNA, 19 bp, Homo sapiens
ctcaggagcaccctgtctt

SEQ ID NO: 3685463 - DNA, 21 bp, Homo sapiens
ctcaggagcaccctgtcttct

SEQ ID NO: 3685464 - DNA, 18 bp, Homo sapiens
ctcaggagtttgagacca

SEQ ID NO: 3685465 - DNA, 15 bp, Homo sapiens
ctcaggcaggtggga

SEQ ID NO: 3685466 - DNA, 18 bp, Homo sapiens
ctcaggcaggtgggatgg

SEQ ID NO: 3685467 - DNA, 17 bp, Homo sapiens
ctcagggccatgctgag

SEQ ID NO: 3685468 - DNA, 19 bp, Homo sapiens
ctcagggccatgctgaggc

SEQ ID NO: 3685469 - DNA, 15 bp, Homo sapiens
ctcagggtggtctct

SEQ ID NO: 3685470 - DNA, 16 bp, Homo sapiens
ctcaggtgagaagcag

SEQ ID NO: 3685471 - DNA, 18 bp, Homo sapiens
ctcagtactttggaggcc

SEQ ID NO: 3685472 - DNA, 11 bp, Homo sapiens
ctcagtgcaga

SEQ ID NO: 3685473 - DNA, 22 bp, Homo sapiens
ctcagtgcatttgtgctagaaa

SEQ ID NO: 3685474 - DNA, 20 bp, Homo sapiens
ctcagtgggctgtttctgct

SEQ ID NO: 3685475 - DNA, 22 bp, Homo sapiens
ctcagtgggctgtttctgctta

SEQ ID NO: 3685476 - DNA, 17 bp, Homo sapiens
ctcagttcccttggcct

SEQ ID NO: 3685477 - DNA, 19 bp, Homo sapiens
ctcagttcccttggcctca

SEQ ID NO: 3685478 - DNA, 20 bp, Homo sapiens
ctcagttcccttggcctcag

SEQ ID NO: 3685479 - DNA, 21 bp, Homo sapiens
ctcagttcccttggcctcaga

SEQ ID NO: 3685480 - DNA, 22 bp, Homo sapiens
ctcagttcccttggcctcagaa

SEQ ID NO: 3685481 - DNA, 15 bp, Homo sapiens
ctcagttgattttct

SEQ ID NO: 3685482 - DNA, 18 bp, Homo sapiens
ctcataagtttgtttaaa

SEQ ID NO: 3685483 - DNA, 22 bp, Homo sapiens
ctcatactacaggatatttact

SEQ ID NO: 3685484 - DNA, 22 bp, Homo sapiens
ctcatccccaaccccctgtaag

SEQ ID NO: 3685485 - DNA, 16 bp, Homo sapiens
ctcatctctctgccca

SEQ ID NO: 3685486 - DNA, 17 bp, Homo sapiens
ctcatctctctgcccaa

SEQ ID NO: 3685487 - DNA, 15 bp, Homo sapiens
ctcatctgctggtcc

SEQ ID NO: 3685488 - DNA, 16 bp, Homo sapiens
ctcatctgctggtccg

SEQ ID NO: 3685489 - DNA, 20 bp, Homo sapiens
ctcatctgctggtccgtggg

SEQ ID NO: 3685490 - DNA, 23 bp, Homo sapiens
ctcatggagtcatcttgcacaca

SEQ ID NO: 3685491 - DNA, 15 bp, Homo sapiens
ctcatggccagcgcc

SEQ ID NO: 3685492 - DNA, 16 bp, Homo sapiens
ctcatggccagcgccc

SEQ ID NO: 3685493 - DNA, 15 bp, Homo sapiens
ctcatggcgggactg

SEQ ID NO: 3685494 - DNA, 14 bp, Homo sapiens
ctcatgtggctgga

SEQ ID NO: 3685495 - DNA, 16 bp, Homo sapiens
ctcatgttttcaactg

SEQ ID NO: 3685496 - DNA, 17 bp, Homo sapiens
ctcatgttttcaactgc

SEQ ID NO: 3685497 - DNA, 18 bp, Homo sapiens
ctcatgttttcaactgcc

SEQ ID NO: 3685498 - DNA, 11 bp, Homo sapiens
ctcattctgaa

SEQ ID NO: 3685499 - DNA, 17 bp, Homo sapiens
ctcatttggggtagcta

SEQ ID NO: 3685500 - DNA, 15 bp, Homo sapiens
ctccaagccccatct

SEQ ID NO: 3685501 - DNA, 13 bp, Homo sapiens
ctccaagcgcctg

SEQ ID NO: 3685502 - DNA, 15 bp, Homo sapiens
ctccaagcgcctggc

SEQ ID NO: 3685503 - DNA, 16 bp, Homo sapiens
ctccaagcgcctggct

SEQ ID NO: 3685504 - DNA, 19 bp, Homo sapiens
ctccaatggggcggggctt

SEQ ID NO: 3685505 - DNA, 12 bp, Homo sapiens
ctccacccttgg

SEQ ID NO: 3685506 - DNA, 21 bp, Homo sapiens
ctccacccttggcctgtctca

SEQ ID NO: 3685507 - DNA, 13 bp, Homo sapiens
ctccactctgctt

SEQ ID NO: 3685508 - DNA, 14 bp, Homo sapiens
ctccactctgcttc

SEQ ID NO: 3685509 - DNA, 14 bp, Homo sapiens
ctccactgccatgt

SEQ ID NO: 3685510 - DNA, 11 bp, Homo sapiens
ctccacttgct

SEQ ID NO: 3685511 - DNA, 12 bp, Homo sapiens
ctccagacctga

SEQ ID NO: 3685512 - DNA, 14 bp, Homo sapiens
ctccagacctgatc

SEQ ID NO: 3685513 - DNA, 19 bp, Homo sapiens
ctccagacctgatcctgga

SEQ ID NO: 3685514 - DNA, 20 bp, Homo sapiens
ctccagagagaaatcaggcc

SEQ ID NO: 3685515 - DNA, 22 bp, Homo sapiens
ctccagagagaaatcaggcctg

SEQ ID NO: 3685516 - DNA, 13 bp, Homo sapiens
ctccagagcagga

SEQ ID NO: 3685517 - DNA, 12 bp, Homo sapiens
ctccagcctggg

SEQ ID NO: 3685518 - DNA, 23 bp, Homo sapiens
ctccagcctggtggcccagctat

SEQ ID NO: 3685519 - DNA, 22 bp, Homo sapiens
ctccagcgatctctccactgtg

SEQ ID NO: 3685520 - DNA, 19 bp, Homo sapiens
ctccagctgggttggaaaa

SEQ ID NO: 3685521 - DNA, 18 bp, Homo sapiens
ctccaggaaccacaccac

SEQ ID NO: 3685522 - DNA, 22 bp, Homo sapiens
ctccaggatctttgactgaaaa

SEQ ID NO: 3685523 - DNA, 18 bp, Homo sapiens
ctccaggatggggagggg

SEQ ID NO: 3685524 - DNA, 20 bp, Homo sapiens
ctccaggatggggaggggct

SEQ ID NO: 3685525 - DNA, 18 bp, Homo sapiens
ctccaggccctcctctcc

SEQ ID NO: 3685526 - DNA, 23 bp, Homo sapiens
ctccaggggctgcttcctcctgg

SEQ ID NO: 3685527 - DNA, 15 bp, Homo sapiens
ctgaagccgtgcctg

SEQ ID NO: 3685528 - DNA, 18 bp, Homo sapiens
ctgaagccgtgcctgtag

SEQ ID NO: 3685529 - DNA, 19 bp, Homo sapiens
ctgaaggaggcggggctct

SEQ ID NO: 3685530 - DNA, 23 bp, Homo sapiens
ctgaaggcagggctcctccctgg

SEQ ID NO: 3685531 - DNA, 13 bp, Homo sapiens
ctgaagggcctcc

SEQ ID NO: 3685532 - DNA, 23 bp, Homo sapiens
ctgaaggggccatgatggcaaca

SEQ ID NO: 3685533 - DNA, 22 bp, Homo sapiens
ctgaagtcccagatacttgggg

SEQ ID NO: 3685534 - DNA, 23 bp, Homo sapiens
ctgaagtttttttgctgctgcct

SEQ ID NO: 3685535 - DNA, 23 bp, Homo sapiens
ctgaatcttcaccatctttctga

SEQ ID NO: 3685536 - DNA, 16 bp, Homo sapiens
ctgaattttgggactt

SEQ ID NO: 3685537 - DNA, 20 bp, Homo sapiens
ctgaattttgggacttctac

SEQ ID NO: 3685538 - DNA, 16 bp, Homo sapiens
ctgacagctgctccta

SEQ ID NO: 3685539 - DNA, 22 bp, Homo sapiens
ctgacagctgctcctagaggga

SEQ ID NO: 3685540 - DNA, 14 bp, Homo sapiens
ctgacatgtggggc

SEQ ID NO: 3685541 - DNA, 21 bp, Homo sapiens
ctgacatgtggggccaggtca

SEQ ID NO: 3685542 - DNA, 20 bp, Homo sapiens
ctgaccaaatcacccaatcc

SEQ ID NO: 3685543 - DNA, 22 bp, Homo sapiens
ctgaccaagactgagccagctt

SEQ ID NO: 3685544 - DNA, 16 bp, Homo sapiens
ctgaccagcagcgcct

SEQ ID NO: 3685545 - DNA, 16 bp, Homo sapiens
ctgaccagggcaaggc

SEQ ID NO: 3685546 - DNA, 15 bp, Homo sapiens
ctgaccaggggccct

SEQ ID NO: 3685547 - DNA, 22 bp, Homo sapiens
ctgaccaggggccctacctggg

SEQ ID NO: 3685548 - DNA, 21 bp, Homo sapiens
ctgaccatgctcatctgctgg

SEQ ID NO: 3685549 - DNA, 12 bp, Homo sapiens
ctgacccagtgc

SEQ ID NO: 3685550 - DNA, 13 bp, Homo sapiens
ctgacccagtgcc

SEQ ID NO: 3685551 - DNA, 13 bp, Homo sapiens
ctgaccccagccc

SEQ ID NO: 3685552 - DNA, 20 bp, Homo sapiens
ctgaccgaaacagcgctggg

SEQ ID NO: 3685553 - DNA, 15 bp, Homo sapiens
ctgacggccagggag

SEQ ID NO: 3685554 - DNA, 20 bp, Homo sapiens
ctgactacggaactgcacac

SEQ ID NO: 3685555 - DNA, 21 bp, Homo sapiens
ctgactacggaactgcacact

SEQ ID NO: 3685556 - DNA, 16 bp, Homo sapiens
ctgactcatccgcctg

SEQ ID NO: 3685557 - DNA, 19 bp, Homo sapiens
ctgactcatccgcctggcc

SEQ ID NO: 3685558 - DNA, 18 bp, Homo sapiens
ctgactcggtttctccaa

SEQ ID NO: 3685559 - DNA, 14 bp, Homo sapiens
ctgactgttcttgg

SEQ ID NO: 3685560 - DNA, 16 bp, Homo sapiens
ctgactgttttctctt

SEQ ID NO: 3685561 - DNA, 16 bp, Homo sapiens
ctgacttctgcctgga

SEQ ID NO: 3685562 - DNA, 20 bp, Homo sapiens
ctgagatgggccggccccct

SEQ ID NO: 3685563 - DNA, 17 bp, Homo sapiens
ctgagcacgctaccaaa

SEQ ID NO: 3685564 - DNA, 16 bp, Homo sapiens
ctgagcccaacccttc

SEQ ID NO: 3685565 - DNA, 18 bp, Homo sapiens
ctgagcccaacccttcta

SEQ ID NO: 3685566 - DNA, 12 bp, Homo sapiens
ctgagcccctgt

SEQ ID NO: 3685567 - DNA, 15 bp, Homo sapiens
ctgagcccctgtcta

SEQ ID NO: 3685568 - DNA, 23 bp, Homo sapiens
ctgagcccctgtctagagaggga

SEQ ID NO: 3685569 - DNA, 14 bp, Homo sapiens
ctgagcctgcaggg

SEQ ID NO: 3685570 - DNA, 15 bp, Homo sapiens
ctgagcctgcaggga

SEQ ID NO: 3685571 - DNA, 18 bp, Homo sapiens
ctgagcctgcagggaagc

SEQ ID NO: 3685572 - DNA, 19 bp, Homo sapiens
ctgagcctgcagggaagcc

SEQ ID NO: 3685573 - DNA, 15 bp, Homo sapiens
ctgagctgaccagcc

SEQ ID NO: 3685574 - DNA, 18 bp, Homo sapiens
ctgagctgcccctgctgc

SEQ ID NO: 3685575 - DNA, 20 bp, Homo sapiens
ctgagctgcccctgctgctt

SEQ ID NO: 3685576 - DNA, 16 bp, Homo sapiens
ctgaggaaaggccagc

SEQ ID NO: 3685577 - DNA, 22 bp, Homo sapiens
ctgaggaaaggccagctggcag

SEQ ID NO: 3685578 - DNA, 16 bp, Homo sapiens
ctgaggcagggaagtc

SEQ ID NO: 3685579 - DNA, 20 bp, Homo sapiens
ctgaggcagggaagtcccca

SEQ ID NO: 3685580 - DNA, 21 bp, Homo sapiens
ctgaggcagggaagtccccag

SEQ ID NO: 3685581 - DNA, 22 bp, Homo sapiens
ctgaggcagggaagtccccagg

SEQ ID NO: 3685582 - DNA, 18 bp, Homo sapiens
ctgagggaccaactgggc

SEQ ID NO: 3685583 - DNA, 21 bp, Homo sapiens
ctgagggaccaactgggccca

SEQ ID NO: 3685584 - DNA, 19 bp, Homo sapiens
ctgagggcagactggggca

SEQ ID NO: 3685585 - DNA, 21 bp, Homo sapiens
ctgagggcggagcgcctcctt

SEQ ID NO: 3685586 - DNA, 16 bp, Homo sapiens
ctgaggggcatctgcc

SEQ ID NO: 3685587 - DNA, 17 bp, Homo sapiens
ctgaggggcatctgccc

SEQ ID NO: 3685588 - DNA, 22 bp, Homo sapiens
ctgaggtcatcggcgtggccca

SEQ ID NO: 3685589 - DNA, 17 bp, Homo sapiens
ctgaggtgaaagggagc

SEQ ID NO: 3685590 - DNA, 19 bp, Homo sapiens
ctgagtagctctcctgact

SEQ ID NO: 3685591 - DNA, 18 bp, Homo sapiens
ctgagtgaaggaaatgaa

SEQ ID NO: 3685592 - DNA, 22 bp, Homo sapiens
ctgagtgggggatcacagcctc

SEQ ID NO: 3685593 - DNA, 21 bp, Homo sapiens
ctgagttggtgttgacatgtg

SEQ ID NO: 3685594 - DNA, 11 bp, Homo sapiens
ctgagttttcc

SEQ ID NO: 3685595 - DNA, 22 bp, Homo sapiens
ctgagttttccatggcaggaag

SEQ ID NO: 3685596 - DNA, 16 bp, Homo sapiens
ctgataaagcacagct

SEQ ID NO: 3685597 - DNA, 18 bp, Homo sapiens
ctgataaagcacagctgt

SEQ ID NO: 3685598 - DNA, 15 bp, Homo sapiens
ctgatcaaggcctta

SEQ ID NO: 3685599 - DNA, 12 bp, Homo sapiens
ctgatcctggag

SEQ ID NO: 3685600 - DNA, 23 bp, Homo sapiens
ctgatgagggggaattcctggaa

SEQ ID NO: 3685601 - DNA, 15 bp, Homo sapiens
ctgatgctccctccc

SEQ ID NO: 3685602 - DNA, 12 bp, Homo sapiens
ctgatgctgcta

SEQ ID NO: 3685603 - DNA, 14 bp, Homo sapiens
ctgatgtcaaagtg

SEQ ID NO: 3685604 - DNA, 15 bp, Homo sapiens
ctgattcccctccac

SEQ ID NO: 3685605 - DNA, 16 bp, Homo sapiens
ctgatttaggagaagc

SEQ ID NO: 3685606 - DNA, 18 bp, Homo sapiens
ctgatttaggagaagcca

SEQ ID NO: 3685607 - DNA, 13 bp, Homo sapiens
ctgcaaaaaatac

SEQ ID NO: 3685608 - DNA, 13 bp, Homo sapiens
ctgcaaccactct

SEQ ID NO: 3685609 - DNA, 20 bp, Homo sapiens
ctgcaaccactctgtggcca

SEQ ID NO: 3685610 - DNA, 23 bp, Homo sapiens
ctgcaaccactctgtggccagcc

SEQ ID NO: 3685611 - DNA, 20 bp, Homo sapiens
ctgcaagaattgaagcagga

SEQ ID NO: 3685612 - DNA, 20 bp, Homo sapiens
ctgcaaggtttaggctggtg

SEQ ID NO: 3685613 - DNA, 15 bp, Homo sapiens
ctgcacaagctgcac

SEQ ID NO: 3685614 - DNA, 18 bp, Homo sapiens
ctgcacaagctgcaccct

SEQ ID NO: 3685615 - DNA, 14 bp, Homo sapiens
ctgcacactcagtg

SEQ ID NO: 3685616 - DNA, 23 bp, Homo sapiens
ctgcacatgactcgggggtgggg

SEQ ID NO: 3685617 - DNA, 14 bp, Homo sapiens
ctgcacccccctgg

SEQ ID NO: 3685618 - DNA, 16 bp, Homo sapiens
ctgcactactgacatg

SEQ ID NO: 3685619 - DNA, 16 bp, Homo sapiens
ctgcactccagcctgg

SEQ ID NO: 3685620 - DNA, 18 bp, Homo sapiens
ctgcactccagcctgggt

SEQ ID NO: 3685621 - DNA, 18 bp, Homo sapiens
ctgcactgatgctgcccc

SEQ ID NO: 3685622 - DNA, 19 bp, Homo sapiens
ctgcactgatgctgcccct

SEQ ID NO: 3685623 - DNA, 15 bp, Homo sapiens
ctgcacttacttgct

SEQ ID NO: 3685624 - DNA, 16 bp, Homo sapiens
ctgcacttacttgctt

SEQ ID NO: 3685625 - DNA, 22 bp, Homo sapiens
ctgcagaatttgggttctgcct

SEQ ID NO: 3685626 - DNA, 15 bp, Homo sapiens
ctgcagaccacgccc

SEQ ID NO: 3685627 - DNA, 11 bp, Homo sapiens
ctgcagaggcc

SEQ ID NO: 3685628 - DNA, 13 bp, Homo sapiens
ctgcagaggccag

SEQ ID NO: 3685629 - DNA, 17 bp, Homo sapiens
ctgcagaggccagaggc

SEQ ID NO: 3685630 - DNA, 11 bp, Homo sapiens
ctgcagagggg

SEQ ID NO: 3685631 - DNA, 18 bp, Homo sapiens
ctgcagatcttccgtggt

SEQ ID NO: 3685632 - DNA, 19 bp, Homo sapiens
ctgcagatcttccgtggtc

SEQ ID NO: 3685633 - DNA, 20 bp, Homo sapiens
ctgcaggaatcccggctcca

SEQ ID NO: 3685634 - DNA, 11 bp, Homo sapiens
ctgcaggcagg

SEQ ID NO: 3685635 - DNA, 14 bp, Homo sapiens
ctgcaggccctggc

SEQ ID NO: 3685636 - DNA, 16 bp, Homo sapiens
ctgcaggccctggcct

SEQ ID NO: 3685637 - DNA, 17 bp, Homo sapiens
ctgcaggccctggcctc

SEQ ID NO: 3685638 - DNA, 19 bp, Homo sapiens
ctgcaggccctggcctccc

SEQ ID NO: 3685639 - DNA, 21 bp, Homo sapiens
ctgcaggcggggctcctcctg

SEQ ID NO: 3685640 - DNA, 18 bp, Homo sapiens
ctgcagggccatggctca

SEQ ID NO: 3685641 - DNA, 20 bp, Homo sapiens
ctgcagttcttgtggaagac

SEQ ID NO: 3685642 - DNA, 15 bp, Homo sapiens
ctgcataggctcctt

SEQ ID NO: 3685643 - DNA, 17 bp, Homo sapiens
ctggagatcctcctgca

SEQ ID NO: 3685644 - DNA, 18 bp, Homo sapiens
ctggagatcctcctgcag

SEQ ID NO: 3685645 - DNA, 23 bp, Homo sapiens
ctggagatcctcctgcagaccac

SEQ ID NO: 3685646 - DNA, 13 bp, Homo sapiens
ctggagcccaggg

SEQ ID NO: 3685647 - DNA, 20 bp, Homo sapiens
ctggagctagtgtctcctct

SEQ ID NO: 3685648 - DNA, 22 bp, Homo sapiens
ctggaggatcccctccaagcct

SEQ ID NO: 3685649 - DNA, 15 bp, Homo sapiens
ctggaggcccagttc

SEQ ID NO: 3685650 - DNA, 13 bp, Homo sapiens
ctggaggggaggg

SEQ ID NO: 3685651 - DNA, 20 bp, Homo sapiens
ctggagggtgagaggaaggg

SEQ ID NO: 3685652 - DNA, 13 bp, Homo sapiens
ctggagtggccac

SEQ ID NO: 3685653 - DNA, 16 bp, Homo sapiens
ctggatgctccttcca

SEQ ID NO: 3685654 - DNA, 18 bp, Homo sapiens
ctggatggggcagagctt

SEQ ID NO: 3685655 - DNA, 20 bp, Homo sapiens
ctggattccccatctcaggc

SEQ ID NO: 3685656 - DNA, 20 bp, Homo sapiens
ctggcaaaaggatctttgtg

SEQ ID NO: 3685657 - DNA, 23 bp, Homo sapiens
ctggcaaaaggatctttgtggcc

SEQ ID NO: 3685658 - DNA, 15 bp, Homo sapiens
ctggcagcagagtgt

SEQ ID NO: 3685659 - DNA, 18 bp, Homo sapiens
ctggcagctctggacagc

SEQ ID NO: 3685660 - DNA, 21 bp, Homo sapiens
ctggcagctctggacagcccc

SEQ ID NO: 3685661 - DNA, 24 bp, Homo sapiens
ctggcaggcaggctcccagggaca

SEQ ID NO: 3685662 - DNA, 17 bp, Homo sapiens
ctggcatcgcaccattc

SEQ ID NO: 3685663 - DNA, 18 bp, Homo sapiens
ctggcatcgcaccattct

SEQ ID NO: 3685664 - DNA, 20 bp, Homo sapiens
ctggcatcgcaccattctga

SEQ ID NO: 3685665 - DNA, 23 bp, Homo sapiens
ctggcatcgcaccattctgactc

SEQ ID NO: 3685666 - DNA, 18 bp, Homo sapiens
ctggcatcttagacctcc

SEQ ID NO: 3685667 - DNA, 13 bp, Homo sapiens
ctggccaggagct

SEQ ID NO: 3685668 - DNA, 20 bp, Homo sapiens
ctggccaggagctcttcagg

SEQ ID NO: 3685669 - DNA, 21 bp, Homo sapiens
ctggccaggcagatctgtgcc

SEQ ID NO: 3685670 - DNA, 17 bp, Homo sapiens
ctggccagtccaggctg

SEQ ID NO: 3685671 - DNA, 12 bp, Homo sapiens
ctggcccactgc

SEQ ID NO: 3685672 - DNA, 11 bp, Homo sapiens
ctggcccaggg

SEQ ID NO: 3685673 - DNA, 13 bp, Homo sapiens
ctggcccagggcc

SEQ ID NO: 3685674 - DNA, 16 bp, Homo sapiens
ctggcccagggcccag

SEQ ID NO: 3685675 - DNA, 18 bp, Homo sapiens
ctggcccagggcccagag

SEQ ID NO: 3685676 - DNA, 20 bp, Homo sapiens
ctggccgagggtcctggctc

SEQ ID NO: 3685677 - DNA, 17 bp, Homo sapiens
ctggcctcccctgccac

SEQ ID NO: 3685678 - DNA, 14 bp, Homo sapiens
ctggccttctccta

SEQ ID NO: 3685679 - DNA, 20 bp, Homo sapiens
ctggctagaggccagcccca

SEQ ID NO: 3685680 - DNA, 23 bp, Homo sapiens
ctggctagaggccagccccaccc

SEQ ID NO: 3685681 - DNA, 18 bp, Homo sapiens
ctggctagagtcctcact

SEQ ID NO: 3685682 - DNA, 14 bp, Homo sapiens
ctggctcctgaggg

SEQ ID NO: 3685683 - DNA, 13 bp, Homo sapiens
ctggctctgagcg

SEQ ID NO: 3685684 - DNA, 20 bp, Homo sapiens
ctggctctgagcgcctccat

SEQ ID NO: 3685685 - DNA, 17 bp, Homo sapiens
ctggctgactaagcccc

SEQ ID NO: 3685686 - DNA, 22 bp, Homo sapiens
ctggctgactaagccccgtctg

SEQ ID NO: 3685687 - DNA, 22 bp, Homo sapiens
ctggctgggtggcaccagcagc

SEQ ID NO: 3685688 - DNA, 22 bp, Homo sapiens
ctggctttggaatgctccaggc

SEQ ID NO: 3685689 - DNA, 19 bp, Homo sapiens
ctgggaaccgccctcctga

SEQ ID NO: 3685690 - DNA, 13 bp, Homo sapiens
ctgggaagcccgg

SEQ ID NO: 3685691 - DNA, 21 bp, Homo sapiens
ctgggaagcccggactgacca

SEQ ID NO: 3685692 - DNA, 14 bp, Homo sapiens
ctgggaccaggctc

SEQ ID NO: 3685693 - DNA, 13 bp, Homo sapiens
ctgggactcagcc

SEQ ID NO: 3685694 - DNA, 13 bp, Homo sapiens
ctgggagaaatct

SEQ ID NO: 3685695 - DNA, 21 bp, Homo sapiens
ctgggagaaatctggcttctg

SEQ ID NO: 3685696 - DNA, 17 bp, Homo sapiens
ctgggagaggacaggga

SEQ ID NO: 3685697 - DNA, 21 bp, Homo sapiens
ctgggatccgagggcccctct

SEQ ID NO: 3685698 - DNA, 13 bp, Homo sapiens
ctgggcagaaggc

SEQ ID NO: 3685699 - DNA, 16 bp, Homo sapiens
ctgggcagccaggctg

SEQ ID NO: 3685700 - DNA, 18 bp, Homo sapiens
ctgggcagccaggctgcc

SEQ ID NO: 3685701 - DNA, 16 bp, Homo sapiens
ctgggcagctgtccct

SEQ ID NO: 3685702 - DNA, 17 bp, Homo sapiens
ctgggcagctgtccctt

SEQ ID NO: 3685703 - DNA, 16 bp, Homo sapiens
ctgggccctgggctgg

SEQ ID NO: 3685704 - DNA, 22 bp, Homo sapiens
ctgggcggcgggcggctgggtc

SEQ ID NO: 3685705 - DNA, 18 bp, Homo sapiens
ctgggctgctcctgaatg

SEQ ID NO: 3685706 - DNA, 15 bp, Homo sapiens
ctggggaaagcctga

SEQ ID NO: 3685707 - DNA, 14 bp, Homo sapiens
ctggggacggggct

SEQ ID NO: 3685708 - DNA, 16 bp, Homo sapiens
ctggggacggggctcc

SEQ ID NO: 3685709 - DNA, 18 bp, Homo sapiens
ctggggcatcctgtgcca

SEQ ID NO: 3685710 - DNA, 14 bp, Homo sapiens
ctgggggcacagga

SEQ ID NO: 3685711 - DNA, 12 bp, Homo sapiens
ctgggggcagga

SEQ ID NO: 3685712 - DNA, 12 bp, Homo sapiens
ctgggggcggga

SEQ ID NO: 3685713 - DNA, 15 bp, Homo sapiens
ctgggggcgggactc

SEQ ID NO: 3685714 - DNA, 18 bp, Homo sapiens
ctggggggacccagtgca

SEQ ID NO: 3685715 - DNA, 19 bp, Homo sapiens
ctggggggacccagtgcag

SEQ ID NO: 3685716 - DNA, 14 bp, Homo sapiens
ctgggggtgggcca

SEQ ID NO: 3685717 - DNA, 16 bp, Homo sapiens
ctgggggtggggctcc

SEQ ID NO: 3685718 - DNA, 18 bp, Homo sapiens
ctgggggtggggctccta

SEQ ID NO: 3685719 - DNA, 21 bp, Homo sapiens
ctggggtaggctgctccctga

SEQ ID NO: 3685720 - DNA, 13 bp, Homo sapiens
ctggggtctggag

SEQ ID NO: 3685721 - DNA, 22 bp, Homo sapiens
ctggggtctggagttgatctgg

SEQ ID NO: 3685722 - DNA, 20 bp, Homo sapiens
ctggggtggggtcatgccct

SEQ ID NO: 3685723 - DNA, 20 bp, Homo sapiens
ctggggtgttagtggcaccg

SEQ ID NO: 3685724 - DNA, 22 bp, Homo sapiens
ctggggtttgaccacccacctg

SEQ ID NO: 3685725 - DNA, 22 bp, Homo sapiens
ctgggtaactagggaagataat

SEQ ID NO: 3685726 - DNA, 23 bp, Homo sapiens
ctgggtaagaagaaagcaaaagc

SEQ ID NO: 3685727 - DNA, 20 bp, Homo sapiens
ctgggtacttcttgaaggtg

SEQ ID NO: 3685728 - DNA, 23 bp, Homo sapiens
ctgggtacttcttgaaggtgctg

SEQ ID NO: 3685729 - DNA, 16 bp, Homo sapiens
ctgggtctccagggag

SEQ ID NO: 3685730 - DNA, 18 bp, Homo sapiens
ctgggtggagcaggactc

SEQ ID NO: 3685731 - DNA, 20 bp, Homo sapiens
ctgggtggcaccagcagcct

SEQ ID NO: 3685732 - DNA, 22 bp, Homo sapiens
ctgggtggcaccagcagcctgg

SEQ ID NO: 3685733 - DNA, 17 bp, Homo sapiens
ctgggtgggcggggcac

SEQ ID NO: 3685734 - DNA, 13 bp, Homo sapiens
ctgggtggtctgc

SEQ ID NO: 3685735 - DNA, 13 bp, Homo sapiens
ctgggtggttctc

SEQ ID NO: 3685736 - DNA, 15 bp, Homo sapiens
ctgggttcaagagac

SEQ ID NO: 3685737 - DNA, 17 bp, Homo sapiens
ctggtaggaccaagcat

SEQ ID NO: 3685738 - DNA, 13 bp, Homo sapiens
ctggtccagggct

SEQ ID NO: 3685739 - DNA, 15 bp, Homo sapiens
ctggtccgtgggacg

SEQ ID NO: 3685740 - DNA, 16 bp, Homo sapiens
ctggtccgtgggacgg

SEQ ID NO: 3685741 - DNA, 19 bp, Homo sapiens
ctggtccgtgggacggtgc

SEQ ID NO: 3685742 - DNA, 16 bp, Homo sapiens
ctggtcgctcctgccc

SEQ ID NO: 3685743 - DNA, 14 bp, Homo sapiens
ctggtctttgagcg

SEQ ID NO: 3685744 - DNA, 14 bp, Homo sapiens
ctggtgcccggaga

SEQ ID NO: 3685745 - DNA, 13 bp, Homo sapiens
ctggtggcccagc

SEQ ID NO: 3685746 - DNA, 21 bp, Homo sapiens
ctggtggccccgtttctggtg

SEQ ID NO: 3685747 - DNA, 14 bp, Homo sapiens
ctggtggctgggct

SEQ ID NO: 3685748 - DNA, 17 bp, Homo sapiens
ctggtggctgggctgct

SEQ ID NO: 3685749 - DNA, 15 bp, Homo sapiens
ctggttccagggtcc

SEQ ID NO: 3685750 - DNA, 13 bp, Homo sapiens
ctggttgcctcat

SEQ ID NO: 3685751 - DNA, 14 bp, Homo sapiens
ctggttgcctcatg

SEQ ID NO: 3685752 - DNA, 17 bp, Homo sapiens
ctggttgcctcatggcc

SEQ ID NO: 3685753 - DNA, 11 bp, Homo sapiens
ctggttgtctg

SEQ ID NO: 3685754 - DNA, 13 bp, Homo sapiens
ctggttgtctgaa

SEQ ID NO: 3685755 - DNA, 23 bp, Homo sapiens
ctggttgtctgaacccaggcagc

SEQ ID NO: 3685756 - DNA, 17 bp, Homo sapiens
ctggttttcacattaga

SEQ ID NO: 3685757 - DNA, 13 bp, Homo sapiens
ctgtaagaaacct

SEQ ID NO: 3685758 - DNA, 22 bp, Homo sapiens
ctgtaagaaacctactgcccag

SEQ ID NO: 3685759 - DNA, 12 bp, Homo sapiens
ctgtaaggttcc

SEQ ID NO: 3685760 - DNA, 16 bp, Homo sapiens
cttcttgcctctgtgc

SEQ ID NO: 3685761 - DNA, 18 bp, Homo sapiens
cttcttgcctctgtgctg

SEQ ID NO: 3685762 - DNA, 18 bp, Homo sapiens
cttcttggggcccagtgc

SEQ ID NO: 3685763 - DNA, 13 bp, Homo sapiens
cttctttgttttt

SEQ ID NO: 3685764 - DNA, 17 bp, Homo sapiens
cttgaagaactgcaggc

SEQ ID NO: 3685765 - DNA, 16 bp, Homo sapiens
cttgaagggccagagc

SEQ ID NO: 3685766 - DNA, 18 bp, Homo sapiens
cttgaagggccagagcca

SEQ ID NO: 3685767 - DNA, 19 bp, Homo sapiens
cttgaagggccagagccag

SEQ ID NO: 3685768 - DNA, 21 bp, Homo sapiens
cttgaagggccagagccaggg

SEQ ID NO: 3685769 - DNA, 16 bp, Homo sapiens
cttgacaactggcagg

SEQ ID NO: 3685770 - DNA, 18 bp, Homo sapiens
cttgaccaagcaggaagc

SEQ ID NO: 3685771 - DNA, 15 bp, Homo sapiens
cttgaccctgagctg

SEQ ID NO: 3685772 - DNA, 14 bp, Homo sapiens
cttgagcagtggct

SEQ ID NO: 3685773 - DNA, 19 bp, Homo sapiens
cttgagttgattcagctct

SEQ ID NO: 3685774 - DNA, 20 bp, Homo sapiens
cttgagttgattcagctctg

SEQ ID NO: 3685775 - DNA, 16 bp, Homo sapiens
cttgagtttgtcgctc

SEQ ID NO: 3685776 - DNA, 21 bp, Homo sapiens
cttgagtttgtcgctcatgtg

SEQ ID NO: 3685777 - DNA, 17 bp, Homo sapiens
cttgatagaaatgccaa

SEQ ID NO: 3685778 - DNA, 22 bp, Homo sapiens
cttgatggaagtgggccagtcc

SEQ ID NO: 3685779 - DNA, 17 bp, Homo sapiens
cttgatgggattctgga

SEQ ID NO: 3685780 - DNA, 18 bp, Homo sapiens
cttgatgggattctggac

SEQ ID NO: 3685781 - DNA, 11 bp, Homo sapiens
cttgccagaga

SEQ ID NO: 3685782 - DNA, 16 bp, Homo sapiens
cttgccagagatccaa

SEQ ID NO: 3685783 - DNA, 18 bp, Homo sapiens
cttgcctccaggtgcaga

SEQ ID NO: 3685784 - DNA, 23 bp, Homo sapiens
cttgcctccaggtgcagaggtac

SEQ ID NO: 3685785 - DNA, 18 bp, Homo sapiens
cttgcctcttccttgaag

SEQ ID NO: 3685786 - DNA, 19 bp, Homo sapiens
cttgctctgtctcccaggc

SEQ ID NO: 3685787 - DNA, 13 bp, Homo sapiens
cttgctgagtgaa

SEQ ID NO: 3685788 - DNA, 19 bp, Homo sapiens
cttgctgttgacatattta

SEQ ID NO: 3685789 - DNA, 23 bp, Homo sapiens
cttgctgttgacatatttaatgt

SEQ ID NO: 3685790 - DNA, 17 bp, Homo sapiens
cttgcttccctaatcta

SEQ ID NO: 3685791 - DNA, 12 bp, Homo sapiens
cttgcttgcctg

SEQ ID NO: 3685792 - DNA, 19 bp, Homo sapiens
cttgcttgcctgcagggcc

SEQ ID NO: 3685793 - DNA, 20 bp, Homo sapiens
cttggacatcctcctcccac

SEQ ID NO: 3685794 - DNA, 11 bp, Homo sapiens
cttggcctcag

SEQ ID NO: 3685795 - DNA, 23 bp, Homo sapiens
cttggcctcagaattcacaaaat

SEQ ID NO: 3685796 - DNA, 14 bp, Homo sapiens
cttggcctttcctg

SEQ ID NO: 3685797 - DNA, 17 bp, Homo sapiens
cttggcctttcctggaa

SEQ ID NO: 3685798 - DNA, 19 bp, Homo sapiens
cttggcctttcctggaagc

SEQ ID NO: 3685799 - DNA, 20 bp, Homo sapiens
cttggcctttcctggaagcc

SEQ ID NO: 3685800 - DNA, 18 bp, Homo sapiens
cttggctcgaatctctgt

SEQ ID NO: 3685801 - DNA, 22 bp, Homo sapiens
cttggctcgaatctctgtgcct

SEQ ID NO: 3685802 - DNA, 13 bp, Homo sapiens
cttggctgcagga

SEQ ID NO: 3685803 - DNA, 14 bp, Homo sapiens
cttggcttaatcat

SEQ ID NO: 3685804 - DNA, 19 bp, Homo sapiens
cttggcttaatcattttca

SEQ ID NO: 3685805 - DNA, 24 bp, Homo sapiens
cttggcttgatggaagtgggccag

SEQ ID NO: 3685806 - DNA, 14 bp, Homo sapiens
cttgggaggcccca

SEQ ID NO: 3685807 - DNA, 19 bp, Homo sapiens
cttgggaggccccactggg

SEQ ID NO: 3685808 - DNA, 21 bp, Homo sapiens
cttgggaggccccactgggga

SEQ ID NO: 3685809 - DNA, 13 bp, Homo sapiens
cttgggcagagct

SEQ ID NO: 3685810 - DNA, 15 bp, Homo sapiens
cttgggcagagctgg

SEQ ID NO: 3685811 - DNA, 23 bp, Homo sapiens
cttgggcagagctggctctgagc

SEQ ID NO: 3685812 - DNA, 14 bp, Homo sapiens
cttgggccactgtg

SEQ ID NO: 3685813 - DNA, 20 bp, Homo sapiens
cttgggccactgtgaagaga

SEQ ID NO: 3685814 - DNA, 21 bp, Homo sapiens
cttggggagttaagacctggc

SEQ ID NO: 3685815 - DNA, 15 bp, Homo sapiens
cttggggggctgagg

SEQ ID NO: 3685816 - DNA, 16 bp, Homo sapiens
cttggggggctgaggt

SEQ ID NO: 3685817 - DNA, 16 bp, Homo sapiens
cttgggggggtggccg

SEQ ID NO: 3685818 - DNA, 22 bp, Homo sapiens
cttgggggggtggccgctgagt

SEQ ID NO: 3685819 - DNA, 20 bp, Homo sapiens
cttggtaaaaactgcagtgt

SEQ ID NO: 3685820 - DNA, 15 bp, Homo sapiens
cttggtcagagccac

SEQ ID NO: 3685821 - DNA, 20 bp, Homo sapiens
cttggtgggggagcctctgg

SEQ ID NO: 3685822 - DNA, 21 bp, Homo sapiens
cttggtgggggagcctctgga

SEQ ID NO: 3685823 - DNA, 22 bp, Homo sapiens
cttggtgggggagcctctggaa

SEQ ID NO: 3685824 - DNA, 15 bp, Homo sapiens
cttgtaggtatgtct

SEQ ID NO: 3685825 - DNA, 18 bp, Homo sapiens
cttgtaggtatgtctgtg

SEQ ID NO: 3685826 - DNA, 22 bp, Homo sapiens
cttgtaggtatgtctgtgccat

SEQ ID NO: 3685827 - DNA, 15 bp, Homo sapiens
cttgtatttccaaac

SEQ ID NO: 3685828 - DNA, 18 bp, Homo sapiens
cttgtcaagcctgtgcaa

SEQ ID NO: 3685829 - DNA, 23 bp, Homo sapiens
cttgtcaagcctgtgcaaaaaaa

SEQ ID NO: 3685830 - DNA, 20 bp, Homo sapiens
cttgtccaacccgaggcccg

SEQ ID NO: 3685831 - DNA, 18 bp, Homo sapiens
cttgtcccactcaagcca

SEQ ID NO: 3685832 - DNA, 15 bp, Homo sapiens
cttgtcccagccagt

SEQ ID NO: 3685833 - DNA, 19 bp, Homo sapiens
cttgtctcaggactctgaa

SEQ ID NO: 3685834 - DNA, 21 bp, Homo sapiens
cttgtctcaggactctgaaaa

SEQ ID NO: 3685835 - DNA, 22 bp, Homo sapiens
cttgtcttgataaagtggaatt

SEQ ID NO: 3685836 - DNA, 14 bp, Homo sapiens
cttgtgcctggggt

SEQ ID NO: 3685837 - DNA, 16 bp, Homo sapiens
cttgtggaagacactt

SEQ ID NO: 3685838 - DNA, 17 bp, Homo sapiens
cttgtgttctgtagact

SEQ ID NO: 3685839 - DNA, 18 bp, Homo sapiens
cttgtgttctgtagactg

SEQ ID NO: 3685840 - DNA, 16 bp, Homo sapiens
cttgttccagctcttt

SEQ ID NO: 3685841 - DNA, 15 bp, Homo sapiens
cttgttgtgctttta

SEQ ID NO: 3685842 - DNA, 17 bp, Homo sapiens
cttgttgtgcttttagt

SEQ ID NO: 3685843 - DNA, 15 bp, Homo sapiens
ctttaaatgctgctt

SEQ ID NO: 3685844 - DNA, 20 bp, Homo sapiens
ctttagaattaatttattaa

SEQ ID NO: 3685845 - DNA, 20 bp, Homo sapiens
ctttataagtcattgtatgt

SEQ ID NO: 3685846 - DNA, 18 bp, Homo sapiens
ctttatcaagcttagtga

SEQ ID NO: 3685847 - DNA, 20 bp, Homo sapiens
ctttatcacctcattctgaa

SEQ ID NO: 3685848 - DNA, 13 bp, Homo sapiens
ctttatgcttgca

SEQ ID NO: 3685849 - DNA, 13 bp, Homo sapiens
ctttattttgtgt

SEQ ID NO: 3685850 - DNA, 17 bp, Homo sapiens
ctttattttgtgtaaaa

SEQ ID NO: 3685851 - DNA, 18 bp, Homo sapiens
ctttattttgtgtaaaaa

SEQ ID NO: 3685852 - DNA, 22 bp, Homo sapiens
ctttcaagcagtcgtgcctgtg

SEQ ID NO: 3685853 - DNA, 21 bp, Homo sapiens
ctttcaatggtttgcaaggaa

SEQ ID NO: 3685854 - DNA, 22 bp, Homo sapiens
ctttcaatggtttgcaaggaag

SEQ ID NO: 3685855 - DNA, 24 bp, Homo sapiens
ctttcacattgtttgctgctattg

SEQ ID NO: 3685856 - DNA, 18 bp, Homo sapiens
ctttcatgcagtgctctt

SEQ ID NO: 3685857 - DNA, 16 bp, Homo sapiens
ctttccaaatgcccag

SEQ ID NO: 3685858 - DNA, 19 bp, Homo sapiens
ctttccaaatgcccagctt

SEQ ID NO: 3685859 - DNA, 15 bp, Homo sapiens
ctttccaccacagcc

SEQ ID NO: 3685860 - DNA, 21 bp, Homo sapiens
ctttccaccacagccagcacc

SEQ ID NO: 3685861 - DNA, 16 bp, Homo sapiens
ctttcctaaggctgca

SEQ ID NO: 3685862 - DNA, 21 bp, Homo sapiens
ctttcctgcaactcaaggact

SEQ ID NO: 3685863 - DNA, 12 bp, Homo sapiens
ctttcctgcccc

SEQ ID NO: 3685864 - DNA, 13 bp, Homo sapiens
ctttcctgcccca

SEQ ID NO: 3685865 - DNA, 14 bp, Homo sapiens
ctttcctgccccag

SEQ ID NO: 3685866 - DNA, 18 bp, Homo sapiens
ctttcctgccccaggcct

SEQ ID NO: 3685867 - DNA, 14 bp, Homo sapiens
ctttcctggaagcc

SEQ ID NO: 3685868 - DNA, 20 bp, Homo sapiens
ctttctaacccactaagtaa

SEQ ID NO: 3685869 - DNA, 17 bp, Homo sapiens
ctttctaagagaagcaa

SEQ ID NO: 3685870 - DNA, 14 bp, Homo sapiens
ctttctctccttgg

SEQ ID NO: 3685871 - DNA, 15 bp, Homo sapiens
ctttctctccttggc

SEQ ID NO: 3685872 - DNA, 14 bp, Homo sapiens
ctttctctgccagt

SEQ ID NO: 3685873 - DNA, 20 bp, Homo sapiens
ctttctgatcaaggccttat

SEQ ID NO: 3685874 - DNA, 21 bp, Homo sapiens
ctttctgccatctagccagcc

SEQ ID NO: 3685875 - DNA, 22 bp, Homo sapiens
ctttctgccatctagccagccc

SEQ ID NO: 3685876 - DNA, 15 bp, Homo sapiens
gacagggcttctcct

SEQ ID NO: 3685877 - DNA, 18 bp, Homo sapiens
gacagggcttctcctgcg

SEQ ID NO: 3685878 - DNA, 20 bp, Homo sapiens
gacatacttgaagggccaga

SEQ ID NO: 3685879 - DNA, 14 bp, Homo sapiens
gacatatttaactg

SEQ ID NO: 3685880 - DNA, 12 bp, Homo sapiens
gacatatttaat

SEQ ID NO: 3685881 - DNA, 21 bp, Homo sapiens
gacatatttaatgttttaaat

SEQ ID NO: 3685882 - DNA, 23 bp, Homo sapiens
gacatatttaatgttttaaatgt

SEQ ID NO: 3685883 - DNA, 20 bp, Homo sapiens
gacatggctccggcctctgc

SEQ ID NO: 3685884 - DNA, 17 bp, Homo sapiens
gacatgggtattttata

SEQ ID NO: 3685885 - DNA, 17 bp, Homo sapiens
gacattctgccaggccc

SEQ ID NO: 3685886 - DNA, 21 bp, Homo sapiens
gacattgtctcctatatattt

SEQ ID NO: 3685887 - DNA, 15 bp, Homo sapiens
gacatttccaagctg

SEQ ID NO: 3685888 - DNA, 21 bp, Homo sapiens
gaccaagactgagccagctta

SEQ ID NO: 3685889 - DNA, 14 bp, Homo sapiens
gaccaagcaggaag

SEQ ID NO: 3685890 - DNA, 23 bp, Homo sapiens
gaccaagcttagtcctgggagag

SEQ ID NO: 3685891 - DNA, 13 bp, Homo sapiens
gaccacccacctg

SEQ ID NO: 3685892 - DNA, 21 bp, Homo sapiens
gaccacgcccgtcctgcctgt

SEQ ID NO: 3685893 - DNA, 12 bp, Homo sapiens
gaccagctcagg

SEQ ID NO: 3685894 - DNA, 16 bp, Homo sapiens
gaccaggactccctcc

SEQ ID NO: 3685895 - DNA, 11 bp, Homo sapiens
gaccagggcct

SEQ ID NO: 3685896 - DNA, 22 bp, Homo sapiens
gaccaggggccctacctgggga

SEQ ID NO: 3685897 - DNA, 21 bp, Homo sapiens
gaccatccactctaccctccc

SEQ ID NO: 3685898 - DNA, 22 bp, Homo sapiens
gaccatgctcatctgctggtcc

SEQ ID NO: 3685899 - DNA, 13 bp, Homo sapiens
gacccaccactgg

SEQ ID NO: 3685900 - DNA, 16 bp, Homo sapiens
gacccagtgcccccac

SEQ ID NO: 3685901 - DNA, 11 bp, Homo sapiens
gacccatctgt

SEQ ID NO: 3685902 - DNA, 15 bp, Homo sapiens
gaccccagcccagac

SEQ ID NO: 3685903 - DNA, 13 bp, Homo sapiens
gaccccagccttg

SEQ ID NO: 3685904 - DNA, 19 bp, Homo sapiens
gaccccagccttggtgggg

SEQ ID NO: 3685905 - DNA, 13 bp, Homo sapiens
gacccccacacct

SEQ ID NO: 3685906 - DNA, 18 bp, Homo sapiens
gacccggaggccgaggcc

SEQ ID NO: 3685907 - DNA, 11 bp, Homo sapiens
gaccctggggg

SEQ ID NO: 3685908 - DNA, 21 bp, Homo sapiens
gaccctgggggcacaggaggc

SEQ ID NO: 3685909 - DNA, 22 bp, Homo sapiens
gaccctggttattgatgtggcc

SEQ ID NO: 3685910 - DNA, 12 bp, Homo sapiens
gaccctgtctca

SEQ ID NO: 3685911 - DNA, 19 bp, Homo sapiens
gacccttcccttgagccct

SEQ ID NO: 3685912 - DNA, 19 bp, Homo sapiens
gaccgaggccctcccaaag

SEQ ID NO: 3685913 - DNA, 21 bp, Homo sapiens
gaccgggtcacacaaaggcat

SEQ ID NO: 3685914 - DNA, 16 bp, Homo sapiens
gacctaaatggcctca

SEQ ID NO: 3685915 - DNA, 18 bp, Homo sapiens
gacctcaggtgagaagca

SEQ ID NO: 3685916 - DNA, 21 bp, Homo sapiens
gacctcaggtgagaagcagag

SEQ ID NO: 3685917 - DNA, 17 bp, Homo sapiens
gacctccgcctcctggg

SEQ ID NO: 3685918 - DNA, 13 bp, Homo sapiens
gacctgaggctgt

SEQ ID NO: 3685919 - DNA, 10 bp, Homo sapiens
gacctggcag

SEQ ID NO: 3685920 - DNA, 17 bp, Homo sapiens
gacctttccaccacagc

SEQ ID NO: 3685921 - DNA, 18 bp, Homo sapiens
gacctttccaccacagcc

SEQ ID NO: 3685922 - DNA, 21 bp, Homo sapiens
gacctttccaccacagccagc

SEQ ID NO: 3685923 - DNA, 18 bp, Homo sapiens
gacgaggggtgtcttggg

SEQ ID NO: 3685924 - DNA, 21 bp, Homo sapiens
gacgcctgtgccaccccttcc

SEQ ID NO: 3685925 - DNA, 15 bp, Homo sapiens
gacggcctgatgctc

SEQ ID NO: 3685926 - DNA, 16 bp, Homo sapiens
gacggggcgggccctg

SEQ ID NO: 3685927 - DNA, 20 bp, Homo sapiens
gacggggcgggccctgcctg

SEQ ID NO: 3685928 - DNA, 22 bp, Homo sapiens
gacggggcgggccctgcctgag

SEQ ID NO: 3685929 - DNA, 15 bp, Homo sapiens
gacggggctcccctg

SEQ ID NO: 3685930 - DNA, 23 bp, Homo sapiens
gacggtgttttgccatgttggcc

SEQ ID NO: 3685931 - DNA, 18 bp, Homo sapiens
gacggtttccagggaggg

SEQ ID NO: 3685932 - DNA, 18 bp, Homo sapiens
gactaacaaaggcagctg

SEQ ID NO: 3685933 - DNA, 19 bp, Homo sapiens
gactaacaaaggcagctgt

SEQ ID NO: 3685934 - DNA, 14 bp, Homo sapiens
gactaatggcatga

SEQ ID NO: 3685935 - DNA, 20 bp, Homo sapiens
gactaatggcatgagaaata

SEQ ID NO: 3685936 - DNA, 17 bp, Homo sapiens
gactacaggtattttca

SEQ ID NO: 3685937 - DNA, 23 bp, Homo sapiens
gactagaagggccagtcctgcct

SEQ ID NO: 3685938 - DNA, 16 bp, Homo sapiens
gactagggagccatgt

SEQ ID NO: 3685939 - DNA, 19 bp, Homo sapiens
gactatatttgggcctgct

SEQ ID NO: 3685940 - DNA, 22 bp, Homo sapiens
gactatatttgggcctgctcca

SEQ ID NO: 3685941 - DNA, 19 bp, Homo sapiens
gactattccttttctgtat

SEQ ID NO: 3685942 - DNA, 11 bp, Homo sapiens
gactcagccct

SEQ ID NO: 3685943 - DNA, 12 bp, Homo sapiens
gactcagccttc

SEQ ID NO: 3685944 - DNA, 20 bp, Homo sapiens
gactcagccttcagacagag

SEQ ID NO: 3685945 - DNA, 14 bp, Homo sapiens
gactcagtgcagat

SEQ ID NO: 3685946 - DNA, 16 bp, Homo sapiens
gactcatccgcctggc

SEQ ID NO: 3685947 - DNA, 17 bp, Homo sapiens
gactcatccgcctggcc

SEQ ID NO: 3685948 - DNA, 20 bp, Homo sapiens
gactcatccgcctggcccgg

SEQ ID NO: 3685949 - DNA, 23 bp, Homo sapiens
gactcccattcctgaagaaccag

SEQ ID NO: 3685950 - DNA, 16 bp, Homo sapiens
gactccctcctcacct

SEQ ID NO: 3685951 - DNA, 19 bp, Homo sapiens
gactccctcctcacctctg

SEQ ID NO: 3685952 - DNA, 20 bp, Homo sapiens
gactccctcctcacctctgg

SEQ ID NO: 3685953 - DNA, 24 bp, Homo sapiens
gactccctcctcacctctggactg

SEQ ID NO: 3685954 - DNA, 14 bp, Homo sapiens
gactcctccctggg

SEQ ID NO: 3685955 - DNA, 17 bp, Homo sapiens
gactcctccctgggggt

SEQ ID NO: 3685956 - DNA, 14 bp, Homo sapiens
gactcgggggtggg

SEQ ID NO: 3685957 - DNA, 13 bp, Homo sapiens
gactcggtttctc

SEQ ID NO: 3685958 - DNA, 19 bp, Homo sapiens
gactcggtttctccaaact

SEQ ID NO: 3685959 - DNA, 14 bp, Homo sapiens
gactcttccctggg

SEQ ID NO: 3685960 - DNA, 16 bp, Homo sapiens
gactcttccctgggaa

SEQ ID NO: 3685961 - DNA, 22 bp, Homo sapiens
gactgaaaaaaaaaaagaagaa

SEQ ID NO: 3685962 - DNA, 19 bp, Homo sapiens
gactgaaattacgggtacc

SEQ ID NO: 3685963 - DNA, 16 bp, Homo sapiens
gactgcagaggggaaa

SEQ ID NO: 3685964 - DNA, 14 bp, Homo sapiens
gactgctacctctg

SEQ ID NO: 3685965 - DNA, 17 bp, Homo sapiens
gactgctacctctgaga

SEQ ID NO: 3685966 - DNA, 21 bp, Homo sapiens
gactgctacctctgagaagac

SEQ ID NO: 3685967 - DNA, 15 bp, Homo sapiens
gactggaacactaga

SEQ ID NO: 3685968 - DNA, 22 bp, Homo sapiens
gactgtagggagggcggcaggg

SEQ ID NO: 3685969 - DNA, 23 bp, Homo sapiens
gactgtagggagggcggcagggg

SEQ ID NO: 3685970 - DNA, 13 bp, Homo sapiens
gactgtgccatgg

SEQ ID NO: 3685971 - DNA, 16 bp, Homo sapiens
gacttcagtcttgcct

SEQ ID NO: 3685972 - DNA, 18 bp, Homo sapiens
gacttcctgtccagctcc

SEQ ID NO: 3685973 - DNA, 20 bp, Homo sapiens
gacttcctgtccagctccaa

SEQ ID NO: 3685974 - DNA, 13 bp, Homo sapiens
gacttctgcctgg

SEQ ID NO: 3685975 - DNA, 15 bp, Homo sapiens
gacttctgcctggag

SEQ ID NO: 3685976 - DNA, 13 bp, Homo sapiens
gacttgtgtccca

SEQ ID NO: 3685977 - DNA, 19 bp, Homo sapiens
gactttagaaagctgacat

SEQ ID NO: 3685978 - DNA, 15 bp, Homo sapiens
gactttagtgaaagc

SEQ ID NO: 3685979 - DNA, 16 bp, Homo sapiens
gactttctgcctggag

SEQ ID NO: 3685980 - DNA, 23 bp, Homo sapiens
gacttttctgtccgagctttgaa

SEQ ID NO: 3685981 - DNA, 16 bp, Homo sapiens
gactttttataaaatg

SEQ ID NO: 3685982 - DNA, 13 bp, Homo sapiens
gagaaaaaaacaa

SEQ ID NO: 3685983 - DNA, 15 bp, Homo sapiens
gagaaaacttgcctt

SEQ ID NO: 3685984 - DNA, 18 bp, Homo sapiens
gagaaaatatatgtattt

SEQ ID NO: 3685985 - DNA, 23 bp, Homo sapiens
gagaaatctggcttctggccagg

SEQ ID NO: 3685986 - DNA, 20 bp, Homo sapiens
gagaaatggtccgctttcct

SEQ ID NO: 3685987 - DNA, 21 bp, Homo sapiens
gagaaatggtccgctttcctg

SEQ ID NO: 3685988 - DNA, 17 bp, Homo sapiens
gagaaccaaatctggaa

SEQ ID NO: 3685989 - DNA, 18 bp, Homo sapiens
gagaaccaaatctggaag

SEQ ID NO: 3685990 - DNA, 13 bp, Homo sapiens
gagaagcggctgg

SEQ ID NO: 3685991 - DNA, 22 bp, Homo sapiens
gagaagctcctctccccagccc

SEQ ID NO: 3685992 - DNA, 13 bp, Homo sapiens
gaggtaccctggg

SEQ ID NO: 3685993 - DNA, 17 bp, Homo sapiens
gaggtcaaggctgcagt

SEQ ID NO: 3685994 - DNA, 21 bp, Homo sapiens
gaggtcggtaggttcagccaa

SEQ ID NO: 3685995 - DNA, 13 bp, Homo sapiens
gaggtctaatcta

SEQ ID NO: 3685996 - DNA, 15 bp, Homo sapiens
gaggtgaaagggagc

SEQ ID NO: 3685997 - DNA, 21 bp, Homo sapiens
gaggtgattccagtgaagata

SEQ ID NO: 3685998 - DNA, 14 bp, Homo sapiens
gaggtggctgggtt

SEQ ID NO: 3685999 - DNA, 15 bp, Homo sapiens
gaggttaaggctgag

SEQ ID NO: 3686000 - DNA, 23 bp, Homo sapiens
gaggtttgtcgggcaccagccag

SEQ ID NO: 3686001 - DNA, 20 bp, Homo sapiens
gagtagaaagacagagctgg

SEQ ID NO: 3686002 - DNA, 23 bp, Homo sapiens
gagtagttatataattgttgaac

SEQ ID NO: 3686003 - DNA, 23 bp, Homo sapiens
gagtatctcctcgcaagctgggt

SEQ ID NO: 3686004 - DNA, 13 bp, Homo sapiens
gagtccactttgt

SEQ ID NO: 3686005 - DNA, 22 bp, Homo sapiens
gagtccactttgtttcgtgggg

SEQ ID NO: 3686006 - DNA, 16 bp, Homo sapiens
gagtcctcactcccag

SEQ ID NO: 3686007 - DNA, 20 bp, Homo sapiens
gagtcgtggggtgtgctggg

SEQ ID NO: 3686008 - DNA, 23 bp, Homo sapiens
gagtctgaagcagatgcaaagag

SEQ ID NO: 3686009 - DNA, 16 bp, Homo sapiens
gagtggcaggggacag

SEQ ID NO: 3686010 - DNA, 23 bp, Homo sapiens
gagtgggggatcacagcctctga

SEQ ID NO: 3686011 - DNA, 18 bp, Homo sapiens
gagtgtgagccacctaag

SEQ ID NO: 3686012 - DNA, 23 bp, Homo sapiens
gagtgtgagccacctaagatctc

SEQ ID NO: 3686013 - DNA, 20 bp, Homo sapiens
gagtgtgcctgaagtcccag

SEQ ID NO: 3686014 - DNA, 15 bp, Homo sapiens
gagtgttatgtattt

SEQ ID NO: 3686015 - DNA, 20 bp, Homo sapiens
gagttaactgtgaaatacca

SEQ ID NO: 3686016 - DNA, 12 bp, Homo sapiens
gagttaagacct

SEQ ID NO: 3686017 - DNA, 21 bp, Homo sapiens
gagttaagacctggcagctct

SEQ ID NO: 3686018 - DNA, 21 bp, Homo sapiens
gagttagtcgccctacagaaa

SEQ ID NO: 3686019 - DNA, 22 bp, Homo sapiens
gagttagtcgccctacagaaaa

SEQ ID NO: 3686020 - DNA, 21 bp, Homo sapiens
gagttgatctggaacccagac

SEQ ID NO: 3686021 - DNA, 20 bp, Homo sapiens
gagtttgagaccagcctggc

SEQ ID NO: 3686022 - DNA, 18 bp, Homo sapiens
gagttttccatggcagga

SEQ ID NO: 3686023 - DNA, 21 bp, Homo sapiens
gagttttccatggcaggaagg

SEQ ID NO: 3686024 - DNA, 17 bp, Homo sapiens
gataaaatactaaacta

SEQ ID NO: 3686025 - DNA, 13 bp, Homo sapiens
gataaagtggaat

SEQ ID NO: 3686026 - DNA, 17 bp, Homo sapiens
gatacagtcaacaagcc

SEQ ID NO: 3686027 - DNA, 14 bp, Homo sapiens
gataccagaaggga

SEQ ID NO: 3686028 - DNA, 16 bp, Homo sapiens
gatacgcatcagacag

SEQ ID NO: 3686029 - DNA, 20 bp, Homo sapiens
gatactgcgactttctgcct

SEQ ID NO: 3686030 - DNA, 22 bp, Homo sapiens
gatacttctgaaataaatgttc

SEQ ID NO: 3686031 - DNA, 13 bp, Homo sapiens
gatagaaatgcca

SEQ ID NO: 3686032 - DNA, 20 bp, Homo sapiens
gatagacacatatgaggggg

SEQ ID NO: 3686033 - DNA, 23 bp, Homo sapiens
gatagagactggaacactagaca

SEQ ID NO: 3686034 - DNA, 17 bp, Homo sapiens
gatagatgctggcccag

SEQ ID NO: 3686035 - DNA, 19 bp, Homo sapiens
gatagctaactgtaaatca

SEQ ID NO: 3686036 - DNA, 22 bp, Homo sapiens
gatagttgctatttttgtaaag

SEQ ID NO: 3686037 - DNA, 23 bp, Homo sapiens
gatagttgctatttttgtaaagt

SEQ ID NO: 3686038 - DNA, 22 bp, Homo sapiens
gatattaagaactgctgtttca

SEQ ID NO: 3686039 - DNA, 23 bp, Homo sapiens
gatattttggggggcagagaata

SEQ ID NO: 3686040 - DNA, 22 bp, Homo sapiens
gatcaaggccttattggaaagc

SEQ ID NO: 3686041 - DNA, 14 bp, Homo sapiens
gatcacagcctctg

SEQ ID NO: 3686042 - DNA, 19 bp, Homo sapiens
gatcagcaaaccggggcct

SEQ ID NO: 3686043 - DNA, 15 bp, Homo sapiens
gatcagcctgggcaa

SEQ ID NO: 3686044 - DNA, 14 bp, Homo sapiens
gatcaggtggggag

SEQ ID NO: 3686045 - DNA, 15 bp, Homo sapiens
gatcatgtacttttt

SEQ ID NO: 3686046 - DNA, 20 bp, Homo sapiens
gatcatgtactttttagtaa

SEQ ID NO: 3686047 - DNA, 18 bp, Homo sapiens
gatcattttccccccact

SEQ ID NO: 3686048 - DNA, 23 bp, Homo sapiens
gatcattttccccccactctccc

SEQ ID NO: 3686049 - DNA, 15 bp, Homo sapiens
gatccagggacagag

SEQ ID NO: 3686050 - DNA, 24 bp, Homo sapiens
gatccctgtgttgtctctagagca

SEQ ID NO: 3686051 - DNA, 15 bp, Homo sapiens
gatccgagggcccct

SEQ ID NO: 3686052 - DNA, 22 bp, Homo sapiens
gatcctcctgcagaccacgccc

SEQ ID NO: 3686053 - DNA, 18 bp, Homo sapiens
gatcctgcgggtggggct

SEQ ID NO: 3686054 - DNA, 20 bp, Homo sapiens
gatcctgtattcagacagat

SEQ ID NO: 3686055 - DNA, 11 bp, Homo sapiens
gatctccagcg

SEQ ID NO: 3686056 - DNA, 12 bp, Homo sapiens
gatctcttgagc

SEQ ID NO: 3686057 - DNA, 18 bp, Homo sapiens
gatctcttgagcctggga

SEQ ID NO: 3686058 - DNA, 17 bp, Homo sapiens
gatctgccattgggacc

SEQ ID NO: 3686059 - DNA, 15 bp, Homo sapiens
gatctggaacccaga

SEQ ID NO: 3686060 - DNA, 18 bp, Homo sapiens
gatctggaacccagactc

SEQ ID NO: 3686061 - DNA, 20 bp, Homo sapiens
gatctggaacccagactcag

SEQ ID NO: 3686062 - DNA, 16 bp, Homo sapiens
gatctggtcctaccca

SEQ ID NO: 3686063 - DNA, 15 bp, Homo sapiens
gatctgtcctcagcc

SEQ ID NO: 3686064 - DNA, 16 bp, Homo sapiens
gatctgtcctcagcct

SEQ ID NO: 3686065 - DNA, 18 bp, Homo sapiens
gatctgtcctcagccttg

SEQ ID NO: 3686066 - DNA, 17 bp, Homo sapiens
gatcttccgtggtcaga

SEQ ID NO: 3686067 - DNA, 16 bp, Homo sapiens
gatcttttcaagttaa

SEQ ID NO: 3686068 - DNA, 15 bp, Homo sapiens
gatgaatgccgtgga

SEQ ID NO: 3686069 - DNA, 14 bp, Homo sapiens
gatgactgcttgta

SEQ ID NO: 3686070 - DNA, 16 bp, Homo sapiens
gatgaggtattttttc

SEQ ID NO: 3686071 - DNA, 14 bp, Homo sapiens
gatgagttaactgt

SEQ ID NO: 3686072 - DNA, 16 bp, Homo sapiens
gatgatcactgtgaaa

SEQ ID NO: 3686073 - DNA, 16 bp, Homo sapiens
gatgcaaagaggcaag

SEQ ID NO: 3686074 - DNA, 19 bp, Homo sapiens
gatgcaaggaccaggactc

SEQ ID NO: 3686075 - DNA, 20 bp, Homo sapiens
gatgcaggtggatctccttg

SEQ ID NO: 3686076 - DNA, 22 bp, Homo sapiens
gatgcatgtcttttaaaatgca

SEQ ID NO: 3686077 - DNA, 16 bp, Homo sapiens
gatgccccagagctgt

SEQ ID NO: 3686078 - DNA, 22 bp, Homo sapiens
gatgcggccattcaaggggagc

SEQ ID NO: 3686079 - DNA, 20 bp, Homo sapiens
gatgcgggccagtgctccag

SEQ ID NO: 3686080 - DNA, 22 bp, Homo sapiens
gatgcgggccagtgctccagcc

SEQ ID NO: 3686081 - DNA, 15 bp, Homo sapiens
gatgctccctcccct

SEQ ID NO: 3686082 - DNA, 14 bp, Homo sapiens
gatgctggatgctc

SEQ ID NO: 3686083 - DNA, 22 bp, Homo sapiens
gatgctggcccagggcccagag

SEQ ID NO: 3686084 - DNA, 16 bp, Homo sapiens
gatgcttttgtctaat

SEQ ID NO: 3686085 - DNA, 18 bp, Homo sapiens
gatggaaccgcaggaagc

SEQ ID NO: 3686086 - DNA, 20 bp, Homo sapiens
gatggaaccgcaggaagctg

SEQ ID NO: 3686087 - DNA, 22 bp, Homo sapiens
gatggaaccgcaggaagctgct

SEQ ID NO: 3686088 - DNA, 19 bp, Homo sapiens
gatggaagtgggccagtcc

SEQ ID NO: 3686089 - DNA, 23 bp, Homo sapiens
gatggcagtgtggggagggcagg

SEQ ID NO: 3686090 - DNA, 15 bp, Homo sapiens
gatggccccagcaca

SEQ ID NO: 3686091 - DNA, 22 bp, Homo sapiens
gatggccgggcgcggtggctca

SEQ ID NO: 3686092 - DNA, 13 bp, Homo sapiens
gatggctcctctc

SEQ ID NO: 3686093 - DNA, 13 bp, Homo sapiens
gatgggattctgg

SEQ ID NO: 3686094 - DNA, 22 bp, Homo sapiens
gatgggccggcccccttcctgg

SEQ ID NO: 3686095 - DNA, 13 bp, Homo sapiens
gatggggaaggag

SEQ ID NO: 3686096 - DNA, 17 bp, Homo sapiens
gatggggaggggctctg

SEQ ID NO: 3686097 - DNA, 17 bp, Homo sapiens
gatggggcacggctctg

SEQ ID NO: 3686098 - DNA, 15 bp, Homo sapiens
gatggggcagagctt

SEQ ID NO: 3686099 - DNA, 21 bp, Homo sapiens
gatggggcagagcttctcctg

SEQ ID NO: 3686100 - DNA, 20 bp, Homo sapiens
gatgggggaactcagatcca

SEQ ID NO: 3686101 - DNA, 22 bp, Homo sapiens
gatgggggaactcagatccagg

SEQ ID NO: 3686102 - DNA, 23 bp, Homo sapiens
gatggtatctgggtaagaagaaa

SEQ ID NO: 3686103 - DNA, 16 bp, Homo sapiens
gatggtgtggcctgtg

SEQ ID NO: 3686104 - DNA, 14 bp, Homo sapiens
gatggttctgtgac

SEQ ID NO: 3686105 - DNA, 16 bp, Homo sapiens
gatgtaaattgaagaa

SEQ ID NO: 3686106 - DNA, 21 bp, Homo sapiens
gatgtcaaagtgtaacagata

SEQ ID NO: 3686107 - DNA, 11 bp, Homo sapiens
ggccctggggc

SEQ ID NO: 3686108 - DNA, 15 bp, Homo sapiens
ggccctgtgtgcagg

SEQ ID NO: 3686109 - DNA, 16 bp, Homo sapiens
ggccgagggtcctggc

SEQ ID NO: 3686110 - DNA, 19 bp, Homo sapiens
ggccgctgaacccacccgg

SEQ ID NO: 3686111 - DNA, 12 bp, Homo sapiens
ggccgctgccac

SEQ ID NO: 3686112 - DNA, 13 bp, Homo sapiens
ggccgctgccacc

SEQ ID NO: 3686113 - DNA, 14 bp, Homo sapiens
ggccggccctgtgt

SEQ ID NO: 3686114 - DNA, 14 bp, Homo sapiens
ggcctaggcctcag

SEQ ID NO: 3686115 - DNA, 17 bp, Homo sapiens
ggcctcagccagagaag

SEQ ID NO: 3686116 - DNA, 13 bp, Homo sapiens
ggcctcagctgcc

SEQ ID NO: 3686117 - DNA, 17 bp, Homo sapiens
ggcctcagctgcctcac

SEQ ID NO: 3686118 - DNA, 19 bp, Homo sapiens
ggcctcatgtggctggaag

SEQ ID NO: 3686119 - DNA, 20 bp, Homo sapiens
ggcctcatgtggctggaaga

SEQ ID NO: 3686120 - DNA, 15 bp, Homo sapiens
ggcctcccagccccc

SEQ ID NO: 3686121 - DNA, 18 bp, Homo sapiens
ggcctcccagcccccaac

SEQ ID NO: 3686122 - DNA, 15 bp, Homo sapiens
ggcctcccctgccac

SEQ ID NO: 3686123 - DNA, 17 bp, Homo sapiens
ggcctgaaagaggctga

SEQ ID NO: 3686124 - DNA, 23 bp, Homo sapiens
ggcctgatgctccctcccctgcc

SEQ ID NO: 3686125 - DNA, 21 bp, Homo sapiens
ggcctgcataggctccttcct

SEQ ID NO: 3686126 - DNA, 16 bp, Homo sapiens
ggcctgcgaccctggg

SEQ ID NO: 3686127 - DNA, 18 bp, Homo sapiens
ggcctgcgaccctggggg

SEQ ID NO: 3686128 - DNA, 17 bp, Homo sapiens
ggcctgctccagacctg

SEQ ID NO: 3686129 - DNA, 15 bp, Homo sapiens
ggcctggagatcctc

SEQ ID NO: 3686130 - DNA, 16 bp, Homo sapiens
ggcctggccaggagct

SEQ ID NO: 3686131 - DNA, 23 bp, Homo sapiens
ggcctgtctcatccccaggggtc

SEQ ID NO: 3686132 - DNA, 21 bp, Homo sapiens
ggccttaaaattacttggctt

SEQ ID NO: 3686133 - DNA, 22 bp, Homo sapiens
ggccttaaaattacttggcttt

SEQ ID NO: 3686134 - DNA, 15 bp, Homo sapiens
ggcgccccaagagcc

SEQ ID NO: 3686135 - DNA, 15 bp, Homo sapiens
ggcgcggtggctcac

SEQ ID NO: 3686136 - DNA, 14 bp, Homo sapiens
ggcggagctccagg

SEQ ID NO: 3686137 - DNA, 20 bp, Homo sapiens
ggcggaggttgtggtgagcg

SEQ ID NO: 3686138 - DNA, 17 bp, Homo sapiens
ggcggcaggggcctgga

SEQ ID NO: 3686139 - DNA, 17 bp, Homo sapiens
ggcgggactcctccctg

SEQ ID NO: 3686140 - DNA, 16 bp, Homo sapiens
ggcgggccctgcctga

SEQ ID NO: 3686141 - DNA, 12 bp, Homo sapiens
ggcggggcacta

SEQ ID NO: 3686142 - DNA, 13 bp, Homo sapiens
ggcggggctcctc

SEQ ID NO: 3686143 - DNA, 18 bp, Homo sapiens
ggcggggcttctcttggg

SEQ ID NO: 3686144 - DNA, 19 bp, Homo sapiens
ggcggtcctactgctgtga

SEQ ID NO: 3686145 - DNA, 16 bp, Homo sapiens
ggcgtctgttccccct

SEQ ID NO: 3686146 - DNA, 15 bp, Homo sapiens
ggcgtggagggaggc

SEQ ID NO: 3686147 - DNA, 18 bp, Homo sapiens
ggcgtggagggaggcccc

SEQ ID NO: 3686148 - DNA, 22 bp, Homo sapiens
ggcgtggcctgcataggctcct

SEQ ID NO: 3686149 - DNA, 23 bp, Homo sapiens
ggcgtggctctgggtgggcgggg

SEQ ID NO: 3686150 - DNA, 18 bp, Homo sapiens
ggcgtgggagccagcctc

SEQ ID NO: 3686151 - DNA, 23 bp, Homo sapiens
ggctagtcaagctcctcctccct

SEQ ID NO: 3686152 - DNA, 20 bp, Homo sapiens
ggctagtcttgaatttctga

SEQ ID NO: 3686153 - DNA, 18 bp, Homo sapiens
ggctcacacacctgtagc

SEQ ID NO: 3686154 - DNA, 17 bp, Homo sapiens
ggctccaatggggcggg

SEQ ID NO: 3686155 - DNA, 14 bp, Homo sapiens
ggctccagagcagg

SEQ ID NO: 3686156 - DNA, 17 bp, Homo sapiens
ggctcccagggacacct

SEQ ID NO: 3686157 - DNA, 15 bp, Homo sapiens
ggctccggcctctgc

SEQ ID NO: 3686158 - DNA, 17 bp, Homo sapiens
ggctcctacctgggggc

SEQ ID NO: 3686159 - DNA, 15 bp, Homo sapiens
ggctcctcctgaagg

SEQ ID NO: 3686160 - DNA, 12 bp, Homo sapiens
ggctcctgaggg

SEQ ID NO: 3686161 - DNA, 15 bp, Homo sapiens
ggctcctgtggtagt

SEQ ID NO: 3686162 - DNA, 16 bp, Homo sapiens
ggctcctgtggtagtc

SEQ ID NO: 3686163 - DNA, 20 bp, Homo sapiens
ggctcctgtggtagtcctcc

SEQ ID NO: 3686164 - DNA, 15 bp, Homo sapiens
ggctcgaatctctgt

SEQ ID NO: 3686165 - DNA, 20 bp, Homo sapiens
ggctcgaatctctgtgcctt

SEQ ID NO: 3686166 - DNA, 14 bp, Homo sapiens
ggctctgagcgcct

SEQ ID NO: 3686167 - DNA, 21 bp, Homo sapiens
ggctcttagcagcttccagat

SEQ ID NO: 3686168 - DNA, 16 bp, Homo sapiens
ggctgaaattctcctg

SEQ ID NO: 3686169 - DNA, 18 bp, Homo sapiens
ggctgaaattctcctgga

SEQ ID NO: 3686170 - DNA, 19 bp, Homo sapiens
ggctgaaattctcctggag

SEQ ID NO: 3686171 - DNA, 21 bp, Homo sapiens
ggctgaaattctcctggaggt

SEQ ID NO: 3686172 - DNA, 15 bp, Homo sapiens
ggctgacgtgtgagg

SEQ ID NO: 3686173 - DNA, 19 bp, Homo sapiens
ggctgactagaagggccag

SEQ ID NO: 3686174 - DNA, 13 bp, Homo sapiens
ggctgagaaggaa

SEQ ID NO: 3686175 - DNA, 14 bp, Homo sapiens
ggctgagaaggaac

SEQ ID NO: 3686176 - DNA, 19 bp, Homo sapiens
ggctgagaaggaacaggga

SEQ ID NO: 3686177 - DNA, 17 bp, Homo sapiens
ggctgaggaaaggccag

SEQ ID NO: 3686178 - DNA, 18 bp, Homo sapiens
ggctgcagaggccagagg

SEQ ID NO: 3686179 - DNA, 19 bp, Homo sapiens
ggctgcagaggccagaggc

SEQ ID NO: 3686180 - DNA, 23 bp, Homo sapiens
ggctgccatctcacctcctgctg

SEQ ID NO: 3686181 - DNA, 19 bp, Homo sapiens
ggctgcccagagctgctgg

SEQ ID NO: 3686182 - DNA, 23 bp, Homo sapiens
ggctgccgtggggccgccgcctc

SEQ ID NO: 3686183 - DNA, 15 bp, Homo sapiens
ggctgctcagggctg

SEQ ID NO: 3686184 - DNA, 13 bp, Homo sapiens
ggctgctccctga

SEQ ID NO: 3686185 - DNA, 19 bp, Homo sapiens
ggctgctccctgagggcgg

SEQ ID NO: 3686186 - DNA, 13 bp, Homo sapiens
ggctgctcctgaa

SEQ ID NO: 3686187 - DNA, 15 bp, Homo sapiens
ggctgcttcctcctg

SEQ ID NO: 3686188 - DNA, 16 bp, Homo sapiens
ggctgcttcctcctgg

SEQ ID NO: 3686189 - DNA, 23 bp, Homo sapiens
ggctggagcccagggagcggaaa

SEQ ID NO: 3686190 - DNA, 21 bp, Homo sapiens
ggctggattttgaattttctt

SEQ ID NO: 3686191 - DNA, 14 bp, Homo sapiens
ggctgggggcagga

SEQ ID NO: 3686192 - DNA, 19 bp, Homo sapiens
ggctgggtggcaccagcag

SEQ ID NO: 3686193 - DNA, 13 bp, Homo sapiens
ggctggtccaggg

SEQ ID NO: 3686194 - DNA, 14 bp, Homo sapiens
ggctggtggcaagt

SEQ ID NO: 3686195 - DNA, 14 bp, Homo sapiens
ggctggtggcccag

SEQ ID NO: 3686196 - DNA, 23 bp, Homo sapiens
ggctgtcaatgggacctgtggct

SEQ ID NO: 3686197 - DNA, 20 bp, Homo sapiens
ggctgtttctgcttatttca

SEQ ID NO: 3686198 - DNA, 21 bp, Homo sapiens
ggcttcacggaagagccttgc

SEQ ID NO: 3686199 - DNA, 16 bp, Homo sapiens
ggcttcaggtccaggc

SEQ ID NO: 3686200 - DNA, 14 bp, Homo sapiens
ggcttctccctggg

SEQ ID NO: 3686201 - DNA, 21 bp, Homo sapiens
ggcttctctccgcgggtggga

SEQ ID NO: 3686202 - DNA, 11 bp, Homo sapiens
ggcttctctgg

SEQ ID NO: 3686203 - DNA, 14 bp, Homo sapiens
ggcttctctgggac

SEQ ID NO: 3686204 - DNA, 18 bp, Homo sapiens
ggcttctggccaggaagc

SEQ ID NO: 3686205 - DNA, 15 bp, Homo sapiens
ggcttcttcctggat

SEQ ID NO: 3686206 - DNA, 21 bp, Homo sapiens
ggcttgatggaagtgggccag

SEQ ID NO: 3686207 - DNA, 13 bp, Homo sapiens
ggctttgcagtgc

SEQ ID NO: 3686208 - DNA, 14 bp, Homo sapiens
ggctttgcatttct

SEQ ID NO: 3686209 - DNA, 19 bp, Homo sapiens
ggctttggaatgctccagg

SEQ ID NO: 3686210 - DNA, 14 bp, Homo sapiens
ggcttttccctggg

SEQ ID NO: 3686211 - DNA, 21 bp, Homo sapiens
ggcttttccctgggtggagca

SEQ ID NO: 3686212 - DNA, 15 bp, Homo sapiens
gggaaaaaaatgttg

SEQ ID NO: 3686213 - DNA, 14 bp, Homo sapiens
gggaaacttggctc

SEQ ID NO: 3686214 - DNA, 20 bp, Homo sapiens
gggaaagcctgaagggcctc

SEQ ID NO: 3686215 - DNA, 22 bp, Homo sapiens
gggaaagggtcctgctttctcc

SEQ ID NO: 3686216 - DNA, 15 bp, Homo sapiens
gggaacatgaagcca

SEQ ID NO: 3686217 - DNA, 16 bp, Homo sapiens
gggaaccgccctcctg

SEQ ID NO: 3686218 - DNA, 13 bp, Homo sapiens
gggaacctgtgtc

SEQ ID NO: 3686219 - DNA, 13 bp, Homo sapiens
gggaactggcctg

SEQ ID NO: 3686220 - DNA, 10 bp, Homo sapiens
gggaagaaaa

SEQ ID NO: 3686221 - DNA, 19 bp, Homo sapiens
gggaagaaaagagctttct

SEQ ID NO: 3686222 - DNA, 19 bp, Homo sapiens
gggaagcgtatatacttaa

SEQ ID NO: 3686223 - DNA, 17 bp, Homo sapiens
gggaaggaggctggctt

SEQ ID NO: 3686224 - DNA, 20 bp, Homo sapiens
ggtgggaggattgcttgagc

SEQ ID NO: 3686225 - DNA, 18 bp, Homo sapiens
ggtggggctcctacctgg

SEQ ID NO: 3686226 - DNA, 12 bp, Homo sapiens
ggtgggggagga

SEQ ID NO: 3686227 - DNA, 19 bp, Homo sapiens
ggtggggtcatgccctcct

SEQ ID NO: 3686228 - DNA, 16 bp, Homo sapiens
ggtggtctgcaggcag

SEQ ID NO: 3686229 - DNA, 18 bp, Homo sapiens
ggtggtctgcaggcaggg

SEQ ID NO: 3686230 - DNA, 21 bp, Homo sapiens
ggtggttatggagagggtgtc

SEQ ID NO: 3686231 - DNA, 23 bp, Homo sapiens
ggtggttgctgttttcctccctt

SEQ ID NO: 3686232 - DNA, 20 bp, Homo sapiens
ggtgtccccgctgctgtgca

SEQ ID NO: 3686233 - DNA, 12 bp, Homo sapiens
ggtgtgctggga

SEQ ID NO: 3686234 - DNA, 17 bp, Homo sapiens
ggtgtggaggctcctgt

SEQ ID NO: 3686235 - DNA, 14 bp, Homo sapiens
ggtgtggatggcag

SEQ ID NO: 3686236 - DNA, 11 bp, Homo sapiens
ggtgtggggga

SEQ ID NO: 3686237 - DNA, 13 bp, Homo sapiens
ggtgtgggggaag

SEQ ID NO: 3686238 - DNA, 17 bp, Homo sapiens
ggtgttgacatgtgctt

SEQ ID NO: 3686239 - DNA, 17 bp, Homo sapiens
ggttaccatgggtgtgg

SEQ ID NO: 3686240 - DNA, 21 bp, Homo sapiens
ggttacccagttagctctcaa

SEQ ID NO: 3686241 - DNA, 13 bp, Homo sapiens
ggttcaagagact

SEQ ID NO: 3686242 - DNA, 17 bp, Homo sapiens
ggttccctttccttcca

SEQ ID NO: 3686243 - DNA, 19 bp, Homo sapiens
ggttcgttctgtactgtta

SEQ ID NO: 3686244 - DNA, 18 bp, Homo sapiens
ggttctaggcatctctgt

SEQ ID NO: 3686245 - DNA, 20 bp, Homo sapiens
ggttctgcctgccagctgca

SEQ ID NO: 3686246 - DNA, 18 bp, Homo sapiens
ggttgctgttttcctccc

SEQ ID NO: 3686247 - DNA, 21 bp, Homo sapiens
ggttgctgttttcctcccttc

SEQ ID NO: 3686248 - DNA, 13 bp, Homo sapiens
ggttggtgggggc

SEQ ID NO: 3686249 - DNA, 18 bp, Homo sapiens
ggttgtctgaacccaggc

SEQ ID NO: 3686250 - DNA, 17 bp, Homo sapiens
ggtttacctagagaaca

SEQ ID NO: 3686251 - DNA, 13 bp, Homo sapiens
ggtttctgaaaat

SEQ ID NO: 3686252 - DNA, 21 bp, Homo sapiens
ggtttgccaaaattcatttct

SEQ ID NO: 3686253 - DNA, 23 bp, Homo sapiens
ggtttgtcgggcaccagccagcg

SEQ ID NO: 3686254 - DNA, 13 bp, Homo sapiens
ggttttgagaaag

SEQ ID NO: 3686255 - DNA, 12 bp, Homo sapiens
ggtttttccctg

SEQ ID NO: 3686256 - DNA, 14 bp, Homo sapiens
gtaaaaataaaatt

SEQ ID NO: 3686257 - DNA, 12 bp, Homo sapiens
gtaaaaatacaa

SEQ ID NO: 3686258 - DNA, 14 bp, Homo sapiens
gtaaaagaaatgta

SEQ ID NO: 3686259 - DNA, 19 bp, Homo sapiens
gtaaacagcctctttttga

SEQ ID NO: 3686260 - DNA, 20 bp, Homo sapiens
gtaaacttcctattttcttg

SEQ ID NO: 3686261 - DNA, 23 bp, Homo sapiens
gtaaagctatttatgggcccctg

SEQ ID NO: 3686262 - DNA, 10 bp, Homo sapiens
gtaaatgcct

SEQ ID NO: 3686263 - DNA, 19 bp, Homo sapiens
gtaaattatatttgtgcta

SEQ ID NO: 3686264 - DNA, 14 bp, Homo sapiens
gtaaccctggtggt

SEQ ID NO: 3686265 - DNA, 17 bp, Homo sapiens
gtaacctctacaggcat

SEQ ID NO: 3686266 - DNA, 16 bp, Homo sapiens
gtaacgcgtcttcctg

SEQ ID NO: 3686267 - DNA, 19 bp, Homo sapiens
gtaactgattacctgccaa

SEQ ID NO: 3686268 - DNA, 15 bp, Homo sapiens
gtaagaagaaagcaa

SEQ ID NO: 3686269 - DNA, 16 bp, Homo sapiens
gtaagaccttggtagg

SEQ ID NO: 3686270 - DNA, 16 bp, Homo sapiens
gtaagatgtaaattga

SEQ ID NO: 3686271 - DNA, 16 bp, Homo sapiens
gtaatcaggattgaat

SEQ ID NO: 3686272 - DNA, 15 bp, Homo sapiens
gtaatcatttgttta

SEQ ID NO: 3686273 - DNA, 20 bp, Homo sapiens
gtaatcccagcactttggga

SEQ ID NO: 3686274 - DNA, 18 bp, Homo sapiens
gtaattgtactaaagcca

SEQ ID NO: 3686275 - DNA, 15 bp, Homo sapiens
gtaatttattgtctg

SEQ ID NO: 3686276 - DNA, 15 bp, Homo sapiens
gtacaacggaggcct

SEQ ID NO: 3686277 - DNA, 12 bp, Homo sapiens
gtacaggcagca

SEQ ID NO: 3686278 - DNA, 17 bp, Homo sapiens
gtacaggcagcacagag

SEQ ID NO: 3686279 - DNA, 21 bp, Homo sapiens
gtaccaagaatcttggtttgc

SEQ ID NO: 3686280 - DNA, 13 bp, Homo sapiens
gtaccctgggtgt

SEQ ID NO: 3686281 - DNA, 23 bp, Homo sapiens
gtaccttttttgttttttcaaaa

SEQ ID NO: 3686282 - DNA, 13 bp, Homo sapiens
gtactaaagccaa

SEQ ID NO: 3686283 - DNA, 12 bp, Homo sapiens
gtactacaattt

SEQ ID NO: 3686284 - DNA, 15 bp, Homo sapiens
gtactacaatttaaa

SEQ ID NO: 3686285 - DNA, 17 bp, Homo sapiens
gtactagtgttctgttt

SEQ ID NO: 3686286 - DNA, 11 bp, Homo sapiens
gtactcagtgg

SEQ ID NO: 3686287 - DNA, 13 bp, Homo sapiens
gtactcagtggac

SEQ ID NO: 3686288 - DNA, 22 bp, Homo sapiens
gtactcgcacctcttggctttg

SEQ ID NO: 3686289 - DNA, 16 bp, Homo sapiens
gtacttaactatctgt

SEQ ID NO: 3686290 - DNA, 12 bp, Homo sapiens
gtacttgtttgc

SEQ ID NO: 3686291 - DNA, 14 bp, Homo sapiens
gtactttggaggcc

SEQ ID NO: 3686292 - DNA, 16 bp, Homo sapiens
gtacttttcattctct

SEQ ID NO: 3686293 - DNA, 18 bp, Homo sapiens
gtacttttcattctcttt

SEQ ID NO: 3686294 - DNA, 21 bp, Homo sapiens
gtacttttcattctcttttaa

SEQ ID NO: 3686295 - DNA, 18 bp, Homo sapiens
gtagaaagacagagctgg

SEQ ID NO: 3686296 - DNA, 15 bp, Homo sapiens
gtagagtgtgcctga

SEQ ID NO: 3686297 - DNA, 14 bp, Homo sapiens
gtagattttccaaa

SEQ ID NO: 3686298 - DNA, 13 bp, Homo sapiens
gtagcacttactg

SEQ ID NO: 3686299 - DNA, 14 bp, Homo sapiens
gtagctagaggaac

SEQ ID NO: 3686300 - DNA, 15 bp, Homo sapiens
gtagctagaggaacc

SEQ ID NO: 3686301 - DNA, 17 bp, Homo sapiens
gtagctagaggaaccaa

SEQ ID NO: 3686302 - DNA, 18 bp, Homo sapiens
gtaggctgctccctgagg

SEQ ID NO: 3686303 - DNA, 19 bp, Homo sapiens
gtaggctgctccctgaggg

SEQ ID NO: 3686304 - DNA, 23 bp, Homo sapiens
gtaggggttaacttggtcagagc

SEQ ID NO: 3686305 - DNA, 18 bp, Homo sapiens
gtaggtatgtctgtgcca

SEQ ID NO: 3686306 - DNA, 19 bp, Homo sapiens
gtaggtatgtctgtgccat

SEQ ID NO: 3686307 - DNA, 17 bp, Homo sapiens
gtaggttcagccaaggt

SEQ ID NO: 3686308 - DNA, 20 bp, Homo sapiens
gtagtcccagctactcggga

SEQ ID NO: 3686309 - DNA, 21 bp, Homo sapiens
gtagtcctcccaagctgtgct

SEQ ID NO: 3686310 - DNA, 12 bp, Homo sapiens
gtagtcctgtga

SEQ ID NO: 3686311 - DNA, 22 bp, Homo sapiens
gtagtttttacagctgtgttat

SEQ ID NO: 3686312 - DNA, 23 bp, Homo sapiens
gtagttttttttttttttatgtg

SEQ ID NO: 3686313 - DNA, 16 bp, Homo sapiens
gtataaaactttcctc

SEQ ID NO: 3686314 - DNA, 20 bp, Homo sapiens
gtataacaactatttacata

SEQ ID NO: 3686315 - DNA, 20 bp, Homo sapiens
gtatataggacaaaatgtta

SEQ ID NO: 3686316 - DNA, 20 bp, Homo sapiens
gtatctccctggagaagcac

SEQ ID NO: 3686317 - DNA, 20 bp, Homo sapiens
gtatctctttcacattgttt

SEQ ID NO: 3686318 - DNA, 16 bp, Homo sapiens
gtatggaagttttcct

SEQ ID NO: 3686319 - DNA, 14 bp, Homo sapiens
gtatggtcaggatg

SEQ ID NO: 3686320 - DNA, 14 bp, Homo sapiens
gtatgtctgtgcca

SEQ ID NO: 3686321 - DNA, 19 bp, Homo sapiens
gtatgtttaatctgttatg

SEQ ID NO: 3686322 - DNA, 19 bp, Homo sapiens
gtatgtttttgtgtatttg

SEQ ID NO: 3686323 - DNA, 13 bp, Homo sapiens
gtattagcaaagc

SEQ ID NO: 3686324 - DNA, 12 bp, Homo sapiens
gtattgtaaatt

SEQ ID NO: 3686325 - DNA, 18 bp, Homo sapiens
gtatttgattcaaaatat

SEQ ID NO: 3686326 - DNA, 22 bp, Homo sapiens
gtatttgcttttttgttttggc

SEQ ID NO: 3686327 - DNA, 19 bp, Homo sapiens
gtattttagtgaacttgaa

SEQ ID NO: 3686328 - DNA, 22 bp, Homo sapiens
gtattttgtttttgtcttaaaa

SEQ ID NO: 3686329 - DNA, 16 bp, Homo sapiens
gtcaaacaaagccaga

SEQ ID NO: 3686330 - DNA, 17 bp, Homo sapiens
gtcaaacgtgaaaatgc

SEQ ID NO: 3686331 - DNA, 15 bp, Homo sapiens
gtcaagctcctcctc

SEQ ID NO: 3686332 - DNA, 20 bp, Homo sapiens
gtcaagctcctcctccctgc

SEQ ID NO: 3686333 - DNA, 19 bp, Homo sapiens
gtcaatacagtacaggcag

SEQ ID NO: 3686334 - DNA, 17 bp, Homo sapiens
gtcaatttctgtgttgc

SEQ ID NO: 3686335 - DNA, 22 bp, Homo sapiens
gtcaatttctgtgttgccaagc

SEQ ID NO: 3686336 - DNA, 20 bp, Homo sapiens
gtcacaaagagatgtccttg

SEQ ID NO: 3686337 - DNA, 14 bp, Homo sapiens
gtcacaacagagtg

SEQ ID NO: 3686338 - DNA, 18 bp, Homo sapiens
gtcacacaaaggcatgct

SEQ ID NO: 3686339 - DNA, 21 bp, Homo sapiens
gtcacccaaaccggcaggtgc

SEQ ID NO: 3686340 - DNA, 19 bp, Homo sapiens
gtcaccggatcctgggtgg

SEQ ID NO: 3686341 - DNA, 14 bp, Homo sapiens
gtggggagggcagg

SEQ ID NO: 3686342 - DNA, 15 bp, Homo sapiens
gtggggcagggagct

SEQ ID NO: 3686343 - DNA, 14 bp, Homo sapiens
gtggggccaggtca

SEQ ID NO: 3686344 - DNA, 11 bp, Homo sapiens
gtggggctcct

SEQ ID NO: 3686345 - DNA, 16 bp, Homo sapiens
gtggggctcctacctg

SEQ ID NO: 3686346 - DNA, 18 bp, Homo sapiens
gtggggctcctacctggg

SEQ ID NO: 3686347 - DNA, 15 bp, Homo sapiens
gtggggcttctctgg

SEQ ID NO: 3686348 - DNA, 17 bp, Homo sapiens
gtggggcttctctggga

SEQ ID NO: 3686349 - DNA, 16 bp, Homo sapiens
gtgggggagcctctgg

SEQ ID NO: 3686350 - DNA, 17 bp, Homo sapiens
gtgggggagcctctgga

SEQ ID NO: 3686351 - DNA, 20 bp, Homo sapiens
gtgggggatcacagcctctg

SEQ ID NO: 3686352 - DNA, 13 bp, Homo sapiens
gtggggtgtgctg

SEQ ID NO: 3686353 - DNA, 20 bp, Homo sapiens
gtgggtagatcacgagatca

SEQ ID NO: 3686354 - DNA, 24 bp, Homo sapiens
gtgggtctgtaagaccttggtagg

SEQ ID NO: 3686355 - DNA, 16 bp, Homo sapiens
gtgggtggggcttctc

SEQ ID NO: 3686356 - DNA, 16 bp, Homo sapiens
gtggtagtcctcccaa

SEQ ID NO: 3686357 - DNA, 18 bp, Homo sapiens
gtggtagtcctcccaagc

SEQ ID NO: 3686358 - DNA, 23 bp, Homo sapiens
gtggtagtcctcccaagctgtgc

SEQ ID NO: 3686359 - DNA, 15 bp, Homo sapiens
gtggtcacagcggag

SEQ ID NO: 3686360 - DNA, 22 bp, Homo sapiens
gtggtcacagcggaggtgtgga

SEQ ID NO: 3686361 - DNA, 16 bp, Homo sapiens
gtggtcggtgggaccc

SEQ ID NO: 3686362 - DNA, 14 bp, Homo sapiens
gtggtctgcaggca

SEQ ID NO: 3686363 - DNA, 19 bp, Homo sapiens
gtggtctgttggcaggctg

SEQ ID NO: 3686364 - DNA, 13 bp, Homo sapiens
gtggtgagatcat

SEQ ID NO: 3686365 - DNA, 20 bp, Homo sapiens
gtggttggggccctgccctg

SEQ ID NO: 3686366 - DNA, 17 bp, Homo sapiens
gtgtagccacaccagga

SEQ ID NO: 3686367 - DNA, 23 bp, Homo sapiens
gtgtaggttccgtatctccctgg

SEQ ID NO: 3686368 - DNA, 18 bp, Homo sapiens
gtgtccatgcgctcaggg

SEQ ID NO: 3686369 - DNA, 21 bp, Homo sapiens
gtgtccatgcgctcagggcca

SEQ ID NO: 3686370 - DNA, 13 bp, Homo sapiens
gtgtcccaggcag

SEQ ID NO: 3686371 - DNA, 14 bp, Homo sapiens
gtgtcccaggcagg

SEQ ID NO: 3686372 - DNA, 19 bp, Homo sapiens
gtgtccccgctgctgtgca

SEQ ID NO: 3686373 - DNA, 22 bp, Homo sapiens
gtgtctcctctctggtggctgg

SEQ ID NO: 3686374 - DNA, 13 bp, Homo sapiens
gtgtctgagccca

SEQ ID NO: 3686375 - DNA, 18 bp, Homo sapiens
gtgtctttaaatgctgct

SEQ ID NO: 3686376 - DNA, 15 bp, Homo sapiens
gtgtcttttgacatt

SEQ ID NO: 3686377 - DNA, 18 bp, Homo sapiens
gtgtgaggagctgctggc

SEQ ID NO: 3686378 - DNA, 19 bp, Homo sapiens
gtgtgaggagctgctggct

SEQ ID NO: 3686379 - DNA, 18 bp, Homo sapiens
gtgtgatctcttcagggt

SEQ ID NO: 3686380 - DNA, 16 bp, Homo sapiens
gtgtgattgacagctt

SEQ ID NO: 3686381 - DNA, 21 bp, Homo sapiens
gtgtgattgacagctttgctg

SEQ ID NO: 3686382 - DNA, 23 bp, Homo sapiens
gtgtgattgacagctttgctgct

SEQ ID NO: 3686383 - DNA, 11 bp, Homo sapiens
gtgtgctggga

SEQ ID NO: 3686384 - DNA, 13 bp, Homo sapiens
gtgtggagaagcg

SEQ ID NO: 3686385 - DNA, 14 bp, Homo sapiens
gtgtggaggctcct

SEQ ID NO: 3686386 - DNA, 16 bp, Homo sapiens
gtgtggggagggcagg

SEQ ID NO: 3686387 - DNA, 20 bp, Homo sapiens
gtgtggggagggcaggtcca

SEQ ID NO: 3686388 - DNA, 16 bp, Homo sapiens
gtgtggtagagtgtgc

SEQ ID NO: 3686389 - DNA, 14 bp, Homo sapiens
gtgtgttgtctctt

SEQ ID NO: 3686390 - DNA, 16 bp, Homo sapiens
gtgttcctgcttttct

SEQ ID NO: 3686391 - DNA, 18 bp, Homo sapiens
gtgttcctgcttttctaa

SEQ ID NO: 3686392 - DNA, 14 bp, Homo sapiens
gtgttctgtttgtt

SEQ ID NO: 3686393 - DNA, 20 bp, Homo sapiens
gtgttgccaaatatgtcctg

SEQ ID NO: 3686394 - DNA, 12 bp, Homo sapiens
gtgtttaaaaaa

SEQ ID NO: 3686395 - DNA, 14 bp, Homo sapiens
gtgtttggctttca

SEQ ID NO: 3686396 - DNA, 15 bp, Homo sapiens
gtgtttttaactcaa

SEQ ID NO: 3686397 - DNA, 18 bp, Homo sapiens
gttaacacaatgtgaatt

SEQ ID NO: 3686398 - DNA, 18 bp, Homo sapiens
gttaactgtgaaatacca

SEQ ID NO: 3686399 - DNA, 14 bp, Homo sapiens
gttaacttggtcag

SEQ ID NO: 3686400 - DNA, 14 bp, Homo sapiens
gttaagacctggca

SEQ ID NO: 3686401 - DNA, 17 bp, Homo sapiens
gttaaggctgaggaaag

SEQ ID NO: 3686402 - DNA, 15 bp, Homo sapiens
gttaagttttcttgt

SEQ ID NO: 3686403 - DNA, 17 bp, Homo sapiens
gttaagttttcttgttt

SEQ ID NO: 3686404 - DNA, 14 bp, Homo sapiens
gttaatttttccta

SEQ ID NO: 3686405 - DNA, 15 bp, Homo sapiens
gttacagcacaaaat

SEQ ID NO: 3686406 - DNA, 23 bp, Homo sapiens
gttaccatgggtgtggatggcag

SEQ ID NO: 3686407 - DNA, 14 bp, Homo sapiens
gttacttctgaggt

SEQ ID NO: 3686408 - DNA, 15 bp, Homo sapiens
gttagctcctgtggc

SEQ ID NO: 3686409 - DNA, 16 bp, Homo sapiens
gttagctcctgtggcc

SEQ ID NO: 3686410 - DNA, 21 bp, Homo sapiens
gttagggacatttccaagctg

SEQ ID NO: 3686411 - DNA, 23 bp, Homo sapiens
gttatatttcagatgtaatgttt

SEQ ID NO: 3686412 - DNA, 13 bp, Homo sapiens
gttatgctgtcat

SEQ ID NO: 3686413 - DNA, 15 bp, Homo sapiens
gttattatatttgac

SEQ ID NO: 3686414 - DNA, 18 bp, Homo sapiens
gttattatatttgacatg

SEQ ID NO: 3686415 - DNA, 15 bp, Homo sapiens
gttatttaattgaaa

SEQ ID NO: 3686416 - DNA, 17 bp, Homo sapiens
gttcagcaccaccctag

SEQ ID NO: 3686417 - DNA, 22 bp, Homo sapiens
gttcagcactgtcccttgcctc

SEQ ID NO: 3686418 - DNA, 18 bp, Homo sapiens
gttcaggggactcagccc

SEQ ID NO: 3686419 - DNA, 20 bp, Homo sapiens
gttccagggtccctctgtgt

SEQ ID NO: 3686420 - DNA, 21 bp, Homo sapiens
gttccagggtccctctgtgta

SEQ ID NO: 3686421 - DNA, 20 bp, Homo sapiens
gttcccttcctctgtgccac

SEQ ID NO: 3686422 - DNA, 16 bp, Homo sapiens
gttcccttggcctcag

SEQ ID NO: 3686423 - DNA, 19 bp, Homo sapiens
gttccctttccttccatcc

SEQ ID NO: 3686424 - DNA, 22 bp, Homo sapiens
gttcctcattagcattttgcta

SEQ ID NO: 3686425 - DNA, 22 bp, Homo sapiens
gttcctctttggtgtacagact

SEQ ID NO: 3686426 - DNA, 20 bp, Homo sapiens
gttcctgttcagtaataaaa

SEQ ID NO: 3686427 - DNA, 23 bp, Homo sapiens
gttcctttccttttctttaaaga

SEQ ID NO: 3686428 - DNA, 17 bp, Homo sapiens
gttctcaggtgttgcca

SEQ ID NO: 3686429 - DNA, 23 bp, Homo sapiens
gttctccgttagctcctgtggcc

SEQ ID NO: 3686430 - DNA, 15 bp, Homo sapiens
gttctgcctgccagc

SEQ ID NO: 3686431 - DNA, 17 bp, Homo sapiens
gttctgcctgccagctg

SEQ ID NO: 3686432 - DNA, 23 bp, Homo sapiens
gttctgcctgccagctgcactga

SEQ ID NO: 3686433 - DNA, 19 bp, Homo sapiens
gttctggggggacccagtg

SEQ ID NO: 3686434 - DNA, 18 bp, Homo sapiens
gttctgtagactgccatc

SEQ ID NO: 3686435 - DNA, 21 bp, Homo sapiens
gttctgtagactgccatcatt

SEQ ID NO: 3686436 - DNA, 18 bp, Homo sapiens
gttctgtttgttattgtt

SEQ ID NO: 3686437 - DNA, 23 bp, Homo sapiens
gttctgtttgttattgttttgtt

SEQ ID NO: 3686438 - DNA, 14 bp, Homo sapiens
gttcttatttaatc

SEQ ID NO: 3686439 - DNA, 14 bp, Homo sapiens
gttcttcctgcaac

SEQ ID NO: 3686440 - DNA, 22 bp, Homo sapiens
gttctttgggccagacatgcca

SEQ ID NO: 3686441 - DNA, 18 bp, Homo sapiens
gttgaagatttgaggact

SEQ ID NO: 3686442 - DNA, 19 bp, Homo sapiens
gttgacatatttaatgttt

SEQ ID NO: 3686443 - DNA, 19 bp, Homo sapiens
gttgacttgacagaacact

SEQ ID NO: 3686444 - DNA, 20 bp, Homo sapiens
gttgactttttaaaattctg

SEQ ID NO: 3686445 - DNA, 14 bp, Homo sapiens
gttgagcaagcagt

SEQ ID NO: 3686446 - DNA, 12 bp, Homo sapiens
gttgaggggagc

SEQ ID NO: 3686447 - DNA, 21 bp, Homo sapiens
gttgagttcaggtagctgccc

SEQ ID NO: 3686448 - DNA, 19 bp, Homo sapiens
gttgatctggaacccagac

SEQ ID NO: 3686449 - DNA, 20 bp, Homo sapiens
gttgatgctccgccaggaag

SEQ ID NO: 3686450 - DNA, 15 bp, Homo sapiens
gttgcagacaggaat

SEQ ID NO: 3686451 - DNA, 15 bp, Homo sapiens
gttgcaggacctcag

SEQ ID NO: 3686452 - DNA, 15 bp, Homo sapiens
gttgccaagctccaa

SEQ ID NO: 3686453 - DNA, 18 bp, Homo sapiens
gttgccaagctccaagcc

SEQ ID NO: 3686454 - DNA, 17 bp, Homo sapiens
gttgcccttctgtccaa

SEQ ID NO: 3686455 - DNA, 17 bp, Homo sapiens
gttgctatttttgtaaa

SEQ ID NO: 3686456 - DNA, 21 bp, Homo sapiens
gttgctgttttcctcccttct

SEQ ID NO: 3686457 - DNA, 17 bp, Homo sapiens
taagacaacaggcattt

SEQ ID NO: 3686458 - DNA, 22 bp, Homo sapiens
taagactaacaaaggcagctgt

SEQ ID NO: 3686459 - DNA, 14 bp, Homo sapiens
taagcaacatcttt

SEQ ID NO: 3686460 - DNA, 13 bp, Homo sapiens
taagcagaggagg

SEQ ID NO: 3686461 - DNA, 16 bp, Homo sapiens
taagcagaggaggggc

SEQ ID NO: 3686462 - DNA, 17 bp, Homo sapiens
taagcagctaaattttc

SEQ ID NO: 3686463 - DNA, 17 bp, Homo sapiens
taagcatactttgtaaa

SEQ ID NO: 3686464 - DNA, 20 bp, Homo sapiens
taaggaaatcaacttgctta

SEQ ID NO: 3686465 - DNA, 18 bp, Homo sapiens
taaggcatgtgtgaaaca

SEQ ID NO: 3686466 - DNA, 18 bp, Homo sapiens
taagggcgtggctctggg

SEQ ID NO: 3686467 - DNA, 16 bp, Homo sapiens
taaggggcccggccag

SEQ ID NO: 3686468 - DNA, 17 bp, Homo sapiens
taaggttccatccaccc

SEQ ID NO: 3686469 - DNA, 15 bp, Homo sapiens
taagtgggcccaccc

SEQ ID NO: 3686470 - DNA, 18 bp, Homo sapiens
taagtgggcccacccggt

SEQ ID NO: 3686471 - DNA, 18 bp, Homo sapiens
taagttttcttgtttctg

SEQ ID NO: 3686472 - DNA, 19 bp, Homo sapiens
taataaaagaacatgcttg

SEQ ID NO: 3686473 - DNA, 15 bp, Homo sapiens
taataaactgtgttt

SEQ ID NO: 3686474 - DNA, 20 bp, Homo sapiens
taatacattccaactcgtat

SEQ ID NO: 3686475 - DNA, 16 bp, Homo sapiens
taatagggaatatatc

SEQ ID NO: 3686476 - DNA, 21 bp, Homo sapiens
taatatcaaatgcagtatatt

SEQ ID NO: 3686477 - DNA, 15 bp, Homo sapiens
taatatctcctggaa

SEQ ID NO: 3686478 - DNA, 17 bp, Homo sapiens
taatattaactacagaa

SEQ ID NO: 3686479 - DNA, 21 bp, Homo sapiens
taatattaactacagaaaaga

SEQ ID NO: 3686480 - DNA, 14 bp, Homo sapiens
taatatttttaatt

SEQ ID NO: 3686481 - DNA, 12 bp, Homo sapiens
taatcattttca

SEQ ID NO: 3686482 - DNA, 18 bp, Homo sapiens
taatcattttcattccta

SEQ ID NO: 3686483 - DNA, 19 bp, Homo sapiens
taatccaatgggtttttcc

SEQ ID NO: 3686484 - DNA, 19 bp, Homo sapiens
taatccaggcagatccagg

SEQ ID NO: 3686485 - DNA, 16 bp, Homo sapiens
taatcccacccacctc

SEQ ID NO: 3686486 - DNA, 20 bp, Homo sapiens
taatctgttatgtactagtg

SEQ ID NO: 3686487 - DNA, 23 bp, Homo sapiens
taatgatgtcgtttgaatcacag

SEQ ID NO: 3686488 - DNA, 19 bp, Homo sapiens
taatgctaatttaaagaga

SEQ ID NO: 3686489 - DNA, 20 bp, Homo sapiens
taatgctcacctttatcacc

SEQ ID NO: 3686490 - DNA, 19 bp, Homo sapiens
taatggttaagttttcttg

SEQ ID NO: 3686491 - DNA, 20 bp, Homo sapiens
taatgtatgtaggagctgca

SEQ ID NO: 3686492 - DNA, 20 bp, Homo sapiens
taatgttttaaatgtacaga

SEQ ID NO: 3686493 - DNA, 13 bp, Homo sapiens
taatgttttcttt

SEQ ID NO: 3686494 - DNA, 21 bp, Homo sapiens
taatgttttctttgcaaagta

SEQ ID NO: 3686495 - DNA, 15 bp, Homo sapiens
taattaaaacacttt

SEQ ID NO: 3686496 - DNA, 18 bp, Homo sapiens
taattaaccttactaatt

SEQ ID NO: 3686497 - DNA, 21 bp, Homo sapiens
taattgcaaaaacatagaaat

SEQ ID NO: 3686498 - DNA, 23 bp, Homo sapiens
taattgcagataactttgacttt

SEQ ID NO: 3686499 - DNA, 17 bp, Homo sapiens
taattgctttgccaaaa

SEQ ID NO: 3686500 - DNA, 20 bp, Homo sapiens
taattgttgaacaggtgttt

SEQ ID NO: 3686501 - DNA, 20 bp, Homo sapiens
taatttattaattgctttga

SEQ ID NO: 3686502 - DNA, 19 bp, Homo sapiens
taatttattgtctgtctac

SEQ ID NO: 3686503 - DNA, 20 bp, Homo sapiens
taatttgatgaggtattttt

SEQ ID NO: 3686504 - DNA, 15 bp, Homo sapiens
taatttgttgtagat

SEQ ID NO: 3686505 - DNA, 22 bp, Homo sapiens
taattttacatgtttataaatc

SEQ ID NO: 3686506 - DNA, 14 bp, Homo sapiens
tacaaaaataaatt

SEQ ID NO: 3686507 - DNA, 12 bp, Homo sapiens
tacaactgaaac

SEQ ID NO: 3686508 - DNA, 13 bp, Homo sapiens
tacaactgaaacc

SEQ ID NO: 3686509 - DNA, 23 bp, Homo sapiens
tacaagagcagcctgtggcatct

SEQ ID NO: 3686510 - DNA, 18 bp, Homo sapiens
tacaagtcagctccagct

SEQ ID NO: 3686511 - DNA, 17 bp, Homo sapiens
tacaagtttatatatat

SEQ ID NO: 3686512 - DNA, 13 bp, Homo sapiens
tacaataaaaaca

SEQ ID NO: 3686513 - DNA, 13 bp, Homo sapiens
tacacacacacac

SEQ ID NO: 3686514 - DNA, 14 bp, Homo sapiens
tacagacagaatat

SEQ ID NO: 3686515 - DNA, 15 bp, Homo sapiens
tacagacatatttaa

SEQ ID NO: 3686516 - DNA, 18 bp, Homo sapiens
tacagacatatttaactg

SEQ ID NO: 3686517 - DNA, 21 bp, Homo sapiens
tacaggaagcaccccatgcca

SEQ ID NO: 3686518 - DNA, 17 bp, Homo sapiens
tacagttgaaataactg

SEQ ID NO: 3686519 - DNA, 13 bp, Homo sapiens
tacataaacttaa

SEQ ID NO: 3686520 - DNA, 19 bp, Homo sapiens
tacataatgggccactgaa

SEQ ID NO: 3686521 - DNA, 23 bp, Homo sapiens
tacataatgggccactgaaatct

SEQ ID NO: 3686522 - DNA, 17 bp, Homo sapiens
tacataattcactctga

SEQ ID NO: 3686523 - DNA, 17 bp, Homo sapiens
tacatatttgagactag

SEQ ID NO: 3686524 - DNA, 17 bp, Homo sapiens
tacatgcagcccatgcc

SEQ ID NO: 3686525 - DNA, 18 bp, Homo sapiens
tacatgccccgtttttga

SEQ ID NO: 3686526 - DNA, 14 bp, Homo sapiens
tacatgtaatttga

SEQ ID NO: 3686527 - DNA, 13 bp, Homo sapiens
tacattacacagt

SEQ ID NO: 3686528 - DNA, 23 bp, Homo sapiens
tacattgtgggatgttcagcact

SEQ ID NO: 3686529 - DNA, 11 bp, Homo sapiens
tacatttctgc

SEQ ID NO: 3686530 - DNA, 15 bp, Homo sapiens
tacatttctgcagat

SEQ ID NO: 3686531 - DNA, 19 bp, Homo sapiens
tacatttttgtggttttga

SEQ ID NO: 3686532 - DNA, 22 bp, Homo sapiens
taccaaagtgtcttttgacatt

SEQ ID NO: 3686533 - DNA, 12 bp, Homo sapiens
taccacaagcct

SEQ ID NO: 3686534 - DNA, 15 bp, Homo sapiens
taccactttcttatt

SEQ ID NO: 3686535 - DNA, 12 bp, Homo sapiens
taccagatgcag

SEQ ID NO: 3686536 - DNA, 19 bp, Homo sapiens
taccatgggtgtggatggc

SEQ ID NO: 3686537 - DNA, 17 bp, Homo sapiens
tacccacaatctgagca

SEQ ID NO: 3686538 - DNA, 21 bp, Homo sapiens
tacccacaatctgagcacgct

SEQ ID NO: 3686539 - DNA, 15 bp, Homo sapiens
taccctcccaccccc

SEQ ID NO: 3686540 - DNA, 19 bp, Homo sapiens
taccctcctgctgagctgc

SEQ ID NO: 3686541 - DNA, 22 bp, Homo sapiens
taccctcttcatggatggggga

SEQ ID NO: 3686542 - DNA, 14 bp, Homo sapiens
tacctcaggcagga

SEQ ID NO: 3686543 - DNA, 18 bp, Homo sapiens
tacctcggtgccttcctc

SEQ ID NO: 3686544 - DNA, 20 bp, Homo sapiens
tacctcgttctgctcagagg

SEQ ID NO: 3686545 - DNA, 19 bp, Homo sapiens
tacctgaaggcagggctcc

SEQ ID NO: 3686546 - DNA, 20 bp, Homo sapiens
tacctgaaggcagggctcct

SEQ ID NO: 3686547 - DNA, 16 bp, Homo sapiens
tacctgcaggcggggc

SEQ ID NO: 3686548 - DNA, 20 bp, Homo sapiens
tacctgcaggcggggctcct

SEQ ID NO: 3686549 - DNA, 15 bp, Homo sapiens
tacctgtattcccag

SEQ ID NO: 3686550 - DNA, 14 bp, Homo sapiens
tacctttcaaagct

SEQ ID NO: 3686551 - DNA, 15 bp, Homo sapiens
tacctttcaaagctt

SEQ ID NO: 3686552 - DNA, 22 bp, Homo sapiens
taccttttttgttttttcaaaa

SEQ ID NO: 3686553 - DNA, 22 bp, Homo sapiens
tacgccaggggaaaatcagcct

SEQ ID NO: 3686554 - DNA, 11 bp, Homo sapiens
tacgtttcttt

SEQ ID NO: 3686555 - DNA, 19 bp, Homo sapiens
tactactttgttaggattt

SEQ ID NO: 3686556 - DNA, 22 bp, Homo sapiens
tactactttgttaggattttca

SEQ ID NO: 3686557 - DNA, 19 bp, Homo sapiens
tactagagtctgaacagct

SEQ ID NO: 3686558 - DNA, 16 bp, Homo sapiens
tactagtgttctgttt

SEQ ID NO: 3686559 - DNA, 17 bp, Homo sapiens
tactataagaactttga

SEQ ID NO: 3686560 - DNA, 23 bp, Homo sapiens
tactcagataaggtaaaatgcca

SEQ ID NO: 3686561 - DNA, 21 bp, Homo sapiens
tactcttggatgggacatttt

SEQ ID NO: 3686562 - DNA, 22 bp, Homo sapiens
tactgacatgtggggccaggtc

SEQ ID NO: 3686563 - DNA, 23 bp, Homo sapiens
tactgagggaccaactgggccca

SEQ ID NO: 3686564 - DNA, 16 bp, Homo sapiens
tactgcgactttctgc

SEQ ID NO: 3686565 - DNA, 17 bp, Homo sapiens
tactgcgactttctgcc

SEQ ID NO: 3686566 - DNA, 20 bp, Homo sapiens
tactgcgactttctgcctgg

SEQ ID NO: 3686567 - DNA, 21 bp, Homo sapiens
tactgctgagatacatacaga

SEQ ID NO: 3686568 - DNA, 15 bp, Homo sapiens
tactgtacaataaaa

SEQ ID NO: 3686569 - DNA, 18 bp, Homo sapiens
tactgttactgggccctg

SEQ ID NO: 3686570 - DNA, 17 bp, Homo sapiens
tacttaagaatacacag

SEQ ID NO: 3686571 - DNA, 15 bp, Homo sapiens
tacttaatccaatgg

SEQ ID NO: 3686572 - DNA, 20 bp, Homo sapiens
tacttagggaagaaaaagca

SEQ ID NO: 3686573 - DNA, 17 bp, Homo sapiens
tcaggccagagccaagg

SEQ ID NO: 3686574 - DNA, 13 bp, Homo sapiens
tcagggtgtggga

SEQ ID NO: 3686575 - DNA, 18 bp, Homo sapiens
tcagggtgtgggatctga

SEQ ID NO: 3686576 - DNA, 14 bp, Homo sapiens
tcaggtacttgtaa

SEQ ID NO: 3686577 - DNA, 23 bp, Homo sapiens
tcaggtgagaagcagaggaagga

SEQ ID NO: 3686578 - DNA, 15 bp, Homo sapiens
tcaggtgcccctctt

SEQ ID NO: 3686579 - DNA, 20 bp, Homo sapiens
tcaggtgcccctcttccaaa

SEQ ID NO: 3686580 - DNA, 23 bp, Homo sapiens
tcagtacttttttaaatattttc

SEQ ID NO: 3686581 - DNA, 17 bp, Homo sapiens
tcagtatccatgctctt

SEQ ID NO: 3686582 - DNA, 15 bp, Homo sapiens
tcagtattgacactg

SEQ ID NO: 3686583 - DNA, 14 bp, Homo sapiens
tcagtgacatctga

SEQ ID NO: 3686584 - DNA, 14 bp, Homo sapiens
tcagtgctgtgctg

SEQ ID NO: 3686585 - DNA, 22 bp, Homo sapiens
tcagtgctgtgctgtgctatgg

SEQ ID NO: 3686586 - DNA, 15 bp, Homo sapiens
tcagtgcttcgcaga

SEQ ID NO: 3686587 - DNA, 16 bp, Homo sapiens
tcagtggacagtgctg

SEQ ID NO: 3686588 - DNA, 15 bp, Homo sapiens
tcagttcccttggcc

SEQ ID NO: 3686589 - DNA, 23 bp, Homo sapiens
tcatactacaggatatttactat

SEQ ID NO: 3686590 - DNA, 16 bp, Homo sapiens
tcatagtagtttttac

SEQ ID NO: 3686591 - DNA, 21 bp, Homo sapiens
tcatatggaaaaaatgtatgt

SEQ ID NO: 3686592 - DNA, 19 bp, Homo sapiens
tcatcaacttaaaagtcag

SEQ ID NO: 3686593 - DNA, 13 bp, Homo sapiens
tcatcattattat

SEQ ID NO: 3686594 - DNA, 14 bp, Homo sapiens
tcatcattattatt

SEQ ID NO: 3686595 - DNA, 20 bp, Homo sapiens
tcatccccaggggtcccagc

SEQ ID NO: 3686596 - DNA, 21 bp, Homo sapiens
tcatccccaggggtcccagcc

SEQ ID NO: 3686597 - DNA, 16 bp, Homo sapiens
tcatctctctttaata

SEQ ID NO: 3686598 - DNA, 23 bp, Homo sapiens
tcatcttgaccaagcaggaagct

SEQ ID NO: 3686599 - DNA, 16 bp, Homo sapiens
tcatcttgcacacact

SEQ ID NO: 3686600 - DNA, 18 bp, Homo sapiens
tcatcttgcacacacttt

SEQ ID NO: 3686601 - DNA, 15 bp, Homo sapiens
tcatgatgctagcca

SEQ ID NO: 3686602 - DNA, 19 bp, Homo sapiens
tcatgctggaacctgcaaa

SEQ ID NO: 3686603 - DNA, 22 bp, Homo sapiens
tcatgctggaacctgcaaaaaa

SEQ ID NO: 3686604 - DNA, 17 bp, Homo sapiens
tcatggagaaccaccta

SEQ ID NO: 3686605 - DNA, 21 bp, Homo sapiens
tcatggagaaccacctacccc

SEQ ID NO: 3686606 - DNA, 23 bp, Homo sapiens
tcatggccagcgcccctcagcct

SEQ ID NO: 3686607 - DNA, 16 bp, Homo sapiens
tcatggcgggactgga

SEQ ID NO: 3686608 - DNA, 19 bp, Homo sapiens
tcatggcgggactggagaa

SEQ ID NO: 3686609 - DNA, 14 bp, Homo sapiens
tcatgtaaacatac

SEQ ID NO: 3686610 - DNA, 22 bp, Homo sapiens
tcatgtaaacataccaacatgt

SEQ ID NO: 3686611 - DNA, 21 bp, Homo sapiens
tcatgttgatcatgtactttt

SEQ ID NO: 3686612 - DNA, 12 bp, Homo sapiens
tcattcatcctg

SEQ ID NO: 3686613 - DNA, 18 bp, Homo sapiens
tcattccttgtcttgata

SEQ ID NO: 3686614 - DNA, 17 bp, Homo sapiens
tcattgatgatcactgt

SEQ ID NO: 3686615 - DNA, 20 bp, Homo sapiens
tcattgatgatcactgtgaa

SEQ ID NO: 3686616 - DNA, 22 bp, Homo sapiens
tcattgatgatcactgtgaaaa

SEQ ID NO: 3686617 - DNA, 20 bp, Homo sapiens
tcatttgctaactagcttgg

SEQ ID NO: 3686618 - DNA, 23 bp, Homo sapiens
tcatttggggtagctagaggaac

SEQ ID NO: 3686619 - DNA, 12 bp, Homo sapiens
tcatttgtttac

SEQ ID NO: 3686620 - DNA, 15 bp, Homo sapiens
tcattttcagagtga

SEQ ID NO: 3686621 - DNA, 15 bp, Homo sapiens
tcattttccccccac

SEQ ID NO: 3686622 - DNA, 19 bp, Homo sapiens
tccaaaggaggctggcagg

SEQ ID NO: 3686623 - DNA, 14 bp, Homo sapiens
tccaaatgcttcta

SEQ ID NO: 3686624 - DNA, 13 bp, Homo sapiens
tccaaatgtccct

SEQ ID NO: 3686625 - DNA, 21 bp, Homo sapiens
tccaacctgcaaagatctgtc

SEQ ID NO: 3686626 - DNA, 14 bp, Homo sapiens
tccaacgtggccca

SEQ ID NO: 3686627 - DNA, 23 bp, Homo sapiens
tccaagccccatcttctaaatgg

SEQ ID NO: 3686628 - DNA, 23 bp, Homo sapiens
tccaagcggatgctccatttcaa

SEQ ID NO: 3686629 - DNA, 21 bp, Homo sapiens
tccaattaattagtaaggatt

SEQ ID NO: 3686630 - DNA, 15 bp, Homo sapiens
tccaattttaattta

SEQ ID NO: 3686631 - DNA, 23 bp, Homo sapiens
tccaattttaatttagtaaatgt

SEQ ID NO: 3686632 - DNA, 19 bp, Homo sapiens
tccaccaaaccccacttcc

SEQ ID NO: 3686633 - DNA, 14 bp, Homo sapiens
tccacccttggcct

SEQ ID NO: 3686634 - DNA, 15 bp, Homo sapiens
tccacccttggcctg

SEQ ID NO: 3686635 - DNA, 20 bp, Homo sapiens
tccacccttggcctgtctca

SEQ ID NO: 3686636 - DNA, 19 bp, Homo sapiens
tccacgggggctgtggctc

SEQ ID NO: 3686637 - DNA, 20 bp, Homo sapiens
tccactctaccctcccaccc

SEQ ID NO: 3686638 - DNA, 21 bp, Homo sapiens
tccactctaccctcccacccc

SEQ ID NO: 3686639 - DNA, 23 bp, Homo sapiens
tccactctaccctcccaccccct

SEQ ID NO: 3686640 - DNA, 23 bp, Homo sapiens
tccacttcagggttctaaccttt

SEQ ID NO: 3686641 - DNA, 18 bp, Homo sapiens
tccactttcagtgaaagc

SEQ ID NO: 3686642 - DNA, 22 bp, Homo sapiens
tccactttgtttcgtggggagg

SEQ ID NO: 3686643 - DNA, 15 bp, Homo sapiens
tccagcaccttgtgc

SEQ ID NO: 3686644 - DNA, 14 bp, Homo sapiens
tccagcccctctgg

SEQ ID NO: 3686645 - DNA, 23 bp, Homo sapiens
tccagccgccattgccaccagga

SEQ ID NO: 3686646 - DNA, 22 bp, Homo sapiens
tccagcctgggcagccaggctg

SEQ ID NO: 3686647 - DNA, 17 bp, Homo sapiens
tccagcctggggtctgg

SEQ ID NO: 3686648 - DNA, 14 bp, Homo sapiens
tccagcctggtggc

SEQ ID NO: 3686649 - DNA, 12 bp, Homo sapiens
tccagctccaac

SEQ ID NO: 3686650 - DNA, 16 bp, Homo sapiens
tccagctccaacctgc

SEQ ID NO: 3686651 - DNA, 18 bp, Homo sapiens
tccagctccaacctgcaa

SEQ ID NO: 3686652 - DNA, 13 bp, Homo sapiens
tccagctctggag

SEQ ID NO: 3686653 - DNA, 15 bp, Homo sapiens
tccagctctggaggg

SEQ ID NO: 3686654 - DNA, 21 bp, Homo sapiens
tccaggagataattgtttcat

SEQ ID NO: 3686655 - DNA, 19 bp, Homo sapiens
tccaggatctttgactgaa

SEQ ID NO: 3686656 - DNA, 16 bp, Homo sapiens
tccaggatggggaggg

SEQ ID NO: 3686657 - DNA, 13 bp, Homo sapiens
tccaggcagatcc

SEQ ID NO: 3686658 - DNA, 17 bp, Homo sapiens
tccaggcagatccagga

SEQ ID NO: 3686659 - DNA, 18 bp, Homo sapiens
tccaggctttcccacttc

SEQ ID NO: 3686660 - DNA, 20 bp, Homo sapiens
tccaggctttcccacttccc

SEQ ID NO: 3686661 - DNA, 22 bp, Homo sapiens
tccaggctttcccacttcccac

SEQ ID NO: 3686662 - DNA, 12 bp, Homo sapiens
tccagggaagct

SEQ ID NO: 3686663 - DNA, 23 bp, Homo sapiens
tccagggaagctggccgagggtc

SEQ ID NO: 3686664 - DNA, 22 bp, Homo sapiens
tccaggggctgcttcctcctgg

SEQ ID NO: 3686665 - DNA, 16 bp, Homo sapiens
tccagggtccctctgt

SEQ ID NO: 3686666 - DNA, 18 bp, Homo sapiens
tccagggtccctctgtgt

SEQ ID NO: 3686667 - DNA, 20 bp, Homo sapiens
tccagtgacaaaccatccag

SEQ ID NO: 3686668 - DNA, 13 bp, Homo sapiens
tccagtgctggat

SEQ ID NO: 3686669 - DNA, 19 bp, Homo sapiens
tccagtgctggatttgatg

SEQ ID NO: 3686670 - DNA, 17 bp, Homo sapiens
tccagtggaggtttgtc

SEQ ID NO: 3686671 - DNA, 14 bp, Homo sapiens
tccatatgctccag

SEQ ID NO: 3686672 - DNA, 21 bp, Homo sapiens
tccatccaaggccaggttctc

SEQ ID NO: 3686673 - DNA, 22 bp, Homo sapiens
tccatccctaccccctaagagc

SEQ ID NO: 3686674 - DNA, 12 bp, Homo sapiens
tccatgaaaatg

SEQ ID NO: 3686675 - DNA, 16 bp, Homo sapiens
tccatgaaaatgcaac

SEQ ID NO: 3686676 - DNA, 21 bp, Homo sapiens
tccatgcctgtagctttcctg

SEQ ID NO: 3686677 - DNA, 16 bp, Homo sapiens
tccatgcgctcagggc

SEQ ID NO: 3686678 - DNA, 14 bp, Homo sapiens
tccatgtacttgtt

SEQ ID NO: 3686679 - DNA, 14 bp, Homo sapiens
tccattttggaaaa

SEQ ID NO: 3686680 - DNA, 15 bp, Homo sapiens
tccattttggaaaat

SEQ ID NO: 3686681 - DNA, 15 bp, Homo sapiens
tcccaacaagcagct

SEQ ID NO: 3686682 - DNA, 15 bp, Homo sapiens
tcccaaccaggcacc

SEQ ID NO: 3686683 - DNA, 13 bp, Homo sapiens
tcccaagctgtgc

SEQ ID NO: 3686684 - DNA, 13 bp, Homo sapiens
tcccaagtctcca

SEQ ID NO: 3686685 - DNA, 16 bp, Homo sapiens
tcccacaaaggagagc

SEQ ID NO: 3686686 - DNA, 11 bp, Homo sapiens
tcccacacagg

SEQ ID NO: 3686687 - DNA, 12 bp, Homo sapiens
tcccacacccaa

SEQ ID NO: 3686688 - DNA, 17 bp, Homo sapiens
tcccacacccaaagctg

SEQ ID NO: 3686689 - DNA, 13 bp, Homo sapiens
tcgtgcctgtgtc

SEQ ID NO: 3686690 - DNA, 14 bp, Homo sapiens
tcgtgcctgtgtcc

SEQ ID NO: 3686691 - DNA, 12 bp, Homo sapiens
tcgtggggaggt

SEQ ID NO: 3686692 - DNA, 15 bp, Homo sapiens
tcgtggggtgtgctg

SEQ ID NO: 3686693 - DNA, 17 bp, Homo sapiens
tcgttctgctcagaggc

SEQ ID NO: 3686694 - DNA, 18 bp, Homo sapiens
tctaaaccccagattctt

SEQ ID NO: 3686695 - DNA, 24 bp, Homo sapiens
tctaaaccccagattcttcagctt

SEQ ID NO: 3686696 - DNA, 12 bp, Homo sapiens
tctaaagttata

SEQ ID NO: 3686697 - DNA, 14 bp, Homo sapiens
tctaacaataatat

SEQ ID NO: 3686698 - DNA, 22 bp, Homo sapiens
tctaacaataatatttcaagtg

SEQ ID NO: 3686699 - DNA, 23 bp, Homo sapiens
tctaacaataatatttcaagtgc

SEQ ID NO: 3686700 - DNA, 14 bp, Homo sapiens
tctaacctttctaa

SEQ ID NO: 3686701 - DNA, 14 bp, Homo sapiens
tctaagcctgaagg

SEQ ID NO: 3686702 - DNA, 20 bp, Homo sapiens
tctaatctagatatcgactt

SEQ ID NO: 3686703 - DNA, 24 bp, Homo sapiens
tctaatgaggagagaaaatatatg

SEQ ID NO: 3686704 - DNA, 11 bp, Homo sapiens
tctacaggcat

SEQ ID NO: 3686705 - DNA, 21 bp, Homo sapiens
tctaccctcttagaaaaacca

SEQ ID NO: 3686706 - DNA, 19 bp, Homo sapiens
tctactccttgtaaagact

SEQ ID NO: 3686707 - DNA, 18 bp, Homo sapiens
tctactctagggaaaaac

SEQ ID NO: 3686708 - DNA, 19 bp, Homo sapiens
tctacttctgcccttgcca

SEQ ID NO: 3686709 - DNA, 20 bp, Homo sapiens
tctacttgtccagttcaaat

SEQ ID NO: 3686710 - DNA, 19 bp, Homo sapiens
tctagaatttatcacactt

SEQ ID NO: 3686711 - DNA, 13 bp, Homo sapiens
tctagagagggag

SEQ ID NO: 3686712 - DNA, 14 bp, Homo sapiens
tctaggatagctaa

SEQ ID NO: 3686713 - DNA, 16 bp, Homo sapiens
tctaggattgggcctc

SEQ ID NO: 3686714 - DNA, 19 bp, Homo sapiens
tctagtcacaaagactcct

SEQ ID NO: 3686715 - DNA, 23 bp, Homo sapiens
tctagtgccttctaaaggtgttg

SEQ ID NO: 3686716 - DNA, 13 bp, Homo sapiens
tctagttctttgt

SEQ ID NO: 3686717 - DNA, 19 bp, Homo sapiens
tctatgtatgttaatttat

SEQ ID NO: 3686718 - DNA, 17 bp, Homo sapiens
tctcaaaatatcctaag

SEQ ID NO: 3686719 - DNA, 13 bp, Homo sapiens
tctcaagccctgc

SEQ ID NO: 3686720 - DNA, 17 bp, Homo sapiens
tctcaatgaagccagct

SEQ ID NO: 3686721 - DNA, 22 bp, Homo sapiens
tctcacccatgcaagcagagga

SEQ ID NO: 3686722 - DNA, 15 bp, Homo sapiens
tctcactgtttgttt

SEQ ID NO: 3686723 - DNA, 19 bp, Homo sapiens
tctcactgtttgtttttat

SEQ ID NO: 3686724 - DNA, 12 bp, Homo sapiens
tctcagaacctt

SEQ ID NO: 3686725 - DNA, 16 bp, Homo sapiens
tctcagaccttacaca

SEQ ID NO: 3686726 - DNA, 21 bp, Homo sapiens
tctcaggagcaccctgtcttc

SEQ ID NO: 3686727 - DNA, 22 bp, Homo sapiens
tctcaggagcaccctgtcttct

SEQ ID NO: 3686728 - DNA, 19 bp, Homo sapiens
tctcaggtctgaatcttca

SEQ ID NO: 3686729 - DNA, 18 bp, Homo sapiens
tctcatcaacttaaaagt

SEQ ID NO: 3686730 - DNA, 15 bp, Homo sapiens
tctcatccccagggg

SEQ ID NO: 3686731 - DNA, 22 bp, Homo sapiens
tctcatccccaggggtcccagc

SEQ ID NO: 3686732 - DNA, 18 bp, Homo sapiens
tctcatgttttcaactgc

SEQ ID NO: 3686733 - DNA, 19 bp, Homo sapiens
tctcatgttttcaactgcc

SEQ ID NO: 3686734 - DNA, 18 bp, Homo sapiens
tctccactgtgctttcag

SEQ ID NO: 3686735 - DNA, 21 bp, Homo sapiens
tctccagcgtcagctgctccc

SEQ ID NO: 3686736 - DNA, 23 bp, Homo sapiens
tctccagggagggtatttattgg

SEQ ID NO: 3686737 - DNA, 20 bp, Homo sapiens
tctccaggggctgcttcctc

SEQ ID NO: 3686738 - DNA, 10 bp, Homo sapiens
tctcccaggt

SEQ ID NO: 3686739 - DNA, 19 bp, Homo sapiens
tctcccattgtccctctgc

SEQ ID NO: 3686740 - DNA, 10 bp, Homo sapiens
tctccccaca

SEQ ID NO: 3686741 - DNA, 11 bp, Homo sapiens
tctccccacac

SEQ ID NO: 3686742 - DNA, 20 bp, Homo sapiens
tctccccaggtccagctctg

SEQ ID NO: 3686743 - DNA, 22 bp, Homo sapiens
tctccccaggtccagctctgga

SEQ ID NO: 3686744 - DNA, 16 bp, Homo sapiens
tctccctggggacggg

SEQ ID NO: 3686745 - DNA, 17 bp, Homo sapiens
tctccgttagctcctgt

SEQ ID NO: 3686746 - DNA, 21 bp, Homo sapiens
tctccgttagctcctgtggcc

SEQ ID NO: 3686747 - DNA, 22 bp, Homo sapiens
tctccgttagctcctgtggccc

SEQ ID NO: 3686748 - DNA, 23 bp, Homo sapiens
tctcctatatatttctattatta

SEQ ID NO: 3686749 - DNA, 19 bp, Homo sapiens
tctcctcgttcttatttaa

SEQ ID NO: 3686750 - DNA, 13 bp, Homo sapiens
tctcctgactggt

SEQ ID NO: 3686751 - DNA, 17 bp, Homo sapiens
tctctaaaagtgtccac

SEQ ID NO: 3686752 - DNA, 16 bp, Homo sapiens
tctctaactcctgcca

SEQ ID NO: 3686753 - DNA, 13 bp, Homo sapiens
tctctatttgaga

SEQ ID NO: 3686754 - DNA, 13 bp, Homo sapiens
tctctccactgtg

SEQ ID NO: 3686755 - DNA, 11 bp, Homo sapiens
tctctcctcct

SEQ ID NO: 3686756 - DNA, 16 bp, Homo sapiens
tctctcttctgctcca

SEQ ID NO: 3686757 - DNA, 19 bp, Homo sapiens
tctctcttctgctccaccc

SEQ ID NO: 3686758 - DNA, 20 bp, Homo sapiens
tctctcttctgctccaccct

SEQ ID NO: 3686759 - DNA, 14 bp, Homo sapiens
tctctgacttctgc

SEQ ID NO: 3686760 - DNA, 14 bp, Homo sapiens
tctctgccagtgac

SEQ ID NO: 3686761 - DNA, 11 bp, Homo sapiens
tctctgctgta

SEQ ID NO: 3686762 - DNA, 18 bp, Homo sapiens
tctctggtggctgggctg

SEQ ID NO: 3686763 - DNA, 22 bp, Homo sapiens
tctctggtggctgggctgctcc

SEQ ID NO: 3686764 - DNA, 18 bp, Homo sapiens
tctctgtggctccaggcc

SEQ ID NO: 3686765 - DNA, 14 bp, Homo sapiens
tctcttctgctcca

SEQ ID NO: 3686766 - DNA, 16 bp, Homo sapiens
tctcttctgctccacc

SEQ ID NO: 3686767 - DNA, 12 bp, Homo sapiens
tctcttttccac

SEQ ID NO: 3686768 - DNA, 19 bp, Homo sapiens
tctgaaaattaacactgct

SEQ ID NO: 3686769 - DNA, 22 bp, Homo sapiens
tctgaaaccttagtttcaagag

SEQ ID NO: 3686770 - DNA, 13 bp, Homo sapiens
tctgaaagtgttg

SEQ ID NO: 3686771 - DNA, 16 bp, Homo sapiens
tctgaaataaatgttc

SEQ ID NO: 3686772 - DNA, 16 bp, Homo sapiens
tctgaacccaggcagc

SEQ ID NO: 3686773 - DNA, 13 bp, Homo sapiens
tctgaactgttac

SEQ ID NO: 3686774 - DNA, 15 bp, Homo sapiens
tctgaactgttacaa

SEQ ID NO: 3686775 - DNA, 12 bp, Homo sapiens
tctgaagcagat

SEQ ID NO: 3686776 - DNA, 11 bp, Homo sapiens
tctgacccagt

SEQ ID NO: 3686777 - DNA, 13 bp, Homo sapiens
tctgacccagtgc

SEQ ID NO: 3686778 - DNA, 14 bp, Homo sapiens
tctgacccagtgcc

SEQ ID NO: 3686779 - DNA, 19 bp, Homo sapiens
tctgacccagtgcccccac

SEQ ID NO: 3686780 - DNA, 22 bp, Homo sapiens
tctgacccagtgcccccactga

SEQ ID NO: 3686781 - DNA, 23 bp, Homo sapiens
tctgacccagtgcccccactgac

SEQ ID NO: 3686782 - DNA, 20 bp, Homo sapiens
tctgacttaagcaaaagaaa

SEQ ID NO: 3686783 - DNA, 12 bp, Homo sapiens
tctgacttctgc

SEQ ID NO: 3686784 - DNA, 20 bp, Homo sapiens
tctgagaaacctgttgaaga

SEQ ID NO: 3686785 - DNA, 12 bp, Homo sapiens
tctgagaagatt

SEQ ID NO: 3686786 - DNA, 24 bp, Homo sapiens
tctgagatcaaaacggttttactg

SEQ ID NO: 3686787 - DNA, 16 bp, Homo sapiens
tctgagcacgctacca

SEQ ID NO: 3686788 - DNA, 18 bp, Homo sapiens
tctgagtatctcctcgca

SEQ ID NO: 3686789 - DNA, 15 bp, Homo sapiens
tctgatcaaggcctt

SEQ ID NO: 3686790 - DNA, 16 bp, Homo sapiens
tctgatgcaagcaaga

SEQ ID NO: 3686791 - DNA, 23 bp, Homo sapiens
tctgatgcaagcaagaaacactg

SEQ ID NO: 3686792 - DNA, 18 bp, Homo sapiens
tctgattccgcaccctgc

SEQ ID NO: 3686793 - DNA, 20 bp, Homo sapiens
tctgattccgcaccctgcct

SEQ ID NO: 3686794 - DNA, 16 bp, Homo sapiens
tctgattggcagatga

SEQ ID NO: 3686795 - DNA, 19 bp, Homo sapiens
tctgcacaagctgcaccct

SEQ ID NO: 3686796 - DNA, 23 bp, Homo sapiens
tctgcaggaatcccggctccaga

SEQ ID NO: 3686797 - DNA, 15 bp, Homo sapiens
tctgcatttcggtgg

SEQ ID NO: 3686798 - DNA, 12 bp, Homo sapiens
tctgccagggag

SEQ ID NO: 3686799 - DNA, 13 bp, Homo sapiens
tctgccagggagc

SEQ ID NO: 3686800 - DNA, 21 bp, Homo sapiens
tctgccagtgacagacaggct

SEQ ID NO: 3686801 - DNA, 18 bp, Homo sapiens
tctgccatctagccagcc

SEQ ID NO: 3686802 - DNA, 16 bp, Homo sapiens
tctgcccctcccccaa

SEQ ID NO: 3686803 - DNA, 18 bp, Homo sapiens
tctgcccttgccaacgga

SEQ ID NO: 3686804 - DNA, 16 bp, Homo sapiens
tctgcctgccagctgc

SEQ ID NO: 3686805 - DNA, 22 bp, Homo sapiens
tctgcctgccagctgcactgat

SEQ ID NO: 3686806 - DNA, 20 bp, Homo sapiens
tctttgggccagacatgcca

SEQ ID NO: 3686807 - DNA, 20 bp, Homo sapiens
tctttgtagctaacagtgaa

SEQ ID NO: 3686808 - DNA, 13 bp, Homo sapiens
tctttgtggccaa

SEQ ID NO: 3686809 - DNA, 21 bp, Homo sapiens
tcttttaatgaggaccaatgt

SEQ ID NO: 3686810 - DNA, 18 bp, Homo sapiens
tcttttactgttatagaa

SEQ ID NO: 3686811 - DNA, 13 bp, Homo sapiens
tcttttgcttttg

SEQ ID NO: 3686812 - DNA, 22 bp, Homo sapiens
tctttttgaccctcattcttta

SEQ ID NO: 3686813 - DNA, 15 bp, Homo sapiens
tctttttgttgtaaa

SEQ ID NO: 3686814 - DNA, 18 bp, Homo sapiens
tgaaaaaaaaaaagaaga

SEQ ID NO: 3686815 - DNA, 19 bp, Homo sapiens
tgaaaaaaaaaaagaagaa

SEQ ID NO: 3686816 - DNA, 20 bp, Homo sapiens
tgaaaaaggaataaattgtt

SEQ ID NO: 3686817 - DNA, 20 bp, Homo sapiens
tgaaaaaggaggaagagaaa

SEQ ID NO: 3686818 - DNA, 22 bp, Homo sapiens
tgaaaaaggaggaagagaaaaa

SEQ ID NO: 3686819 - DNA, 15 bp, Homo sapiens
tgaaaagaaaaatga

SEQ ID NO: 3686820 - DNA, 20 bp, Homo sapiens
tgaaaatgcaacaacatgta

SEQ ID NO: 3686821 - DNA, 21 bp, Homo sapiens
tgaaaatgcaacaacatgtat

SEQ ID NO: 3686822 - DNA, 23 bp, Homo sapiens
tgaaaatgcaacaacatgtataa

SEQ ID NO: 3686823 - DNA, 13 bp, Homo sapiens
tgaaaatgttttt

SEQ ID NO: 3686824 - DNA, 14 bp, Homo sapiens
tgaaaattcagtgg

SEQ ID NO: 3686825 - DNA, 15 bp, Homo sapiens
tgaaacaacttggaa

SEQ ID NO: 3686826 - DNA, 15 bp, Homo sapiens
tgaaaggaacatttt

SEQ ID NO: 3686827 - DNA, 22 bp, Homo sapiens
tgaaaggcaggaagggaagcgt

SEQ ID NO: 3686828 - DNA, 16 bp, Homo sapiens
tgaaagtttttctgaa

SEQ ID NO: 3686829 - DNA, 20 bp, Homo sapiens
tgaaagtttttctgaaagtg

SEQ ID NO: 3686830 - DNA, 22 bp, Homo sapiens
tgaaagtttttctgaaagtgtt

SEQ ID NO: 3686831 - DNA, 14 bp, Homo sapiens
tgaaataaatgttc

SEQ ID NO: 3686832 - DNA, 14 bp, Homo sapiens
tgaaataactggaa

SEQ ID NO: 3686833 - DNA, 23 bp, Homo sapiens
tgaaataccacaagcctgagaac

SEQ ID NO: 3686834 - DNA, 13 bp, Homo sapiens
tgaaatactcagg

SEQ ID NO: 3686835 - DNA, 15 bp, Homo sapiens
tgaaatatcctgctt

SEQ ID NO: 3686836 - DNA, 19 bp, Homo sapiens
tgaaattacgggtacctga

SEQ ID NO: 3686837 - DNA, 20 bp, Homo sapiens
tgaaattacgggtacctgaa

SEQ ID NO: 3686838 - DNA, 16 bp, Homo sapiens
tgaaattctcctggag

SEQ ID NO: 3686839 - DNA, 12 bp, Homo sapiens
tgaacagtggag

SEQ ID NO: 3686840 - DNA, 16 bp, Homo sapiens
tgaaccacgcgggggc

SEQ ID NO: 3686841 - DNA, 17 bp, Homo sapiens
tgaaccattaaccagat

SEQ ID NO: 3686842 - DNA, 16 bp, Homo sapiens
tgaacccaggcagctg

SEQ ID NO: 3686843 - DNA, 22 bp, Homo sapiens
tgaacccaggcagctggcagga

SEQ ID NO: 3686844 - DNA, 22 bp, Homo sapiens
tgaaccggctcccaccctcaag

SEQ ID NO: 3686845 - DNA, 15 bp, Homo sapiens
tgaactcttcactct

SEQ ID NO: 3686846 - DNA, 14 bp, Homo sapiens
tgaactggaagaaa

SEQ ID NO: 3686847 - DNA, 17 bp, Homo sapiens
tgaactgttgcccttct

SEQ ID NO: 3686848 - DNA, 19 bp, Homo sapiens
tgaagaaccagtcccccca

SEQ ID NO: 3686849 - DNA, 17 bp, Homo sapiens
tgaagaactgcaggccc

SEQ ID NO: 3686850 - DNA, 23 bp, Homo sapiens
tgaagaactgcaggccctggcct

SEQ ID NO: 3686851 - DNA, 11 bp, Homo sapiens
tgaagaagaga

SEQ ID NO: 3686852 - DNA, 13 bp, Homo sapiens
tgaagacagaagt

SEQ ID NO: 3686853 - DNA, 13 bp, Homo sapiens
tgaagcagcctct

SEQ ID NO: 3686854 - DNA, 15 bp, Homo sapiens
tgaagccgtgcctgt

SEQ ID NO: 3686855 - DNA, 20 bp, Homo sapiens
tgaagccgtgcctgtagcct

SEQ ID NO: 3686856 - DNA, 15 bp, Homo sapiens
tgaaggaggcggggc

SEQ ID NO: 3686857 - DNA, 15 bp, Homo sapiens
tgaaggcagggctcc

SEQ ID NO: 3686858 - DNA, 16 bp, Homo sapiens
tgaagggccagagcca

SEQ ID NO: 3686859 - DNA, 18 bp, Homo sapiens
tgaagggccagagccagg

SEQ ID NO: 3686860 - DNA, 15 bp, Homo sapiens
tgaagggcctcccag

SEQ ID NO: 3686861 - DNA, 23 bp, Homo sapiens
tgaaggggcaaattcttttgaat

SEQ ID NO: 3686862 - DNA, 16 bp, Homo sapiens
tgaaggtttctgaaaa

SEQ ID NO: 3686863 - DNA, 20 bp, Homo sapiens
tgaataataagcaggatgtt

SEQ ID NO: 3686864 - DNA, 14 bp, Homo sapiens
tgaatataaacact

SEQ ID NO: 3686865 - DNA, 21 bp, Homo sapiens
tgaatcactgcacctctttgt

SEQ ID NO: 3686866 - DNA, 16 bp, Homo sapiens
tgaatcttggtgtcta

SEQ ID NO: 3686867 - DNA, 13 bp, Homo sapiens
tgaatgcggccca

SEQ ID NO: 3686868 - DNA, 11 bp, Homo sapiens
tgaatgctggg

SEQ ID NO: 3686869 - DNA, 13 bp, Homo sapiens
tgaatgctgggac

SEQ ID NO: 3686870 - DNA, 19 bp, Homo sapiens
tgaatgctgggactcagcc

SEQ ID NO: 3686871 - DNA, 15 bp, Homo sapiens
tgaatggtgcgtgaa

SEQ ID NO: 3686872 - DNA, 17 bp, Homo sapiens
tgaattttctggaaaat

SEQ ID NO: 3686873 - DNA, 18 bp, Homo sapiens
tgacaaaaaatgttttaa

SEQ ID NO: 3686874 - DNA, 21 bp, Homo sapiens
tgacaaaaaatgttttaaaga

SEQ ID NO: 3686875 - DNA, 20 bp, Homo sapiens
tgacaaataaattaggacca

SEQ ID NO: 3686876 - DNA, 14 bp, Homo sapiens
tgacaactggcagg

SEQ ID NO: 3686877 - DNA, 13 bp, Homo sapiens
tgacacaaacaca

SEQ ID NO: 3686878 - DNA, 19 bp, Homo sapiens
tgacacccaagagggctgc

SEQ ID NO: 3686879 - DNA, 13 bp, Homo sapiens
tgacagaacactg

SEQ ID NO: 3686880 - DNA, 21 bp, Homo sapiens
tgacagaacactgtcttgaag

SEQ ID NO: 3686881 - DNA, 22 bp, Homo sapiens
tgacagagcaagtgagaccctg

SEQ ID NO: 3686882 - DNA, 14 bp, Homo sapiens
tgacagctgctcct

SEQ ID NO: 3686883 - DNA, 16 bp, Homo sapiens
tgacagctttgctgct

SEQ ID NO: 3686884 - DNA, 17 bp, Homo sapiens
tgacagctttgctgctg

SEQ ID NO: 3686885 - DNA, 21 bp, Homo sapiens
tgacagtgacacccagaggga

SEQ ID NO: 3686886 - DNA, 17 bp, Homo sapiens
tgacatatttaatgttt

SEQ ID NO: 3686887 - DNA, 18 bp, Homo sapiens
tgacatatttaatgtttt

SEQ ID NO: 3686888 - DNA, 19 bp, Homo sapiens
tgacatatttaatgtttta

SEQ ID NO: 3686889 - DNA, 20 bp, Homo sapiens
tgacatatttaatgttttaa

SEQ ID NO: 3686890 - DNA, 23 bp, Homo sapiens
tgacatatttaatgttttaaatg

SEQ ID NO: 3686891 - DNA, 18 bp, Homo sapiens
tgacatctgattggcaga

SEQ ID NO: 3686892 - DNA, 19 bp, Homo sapiens
tgacatgtggggccaggtc

SEQ ID NO: 3686893 - DNA, 20 bp, Homo sapiens
tgacatgtggggccaggtca

SEQ ID NO: 3686894 - DNA, 12 bp, Homo sapiens
tgacattgtctc

SEQ ID NO: 3686895 - DNA, 11 bp, Homo sapiens
tgacatttcat

SEQ ID NO: 3686896 - DNA, 19 bp, Homo sapiens
tgacatttcattagccatg

SEQ ID NO: 3686897 - DNA, 12 bp, Homo sapiens
tgacattttatt

SEQ ID NO: 3686898 - DNA, 23 bp, Homo sapiens
tgaccaaatcacccaatcccagt

SEQ ID NO: 3686899 - DNA, 22 bp, Homo sapiens
tgaccaagactgagccagctta

SEQ ID NO: 3686900 - DNA, 11 bp, Homo sapiens
tgaccagcagc

SEQ ID NO: 3686901 - DNA, 14 bp, Homo sapiens
tgaccaggggccct

SEQ ID NO: 3686902 - DNA, 19 bp, Homo sapiens
tgaccaggggccctacctg

SEQ ID NO: 3686903 - DNA, 21 bp, Homo sapiens
tgaccaggggccctacctggg

SEQ ID NO: 3686904 - DNA, 23 bp, Homo sapiens
tgaccaggggccctacctgggga

SEQ ID NO: 3686905 - DNA, 19 bp, Homo sapiens
tgaccatccactctaccct

SEQ ID NO: 3686906 - DNA, 16 bp, Homo sapiens
tgaccatgctcatctg

SEQ ID NO: 3686907 - DNA, 19 bp, Homo sapiens
tgaccatgctcatctgctg

SEQ ID NO: 3686908 - DNA, 23 bp, Homo sapiens
tgacccagtgcccccactgacca

SEQ ID NO: 3686909 - DNA, 15 bp, Homo sapiens
tgacccatctgtagt

SEQ ID NO: 3686910 - DNA, 14 bp, Homo sapiens
tgaccccagcccag

SEQ ID NO: 3686911 - DNA, 15 bp, Homo sapiens
tgaccccagcccaga

SEQ ID NO: 3686912 - DNA, 17 bp, Homo sapiens
tgaccctgagctgacca

SEQ ID NO: 3686913 - DNA, 16 bp, Homo sapiens
tgaccggacttttctg

SEQ ID NO: 3686914 - DNA, 14 bp, Homo sapiens
tgacctccacagct

SEQ ID NO: 3686915 - DNA, 15 bp, Homo sapiens
tgacctccacagctt

SEQ ID NO: 3686916 - DNA, 13 bp, Homo sapiens
tgacctttagtgc

SEQ ID NO: 3686917 - DNA, 19 bp, Homo sapiens
tgacggccagggagaagct

SEQ ID NO: 3686918 - DNA, 17 bp, Homo sapiens
tgacgtgaccggacttt

SEQ ID NO: 3686919 - DNA, 22 bp, Homo sapiens
tgacgtgaccggacttttctgc

SEQ ID NO: 3686920 - DNA, 18 bp, Homo sapiens
tgactagggagccatgtt

SEQ ID NO: 3686921 - DNA, 20 bp, Homo sapiens
tgactagggagccatgtttc

SEQ ID NO: 3686922 - DNA, 23 bp, Homo sapiens
tgccaccccttcctcagcctggg

SEQ ID NO: 3686923 - DNA, 14 bp, Homo sapiens
tgccactcactagg

SEQ ID NO: 3686924 - DNA, 20 bp, Homo sapiens
tgccactcactaggccccca

SEQ ID NO: 3686925 - DNA, 21 bp, Homo sapiens
tgccactcactaggcccccac

SEQ ID NO: 3686926 - DNA, 22 bp, Homo sapiens
tgccactgccttcgcttcttgc

SEQ ID NO: 3686927 - DNA, 19 bp, Homo sapiens
tgccagggaactggcctgc

SEQ ID NO: 3686928 - DNA, 16 bp, Homo sapiens
tgccatctagccagcc

SEQ ID NO: 3686929 - DNA, 20 bp, Homo sapiens
tgccatctcacctcctgctg

SEQ ID NO: 3686930 - DNA, 21 bp, Homo sapiens
tgccatctcacctcctgctgg

SEQ ID NO: 3686931 - DNA, 16 bp, Homo sapiens
tgccatgatgcctctg

SEQ ID NO: 3686932 - DNA, 16 bp, Homo sapiens
tgccattcttctggtg

SEQ ID NO: 3686933 - DNA, 15 bp, Homo sapiens
tgccattgcactcca

SEQ ID NO: 3686934 - DNA, 13 bp, Homo sapiens
tgccattgggacc

SEQ ID NO: 3686935 - DNA, 17 bp, Homo sapiens
tgccattgggaccctcc

SEQ ID NO: 3686936 - DNA, 21 bp, Homo sapiens
tgccatttctgaactgttaca

SEQ ID NO: 3686937 - DNA, 19 bp, Homo sapiens
tgcccaacccttccctcac

SEQ ID NO: 3686938 - DNA, 11 bp, Homo sapiens
tgcccaagcca

SEQ ID NO: 3686939 - DNA, 13 bp, Homo sapiens
tgcccaagccaga

SEQ ID NO: 3686940 - DNA, 18 bp, Homo sapiens
tgcccaagccagaggctg

SEQ ID NO: 3686941 - DNA, 17 bp, Homo sapiens
tgcccacctgcccatca

SEQ ID NO: 3686942 - DNA, 14 bp, Homo sapiens
tgcccagagctgct

SEQ ID NO: 3686943 - DNA, 18 bp, Homo sapiens
tgcccagcccctcctccc

SEQ ID NO: 3686944 - DNA, 21 bp, Homo sapiens
tgcccagcccctcctccctgc

SEQ ID NO: 3686945 - DNA, 15 bp, Homo sapiens
tgcccaggcactgca

SEQ ID NO: 3686946 - DNA, 14 bp, Homo sapiens
tgccccagagctgt

SEQ ID NO: 3686947 - DNA, 13 bp, Homo sapiens
tgccccaggacca

SEQ ID NO: 3686948 - DNA, 17 bp, Homo sapiens
tgccccatcctccagca

SEQ ID NO: 3686949 - DNA, 15 bp, Homo sapiens
tgccccatgcctgtc

SEQ ID NO: 3686950 - DNA, 23 bp, Homo sapiens
tgccccatgcctgtccagcctgg

SEQ ID NO: 3686951 - DNA, 17 bp, Homo sapiens
tgcccccactgaccaga

SEQ ID NO: 3686952 - DNA, 17 bp, Homo sapiens
tgccccgccctccttcc

SEQ ID NO: 3686953 - DNA, 14 bp, Homo sapiens
tgcccctcagagac

SEQ ID NO: 3686954 - DNA, 13 bp, Homo sapiens
tgcccctccaagt

SEQ ID NO: 3686955 - DNA, 12 bp, Homo sapiens
tgcccctcccag

SEQ ID NO: 3686956 - DNA, 12 bp, Homo sapiens
tgcccctccccc

SEQ ID NO: 3686957 - DNA, 17 bp, Homo sapiens
tgcccctcccccaaccc

SEQ ID NO: 3686958 - DNA, 14 bp, Homo sapiens
tgcccctcttccaa

SEQ ID NO: 3686959 - DNA, 20 bp, Homo sapiens
tgcccctcttccaaaggcag

SEQ ID NO: 3686960 - DNA, 21 bp, Homo sapiens
tgcccctcttccaaaggcagc

SEQ ID NO: 3686961 - DNA, 14 bp, Homo sapiens
tgcccctggctctg

SEQ ID NO: 3686962 - DNA, 23 bp, Homo sapiens
tgccctcttactgttttgaggaa

SEQ ID NO: 3686963 - DNA, 20 bp, Homo sapiens
tgccctcttctcgtgcctcc

SEQ ID NO: 3686964 - DNA, 17 bp, Homo sapiens
tgcccttggaggccagc

SEQ ID NO: 3686965 - DNA, 16 bp, Homo sapiens
tgcccttgtcccactc

SEQ ID NO: 3686966 - DNA, 17 bp, Homo sapiens
tgcccttgtcccactca

SEQ ID NO: 3686967 - DNA, 13 bp, Homo sapiens
tgccgagccagca

SEQ ID NO: 3686968 - DNA, 17 bp, Homo sapiens
tgccggttaaattccat

SEQ ID NO: 3686969 - DNA, 22 bp, Homo sapiens
tgccgtggattgcacgtggcct

SEQ ID NO: 3686970 - DNA, 13 bp, Homo sapiens
tgccgtggcacca

SEQ ID NO: 3686971 - DNA, 13 bp, Homo sapiens
tgcctaagccctc

SEQ ID NO: 3686972 - DNA, 14 bp, Homo sapiens
tgcctacgccagga

SEQ ID NO: 3686973 - DNA, 16 bp, Homo sapiens
tgcctagactgttact

SEQ ID NO: 3686974 - DNA, 15 bp, Homo sapiens
tgcctcactaatttt

SEQ ID NO: 3686975 - DNA, 17 bp, Homo sapiens
tgcctcagcctccctgg

SEQ ID NO: 3686976 - DNA, 12 bp, Homo sapiens
tgcctccagcct

SEQ ID NO: 3686977 - DNA, 15 bp, Homo sapiens
tgcctccaggtgcag

SEQ ID NO: 3686978 - DNA, 16 bp, Homo sapiens
tgcctccaggtgcaga

SEQ ID NO: 3686979 - DNA, 17 bp, Homo sapiens
tgcctccaggtgcagag

SEQ ID NO: 3686980 - DNA, 16 bp, Homo sapiens
tgcctctgtcttctgg

SEQ ID NO: 3686981 - DNA, 18 bp, Homo sapiens
tgcctctgtcttctggac

SEQ ID NO: 3686982 - DNA, 11 bp, Homo sapiens
tgcctctgtgc

SEQ ID NO: 3686983 - DNA, 17 bp, Homo sapiens
tgcctctgtgctgtgtg

SEQ ID NO: 3686984 - DNA, 21 bp, Homo sapiens
tgcctctgtgctgtgtgtgac

SEQ ID NO: 3686985 - DNA, 21 bp, Homo sapiens
tgcctcttctctactctaggg

SEQ ID NO: 3686986 - DNA, 11 bp, Homo sapiens
tgcctctttcc

SEQ ID NO: 3686987 - DNA, 12 bp, Homo sapiens
tgcctctttccc

SEQ ID NO: 3686988 - DNA, 17 bp, Homo sapiens
tgcctctttccctagga

SEQ ID NO: 3686989 - DNA, 21 bp, Homo sapiens
tgcctgactagggagccatgt

SEQ ID NO: 3686990 - DNA, 17 bp, Homo sapiens
tgcctgagggtgggctt

SEQ ID NO: 3686991 - DNA, 12 bp, Homo sapiens
tgcctgcagggc

SEQ ID NO: 3686992 - DNA, 13 bp, Homo sapiens
tgcctgcagggcc

SEQ ID NO: 3686993 - DNA, 22 bp, Homo sapiens
tgcctgcagggccatggctcag

SEQ ID NO: 3686994 - DNA, 20 bp, Homo sapiens
tgcctggagacttagggcac

SEQ ID NO: 3686995 - DNA, 16 bp, Homo sapiens
tgcctggccaggcaga

SEQ ID NO: 3686996 - DNA, 20 bp, Homo sapiens
tgcctggccaggcagatctg

SEQ ID NO: 3686997 - DNA, 20 bp, Homo sapiens
tgcctgtagctttcctggtc

SEQ ID NO: 3686998 - DNA, 22 bp, Homo sapiens
tgcctgtagctttcctggtccc

SEQ ID NO: 3686999 - DNA, 23 bp, Homo sapiens
tgcctgtagctttcctggtccct

SEQ ID NO: 3687000 - DNA, 16 bp, Homo sapiens
tgcctgtagtcccagg

SEQ ID NO: 3687001 - DNA, 17 bp, Homo sapiens
tgcctgtagtcccaggc

SEQ ID NO: 3687002 - DNA, 15 bp, Homo sapiens
tgcctgtccagcctg

SEQ ID NO: 3687003 - DNA, 18 bp, Homo sapiens
tgcctgtccagcctgggc

SEQ ID NO: 3687004 - DNA, 20 bp, Homo sapiens
tgccttacagacagaatata

SEQ ID NO: 3687005 - DNA, 18 bp, Homo sapiens
tgccttccagaaaacaaa

SEQ ID NO: 3687006 - DNA, 22 bp, Homo sapiens
tgccttcgcttcttgcctctgt

SEQ ID NO: 3687007 - DNA, 20 bp, Homo sapiens
tgccttcgtctttcccatgg

SEQ ID NO: 3687008 - DNA, 19 bp, Homo sapiens
tgccttgggctgctcctca

SEQ ID NO: 3687009 - DNA, 13 bp, Homo sapiens
tgcctttcaaatt

SEQ ID NO: 3687010 - DNA, 19 bp, Homo sapiens
tgccttttttgtagttttt

SEQ ID NO: 3687011 - DNA, 13 bp, Homo sapiens
tgcgaccctgggg

SEQ ID NO: 3687012 - DNA, 14 bp, Homo sapiens
tgcgaccctggggg

SEQ ID NO: 3687013 - DNA, 19 bp, Homo sapiens
tgcgaccctgggggcacag

SEQ ID NO: 3687014 - DNA, 21 bp, Homo sapiens
tgcgactttctgcctggagtg

SEQ ID NO: 3687015 - DNA, 22 bp, Homo sapiens
tgcgcatcttgcctccaggtgc

SEQ ID NO: 3687016 - DNA, 19 bp, Homo sapiens
tgcgcctgtgatgctgggc

SEQ ID NO: 3687017 - DNA, 17 bp, Homo sapiens
tgcgggagctctgtatg

SEQ ID NO: 3687018 - DNA, 13 bp, Homo sapiens
tgcggggagaaga

SEQ ID NO: 3687019 - DNA, 18 bp, Homo sapiens
tgctaccgttgacttcca

SEQ ID NO: 3687020 - DNA, 17 bp, Homo sapiens
tgctacctttcaaagct

SEQ ID NO: 3687021 - DNA, 18 bp, Homo sapiens
tgctacctttcaaagctt

SEQ ID NO: 3687022 - DNA, 12 bp, Homo sapiens
tgctactccatg

SEQ ID NO: 3687023 - DNA, 21 bp, Homo sapiens
tgctatagtatttgattcaaa

SEQ ID NO: 3687024 - DNA, 22 bp, Homo sapiens
tgctatagtatttgattcaaaa

SEQ ID NO: 3687025 - DNA, 17 bp, Homo sapiens
tgctatcattattcgta

SEQ ID NO: 3687026 - DNA, 15 bp, Homo sapiens
tgctatggtgctctg

SEQ ID NO: 3687027 - DNA, 20 bp, Homo sapiens
tgctattggaggatcagttt

SEQ ID NO: 3687028 - DNA, 17 bp, Homo sapiens
tgctatttgaacaagtg

SEQ ID NO: 3687029 - DNA, 15 bp, Homo sapiens
tgctatttttgtaaa

SEQ ID NO: 3687030 - DNA, 14 bp, Homo sapiens
tgctcaagaaacaa

SEQ ID NO: 3687031 - DNA, 12 bp, Homo sapiens
tgctcacctggg

SEQ ID NO: 3687032 - DNA, 15 bp, Homo sapiens
tgctcagcttctcct

SEQ ID NO: 3687033 - DNA, 13 bp, Homo sapiens
tgctcaggtactt

SEQ ID NO: 3687034 - DNA, 13 bp, Homo sapiens
tgctcatctgctg

SEQ ID NO: 3687035 - DNA, 15 bp, Homo sapiens
tgctcatctgctggt

SEQ ID NO: 3687036 - DNA, 22 bp, Homo sapiens
tgctccacccttggcctgtctc

SEQ ID NO: 3687037 - DNA, 13 bp, Homo sapiens
tgctccatttcaa

SEQ ID NO: 3687038 - DNA, 17 bp, Homo sapiens
tgctccctgagggcgga

SEQ ID NO: 3687039 - DNA, 13 bp, Homo sapiens
tgggaccaggctc

SEQ ID NO: 3687040 - DNA, 15 bp, Homo sapiens
tgggaccaggctcca

SEQ ID NO: 3687041 - DNA, 20 bp, Homo sapiens
tgggaccctccagtgctgga

SEQ ID NO: 3687042 - DNA, 21 bp, Homo sapiens
tgggaccctccagtgctggat

SEQ ID NO: 3687043 - DNA, 14 bp, Homo sapiens
tgggacctgtggct

SEQ ID NO: 3687044 - DNA, 18 bp, Homo sapiens
tgggacctgtggctgtcg

SEQ ID NO: 3687045 - DNA, 13 bp, Homo sapiens
tgggacggcggca

SEQ ID NO: 3687046 - DNA, 17 bp, Homo sapiens
tgggactcttccctggg

SEQ ID NO: 3687047 - DNA, 20 bp, Homo sapiens
tgggacttctacccagatgg

SEQ ID NO: 3687048 - DNA, 23 bp, Homo sapiens
tgggacttctacccagatggaaa

SEQ ID NO: 3687049 - DNA, 14 bp, Homo sapiens
tgggagatgttaga

SEQ ID NO: 3687050 - DNA, 16 bp, Homo sapiens
tgggagccccagggtc

SEQ ID NO: 3687051 - DNA, 22 bp, Homo sapiens
tgggagccccagggtcttccct

SEQ ID NO: 3687052 - DNA, 16 bp, Homo sapiens
tgggagctccactctg

SEQ ID NO: 3687053 - DNA, 20 bp, Homo sapiens
tgggaggccccactggggaa

SEQ ID NO: 3687054 - DNA, 23 bp, Homo sapiens
tgggaggtcaaggctgcagtgag

SEQ ID NO: 3687055 - DNA, 22 bp, Homo sapiens
tgggatccgagggcccctctcc

SEQ ID NO: 3687056 - DNA, 20 bp, Homo sapiens
tgggatgttcagcactgtcc

SEQ ID NO: 3687057 - DNA, 16 bp, Homo sapiens
tgggcagaaggccaag

SEQ ID NO: 3687058 - DNA, 17 bp, Homo sapiens
tgggcagaaggccaaga

SEQ ID NO: 3687059 - DNA, 14 bp, Homo sapiens
tgggcagagctggc

SEQ ID NO: 3687060 - DNA, 14 bp, Homo sapiens
tgggcagccaggct

SEQ ID NO: 3687061 - DNA, 15 bp, Homo sapiens
tgggccactgtggtg

SEQ ID NO: 3687062 - DNA, 14 bp, Homo sapiens
tgggccagtcctgg

SEQ ID NO: 3687063 - DNA, 17 bp, Homo sapiens
tgggccagtcctggttg

SEQ ID NO: 3687064 - DNA, 22 bp, Homo sapiens
tgggcccaagacagatgcccca

SEQ ID NO: 3687065 - DNA, 15 bp, Homo sapiens
tgggccccttccaaa

SEQ ID NO: 3687066 - DNA, 13 bp, Homo sapiens
tgggccctaccct

SEQ ID NO: 3687067 - DNA, 15 bp, Homo sapiens
tgggccctaccctcc

SEQ ID NO: 3687068 - DNA, 16 bp, Homo sapiens
tgggccctgggctgga

SEQ ID NO: 3687069 - DNA, 17 bp, Homo sapiens
tgggccctgggctggaa

SEQ ID NO: 3687070 - DNA, 13 bp, Homo sapiens
tgggccgctgcca

SEQ ID NO: 3687071 - DNA, 16 bp, Homo sapiens
tgggccggcccccttc

SEQ ID NO: 3687072 - DNA, 20 bp, Homo sapiens
tgggccggcccccttcctgg

SEQ ID NO: 3687073 - DNA, 19 bp, Homo sapiens
tgggcctcggcccctccca

SEQ ID NO: 3687074 - DNA, 15 bp, Homo sapiens
tgggcctgctccaga

SEQ ID NO: 3687075 - DNA, 18 bp, Homo sapiens
tgggcctgctccagacct

SEQ ID NO: 3687076 - DNA, 13 bp, Homo sapiens
tgggcggggcttc

SEQ ID NO: 3687077 - DNA, 14 bp, Homo sapiens
tgggcggggcttct

SEQ ID NO: 3687078 - DNA, 18 bp, Homo sapiens
tgggctgctcctgaatga

SEQ ID NO: 3687079 - DNA, 18 bp, Homo sapiens
tgggctggaatcaggaat

SEQ ID NO: 3687080 - DNA, 15 bp, Homo sapiens
tgggcttttccctgg

SEQ ID NO: 3687081 - DNA, 20 bp, Homo sapiens
tgggcttttccctgggtgga

SEQ ID NO: 3687082 - DNA, 23 bp, Homo sapiens
tggggaaaggggtcggctgacca

SEQ ID NO: 3687083 - DNA, 18 bp, Homo sapiens
tggggagggattctggtt

SEQ ID NO: 3687084 - DNA, 22 bp, Homo sapiens
tggggagggattctggttccag

SEQ ID NO: 3687085 - DNA, 24 bp, Homo sapiens
tggggagggcaggtccagctctgt

SEQ ID NO: 3687086 - DNA, 16 bp, Homo sapiens
tggggagttaagacct

SEQ ID NO: 3687087 - DNA, 16 bp, Homo sapiens
tggggcacggctctgg

SEQ ID NO: 3687088 - DNA, 12 bp, Homo sapiens
tggggcagagct

SEQ ID NO: 3687089 - DNA, 19 bp, Homo sapiens
tggggcccagtgcatggtg

SEQ ID NO: 3687090 - DNA, 19 bp, Homo sapiens
tggggccgccgcctctttc

SEQ ID NO: 3687091 - DNA, 15 bp, Homo sapiens
tggggcggggcttct

SEQ ID NO: 3687092 - DNA, 14 bp, Homo sapiens
tggggctcctacct

SEQ ID NO: 3687093 - DNA, 17 bp, Homo sapiens
tggggctcctacctggg

SEQ ID NO: 3687094 - DNA, 18 bp, Homo sapiens
tggggctcctacctgggg

SEQ ID NO: 3687095 - DNA, 16 bp, Homo sapiens
tggggcttctctggga

SEQ ID NO: 3687096 - DNA, 21 bp, Homo sapiens
tggggcttctctgggaccagg

SEQ ID NO: 3687097 - DNA, 19 bp, Homo sapiens
tgggggagtctgaagcaga

SEQ ID NO: 3687098 - DNA, 22 bp, Homo sapiens
tgggggcaggagggccctacct

SEQ ID NO: 3687099 - DNA, 16 bp, Homo sapiens
tgggggcgggactcct

SEQ ID NO: 3687100 - DNA, 17 bp, Homo sapiens
tggggggacccagtgca

SEQ ID NO: 3687101 - DNA, 12 bp, Homo sapiens
tgggggtggggc

SEQ ID NO: 3687102 - DNA, 14 bp, Homo sapiens
tgggggtggggctc

SEQ ID NO: 3687103 - DNA, 20 bp, Homo sapiens
tggggtagctagaggaacca

SEQ ID NO: 3687104 - DNA, 17 bp, Homo sapiens
tggggtaggctgctccc

SEQ ID NO: 3687105 - DNA, 24 bp, Homo sapiens
tggggtaggctgctccctgagggc

SEQ ID NO: 3687106 - DNA, 13 bp, Homo sapiens
tggggtcatgccc

SEQ ID NO: 3687107 - DNA, 12 bp, Homo sapiens
tggggtcctggc

SEQ ID NO: 3687108 - DNA, 13 bp, Homo sapiens
tggggtgtgctgg

SEQ ID NO: 3687109 - DNA, 22 bp, Homo sapiens
tggggtttgaccacccacctga

SEQ ID NO: 3687110 - DNA, 12 bp, Homo sapiens
tgggtaagaaga

SEQ ID NO: 3687111 - DNA, 16 bp, Homo sapiens
tgggtacttcttgaag

SEQ ID NO: 3687112 - DNA, 16 bp, Homo sapiens
tgggtatgaactaaaa

SEQ ID NO: 3687113 - DNA, 18 bp, Homo sapiens
tgggtattttataatgtt

SEQ ID NO: 3687114 - DNA, 20 bp, Homo sapiens
tgggtccaggggatgggagg

SEQ ID NO: 3687115 - DNA, 14 bp, Homo sapiens
tgggtggagcagga

SEQ ID NO: 3687116 - DNA, 23 bp, Homo sapiens
tgggtgggacagggcttctcctg

SEQ ID NO: 3687117 - DNA, 12 bp, Homo sapiens
tgggtggggctt

SEQ ID NO: 3687118 - DNA, 14 bp, Homo sapiens
tgggtggggcttct

SEQ ID NO: 3687119 - DNA, 11 bp, Homo sapiens
tgggtgtggat

SEQ ID NO: 3687120 - DNA, 19 bp, Homo sapiens
tgggttctgcctgccagct

SEQ ID NO: 3687121 - DNA, 16 bp, Homo sapiens
tggtacaacggaggcc

SEQ ID NO: 3687122 - DNA, 20 bp, Homo sapiens
tggtacaacggaggcctgcg

SEQ ID NO: 3687123 - DNA, 17 bp, Homo sapiens
tggtagtcctcccaagc

SEQ ID NO: 3687124 - DNA, 20 bp, Homo sapiens
tggtagtcctcccaagctgt

SEQ ID NO: 3687125 - DNA, 16 bp, Homo sapiens
tggtatctcaggtctg

SEQ ID NO: 3687126 - DNA, 15 bp, Homo sapiens
tggtcacagcggagg

SEQ ID NO: 3687127 - DNA, 14 bp, Homo sapiens
tggtcagagtgcca

SEQ ID NO: 3687128 - DNA, 15 bp, Homo sapiens
tggtcagagtgccac

SEQ ID NO: 3687129 - DNA, 18 bp, Homo sapiens
tggtccgctttcctggag

SEQ ID NO: 3687130 - DNA, 19 bp, Homo sapiens
tggtccgctttcctggagc

SEQ ID NO: 3687131 - DNA, 18 bp, Homo sapiens
tggtctcatttgggggcg

SEQ ID NO: 3687132 - DNA, 15 bp, Homo sapiens
tggtctgcaggcagg

SEQ ID NO: 3687133 - DNA, 23 bp, Homo sapiens
tggtctgtgtgtgtgtgtgtgcg

SEQ ID NO: 3687134 - DNA, 21 bp, Homo sapiens
tggtgccatttctgaactgtt

SEQ ID NO: 3687135 - DNA, 18 bp, Homo sapiens
tggtgccccaggaccagc

SEQ ID NO: 3687136 - DNA, 16 bp, Homo sapiens
tggtggatgaggcttc

SEQ ID NO: 3687137 - DNA, 22 bp, Homo sapiens
tggtggatgaggcttcttcctg

SEQ ID NO: 3687138 - DNA, 23 bp, Homo sapiens
tggtggatgaggcttcttcctgg

SEQ ID NO: 3687139 - DNA, 16 bp, Homo sapiens
tggtggccactgagct

SEQ ID NO: 3687140 - DNA, 20 bp, Homo sapiens
tggtggccactgagctggct

SEQ ID NO: 3687141 - DNA, 12 bp, Homo sapiens
tggtggcccagc

SEQ ID NO: 3687142 - DNA, 20 bp, Homo sapiens
tggtggctgggctgctcctg

SEQ ID NO: 3687143 - DNA, 20 bp, Homo sapiens
tggtgggccaacaaagaaca

SEQ ID NO: 3687144 - DNA, 23 bp, Homo sapiens
tggtgggccaacaaagaacacta

SEQ ID NO: 3687145 - DNA, 19 bp, Homo sapiens
tggtgggttcaggggactc

SEQ ID NO: 3687146 - DNA, 15 bp, Homo sapiens
tggtggtctgttggc

SEQ ID NO: 3687147 - DNA, 14 bp, Homo sapiens
tggtggttgctgtt

SEQ ID NO: 3687148 - DNA, 22 bp, Homo sapiens
tggtgtgaacccgggaggcaga

SEQ ID NO: 3687149 - DNA, 21 bp, Homo sapiens
tggttaagttttcttgtttct

SEQ ID NO: 3687150 - DNA, 13 bp, Homo sapiens
tggttaatgccat

SEQ ID NO: 3687151 - DNA, 16 bp, Homo sapiens
tggttaccatgggtgt

SEQ ID NO: 3687152 - DNA, 17 bp, Homo sapiens
tggttaccatgggtgtg

SEQ ID NO: 3687153 - DNA, 18 bp, Homo sapiens
tggttaccatgggtgtgg

SEQ ID NO: 3687154 - DNA, 14 bp, Homo sapiens
tggttatggagagg

SEQ ID NO: 3687155 - DNA, 16 bp, Homo sapiens
tggttctctgggcctc

SEQ ID NO: 3687156 - DNA, 13 bp, Homo sapiens
tgttttttccttt

SEQ ID NO: 3687157 - DNA, 16 bp, Homo sapiens
ttaaaactggacctgt

SEQ ID NO: 3687158 - DNA, 20 bp, Homo sapiens
ttaaaagatgcttttaacag

SEQ ID NO: 3687159 - DNA, 22 bp, Homo sapiens
ttaaaagatgcttttaacagag

SEQ ID NO: 3687160 - DNA, 16 bp, Homo sapiens
ttaaaatgtaaagcca

SEQ ID NO: 3687161 - DNA, 12 bp, Homo sapiens
ttaaacacacag

SEQ ID NO: 3687162 - DNA, 19 bp, Homo sapiens
ttaaaccagattggagcaa

SEQ ID NO: 3687163 - DNA, 21 bp, Homo sapiens
ttaaagtgactaatggcatga

SEQ ID NO: 3687164 - DNA, 17 bp, Homo sapiens
ttaaatattatgctgct

SEQ ID NO: 3687165 - DNA, 21 bp, Homo sapiens
ttaaatattatgctgctttaa

SEQ ID NO: 3687166 - DNA, 23 bp, Homo sapiens
ttaaatattatgctgctttaaca

SEQ ID NO: 3687167 - DNA, 19 bp, Homo sapiens
ttaaatgtacagacatatt

SEQ ID NO: 3687168 - DNA, 12 bp, Homo sapiens
ttaaattatata

SEQ ID NO: 3687169 - DNA, 14 bp, Homo sapiens
ttaaattttgtaat

SEQ ID NO: 3687170 - DNA, 16 bp, Homo sapiens
ttaaattttgtaatga

SEQ ID NO: 3687171 - DNA, 19 bp, Homo sapiens
ttaacactgcttgtgtttt

SEQ ID NO: 3687172 - DNA, 19 bp, Homo sapiens
ttaacagagtctgaaccta

SEQ ID NO: 3687173 - DNA, 23 bp, Homo sapiens
ttaacagtggagctgaattttct

SEQ ID NO: 3687174 - DNA, 20 bp, Homo sapiens
ttaacatttatatatttcca

SEQ ID NO: 3687175 - DNA, 13 bp, Homo sapiens
ttaaccagatcta

SEQ ID NO: 3687176 - DNA, 21 bp, Homo sapiens
ttaaccttgtataaattattc

SEQ ID NO: 3687177 - DNA, 22 bp, Homo sapiens
ttaactggtgcactttgtaaat

SEQ ID NO: 3687178 - DNA, 17 bp, Homo sapiens
ttaaggtgtagccacac

SEQ ID NO: 3687179 - DNA, 19 bp, Homo sapiens
ttaagttttcttgtttctg

SEQ ID NO: 3687180 - DNA, 12 bp, Homo sapiens
ttaataaaagaa

SEQ ID NO: 3687181 - DNA, 18 bp, Homo sapiens
ttaatacaattaatatta

SEQ ID NO: 3687182 - DNA, 22 bp, Homo sapiens
ttaatacagtttatttttaaag

SEQ ID NO: 3687183 - DNA, 22 bp, Homo sapiens
ttaatataaagtagtcctgtga

SEQ ID NO: 3687184 - DNA, 13 bp, Homo sapiens
ttaatatctcctg

SEQ ID NO: 3687185 - DNA, 17 bp, Homo sapiens
ttaatatctcctggaac

SEQ ID NO: 3687186 - DNA, 13 bp, Homo sapiens
ttaatttttccta

SEQ ID NO: 3687187 - DNA, 13 bp, Homo sapiens
ttacaattttatc

SEQ ID NO: 3687188 - DNA, 18 bp, Homo sapiens
ttacaattttatctgttt

SEQ ID NO: 3687189 - DNA, 20 bp, Homo sapiens
ttacataattcactctgagt

SEQ ID NO: 3687190 - DNA, 16 bp, Homo sapiens
ttacatgtttataaat

SEQ ID NO: 3687191 - DNA, 22 bp, Homo sapiens
ttaccatgggtgtggatggcag

SEQ ID NO: 3687192 - DNA, 16 bp, Homo sapiens
ttaccatttttctgga

SEQ ID NO: 3687193 - DNA, 18 bp, Homo sapiens
ttacctgccaattgctac

SEQ ID NO: 3687194 - DNA, 14 bp, Homo sapiens
ttacgggtacctga

SEQ ID NO: 3687195 - DNA, 17 bp, Homo sapiens
ttactaattatactact

SEQ ID NO: 3687196 - DNA, 15 bp, Homo sapiens
ttactataagaactt

SEQ ID NO: 3687197 - DNA, 23 bp, Homo sapiens
ttactataagaactttgagctac

SEQ ID NO: 3687198 - DNA, 21 bp, Homo sapiens
ttactatcatgtcaaacgtga

SEQ ID NO: 3687199 - DNA, 15 bp, Homo sapiens
ttactgcagctttgt

SEQ ID NO: 3687200 - DNA, 15 bp, Homo sapiens
ttactgtaactgatt

SEQ ID NO: 3687201 - DNA, 16 bp, Homo sapiens
ttactgttatttaatt

SEQ ID NO: 3687202 - DNA, 21 bp, Homo sapiens
ttacttcactatacaaacaaa

SEQ ID NO: 3687203 - DNA, 12 bp, Homo sapiens
ttacttggcttt

SEQ ID NO: 3687204 - DNA, 23 bp, Homo sapiens
ttacttttttagtaacaattcag

SEQ ID NO: 3687205 - DNA, 22 bp, Homo sapiens
ttagaaagctgacattgccaaa

SEQ ID NO: 3687206 - DNA, 23 bp, Homo sapiens
ttagaatgccggttaaattccat

SEQ ID NO: 3687207 - DNA, 13 bp, Homo sapiens
ttagaattaaaaa

SEQ ID NO: 3687208 - DNA, 12 bp, Homo sapiens
ttagcaaggatt

SEQ ID NO: 3687209 - DNA, 18 bp, Homo sapiens
ttagctggccacatggcg

SEQ ID NO: 3687210 - DNA, 12 bp, Homo sapiens
ttaggagaagcc

SEQ ID NO: 3687211 - DNA, 13 bp, Homo sapiens
ttagggaagaaaa

SEQ ID NO: 3687212 - DNA, 14 bp, Homo sapiens
ttaggtcttgctgg

SEQ ID NO: 3687213 - DNA, 22 bp, Homo sapiens
ttaggttccatcctttacgtgt

SEQ ID NO: 3687214 - DNA, 17 bp, Homo sapiens
ttagtaatttctttttt

SEQ ID NO: 3687215 - DNA, 22 bp, Homo sapiens
ttagtcctgggagaggacaggg

SEQ ID NO: 3687216 - DNA, 21 bp, Homo sapiens
ttagtgagcagtgagcactga

SEQ ID NO: 3687217 - DNA, 19 bp, Homo sapiens
ttagtggtttatcagcaaa

SEQ ID NO: 3687218 - DNA, 21 bp, Homo sapiens
ttagtgtttgaaaaagctggt

SEQ ID NO: 3687219 - DNA, 17 bp, Homo sapiens
ttagtttcaagagtcta

SEQ ID NO: 3687220 - DNA, 20 bp, Homo sapiens
ttagtttcaagagtctaaac

SEQ ID NO: 3687221 - DNA, 17 bp, Homo sapiens
ttagtttttaacaatct

SEQ ID NO: 3687222 - DNA, 20 bp, Homo sapiens
ttataaaatggctgtaatca

SEQ ID NO: 3687223 - DNA, 18 bp, Homo sapiens
ttataagtcattgtatgt

SEQ ID NO: 3687224 - DNA, 23 bp, Homo sapiens
ttatactactttgttaggatttt

SEQ ID NO: 3687225 - DNA, 13 bp, Homo sapiens
ttatactgtacaa

SEQ ID NO: 3687226 - DNA, 16 bp, Homo sapiens
ttatagccgaaatgat

SEQ ID NO: 3687227 - DNA, 20 bp, Homo sapiens
ttatagcctggactgctacc

SEQ ID NO: 3687228 - DNA, 18 bp, Homo sapiens
ttataggtgagaaaaaaa

SEQ ID NO: 3687229 - DNA, 16 bp, Homo sapiens
ttatataattgttgaa

SEQ ID NO: 3687230 - DNA, 15 bp, Homo sapiens
ttatatttcagatgt

SEQ ID NO: 3687231 - DNA, 21 bp, Homo sapiens
ttatatttcagatgtaatgtt

SEQ ID NO: 3687232 - DNA, 21 bp, Homo sapiens
ttatcaacttcctaaatatta

SEQ ID NO: 3687233 - DNA, 21 bp, Homo sapiens
ttatcttatactgtacaataa

SEQ ID NO: 3687234 - DNA, 14 bp, Homo sapiens
ttatcttctggatt

SEQ ID NO: 3687235 - DNA, 13 bp, Homo sapiens
ttatgagaaactg

SEQ ID NO: 3687236 - DNA, 15 bp, Homo sapiens
ttatgagaaagcctt

SEQ ID NO: 3687237 - DNA, 15 bp, Homo sapiens
ttatgccttttattt

SEQ ID NO: 3687238 - DNA, 19 bp, Homo sapiens
ttatgctctcactgtttgt

SEQ ID NO: 3687239 - DNA, 13 bp, Homo sapiens
ttatgctgcttta

SEQ ID NO: 3687240 - DNA, 14 bp, Homo sapiens
ttatgctgtcatgg

SEQ ID NO: 3687241 - DNA, 18 bp, Homo sapiens
ttatggcctcagctgcct

SEQ ID NO: 3687242 - DNA, 11 bp, Homo sapiens
ttatgtatttc

SEQ ID NO: 3687243 - DNA, 20 bp, Homo sapiens
ttatgtatttcctggatgtt

SEQ ID NO: 3687244 - DNA, 18 bp, Homo sapiens
ttattacatgtaatttga

SEQ ID NO: 3687245 - DNA, 12 bp, Homo sapiens
ttattgcatttg

SEQ ID NO: 3687246 - DNA, 14 bp, Homo sapiens
ttattgtctgtcta

SEQ ID NO: 3687247 - DNA, 22 bp, Homo sapiens
ttattgtctgtctacatttctg

SEQ ID NO: 3687248 - DNA, 14 bp, Homo sapiens
ttattttgtgtaaa

SEQ ID NO: 3687249 - DNA, 21 bp, Homo sapiens
ttattttttggacttcaaagc

SEQ ID NO: 3687250 - DNA, 15 bp, Homo sapiens
ttcaaaatatttaaa

SEQ ID NO: 3687251 - DNA, 23 bp, Homo sapiens
ttcaaatcattccttagatacct

SEQ ID NO: 3687252 - DNA, 11 bp, Homo sapiens
ttcaaatttag

SEQ ID NO: 3687253 - DNA, 19 bp, Homo sapiens
ttcaacagtgaagacagaa

SEQ ID NO: 3687254 - DNA, 19 bp, Homo sapiens
ttcaacttattaacaatta

SEQ ID NO: 3687255 - DNA, 14 bp, Homo sapiens
ttcaagtgccaaac

SEQ ID NO: 3687256 - DNA, 15 bp, Homo sapiens
ttcaagtgcctagac

SEQ ID NO: 3687257 - DNA, 18 bp, Homo sapiens
ttcaagtgcctagactgt

SEQ ID NO: 3687258 - DNA, 20 bp, Homo sapiens
ttcaagttttgggtatgttt

SEQ ID NO: 3687259 - DNA, 22 bp, Homo sapiens
ttcaatggtttgcaaggaagcc

SEQ ID NO: 3687260 - DNA, 20 bp, Homo sapiens
ttcacagctttgaggaacat

SEQ ID NO: 3687261 - DNA, 22 bp, Homo sapiens
ttcacggggcccttacctgtga

SEQ ID NO: 3687262 - DNA, 22 bp, Homo sapiens
ttcactggcccctactttgtgg

SEQ ID NO: 3687263 - DNA, 22 bp, Homo sapiens
ttcacttagaacctttctgtgt

SEQ ID NO: 3687264 - DNA, 15 bp, Homo sapiens
ttcagaacctcttcc

SEQ ID NO: 3687265 - DNA, 17 bp, Homo sapiens
ttcagaacctcttcccc

SEQ ID NO: 3687266 - DNA, 18 bp, Homo sapiens
ttcagaacctcttcccca

SEQ ID NO: 3687267 - DNA, 20 bp, Homo sapiens
ttcagactcccattcctgaa

SEQ ID NO: 3687268 - DNA, 15 bp, Homo sapiens
ttcagacttgtcaag

SEQ ID NO: 3687269 - DNA, 13 bp, Homo sapiens
ttcagatgtaatg

SEQ ID NO: 3687270 - DNA, 15 bp, Homo sapiens
ttcagatgtaatgtt

SEQ ID NO: 3687271 - DNA, 18 bp, Homo sapiens
ttcagatgtaatgttttc

SEQ ID NO: 3687272 - DNA, 20 bp, Homo sapiens
tttcagaacctcttccccag

SEQ ID NO: 3687273 - DNA, 19 bp, Homo sapiens
tttcagatgtaatgttttc

SEQ ID NO: 3687274 - DNA, 18 bp, Homo sapiens
tttcagcgactccgttgg

SEQ ID NO: 3687275 - DNA, 12 bp, Homo sapiens
tttccaaatgct

SEQ ID NO: 3687276 - DNA, 16 bp, Homo sapiens
tttccagcagaagaca

SEQ ID NO: 3687277 - DNA, 19 bp, Homo sapiens
tttccaggtttaagctgtt

SEQ ID NO: 3687278 - DNA, 12 bp, Homo sapiens
tttcccaactct

SEQ ID NO: 3687279 - DNA, 19 bp, Homo sapiens
tttcccacttcccaccctg

SEQ ID NO: 3687280 - DNA, 14 bp, Homo sapiens
tttcccaggaccct

SEQ ID NO: 3687281 - DNA, 16 bp, Homo sapiens
tttcccatggggaggg

SEQ ID NO: 3687282 - DNA, 12 bp, Homo sapiens
tttccccccact

SEQ ID NO: 3687283 - DNA, 13 bp, Homo sapiens
tttccctgggtgg

SEQ ID NO: 3687284 - DNA, 17 bp, Homo sapiens
tttcccttgcttcccct

SEQ ID NO: 3687285 - DNA, 15 bp, Homo sapiens
tttcctatctttaca

SEQ ID NO: 3687286 - DNA, 12 bp, Homo sapiens
tttcctcccttc

SEQ ID NO: 3687287 - DNA, 20 bp, Homo sapiens
tttcctcccttctgctactg

SEQ ID NO: 3687288 - DNA, 16 bp, Homo sapiens
tttcctggccctccac

SEQ ID NO: 3687289 - DNA, 21 bp, Homo sapiens
tttcctttttaaggtctttca

SEQ ID NO: 3687290 - DNA, 23 bp, Homo sapiens
tttctaatgaggagagaaaatat

SEQ ID NO: 3687291 - DNA, 20 bp, Homo sapiens
tttctaatggaatggtttgg

SEQ ID NO: 3687292 - DNA, 21 bp, Homo sapiens
tttctagaatttatcacactt

SEQ ID NO: 3687293 - DNA, 20 bp, Homo sapiens
tttctgaaaattaacactgc

SEQ ID NO: 3687294 - DNA, 23 bp, Homo sapiens
tttctgatctgatgcaagcaaga

SEQ ID NO: 3687295 - DNA, 18 bp, Homo sapiens
tttctgctcagcttctcc

SEQ ID NO: 3687296 - DNA, 12 bp, Homo sapiens
tttctgtgaata

SEQ ID NO: 3687297 - DNA, 14 bp, Homo sapiens
tttcttattgcgct

SEQ ID NO: 3687298 - DNA, 22 bp, Homo sapiens
tttcttgagtcaaaaaacatga

SEQ ID NO: 3687299 - DNA, 16 bp, Homo sapiens
tttcttgtgttctgta

SEQ ID NO: 3687300 - DNA, 23 bp, Homo sapiens
tttctttaaccttgtataaatta

SEQ ID NO: 3687301 - DNA, 14 bp, Homo sapiens
tttctttgcaaagt

SEQ ID NO: 3687302 - DNA, 13 bp, Homo sapiens
tttgaaaaagctg

SEQ ID NO: 3687303 - DNA, 18 bp, Homo sapiens
tttgaatataaacactat

SEQ ID NO: 3687304 - DNA, 19 bp, Homo sapiens
tttgaatataaacactata

SEQ ID NO: 3687305 - DNA, 14 bp, Homo sapiens
tttgaattgttaca

SEQ ID NO: 3687306 - DNA, 15 bp, Homo sapiens
tttgaattgttacat

SEQ ID NO: 3687307 - DNA, 13 bp, Homo sapiens
tttgacatttcat

SEQ ID NO: 3687308 - DNA, 14 bp, Homo sapiens
tttgactaatttta

SEQ ID NO: 3687309 - DNA, 17 bp, Homo sapiens
tttgactaattttacat

SEQ ID NO: 3687310 - DNA, 16 bp, Homo sapiens
tttgacttaatgtgat

SEQ ID NO: 3687311 - DNA, 23 bp, Homo sapiens
tttgagattaagaatgccaggaa

SEQ ID NO: 3687312 - DNA, 18 bp, Homo sapiens
tttgatcaggtggggagt

SEQ ID NO: 3687313 - DNA, 17 bp, Homo sapiens
tttgatgcatgtctttt

SEQ ID NO: 3687314 - DNA, 15 bp, Homo sapiens
tttgattcaaaatat

SEQ ID NO: 3687315 - DNA, 13 bp, Homo sapiens
tttgctgaagaat

SEQ ID NO: 3687316 - DNA, 17 bp, Homo sapiens
tttgctgtgaggctgtc

SEQ ID NO: 3687317 - DNA, 21 bp, Homo sapiens
tttgcttgctcatatgcatgt

SEQ ID NO: 3687318 - DNA, 13 bp, Homo sapiens
tttgctttctggt

SEQ ID NO: 3687319 - DNA, 18 bp, Homo sapiens
tttggagagtttcctgaa

SEQ ID NO: 3687320 - DNA, 19 bp, Homo sapiens
tttggagtgttatgtattt

SEQ ID NO: 3687321 - DNA, 19 bp, Homo sapiens
tttggcaatttcctggccc

SEQ ID NO: 3687322 - DNA, 20 bp, Homo sapiens
tttggcaatttcctggccct

SEQ ID NO: 3687323 - DNA, 20 bp, Homo sapiens
tttggctgaaattctcctgg

SEQ ID NO: 3687324 - DNA, 16 bp, Homo sapiens
tttggggtctttgtgg

SEQ ID NO: 3687325 - DNA, 15 bp, Homo sapiens
tttgggttctgcctg

SEQ ID NO: 3687326 - DNA, 18 bp, Homo sapiens
tttggtgccaatgtgaaa

SEQ ID NO: 3687327 - DNA, 14 bp, Homo sapiens
tttgtaaataggat

SEQ ID NO: 3687328 - DNA, 20 bp, Homo sapiens
tttgtaaataggatttttag

SEQ ID NO: 3687329 - DNA, 14 bp, Homo sapiens
tttgtaatgaattc

SEQ ID NO: 3687330 - DNA, 21 bp, Homo sapiens
tttgtatgaaattataatctg

SEQ ID NO: 3687331 - DNA, 13 bp, Homo sapiens
tttgtctgtcgtg

SEQ ID NO: 3687332 - DNA, 13 bp, Homo sapiens
tttgtcttaaaaa

SEQ ID NO: 3687333 - DNA, 14 bp, Homo sapiens
tttgtcttaaaaag

SEQ ID NO: 3687334 - DNA, 15 bp, Homo sapiens
tttgtgaactggaag

SEQ ID NO: 3687335 - DNA, 21 bp, Homo sapiens
tttgtgaactggaagaaagca

SEQ ID NO: 3687336 - DNA, 14 bp, Homo sapiens
tttgtgctagaaat

SEQ ID NO: 3687337 - DNA, 21 bp, Homo sapiens
tttgtgctagaaattttcaag

SEQ ID NO: 3687338 - DNA, 21 bp, Homo sapiens
tttgtggccaaggagctgcta

SEQ ID NO: 3687339 - DNA, 14 bp, Homo sapiens
tttgtggcctcaga

SEQ ID NO: 3687340 - DNA, 15 bp, Homo sapiens
tttgtgtttccattt

SEQ ID NO: 3687341 - DNA, 23 bp, Homo sapiens
tttgttcaagttttgggtatgtt

SEQ ID NO: 3687342 - DNA, 15 bp, Homo sapiens
tttgttgtgtgtgca

SEQ ID NO: 3687343 - DNA, 18 bp, Homo sapiens
tttgttttacaatgtcat

SEQ ID NO: 3687344 - DNA, 23 bp, Homo sapiens
ttttaaagaatatgactttttat

SEQ ID NO: 3687345 - DNA, 15 bp, Homo sapiens
ttttaaatattttct

SEQ ID NO: 3687346 - DNA, 15 bp, Homo sapiens
ttttaaatgtacaga

SEQ ID NO: 3687347 - DNA, 17 bp, Homo sapiens
ttttaatgtttaaaaag

SEQ ID NO: 3687348 - DNA, 13 bp, Homo sapiens
ttttaattaaata

SEQ ID NO: 3687349 - DNA, 20 bp, Homo sapiens
ttttacatgccccgtttttg

SEQ ID NO: 3687350 - DNA, 18 bp, Homo sapiens
ttttacatgtttataaat

SEQ ID NO: 3687351 - DNA, 21 bp, Homo sapiens
ttttagaccctattgctgctt

SEQ ID NO: 3687352 - DNA, 22 bp, Homo sapiens
ttttatataatatctaaagtta

SEQ ID NO: 3687353 - DNA, 16 bp, Homo sapiens
ttttattatcttctat

SEQ ID NO: 3687354 - DNA, 21 bp, Homo sapiens
ttttcaaatcattccttagat

SEQ ID NO: 3687355 - DNA, 13 bp, Homo sapiens
ttttcacagcttt

SEQ ID NO: 3687356 - DNA, 23 bp, Homo sapiens
ttttcacttagaacctttctgtg

SEQ ID NO: 3687357 - DNA, 16 bp, Homo sapiens
ttttcagacttgtcaa

SEQ ID NO: 3687358 - DNA, 13 bp, Homo sapiens
ttttccaaatgct

SEQ ID NO: 3687359 - DNA, 15 bp, Homo sapiens
ttttccaaatgcttc

SEQ ID NO: 3687360 - DNA, 22 bp, Homo sapiens
ttttccaaatgtaataaacttt

SEQ ID NO: 3687361 - DNA, 18 bp, Homo sapiens
ttttccactccattgtcg

SEQ ID NO: 3687362 - DNA, 19 bp, Homo sapiens
ttttccaggtttaagctgt

SEQ ID NO: 3687363 - DNA, 22 bp, Homo sapiens
ttttccctattagagaagagat

SEQ ID NO: 3687364 - DNA, 15 bp, Homo sapiens
ttttccctgtacagt

SEQ ID NO: 3687365 - DNA, 14 bp, Homo sapiens
ttttcctcccttct

SEQ ID NO: 3687366 - DNA, 20 bp, Homo sapiens
ttttcctcccttctgctact

SEQ ID NO: 3687367 - DNA, 18 bp, Homo sapiens
ttttctctgtacttttca

SEQ ID NO: 3687368 - DNA, 18 bp, Homo sapiens
ttttctggaaaatgcttc

SEQ ID NO: 3687369 - DNA, 19 bp, Homo sapiens
ttttctggaaaatgcttct

SEQ ID NO: 3687370 - DNA, 11 bp, Homo sapiens
ttttctggcac

SEQ ID NO: 3687371 - DNA, 15 bp, Homo sapiens
ttttgagacagtctt

SEQ ID NO: 3687372 - DNA, 20 bp, Homo sapiens
ttttgatgtttgtggcctca

SEQ ID NO: 3687373 - DNA, 22 bp, Homo sapiens
ttttgatgtttgtggcctcaga

SEQ ID NO: 3687374 - DNA, 16 bp, Homo sapiens
ttttggagtgttatgt

SEQ ID NO: 3687375 - DNA, 11 bp, Homo sapiens
ttttgggactt

SEQ ID NO: 3687376 - DNA, 14 bp, Homo sapiens
ttttggtacaaaaa

SEQ ID NO: 3687377 - DNA, 13 bp, Homo sapiens
ttttgttgtgtgt

SEQ ID NO: 3687378 - DNA, 22 bp, Homo sapiens
ttttgttgttgttgtttgtaaa

SEQ ID NO: 3687379 - DNA, 16 bp, Homo sapiens
ttttgttttaaaactg

SEQ ID NO: 3687380 - DNA, 22 bp, Homo sapiens
ttttgttttaaaactggacctg

SEQ ID NO: 3687381 - DNA, 15 bp, Homo sapiens
ttttgttttggctga

SEQ ID NO: 3687382 - DNA, 18 bp, Homo sapiens
tttttaaaaaatattttc

SEQ ID NO: 3687383 - DNA, 19 bp, Homo sapiens
tttttaaaaaatattttct

SEQ ID NO: 3687384 - DNA, 19 bp, Homo sapiens
tttttaaattttgtaatga

SEQ ID NO: 3687385 - DNA, 22 bp, Homo sapiens
tttttaactcaatattttccat

SEQ ID NO: 3687386 - DNA, 18 bp, Homo sapiens
tttttaagttaatagatt

SEQ ID NO: 3687387 - DNA, 18 bp, Homo sapiens
tttttaataaaaaggcac

SEQ ID NO: 3687388 - DNA, 18 bp, Homo sapiens
tttttaatgtttaaaaag

SEQ ID NO: 3687389 - DNA, 12 bp, Homo sapiens
aaaaaaaaagca

SEQ ID NO: 3687390 - DNA, 12 bp, Homo sapiens
aaaaaaagcata

SEQ ID NO: 3687391 - DNA, 15 bp, Homo sapiens
aaaaaatattttcct

SEQ ID NO: 3687392 - DNA, 13 bp, Homo sapiens
aaaaaattcttta

SEQ ID NO: 3687393 - DNA, 15 bp, Homo sapiens
aaaaacattgccttt

SEQ ID NO: 3687394 - DNA, 19 bp, Homo sapiens
aaaaactacaaccaatgga

SEQ ID NO: 3687395 - DNA, 15 bp, Homo sapiens
aaaaactgtctttaa

SEQ ID NO: 3687396 - DNA, 20 bp, Homo sapiens
aaaaagcataaaaacatttt

SEQ ID NO: 3687397 - DNA, 17 bp, Homo sapiens
aaaaaggatacataatg

SEQ ID NO: 3687398 - DNA, 12 bp, Homo sapiens
aaaaaggcagga

SEQ ID NO: 3687399 - DNA, 13 bp, Homo sapiens
aaaaaggtttaca

SEQ ID NO: 3687400 - DNA, 18 bp, Homo sapiens
aaaaaggtttacagaatt

SEQ ID NO: 3687401 - DNA, 13 bp, Homo sapiens
aaaaatactcaga

SEQ ID NO: 3687402 - DNA, 18 bp, Homo sapiens
aaaacaatggagtattct

SEQ ID NO: 3687403 - DNA, 22 bp, Homo sapiens
aaaacattgcctttgaatgtta

SEQ ID NO: 3687404 - DNA, 15 bp, Homo sapiens
aaaaccaatgttctc

SEQ ID NO: 3687405 - DNA, 18 bp, Homo sapiens
aaaaccaccaaaaacaaa

SEQ ID NO: 3687406 - DNA, 17 bp, Homo sapiens
aaaacctcaagcagtaa

SEQ ID NO: 3687407 - DNA, 22 bp, Homo sapiens
aaaactacaaccaatggaatgt

SEQ ID NO: 3687408 - DNA, 20 bp, Homo sapiens
aaaactgctgactgttttct

SEQ ID NO: 3687409 - DNA, 11 bp, Homo sapiens
aaaagaaaaag

SEQ ID NO: 3687410 - DNA, 17 bp, Homo sapiens
aaaagagactgtgccat

SEQ ID NO: 3687411 - DNA, 20 bp, Homo sapiens
aaaagcaagtgttcactgct

SEQ ID NO: 3687412 - DNA, 14 bp, Homo sapiens
aaaagctggtcttt

SEQ ID NO: 3687413 - DNA, 19 bp, Homo sapiens
aaaaggatctttgtggcca

SEQ ID NO: 3687414 - DNA, 20 bp, Homo sapiens
aaaaggatctttgtggccaa

SEQ ID NO: 3687415 - DNA, 23 bp, Homo sapiens
aaaaggatctttgtggccaagga

SEQ ID NO: 3687416 - DNA, 11 bp, Homo sapiens
aaaaggcagga

SEQ ID NO: 3687417 - DNA, 16 bp, Homo sapiens
aaaaggtttacagaat

SEQ ID NO: 3687418 - DNA, 21 bp, Homo sapiens
aaaagtcagtatcatattatt

SEQ ID NO: 3687419 - DNA, 19 bp, Homo sapiens
aaaataaaattaaagctga

SEQ ID NO: 3687420 - DNA, 23 bp, Homo sapiens
aaaataatactgctgagatacat

SEQ ID NO: 3687421 - DNA, 23 bp, Homo sapiens
aaaataccagagccttcaagtgc

SEQ ID NO: 3687422 - DNA, 19 bp, Homo sapiens
aaaatactttttctaatga

SEQ ID NO: 3687423 - DNA, 16 bp, Homo sapiens
aaaatagaaaagttat

SEQ ID NO: 3687424 - DNA, 12 bp, Homo sapiens
aaaatatatgta

SEQ ID NO: 3687425 - DNA, 14 bp, Homo sapiens
aaaatatgtaccaa

SEQ ID NO: 3687426 - DNA, 20 bp, Homo sapiens
aaaatatttaaaaatgtctt

SEQ ID NO: 3687427 - DNA, 16 bp, Homo sapiens
aaaatcctacagtgaa

SEQ ID NO: 3687428 - DNA, 16 bp, Homo sapiens
aaaatctgagaaactc

SEQ ID NO: 3687429 - DNA, 18 bp, Homo sapiens
aaaatgagcatacatctt

SEQ ID NO: 3687430 - DNA, 21 bp, Homo sapiens
aaaatgagcctggcaagaatg

SEQ ID NO: 3687431 - DNA, 15 bp, Homo sapiens
aaaattagccaagtg

SEQ ID NO: 3687432 - DNA, 16 bp, Homo sapiens
aaaattcagcaaacca

SEQ ID NO: 3687433 - DNA, 18 bp, Homo sapiens
aaaattcagcaaaccatt

SEQ ID NO: 3687434 - DNA, 17 bp, Homo sapiens
aaaattctttagagatt

SEQ ID NO: 3687435 - DNA, 19 bp, Homo sapiens
aaaatttgactaattttac

SEQ ID NO: 3687436 - DNA, 12 bp, Homo sapiens
aaacaaaatttg

SEQ ID NO: 3687437 - DNA, 12 bp, Homo sapiens
aaacaaagccag

SEQ ID NO: 3687438 - DNA, 18 bp, Homo sapiens
aaacaatctggaagaaaa

SEQ ID NO: 3687439 - DNA, 18 bp, Homo sapiens
aaacaatggagtattctc

SEQ ID NO: 3687440 - DNA, 19 bp, Homo sapiens
aaacaccaacatgttggga

SEQ ID NO: 3687441 - DNA, 18 bp, Homo sapiens
aaacacttatcttctgga

SEQ ID NO: 3687442 - DNA, 19 bp, Homo sapiens
aaacacttatcttctggat

SEQ ID NO: 3687443 - DNA, 21 bp, Homo sapiens
aaacagcgctgggtccacccc

SEQ ID NO: 3687444 - DNA, 17 bp, Homo sapiens
aaacagtctaaagaaga

SEQ ID NO: 3687445 - DNA, 14 bp, Homo sapiens
aaacattgttttgt

SEQ ID NO: 3687446 - DNA, 23 bp, Homo sapiens
aaacattgttttgtgtaacatat

SEQ ID NO: 3687447 - DNA, 14 bp, Homo sapiens
aaacattttaaaaa

SEQ ID NO: 3687448 - DNA, 17 bp, Homo sapiens
aaaccaccaaaaacaaa

SEQ ID NO: 3687449 - DNA, 20 bp, Homo sapiens
aaaccattatgaagaagaga

SEQ ID NO: 3687450 - DNA, 15 bp, Homo sapiens
aaaccgccaaggctg

SEQ ID NO: 3687451 - DNA, 12 bp, Homo sapiens
aaacctggttca

SEQ ID NO: 3687452 - DNA, 21 bp, Homo sapiens
aaacctgttgaagattatttc

SEQ ID NO: 3687453 - DNA, 14 bp, Homo sapiens
aaaccttctgcctt

SEQ ID NO: 3687454 - DNA, 21 bp, Homo sapiens
aaacggggcagtactcctccc

SEQ ID NO: 3687455 - DNA, 19 bp, Homo sapiens
aaactcttcagttaattct

SEQ ID NO: 3687456 - DNA, 22 bp, Homo sapiens
aaactcttcagttaattcttag

SEQ ID NO: 3687457 - DNA, 22 bp, Homo sapiens
aaactgaagcagcctctcccca

SEQ ID NO: 3687458 - DNA, 14 bp, Homo sapiens
aaactggctttggc

SEQ ID NO: 3687459 - DNA, 17 bp, Homo sapiens
aaactgtaatacaatga

SEQ ID NO: 3687460 - DNA, 17 bp, Homo sapiens
aaacttagtgacaaaat

SEQ ID NO: 3687461 - DNA, 13 bp, Homo sapiens
aaactttaatata

SEQ ID NO: 3687462 - DNA, 18 bp, Homo sapiens
aaactttcctcgcctgac

SEQ ID NO: 3687463 - DNA, 14 bp, Homo sapiens
aaagaaagcaactt

SEQ ID NO: 3687464 - DNA, 18 bp, Homo sapiens
aaagaagctgtcttggaa

SEQ ID NO: 3687465 - DNA, 18 bp, Homo sapiens
aaagaagtggggacagag

SEQ ID NO: 3687466 - DNA, 16 bp, Homo sapiens
aaagagactgtgccat

SEQ ID NO: 3687467 - DNA, 11 bp, Homo sapiens
aaagagagaga

SEQ ID NO: 3687468 - DNA, 18 bp, Homo sapiens
aaagatctgtcctcagcc

SEQ ID NO: 3687469 - DNA, 19 bp, Homo sapiens
aaagatctgtcctcagcct

SEQ ID NO: 3687470 - DNA, 13 bp, Homo sapiens
aaagatgatatta

SEQ ID NO: 3687471 - DNA, 13 bp, Homo sapiens
aaagatgcacaga

SEQ ID NO: 3687472 - DNA, 14 bp, Homo sapiens
aaagatgcttctca

SEQ ID NO: 3687473 - DNA, 17 bp, Homo sapiens
aaagatgcttctcactg

SEQ ID NO: 3687474 - DNA, 19 bp, Homo sapiens
aaagatgcttctcactgcc

SEQ ID NO: 3687475 - DNA, 19 bp, Homo sapiens
aaggtgtggaggctcctgt

SEQ ID NO: 3687476 - DNA, 22 bp, Homo sapiens
aaggtttaggctggtggcccag

SEQ ID NO: 3687477 - DNA, 16 bp, Homo sapiens
aaggtttctgaaaatt

SEQ ID NO: 3687478 - DNA, 20 bp, Homo sapiens
aaggttttataaggctgatg

SEQ ID NO: 3687479 - DNA, 13 bp, Homo sapiens
aagtaagcaaaga

SEQ ID NO: 3687480 - DNA, 22 bp, Homo sapiens
aagtaatggttaagttttcttg

SEQ ID NO: 3687481 - DNA, 20 bp, Homo sapiens
aagtacagcagtagactggg

SEQ ID NO: 3687482 - DNA, 17 bp, Homo sapiens
aagtaccaatgggaagc

SEQ ID NO: 3687483 - DNA, 18 bp, Homo sapiens
aagtaccaatgggaagca

SEQ ID NO: 3687484 - DNA, 19 bp, Homo sapiens
aagtaccaatgggaagcag

SEQ ID NO: 3687485 - DNA, 12 bp, Homo sapiens
aagtagaagagg

SEQ ID NO: 3687486 - DNA, 17 bp, Homo sapiens
aagtagtgtatcacagt

SEQ ID NO: 3687487 - DNA, 18 bp, Homo sapiens
aagtatacctatcactta

SEQ ID NO: 3687488 - DNA, 16 bp, Homo sapiens
aagtatcacttttctg

SEQ ID NO: 3687489 - DNA, 11 bp, Homo sapiens
aagtatttctg

SEQ ID NO: 3687490 - DNA, 22 bp, Homo sapiens
aagtcagctccagctttctgcc

SEQ ID NO: 3687491 - DNA, 18 bp, Homo sapiens
aagtcagtatcatattat

SEQ ID NO: 3687492 - DNA, 14 bp, Homo sapiens
aagtctgtttactg

SEQ ID NO: 3687493 - DNA, 16 bp, Homo sapiens
aagtctgtttactgca

SEQ ID NO: 3687494 - DNA, 21 bp, Homo sapiens
aagtgaaaaaggaggaagaga

SEQ ID NO: 3687495 - DNA, 13 bp, Homo sapiens
aagtgaaaatctt

SEQ ID NO: 3687496 - DNA, 22 bp, Homo sapiens
aagtgatgtgtttacatttact

SEQ ID NO: 3687497 - DNA, 20 bp, Homo sapiens
aagtgcatgcattgagctgc

SEQ ID NO: 3687498 - DNA, 14 bp, Homo sapiens
aagtgcatttttgt

SEQ ID NO: 3687499 - DNA, 18 bp, Homo sapiens
aagtgccagggctgggcc

SEQ ID NO: 3687500 - DNA, 15 bp, Homo sapiens
aagtgcccttcctgc

SEQ ID NO: 3687501 - DNA, 19 bp, Homo sapiens
aagtggaaaaatagcctgc

SEQ ID NO: 3687502 - DNA, 19 bp, Homo sapiens
aagtgggcccacccggtgg

SEQ ID NO: 3687503 - DNA, 15 bp, Homo sapiens
aagtggggacagagc

SEQ ID NO: 3687504 - DNA, 18 bp, Homo sapiens
aagtggtggtaaccctgg

SEQ ID NO: 3687505 - DNA, 19 bp, Homo sapiens
aagtgtaagaaacacactg

SEQ ID NO: 3687506 - DNA, 17 bp, Homo sapiens
aagtgtcttttgacatt

SEQ ID NO: 3687507 - DNA, 13 bp, Homo sapiens
aagtgtggtagag

SEQ ID NO: 3687508 - DNA, 18 bp, Homo sapiens
aagtgttgaagggaggtg

SEQ ID NO: 3687509 - DNA, 23 bp, Homo sapiens
aagttaagaatgttcttatgttg

SEQ ID NO: 3687510 - DNA, 17 bp, Homo sapiens
aagtttctggtgccatt

SEQ ID NO: 3687511 - DNA, 22 bp, Homo sapiens
aagtttctggtgccatttctga

SEQ ID NO: 3687512 - DNA, 19 bp, Homo sapiens
aagtttgcactatctttca

SEQ ID NO: 3687513 - DNA, 20 bp, Homo sapiens
aagtttgcactatctttcag

SEQ ID NO: 3687514 - DNA, 12 bp, Homo sapiens
aagtttttctga

SEQ ID NO: 3687515 - DNA, 23 bp, Homo sapiens
aagtttttttgctgctgcctctt

SEQ ID NO: 3687516 - DNA, 18 bp, Homo sapiens
aataaaaaggatctcctt

SEQ ID NO: 3687517 - DNA, 18 bp, Homo sapiens
aataaaaaggcacctata

SEQ ID NO: 3687518 - DNA, 15 bp, Homo sapiens
aataaaactggcttt

SEQ ID NO: 3687519 - DNA, 13 bp, Homo sapiens
aataaactttaat

SEQ ID NO: 3687520 - DNA, 16 bp, Homo sapiens
aataaatctgacccag

SEQ ID NO: 3687521 - DNA, 15 bp, Homo sapiens
aataaatttatatga

SEQ ID NO: 3687522 - DNA, 21 bp, Homo sapiens
aataagtatttctgattttgt

SEQ ID NO: 3687523 - DNA, 14 bp, Homo sapiens
aataatatttcaag

SEQ ID NO: 3687524 - DNA, 16 bp, Homo sapiens
aataatatttcaagtg

SEQ ID NO: 3687525 - DNA, 17 bp, Homo sapiens
aataatatttcaagtgc

SEQ ID NO: 3687526 - DNA, 15 bp, Homo sapiens
aataatcatgtgaaa

SEQ ID NO: 3687527 - DNA, 20 bp, Homo sapiens
aataatcatgtgaaatgttt

SEQ ID NO: 3687528 - DNA, 20 bp, Homo sapiens
aataatttacaggttcttag

SEQ ID NO: 3687529 - DNA, 21 bp, Homo sapiens
aatacaccaggtagaacacaa

SEQ ID NO: 3687530 - DNA, 13 bp, Homo sapiens
aatacagaggcaa

SEQ ID NO: 3687531 - DNA, 21 bp, Homo sapiens
aatacagtacaggcagcacag

SEQ ID NO: 3687532 - DNA, 17 bp, Homo sapiens
aatacagttctgtcata

SEQ ID NO: 3687533 - DNA, 14 bp, Homo sapiens
aataccacaagcct

SEQ ID NO: 3687534 - DNA, 16 bp, Homo sapiens
aataccacaagcctga

SEQ ID NO: 3687535 - DNA, 21 bp, Homo sapiens
aatactgctgagatacataca

SEQ ID NO: 3687536 - DNA, 16 bp, Homo sapiens
aataggatttttagaa

SEQ ID NO: 3687537 - DNA, 16 bp, Homo sapiens
aataggcattaacaca

SEQ ID NO: 3687538 - DNA, 21 bp, Homo sapiens
aatagtctagatggctcctct

SEQ ID NO: 3687539 - DNA, 14 bp, Homo sapiens
aatagtctgtgtga

SEQ ID NO: 3687540 - DNA, 15 bp, Homo sapiens
aatagtctgtgtgaa

SEQ ID NO: 3687541 - DNA, 14 bp, Homo sapiens
aatataaacactat

SEQ ID NO: 3687542 - DNA, 15 bp, Homo sapiens
aatatagctgagact

SEQ ID NO: 3687543 - DNA, 14 bp, Homo sapiens
aatatataatttat

SEQ ID NO: 3687544 - DNA, 14 bp, Homo sapiens
aatatatctctatt

SEQ ID NO: 3687545 - DNA, 22 bp, Homo sapiens
aatatcaaatgcagtatatttc

SEQ ID NO: 3687546 - DNA, 13 bp, Homo sapiens
aatatcctgcttg

SEQ ID NO: 3687547 - DNA, 12 bp, Homo sapiens
aatatctaaagt

SEQ ID NO: 3687548 - DNA, 16 bp, Homo sapiens
aatatctaaagttata

SEQ ID NO: 3687549 - DNA, 14 bp, Homo sapiens
aatatctcctggaa

SEQ ID NO: 3687550 - DNA, 15 bp, Homo sapiens
aatatcttggcctaa

SEQ ID NO: 3687551 - DNA, 12 bp, Homo sapiens
aatatgtcctgg

SEQ ID NO: 3687552 - DNA, 13 bp, Homo sapiens
aatatgtcctggg

SEQ ID NO: 3687553 - DNA, 21 bp, Homo sapiens
aatatgtgaaaggaacatttt

SEQ ID NO: 3687554 - DNA, 18 bp, Homo sapiens
aatattaactacagaaaa

SEQ ID NO: 3687555 - DNA, 16 bp, Homo sapiens
aatattatgagatgct

SEQ ID NO: 3687556 - DNA, 15 bp, Homo sapiens
aatatttaaaaatgt

SEQ ID NO: 3687557 - DNA, 17 bp, Homo sapiens
aatatttaaaaatgtct

SEQ ID NO: 3687558 - DNA, 18 bp, Homo sapiens
aatatttcaagtgcctag

SEQ ID NO: 3687559 - DNA, 15 bp, Homo sapiens
aatcaacttgcttat

SEQ ID NO: 3687560 - DNA, 21 bp, Homo sapiens
aatcaagtctgtttactgcaa

SEQ ID NO: 3687561 - DNA, 15 bp, Homo sapiens
aatcatccaatgctc

SEQ ID NO: 3687562 - DNA, 17 bp, Homo sapiens
aatcattttcattccta

SEQ ID NO: 3687563 - DNA, 18 bp, Homo sapiens
aatccaggcagatccagg

SEQ ID NO: 3687564 - DNA, 21 bp, Homo sapiens
aatccaggcagatccaggact

SEQ ID NO: 3687565 - DNA, 16 bp, Homo sapiens
aatcccacccacctca

SEQ ID NO: 3687566 - DNA, 17 bp, Homo sapiens
aatcccatttaaaaaaa

SEQ ID NO: 3687567 - DNA, 16 bp, Homo sapiens
aatcctacagtgaaat

SEQ ID NO: 3687568 - DNA, 19 bp, Homo sapiens
aatccttagatctggcatg

SEQ ID NO: 3687569 - DNA, 20 bp, Homo sapiens
aatccttagatctggcatgt

SEQ ID NO: 3687570 - DNA, 19 bp, Homo sapiens
aatctaacaataatatttc

SEQ ID NO: 3687571 - DNA, 23 bp, Homo sapiens
aatctaacaataatatttcaagt

SEQ ID NO: 3687572 - DNA, 17 bp, Homo sapiens
aatctacttgttaaaaa

SEQ ID NO: 3687573 - DNA, 20 bp, Homo sapiens
aatctcaaaatatcctaaga

SEQ ID NO: 3687574 - DNA, 19 bp, Homo sapiens
aatctcaatgaagccagct

SEQ ID NO: 3687575 - DNA, 16 bp, Homo sapiens
aatctcagttgatttt

SEQ ID NO: 3687576 - DNA, 11 bp, Homo sapiens
aatctccattt

SEQ ID NO: 3687577 - DNA, 17 bp, Homo sapiens
aatctgacccagtgccc

SEQ ID NO: 3687578 - DNA, 15 bp, Homo sapiens
aatctggaagaaaaa

SEQ ID NO: 3687579 - DNA, 13 bp, Homo sapiens
aatctgtcaagag

SEQ ID NO: 3687580 - DNA, 23 bp, Homo sapiens
aatctgttatgtactagtgttct

SEQ ID NO: 3687581 - DNA, 17 bp, Homo sapiens
aatctttaaaagatgct

SEQ ID NO: 3687582 - DNA, 21 bp, Homo sapiens
aatctttaaaagatgctttta

SEQ ID NO: 3687583 - DNA, 20 bp, Homo sapiens
aatgaatcgtaatgaagttg

SEQ ID NO: 3687584 - DNA, 17 bp, Homo sapiens
aatgaatctttgactga

SEQ ID NO: 3687585 - DNA, 12 bp, Homo sapiens
aatgagcctggc

SEQ ID NO: 3687586 - DNA, 21 bp, Homo sapiens
aatgatcctgtattcagacag

SEQ ID NO: 3687587 - DNA, 23 bp, Homo sapiens
aatgatcctgtattcagacagat

SEQ ID NO: 3687588 - DNA, 19 bp, Homo sapiens
aatgatgacaaaaaatgtt

SEQ ID NO: 3687589 - DNA, 15 bp, Homo sapiens
aatgcaacaacatgt

SEQ ID NO: 3687590 - DNA, 18 bp, Homo sapiens
aatgcaacaacatgtata

SEQ ID NO: 3687591 - DNA, 24 bp, Homo sapiens
aatgcaatctccccttgatttaaa

SEQ ID NO: 3687592 - DNA, 17 bp, Homo sapiens
actactcccccaggtgg

SEQ ID NO: 3687593 - DNA, 22 bp, Homo sapiens
actactttgttaggattttcac

SEQ ID NO: 3687594 - DNA, 23 bp, Homo sapiens
actagaagggccagtcctgcctg

SEQ ID NO: 3687595 - DNA, 17 bp, Homo sapiens
actagacaagccagaac

SEQ ID NO: 3687596 - DNA, 19 bp, Homo sapiens
actagactcccaagctgga

SEQ ID NO: 3687597 - DNA, 20 bp, Homo sapiens
actagagtctgaacagctgt

SEQ ID NO: 3687598 - DNA, 18 bp, Homo sapiens
actaggcccccacttgcc

SEQ ID NO: 3687599 - DNA, 23 bp, Homo sapiens
actaggcccccacttgcctcttc

SEQ ID NO: 3687600 - DNA, 18 bp, Homo sapiens
actagggagccatgtttc

SEQ ID NO: 3687601 - DNA, 16 bp, Homo sapiens
actagggattcaggct

SEQ ID NO: 3687602 - DNA, 18 bp, Homo sapiens
actagggattcaggctgc

SEQ ID NO: 3687603 - DNA, 19 bp, Homo sapiens
actagggattcaggctgct

SEQ ID NO: 3687604 - DNA, 23 bp, Homo sapiens
actagtgtacatttctataaata

SEQ ID NO: 3687605 - DNA, 14 bp, Homo sapiens
actataaagagaag

SEQ ID NO: 3687606 - DNA, 19 bp, Homo sapiens
actataagaactttgagct

SEQ ID NO: 3687607 - DNA, 22 bp, Homo sapiens
actatatttgggcctgctccag

SEQ ID NO: 3687608 - DNA, 14 bp, Homo sapiens
actatctgtctggt

SEQ ID NO: 3687609 - DNA, 21 bp, Homo sapiens
actatgcatggtgccccagga

SEQ ID NO: 3687610 - DNA, 22 bp, Homo sapiens
actatgcatggtgccccaggac

SEQ ID NO: 3687611 - DNA, 24 bp, Homo sapiens
actatgcatggtgccccaggacca

SEQ ID NO: 3687612 - DNA, 14 bp, Homo sapiens
actatttcttcaga

SEQ ID NO: 3687613 - DNA, 12 bp, Homo sapiens
actattttcaga

SEQ ID NO: 3687614 - DNA, 16 bp, Homo sapiens
actcaaactcttaaaa

SEQ ID NO: 3687615 - DNA, 22 bp, Homo sapiens
actcaagccaagcagccaagct

SEQ ID NO: 3687616 - DNA, 23 bp, Homo sapiens
actcaagtaccaccaagggatct

SEQ ID NO: 3687617 - DNA, 18 bp, Homo sapiens
actcaatattttccatga

SEQ ID NO: 3687618 - DNA, 20 bp, Homo sapiens
actcacatggctatgtttta

SEQ ID NO: 3687619 - DNA, 20 bp, Homo sapiens
actcactaaaagttctcaaa

SEQ ID NO: 3687620 - DNA, 14 bp, Homo sapiens
actcactaggcccc

SEQ ID NO: 3687621 - DNA, 22 bp, Homo sapiens
actcagataaggtaaaatgcca

SEQ ID NO: 3687622 - DNA, 11 bp, Homo sapiens
actcagatcca

SEQ ID NO: 3687623 - DNA, 14 bp, Homo sapiens
actcagatccaggg

SEQ ID NO: 3687624 - DNA, 16 bp, Homo sapiens
actcagatccagggac

SEQ ID NO: 3687625 - DNA, 19 bp, Homo sapiens
actcagatccagggacaga

SEQ ID NO: 3687626 - DNA, 22 bp, Homo sapiens
actcagatggaaccgcaggaag

SEQ ID NO: 3687627 - DNA, 15 bp, Homo sapiens
actcagccctgaggt

SEQ ID NO: 3687628 - DNA, 11 bp, Homo sapiens
actcagtgcag

SEQ ID NO: 3687629 - DNA, 12 bp, Homo sapiens
actcagtgcaga

SEQ ID NO: 3687630 - DNA, 16 bp, Homo sapiens
actcagtgggctgttt

SEQ ID NO: 3687631 - DNA, 19 bp, Homo sapiens
actcagtgggctgtttctg

SEQ ID NO: 3687632 - DNA, 13 bp, Homo sapiens
actcatagttttt

SEQ ID NO: 3687633 - DNA, 15 bp, Homo sapiens
actcatccgcctggc

SEQ ID NO: 3687634 - DNA, 13 bp, Homo sapiens
actcatttacaac

SEQ ID NO: 3687635 - DNA, 18 bp, Homo sapiens
actcatttacaactgaaa

SEQ ID NO: 3687636 - DNA, 12 bp, Homo sapiens
actccagcctgg

SEQ ID NO: 3687637 - DNA, 14 bp, Homo sapiens
actccatcagctta

SEQ ID NO: 3687638 - DNA, 22 bp, Homo sapiens
actcccaggctggagagcactg

SEQ ID NO: 3687639 - DNA, 13 bp, Homo sapiens
actcccattcctg

SEQ ID NO: 3687640 - DNA, 16 bp, Homo sapiens
actcccattcctgaag

SEQ ID NO: 3687641 - DNA, 22 bp, Homo sapiens
actcccattcctgaagaaccag

SEQ ID NO: 3687642 - DNA, 14 bp, Homo sapiens
actcccccaggtgg

SEQ ID NO: 3687643 - DNA, 11 bp, Homo sapiens
actcctacctg

SEQ ID NO: 3687644 - DNA, 15 bp, Homo sapiens
actcctacctgaagg

SEQ ID NO: 3687645 - DNA, 20 bp, Homo sapiens
actcctcatccccacaatct

SEQ ID NO: 3687646 - DNA, 15 bp, Homo sapiens
actcctccctggggg

SEQ ID NO: 3687647 - DNA, 16 bp, Homo sapiens
actcctccctgggggt

SEQ ID NO: 3687648 - DNA, 14 bp, Homo sapiens
actcgcacctcttg

SEQ ID NO: 3687649 - DNA, 18 bp, Homo sapiens
actcggtctgagaagatt

SEQ ID NO: 3687650 - DNA, 16 bp, Homo sapiens
actcggtttctccaaa

SEQ ID NO: 3687651 - DNA, 15 bp, Homo sapiens
actctaccctcccac

SEQ ID NO: 3687652 - DNA, 16 bp, Homo sapiens
actctaccctcccacc

SEQ ID NO: 3687653 - DNA, 13 bp, Homo sapiens
actctacctcata

SEQ ID NO: 3687654 - DNA, 22 bp, Homo sapiens
actctacctcatatcagtttgc

SEQ ID NO: 3687655 - DNA, 14 bp, Homo sapiens
actctgcttctctg

SEQ ID NO: 3687656 - DNA, 11 bp, Homo sapiens
actctgtggcc

SEQ ID NO: 3687657 - DNA, 14 bp, Homo sapiens
actctgtggccagc

SEQ ID NO: 3687658 - DNA, 18 bp, Homo sapiens
actctgtggccagcctgg

SEQ ID NO: 3687659 - DNA, 21 bp, Homo sapiens
actctgtggccagcctggcat

SEQ ID NO: 3687660 - DNA, 22 bp, Homo sapiens
actctgtggccagcctggcatc

SEQ ID NO: 3687661 - DNA, 14 bp, Homo sapiens
actcttccctggga

SEQ ID NO: 3687662 - DNA, 15 bp, Homo sapiens
actcttccctgggaa

SEQ ID NO: 3687663 - DNA, 22 bp, Homo sapiens
actcttcctatttttgtagtga

SEQ ID NO: 3687664 - DNA, 22 bp, Homo sapiens
actcttggatgggacatttttg

SEQ ID NO: 3687665 - DNA, 14 bp, Homo sapiens
actctttatgcttg

SEQ ID NO: 3687666 - DNA, 15 bp, Homo sapiens
actctttatgcttgc

SEQ ID NO: 3687667 - DNA, 17 bp, Homo sapiens
actctttatgcttgcaa

SEQ ID NO: 3687668 - DNA, 18 bp, Homo sapiens
actgaaaaaaaaaaagaa

SEQ ID NO: 3687669 - DNA, 24 bp, Homo sapiens
actgaaaaaaaaaaagaagaagaa

SEQ ID NO: 3687670 - DNA, 21 bp, Homo sapiens
actgaaacattattttttaat

SEQ ID NO: 3687671 - DNA, 14 bp, Homo sapiens
actgaagcagcctc

SEQ ID NO: 3687672 - DNA, 21 bp, Homo sapiens
actgaagcagcctctccccag

SEQ ID NO: 3687673 - DNA, 20 bp, Homo sapiens
actgaattttgggacttcta

SEQ ID NO: 3687674 - DNA, 22 bp, Homo sapiens
actgacatgtggggccaggtca

SEQ ID NO: 3687675 - DNA, 20 bp, Homo sapiens
actgaccaaatcacccaatc

SEQ ID NO: 3687676 - DNA, 21 bp, Homo sapiens
actgaccaaatcacccaatcc

SEQ ID NO: 3687677 - DNA, 16 bp, Homo sapiens
actgaccatccactct

SEQ ID NO: 3687678 - DNA, 22 bp, Homo sapiens
actgaccatccactctaccctc

SEQ ID NO: 3687679 - DNA, 17 bp, Homo sapiens
actgactttaagtaatc

SEQ ID NO: 3687680 - DNA, 14 bp, Homo sapiens
actgagctggctga

SEQ ID NO: 3687681 - DNA, 12 bp, Homo sapiens
actgaggcaggg

SEQ ID NO: 3687682 - DNA, 20 bp, Homo sapiens
actgagggaccaactgggcc

SEQ ID NO: 3687683 - DNA, 12 bp, Homo sapiens
actgatgctgcc

SEQ ID NO: 3687684 - DNA, 20 bp, Homo sapiens
actgatgctgcccctcatct

SEQ ID NO: 3687685 - DNA, 20 bp, Homo sapiens
actgcaacttgtaaatgtgg

SEQ ID NO: 3687686 - DNA, 14 bp, Homo sapiens
actgcactccagcc

SEQ ID NO: 3687687 - DNA, 15 bp, Homo sapiens
actgcagaggggaaa

SEQ ID NO: 3687688 - DNA, 19 bp, Homo sapiens
actgcagaggggaaagact

SEQ ID NO: 3687689 - DNA, 12 bp, Homo sapiens
actgcaggccct

SEQ ID NO: 3687690 - DNA, 16 bp, Homo sapiens
actgcaggccctggcc

SEQ ID NO: 3687691 - DNA, 16 bp, Homo sapiens
actgcataccaacctg

SEQ ID NO: 3687692 - DNA, 15 bp, Homo sapiens
actgcccggcagggt

SEQ ID NO: 3687693 - DNA, 15 bp, Homo sapiens
actgcctaagccctc

SEQ ID NO: 3687694 - DNA, 15 bp, Homo sapiens
actgccttcgcttct

SEQ ID NO: 3687695 - DNA, 17 bp, Homo sapiens
actgccttcgcttcttg

SEQ ID NO: 3687696 - DNA, 22 bp, Homo sapiens
actgccttcgcttcttgcctct

SEQ ID NO: 3687697 - DNA, 21 bp, Homo sapiens
actgcgactttctgcctggag

SEQ ID NO: 3687698 - DNA, 23 bp, Homo sapiens
actgcgactttctgcctggagtg

SEQ ID NO: 3687699 - DNA, 18 bp, Homo sapiens
actgcttgtgtttttaac

SEQ ID NO: 3687700 - DNA, 16 bp, Homo sapiens
actggaacactagaca

SEQ ID NO: 3687701 - DNA, 14 bp, Homo sapiens
actggaagaaagca

SEQ ID NO: 3687702 - DNA, 15 bp, Homo sapiens
actggaagaaagcaa

SEQ ID NO: 3687703 - DNA, 22 bp, Homo sapiens
actggagataccagagactctg

SEQ ID NO: 3687704 - DNA, 11 bp, Homo sapiens
actggagcccc

SEQ ID NO: 3687705 - DNA, 22 bp, Homo sapiens
actggcaaaaggatctttgtgg

SEQ ID NO: 3687706 - DNA, 22 bp, Homo sapiens
actggcctgctgcgccccaggc

SEQ ID NO: 3687707 - DNA, 18 bp, Homo sapiens
actggctagagtcctcac

SEQ ID NO: 3687708 - DNA, 12 bp, Homo sapiens
atgctggcccag

SEQ ID NO: 3687709 - DNA, 20 bp, Homo sapiens
atgctggcccagggcccaga

SEQ ID NO: 3687710 - DNA, 21 bp, Homo sapiens
atgctggcccagggcccagag

SEQ ID NO: 3687711 - DNA, 22 bp, Homo sapiens
atgctggcccagggcccagagc

SEQ ID NO: 3687712 - DNA, 9 bp, Homo sapiens
atgctggga

SEQ ID NO: 3687713 - DNA, 10 bp, Homo sapiens
atgctgggac

SEQ ID NO: 3687714 - DNA, 14 bp, Homo sapiens
atgcttaataaaag

SEQ ID NO: 3687715 - DNA, 15 bp, Homo sapiens
atgcttaataaaaga

SEQ ID NO: 3687716 - DNA, 16 bp, Homo sapiens
atgcttaataaaagaa

SEQ ID NO: 3687717 - DNA, 20 bp, Homo sapiens
atgcttaataaaagaacatg

SEQ ID NO: 3687718 - DNA, 23 bp, Homo sapiens
atgcttacgtgatcctctcacct

SEQ ID NO: 3687719 - DNA, 15 bp, Homo sapiens
atgcttccctgcagc

SEQ ID NO: 3687720 - DNA, 17 bp, Homo sapiens
atgcttccctgcagctg

SEQ ID NO: 3687721 - DNA, 20 bp, Homo sapiens
atgcttccctgcagctgacc

SEQ ID NO: 3687722 - DNA, 16 bp, Homo sapiens
atgcttctagagtttt

SEQ ID NO: 3687723 - DNA, 12 bp, Homo sapiens
atgcttctattt

SEQ ID NO: 3687724 - DNA, 19 bp, Homo sapiens
atgcttgcaaaaactacaa

SEQ ID NO: 3687725 - DNA, 16 bp, Homo sapiens
atggaaaaataacaac

SEQ ID NO: 3687726 - DNA, 21 bp, Homo sapiens
atggaaaatcagtgacatctg

SEQ ID NO: 3687727 - DNA, 16 bp, Homo sapiens
atggaaattttgctat

SEQ ID NO: 3687728 - DNA, 18 bp, Homo sapiens
atggaaccgcaggaagct

SEQ ID NO: 3687729 - DNA, 19 bp, Homo sapiens
atggaagtgggccagtcct

SEQ ID NO: 3687730 - DNA, 20 bp, Homo sapiens
atggaagtgggccagtcctg

SEQ ID NO: 3687731 - DNA, 13 bp, Homo sapiens
atggactatctgt

SEQ ID NO: 3687732 - DNA, 21 bp, Homo sapiens
atggactatctgtctggtggc

SEQ ID NO: 3687733 - DNA, 22 bp, Homo sapiens
atggactatctgtctggtggcc

SEQ ID NO: 3687734 - DNA, 15 bp, Homo sapiens
atggagaaccaccta

SEQ ID NO: 3687735 - DNA, 16 bp, Homo sapiens
atggagctttctgtat

SEQ ID NO: 3687736 - DNA, 16 bp, Homo sapiens
atggcaacagatctgg

SEQ ID NO: 3687737 - DNA, 24 bp, Homo sapiens
atggcaacagatctggaacctcag

SEQ ID NO: 3687738 - DNA, 17 bp, Homo sapiens
atggcaggaaggcttgt

SEQ ID NO: 3687739 - DNA, 15 bp, Homo sapiens
atggcagtgtctttc

SEQ ID NO: 3687740 - DNA, 19 bp, Homo sapiens
atggcagtgtggggagggc

SEQ ID NO: 3687741 - DNA, 15 bp, Homo sapiens
atggccccagcacag

SEQ ID NO: 3687742 - DNA, 17 bp, Homo sapiens
atggccccagcacagct

SEQ ID NO: 3687743 - DNA, 14 bp, Homo sapiens
atggcccggcccct

SEQ ID NO: 3687744 - DNA, 18 bp, Homo sapiens
atggcccggcccctcctg

SEQ ID NO: 3687745 - DNA, 21 bp, Homo sapiens
atggccgggcgcggtggctca

SEQ ID NO: 3687746 - DNA, 14 bp, Homo sapiens
atggcctcagctgc

SEQ ID NO: 3687747 - DNA, 12 bp, Homo sapiens
atgggaccacaa

SEQ ID NO: 3687748 - DNA, 19 bp, Homo sapiens
atgggacctgtggctgtcg

SEQ ID NO: 3687749 - DNA, 13 bp, Homo sapiens
atgggagccccag

SEQ ID NO: 3687750 - DNA, 14 bp, Homo sapiens
atgggcacacacac

SEQ ID NO: 3687751 - DNA, 22 bp, Homo sapiens
atggggaatctaagagagctgc

SEQ ID NO: 3687752 - DNA, 15 bp, Homo sapiens
atggggcacggctct

SEQ ID NO: 3687753 - DNA, 15 bp, Homo sapiens
atggggccagatcca

SEQ ID NO: 3687754 - DNA, 18 bp, Homo sapiens
atgggggaactcagatcc

SEQ ID NO: 3687755 - DNA, 19 bp, Homo sapiens
atgggggaactcagatcca

SEQ ID NO: 3687756 - DNA, 19 bp, Homo sapiens
atgggggagtctgaagcag

SEQ ID NO: 3687757 - DNA, 21 bp, Homo sapiens
atgggggagtctgaagcagat

SEQ ID NO: 3687758 - DNA, 19 bp, Homo sapiens
atggggtggggtagggctg

SEQ ID NO: 3687759 - DNA, 20 bp, Homo sapiens
atgggtgcaaggaaaattag

SEQ ID NO: 3687760 - DNA, 16 bp, Homo sapiens
atggtaccagatgcag

SEQ ID NO: 3687761 - DNA, 14 bp, Homo sapiens
atggtatatataca

SEQ ID NO: 3687762 - DNA, 16 bp, Homo sapiens
atggtatatatacata

SEQ ID NO: 3687763 - DNA, 18 bp, Homo sapiens
atggtgccccaggaccag

SEQ ID NO: 3687764 - DNA, 21 bp, Homo sapiens
atggtgccccaggaccagctc

SEQ ID NO: 3687765 - DNA, 22 bp, Homo sapiens
atggtgccccaggaccagctca

SEQ ID NO: 3687766 - DNA, 23 bp, Homo sapiens
atggtggatgaggcttcttcctg

SEQ ID NO: 3687767 - DNA, 15 bp, Homo sapiens
atggtgtggcctgtg

SEQ ID NO: 3687768 - DNA, 20 bp, Homo sapiens
atggttaccatgggtgtgga

SEQ ID NO: 3687769 - DNA, 21 bp, Homo sapiens
atggttctgtgacccatctgt

SEQ ID NO: 3687770 - DNA, 21 bp, Homo sapiens
atggtttgaatataaacacta

SEQ ID NO: 3687771 - DNA, 22 bp, Homo sapiens
atggtttgaatataaacactat

SEQ ID NO: 3687772 - DNA, 16 bp, Homo sapiens
atggtttgcaaggaag

SEQ ID NO: 3687773 - DNA, 18 bp, Homo sapiens
atggtttttaaattttgt

SEQ ID NO: 3687774 - DNA, 19 bp, Homo sapiens
atgtaaaatcctacagtga

SEQ ID NO: 3687775 - DNA, 21 bp, Homo sapiens
atgtaaaatcctacagtgaaa

SEQ ID NO: 3687776 - DNA, 18 bp, Homo sapiens
atgtaaacataccaacat

SEQ ID NO: 3687777 - DNA, 12 bp, Homo sapiens
atgtaaacattt

SEQ ID NO: 3687778 - DNA, 13 bp, Homo sapiens
atgtaaagccatg

SEQ ID NO: 3687779 - DNA, 21 bp, Homo sapiens
atgtaaatgattttatgtttt

SEQ ID NO: 3687780 - DNA, 15 bp, Homo sapiens
atgtaagcatacttt

SEQ ID NO: 3687781 - DNA, 16 bp, Homo sapiens
atgtaagcatactttg

SEQ ID NO: 3687782 - DNA, 14 bp, Homo sapiens
atgtaagtgggccc

SEQ ID NO: 3687783 - DNA, 14 bp, Homo sapiens
atgtaataaacttt

SEQ ID NO: 3687784 - DNA, 15 bp, Homo sapiens
atgtaataaacttta

SEQ ID NO: 3687785 - DNA, 12 bp, Homo sapiens
atgtaatgtttt

SEQ ID NO: 3687786 - DNA, 18 bp, Homo sapiens
atgtacagacatatttaa

SEQ ID NO: 3687787 - DNA, 15 bp, Homo sapiens
atgtactttttagta

SEQ ID NO: 3687788 - DNA, 14 bp, Homo sapiens
atgtataatatttt

SEQ ID NO: 3687789 - DNA, 23 bp, Homo sapiens
atgtataatatttttaattaaat

SEQ ID NO: 3687790 - DNA, 14 bp, Homo sapiens
atgtatacatctta

SEQ ID NO: 3687791 - DNA, 14 bp, Homo sapiens
atgtatgattacat

SEQ ID NO: 3687792 - DNA, 12 bp, Homo sapiens
atgtatgttaat

SEQ ID NO: 3687793 - DNA, 13 bp, Homo sapiens
atgtatgttaatt

SEQ ID NO: 3687794 - DNA, 16 bp, Homo sapiens
atgtattaatgtatgt

SEQ ID NO: 3687795 - DNA, 15 bp, Homo sapiens
atgtattataacttt

SEQ ID NO: 3687796 - DNA, 19 bp, Homo sapiens
atgtatttcctggatgttt

SEQ ID NO: 3687797 - DNA, 19 bp, Homo sapiens
atgtcaaagatatgttaag

SEQ ID NO: 3687798 - DNA, 19 bp, Homo sapiens
atgtcaaagtgtaacagat

SEQ ID NO: 3687799 - DNA, 16 bp, Homo sapiens
atgtccctccaacaca

SEQ ID NO: 3687800 - DNA, 18 bp, Homo sapiens
atgtcctccagaagcctc

SEQ ID NO: 3687801 - DNA, 19 bp, Homo sapiens
atgtctactcagcatttga

SEQ ID NO: 3687802 - DNA, 20 bp, Homo sapiens
atgtctactcagcatttgat

SEQ ID NO: 3687803 - DNA, 14 bp, Homo sapiens
atgtctgcatttcg

SEQ ID NO: 3687804 - DNA, 12 bp, Homo sapiens
atgtctgtgcca

SEQ ID NO: 3687805 - DNA, 20 bp, Homo sapiens
atgtcttgctgttgacatat

SEQ ID NO: 3687806 - DNA, 17 bp, Homo sapiens
atgtgataaggaaatca

SEQ ID NO: 3687807 - DNA, 17 bp, Homo sapiens
atgtgcatagtttcttt

SEQ ID NO: 3687808 - DNA, 20 bp, Homo sapiens
atgtgggaattaagcaaaat

SEQ ID NO: 3687809 - DNA, 19 bp, Homo sapiens
atgtgtgaggagctgctgg

SEQ ID NO: 3687810 - DNA, 18 bp, Homo sapiens
atgtgtgttcctgctttt

SEQ ID NO: 3687811 - DNA, 12 bp, Homo sapiens
atgtgtttgctt

SEQ ID NO: 3687812 - DNA, 15 bp, Homo sapiens
atgtgtttgctttct

SEQ ID NO: 3687813 - DNA, 17 bp, Homo sapiens
atgttaattttttggta

SEQ ID NO: 3687814 - DNA, 22 bp, Homo sapiens
atgttaattttttggtacaaaa

SEQ ID NO: 3687815 - DNA, 17 bp, Homo sapiens
atgttacaagtttatat

SEQ ID NO: 3687816 - DNA, 20 bp, Homo sapiens
atgttacaagtttatatata

SEQ ID NO: 3687817 - DNA, 16 bp, Homo sapiens
atgttctctcttctcc

SEQ ID NO: 3687818 - DNA, 21 bp, Homo sapiens
atgttgactttttaaaattct

SEQ ID NO: 3687819 - DNA, 18 bp, Homo sapiens
atgttgatcatgtacttt

SEQ ID NO: 3687820 - DNA, 19 bp, Homo sapiens
atgttgctgttattatatt

SEQ ID NO: 3687821 - DNA, 20 bp, Homo sapiens
atgttgggaaacttggctcg

SEQ ID NO: 3687822 - DNA, 19 bp, Homo sapiens
atgtttaaaaagtttctaa

SEQ ID NO: 3687823 - DNA, 17 bp, Homo sapiens
atgtttaatctgttatg

SEQ ID NO: 3687824 - DNA, 17 bp, Homo sapiens
atgtttcacaaggtctt

SEQ ID NO: 3687825 - DNA, 14 bp, Homo sapiens
atttctcagggaag

SEQ ID NO: 3687826 - DNA, 13 bp, Homo sapiens
atttctgaactgt

SEQ ID NO: 3687827 - DNA, 11 bp, Homo sapiens
atttctgtgtt

SEQ ID NO: 3687828 - DNA, 15 bp, Homo sapiens
atttctgtgttgcca

SEQ ID NO: 3687829 - DNA, 23 bp, Homo sapiens
atttctgtgttgccaagctccaa

SEQ ID NO: 3687830 - DNA, 17 bp, Homo sapiens
atttcttcgttcttttt

SEQ ID NO: 3687831 - DNA, 16 bp, Homo sapiens
atttctttttttcctt

SEQ ID NO: 3687832 - DNA, 12 bp, Homo sapiens
atttgactaatt

SEQ ID NO: 3687833 - DNA, 13 bp, Homo sapiens
atttgactaattt

SEQ ID NO: 3687834 - DNA, 17 bp, Homo sapiens
atttgactttagtgaaa

SEQ ID NO: 3687835 - DNA, 20 bp, Homo sapiens
atttgatagtattgtgcata

SEQ ID NO: 3687836 - DNA, 17 bp, Homo sapiens
atttgatgagttaactg

SEQ ID NO: 3687837 - DNA, 22 bp, Homo sapiens
atttgatgagttaactgtgaaa

SEQ ID NO: 3687838 - DNA, 15 bp, Homo sapiens
atttggccggctctg

SEQ ID NO: 3687839 - DNA, 16 bp, Homo sapiens
atttggccggctctgg

SEQ ID NO: 3687840 - DNA, 23 bp, Homo sapiens
atttggggtagctagaggaacca

SEQ ID NO: 3687841 - DNA, 17 bp, Homo sapiens
atttgtaaagctattta

SEQ ID NO: 3687842 - DNA, 14 bp, Homo sapiens
atttgtctttttgt

SEQ ID NO: 3687843 - DNA, 21 bp, Homo sapiens
atttgtctttttgttgtaaaa

SEQ ID NO: 3687844 - DNA, 20 bp, Homo sapiens
atttgtgaactggaagaaag

SEQ ID NO: 3687845 - DNA, 16 bp, Homo sapiens
attttaaaaacataga

SEQ ID NO: 3687846 - DNA, 19 bp, Homo sapiens
attttaatttagtaaatgt

SEQ ID NO: 3687847 - DNA, 21 bp, Homo sapiens
attttaatttagtaaatgtta

SEQ ID NO: 3687848 - DNA, 17 bp, Homo sapiens
attttatttttgtatct

SEQ ID NO: 3687849 - DNA, 18 bp, Homo sapiens
attttcacagctttgagg

SEQ ID NO: 3687850 - DNA, 12 bp, Homo sapiens
attttcagagtg

SEQ ID NO: 3687851 - DNA, 20 bp, Homo sapiens
attttccccccactctcccc

SEQ ID NO: 3687852 - DNA, 16 bp, Homo sapiens
attttctattttaaga

SEQ ID NO: 3687853 - DNA, 23 bp, Homo sapiens
attttctattttaagactgattt

SEQ ID NO: 3687854 - DNA, 17 bp, Homo sapiens
attttctctgtactttt

SEQ ID NO: 3687855 - DNA, 17 bp, Homo sapiens
attttctggaaaatgct

SEQ ID NO: 3687856 - DNA, 21 bp, Homo sapiens
attttctggaaaatgcttctt

SEQ ID NO: 3687857 - DNA, 19 bp, Homo sapiens
attttgacttaatgtgatt

SEQ ID NO: 3687858 - DNA, 20 bp, Homo sapiens
attttgctaaatgtgaatga

SEQ ID NO: 3687859 - DNA, 21 bp, Homo sapiens
attttggagagtttcctgaaa

SEQ ID NO: 3687860 - DNA, 16 bp, Homo sapiens
attttgggacttctac

SEQ ID NO: 3687861 - DNA, 19 bp, Homo sapiens
attttgtatatttaggaaa

SEQ ID NO: 3687862 - DNA, 14 bp, Homo sapiens
attttgtgtaaaaa

SEQ ID NO: 3687863 - DNA, 19 bp, Homo sapiens
atttttaaaaaatattttc

SEQ ID NO: 3687864 - DNA, 20 bp, Homo sapiens
atttttaaaaaatattttct

SEQ ID NO: 3687865 - DNA, 18 bp, Homo sapiens
atttttaaaatatgtttt

SEQ ID NO: 3687866 - DNA, 15 bp, Homo sapiens
atttttaaagataga

SEQ ID NO: 3687867 - DNA, 14 bp, Homo sapiens
atttttaaagcatg

SEQ ID NO: 3687868 - DNA, 15 bp, Homo sapiens
atttttaaagcatgg

SEQ ID NO: 3687869 - DNA, 19 bp, Homo sapiens
atttttaaagtagaagagg

SEQ ID NO: 3687870 - DNA, 17 bp, Homo sapiens
atttttatataatatct

SEQ ID NO: 3687871 - DNA, 23 bp, Homo sapiens
atttttatataatatctaaagtt

SEQ ID NO: 3687872 - DNA, 19 bp, Homo sapiens
atttttcaaatcattcctt

SEQ ID NO: 3687873 - DNA, 15 bp, Homo sapiens
atttttgtaaagttt

SEQ ID NO: 3687874 - DNA, 13 bp, Homo sapiens
atttttgtaaatg

SEQ ID NO: 3687875 - DNA, 15 bp, Homo sapiens
atttttgtctgtcct

SEQ ID NO: 3687876 - DNA, 23 bp, Homo sapiens
attttttaaaacaagccaagaaa

SEQ ID NO: 3687877 - DNA, 18 bp, Homo sapiens
caaaaaagtccaatttta

SEQ ID NO: 3687878 - DNA, 15 bp, Homo sapiens
caaaaaatgttttaa

SEQ ID NO: 3687879 - DNA, 15 bp, Homo sapiens
caaaaaccaaatgtt

SEQ ID NO: 3687880 - DNA, 22 bp, Homo sapiens
caaaaactgtctttaaaagaga

SEQ ID NO: 3687881 - DNA, 13 bp, Homo sapiens
caaaaaggcagga

SEQ ID NO: 3687882 - DNA, 14 bp, Homo sapiens
caaaaataaattta

SEQ ID NO: 3687883 - DNA, 15 bp, Homo sapiens
caaaacggttttact

SEQ ID NO: 3687884 - DNA, 16 bp, Homo sapiens
caaaagaagcccccag

SEQ ID NO: 3687885 - DNA, 20 bp, Homo sapiens
caaaagatttggaaagatat

SEQ ID NO: 3687886 - DNA, 20 bp, Homo sapiens
caaaaggaagggtggctttg

SEQ ID NO: 3687887 - DNA, 19 bp, Homo sapiens
caaaaggatctttgtggcc

SEQ ID NO: 3687888 - DNA, 22 bp, Homo sapiens
caaaaggatctttgtggccaag

SEQ ID NO: 3687889 - DNA, 24 bp, Homo sapiens
caaaaggatctttgtggccaagga

SEQ ID NO: 3687890 - DNA, 15 bp, Homo sapiens
caaaataaaaaccaa

SEQ ID NO: 3687891 - DNA, 14 bp, Homo sapiens
caaaataccagagc

SEQ ID NO: 3687892 - DNA, 12 bp, Homo sapiens
caaaatagaaaa

SEQ ID NO: 3687893 - DNA, 23 bp, Homo sapiens
caaaatgtaggcttagtttgtgt

SEQ ID NO: 3687894 - DNA, 18 bp, Homo sapiens
caaaattcatttctaatt

SEQ ID NO: 3687895 - DNA, 23 bp, Homo sapiens
caaaatttgactaattttacatg

SEQ ID NO: 3687896 - DNA, 16 bp, Homo sapiens
caaacaaaaaggttct

SEQ ID NO: 3687897 - DNA, 16 bp, Homo sapiens
caaacaaagccagaag

SEQ ID NO: 3687898 - DNA, 12 bp, Homo sapiens
caaacaatgaaa

SEQ ID NO: 3687899 - DNA, 21 bp, Homo sapiens
caaacatatatatactattaa

SEQ ID NO: 3687900 - DNA, 20 bp, Homo sapiens
caaacatgtggttaatgcca

SEQ ID NO: 3687901 - DNA, 17 bp, Homo sapiens
caaaccagtatcgctca

SEQ ID NO: 3687902 - DNA, 18 bp, Homo sapiens
caaaccccacttcccctc

SEQ ID NO: 3687903 - DNA, 13 bp, Homo sapiens
caaacctggttca

SEQ ID NO: 3687904 - DNA, 12 bp, Homo sapiens
caaactcttcag

SEQ ID NO: 3687905 - DNA, 13 bp, Homo sapiens
caaactcttcagt

SEQ ID NO: 3687906 - DNA, 23 bp, Homo sapiens
caaactgcctaagccctccgcca

SEQ ID NO: 3687907 - DNA, 20 bp, Homo sapiens
caaagaggcaagaggctgga

SEQ ID NO: 3687908 - DNA, 21 bp, Homo sapiens
caaagaggttttaaaaaaatc

SEQ ID NO: 3687909 - DNA, 23 bp, Homo sapiens
caaagctaggatggttctgtgac

SEQ ID NO: 3687910 - DNA, 13 bp, Homo sapiens
caaagctgagcct

SEQ ID NO: 3687911 - DNA, 14 bp, Homo sapiens
caaagctttcctgc

SEQ ID NO: 3687912 - DNA, 16 bp, Homo sapiens
caaagctttcctgccc

SEQ ID NO: 3687913 - DNA, 17 bp, Homo sapiens
caaaggaaggtggatgg

SEQ ID NO: 3687914 - DNA, 17 bp, Homo sapiens
caaaggaggctggcagg

SEQ ID NO: 3687915 - DNA, 21 bp, Homo sapiens
caaaggcagcgtgccgagcca

SEQ ID NO: 3687916 - DNA, 14 bp, Homo sapiens
caaaggcagctgtg

SEQ ID NO: 3687917 - DNA, 22 bp, Homo sapiens
caaaggcagctgtgtctgagcc

SEQ ID NO: 3687918 - DNA, 14 bp, Homo sapiens
caaagtattgtaaa

SEQ ID NO: 3687919 - DNA, 20 bp, Homo sapiens
caaagtattgtaaattatat

SEQ ID NO: 3687920 - DNA, 22 bp, Homo sapiens
caaagtattgtaaattatattt

SEQ ID NO: 3687921 - DNA, 19 bp, Homo sapiens
caaagtgtcttttgacatt

SEQ ID NO: 3687922 - DNA, 23 bp, Homo sapiens
caaatcacccaatcccagttctt

SEQ ID NO: 3687923 - DNA, 15 bp, Homo sapiens
caaatcattccttag

SEQ ID NO: 3687924 - DNA, 19 bp, Homo sapiens
caaatggagctttctgtat

SEQ ID NO: 3687925 - DNA, 19 bp, Homo sapiens
caaatgtcctccagaagcc

SEQ ID NO: 3687926 - DNA, 18 bp, Homo sapiens
caaatgtttaaacatttt

SEQ ID NO: 3687927 - DNA, 13 bp, Homo sapiens
caaatgtttattt

SEQ ID NO: 3687928 - DNA, 14 bp, Homo sapiens
caaatgtttatttt

SEQ ID NO: 3687929 - DNA, 16 bp, Homo sapiens
caaattcttttgaatt

SEQ ID NO: 3687930 - DNA, 17 bp, Homo sapiens
caaattcttttgaattg

SEQ ID NO: 3687931 - DNA, 18 bp, Homo sapiens
caaattcttttgaattgt

SEQ ID NO: 3687932 - DNA, 15 bp, Homo sapiens
caacaataaaatttt

SEQ ID NO: 3687933 - DNA, 16 bp, Homo sapiens
caacaataaaattttt

SEQ ID NO: 3687934 - DNA, 22 bp, Homo sapiens
caacaggagctgggatcctaag

SEQ ID NO: 3687935 - DNA, 12 bp, Homo sapiens
caacagttttcc

SEQ ID NO: 3687936 - DNA, 21 bp, Homo sapiens
caacatagtattcatgactat

SEQ ID NO: 3687937 - DNA, 13 bp, Homo sapiens
caacatcttttta

SEQ ID NO: 3687938 - DNA, 23 bp, Homo sapiens
caacatgttgggaaacttggctc

SEQ ID NO: 3687939 - DNA, 15 bp, Homo sapiens
caaccactctgtggc

SEQ ID NO: 3687940 - DNA, 20 bp, Homo sapiens
caaccactctgtggccagcc

SEQ ID NO: 3687941 - DNA, 18 bp, Homo sapiens
cagaacctcttccccaga

SEQ ID NO: 3687942 - DNA, 21 bp, Homo sapiens
cagaacctcttccccagaaag

SEQ ID NO: 3687943 - DNA, 16 bp, Homo sapiens
cagaaccttgtcccag

SEQ ID NO: 3687944 - DNA, 18 bp, Homo sapiens
cagaaccttgtcccagcc

SEQ ID NO: 3687945 - DNA, 17 bp, Homo sapiens
cagaactaccaggtggc

SEQ ID NO: 3687946 - DNA, 21 bp, Homo sapiens
cagaactcaaatggggccaga

SEQ ID NO: 3687947 - DNA, 13 bp, Homo sapiens
cagaagcctctgg

SEQ ID NO: 3687948 - DNA, 21 bp, Homo sapiens
cagaagctgagcaccagggga

SEQ ID NO: 3687949 - DNA, 13 bp, Homo sapiens
cagaaggccaaga

SEQ ID NO: 3687950 - DNA, 14 bp, Homo sapiens
cagaaggccaagag

SEQ ID NO: 3687951 - DNA, 23 bp, Homo sapiens
cagaagtcagttgcaaattttag

SEQ ID NO: 3687952 - DNA, 21 bp, Homo sapiens
cagaagtgcccttcctgctgc

SEQ ID NO: 3687953 - DNA, 23 bp, Homo sapiens
cagaagtttgagatcagcctggg

SEQ ID NO: 3687954 - DNA, 13 bp, Homo sapiens
cagaatgtaagtg

SEQ ID NO: 3687955 - DNA, 18 bp, Homo sapiens
cagaatgtaagtgggccc

SEQ ID NO: 3687956 - DNA, 19 bp, Homo sapiens
cagaatgtaagtgggccca

SEQ ID NO: 3687957 - DNA, 21 bp, Homo sapiens
cagaatgtaagtgggcccacc

SEQ ID NO: 3687958 - DNA, 16 bp, Homo sapiens
cagaatgttgattaca

SEQ ID NO: 3687959 - DNA, 23 bp, Homo sapiens
cagaattactgtaactgattaca

SEQ ID NO: 3687960 - DNA, 19 bp, Homo sapiens
cagaatttgggttctgcct

SEQ ID NO: 3687961 - DNA, 15 bp, Homo sapiens
cagacacccaggact

SEQ ID NO: 3687962 - DNA, 17 bp, Homo sapiens
cagacagcaaggtgtgg

SEQ ID NO: 3687963 - DNA, 22 bp, Homo sapiens
cagacaggctcttagcagcttc

SEQ ID NO: 3687964 - DNA, 14 bp, Homo sapiens
cagacatatttaac

SEQ ID NO: 3687965 - DNA, 17 bp, Homo sapiens
cagacatatttaactgg

SEQ ID NO: 3687966 - DNA, 16 bp, Homo sapiens
cagacattctgccagg

SEQ ID NO: 3687967 - DNA, 17 bp, Homo sapiens
cagacctgatcctggag

SEQ ID NO: 3687968 - DNA, 20 bp, Homo sapiens
cagacctgatcctggaggcc

SEQ ID NO: 3687969 - DNA, 22 bp, Homo sapiens
cagacctgatcctggaggccca

SEQ ID NO: 3687970 - DNA, 14 bp, Homo sapiens
cagactcccattcc

SEQ ID NO: 3687971 - DNA, 17 bp, Homo sapiens
cagactcccattcctga

SEQ ID NO: 3687972 - DNA, 18 bp, Homo sapiens
cagactcccattcctgaa

SEQ ID NO: 3687973 - DNA, 20 bp, Homo sapiens
cagactcccattcctgaaga

SEQ ID NO: 3687974 - DNA, 19 bp, Homo sapiens
cagactctttatgcttgca

SEQ ID NO: 3687975 - DNA, 23 bp, Homo sapiens
cagactgcagaggggaaagactt

SEQ ID NO: 3687976 - DNA, 18 bp, Homo sapiens
cagactggggcatcctgt

SEQ ID NO: 3687977 - DNA, 13 bp, Homo sapiens
cagacttgtcaag

SEQ ID NO: 3687978 - DNA, 20 bp, Homo sapiens
cagactttttttaaatagta

SEQ ID NO: 3687979 - DNA, 15 bp, Homo sapiens
cagagaaaacttgcc

SEQ ID NO: 3687980 - DNA, 23 bp, Homo sapiens
cagagaagctataaattcctctt

SEQ ID NO: 3687981 - DNA, 16 bp, Homo sapiens
cagagacatacttgaa

SEQ ID NO: 3687982 - DNA, 17 bp, Homo sapiens
cagagacatacttgaag

SEQ ID NO: 3687983 - DNA, 20 bp, Homo sapiens
cagagagaaatcaggcctga

SEQ ID NO: 3687984 - DNA, 20 bp, Homo sapiens
cagagatccaaaagaagccc

SEQ ID NO: 3687985 - DNA, 14 bp, Homo sapiens
cagagcaagtgaga

SEQ ID NO: 3687986 - DNA, 20 bp, Homo sapiens
cagagcaagtgagaccctgt

SEQ ID NO: 3687987 - DNA, 16 bp, Homo sapiens
cagagccactctatga

SEQ ID NO: 3687988 - DNA, 17 bp, Homo sapiens
cagagccactctatgag

SEQ ID NO: 3687989 - DNA, 22 bp, Homo sapiens
cagagccactctatgagttgga

SEQ ID NO: 3687990 - DNA, 14 bp, Homo sapiens
cagagcccagctcc

SEQ ID NO: 3687991 - DNA, 19 bp, Homo sapiens
cagagctgtttatggcctc

SEQ ID NO: 3687992 - DNA, 20 bp, Homo sapiens
cagagctgtttatggcctca

SEQ ID NO: 3687993 - DNA, 12 bp, Homo sapiens
cagagcttctcc

SEQ ID NO: 3687994 - DNA, 14 bp, Homo sapiens
cagagcttctcctg

SEQ ID NO: 3687995 - DNA, 17 bp, Homo sapiens
cagagcttctcctgacc

SEQ ID NO: 3687996 - DNA, 18 bp, Homo sapiens
cagagcttctcctgacca

SEQ ID NO: 3687997 - DNA, 15 bp, Homo sapiens
cagagctttggtctg

SEQ ID NO: 3687998 - DNA, 15 bp, Homo sapiens
cagaggacagtctgg

SEQ ID NO: 3687999 - DNA, 18 bp, Homo sapiens
cagaggacagtctggaga

SEQ ID NO: 3688000 - DNA, 21 bp, Homo sapiens
cagaggacagtctggagaagg

SEQ ID NO: 3688001 - DNA, 18 bp, Homo sapiens
cagaggagagctgctggg

SEQ ID NO: 3688002 - DNA, 13 bp, Homo sapiens
cagaggaggggcc

SEQ ID NO: 3688003 - DNA, 14 bp, Homo sapiens
cagaggaggggccg

SEQ ID NO: 3688004 - DNA, 13 bp, Homo sapiens
cagaggccccagc

SEQ ID NO: 3688005 - DNA, 16 bp, Homo sapiens
cagaggccccagcctc

SEQ ID NO: 3688006 - DNA, 22 bp, Homo sapiens
cagaggcccccagcccagggct

SEQ ID NO: 3688007 - DNA, 23 bp, Homo sapiens
cagaggcccccagcccagggctc

SEQ ID NO: 3688008 - DNA, 12 bp, Homo sapiens
cagaggctgggt

SEQ ID NO: 3688009 - DNA, 13 bp, Homo sapiens
cagaggctgggtt

SEQ ID NO: 3688010 - DNA, 14 bp, Homo sapiens
cagaggctgggttc

SEQ ID NO: 3688011 - DNA, 19 bp, Homo sapiens
cagagggaagaaaagagct

SEQ ID NO: 3688012 - DNA, 15 bp, Homo sapiens
cagaggtaccctggg

SEQ ID NO: 3688013 - DNA, 18 bp, Homo sapiens
cagaggtaccctgggtgt

SEQ ID NO: 3688014 - DNA, 20 bp, Homo sapiens
cagagtatgtccgatggtat

SEQ ID NO: 3688015 - DNA, 22 bp, Homo sapiens
cagagtatgtccgatggtatct

SEQ ID NO: 3688016 - DNA, 15 bp, Homo sapiens
cagagtggcctggcc

SEQ ID NO: 3688017 - DNA, 23 bp, Homo sapiens
cagagtgtggccttcggacaact

SEQ ID NO: 3688018 - DNA, 20 bp, Homo sapiens
cagataaggtaaaatgccat

SEQ ID NO: 3688019 - DNA, 19 bp, Homo sapiens
cagatacttggggggctga

SEQ ID NO: 3688020 - DNA, 15 bp, Homo sapiens
cagatatcagtgtct

SEQ ID NO: 3688021 - DNA, 18 bp, Homo sapiens
cagatcacagcttcagcc

SEQ ID NO: 3688022 - DNA, 22 bp, Homo sapiens
cagatcacagcttcagccagga

SEQ ID NO: 3688023 - DNA, 12 bp, Homo sapiens
cagatccagcct

SEQ ID NO: 3688024 - DNA, 17 bp, Homo sapiens
cagatccagcctggggt

SEQ ID NO: 3688025 - DNA, 18 bp, Homo sapiens
cagatccagcctggggtc

SEQ ID NO: 3688026 - DNA, 13 bp, Homo sapiens
cagatccagggac

SEQ ID NO: 3688027 - DNA, 21 bp, Homo sapiens
cagatctagtcaatcaagtct

SEQ ID NO: 3688028 - DNA, 18 bp, Homo sapiens
cagatctggaacctcagc

SEQ ID NO: 3688029 - DNA, 20 bp, Homo sapiens
cagatctggaacctcagcct

SEQ ID NO: 3688030 - DNA, 23 bp, Homo sapiens
cagatctggaacctcagcctggc

SEQ ID NO: 3688031 - DNA, 17 bp, Homo sapiens
cagatgaatgccgtgga

SEQ ID NO: 3688032 - DNA, 16 bp, Homo sapiens
cagatgcagctcaaga

SEQ ID NO: 3688033 - DNA, 13 bp, Homo sapiens
cagatgccccaga

SEQ ID NO: 3688034 - DNA, 18 bp, Homo sapiens
cagatggaaccgcaggaa

SEQ ID NO: 3688035 - DNA, 15 bp, Homo sapiens
cagatgggacttaac

SEQ ID NO: 3688036 - DNA, 13 bp, Homo sapiens
cagatgtaatgtt

SEQ ID NO: 3688037 - DNA, 22 bp, Homo sapiens
cagatgtaatgttttctttgca

SEQ ID NO: 3688038 - DNA, 23 bp, Homo sapiens
cagatgtaatgttttctttgcaa

SEQ ID NO: 3688039 - DNA, 14 bp, Homo sapiens
cagcaaaccggggc

SEQ ID NO: 3688040 - DNA, 21 bp, Homo sapiens
cagcaagaggaaggggtgctg

SEQ ID NO: 3688041 - DNA, 15 bp, Homo sapiens
cagcaaggtgtggag

SEQ ID NO: 3688042 - DNA, 18 bp, Homo sapiens
cagcaaggtgtggaggct

SEQ ID NO: 3688043 - DNA, 19 bp, Homo sapiens
cagcaaggtgtggaggctc

SEQ ID NO: 3688044 - DNA, 24 bp, Homo sapiens
cagcaaggtgtggaggctcctgtg

SEQ ID NO: 3688045 - DNA, 12 bp, Homo sapiens
cagcacaaaatg

SEQ ID NO: 3688046 - DNA, 15 bp, Homo sapiens
cagcacagcttgacc

SEQ ID NO: 3688047 - DNA, 16 bp, Homo sapiens
cagcacagcttgacct

SEQ ID NO: 3688048 - DNA, 13 bp, Homo sapiens
cagcaccacccta

SEQ ID NO: 3688049 - DNA, 18 bp, Homo sapiens
cagcaccgaggggccttt

SEQ ID NO: 3688050 - DNA, 16 bp, Homo sapiens
cagcaccttgtgcctg

SEQ ID NO: 3688051 - DNA, 17 bp, Homo sapiens
cagcaccttgtgcctgg

SEQ ID NO: 3688052 - DNA, 18 bp, Homo sapiens
cagcaccttgtgcctggg

SEQ ID NO: 3688053 - DNA, 19 bp, Homo sapiens
cagcaccttgtgcctgggg

SEQ ID NO: 3688054 - DNA, 20 bp, Homo sapiens
cagcaccttgtgcctggggt

SEQ ID NO: 3688055 - DNA, 18 bp, Homo sapiens
cagcacttcaaagaagct

SEQ ID NO: 3688056 - DNA, 15 bp, Homo sapiens
cagcagactgtgttt

SEQ ID NO: 3688057 - DNA, 14 bp, Homo sapiens
catctcaaccatcc

SEQ ID NO: 3688058 - DNA, 16 bp, Homo sapiens
catctcaaccatcccc

SEQ ID NO: 3688059 - DNA, 17 bp, Homo sapiens
catctcacctcctgctg

SEQ ID NO: 3688060 - DNA, 18 bp, Homo sapiens
catctcacctcctgctgg

SEQ ID NO: 3688061 - DNA, 14 bp, Homo sapiens
catctcaggccaga

SEQ ID NO: 3688062 - DNA, 18 bp, Homo sapiens
catctcaggccagagcca

SEQ ID NO: 3688063 - DNA, 16 bp, Homo sapiens
catctctacaaaaagc

SEQ ID NO: 3688064 - DNA, 19 bp, Homo sapiens
catctgaaggggcaaattc

SEQ ID NO: 3688065 - DNA, 21 bp, Homo sapiens
catctgaccagcagcgccttt

SEQ ID NO: 3688066 - DNA, 20 bp, Homo sapiens
catctgagaaacctgttgaa

SEQ ID NO: 3688067 - DNA, 14 bp, Homo sapiens
catctgcccctccc

SEQ ID NO: 3688068 - DNA, 18 bp, Homo sapiens
catctgttctatgcttcc

SEQ ID NO: 3688069 - DNA, 17 bp, Homo sapiens
catcttagacctccaca

SEQ ID NO: 3688070 - DNA, 15 bp, Homo sapiens
catcttgaccaagca

SEQ ID NO: 3688071 - DNA, 15 bp, Homo sapiens
catcttgcacacact

SEQ ID NO: 3688072 - DNA, 22 bp, Homo sapiens
catcttgcctccaggtgcagag

SEQ ID NO: 3688073 - DNA, 13 bp, Homo sapiens
catcttgcttccc

SEQ ID NO: 3688074 - DNA, 15 bp, Homo sapiens
catgaaaatgcaaca

SEQ ID NO: 3688075 - DNA, 15 bp, Homo sapiens
catgaaggtttctga

SEQ ID NO: 3688076 - DNA, 17 bp, Homo sapiens
catgaataacatttaaa

SEQ ID NO: 3688077 - DNA, 22 bp, Homo sapiens
catgaataacatttaaattcca

SEQ ID NO: 3688078 - DNA, 20 bp, Homo sapiens
catgatgcctctgtcttctg

SEQ ID NO: 3688079 - DNA, 14 bp, Homo sapiens
catgatgcgggcca

SEQ ID NO: 3688080 - DNA, 15 bp, Homo sapiens
catgatgcgggccag

SEQ ID NO: 3688081 - DNA, 14 bp, Homo sapiens
catgatgctagcca

SEQ ID NO: 3688082 - DNA, 15 bp, Homo sapiens
catgcaagcagagga

SEQ ID NO: 3688083 - DNA, 17 bp, Homo sapiens
catgcaagcagaggacc

SEQ ID NO: 3688084 - DNA, 22 bp, Homo sapiens
catgcaagcagaggaccagggc

SEQ ID NO: 3688085 - DNA, 23 bp, Homo sapiens
catgcaagcagaggaccagggcc

SEQ ID NO: 3688086 - DNA, 14 bp, Homo sapiens
catgcagtgctctt

SEQ ID NO: 3688087 - DNA, 21 bp, Homo sapiens
catgcagtgctctttgtagct

SEQ ID NO: 3688088 - DNA, 23 bp, Homo sapiens
catgcataagaaatgtagctgaa

SEQ ID NO: 3688089 - DNA, 15 bp, Homo sapiens
catgcatctgtttat

SEQ ID NO: 3688090 - DNA, 15 bp, Homo sapiens
catgcattgagctgc

SEQ ID NO: 3688091 - DNA, 18 bp, Homo sapiens
catgcattgagctgcctc

SEQ ID NO: 3688092 - DNA, 14 bp, Homo sapiens
catgcccacctgcc

SEQ ID NO: 3688093 - DNA, 13 bp, Homo sapiens
catgccctcctct

SEQ ID NO: 3688094 - DNA, 15 bp, Homo sapiens
catgccctcctctcc

SEQ ID NO: 3688095 - DNA, 20 bp, Homo sapiens
catgccctcctctcccattg

SEQ ID NO: 3688096 - DNA, 12 bp, Homo sapiens
catgcccttctg

SEQ ID NO: 3688097 - DNA, 13 bp, Homo sapiens
catgcccttctga

SEQ ID NO: 3688098 - DNA, 20 bp, Homo sapiens
catgcctgtccagcctgggc

SEQ ID NO: 3688099 - DNA, 23 bp, Homo sapiens
catgcctgtccagcctgggcagc

SEQ ID NO: 3688100 - DNA, 14 bp, Homo sapiens
catgcgctcagggc

SEQ ID NO: 3688101 - DNA, 16 bp, Homo sapiens
catgctcatctgctgg

SEQ ID NO: 3688102 - DNA, 17 bp, Homo sapiens
catgctcatctgctggt

SEQ ID NO: 3688103 - DNA, 13 bp, Homo sapiens
catgctcctggcc

SEQ ID NO: 3688104 - DNA, 18 bp, Homo sapiens
catgctggagtacccagc

SEQ ID NO: 3688105 - DNA, 20 bp, Homo sapiens
catgctggagtacccagcct

SEQ ID NO: 3688106 - DNA, 21 bp, Homo sapiens
catgctggagtacccagccta

SEQ ID NO: 3688107 - DNA, 14 bp, Homo sapiens
catgcttccctgca

SEQ ID NO: 3688108 - DNA, 16 bp, Homo sapiens
catgcttccctgcagc

SEQ ID NO: 3688109 - DNA, 23 bp, Homo sapiens
catggagtcatcttgcacacact

SEQ ID NO: 3688110 - DNA, 20 bp, Homo sapiens
catggccagcgcccctcagc

SEQ ID NO: 3688111 - DNA, 22 bp, Homo sapiens
catggccagcgcccctcagcct

SEQ ID NO: 3688112 - DNA, 15 bp, Homo sapiens
catggccccaggccc

SEQ ID NO: 3688113 - DNA, 14 bp, Homo sapiens
catggcgggactgg

SEQ ID NO: 3688114 - DNA, 17 bp, Homo sapiens
catggctccggcctctg

SEQ ID NO: 3688115 - DNA, 12 bp, Homo sapiens
catggctgtgtt

SEQ ID NO: 3688116 - DNA, 14 bp, Homo sapiens
catgggaaggggag

SEQ ID NO: 3688117 - DNA, 20 bp, Homo sapiens
catggggcgggtcctagctg

SEQ ID NO: 3688118 - DNA, 21 bp, Homo sapiens
catggggtggggtagggctga

SEQ ID NO: 3688119 - DNA, 15 bp, Homo sapiens
catggtgccccagga

SEQ ID NO: 3688120 - DNA, 16 bp, Homo sapiens
catggtgccccaggac

SEQ ID NO: 3688121 - DNA, 17 bp, Homo sapiens
catggtgccccaggacc

SEQ ID NO: 3688122 - DNA, 16 bp, Homo sapiens
catggtggacccagcg

SEQ ID NO: 3688123 - DNA, 14 bp, Homo sapiens
catggtgtgttaca

SEQ ID NO: 3688124 - DNA, 15 bp, Homo sapiens
catggtgtgttacac

SEQ ID NO: 3688125 - DNA, 23 bp, Homo sapiens
catggtgtttttataaagaattc

SEQ ID NO: 3688126 - DNA, 22 bp, Homo sapiens
catgtaaccggcatgtttccag

SEQ ID NO: 3688127 - DNA, 15 bp, Homo sapiens
catgtaactatttct

SEQ ID NO: 3688128 - DNA, 23 bp, Homo sapiens
catgtccagcaccttgtgcctgg

SEQ ID NO: 3688129 - DNA, 19 bp, Homo sapiens
catgtcctttgcgcctgtg

SEQ ID NO: 3688130 - DNA, 14 bp, Homo sapiens
catgtctgcatttc

SEQ ID NO: 3688131 - DNA, 15 bp, Homo sapiens
catgtctgcatttcg

SEQ ID NO: 3688132 - DNA, 17 bp, Homo sapiens
catgtgcatagtttctt

SEQ ID NO: 3688133 - DNA, 11 bp, Homo sapiens
catgtgctgca

SEQ ID NO: 3688134 - DNA, 13 bp, Homo sapiens
catgtggctggaa

SEQ ID NO: 3688135 - DNA, 14 bp, Homo sapiens
catgtggggccagg

SEQ ID NO: 3688136 - DNA, 18 bp, Homo sapiens
catgtggggccaggtcac

SEQ ID NO: 3688137 - DNA, 23 bp, Homo sapiens
catgtggggccaggtcacccttt

SEQ ID NO: 3688138 - DNA, 17 bp, Homo sapiens
catgtggttaatgccat

SEQ ID NO: 3688139 - DNA, 21 bp, Homo sapiens
catgttgatcatgtacttttt

SEQ ID NO: 3688140 - DNA, 19 bp, Homo sapiens
catgttgggaaacttggct

SEQ ID NO: 3688141 - DNA, 21 bp, Homo sapiens
catgttgggaaacttggctcg

SEQ ID NO: 3688142 - DNA, 14 bp, Homo sapiens
catgtttaaacctg

SEQ ID NO: 3688143 - DNA, 13 bp, Homo sapiens
catgtttcctcta

SEQ ID NO: 3688144 - DNA, 16 bp, Homo sapiens
catgttttcaactgcc

SEQ ID NO: 3688145 - DNA, 13 bp, Homo sapiens
cattaacacaaag

SEQ ID NO: 3688146 - DNA, 19 bp, Homo sapiens
cattagaagacaattgaca

SEQ ID NO: 3688147 - DNA, 18 bp, Homo sapiens
cattagccagatttgtct

SEQ ID NO: 3688148 - DNA, 22 bp, Homo sapiens
cattattatataaatcatgatg

SEQ ID NO: 3688149 - DNA, 11 bp, Homo sapiens
cattattatta

SEQ ID NO: 3688150 - DNA, 12 bp, Homo sapiens
cattcatcctga

SEQ ID NO: 3688151 - DNA, 15 bp, Homo sapiens
cattccagcccctct

SEQ ID NO: 3688152 - DNA, 12 bp, Homo sapiens
cattctgactcg

SEQ ID NO: 3688153 - DNA, 23 bp, Homo sapiens
cattctgactcggtttctccaaa

SEQ ID NO: 3688154 - DNA, 20 bp, Homo sapiens
cattcttaacaaactcttca

SEQ ID NO: 3688155 - DNA, 20 bp, Homo sapiens
cattcttggcttaatcattt

SEQ ID NO: 3688156 - DNA, 23 bp, Homo sapiens
cattgagctgcctccagcctggt

SEQ ID NO: 3688157 - DNA, 20 bp, Homo sapiens
cattgatgatcactgtgaaa

SEQ ID NO: 3688158 - DNA, 16 bp, Homo sapiens
cattgatggggaagga

SEQ ID NO: 3688159 - DNA, 19 bp, Homo sapiens
cattgatggggaaggaggc

SEQ ID NO: 3688160 - DNA, 21 bp, Homo sapiens
cattgccttaactggagcccc

SEQ ID NO: 3688161 - DNA, 22 bp, Homo sapiens
cattgcctttgaatgttaattt

SEQ ID NO: 3688162 - DNA, 22 bp, Homo sapiens
cattggagctgactgttcttgg

SEQ ID NO: 3688163 - DNA, 20 bp, Homo sapiens
cattgggaccctccagtgct

SEQ ID NO: 3688164 - DNA, 21 bp, Homo sapiens
cattgtgggatgttcagcact

SEQ ID NO: 3688165 - DNA, 15 bp, Homo sapiens
catttaaaaaaaatc

SEQ ID NO: 3688166 - DNA, 12 bp, Homo sapiens
catttaaattcc

SEQ ID NO: 3688167 - DNA, 15 bp, Homo sapiens
catttaaattccaca

SEQ ID NO: 3688168 - DNA, 12 bp, Homo sapiens
catttactgaaa

SEQ ID NO: 3688169 - DNA, 14 bp, Homo sapiens
catttagctggcca

SEQ ID NO: 3688170 - DNA, 16 bp, Homo sapiens
catttcacttttctgt

SEQ ID NO: 3688171 - DNA, 17 bp, Homo sapiens
catttcacttttctgta

SEQ ID NO: 3688172 - DNA, 13 bp, Homo sapiens
catttccaagctg

SEQ ID NO: 3688173 - DNA, 23 bp, Homo sapiens
catttccaagctgttagttgctg

SEQ ID NO: 3688174 - DNA, 16 bp, Homo sapiens
ccaggaccctgaaggg

SEQ ID NO: 3688175 - DNA, 21 bp, Homo sapiens
ccaggactatatttgggcctg

SEQ ID NO: 3688176 - DNA, 16 bp, Homo sapiens
ccaggactccctcctc

SEQ ID NO: 3688177 - DNA, 23 bp, Homo sapiens
ccaggactccctcctcacctctg

SEQ ID NO: 3688178 - DNA, 13 bp, Homo sapiens
ccaggagataatt

SEQ ID NO: 3688179 - DNA, 22 bp, Homo sapiens
ccaggagcaagtgaggccggag

SEQ ID NO: 3688180 - DNA, 23 bp, Homo sapiens
ccaggagctgggcagaaggccaa

SEQ ID NO: 3688181 - DNA, 20 bp, Homo sapiens
ccaggatctttgactgaaaa

SEQ ID NO: 3688182 - DNA, 19 bp, Homo sapiens
ccaggcagatccaggacta

SEQ ID NO: 3688183 - DNA, 13 bp, Homo sapiens
ccaggcagatctg

SEQ ID NO: 3688184 - DNA, 21 bp, Homo sapiens
ccaggcagatctgtgccccat

SEQ ID NO: 3688185 - DNA, 23 bp, Homo sapiens
ccaggcagatctgtgccccatgc

SEQ ID NO: 3688186 - DNA, 10 bp, Homo sapiens
ccaggcaggg

SEQ ID NO: 3688187 - DNA, 12 bp, Homo sapiens
ccaggcagggag

SEQ ID NO: 3688188 - DNA, 13 bp, Homo sapiens
ccaggcagggaga

SEQ ID NO: 3688189 - DNA, 17 bp, Homo sapiens
ccaggccacctccccag

SEQ ID NO: 3688190 - DNA, 21 bp, Homo sapiens
ccaggccacctccccagcatt

SEQ ID NO: 3688191 - DNA, 15 bp, Homo sapiens
ccaggccccaggaag

SEQ ID NO: 3688192 - DNA, 17 bp, Homo sapiens
ccaggccccaggaagcc

SEQ ID NO: 3688193 - DNA, 18 bp, Homo sapiens
ccaggccctcctctccca

SEQ ID NO: 3688194 - DNA, 20 bp, Homo sapiens
ccaggcgcgccgacgcctgt

SEQ ID NO: 3688195 - DNA, 20 bp, Homo sapiens
ccaggcggggcgccccaaga

SEQ ID NO: 3688196 - DNA, 23 bp, Homo sapiens
ccaggcggggcgccccaagagcc

SEQ ID NO: 3688197 - DNA, 11 bp, Homo sapiens
ccaggctccaa

SEQ ID NO: 3688198 - DNA, 15 bp, Homo sapiens
ccaggctccaatggg

SEQ ID NO: 3688199 - DNA, 19 bp, Homo sapiens
ccaggctccaatggggcgg

SEQ ID NO: 3688200 - DNA, 18 bp, Homo sapiens
ccaggctgcccagagctg

SEQ ID NO: 3688201 - DNA, 19 bp, Homo sapiens
ccaggctgcccagagctgc

SEQ ID NO: 3688202 - DNA, 20 bp, Homo sapiens
ccaggctgcccagagctgct

SEQ ID NO: 3688203 - DNA, 21 bp, Homo sapiens
ccaggctgcccagagctgctg

SEQ ID NO: 3688204 - DNA, 14 bp, Homo sapiens
ccaggctgccgtgg

SEQ ID NO: 3688205 - DNA, 13 bp, Homo sapiens
ccaggctgctcag

SEQ ID NO: 3688206 - DNA, 17 bp, Homo sapiens
ccaggctgctcagggct

SEQ ID NO: 3688207 - DNA, 18 bp, Homo sapiens
ccagggaagctggccgag

SEQ ID NO: 3688208 - DNA, 18 bp, Homo sapiens
ccagggacagaggcccca

SEQ ID NO: 3688209 - DNA, 20 bp, Homo sapiens
ccagggacagaggccccagc

SEQ ID NO: 3688210 - DNA, 23 bp, Homo sapiens
ccagggacagaggccccagcctc

SEQ ID NO: 3688211 - DNA, 14 bp, Homo sapiens
ccagggagaagctc

SEQ ID NO: 3688212 - DNA, 19 bp, Homo sapiens
ccagggagcggaaagcagc

SEQ ID NO: 3688213 - DNA, 23 bp, Homo sapiens
ccagggagcggaaagcagctcaa

SEQ ID NO: 3688214 - DNA, 23 bp, Homo sapiens
ccagggaggggccggccctgtgt

SEQ ID NO: 3688215 - DNA, 19 bp, Homo sapiens
ccagggcccagagcccagc

SEQ ID NO: 3688216 - DNA, 23 bp, Homo sapiens
ccagggcccagagcccagctcca

SEQ ID NO: 3688217 - DNA, 21 bp, Homo sapiens
ccagggccttttctggcaccg

SEQ ID NO: 3688218 - DNA, 13 bp, Homo sapiens
ccagggctcctgc

SEQ ID NO: 3688219 - DNA, 17 bp, Homo sapiens
ccaggggtcccagccac

SEQ ID NO: 3688220 - DNA, 14 bp, Homo sapiens
ccagggtatgacct

SEQ ID NO: 3688221 - DNA, 16 bp, Homo sapiens
ccagggtccctctgtg

SEQ ID NO: 3688222 - DNA, 18 bp, Homo sapiens
ccagggtccctctgtgta

SEQ ID NO: 3688223 - DNA, 14 bp, Homo sapiens
ccaggtagaacaca

SEQ ID NO: 3688224 - DNA, 13 bp, Homo sapiens
ccaggtccagctc

SEQ ID NO: 3688225 - DNA, 14 bp, Homo sapiens
ccaggtccagctct

SEQ ID NO: 3688226 - DNA, 15 bp, Homo sapiens
ccaggtccagctctg

SEQ ID NO: 3688227 - DNA, 17 bp, Homo sapiens
ccaggtccagctctgga

SEQ ID NO: 3688228 - DNA, 19 bp, Homo sapiens
ccaggtccagctctggagg

SEQ ID NO: 3688229 - DNA, 14 bp, Homo sapiens
ccaggtgcagaggt

SEQ ID NO: 3688230 - DNA, 15 bp, Homo sapiens
ccaggtgcatttctt

SEQ ID NO: 3688231 - DNA, 21 bp, Homo sapiens
ccaggtgcctttcaaatttag

SEQ ID NO: 3688232 - DNA, 17 bp, Homo sapiens
ccaggtggcaaagtact

SEQ ID NO: 3688233 - DNA, 17 bp, Homo sapiens
ccaggtgtgcccctcca

SEQ ID NO: 3688234 - DNA, 22 bp, Homo sapiens
ccaggtgtgcccctccaagtca

SEQ ID NO: 3688235 - DNA, 12 bp, Homo sapiens
ccaggttacctc

SEQ ID NO: 3688236 - DNA, 23 bp, Homo sapiens
ccaggttctccgttagctcctgt

SEQ ID NO: 3688237 - DNA, 13 bp, Homo sapiens
ccaggtttaagct

SEQ ID NO: 3688238 - DNA, 19 bp, Homo sapiens
ccagtaacgcgtcttcctg

SEQ ID NO: 3688239 - DNA, 21 bp, Homo sapiens
ccagtaagggcgtggctctgg

SEQ ID NO: 3688240 - DNA, 21 bp, Homo sapiens
ccagtccaaatgtcctccaga

SEQ ID NO: 3688241 - DNA, 17 bp, Homo sapiens
ccagtccaccctgcctg

SEQ ID NO: 3688242 - DNA, 18 bp, Homo sapiens
ccagtccaccctgcctgc

SEQ ID NO: 3688243 - DNA, 13 bp, Homo sapiens
ccagtccaggctg

SEQ ID NO: 3688244 - DNA, 14 bp, Homo sapiens
ccagtccaggctgc

SEQ ID NO: 3688245 - DNA, 18 bp, Homo sapiens
ccagtcctgcctggccag

SEQ ID NO: 3688246 - DNA, 19 bp, Homo sapiens
ccagtcctgcctggccagg

SEQ ID NO: 3688247 - DNA, 21 bp, Homo sapiens
ccagtctgtggatcagagatg

SEQ ID NO: 3688248 - DNA, 15 bp, Homo sapiens
ccagtgaagatattt

SEQ ID NO: 3688249 - DNA, 15 bp, Homo sapiens
ccagtgacagacagg

SEQ ID NO: 3688250 - DNA, 17 bp, Homo sapiens
ccagtgacagacaggct

SEQ ID NO: 3688251 - DNA, 21 bp, Homo sapiens
ccagtgacagacaggctctta

SEQ ID NO: 3688252 - DNA, 15 bp, Homo sapiens
ccagtgcatggtggc

SEQ ID NO: 3688253 - DNA, 16 bp, Homo sapiens
ccagtgcccccactga

SEQ ID NO: 3688254 - DNA, 14 bp, Homo sapiens
ccagtgctggattt

SEQ ID NO: 3688255 - DNA, 16 bp, Homo sapiens
ccagtgggagatgtta

SEQ ID NO: 3688256 - DNA, 20 bp, Homo sapiens
ccagtgtaaacttccgttca

SEQ ID NO: 3688257 - DNA, 13 bp, Homo sapiens
ccagttaattttt

SEQ ID NO: 3688258 - DNA, 21 bp, Homo sapiens
ccagttcctttcaatggtttg

SEQ ID NO: 3688259 - DNA, 23 bp, Homo sapiens
ccagttcctttcaatggtttgca

SEQ ID NO: 3688260 - DNA, 15 bp, Homo sapiens
ccagttggagttttt

SEQ ID NO: 3688261 - DNA, 13 bp, Homo sapiens
ccatacccacaat

SEQ ID NO: 3688262 - DNA, 20 bp, Homo sapiens
ccatacccacaatctgagca

SEQ ID NO: 3688263 - DNA, 20 bp, Homo sapiens
ccatcacagggttgggccca

SEQ ID NO: 3688264 - DNA, 13 bp, Homo sapiens
ccatcaccagaca

SEQ ID NO: 3688265 - DNA, 13 bp, Homo sapiens
ccatcatcctact

SEQ ID NO: 3688266 - DNA, 19 bp, Homo sapiens
ccatccactctaccctccc

SEQ ID NO: 3688267 - DNA, 18 bp, Homo sapiens
ccatccagtgacaaacca

SEQ ID NO: 3688268 - DNA, 17 bp, Homo sapiens
ccatccccgcagtgtgc

SEQ ID NO: 3688269 - DNA, 14 bp, Homo sapiens
ccatcctctgcctc

SEQ ID NO: 3688270 - DNA, 16 bp, Homo sapiens
ccatcgctgtcatctc

SEQ ID NO: 3688271 - DNA, 14 bp, Homo sapiens
ccatctagccagcc

SEQ ID NO: 3688272 - DNA, 14 bp, Homo sapiens
ccatctagtcacaa

SEQ ID NO: 3688273 - DNA, 17 bp, Homo sapiens
ccatctcacctcctgct

SEQ ID NO: 3688274 - DNA, 23 bp, Homo sapiens
ccatctcacctcctgctgggcag

SEQ ID NO: 3688275 - DNA, 19 bp, Homo sapiens
ccatctgcacccccctggg

SEQ ID NO: 3688276 - DNA, 21 bp, Homo sapiens
ccatcttgcttccctaatcta

SEQ ID NO: 3688277 - DNA, 16 bp, Homo sapiens
ccatgatccctgtgtt

SEQ ID NO: 3688278 - DNA, 15 bp, Homo sapiens
ccatgatggcaacag

SEQ ID NO: 3688279 - DNA, 19 bp, Homo sapiens
ccatgattaaccacttcag

SEQ ID NO: 3688280 - DNA, 15 bp, Homo sapiens
ccatgcaagcagagg

SEQ ID NO: 3688281 - DNA, 17 bp, Homo sapiens
ccatgcaagcagaggac

SEQ ID NO: 3688282 - DNA, 17 bp, Homo sapiens
ccatgcactgtgaagga

SEQ ID NO: 3688283 - DNA, 23 bp, Homo sapiens
ccatgcctgtagctttcctggtc

SEQ ID NO: 3688284 - DNA, 19 bp, Homo sapiens
ccatgcctgtccagcctgg

SEQ ID NO: 3688285 - DNA, 14 bp, Homo sapiens
ccatgcgccccctc

SEQ ID NO: 3688286 - DNA, 16 bp, Homo sapiens
ccatgctcatctgctg

SEQ ID NO: 3688287 - DNA, 20 bp, Homo sapiens
ccatgctcatctgctggtcc

SEQ ID NO: 3688288 - DNA, 20 bp, Homo sapiens
ccatgctgaggcctgggccg

SEQ ID NO: 3688289 - DNA, 16 bp, Homo sapiens
ccatggccccaggccc

SEQ ID NO: 3688290 - DNA, 23 bp, Homo sapiens
cctacttagggaagaaaaagcaa

SEQ ID NO: 3688291 - DNA, 14 bp, Homo sapiens
cctagactgttact

SEQ ID NO: 3688292 - DNA, 15 bp, Homo sapiens
cctagactgttactt

SEQ ID NO: 3688293 - DNA, 17 bp, Homo sapiens
cctagagggaggggcct

SEQ ID NO: 3688294 - DNA, 17 bp, Homo sapiens
cctagcactttgggagg

SEQ ID NO: 3688295 - DNA, 23 bp, Homo sapiens
cctagcagcccaccctgctgctg

SEQ ID NO: 3688296 - DNA, 16 bp, Homo sapiens
cctaggaaactcacac

SEQ ID NO: 3688297 - DNA, 22 bp, Homo sapiens
cctaggaaactcacactcccct

SEQ ID NO: 3688298 - DNA, 14 bp, Homo sapiens
cctaggcctcagcc

SEQ ID NO: 3688299 - DNA, 16 bp, Homo sapiens
cctagtaagtgcctgc

SEQ ID NO: 3688300 - DNA, 18 bp, Homo sapiens
cctagtaagtgcctgctg

SEQ ID NO: 3688301 - DNA, 21 bp, Homo sapiens
cctagtcccttcccctccctg

SEQ ID NO: 3688302 - DNA, 13 bp, Homo sapiens
cctatatatttct

SEQ ID NO: 3688303 - DNA, 17 bp, Homo sapiens
cctatctttacatctat

SEQ ID NO: 3688304 - DNA, 16 bp, Homo sapiens
cctatgtagtccgtgc

SEQ ID NO: 3688305 - DNA, 16 bp, Homo sapiens
cctattagagaagaga

SEQ ID NO: 3688306 - DNA, 19 bp, Homo sapiens
cctcaaggtgcggggagaa

SEQ ID NO: 3688307 - DNA, 23 bp, Homo sapiens
cctcaatgccagtaacgcgtctt

SEQ ID NO: 3688308 - DNA, 22 bp, Homo sapiens
cctcaccctgccttatcttgca

SEQ ID NO: 3688309 - DNA, 14 bp, Homo sapiens
cctcacgcaagtgc

SEQ ID NO: 3688310 - DNA, 20 bp, Homo sapiens
cctcactcccttcccataag

SEQ ID NO: 3688311 - DNA, 23 bp, Homo sapiens
cctcactcgggtttctctgtggc

SEQ ID NO: 3688312 - DNA, 11 bp, Homo sapiens
cctcagccaga

SEQ ID NO: 3688313 - DNA, 13 bp, Homo sapiens
cctcagcctggcc

SEQ ID NO: 3688314 - DNA, 17 bp, Homo sapiens
cctcagcctggccagac

SEQ ID NO: 3688315 - DNA, 20 bp, Homo sapiens
cctcagcctggccagacaca

SEQ ID NO: 3688316 - DNA, 12 bp, Homo sapiens
cctcagcctggg

SEQ ID NO: 3688317 - DNA, 13 bp, Homo sapiens
cctcagcctgggg

SEQ ID NO: 3688318 - DNA, 18 bp, Homo sapiens
cctcagccttgccagaga

SEQ ID NO: 3688319 - DNA, 14 bp, Homo sapiens
cctcagctgcctca

SEQ ID NO: 3688320 - DNA, 17 bp, Homo sapiens
cctcagctgcctcactt

SEQ ID NO: 3688321 - DNA, 12 bp, Homo sapiens
cctcaggcaggt

SEQ ID NO: 3688322 - DNA, 18 bp, Homo sapiens
cctcaggtgagaagcaga

SEQ ID NO: 3688323 - DNA, 20 bp, Homo sapiens
cctcaggtgagaagcagagg

SEQ ID NO: 3688324 - DNA, 18 bp, Homo sapiens
cctcagttcccttggcct

SEQ ID NO: 3688325 - DNA, 20 bp, Homo sapiens
cctcagttcccttggcctca

SEQ ID NO: 3688326 - DNA, 20 bp, Homo sapiens
cctcatctctctgcccaacc

SEQ ID NO: 3688327 - DNA, 19 bp, Homo sapiens
cctcatggtgggttcaggg

SEQ ID NO: 3688328 - DNA, 18 bp, Homo sapiens
cctcatgtggctggaaga

SEQ ID NO: 3688329 - DNA, 18 bp, Homo sapiens
cctcattagcattttgct

SEQ ID NO: 3688330 - DNA, 13 bp, Homo sapiens
cctcattccttgt

SEQ ID NO: 3688331 - DNA, 20 bp, Homo sapiens
cctcattccttgtcttgata

SEQ ID NO: 3688332 - DNA, 23 bp, Homo sapiens
cctcatttttgaatacaggcata

SEQ ID NO: 3688333 - DNA, 12 bp, Homo sapiens
cctccacagctt

SEQ ID NO: 3688334 - DNA, 18 bp, Homo sapiens
cctccaccaaaccccact

SEQ ID NO: 3688335 - DNA, 12 bp, Homo sapiens
cctccagaagcc

SEQ ID NO: 3688336 - DNA, 17 bp, Homo sapiens
cctccagaagcctctgg

SEQ ID NO: 3688337 - DNA, 18 bp, Homo sapiens
cctccagaagcctctggc

SEQ ID NO: 3688338 - DNA, 20 bp, Homo sapiens
cctccagaagcctctggcta

SEQ ID NO: 3688339 - DNA, 13 bp, Homo sapiens
cctccagcctggt

SEQ ID NO: 3688340 - DNA, 13 bp, Homo sapiens
cctcccaaagagg

SEQ ID NO: 3688341 - DNA, 17 bp, Homo sapiens
cctcccaagctgtgctg

SEQ ID NO: 3688342 - DNA, 18 bp, Homo sapiens
cctcccaagctgtgctgg

SEQ ID NO: 3688343 - DNA, 23 bp, Homo sapiens
cctcccaagctgtgctgggaagc

SEQ ID NO: 3688344 - DNA, 20 bp, Homo sapiens
cctcccaatttcagactccc

SEQ ID NO: 3688345 - DNA, 19 bp, Homo sapiens
cctcccacacccaaagctg

SEQ ID NO: 3688346 - DNA, 13 bp, Homo sapiens
cctcccaccccct

SEQ ID NO: 3688347 - DNA, 20 bp, Homo sapiens
cctcccacccccttctctgc

SEQ ID NO: 3688348 - DNA, 18 bp, Homo sapiens
cctcccagaacacactcc

SEQ ID NO: 3688349 - DNA, 22 bp, Homo sapiens
cctccccagcattccagcccct

SEQ ID NO: 3688350 - DNA, 22 bp, Homo sapiens
cctcccccaacccccaccccac

SEQ ID NO: 3688351 - DNA, 12 bp, Homo sapiens
cctcccctgcca

SEQ ID NO: 3688352 - DNA, 13 bp, Homo sapiens
cctcccctgccac

SEQ ID NO: 3688353 - DNA, 15 bp, Homo sapiens
cctcccctgccctgg

SEQ ID NO: 3688354 - DNA, 18 bp, Homo sapiens
cctccctctctcttctgc

SEQ ID NO: 3688355 - DNA, 20 bp, Homo sapiens
cctccctgcatctgaccagc

SEQ ID NO: 3688356 - DNA, 21 bp, Homo sapiens
cctccctgcatctgaccagca

SEQ ID NO: 3688357 - DNA, 13 bp, Homo sapiens
cctccctggagct

SEQ ID NO: 3688358 - DNA, 12 bp, Homo sapiens
cctccctggctc

SEQ ID NO: 3688359 - DNA, 18 bp, Homo sapiens
cctccctggctcccatga

SEQ ID NO: 3688360 - DNA, 20 bp, Homo sapiens
cctccctggctcccatgacc

SEQ ID NO: 3688361 - DNA, 13 bp, Homo sapiens
cctccctgggggc

SEQ ID NO: 3688362 - DNA, 19 bp, Homo sapiens
cctccctgttccccagaga

SEQ ID NO: 3688363 - DNA, 10 bp, Homo sapiens
cctcccttct

SEQ ID NO: 3688364 - DNA, 15 bp, Homo sapiens
cctcccttctgctac

SEQ ID NO: 3688365 - DNA, 15 bp, Homo sapiens
cctccgccctgccac

SEQ ID NO: 3688366 - DNA, 15 bp, Homo sapiens
cctcctcacctctgg

SEQ ID NO: 3688367 - DNA, 23 bp, Homo sapiens
cctcctcccacccggctgcagag

SEQ ID NO: 3688368 - DNA, 19 bp, Homo sapiens
cctcctctcccatccttga

SEQ ID NO: 3688369 - DNA, 14 bp, Homo sapiens
cctcctgaaggagg

SEQ ID NO: 3688370 - DNA, 22 bp, Homo sapiens
cctcctgaaggaggcggggctc

SEQ ID NO: 3688371 - DNA, 14 bp, Homo sapiens
cctcctgcccacct

SEQ ID NO: 3688372 - DNA, 14 bp, Homo sapiens
cctcctgctgagct

SEQ ID NO: 3688373 - DNA, 13 bp, Homo sapiens
cctcctgctgggc

SEQ ID NO: 3688374 - DNA, 14 bp, Homo sapiens
cctcgcaagctggg

SEQ ID NO: 3688375 - DNA, 13 bp, Homo sapiens
cctcgcctgacaa

SEQ ID NO: 3688376 - DNA, 18 bp, Homo sapiens
cctcggcccctcccacac

SEQ ID NO: 3688377 - DNA, 19 bp, Homo sapiens
cctcgggtctccccacctg

SEQ ID NO: 3688378 - DNA, 16 bp, Homo sapiens
cctcggtgccttcctc

SEQ ID NO: 3688379 - DNA, 16 bp, Homo sapiens
cctcgtcccatccagc

SEQ ID NO: 3688380 - DNA, 15 bp, Homo sapiens
cctctaactggacag

SEQ ID NO: 3688381 - DNA, 16 bp, Homo sapiens
cctctaactggacagc

SEQ ID NO: 3688382 - DNA, 19 bp, Homo sapiens
cctctccaagcgcctggct

SEQ ID NO: 3688383 - DNA, 23 bp, Homo sapiens
cctctccccaggtccagctctgg

SEQ ID NO: 3688384 - DNA, 18 bp, Homo sapiens
cctctctcttctgctcca

SEQ ID NO: 3688385 - DNA, 21 bp, Homo sapiens
cctctctcttctgctccaccc

SEQ ID NO: 3688386 - DNA, 22 bp, Homo sapiens
cctctctggtggctgggctgct

SEQ ID NO: 3688387 - DNA, 11 bp, Homo sapiens
cctctgagaag

SEQ ID NO: 3688388 - DNA, 11 bp, Homo sapiens
cctctgcacaa

SEQ ID NO: 3688389 - DNA, 15 bp, Homo sapiens
cctctgcacaagctg

SEQ ID NO: 3688390 - DNA, 17 bp, Homo sapiens
cctctgcacaagctgca

SEQ ID NO: 3688391 - DNA, 19 bp, Homo sapiens
cctctgcacaagctgcacc

SEQ ID NO: 3688392 - DNA, 20 bp, Homo sapiens
cctctgcactactgacatgt

SEQ ID NO: 3688393 - DNA, 19 bp, Homo sapiens
cctctgccccatcctccag

SEQ ID NO: 3688394 - DNA, 22 bp, Homo sapiens
cctctgccccatcctccagcag

SEQ ID NO: 3688395 - DNA, 19 bp, Homo sapiens
cctctgccccgccctcctt

SEQ ID NO: 3688396 - DNA, 23 bp, Homo sapiens
cctctgcctttgcaccacgggac

SEQ ID NO: 3688397 - DNA, 17 bp, Homo sapiens
cctctggactggctaga

SEQ ID NO: 3688398 - DNA, 13 bp, Homo sapiens
cctctggagtggc

SEQ ID NO: 3688399 - DNA, 14 bp, Homo sapiens
cctctggagtggcc

SEQ ID NO: 3688400 - DNA, 15 bp, Homo sapiens
cctctggagtggcca

SEQ ID NO: 3688401 - DNA, 21 bp, Homo sapiens
cctctggagtggccactaagc

SEQ ID NO: 3688402 - DNA, 13 bp, Homo sapiens
cctctggctagag

SEQ ID NO: 3688403 - DNA, 21 bp, Homo sapiens
cctctggtcgctcctgcccac

SEQ ID NO: 3688404 - DNA, 20 bp, Homo sapiens
cctctgtcttcagcaccctc

SEQ ID NO: 3688405 - DNA, 11 bp, Homo sapiens
cctctgtgcca

SEQ ID NO: 3688406 - DNA, 12 bp, Homo sapiens
cctctgtgccac

SEQ ID NO: 3688407 - DNA, 18 bp, Homo sapiens
cggtatccccccatcttg

SEQ ID NO: 3688408 - DNA, 22 bp, Homo sapiens
cggtatccccccatcttgcttc

SEQ ID NO: 3688409 - DNA, 14 bp, Homo sapiens
cggtgcccaagcca

SEQ ID NO: 3688410 - DNA, 21 bp, Homo sapiens
cggtggctagtcaagctcctc

SEQ ID NO: 3688411 - DNA, 22 bp, Homo sapiens
cggtggctagtcaagctcctcc

SEQ ID NO: 3688412 - DNA, 22 bp, Homo sapiens
cggtgggactcgtggctgtcaa

SEQ ID NO: 3688413 - DNA, 13 bp, Homo sapiens
cggtgtggagaag

SEQ ID NO: 3688414 - DNA, 18 bp, Homo sapiens
cggtgtggagaagcggct

SEQ ID NO: 3688415 - DNA, 20 bp, Homo sapiens
cggtttccagggaggggccg

SEQ ID NO: 3688416 - DNA, 14 bp, Homo sapiens
cgtaaaagaaatgt

SEQ ID NO: 3688417 - DNA, 20 bp, Homo sapiens
cgtagcgtgcccgtgtgcat

SEQ ID NO: 3688418 - DNA, 14 bp, Homo sapiens
cgtcccgtccctcc

SEQ ID NO: 3688419 - DNA, 20 bp, Homo sapiens
cgtccggcagttctgggtgc

SEQ ID NO: 3688420 - DNA, 14 bp, Homo sapiens
cgtctccaggggct

SEQ ID NO: 3688421 - DNA, 14 bp, Homo sapiens
cgtctgaccccagc

SEQ ID NO: 3688422 - DNA, 18 bp, Homo sapiens
cgtctgaccccagcccag

SEQ ID NO: 3688423 - DNA, 20 bp, Homo sapiens
cgtctgaccccagcccagac

SEQ ID NO: 3688424 - DNA, 17 bp, Homo sapiens
cgtgaactgcagtgatg

SEQ ID NO: 3688425 - DNA, 19 bp, Homo sapiens
cgtgaaggccgagaagcaa

SEQ ID NO: 3688426 - DNA, 13 bp, Homo sapiens
cgtgacacaaaca

SEQ ID NO: 3688427 - DNA, 20 bp, Homo sapiens
cgtgagcatgtttggaaggg

SEQ ID NO: 3688428 - DNA, 22 bp, Homo sapiens
cgtgcacgtggagagctggtgc

SEQ ID NO: 3688429 - DNA, 21 bp, Homo sapiens
cgtgccagtcaagaagaaaaa

SEQ ID NO: 3688430 - DNA, 14 bp, Homo sapiens
cgtgccgagccagc

SEQ ID NO: 3688431 - DNA, 15 bp, Homo sapiens
cgtgccgagccagca

SEQ ID NO: 3688432 - DNA, 15 bp, Homo sapiens
cgtgccgtggcacca

SEQ ID NO: 3688433 - DNA, 16 bp, Homo sapiens
cgtgctgacagctgct

SEQ ID NO: 3688434 - DNA, 16 bp, Homo sapiens
cgtggagggaggcccc

SEQ ID NO: 3688435 - DNA, 19 bp, Homo sapiens
cgtggagggaggccccagg

SEQ ID NO: 3688436 - DNA, 14 bp, Homo sapiens
cgtggcccaaggct

SEQ ID NO: 3688437 - DNA, 16 bp, Homo sapiens
cgtggcccagagaagc

SEQ ID NO: 3688438 - DNA, 21 bp, Homo sapiens
cgtggcctcccaaagtgctgg

SEQ ID NO: 3688439 - DNA, 22 bp, Homo sapiens
cgtggctaagagtgtcctagga

SEQ ID NO: 3688440 - DNA, 15 bp, Homo sapiens
cgtggctctgggtgg

SEQ ID NO: 3688441 - DNA, 16 bp, Homo sapiens
cgtggctctgggtggg

SEQ ID NO: 3688442 - DNA, 21 bp, Homo sapiens
cgtggctctgggtgggcgggg

SEQ ID NO: 3688443 - DNA, 14 bp, Homo sapiens
cgtggcttctgcag

SEQ ID NO: 3688444 - DNA, 14 bp, Homo sapiens
cgtgggagccagcc

SEQ ID NO: 3688445 - DNA, 14 bp, Homo sapiens
cgtgggcattgtct

SEQ ID NO: 3688446 - DNA, 15 bp, Homo sapiens
cgtggggcagggagc

SEQ ID NO: 3688447 - DNA, 22 bp, Homo sapiens
cgtgtagctatggaagttgcat

SEQ ID NO: 3688448 - DNA, 21 bp, Homo sapiens
cgtgtgagaagtgaatgctgg

SEQ ID NO: 3688449 - DNA, 22 bp, Homo sapiens
cgtgtgagaagtgaatgctggg

SEQ ID NO: 3688450 - DNA, 22 bp, Homo sapiens
cgtgtgtgtgtgtgtgtgtgca

SEQ ID NO: 3688451 - DNA, 14 bp, Homo sapiens
cgttaccaggcagg

SEQ ID NO: 3688452 - DNA, 17 bp, Homo sapiens
cgttagctcctgtggcc

SEQ ID NO: 3688453 - DNA, 23 bp, Homo sapiens
cgttctgtactgttactgggccc

SEQ ID NO: 3688454 - DNA, 17 bp, Homo sapiens
cgttggcttctccctgg

SEQ ID NO: 3688455 - DNA, 18 bp, Homo sapiens
cgttggcttctccctggg

SEQ ID NO: 3688456 - DNA, 19 bp, Homo sapiens
cgttggcttctccctgggg

SEQ ID NO: 3688457 - DNA, 22 bp, Homo sapiens
cgtttcagcgactccgttggcc

SEQ ID NO: 3688458 - DNA, 18 bp, Homo sapiens
ctaaaaagagactgtgcc

SEQ ID NO: 3688459 - DNA, 19 bp, Homo sapiens
ctaaaaagagactgtgcca

SEQ ID NO: 3688460 - DNA, 17 bp, Homo sapiens
ctaaacacgtgacacaa

SEQ ID NO: 3688461 - DNA, 17 bp, Homo sapiens
ctaaacctcagttatta

SEQ ID NO: 3688462 - DNA, 11 bp, Homo sapiens
ctaaagccaaa

SEQ ID NO: 3688463 - DNA, 15 bp, Homo sapiens
ctaaagttatatttc

SEQ ID NO: 3688464 - DNA, 16 bp, Homo sapiens
ctaaagttatatttca

SEQ ID NO: 3688465 - DNA, 13 bp, Homo sapiens
ctaaattttctga

SEQ ID NO: 3688466 - DNA, 18 bp, Homo sapiens
ctaacaaaggcagctgtg

SEQ ID NO: 3688467 - DNA, 18 bp, Homo sapiens
ctaacaataatatttcaa

SEQ ID NO: 3688468 - DNA, 22 bp, Homo sapiens
ctaacaataatatttcaagtgc

SEQ ID NO: 3688469 - DNA, 23 bp, Homo sapiens
ctaacaataatatttcaagtgcc

SEQ ID NO: 3688470 - DNA, 17 bp, Homo sapiens
ctaacctgggttccctt

SEQ ID NO: 3688471 - DNA, 23 bp, Homo sapiens
ctaactcctgccattcttctggt

SEQ ID NO: 3688472 - DNA, 14 bp, Homo sapiens
ctaactgtaaatca

SEQ ID NO: 3688473 - DNA, 14 bp, Homo sapiens
ctaagaacctggaa

SEQ ID NO: 3688474 - DNA, 19 bp, Homo sapiens
ctaagactaacaaaggcag

SEQ ID NO: 3688475 - DNA, 15 bp, Homo sapiens
ctaagcagaggaggg

SEQ ID NO: 3688476 - DNA, 22 bp, Homo sapiens
ctaagtaacctctacaggcatt

SEQ ID NO: 3688477 - DNA, 17 bp, Homo sapiens
ctaatgaggagagaaaa

SEQ ID NO: 3688478 - DNA, 19 bp, Homo sapiens
ctaatgaggagagaaaata

SEQ ID NO: 3688479 - DNA, 13 bp, Homo sapiens
ctaatgctcacct

SEQ ID NO: 3688480 - DNA, 16 bp, Homo sapiens
ctaatggcatgagaaa

SEQ ID NO: 3688481 - DNA, 20 bp, Homo sapiens
ctaattaaaacactttcaaa

SEQ ID NO: 3688482 - DNA, 17 bp, Homo sapiens
ctaattgactttagaaa

SEQ ID NO: 3688483 - DNA, 20 bp, Homo sapiens
ctaattgactttagaaagct

SEQ ID NO: 3688484 - DNA, 19 bp, Homo sapiens
ctaatttttgtattatttt

SEQ ID NO: 3688485 - DNA, 22 bp, Homo sapiens
ctaatttttttttatttttagt

SEQ ID NO: 3688486 - DNA, 19 bp, Homo sapiens
ctacaaaaagcataaaaat

SEQ ID NO: 3688487 - DNA, 22 bp, Homo sapiens
ctacaagagcagcctgtggcat

SEQ ID NO: 3688488 - DNA, 16 bp, Homo sapiens
ctacaatttaaagcaa

SEQ ID NO: 3688489 - DNA, 17 bp, Homo sapiens
ctacagattgggcgggg

SEQ ID NO: 3688490 - DNA, 13 bp, Homo sapiens
ctacagttgaaaa

SEQ ID NO: 3688491 - DNA, 14 bp, Homo sapiens
ctaccacctcccca

SEQ ID NO: 3688492 - DNA, 15 bp, Homo sapiens
ctaccacctccccag

SEQ ID NO: 3688493 - DNA, 18 bp, Homo sapiens
ctaccatcccctgtagag

SEQ ID NO: 3688494 - DNA, 19 bp, Homo sapiens
ctacccagatggaaaaata

SEQ ID NO: 3688495 - DNA, 13 bp, Homo sapiens
ctacccatccccg

SEQ ID NO: 3688496 - DNA, 15 bp, Homo sapiens
ctacccatccccgca

SEQ ID NO: 3688497 - DNA, 18 bp, Homo sapiens
ctacccccagctgtgctt

SEQ ID NO: 3688498 - DNA, 19 bp, Homo sapiens
ctacccccagctgtgctta

SEQ ID NO: 3688499 - DNA, 16 bp, Homo sapiens
ctaccctcccaccccc

SEQ ID NO: 3688500 - DNA, 14 bp, Homo sapiens
ctaccctcctgctg

SEQ ID NO: 3688501 - DNA, 17 bp, Homo sapiens
ctaccctcttagaaaaa

SEQ ID NO: 3688502 - DNA, 16 bp, Homo sapiens
ctacctctgagaagac

SEQ ID NO: 3688503 - DNA, 15 bp, Homo sapiens
ctacctgcaggcggg

SEQ ID NO: 3688504 - DNA, 20 bp, Homo sapiens
ctacctgcaggcggggctcc

SEQ ID NO: 3688505 - DNA, 21 bp, Homo sapiens
ctacctgcaggcggggctcct

SEQ ID NO: 3688506 - DNA, 22 bp, Homo sapiens
ctacctgcaggcggggctcctc

SEQ ID NO: 3688507 - DNA, 21 bp, Homo sapiens
ctacctgggggcagaactcct

SEQ ID NO: 3688508 - DNA, 18 bp, Homo sapiens
ctaccttccagttcctca

SEQ ID NO: 3688509 - DNA, 17 bp, Homo sapiens
ctacgttaccaggcagg

SEQ ID NO: 3688510 - DNA, 15 bp, Homo sapiens
ctactataaagagaa

SEQ ID NO: 3688511 - DNA, 17 bp, Homo sapiens
ctactataaagagaaga

SEQ ID NO: 3688512 - DNA, 17 bp, Homo sapiens
ctactcagcatttgatt

SEQ ID NO: 3688513 - DNA, 22 bp, Homo sapiens
ctactgtaataaagatgattgt

SEQ ID NO: 3688514 - DNA, 13 bp, Homo sapiens
ctacttggtttgt

SEQ ID NO: 3688515 - DNA, 14 bp, Homo sapiens
ctacttggtttgtg

SEQ ID NO: 3688516 - DNA, 20 bp, Homo sapiens
ctagaagggccagtcctgcc

SEQ ID NO: 3688517 - DNA, 17 bp, Homo sapiens
ctagaataatcttgctc

SEQ ID NO: 3688518 - DNA, 21 bp, Homo sapiens
ctagaatttatcacacttctg

SEQ ID NO: 3688519 - DNA, 14 bp, Homo sapiens
ctagacaagccaga

SEQ ID NO: 3688520 - DNA, 15 bp, Homo sapiens
ctagactgttacttt

SEQ ID NO: 3688521 - DNA, 16 bp, Homo sapiens
ctagactgttactttg

SEQ ID NO: 3688522 - DNA, 20 bp, Homo sapiens
ctagactgttactttggcaa

SEQ ID NO: 3688523 - DNA, 20 bp, Homo sapiens
ctctgttgcaagtgcaataa

SEQ ID NO: 3688524 - DNA, 20 bp, Homo sapiens
ctctgtttgtttggctgtcc

SEQ ID NO: 3688525 - DNA, 23 bp, Homo sapiens
ctctgtttgtttggctgtccagc

SEQ ID NO: 3688526 - DNA, 24 bp, Homo sapiens
ctcttaaaacccaagtgccttagc

SEQ ID NO: 3688527 - DNA, 20 bp, Homo sapiens
ctcttaaattatatatttat

SEQ ID NO: 3688528 - DNA, 15 bp, Homo sapiens
ctcttagaaaaacca

SEQ ID NO: 3688529 - DNA, 15 bp, Homo sapiens
ctcttagaacattgt

SEQ ID NO: 3688530 - DNA, 15 bp, Homo sapiens
ctcttagagaataag

SEQ ID NO: 3688531 - DNA, 16 bp, Homo sapiens
ctcttcaggcctccct

SEQ ID NO: 3688532 - DNA, 19 bp, Homo sapiens
ctcttcaggcctccctctc

SEQ ID NO: 3688533 - DNA, 15 bp, Homo sapiens
ctcttccaaaggcag

SEQ ID NO: 3688534 - DNA, 17 bp, Homo sapiens
ctcttccaaaggcagcg

SEQ ID NO: 3688535 - DNA, 21 bp, Homo sapiens
ctcttccccagaaaggagact

SEQ ID NO: 3688536 - DNA, 23 bp, Homo sapiens
ctcttccttgctttctcttctaa

SEQ ID NO: 3688537 - DNA, 12 bp, Homo sapiens
ctcttctgctcc

SEQ ID NO: 3688538 - DNA, 14 bp, Homo sapiens
ctcttctgctccac

SEQ ID NO: 3688539 - DNA, 20 bp, Homo sapiens
ctcttctgctccacccttgg

SEQ ID NO: 3688540 - DNA, 21 bp, Homo sapiens
ctcttctgctccacccttggc

SEQ ID NO: 3688541 - DNA, 13 bp, Homo sapiens
ctcttctgtccca

SEQ ID NO: 3688542 - DNA, 22 bp, Homo sapiens
ctcttcttggggcccagtgcat

SEQ ID NO: 3688543 - DNA, 14 bp, Homo sapiens
ctcttgagcctggg

SEQ ID NO: 3688544 - DNA, 16 bp, Homo sapiens
ctcttgagcctgggag

SEQ ID NO: 3688545 - DNA, 22 bp, Homo sapiens
ctcttggatgggacatttttgt

SEQ ID NO: 3688546 - DNA, 19 bp, Homo sapiens
ctcttgggtgggacagggc

SEQ ID NO: 3688547 - DNA, 22 bp, Homo sapiens
ctcttgggtgggacagggcttc

SEQ ID NO: 3688548 - DNA, 23 bp, Homo sapiens
ctctttagttgatttaaactctt

SEQ ID NO: 3688549 - DNA, 22 bp, Homo sapiens
ctctttcaagcagtcgtgcctg

SEQ ID NO: 3688550 - DNA, 16 bp, Homo sapiens
ctctttcacattgttt

SEQ ID NO: 3688551 - DNA, 16 bp, Homo sapiens
ctctttctctgccagt

SEQ ID NO: 3688552 - DNA, 17 bp, Homo sapiens
ctctttctctgccagtg

SEQ ID NO: 3688553 - DNA, 18 bp, Homo sapiens
ctctttctctgccagtga

SEQ ID NO: 3688554 - DNA, 22 bp, Homo sapiens
ctctttgaaatagtctgtgtga

SEQ ID NO: 3688555 - DNA, 16 bp, Homo sapiens
ctctttgctttctggt

SEQ ID NO: 3688556 - DNA, 14 bp, Homo sapiens
ctctttgctttgct

SEQ ID NO: 3688557 - DNA, 21 bp, Homo sapiens
ctctttgtagctaacagtgaa

SEQ ID NO: 3688558 - DNA, 20 bp, Homo sapiens
ctgaaaaaaaaaaagaagaa

SEQ ID NO: 3688559 - DNA, 22 bp, Homo sapiens
ctgaaaacaatggagtattctc

SEQ ID NO: 3688560 - DNA, 17 bp, Homo sapiens
ctgaaaattaacactgc

SEQ ID NO: 3688561 - DNA, 15 bp, Homo sapiens
ctgaaacaacttgga

SEQ ID NO: 3688562 - DNA, 17 bp, Homo sapiens
ctgaaagccctgagctt

SEQ ID NO: 3688563 - DNA, 18 bp, Homo sapiens
ctgaaagccctgagcttt

SEQ ID NO: 3688564 - DNA, 15 bp, Homo sapiens
ctgaaattctcctgg

SEQ ID NO: 3688565 - DNA, 18 bp, Homo sapiens
ctgaaattctcctggagg

SEQ ID NO: 3688566 - DNA, 14 bp, Homo sapiens
ctgaagaaccagtc

SEQ ID NO: 3688567 - DNA, 22 bp, Homo sapiens
ctgaagaaccagtccccccacc

SEQ ID NO: 3688568 - DNA, 15 bp, Homo sapiens
ctgaagatgggagcc

SEQ ID NO: 3688569 - DNA, 14 bp, Homo sapiens
ctgaagcagcctct

SEQ ID NO: 3688570 - DNA, 20 bp, Homo sapiens
ctgaagcagcctctccccag

SEQ ID NO: 3688571 - DNA, 14 bp, Homo sapiens
ctgaaggcagggct

SEQ ID NO: 3688572 - DNA, 15 bp, Homo sapiens
ctgaaggcagggctc

SEQ ID NO: 3688573 - DNA, 14 bp, Homo sapiens
ctgaagggcctccc

SEQ ID NO: 3688574 - DNA, 19 bp, Homo sapiens
ctgaaggggccatgatggc

SEQ ID NO: 3688575 - DNA, 20 bp, Homo sapiens
ctgaaggggcgtctgttccc

SEQ ID NO: 3688576 - DNA, 16 bp, Homo sapiens
ctgaatacagaggcaa

SEQ ID NO: 3688577 - DNA, 19 bp, Homo sapiens
ctgaatgaggcggagctcc

SEQ ID NO: 3688578 - DNA, 17 bp, Homo sapiens
ctgaatggtgcgtgaag

SEQ ID NO: 3688579 - DNA, 14 bp, Homo sapiens
ctgaattttctgga

SEQ ID NO: 3688580 - DNA, 16 bp, Homo sapiens
ctgaattttctggaaa

SEQ ID NO: 3688581 - DNA, 15 bp, Homo sapiens
ctgaattttgggact

SEQ ID NO: 3688582 - DNA, 18 bp, Homo sapiens
ctgacaaccactggtctg

SEQ ID NO: 3688583 - DNA, 20 bp, Homo sapiens
ctgacaaccactggtctgta

SEQ ID NO: 3688584 - DNA, 22 bp, Homo sapiens
ctgacaatggtgttatttgaaa

SEQ ID NO: 3688585 - DNA, 17 bp, Homo sapiens
ctgacagctgctcctag

SEQ ID NO: 3688586 - DNA, 14 bp, Homo sapiens
ctgacattgccaaa

SEQ ID NO: 3688587 - DNA, 17 bp, Homo sapiens
ctgacattgccaaaaag

SEQ ID NO: 3688588 - DNA, 19 bp, Homo sapiens
ctgaccaaatcacccaatc

SEQ ID NO: 3688589 - DNA, 23 bp, Homo sapiens
ctgaccaaatcacccaatcccag

SEQ ID NO: 3688590 - DNA, 23 bp, Homo sapiens
ctgaccagccgtgagcatgtttg

SEQ ID NO: 3688591 - DNA, 20 bp, Homo sapiens
ctgaccaggggccctacctg

SEQ ID NO: 3688592 - DNA, 16 bp, Homo sapiens
ctgaccatccactcta

SEQ ID NO: 3688593 - DNA, 22 bp, Homo sapiens
ctgaccatccactctaccctcc

SEQ ID NO: 3688594 - DNA, 23 bp, Homo sapiens
ctgaccatccactctaccctccc

SEQ ID NO: 3688595 - DNA, 20 bp, Homo sapiens
ctgacccagtgcccccactg

SEQ ID NO: 3688596 - DNA, 21 bp, Homo sapiens
ctgacccagtgcccccactga

SEQ ID NO: 3688597 - DNA, 20 bp, Homo sapiens
ctgaccccagcccagacagc

SEQ ID NO: 3688598 - DNA, 13 bp, Homo sapiens
ctgacctccacag

SEQ ID NO: 3688599 - DNA, 15 bp, Homo sapiens
ctgacctccacagct

SEQ ID NO: 3688600 - DNA, 19 bp, Homo sapiens
ctgacggccagggagaagc

SEQ ID NO: 3688601 - DNA, 21 bp, Homo sapiens
ctgacggccagggagaagctc

SEQ ID NO: 3688602 - DNA, 21 bp, Homo sapiens
ctgactaagccccgtctgacc

SEQ ID NO: 3688603 - DNA, 22 bp, Homo sapiens
ctgactaagccccgtctgaccc

SEQ ID NO: 3688604 - DNA, 17 bp, Homo sapiens
ctgactacggaactgca

SEQ ID NO: 3688605 - DNA, 18 bp, Homo sapiens
ctgactagagtgatgact

SEQ ID NO: 3688606 - DNA, 18 bp, Homo sapiens
ctgactagggagccatgt

SEQ ID NO: 3688607 - DNA, 13 bp, Homo sapiens
ctgactcatccgc

SEQ ID NO: 3688608 - DNA, 15 bp, Homo sapiens
ctgactcggtttctc

SEQ ID NO: 3688609 - DNA, 20 bp, Homo sapiens
ctgacttaagcaaaagaaaa

SEQ ID NO: 3688610 - DNA, 11 bp, Homo sapiens
ctgacttctgc

SEQ ID NO: 3688611 - DNA, 14 bp, Homo sapiens
ctgacttctgcctg

SEQ ID NO: 3688612 - DNA, 21 bp, Homo sapiens
ctgagaaggaacagggaacat

SEQ ID NO: 3688613 - DNA, 20 bp, Homo sapiens
ctgagacaaatggaggcctg

SEQ ID NO: 3688614 - DNA, 17 bp, Homo sapiens
ctgagatacatacagaa

SEQ ID NO: 3688615 - DNA, 21 bp, Homo sapiens
ctgagatcaaaacggttttac

SEQ ID NO: 3688616 - DNA, 22 bp, Homo sapiens
ctgagccagcttagcaactgct

SEQ ID NO: 3688617 - DNA, 13 bp, Homo sapiens
ctgagcccaaccc

SEQ ID NO: 3688618 - DNA, 15 bp, Homo sapiens
ctgagcgcctccatc

SEQ ID NO: 3688619 - DNA, 22 bp, Homo sapiens
ctgagcggtgggggaggagggt

SEQ ID NO: 3688620 - DNA, 14 bp, Homo sapiens
ctgagctgcccctg

SEQ ID NO: 3688621 - DNA, 15 bp, Homo sapiens
ctgagctgcccctgc

SEQ ID NO: 3688622 - DNA, 19 bp, Homo sapiens
ctgagctgcccctgctgct

SEQ ID NO: 3688623 - DNA, 13 bp, Homo sapiens
ctgagctggctga

SEQ ID NO: 3688624 - DNA, 14 bp, Homo sapiens
ctgagctttctgct

SEQ ID NO: 3688625 - DNA, 15 bp, Homo sapiens
ctgagctttctgcta

SEQ ID NO: 3688626 - DNA, 17 bp, Homo sapiens
ctgaggaaaggccagct

SEQ ID NO: 3688627 - DNA, 19 bp, Homo sapiens
ctgaggaaaggccagctgg

SEQ ID NO: 3688628 - DNA, 16 bp, Homo sapiens
ctgaggcaagagaatt

SEQ ID NO: 3688629 - DNA, 15 bp, Homo sapiens
ctgaggcctggactt

SEQ ID NO: 3688630 - DNA, 22 bp, Homo sapiens
ctgaggcctggactttcctgca

SEQ ID NO: 3688631 - DNA, 19 bp, Homo sapiens
ctgaggcctgggccgctgc

SEQ ID NO: 3688632 - DNA, 14 bp, Homo sapiens
ctgaggctgtggtc

SEQ ID NO: 3688633 - DNA, 17 bp, Homo sapiens
ctgaggctgtggtcaca

SEQ ID NO: 3688634 - DNA, 19 bp, Homo sapiens
ctgaggctgtggtcacagc

SEQ ID NO: 3688635 - DNA, 20 bp, Homo sapiens
ctgagggaccaactgggccc

SEQ ID NO: 3688636 - DNA, 14 bp, Homo sapiens
ctgagtctgggcag

SEQ ID NO: 3688637 - DNA, 18 bp, Homo sapiens
ctgagtggcaggggacag

SEQ ID NO: 3688638 - DNA, 22 bp, Homo sapiens
ctgagtttgaacacagatcatt

SEQ ID NO: 3688639 - DNA, 15 bp, Homo sapiens
ctgtcgtgatggggc

SEQ ID NO: 3688640 - DNA, 20 bp, Homo sapiens
ctgtctacttgctcaggtac

SEQ ID NO: 3688641 - DNA, 13 bp, Homo sapiens
ctgtctagagagg

SEQ ID NO: 3688642 - DNA, 14 bp, Homo sapiens
ctgtctcatcccca

SEQ ID NO: 3688643 - DNA, 19 bp, Homo sapiens
ctgtctcatccccaggggt

SEQ ID NO: 3688644 - DNA, 20 bp, Homo sapiens
ctgtctcatccccaggggtc

SEQ ID NO: 3688645 - DNA, 21 bp, Homo sapiens
ctgtctgaaccacgcgggggc

SEQ ID NO: 3688646 - DNA, 21 bp, Homo sapiens
ctgtctgaatggtgcgtgaag

SEQ ID NO: 3688647 - DNA, 18 bp, Homo sapiens
ctgtcttcagtaagccgt

SEQ ID NO: 3688648 - DNA, 13 bp, Homo sapiens
ctgtcttctggac

SEQ ID NO: 3688649 - DNA, 13 bp, Homo sapiens
ctgtcttcttaat

SEQ ID NO: 3688650 - DNA, 18 bp, Homo sapiens
ctgtctttaaaagagaga

SEQ ID NO: 3688651 - DNA, 13 bp, Homo sapiens
ctgtgaaatacca

SEQ ID NO: 3688652 - DNA, 16 bp, Homo sapiens
ctgtgaatgccactgc

SEQ ID NO: 3688653 - DNA, 20 bp, Homo sapiens
ctgtgacattcctgcaggga

SEQ ID NO: 3688654 - DNA, 18 bp, Homo sapiens
ctgtgaccctctttgctg

SEQ ID NO: 3688655 - DNA, 19 bp, Homo sapiens
ctgtgaccctctttgctga

SEQ ID NO: 3688656 - DNA, 23 bp, Homo sapiens
ctgtgaccctctttgctgaagaa

SEQ ID NO: 3688657 - DNA, 19 bp, Homo sapiens
ctgtgacctccgcctcctg

SEQ ID NO: 3688658 - DNA, 14 bp, Homo sapiens
ctgtgagaccccca

SEQ ID NO: 3688659 - DNA, 23 bp, Homo sapiens
ctgtgagacccccacacctcagt

SEQ ID NO: 3688660 - DNA, 15 bp, Homo sapiens
ctgtgaggctgtcct

SEQ ID NO: 3688661 - DNA, 16 bp, Homo sapiens
ctgtgaggctgtcctg

SEQ ID NO: 3688662 - DNA, 17 bp, Homo sapiens
ctgtgcatttctggttg

SEQ ID NO: 3688663 - DNA, 16 bp, Homo sapiens
ctgtgccaccccttcc

SEQ ID NO: 3688664 - DNA, 17 bp, Homo sapiens
ctgtgccaccccttcct

SEQ ID NO: 3688665 - DNA, 18 bp, Homo sapiens
ctgtgccacgctcctctg

SEQ ID NO: 3688666 - DNA, 11 bp, Homo sapiens
ctgtgccatgg

SEQ ID NO: 3688667 - DNA, 14 bp, Homo sapiens
ctgtgccatttctc

SEQ ID NO: 3688668 - DNA, 17 bp, Homo sapiens
ctgtgccccatgcctgt

SEQ ID NO: 3688669 - DNA, 20 bp, Homo sapiens
ctgtgccccttgacaactgg

SEQ ID NO: 3688670 - DNA, 17 bp, Homo sapiens
ctgtgcctcgcatccta

SEQ ID NO: 3688671 - DNA, 11 bp, Homo sapiens
ctgtgctgtgt

SEQ ID NO: 3688672 - DNA, 16 bp, Homo sapiens
ctgtgcttatggtacc

SEQ ID NO: 3688673 - DNA, 17 bp, Homo sapiens
ctgtggagctccactgc

SEQ ID NO: 3688674 - DNA, 21 bp, Homo sapiens
ctgtggagctccactgccatg

SEQ ID NO: 3688675 - DNA, 15 bp, Homo sapiens
ctgtggatcagagat

SEQ ID NO: 3688676 - DNA, 17 bp, Homo sapiens
ctgtggcatctttgcct

SEQ ID NO: 3688677 - DNA, 14 bp, Homo sapiens
ctgtggccagcctg

SEQ ID NO: 3688678 - DNA, 16 bp, Homo sapiens
ctgtggccagcctggc

SEQ ID NO: 3688679 - DNA, 16 bp, Homo sapiens
ctgtggccagctgcat

SEQ ID NO: 3688680 - DNA, 15 bp, Homo sapiens
ctgtggctccaggcc

SEQ ID NO: 3688681 - DNA, 16 bp, Homo sapiens
ctgtggctccaggcca

SEQ ID NO: 3688682 - DNA, 14 bp, Homo sapiens
ctgtggctctgggt

SEQ ID NO: 3688683 - DNA, 15 bp, Homo sapiens
ctgtggctctgggtg

SEQ ID NO: 3688684 - DNA, 17 bp, Homo sapiens
ctgtggctctgggtggg

SEQ ID NO: 3688685 - DNA, 21 bp, Homo sapiens
ctgtgggccctaccctcctgc

SEQ ID NO: 3688686 - DNA, 22 bp, Homo sapiens
ctgtgggccctaccctcctgct

SEQ ID NO: 3688687 - DNA, 23 bp, Homo sapiens
ctgtgggctacatgctggggtca

SEQ ID NO: 3688688 - DNA, 14 bp, Homo sapiens
ctgtgggtggggct

SEQ ID NO: 3688689 - DNA, 22 bp, Homo sapiens
ctgtgggtggggcttctctggg

SEQ ID NO: 3688690 - DNA, 22 bp, Homo sapiens
ctgtggtagtcctcccaagctg

SEQ ID NO: 3688691 - DNA, 16 bp, Homo sapiens
ctgtgtatttgctttt

SEQ ID NO: 3688692 - DNA, 17 bp, Homo sapiens
ctgtgtcagcatagaag

SEQ ID NO: 3688693 - DNA, 20 bp, Homo sapiens
ctgtgtcagcatagaagtaa

SEQ ID NO: 3688694 - DNA, 22 bp, Homo sapiens
ctgtgtccatgcgctcagggcc

SEQ ID NO: 3688695 - DNA, 23 bp, Homo sapiens
ctgtgtccatgcgctcagggcca

SEQ ID NO: 3688696 - DNA, 12 bp, Homo sapiens
ctgtgtctgagc

SEQ ID NO: 3688697 - DNA, 14 bp, Homo sapiens
ctgtgtctgagccc

SEQ ID NO: 3688698 - DNA, 20 bp, Homo sapiens
ctgtgtctttaaatgctgct

SEQ ID NO: 3688699 - DNA, 22 bp, Homo sapiens
ctgtgtgattgacagctttgct

SEQ ID NO: 3688700 - DNA, 16 bp, Homo sapiens
ctgtgtgtcccaggca

SEQ ID NO: 3688701 - DNA, 23 bp, Homo sapiens
ctgtgtgtcccaggcagggagac

SEQ ID NO: 3688702 - DNA, 21 bp, Homo sapiens
ctgtgtgtgtgtgtgtgcgtg

SEQ ID NO: 3688703 - DNA, 13 bp, Homo sapiens
ctgtgttgccaag

SEQ ID NO: 3688704 - DNA, 17 bp, Homo sapiens
ctgtgttgccaagctcc

SEQ ID NO: 3688705 - DNA, 23 bp, Homo sapiens
ctgtgtttcgtgaactgcagtga

SEQ ID NO: 3688706 - DNA, 22 bp, Homo sapiens
ctgtgtttggctttcagggagg

SEQ ID NO: 3688707 - DNA, 23 bp, Homo sapiens
ctgtgtttggctttcagggaggc

SEQ ID NO: 3688708 - DNA, 22 bp, Homo sapiens
ctgttacaacttgtatttccaa

SEQ ID NO: 3688709 - DNA, 17 bp, Homo sapiens
ctgttactgtcttcagt

SEQ ID NO: 3688710 - DNA, 19 bp, Homo sapiens
ctgttagggacatttccaa

SEQ ID NO: 3688711 - DNA, 16 bp, Homo sapiens
ctgttattatatttga

SEQ ID NO: 3688712 - DNA, 19 bp, Homo sapiens
ctgttattatatttgacat

SEQ ID NO: 3688713 - DNA, 20 bp, Homo sapiens
ctgttattatatttgacatg

SEQ ID NO: 3688714 - DNA, 16 bp, Homo sapiens
ctgttccccagagaaa

SEQ ID NO: 3688715 - DNA, 15 bp, Homo sapiens
ctgttcccccttcac

SEQ ID NO: 3688716 - DNA, 16 bp, Homo sapiens
ctgttcctgttcagta

SEQ ID NO: 3688717 - DNA, 16 bp, Homo sapiens
ctgttctaacatgtaa

SEQ ID NO: 3688718 - DNA, 18 bp, Homo sapiens
ctgttctatgcttcctcg

SEQ ID NO: 3688719 - DNA, 22 bp, Homo sapiens
ctgttcttggtaactgattacc

SEQ ID NO: 3688720 - DNA, 21 bp, Homo sapiens
ctgttgaagatttgaggactt

SEQ ID NO: 3688721 - DNA, 17 bp, Homo sapiens
ctgttgacacaggtctt

SEQ ID NO: 3688722 - DNA, 15 bp, Homo sapiens
ctgttgacatattta

SEQ ID NO: 3688723 - DNA, 18 bp, Homo sapiens
ctgttgacatatttaatg

SEQ ID NO: 3688724 - DNA, 23 bp, Homo sapiens
ctgttgacatatttaatgtttta

SEQ ID NO: 3688725 - DNA, 17 bp, Homo sapiens
ctgttgagcatcacaga

SEQ ID NO: 3688726 - DNA, 13 bp, Homo sapiens
ctgttgcccttct

SEQ ID NO: 3688727 - DNA, 14 bp, Homo sapiens
ctgttgcccttctg

SEQ ID NO: 3688728 - DNA, 18 bp, Homo sapiens
ctgttgcccttctgtcca

SEQ ID NO: 3688729 - DNA, 15 bp, Homo sapiens
ctgttggcaggctgg

SEQ ID NO: 3688730 - DNA, 17 bp, Homo sapiens
ctgtttactgcaaggtt

SEQ ID NO: 3688731 - DNA, 14 bp, Homo sapiens
ctgtttatggcctc

SEQ ID NO: 3688732 - DNA, 21 bp, Homo sapiens
ctgtttatggcctcagctgcc

SEQ ID NO: 3688733 - DNA, 19 bp, Homo sapiens
ctgtttcctgacattgtct

SEQ ID NO: 3688734 - DNA, 20 bp, Homo sapiens
ctgtttcctgacattgtctc

SEQ ID NO: 3688735 - DNA, 15 bp, Homo sapiens
ctgtttctgcttatt

SEQ ID NO: 3688736 - DNA, 15 bp, Homo sapiens
ctgtttgtatgaaat

SEQ ID NO: 3688737 - DNA, 22 bp, Homo sapiens
ctgtttgtcctgagatggaaaa

SEQ ID NO: 3688738 - DNA, 15 bp, Homo sapiens
ctgttttcctccctt

SEQ ID NO: 3688739 - DNA, 21 bp, Homo sapiens
ctgttttcctcccttctgcta

SEQ ID NO: 3688740 - DNA, 21 bp, Homo sapiens
ctgtttttcagggaggtggct

SEQ ID NO: 3688741 - DNA, 23 bp, Homo sapiens
cttaaaaagaaaacctcatggag

SEQ ID NO: 3688742 - DNA, 17 bp, Homo sapiens
cttaaagtttcatgtga

SEQ ID NO: 3688743 - DNA, 18 bp, Homo sapiens
cttaaattatatatttat

SEQ ID NO: 3688744 - DNA, 13 bp, Homo sapiens
cttaaatttctaa

SEQ ID NO: 3688745 - DNA, 16 bp, Homo sapiens
cttaactatctgttcc

SEQ ID NO: 3688746 - DNA, 17 bp, Homo sapiens
cttaactatctgttccc

SEQ ID NO: 3688747 - DNA, 16 bp, Homo sapiens
cttaactggagcccca

SEQ ID NO: 3688748 - DNA, 15 bp, Homo sapiens
cttaagcaaaagaaa

SEQ ID NO: 3688749 - DNA, 21 bp, Homo sapiens
cttaagtaccaatgggaagca

SEQ ID NO: 3688750 - DNA, 22 bp, Homo sapiens
cttaagtgcatgcattgagctg

SEQ ID NO: 3688751 - DNA, 16 bp, Homo sapiens
cttaataaaagaacat

SEQ ID NO: 3688752 - DNA, 20 bp, Homo sapiens
cttaatgtgattactgctct

SEQ ID NO: 3688753 - DNA, 17 bp, Homo sapiens
cttacagacagaatata

SEQ ID NO: 3688754 - DNA, 20 bp, Homo sapiens
cttacatttttgtggttttg

SEQ ID NO: 3688755 - DNA, 14 bp, Homo sapiens
gaccagctcaggac

SEQ ID NO: 3688756 - DNA, 22 bp, Homo sapiens
gaccagctcaggacagatgcca

SEQ ID NO: 3688757 - DNA, 21 bp, Homo sapiens
gaccaggactccctcctcacc

SEQ ID NO: 3688758 - DNA, 15 bp, Homo sapiens
gaccaggctgtgtcc

SEQ ID NO: 3688759 - DNA, 13 bp, Homo sapiens
gaccagggcaagg

SEQ ID NO: 3688760 - DNA, 14 bp, Homo sapiens
gaccagggcctttt

SEQ ID NO: 3688761 - DNA, 19 bp, Homo sapiens
gaccagggccttttctggc

SEQ ID NO: 3688762 - DNA, 21 bp, Homo sapiens
gaccaggggccctacctgggg

SEQ ID NO: 3688763 - DNA, 15 bp, Homo sapiens
gacccaccactggaa

SEQ ID NO: 3688764 - DNA, 10 bp, Homo sapiens
gacccagtgc

SEQ ID NO: 3688765 - DNA, 14 bp, Homo sapiens
gacccagtgcagaa

SEQ ID NO: 3688766 - DNA, 20 bp, Homo sapiens
gacccagtgcccccactgac

SEQ ID NO: 3688767 - DNA, 15 bp, Homo sapiens
gacccccgtggggca

SEQ ID NO: 3688768 - DNA, 16 bp, Homo sapiens
gaccctattgctgctt

SEQ ID NO: 3688769 - DNA, 15 bp, Homo sapiens
gaccctccagtgctg

SEQ ID NO: 3688770 - DNA, 16 bp, Homo sapiens
gaccctgaaggggcca

SEQ ID NO: 3688771 - DNA, 17 bp, Homo sapiens
gaccctgggggcacagg

SEQ ID NO: 3688772 - DNA, 18 bp, Homo sapiens
gaccctgggggcacagga

SEQ ID NO: 3688773 - DNA, 23 bp, Homo sapiens
gaccctgtctcaaaaaaagaaaa

SEQ ID NO: 3688774 - DNA, 20 bp, Homo sapiens
gacctccacacccgtgagaa

SEQ ID NO: 3688775 - DNA, 15 bp, Homo sapiens
gacctgaggctgtgg

SEQ ID NO: 3688776 - DNA, 14 bp, Homo sapiens
gacctgatcctgga

SEQ ID NO: 3688777 - DNA, 23 bp, Homo sapiens
gacctgtatatttgtaaagctat

SEQ ID NO: 3688778 - DNA, 17 bp, Homo sapiens
gacctgtttatgagatg

SEQ ID NO: 3688779 - DNA, 21 bp, Homo sapiens
gaccttacacaccattttgta

SEQ ID NO: 3688780 - DNA, 15 bp, Homo sapiens
gaccttctaggaagc

SEQ ID NO: 3688781 - DNA, 13 bp, Homo sapiens
gacctttccacca

SEQ ID NO: 3688782 - DNA, 20 bp, Homo sapiens
gacgcctgtgccaccccttc

SEQ ID NO: 3688783 - DNA, 20 bp, Homo sapiens
gacggcctgatgctccctcc

SEQ ID NO: 3688784 - DNA, 17 bp, Homo sapiens
gacggggtttcaccatg

SEQ ID NO: 3688785 - DNA, 18 bp, Homo sapiens
gacggtgcccaagccaga

SEQ ID NO: 3688786 - DNA, 22 bp, Homo sapiens
gacggtttccagggaggggccg

SEQ ID NO: 3688787 - DNA, 22 bp, Homo sapiens
gacgtgaccggacttttctgca

SEQ ID NO: 3688788 - DNA, 14 bp, Homo sapiens
gactaacaaaggca

SEQ ID NO: 3688789 - DNA, 16 bp, Homo sapiens
gactaacaaaggcagc

SEQ ID NO: 3688790 - DNA, 20 bp, Homo sapiens
gactaacaaaggcagctgtg

SEQ ID NO: 3688791 - DNA, 21 bp, Homo sapiens
gactaacaaaggcagctgtgt

SEQ ID NO: 3688792 - DNA, 19 bp, Homo sapiens
gactaagaataagaagcat

SEQ ID NO: 3688793 - DNA, 16 bp, Homo sapiens
gactaatggcatgaga

SEQ ID NO: 3688794 - DNA, 17 bp, Homo sapiens
gactagggattcaggct

SEQ ID NO: 3688795 - DNA, 18 bp, Homo sapiens
gactagggattcaggctg

SEQ ID NO: 3688796 - DNA, 19 bp, Homo sapiens
gactagggattcaggctgc

SEQ ID NO: 3688797 - DNA, 20 bp, Homo sapiens
gactagggattcaggctgct

SEQ ID NO: 3688798 - DNA, 21 bp, Homo sapiens
gactatatttgggcctgctcc

SEQ ID NO: 3688799 - DNA, 14 bp, Homo sapiens
gactattcagtttt

SEQ ID NO: 3688800 - DNA, 18 bp, Homo sapiens
gactcagacattggcacc

SEQ ID NO: 3688801 - DNA, 19 bp, Homo sapiens
gactcagccttcagacaga

SEQ ID NO: 3688802 - DNA, 20 bp, Homo sapiens
gactcagtgcagatggagag

SEQ ID NO: 3688803 - DNA, 18 bp, Homo sapiens
gactcatggtgtgttaca

SEQ ID NO: 3688804 - DNA, 20 bp, Homo sapiens
gactcccaggctggagagca

SEQ ID NO: 3688805 - DNA, 13 bp, Homo sapiens
gactcccattcct

SEQ ID NO: 3688806 - DNA, 13 bp, Homo sapiens
gactccctcctca

SEQ ID NO: 3688807 - DNA, 17 bp, Homo sapiens
gactccgttggccactc

SEQ ID NO: 3688808 - DNA, 22 bp, Homo sapiens
gactcctccctgggggtggggc

SEQ ID NO: 3688809 - DNA, 16 bp, Homo sapiens
gactcgggggtgggga

SEQ ID NO: 3688810 - DNA, 15 bp, Homo sapiens
gactctgaaaaggaa

SEQ ID NO: 3688811 - DNA, 16 bp, Homo sapiens
gactctttatgcttgc

SEQ ID NO: 3688812 - DNA, 18 bp, Homo sapiens
gactgaagccgtgcctgt

SEQ ID NO: 3688813 - DNA, 23 bp, Homo sapiens
gactgcagaggggaaagacttcc

SEQ ID NO: 3688814 - DNA, 15 bp, Homo sapiens
gactgccatcattga

SEQ ID NO: 3688815 - DNA, 16 bp, Homo sapiens
gactgctacctctgag

SEQ ID NO: 3688816 - DNA, 23 bp, Homo sapiens
gactgctacctctgagaagacac

SEQ ID NO: 3688817 - DNA, 21 bp, Homo sapiens
gactgctacctttcaaagctt

SEQ ID NO: 3688818 - DNA, 17 bp, Homo sapiens
gactggctagagtcctc

SEQ ID NO: 3688819 - DNA, 13 bp, Homo sapiens
gactgtagggagg

SEQ ID NO: 3688820 - DNA, 18 bp, Homo sapiens
gactgttttctcttgaga

SEQ ID NO: 3688821 - DNA, 12 bp, Homo sapiens
gacttaacaggc

SEQ ID NO: 3688822 - DNA, 20 bp, Homo sapiens
gacttaagcaaaagaaaaag

SEQ ID NO: 3688823 - DNA, 23 bp, Homo sapiens
gacttaatgtgattactgctcta

SEQ ID NO: 3688824 - DNA, 17 bp, Homo sapiens
gacttagggcaccaggg

SEQ ID NO: 3688825 - DNA, 12 bp, Homo sapiens
gacttcaaagca

SEQ ID NO: 3688826 - DNA, 15 bp, Homo sapiens
gacttcagtcttgcc

SEQ ID NO: 3688827 - DNA, 14 bp, Homo sapiens
gacttccatctagt

SEQ ID NO: 3688828 - DNA, 19 bp, Homo sapiens
gacttcctgtccagctcca

SEQ ID NO: 3688829 - DNA, 21 bp, Homo sapiens
gacttcctgtccagctccaac

SEQ ID NO: 3688830 - DNA, 14 bp, Homo sapiens
gacttctgcctgga

SEQ ID NO: 3688831 - DNA, 12 bp, Homo sapiens
gacttcttcttc

SEQ ID NO: 3688832 - DNA, 18 bp, Homo sapiens
gacttgacagaacactgt

SEQ ID NO: 3688833 - DNA, 19 bp, Homo sapiens
gacttgtgacggtgtacct

SEQ ID NO: 3688834 - DNA, 11 bp, Homo sapiens
gactttcctct

SEQ ID NO: 3688835 - DNA, 11 bp, Homo sapiens
gactttcctgc

SEQ ID NO: 3688836 - DNA, 17 bp, Homo sapiens
gactttgtttttaaaat

SEQ ID NO: 3688837 - DNA, 21 bp, Homo sapiens
gacttttaatgtcatttgtta

SEQ ID NO: 3688838 - DNA, 21 bp, Homo sapiens
gacttttctgtccgagctttg

SEQ ID NO: 3688839 - DNA, 22 bp, Homo sapiens
gactttttaaaattctgagtga

SEQ ID NO: 3688840 - DNA, 16 bp, Homo sapiens
gagaaaaaaaaaatag

SEQ ID NO: 3688841 - DNA, 19 bp, Homo sapiens
gagaaaatatatgtatttt

SEQ ID NO: 3688842 - DNA, 16 bp, Homo sapiens
gagaaacagcctgtgt

SEQ ID NO: 3688843 - DNA, 15 bp, Homo sapiens
gagaaatcaggcctg

SEQ ID NO: 3688844 - DNA, 19 bp, Homo sapiens
gagaaccactacatgcagc

SEQ ID NO: 3688845 - DNA, 21 bp, Homo sapiens
gagaactgaattttgggactt

SEQ ID NO: 3688846 - DNA, 23 bp, Homo sapiens
gagaagcaagaaagaaacccgac

SEQ ID NO: 3688847 - DNA, 12 bp, Homo sapiens
gagaagccagga

SEQ ID NO: 3688848 - DNA, 15 bp, Homo sapiens
gagaagccatgtact

SEQ ID NO: 3688849 - DNA, 14 bp, Homo sapiens
gagaagcccgtgtg

SEQ ID NO: 3688850 - DNA, 15 bp, Homo sapiens
gagaagcccgtgtga

SEQ ID NO: 3688851 - DNA, 16 bp, Homo sapiens
gagaagcccgtgtgag

SEQ ID NO: 3688852 - DNA, 15 bp, Homo sapiens
gagaagcggctggca

SEQ ID NO: 3688853 - DNA, 16 bp, Homo sapiens
gagaagcggctggcag

SEQ ID NO: 3688854 - DNA, 17 bp, Homo sapiens
gagaagcggctggcagc

SEQ ID NO: 3688855 - DNA, 12 bp, Homo sapiens
gagaaggaagcc

SEQ ID NO: 3688856 - DNA, 17 bp, Homo sapiens
gagaaggttggaggtgg

SEQ ID NO: 3688857 - DNA, 23 bp, Homo sapiens
gagaaggttggaggtggggaagg

SEQ ID NO: 3688858 - DNA, 17 bp, Homo sapiens
gagaagtgaatgctggg

SEQ ID NO: 3688859 - DNA, 20 bp, Homo sapiens
gagaagtgaatgctgggact

SEQ ID NO: 3688860 - DNA, 16 bp, Homo sapiens
gagacaaatggaggcc

SEQ ID NO: 3688861 - DNA, 13 bp, Homo sapiens
gagacccccacac

SEQ ID NO: 3688862 - DNA, 14 bp, Homo sapiens
gagacccccacacc

SEQ ID NO: 3688863 - DNA, 21 bp, Homo sapiens
gagaccctgtctcaaaaaaag

SEQ ID NO: 3688864 - DNA, 17 bp, Homo sapiens
gagacggtttccaggga

SEQ ID NO: 3688865 - DNA, 15 bp, Homo sapiens
gagactcagtgcaga

SEQ ID NO: 3688866 - DNA, 13 bp, Homo sapiens
gagagaaaatata

SEQ ID NO: 3688867 - DNA, 21 bp, Homo sapiens
gagagaaaatatatgtatttt

SEQ ID NO: 3688868 - DNA, 20 bp, Homo sapiens
gagagacttgtgctcaagga

SEQ ID NO: 3688869 - DNA, 13 bp, Homo sapiens
gagagagaaaaaa

SEQ ID NO: 3688870 - DNA, 15 bp, Homo sapiens
gagagctagcagcag

SEQ ID NO: 3688871 - DNA, 14 bp, Homo sapiens
gagaggaagggtgg

SEQ ID NO: 3688872 - DNA, 22 bp, Homo sapiens
gcagggagctgggcccgacatg

SEQ ID NO: 3688873 - DNA, 14 bp, Homo sapiens
gcagggagggcagt

SEQ ID NO: 3688874 - DNA, 22 bp, Homo sapiens
gcagggattaacctctgcacta

SEQ ID NO: 3688875 - DNA, 16 bp, Homo sapiens
gcagggccatggctca

SEQ ID NO: 3688876 - DNA, 22 bp, Homo sapiens
gcagggccatggctcagggtgg

SEQ ID NO: 3688877 - DNA, 12 bp, Homo sapiens
gcagggctcctc

SEQ ID NO: 3688878 - DNA, 15 bp, Homo sapiens
gcagggctcctccct

SEQ ID NO: 3688879 - DNA, 21 bp, Homo sapiens
gcagggctcctccctggagct

SEQ ID NO: 3688880 - DNA, 20 bp, Homo sapiens
gcaggtccagctctgtgggc

SEQ ID NO: 3688881 - DNA, 15 bp, Homo sapiens
gcagtactcctccct

SEQ ID NO: 3688882 - DNA, 13 bp, Homo sapiens
gcagtcgtgcctg

SEQ ID NO: 3688883 - DNA, 17 bp, Homo sapiens
gcagtcgtgcctgtgtc

SEQ ID NO: 3688884 - DNA, 19 bp, Homo sapiens
gcagtcgtgcctgtgtcca

SEQ ID NO: 3688885 - DNA, 21 bp, Homo sapiens
gcagtgatgctggatgctcct

SEQ ID NO: 3688886 - DNA, 20 bp, Homo sapiens
gcagtgtgcactaaggggcc

SEQ ID NO: 3688887 - DNA, 20 bp, Homo sapiens
gcagtgtggggagggcaggt

SEQ ID NO: 3688888 - DNA, 19 bp, Homo sapiens
gcagttcagcaccacccta

SEQ ID NO: 3688889 - DNA, 16 bp, Homo sapiens
gcataaaaacatttta

SEQ ID NO: 3688890 - DNA, 15 bp, Homo sapiens
gcataaagaagaaga

SEQ ID NO: 3688891 - DNA, 14 bp, Homo sapiens
gcatactttgtaaa

SEQ ID NO: 3688892 - DNA, 15 bp, Homo sapiens
gcatactttgtaaat

SEQ ID NO: 3688893 - DNA, 12 bp, Homo sapiens
gcatagtttctt

SEQ ID NO: 3688894 - DNA, 15 bp, Homo sapiens
gcatcaaccccccga

SEQ ID NO: 3688895 - DNA, 18 bp, Homo sapiens
gcatcaccttaggcaggg

SEQ ID NO: 3688896 - DNA, 20 bp, Homo sapiens
gcatcaccttaggcagggaa

SEQ ID NO: 3688897 - DNA, 17 bp, Homo sapiens
gcatcagtttaggcctt

SEQ ID NO: 3688898 - DNA, 18 bp, Homo sapiens
gcatcagtttaggccttg

SEQ ID NO: 3688899 - DNA, 17 bp, Homo sapiens
gcatcatagtagttttt

SEQ ID NO: 3688900 - DNA, 17 bp, Homo sapiens
gcatccatctgggctac

SEQ ID NO: 3688901 - DNA, 14 bp, Homo sapiens
gcatcctatgctta

SEQ ID NO: 3688902 - DNA, 14 bp, Homo sapiens
gcatctgaccagca

SEQ ID NO: 3688903 - DNA, 20 bp, Homo sapiens
gcatctgaccagcagcgcct

SEQ ID NO: 3688904 - DNA, 17 bp, Homo sapiens
gcatctgcccctccccc

SEQ ID NO: 3688905 - DNA, 16 bp, Homo sapiens
gcatctgtctgaatgg

SEQ ID NO: 3688906 - DNA, 16 bp, Homo sapiens
gcatcttgcctccagg

SEQ ID NO: 3688907 - DNA, 19 bp, Homo sapiens
gcatcttgcctccaggtgc

SEQ ID NO: 3688908 - DNA, 22 bp, Homo sapiens
gcatctttgccttgggctgctc

SEQ ID NO: 3688909 - DNA, 15 bp, Homo sapiens
gcatgcattgagctg

SEQ ID NO: 3688910 - DNA, 15 bp, Homo sapiens
gcatgcggcccagga

SEQ ID NO: 3688911 - DNA, 23 bp, Homo sapiens
gcatgctggagtacccagcctat

SEQ ID NO: 3688912 - DNA, 16 bp, Homo sapiens
gcatgcttccctgcag

SEQ ID NO: 3688913 - DNA, 22 bp, Homo sapiens
gcatgcttccctgcagctgacc

SEQ ID NO: 3688914 - DNA, 16 bp, Homo sapiens
gcatggtgccccagga

SEQ ID NO: 3688915 - DNA, 17 bp, Homo sapiens
gcatggtgccccaggac

SEQ ID NO: 3688916 - DNA, 18 bp, Homo sapiens
gcatggtgccccaggacc

SEQ ID NO: 3688917 - DNA, 21 bp, Homo sapiens
gcatggtgccccaggaccagc

SEQ ID NO: 3688918 - DNA, 23 bp, Homo sapiens
gcatggtgccccaggaccagctc

SEQ ID NO: 3688919 - DNA, 14 bp, Homo sapiens
gcatgtcttttaaa

SEQ ID NO: 3688920 - DNA, 17 bp, Homo sapiens
gcatgtcttttaaaatg

SEQ ID NO: 3688921 - DNA, 15 bp, Homo sapiens
gcatgtttccagcag

SEQ ID NO: 3688922 - DNA, 13 bp, Homo sapiens
gcattgagctgcc

SEQ ID NO: 3688923 - DNA, 22 bp, Homo sapiens
gcattgagctgcctccagcctg

SEQ ID NO: 3688924 - DNA, 16 bp, Homo sapiens
gcattgatggggaagg

SEQ ID NO: 3688925 - DNA, 22 bp, Homo sapiens
gcatttcactttcccggtgttc

SEQ ID NO: 3688926 - DNA, 16 bp, Homo sapiens
gcatttcttgtgttct

SEQ ID NO: 3688927 - DNA, 13 bp, Homo sapiens
gcatttgctgaat

SEQ ID NO: 3688928 - DNA, 14 bp, Homo sapiens
gcatttgctgaata

SEQ ID NO: 3688929 - DNA, 23 bp, Homo sapiens
gcatttgctgaatacagaggcaa

SEQ ID NO: 3688930 - DNA, 22 bp, Homo sapiens
gcatttggattggggtccctct

SEQ ID NO: 3688931 - DNA, 22 bp, Homo sapiens
gcattttggagagtttcctgaa

SEQ ID NO: 3688932 - DNA, 23 bp, Homo sapiens
gcattttggagagtttcctgaaa

SEQ ID NO: 3688933 - DNA, 20 bp, Homo sapiens
gccaaagctagggtggccct

SEQ ID NO: 3688934 - DNA, 19 bp, Homo sapiens
gccaagaaagatgtatata

SEQ ID NO: 3688935 - DNA, 14 bp, Homo sapiens
gccaagcagccaag

SEQ ID NO: 3688936 - DNA, 19 bp, Homo sapiens
gccaagctccttgggaggc

SEQ ID NO: 3688937 - DNA, 11 bp, Homo sapiens
gccaaggagct

SEQ ID NO: 3688938 - DNA, 12 bp, Homo sapiens
gccaaggagctg

SEQ ID NO: 3688939 - DNA, 13 bp, Homo sapiens
gccaaggagctgc

SEQ ID NO: 3688940 - DNA, 20 bp, Homo sapiens
gccaaggagctgctatagcc

SEQ ID NO: 3688941 - DNA, 20 bp, Homo sapiens
gccaaggccagagtggcctg

SEQ ID NO: 3688942 - DNA, 21 bp, Homo sapiens
gccaaggctgggggaagaagc

SEQ ID NO: 3688943 - DNA, 14 bp, Homo sapiens
gccaagtctcagaa

SEQ ID NO: 3688944 - DNA, 16 bp, Homo sapiens
gccaagtctcagaaga

SEQ ID NO: 3688945 - DNA, 16 bp, Homo sapiens
gccacaccaggataga

SEQ ID NO: 3688946 - DNA, 12 bp, Homo sapiens
gccaccaggcca

SEQ ID NO: 3688947 - DNA, 15 bp, Homo sapiens
gccaccaggccacct

SEQ ID NO: 3688948 - DNA, 16 bp, Homo sapiens
gccacccacctccctg

SEQ ID NO: 3688949 - DNA, 17 bp, Homo sapiens
gccacccacctccctgc

SEQ ID NO: 3688950 - DNA, 13 bp, Homo sapiens
gccaccccttcct

SEQ ID NO: 3688951 - DNA, 21 bp, Homo sapiens
gccaccccttcctcagcctgg

SEQ ID NO: 3688952 - DNA, 23 bp, Homo sapiens
gccaccccttcctcagcctgggg

SEQ ID NO: 3688953 - DNA, 17 bp, Homo sapiens
gccactaagcagaggag

SEQ ID NO: 3688954 - DNA, 14 bp, Homo sapiens
gccactcactaggc

SEQ ID NO: 3688955 - DNA, 23 bp, Homo sapiens
gccactcactaggcccccacttg

SEQ ID NO: 3688956 - DNA, 22 bp, Homo sapiens
gccactccccggcatgagactc

SEQ ID NO: 3688957 - DNA, 15 bp, Homo sapiens
gccactgaaatctgt

SEQ ID NO: 3688958 - DNA, 19 bp, Homo sapiens
gccactgagctggctgact

SEQ ID NO: 3688959 - DNA, 19 bp, Homo sapiens
gccactgcataccaacctg

SEQ ID NO: 3688960 - DNA, 21 bp, Homo sapiens
gccactgcgggagctctgtat

SEQ ID NO: 3688961 - DNA, 19 bp, Homo sapiens
gccactgtgaagagaacca

SEQ ID NO: 3688962 - DNA, 16 bp, Homo sapiens
gccactgtggtggcag

SEQ ID NO: 3688963 - DNA, 21 bp, Homo sapiens
gccagagatccaaaagaagcc

SEQ ID NO: 3688964 - DNA, 22 bp, Homo sapiens
gccagagatccaaaagaagccc

SEQ ID NO: 3688965 - DNA, 22 bp, Homo sapiens
gccagaggagagctgctgggcc

SEQ ID NO: 3688966 - DNA, 14 bp, Homo sapiens
gccagaggccccca

SEQ ID NO: 3688967 - DNA, 18 bp, Homo sapiens
gccagaggcccccagccc

SEQ ID NO: 3688968 - DNA, 24 bp, Homo sapiens
gccagaggcccccagcccagggct

SEQ ID NO: 3688969 - DNA, 13 bp, Homo sapiens
gccagagtggcct

SEQ ID NO: 3688970 - DNA, 17 bp, Homo sapiens
gccagagtggcctggcc

SEQ ID NO: 3688971 - DNA, 18 bp, Homo sapiens
gccagagtggcctggcca

SEQ ID NO: 3688972 - DNA, 22 bp, Homo sapiens
gccagagtggcctggccaggag

SEQ ID NO: 3688973 - DNA, 16 bp, Homo sapiens
gccagatccagcctgg

SEQ ID NO: 3688974 - DNA, 15 bp, Homo sapiens
gccagatttgtcttt

SEQ ID NO: 3688975 - DNA, 16 bp, Homo sapiens
gccagatttgtctttt

SEQ ID NO: 3688976 - DNA, 22 bp, Homo sapiens
gccagccagtgacctgaggaag

SEQ ID NO: 3688977 - DNA, 18 bp, Homo sapiens
gccagccccacccaggag

SEQ ID NO: 3688978 - DNA, 13 bp, Homo sapiens
gccagcctggcat

SEQ ID NO: 3688979 - DNA, 16 bp, Homo sapiens
gccagcctggcatcag

SEQ ID NO: 3688980 - DNA, 16 bp, Homo sapiens
gccagcgcccctcagc

SEQ ID NO: 3688981 - DNA, 19 bp, Homo sapiens
gccagctcacagtgctgtg

SEQ ID NO: 3688982 - DNA, 14 bp, Homo sapiens
gccagctgcactga

SEQ ID NO: 3688983 - DNA, 20 bp, Homo sapiens
gccagctgcactgatgctgc

SEQ ID NO: 3688984 - DNA, 14 bp, Homo sapiens
gccagctggcagca

SEQ ID NO: 3688985 - DNA, 18 bp, Homo sapiens
gccagctggcagcagagt

SEQ ID NO: 3688986 - DNA, 17 bp, Homo sapiens
gccaggaatttcccagg

SEQ ID NO: 3688987 - DNA, 23 bp, Homo sapiens
gccaggaatttcccaggaccctg

SEQ ID NO: 3688988 - DNA, 13 bp, Homo sapiens
gcctttcctggaa

SEQ ID NO: 3688989 - DNA, 16 bp, Homo sapiens
gccttttctggcaccg

SEQ ID NO: 3688990 - DNA, 14 bp, Homo sapiens
gcgaaggtcccaca

SEQ ID NO: 3688991 - DNA, 20 bp, Homo sapiens
gcgaaggtcccacagccctg

SEQ ID NO: 3688992 - DNA, 23 bp, Homo sapiens
gcgaaggtcccacagccctgaga

SEQ ID NO: 3688993 - DNA, 13 bp, Homo sapiens
gcgaccctggggg

SEQ ID NO: 3688994 - DNA, 16 bp, Homo sapiens
gcgaccgaggccctcc

SEQ ID NO: 3688995 - DNA, 12 bp, Homo sapiens
gcgactttctgc

SEQ ID NO: 3688996 - DNA, 23 bp, Homo sapiens
gcgagatggggtggggtggagaa

SEQ ID NO: 3688997 - DNA, 16 bp, Homo sapiens
gcgaggtgcggccacc

SEQ ID NO: 3688998 - DNA, 15 bp, Homo sapiens
gcgatcccacacagg

SEQ ID NO: 3688999 - DNA, 20 bp, Homo sapiens
gcgatcccacacaggctggc

SEQ ID NO: 3689000 - DNA, 17 bp, Homo sapiens
gcgatctctccactgtg

SEQ ID NO: 3689001 - DNA, 18 bp, Homo sapiens
gcgatctctccactgtgc

SEQ ID NO: 3689002 - DNA, 15 bp, Homo sapiens
gcgattttgtctacc

SEQ ID NO: 3689003 - DNA, 18 bp, Homo sapiens
gcgcatcttgcctccagg

SEQ ID NO: 3689004 - DNA, 13 bp, Homo sapiens
gcgccccaggccc

SEQ ID NO: 3689005 - DNA, 20 bp, Homo sapiens
gcgcccctcagcctctgcca

SEQ ID NO: 3689006 - DNA, 13 bp, Homo sapiens
gcgccgtctccag

SEQ ID NO: 3689007 - DNA, 20 bp, Homo sapiens
gcgcctccttaggagtgggg

SEQ ID NO: 3689008 - DNA, 14 bp, Homo sapiens
gcgcttcccagcac

SEQ ID NO: 3689009 - DNA, 13 bp, Homo sapiens
gcggccaccaccc

SEQ ID NO: 3689010 - DNA, 16 bp, Homo sapiens
gcggcctttggcttca

SEQ ID NO: 3689011 - DNA, 15 bp, Homo sapiens
gcggctggcagccca

SEQ ID NO: 3689012 - DNA, 14 bp, Homo sapiens
gcgggactcctccc

SEQ ID NO: 3689013 - DNA, 18 bp, Homo sapiens
gcgggactcctccctggg

SEQ ID NO: 3689014 - DNA, 13 bp, Homo sapiens
gcgggccctgcct

SEQ ID NO: 3689015 - DNA, 14 bp, Homo sapiens
gcgggccctgcctg

SEQ ID NO: 3689016 - DNA, 15 bp, Homo sapiens
gcgggccctgcctga

SEQ ID NO: 3689017 - DNA, 20 bp, Homo sapiens
gcggggcgccccaagagccc

SEQ ID NO: 3689018 - DNA, 22 bp, Homo sapiens
gcggggctacagattgggcggg

SEQ ID NO: 3689019 - DNA, 12 bp, Homo sapiens
gcggggctcctc

SEQ ID NO: 3689020 - DNA, 14 bp, Homo sapiens
gcgggtcctagctg

SEQ ID NO: 3689021 - DNA, 22 bp, Homo sapiens
gcggtcccctccgccaggcgag

SEQ ID NO: 3689022 - DNA, 14 bp, Homo sapiens
gcgtcagctgctcc

SEQ ID NO: 3689023 - DNA, 22 bp, Homo sapiens
gcgtcagctgctccctggcatt

SEQ ID NO: 3689024 - DNA, 21 bp, Homo sapiens
gcgtcttcctgagtggtgcca

SEQ ID NO: 3689025 - DNA, 13 bp, Homo sapiens
gcgtgaaggccga

SEQ ID NO: 3689026 - DNA, 15 bp, Homo sapiens
gcgtgaaggccgaga

SEQ ID NO: 3689027 - DNA, 16 bp, Homo sapiens
gcgtgaaggccgagaa

SEQ ID NO: 3689028 - DNA, 17 bp, Homo sapiens
gcgtgccgagccagcaa

SEQ ID NO: 3689029 - DNA, 17 bp, Homo sapiens
gcgtgccgtggcaccag

SEQ ID NO: 3689030 - DNA, 23 bp, Homo sapiens
gcgtgcgcatcttgcctccaggt

SEQ ID NO: 3689031 - DNA, 14 bp, Homo sapiens
gcgtggagggaggc

SEQ ID NO: 3689032 - DNA, 17 bp, Homo sapiens
gcgtggagggaggcccc

SEQ ID NO: 3689033 - DNA, 20 bp, Homo sapiens
gcgtggagggaggccccagg

SEQ ID NO: 3689034 - DNA, 14 bp, Homo sapiens
gcgtggcccaaggc

SEQ ID NO: 3689035 - DNA, 19 bp, Homo sapiens
gcgtggcttctgcaggaat

SEQ ID NO: 3689036 - DNA, 15 bp, Homo sapiens
gcgtgggagccagcc

SEQ ID NO: 3689037 - DNA, 16 bp, Homo sapiens
gcgtgggagccagcct

SEQ ID NO: 3689038 - DNA, 13 bp, Homo sapiens
gcgtgtgcagtgc

SEQ ID NO: 3689039 - DNA, 20 bp, Homo sapiens
gcgttggcttctccctgggg

SEQ ID NO: 3689040 - DNA, 13 bp, Homo sapiens
gctaacagtgaag

SEQ ID NO: 3689041 - DNA, 17 bp, Homo sapiens
gctaagaacctggaact

SEQ ID NO: 3689042 - DNA, 16 bp, Homo sapiens
gctaatttaaagagac

SEQ ID NO: 3689043 - DNA, 16 bp, Homo sapiens
gctacacagatcacag

SEQ ID NO: 3689044 - DNA, 18 bp, Homo sapiens
gctacagattgggcgggg

SEQ ID NO: 3689045 - DNA, 21 bp, Homo sapiens
gctacagattgggcggggctt

SEQ ID NO: 3689046 - DNA, 19 bp, Homo sapiens
gctacaggaagcaccccat

SEQ ID NO: 3689047 - DNA, 22 bp, Homo sapiens
gctacaggaagcaccccatgcc

SEQ ID NO: 3689048 - DNA, 13 bp, Homo sapiens
gctaccccaccca

SEQ ID NO: 3689049 - DNA, 16 bp, Homo sapiens
gctacctttcaaagct

SEQ ID NO: 3689050 - DNA, 17 bp, Homo sapiens
gctacctttcaaagctt

SEQ ID NO: 3689051 - DNA, 16 bp, Homo sapiens
gctactataaagagaa

SEQ ID NO: 3689052 - DNA, 15 bp, Homo sapiens
gctacttggtttgtg

SEQ ID NO: 3689053 - DNA, 20 bp, Homo sapiens
gctagagtcctcactcccag

SEQ ID NO: 3689054 - DNA, 22 bp, Homo sapiens
gctagcagcagggagggcttct

SEQ ID NO: 3689055 - DNA, 14 bp, Homo sapiens
gctaggatggttct

SEQ ID NO: 3689056 - DNA, 20 bp, Homo sapiens
gctaggcataggtctctttg

SEQ ID NO: 3689057 - DNA, 15 bp, Homo sapiens
gctagggtggccctt

SEQ ID NO: 3689058 - DNA, 14 bp, Homo sapiens
gctagtgacttgtg

SEQ ID NO: 3689059 - DNA, 18 bp, Homo sapiens
gctataaattcctctttg

SEQ ID NO: 3689060 - DNA, 19 bp, Homo sapiens
gctatagacccgaggaaac

SEQ ID NO: 3689061 - DNA, 23 bp, Homo sapiens
gctatagacccgaggaaactcag

SEQ ID NO: 3689062 - DNA, 21 bp, Homo sapiens
gctatgcaaaaaattctttag

SEQ ID NO: 3689063 - DNA, 13 bp, Homo sapiens
gctatgggagccc

SEQ ID NO: 3689064 - DNA, 16 bp, Homo sapiens
gctatttatgggcccc

SEQ ID NO: 3689065 - DNA, 17 bp, Homo sapiens
gctatttatgggcccct

SEQ ID NO: 3689066 - DNA, 22 bp, Homo sapiens
gctatttttatttgtttgtgca

SEQ ID NO: 3689067 - DNA, 12 bp, Homo sapiens
gctatttttgta

SEQ ID NO: 3689068 - DNA, 14 bp, Homo sapiens
gctcacacctgtaa

SEQ ID NO: 3689069 - DNA, 13 bp, Homo sapiens
gctcacagctgtg

SEQ ID NO: 3689070 - DNA, 13 bp, Homo sapiens
gctcacctggggt

SEQ ID NO: 3689071 - DNA, 22 bp, Homo sapiens
gctcacgtgagagtgtcttcac

SEQ ID NO: 3689072 - DNA, 14 bp, Homo sapiens
gctcactgtgacct

SEQ ID NO: 3689073 - DNA, 19 bp, Homo sapiens
gctcagaggccttgctgtg

SEQ ID NO: 3689074 - DNA, 22 bp, Homo sapiens
gctcagcaaaagatgcttctca

SEQ ID NO: 3689075 - DNA, 13 bp, Homo sapiens
gctcagctgcgcc

SEQ ID NO: 3689076 - DNA, 12 bp, Homo sapiens
gctcagcttctc

SEQ ID NO: 3689077 - DNA, 13 bp, Homo sapiens
gctcaggagtttg

SEQ ID NO: 3689078 - DNA, 16 bp, Homo sapiens
gctcaggtacttgtaa

SEQ ID NO: 3689079 - DNA, 16 bp, Homo sapiens
gctcatctgctggtcc

SEQ ID NO: 3689080 - DNA, 22 bp, Homo sapiens
gctcatgtgtgcaacagggtat

SEQ ID NO: 3689081 - DNA, 18 bp, Homo sapiens
gctccaacctgcaaagat

SEQ ID NO: 3689082 - DNA, 19 bp, Homo sapiens
gctccaagccccatcttct

SEQ ID NO: 3689083 - DNA, 20 bp, Homo sapiens
gctccaaggggaatcagaac

SEQ ID NO: 3689084 - DNA, 23 bp, Homo sapiens
gctccaaggggaatcagaactca

SEQ ID NO: 3689085 - DNA, 14 bp, Homo sapiens
gctccaatggggcg

SEQ ID NO: 3689086 - DNA, 22 bp, Homo sapiens
gctccaatggggcggggcttct

SEQ ID NO: 3689087 - DNA, 16 bp, Homo sapiens
gctccacccttggcct

SEQ ID NO: 3689088 - DNA, 17 bp, Homo sapiens
gctccacccttggcctg

SEQ ID NO: 3689089 - DNA, 15 bp, Homo sapiens
gctccactctgcttc

SEQ ID NO: 3689090 - DNA, 20 bp, Homo sapiens
gctccactctgcttctctga

SEQ ID NO: 3689091 - DNA, 15 bp, Homo sapiens
gctccactgccatgt

SEQ ID NO: 3689092 - DNA, 21 bp, Homo sapiens
gctccagacctgatcctggag

SEQ ID NO: 3689093 - DNA, 23 bp, Homo sapiens
gctccagacctgatcctggaggc

SEQ ID NO: 3689094 - DNA, 15 bp, Homo sapiens
gctccagagcaggaa

SEQ ID NO: 3689095 - DNA, 11 bp, Homo sapiens
gctccagctgt

SEQ ID NO: 3689096 - DNA, 16 bp, Homo sapiens
gctccaggatggggag

SEQ ID NO: 3689097 - DNA, 22 bp, Homo sapiens
gctccaggcgcgccgacgcctg

SEQ ID NO: 3689098 - DNA, 22 bp, Homo sapiens
gctccattttcttattgcgctg

SEQ ID NO: 3689099 - DNA, 13 bp, Homo sapiens
gctccccctggac

SEQ ID NO: 3689100 - DNA, 18 bp, Homo sapiens
gctccccctggacggggc

SEQ ID NO: 3689101 - DNA, 22 bp, Homo sapiens
gctccccctggacggggcgggc

SEQ ID NO: 3689102 - DNA, 16 bp, Homo sapiens
gctccctaccacctcc

SEQ ID NO: 3689103 - DNA, 13 bp, Homo sapiens
gctccctgagggc

SEQ ID NO: 3689104 - DNA, 23 bp, Homo sapiens
gctccctgagggcggagcgcctc

SEQ ID NO: 3689105 - DNA, 17 bp, Homo sapiens
ggacggggcgggccctg

SEQ ID NO: 3689106 - DNA, 23 bp, Homo sapiens
ggactatatttgggcctgctcca

SEQ ID NO: 3689107 - DNA, 14 bp, Homo sapiens
ggactcagccctga

SEQ ID NO: 3689108 - DNA, 21 bp, Homo sapiens
ggactcagccttcagacagag

SEQ ID NO: 3689109 - DNA, 13 bp, Homo sapiens
ggactcctccctg

SEQ ID NO: 3689110 - DNA, 15 bp, Homo sapiens
ggactcctccctggg

SEQ ID NO: 3689111 - DNA, 22 bp, Homo sapiens
ggactggctagagtcctcactc

SEQ ID NO: 3689112 - DNA, 23 bp, Homo sapiens
ggactggctagagtcctcactcc

SEQ ID NO: 3689113 - DNA, 19 bp, Homo sapiens
ggacttcaaagcaagctgg

SEQ ID NO: 3689114 - DNA, 11 bp, Homo sapiens
ggacttcctgt

SEQ ID NO: 3689115 - DNA, 18 bp, Homo sapiens
ggacttcctgtccagctc

SEQ ID NO: 3689116 - DNA, 17 bp, Homo sapiens
ggactttgcagccggca

SEQ ID NO: 3689117 - DNA, 13 bp, Homo sapiens
ggacttttctgca

SEQ ID NO: 3689118 - DNA, 18 bp, Homo sapiens
ggagaagcaccagcaatt

SEQ ID NO: 3689119 - DNA, 15 bp, Homo sapiens
ggagaagccaggaat

SEQ ID NO: 3689120 - DNA, 17 bp, Homo sapiens
ggagaagcggctggcag

SEQ ID NO: 3689121 - DNA, 18 bp, Homo sapiens
ggagaagcggctggcagc

SEQ ID NO: 3689122 - DNA, 19 bp, Homo sapiens
ggagaagctcctctcccca

SEQ ID NO: 3689123 - DNA, 23 bp, Homo sapiens
ggagaagttgaggggagcatgct

SEQ ID NO: 3689124 - DNA, 22 bp, Homo sapiens
ggagaattgcggcgagacaagc

SEQ ID NO: 3689125 - DNA, 18 bp, Homo sapiens
ggagacagcatcagggtt

SEQ ID NO: 3689126 - DNA, 21 bp, Homo sapiens
ggagacggtttccagggaggg

SEQ ID NO: 3689127 - DNA, 14 bp, Homo sapiens
ggagagaaaatata

SEQ ID NO: 3689128 - DNA, 14 bp, Homo sapiens
ggagagagactcca

SEQ ID NO: 3689129 - DNA, 16 bp, Homo sapiens
ggagagcgcctgcccc

SEQ ID NO: 3689130 - DNA, 20 bp, Homo sapiens
ggagagcgcctgcccctccc

SEQ ID NO: 3689131 - DNA, 14 bp, Homo sapiens
ggagaggagttcag

SEQ ID NO: 3689132 - DNA, 14 bp, Homo sapiens
ggagcaggactccc

SEQ ID NO: 3689133 - DNA, 15 bp, Homo sapiens
ggagccagcctccct

SEQ ID NO: 3689134 - DNA, 23 bp, Homo sapiens
ggagccatgcgccccctccgccc

SEQ ID NO: 3689135 - DNA, 22 bp, Homo sapiens
ggagcccactgtcctgggcctg

SEQ ID NO: 3689136 - DNA, 19 bp, Homo sapiens
ggagcctccaattgcagtg

SEQ ID NO: 3689137 - DNA, 12 bp, Homo sapiens
ggagcctctgga

SEQ ID NO: 3689138 - DNA, 21 bp, Homo sapiens
ggagctagtgtctcctctctg

SEQ ID NO: 3689139 - DNA, 15 bp, Homo sapiens
ggagctatcaggaac

SEQ ID NO: 3689140 - DNA, 22 bp, Homo sapiens
ggagctatcaggaacagctatg

SEQ ID NO: 3689141 - DNA, 20 bp, Homo sapiens
ggagctccactctgcttctc

SEQ ID NO: 3689142 - DNA, 18 bp, Homo sapiens
ggagctcttcaggcctcc

SEQ ID NO: 3689143 - DNA, 23 bp, Homo sapiens
ggagctgctggcttgcagtgcgc

SEQ ID NO: 3689144 - DNA, 19 bp, Homo sapiens
ggagctgggcagaaggcca

SEQ ID NO: 3689145 - DNA, 14 bp, Homo sapiens
ggagctttctgtat

SEQ ID NO: 3689146 - DNA, 12 bp, Homo sapiens
ggaggaagagaa

SEQ ID NO: 3689147 - DNA, 12 bp, Homo sapiens
ggaggaggagcc

SEQ ID NO: 3689148 - DNA, 18 bp, Homo sapiens
ggaggatcagttttttgt

SEQ ID NO: 3689149 - DNA, 17 bp, Homo sapiens
ggaggatctcttgagcc

SEQ ID NO: 3689150 - DNA, 20 bp, Homo sapiens
ggaggccaaggtgggaggat

SEQ ID NO: 3689151 - DNA, 12 bp, Homo sapiens
ggaggccagcca

SEQ ID NO: 3689152 - DNA, 17 bp, Homo sapiens
ggaggccccactgggga

SEQ ID NO: 3689153 - DNA, 13 bp, Homo sapiens
ggaggctcctgtg

SEQ ID NO: 3689154 - DNA, 15 bp, Homo sapiens
ggaggctcctgtggt

SEQ ID NO: 3689155 - DNA, 17 bp, Homo sapiens
ggaggctgcgtgccagt

SEQ ID NO: 3689156 - DNA, 13 bp, Homo sapiens
ggaggctggcagg

SEQ ID NO: 3689157 - DNA, 20 bp, Homo sapiens
ggagggcggcaggggcctgg

SEQ ID NO: 3689158 - DNA, 17 bp, Homo sapiens
ggaggggaaaaaaatgt

SEQ ID NO: 3689159 - DNA, 21 bp, Homo sapiens
ggaggggcctaggcctcagcc

SEQ ID NO: 3689160 - DNA, 14 bp, Homo sapiens
ggagggggatccga

SEQ ID NO: 3689161 - DNA, 18 bp, Homo sapiens
ggaggtcggtaggttcag

SEQ ID NO: 3689162 - DNA, 17 bp, Homo sapiens
ggaggtgattccagtga

SEQ ID NO: 3689163 - DNA, 17 bp, Homo sapiens
ggaggttaaggctgagg

SEQ ID NO: 3689164 - DNA, 14 bp, Homo sapiens
ggagtacccagcct

SEQ ID NO: 3689165 - DNA, 15 bp, Homo sapiens
ggagtacccagccta

SEQ ID NO: 3689166 - DNA, 22 bp, Homo sapiens
ggagtcgtggggtgtgctggga

SEQ ID NO: 3689167 - DNA, 15 bp, Homo sapiens
ggagtctgaagcaga

SEQ ID NO: 3689168 - DNA, 19 bp, Homo sapiens
ggagtgtgagccacctaag

SEQ ID NO: 3689169 - DNA, 14 bp, Homo sapiens
ggagtgttatgtat

SEQ ID NO: 3689170 - DNA, 16 bp, Homo sapiens
ggagtgttatgtattt

SEQ ID NO: 3689171 - DNA, 15 bp, Homo sapiens
ggagttaagacctgg

SEQ ID NO: 3689172 - DNA, 16 bp, Homo sapiens
ggagttaagacctggc

SEQ ID NO: 3689173 - DNA, 23 bp, Homo sapiens
ggagttaagacctggcagctctg

SEQ ID NO: 3689174 - DNA, 20 bp, Homo sapiens
ggagttcaggaacccttctc

SEQ ID NO: 3689175 - DNA, 21 bp, Homo sapiens
ggagttgatctggaacccaga

SEQ ID NO: 3689176 - DNA, 14 bp, Homo sapiens
ggatagatgctggc

SEQ ID NO: 3689177 - DNA, 21 bp, Homo sapiens
ggatccgactgctttggacct

SEQ ID NO: 3689178 - DNA, 16 bp, Homo sapiens
ggatccgagggcccct

SEQ ID NO: 3689179 - DNA, 18 bp, Homo sapiens
ggatctcttgagcctggg

SEQ ID NO: 3689180 - DNA, 18 bp, Homo sapiens
ggatgaaaaatatttctg

SEQ ID NO: 3689181 - DNA, 12 bp, Homo sapiens
ggatgccctgga

SEQ ID NO: 3689182 - DNA, 10 bp, Homo sapiens
ggatggcagt

SEQ ID NO: 3689183 - DNA, 14 bp, Homo sapiens
ggatggcagtgtgg

SEQ ID NO: 3689184 - DNA, 16 bp, Homo sapiens
ggatggccccagcaca

SEQ ID NO: 3689185 - DNA, 15 bp, Homo sapiens
ggatggggaggggct

SEQ ID NO: 3689186 - DNA, 17 bp, Homo sapiens
ggatggggaggggctct

SEQ ID NO: 3689187 - DNA, 19 bp, Homo sapiens
ggatggggcagagcttctc

SEQ ID NO: 3689188 - DNA, 15 bp, Homo sapiens
ggatgggggaactca

SEQ ID NO: 3689189 - DNA, 17 bp, Homo sapiens
ggatgggggaactcaga

SEQ ID NO: 3689190 - DNA, 21 bp, Homo sapiens
ggatgggggaactcagatcca

SEQ ID NO: 3689191 - DNA, 23 bp, Homo sapiens
ggatgttggccaccaggtgcctt

SEQ ID NO: 3689192 - DNA, 18 bp, Homo sapiens
ggattaacctctgcacta

SEQ ID NO: 3689193 - DNA, 14 bp, Homo sapiens
ggattcaggctgct

SEQ ID NO: 3689194 - DNA, 23 bp, Homo sapiens
ggcaaaaggatctttgtggccaa

SEQ ID NO: 3689195 - DNA, 16 bp, Homo sapiens
ggcaaaggaaggtgga

SEQ ID NO: 3689196 - DNA, 17 bp, Homo sapiens
ggcaaaggaaggtggat

SEQ ID NO: 3689197 - DNA, 21 bp, Homo sapiens
ggcaaagtacttgtcatagac

SEQ ID NO: 3689198 - DNA, 16 bp, Homo sapiens
ggcaaggccccttcca

SEQ ID NO: 3689199 - DNA, 13 bp, Homo sapiens
ggcaagtgtgggc

SEQ ID NO: 3689200 - DNA, 23 bp, Homo sapiens
ggcacaggaggcaggcatggccc

SEQ ID NO: 3689201 - DNA, 17 bp, Homo sapiens
ggcacagggtctgctct

SEQ ID NO: 3689202 - DNA, 18 bp, Homo sapiens
ggcacagggtctgctctt

SEQ ID NO: 3689203 - DNA, 15 bp, Homo sapiens
ggcaccagcagcctg

SEQ ID NO: 3689204 - DNA, 14 bp, Homo sapiens
ggcaccagccagcg

SEQ ID NO: 3689205 - DNA, 15 bp, Homo sapiens
ggcacctaatccagg

SEQ ID NO: 3689206 - DNA, 22 bp, Homo sapiens
ggcacctaatccaggcagatcc

SEQ ID NO: 3689207 - DNA, 17 bp, Homo sapiens
ggcacctataaaacagg

SEQ ID NO: 3689208 - DNA, 13 bp, Homo sapiens
ggcacggctctgg

SEQ ID NO: 3689209 - DNA, 12 bp, Homo sapiens
ggcagagaataa

SEQ ID NO: 3689210 - DNA, 19 bp, Homo sapiens
ggcagagctggctctgagc

SEQ ID NO: 3689211 - DNA, 20 bp, Homo sapiens
ggcagagcttctcctgacca

SEQ ID NO: 3689212 - DNA, 19 bp, Homo sapiens
ggcagatgagcttatttca

SEQ ID NO: 3689213 - DNA, 17 bp, Homo sapiens
ggcagcatccccttgaa

SEQ ID NO: 3689214 - DNA, 12 bp, Homo sapiens
ggcagccaggct

SEQ ID NO: 3689215 - DNA, 15 bp, Homo sapiens
ggcagccaggctgcc

SEQ ID NO: 3689216 - DNA, 15 bp, Homo sapiens
ggcagctctggacag

SEQ ID NO: 3689217 - DNA, 19 bp, Homo sapiens
ggcagctgtgtctgagccc

SEQ ID NO: 3689218 - DNA, 15 bp, Homo sapiens
ggcaggaaggagagc

SEQ ID NO: 3689219 - DNA, 16 bp, Homo sapiens
ggcaggaaggagagcc

SEQ ID NO: 3689220 - DNA, 14 bp, Homo sapiens
ggcaggaaggctga

SEQ ID NO: 3689221 - DNA, 16 bp, Homo sapiens
ggcaggaagggaagcg

SEQ ID NO: 3689222 - DNA, 13 bp, Homo sapiens
gggtcctggccat

SEQ ID NO: 3689223 - DNA, 17 bp, Homo sapiens
gggtcctggccatccca

SEQ ID NO: 3689224 - DNA, 18 bp, Homo sapiens
gggtcctggctcctgagg

SEQ ID NO: 3689225 - DNA, 22 bp, Homo sapiens
gggtctggagttgatctggaac

SEQ ID NO: 3689226 - DNA, 23 bp, Homo sapiens
gggtctgggcggcgggcggctgg

SEQ ID NO: 3689227 - DNA, 20 bp, Homo sapiens
gggtggagaactcctagggt

SEQ ID NO: 3689228 - DNA, 17 bp, Homo sapiens
gggtggccgctgagtgg

SEQ ID NO: 3689229 - DNA, 22 bp, Homo sapiens
gggtgggacagggcttctcctg

SEQ ID NO: 3689230 - DNA, 12 bp, Homo sapiens
gggtgggactct

SEQ ID NO: 3689231 - DNA, 13 bp, Homo sapiens
gggtgggcctcgg

SEQ ID NO: 3689232 - DNA, 13 bp, Homo sapiens
gggtggggctcct

SEQ ID NO: 3689233 - DNA, 13 bp, Homo sapiens
gggtgtgctggga

SEQ ID NO: 3689234 - DNA, 16 bp, Homo sapiens
gggttaagaagacttt

SEQ ID NO: 3689235 - DNA, 13 bp, Homo sapiens
gggttcaggggac

SEQ ID NO: 3689236 - DNA, 13 bp, Homo sapiens
gggttcatttgtg

SEQ ID NO: 3689237 - DNA, 18 bp, Homo sapiens
gggttccctttccttcca

SEQ ID NO: 3689238 - DNA, 20 bp, Homo sapiens
gggttggtatctcaggtctg

SEQ ID NO: 3689239 - DNA, 15 bp, Homo sapiens
ggtaagaagaaagca

SEQ ID NO: 3689240 - DNA, 17 bp, Homo sapiens
ggtaagaagaaagcaaa

SEQ ID NO: 3689241 - DNA, 13 bp, Homo sapiens
ggtacaaaaataa

SEQ ID NO: 3689242 - DNA, 16 bp, Homo sapiens
ggtacaacggaggcct

SEQ ID NO: 3689243 - DNA, 22 bp, Homo sapiens
ggtaccagatgcagctcaagag

SEQ ID NO: 3689244 - DNA, 22 bp, Homo sapiens
ggtactcgcacctcttggcttt

SEQ ID NO: 3689245 - DNA, 15 bp, Homo sapiens
ggtacttcttgaagg

SEQ ID NO: 3689246 - DNA, 15 bp, Homo sapiens
ggtagctagaggaac

SEQ ID NO: 3689247 - DNA, 22 bp, Homo sapiens
ggtagctgggattacaggtgtg

SEQ ID NO: 3689248 - DNA, 16 bp, Homo sapiens
ggtaggttcagccaag

SEQ ID NO: 3689249 - DNA, 17 bp, Homo sapiens
ggtaggttcagccaagg

SEQ ID NO: 3689250 - DNA, 19 bp, Homo sapiens
ggtaggttcagccaaggtt

SEQ ID NO: 3689251 - DNA, 16 bp, Homo sapiens
ggtagtcctcccaagc

SEQ ID NO: 3689252 - DNA, 18 bp, Homo sapiens
ggtagtcctcccaagctg

SEQ ID NO: 3689253 - DNA, 22 bp, Homo sapiens
ggtagtcctcccaagctgtgct

SEQ ID NO: 3689254 - DNA, 23 bp, Homo sapiens
ggtagtcctcccaagctgtgctg

SEQ ID NO: 3689255 - DNA, 13 bp, Homo sapiens
ggtatatatacat

SEQ ID NO: 3689256 - DNA, 18 bp, Homo sapiens
ggtatatatccgcctggc

SEQ ID NO: 3689257 - DNA, 15 bp, Homo sapiens
ggtatctcaggtctg

SEQ ID NO: 3689258 - DNA, 21 bp, Homo sapiens
ggtatgaccttctaggaagct

SEQ ID NO: 3689259 - DNA, 15 bp, Homo sapiens
ggtatgtctgtgcca

SEQ ID NO: 3689260 - DNA, 18 bp, Homo sapiens
ggtatgtttaatctgtta

SEQ ID NO: 3689261 - DNA, 18 bp, Homo sapiens
ggtattagtgtttgaaaa

SEQ ID NO: 3689262 - DNA, 16 bp, Homo sapiens
ggtcaacagttttcct

SEQ ID NO: 3689263 - DNA, 23 bp, Homo sapiens
ggtcaaggcagtagaactccagg

SEQ ID NO: 3689264 - DNA, 20 bp, Homo sapiens
ggtcacacaaaggcatgctg

SEQ ID NO: 3689265 - DNA, 15 bp, Homo sapiens
ggtcacagcggaggt

SEQ ID NO: 3689266 - DNA, 14 bp, Homo sapiens
ggtcagagtgccac

SEQ ID NO: 3689267 - DNA, 22 bp, Homo sapiens
ggtcaggatgtaggggttaact

SEQ ID NO: 3689268 - DNA, 17 bp, Homo sapiens
ggtcagtgcagcagagg

SEQ ID NO: 3689269 - DNA, 20 bp, Homo sapiens
ggtcatgccctcctctccca

SEQ ID NO: 3689270 - DNA, 11 bp, Homo sapiens
ggtccacttcc

SEQ ID NO: 3689271 - DNA, 11 bp, Homo sapiens
ggtccagctct

SEQ ID NO: 3689272 - DNA, 12 bp, Homo sapiens
ggtccagctctg

SEQ ID NO: 3689273 - DNA, 13 bp, Homo sapiens
ggtccagctctgg

SEQ ID NO: 3689274 - DNA, 16 bp, Homo sapiens
ggtccagctctggagg

SEQ ID NO: 3689275 - DNA, 17 bp, Homo sapiens
ggtccagctctgtgggc

SEQ ID NO: 3689276 - DNA, 13 bp, Homo sapiens
ggtccaggctgtg

SEQ ID NO: 3689277 - DNA, 15 bp, Homo sapiens
ggtcccacagccctg

SEQ ID NO: 3689278 - DNA, 14 bp, Homo sapiens
ggtcctgctttctc

SEQ ID NO: 3689279 - DNA, 12 bp, Homo sapiens
ggtcctggctcc

SEQ ID NO: 3689280 - DNA, 16 bp, Homo sapiens
ggtcctttctggaagt

SEQ ID NO: 3689281 - DNA, 13 bp, Homo sapiens
ggtcgaggcagga

SEQ ID NO: 3689282 - DNA, 12 bp, Homo sapiens
ggtcgctcctgc

SEQ ID NO: 3689283 - DNA, 20 bp, Homo sapiens
ggtcggtaggttcagccaag

SEQ ID NO: 3689284 - DNA, 23 bp, Homo sapiens
ggtctcacccatgcaagcagagg

SEQ ID NO: 3689285 - DNA, 20 bp, Homo sapiens
ggtctcttcttggggcccag

SEQ ID NO: 3689286 - DNA, 17 bp, Homo sapiens
ggtctctttgctttctg

SEQ ID NO: 3689287 - DNA, 14 bp, Homo sapiens
ggtctgcaggcagg

SEQ ID NO: 3689288 - DNA, 18 bp, Homo sapiens
ggtctgctctttctctgc

SEQ ID NO: 3689289 - DNA, 19 bp, Homo sapiens
ggtctgctctttctctgcc

SEQ ID NO: 3689290 - DNA, 16 bp, Homo sapiens
ggtctgtgcatttctg

SEQ ID NO: 3689291 - DNA, 20 bp, Homo sapiens
ggtctgttggcaggctggcc

SEQ ID NO: 3689292 - DNA, 12 bp, Homo sapiens
ggtcttcagggg

SEQ ID NO: 3689293 - DNA, 17 bp, Homo sapiens
ggtcttccctacctcag

SEQ ID NO: 3689294 - DNA, 22 bp, Homo sapiens
ggtcttccctacctcaggcagg

SEQ ID NO: 3689295 - DNA, 21 bp, Homo sapiens
ggtcttgaactcctggactca

SEQ ID NO: 3689296 - DNA, 17 bp, Homo sapiens
ggtgagaggaagggtgg

SEQ ID NO: 3689297 - DNA, 16 bp, Homo sapiens
ggtgagggttggcgct

SEQ ID NO: 3689298 - DNA, 23 bp, Homo sapiens
ggtgatttcagactgcagagggg

SEQ ID NO: 3689299 - DNA, 16 bp, Homo sapiens
ggtgcaacccttaccc

SEQ ID NO: 3689300 - DNA, 11 bp, Homo sapiens
ggtgcagaggt

SEQ ID NO: 3689301 - DNA, 19 bp, Homo sapiens
ggtgcagaggtaccctggg

SEQ ID NO: 3689302 - DNA, 16 bp, Homo sapiens
ggtgccatttctgaac

SEQ ID NO: 3689303 - DNA, 17 bp, Homo sapiens
ggtgcccaagccagagg

SEQ ID NO: 3689304 - DNA, 22 bp, Homo sapiens
ggtgcccaagccagaggctggg

SEQ ID NO: 3689305 - DNA, 21 bp, Homo sapiens
ggtgccccaggaccagctcag

SEQ ID NO: 3689306 - DNA, 17 bp, Homo sapiens
ggtgctgacggccaggg

SEQ ID NO: 3689307 - DNA, 18 bp, Homo sapiens
ggtggaacaactctggga

SEQ ID NO: 3689308 - DNA, 12 bp, Homo sapiens
ggtggagcagga

SEQ ID NO: 3689309 - DNA, 15 bp, Homo sapiens
ggtggatgaggcttc

SEQ ID NO: 3689310 - DNA, 14 bp, Homo sapiens
ggtggcaccagcag

SEQ ID NO: 3689311 - DNA, 18 bp, Homo sapiens
ggtggccactgagctggc

SEQ ID NO: 3689312 - DNA, 12 bp, Homo sapiens
ggtggcccagct

SEQ ID NO: 3689313 - DNA, 20 bp, Homo sapiens
ggtggccgctgagtggcagg

SEQ ID NO: 3689314 - DNA, 21 bp, Homo sapiens
ggtggccgctgagtggcaggg

SEQ ID NO: 3689315 - DNA, 22 bp, Homo sapiens
ggtggctagtcaagctcctcct

SEQ ID NO: 3689316 - DNA, 23 bp, Homo sapiens
ggtggctagtcaagctcctcctc

SEQ ID NO: 3689317 - DNA, 19 bp, Homo sapiens
ggtggctcacacctgtaat

SEQ ID NO: 3689318 - DNA, 19 bp, Homo sapiens
ggtggctgggctgctcctg

SEQ ID NO: 3689319 - DNA, 14 bp, Homo sapiens
ggtgggacagggct

SEQ ID NO: 3689320 - DNA, 15 bp, Homo sapiens
ggtgggacagggctt

SEQ ID NO: 3689321 - DNA, 11 bp, Homo sapiens
ggtgggacccc

SEQ ID NO: 3689322 - DNA, 20 bp, Homo sapiens
ggtgggacccccgtggggca

SEQ ID NO: 3689323 - DNA, 20 bp, Homo sapiens
ggtgggaggatctcttgagc

SEQ ID NO: 3689324 - DNA, 17 bp, Homo sapiens
ggtgggcttttccctgg

SEQ ID NO: 3689325 - DNA, 20 bp, Homo sapiens
ggtgggcttttccctgggtg

SEQ ID NO: 3689326 - DNA, 22 bp, Homo sapiens
ggtgggcttttccctgggtgga

SEQ ID NO: 3689327 - DNA, 14 bp, Homo sapiens
ggtgggggagcctc

SEQ ID NO: 3689328 - DNA, 13 bp, Homo sapiens
ggtgggggcctcg

SEQ ID NO: 3689329 - DNA, 23 bp, Homo sapiens
ggtggggtcatgccctcctctcc

SEQ ID NO: 3689330 - DNA, 16 bp, Homo sapiens
ggtgtggaggctcctg

SEQ ID NO: 3689331 - DNA, 15 bp, Homo sapiens
ggtgtggatggcagt

SEQ ID NO: 3689332 - DNA, 18 bp, Homo sapiens
ggtgtggcccatggctgt

SEQ ID NO: 3689333 - DNA, 22 bp, Homo sapiens
ggtgttgccaaatatgtcctgg

SEQ ID NO: 3689334 - DNA, 22 bp, Homo sapiens
ggttaaggctgaggaaaggcca

SEQ ID NO: 3689335 - DNA, 16 bp, Homo sapiens
ggttaccatgggtgtg

SEQ ID NO: 3689336 - DNA, 23 bp, Homo sapiens
ggttatgtttccatggttaccat

SEQ ID NO: 3689337 - DNA, 23 bp, Homo sapiens
ggttctaggcatctctgtacttt

SEQ ID NO: 3689338 - DNA, 23 bp, Homo sapiens
ggttctcacagtgggagccaggg

SEQ ID NO: 3689339 - DNA, 15 bp, Homo sapiens
gtggtcagagtgcca

SEQ ID NO: 3689340 - DNA, 15 bp, Homo sapiens
gtggtcggtgggacc

SEQ ID NO: 3689341 - DNA, 21 bp, Homo sapiens
gtggtctcttcttggggccca

SEQ ID NO: 3689342 - DNA, 15 bp, Homo sapiens
gtggtctgcaggcag

SEQ ID NO: 3689343 - DNA, 16 bp, Homo sapiens
gtggtctgcaggcagg

SEQ ID NO: 3689344 - DNA, 21 bp, Homo sapiens
gtggtctgttggcaggctggc

SEQ ID NO: 3689345 - DNA, 22 bp, Homo sapiens
gtggtctgttggcaggctggcc

SEQ ID NO: 3689346 - DNA, 23 bp, Homo sapiens
gtggtctgttggcaggctggcca

SEQ ID NO: 3689347 - DNA, 17 bp, Homo sapiens
gtggtggcagtggaggt

SEQ ID NO: 3689348 - DNA, 16 bp, Homo sapiens
gtggtggtaaccctgg

SEQ ID NO: 3689349 - DNA, 20 bp, Homo sapiens
gtggtggtaaccctggtggt

SEQ ID NO: 3689350 - DNA, 14 bp, Homo sapiens
gtggtgtgcagtgg

SEQ ID NO: 3689351 - DNA, 13 bp, Homo sapiens
gtggttctctggg

SEQ ID NO: 3689352 - DNA, 18 bp, Homo sapiens
gtggttgctgttttcctc

SEQ ID NO: 3689353 - DNA, 19 bp, Homo sapiens
gtggttgctgttttcctcc

SEQ ID NO: 3689354 - DNA, 20 bp, Homo sapiens
gtggttgctgttttcctccc

SEQ ID NO: 3689355 - DNA, 14 bp, Homo sapiens
gtgtatttgctttt

SEQ ID NO: 3689356 - DNA, 19 bp, Homo sapiens
gtgtcccaggcagggagac

SEQ ID NO: 3689357 - DNA, 21 bp, Homo sapiens
gtgtccccgctgctgtgcaac

SEQ ID NO: 3689358 - DNA, 14 bp, Homo sapiens
gtgtcctaggagta

SEQ ID NO: 3689359 - DNA, 15 bp, Homo sapiens
gtgtcctctccctgc

SEQ ID NO: 3689360 - DNA, 16 bp, Homo sapiens
gtgtctcccaggtgca

SEQ ID NO: 3689361 - DNA, 12 bp, Homo sapiens
gtgtctgagccc

SEQ ID NO: 3689362 - DNA, 21 bp, Homo sapiens
gtgtctgagcccaacccttct

SEQ ID NO: 3689363 - DNA, 16 bp, Homo sapiens
gtgtcttgggcagagc

SEQ ID NO: 3689364 - DNA, 17 bp, Homo sapiens
gtgtcttgggcagagct

SEQ ID NO: 3689365 - DNA, 20 bp, Homo sapiens
gtgtcttgggcagagctggc

SEQ ID NO: 3689366 - DNA, 14 bp, Homo sapiens
gtgtgaaacatact

SEQ ID NO: 3689367 - DNA, 22 bp, Homo sapiens
gtgtgagaagtgaatgctggga

SEQ ID NO: 3689368 - DNA, 16 bp, Homo sapiens
gtgtgaggagctgctg

SEQ ID NO: 3689369 - DNA, 17 bp, Homo sapiens
gtgtgcactaaggggcc

SEQ ID NO: 3689370 - DNA, 19 bp, Homo sapiens
gtgtgctgggagctccact

SEQ ID NO: 3689371 - DNA, 14 bp, Homo sapiens
gtgtggatggcagt

SEQ ID NO: 3689372 - DNA, 15 bp, Homo sapiens
gtgtggcctgtggct

SEQ ID NO: 3689373 - DNA, 18 bp, Homo sapiens
gtgtgtcccctcacgcaa

SEQ ID NO: 3689374 - DNA, 17 bp, Homo sapiens
gtgtgtgacaattctgt

SEQ ID NO: 3689375 - DNA, 14 bp, Homo sapiens
gtgtgtgtgtgcac

SEQ ID NO: 3689376 - DNA, 16 bp, Homo sapiens
gtgtgttgtctcttga

SEQ ID NO: 3689377 - DNA, 15 bp, Homo sapiens
gtgtgtttctgatct

SEQ ID NO: 3689378 - DNA, 21 bp, Homo sapiens
gtgttagtggcaccgcctccc

SEQ ID NO: 3689379 - DNA, 14 bp, Homo sapiens
gtgttctgtagact

SEQ ID NO: 3689380 - DNA, 19 bp, Homo sapiens
gtgttgccaaatatgtcct

SEQ ID NO: 3689381 - DNA, 14 bp, Homo sapiens
gtgttgccaagctc

SEQ ID NO: 3689382 - DNA, 18 bp, Homo sapiens
gtgttgccaagctccaag

SEQ ID NO: 3689383 - DNA, 21 bp, Homo sapiens
gtgttgcttcaaactgagaca

SEQ ID NO: 3689384 - DNA, 12 bp, Homo sapiens
gtgttgtctcta

SEQ ID NO: 3689385 - DNA, 23 bp, Homo sapiens
gtgtttgaaaaagctggtctttg

SEQ ID NO: 3689386 - DNA, 22 bp, Homo sapiens
gttaaaatacagttctgtcata

SEQ ID NO: 3689387 - DNA, 19 bp, Homo sapiens
gttaactgtgaaataccac

SEQ ID NO: 3689388 - DNA, 19 bp, Homo sapiens
gttaacttggtcagagcca

SEQ ID NO: 3689389 - DNA, 17 bp, Homo sapiens
gttaagacaacaggcat

SEQ ID NO: 3689390 - DNA, 16 bp, Homo sapiens
gttaagacctggcagc

SEQ ID NO: 3689391 - DNA, 16 bp, Homo sapiens
gttaaggctgaggaaa

SEQ ID NO: 3689392 - DNA, 16 bp, Homo sapiens
gttaatccctttgtct

SEQ ID NO: 3689393 - DNA, 20 bp, Homo sapiens
gttaattttttggtacaaaa

SEQ ID NO: 3689394 - DNA, 17 bp, Homo sapiens
gttacaacttgtatttc

SEQ ID NO: 3689395 - DNA, 20 bp, Homo sapiens
gttacaggaatgaagtaaag

SEQ ID NO: 3689396 - DNA, 19 bp, Homo sapiens
gttatagaatagcctgagg

SEQ ID NO: 3689397 - DNA, 22 bp, Homo sapiens
gttatagtgacagctttccatg

SEQ ID NO: 3689398 - DNA, 12 bp, Homo sapiens
gttatatttcag

SEQ ID NO: 3689399 - DNA, 19 bp, Homo sapiens
gttatcttatactgtacaa

SEQ ID NO: 3689400 - DNA, 22 bp, Homo sapiens
gttatcttatactgtacaataa

SEQ ID NO: 3689401 - DNA, 23 bp, Homo sapiens
gttatcttatactgtacaataaa

SEQ ID NO: 3689402 - DNA, 22 bp, Homo sapiens
gttatgtactagtgttctgttt

SEQ ID NO: 3689403 - DNA, 13 bp, Homo sapiens
gttatgtatttcc

SEQ ID NO: 3689404 - DNA, 15 bp, Homo sapiens
gttatgttttacatg

SEQ ID NO: 3689405 - DNA, 16 bp, Homo sapiens
gttcagcaccacccta

SEQ ID NO: 3689406 - DNA, 14 bp, Homo sapiens
gttcagcactgtcc

SEQ ID NO: 3689407 - DNA, 16 bp, Homo sapiens
gttcagcactgtccct

SEQ ID NO: 3689408 - DNA, 15 bp, Homo sapiens
gttcagccaaggttt

SEQ ID NO: 3689409 - DNA, 15 bp, Homo sapiens
gttcaggggactcag

SEQ ID NO: 3689410 - DNA, 12 bp, Homo sapiens
gttccagctctt

SEQ ID NO: 3689411 - DNA, 19 bp, Homo sapiens
gttccagggtccctctgtg

SEQ ID NO: 3689412 - DNA, 19 bp, Homo sapiens
gttcccaccaggctgctca

SEQ ID NO: 3689413 - DNA, 21 bp, Homo sapiens
gttcccccttcacaaagccca

SEQ ID NO: 3689414 - DNA, 19 bp, Homo sapiens
gttcccttcctctgtgcca

SEQ ID NO: 3689415 - DNA, 14 bp, Homo sapiens
gttcccttggcctc

SEQ ID NO: 3689416 - DNA, 22 bp, Homo sapiens
gttccctttccttccatcccta

SEQ ID NO: 3689417 - DNA, 19 bp, Homo sapiens
gttccgtatctccctggag

SEQ ID NO: 3689418 - DNA, 20 bp, Homo sapiens
gttcgagaccagcctggcca

SEQ ID NO: 3689419 - DNA, 13 bp, Homo sapiens
gttctatgcttcc

SEQ ID NO: 3689420 - DNA, 21 bp, Homo sapiens
gttctatgcttcctcgtgcca

SEQ ID NO: 3689421 - DNA, 21 bp, Homo sapiens
gttctccgttagctcctgtgg

SEQ ID NO: 3689422 - DNA, 19 bp, Homo sapiens
gttctctgggcctcagttt

SEQ ID NO: 3689423 - DNA, 21 bp, Homo sapiens
gttctcttgctttcacattgt

SEQ ID NO: 3689424 - DNA, 14 bp, Homo sapiens
gttctgtttgttat

SEQ ID NO: 3689425 - DNA, 22 bp, Homo sapiens
gttctgtttgttattgttttgt

SEQ ID NO: 3689426 - DNA, 12 bp, Homo sapiens
gttcttatttaa

SEQ ID NO: 3689427 - DNA, 15 bp, Homo sapiens
gttcttcctgcaacc

SEQ ID NO: 3689428 - DNA, 18 bp, Homo sapiens
gttcttgagattttgtat

SEQ ID NO: 3689429 - DNA, 14 bp, Homo sapiens
gttcttgtggaaga

SEQ ID NO: 3689430 - DNA, 15 bp, Homo sapiens
gttctttgggccaga

SEQ ID NO: 3689431 - DNA, 13 bp, Homo sapiens
gttctttgttcat

SEQ ID NO: 3689432 - DNA, 20 bp, Homo sapiens
gttctttgttcatagcccag

SEQ ID NO: 3689433 - DNA, 21 bp, Homo sapiens
gttctttgttcatagcccagt

SEQ ID NO: 3689434 - DNA, 15 bp, Homo sapiens
gttctttttaagtta

SEQ ID NO: 3689435 - DNA, 17 bp, Homo sapiens
gttgaaaaacagctgag

SEQ ID NO: 3689436 - DNA, 16 bp, Homo sapiens
gttgaagactttgttt

SEQ ID NO: 3689437 - DNA, 15 bp, Homo sapiens
gttgacacaggtctt

SEQ ID NO: 3689438 - DNA, 22 bp, Homo sapiens
gttgacatatttaatgttttaa

SEQ ID NO: 3689439 - DNA, 20 bp, Homo sapiens
gttgacttgacagaacactg

SEQ ID NO: 3689440 - DNA, 23 bp, Homo sapiens
gttgactttttaaaattctgagt

SEQ ID NO: 3689441 - DNA, 11 bp, Homo sapiens
gttgaggggag

SEQ ID NO: 3689442 - DNA, 18 bp, Homo sapiens
gttgaggggagcatgctt

SEQ ID NO: 3689443 - DNA, 15 bp, Homo sapiens
gttgatctggaaccc

SEQ ID NO: 3689444 - DNA, 16 bp, Homo sapiens
gttgatctggaaccca

SEQ ID NO: 3689445 - DNA, 16 bp, Homo sapiens
gttgcagacaggaatc

SEQ ID NO: 3689446 - DNA, 20 bp, Homo sapiens
gttgcagacaggaatcttaa

SEQ ID NO: 3689447 - DNA, 13 bp, Homo sapiens
gttgcctcatggc

SEQ ID NO: 3689448 - DNA, 21 bp, Homo sapiens
gttgcctcatggccagcgccc

SEQ ID NO: 3689449 - DNA, 17 bp, Homo sapiens
gttgctgttttcctccc

SEQ ID NO: 3689450 - DNA, 19 bp, Homo sapiens
gttgctgttttcctccctt

SEQ ID NO: 3689451 - DNA, 13 bp, Homo sapiens
gttggacagtagt

SEQ ID NO: 3689452 - DNA, 14 bp, Homo sapiens
gttggcaaaaaggc

SEQ ID NO: 3689453 - DNA, 14 bp, Homo sapiens
gttggcaggctggc

SEQ ID NO: 3689454 - DNA, 19 bp, Homo sapiens
gttggcttctccctgggga

SEQ ID NO: 3689455 - DNA, 16 bp, Homo sapiens
tagggacatttccaag

SEQ ID NO: 3689456 - DNA, 18 bp, Homo sapiens
taggtaggcttctacctg

SEQ ID NO: 3689457 - DNA, 19 bp, Homo sapiens
taggtatgtctgtgccatt

SEQ ID NO: 3689458 - DNA, 12 bp, Homo sapiens
taggtctccagt

SEQ ID NO: 3689459 - DNA, 13 bp, Homo sapiens
taggtcttgctgg

SEQ ID NO: 3689460 - DNA, 13 bp, Homo sapiens
tagtaaatgttat

SEQ ID NO: 3689461 - DNA, 20 bp, Homo sapiens
tagtaagtttttcttcatga

SEQ ID NO: 3689462 - DNA, 21 bp, Homo sapiens
tagtaatttattgtctgtcta

SEQ ID NO: 3689463 - DNA, 14 bp, Homo sapiens
tagtcaagctcctc

SEQ ID NO: 3689464 - DNA, 16 bp, Homo sapiens
tagtcccttcccctcc

SEQ ID NO: 3689465 - DNA, 20 bp, Homo sapiens
tagtcccttcccctccctgg

SEQ ID NO: 3689466 - DNA, 14 bp, Homo sapiens
tagtcctcccaagc

SEQ ID NO: 3689467 - DNA, 16 bp, Homo sapiens
tagtcctcccaagctg

SEQ ID NO: 3689468 - DNA, 18 bp, Homo sapiens
tagtcctcccaagctgtg

SEQ ID NO: 3689469 - DNA, 19 bp, Homo sapiens
tagtcctcccaagctgtgc

SEQ ID NO: 3689470 - DNA, 21 bp, Homo sapiens
tagtcctcccaagctgtgctg

SEQ ID NO: 3689471 - DNA, 22 bp, Homo sapiens
tagtcctgggagaggacaggga

SEQ ID NO: 3689472 - DNA, 14 bp, Homo sapiens
tagtcttttgcttt

SEQ ID NO: 3689473 - DNA, 21 bp, Homo sapiens
tagtcttttgcttttggcaaa

SEQ ID NO: 3689474 - DNA, 20 bp, Homo sapiens
tagtgccaacttcccctcta

SEQ ID NO: 3689475 - DNA, 13 bp, Homo sapiens
tagtgccacccac

SEQ ID NO: 3689476 - DNA, 12 bp, Homo sapiens
tagtgttctgtt

SEQ ID NO: 3689477 - DNA, 15 bp, Homo sapiens
tagttatataattgt

SEQ ID NO: 3689478 - DNA, 19 bp, Homo sapiens
tagttgctatttttgtaaa

SEQ ID NO: 3689479 - DNA, 22 bp, Homo sapiens
tagtttctttattttgtgtaaa

SEQ ID NO: 3689480 - DNA, 22 bp, Homo sapiens
tagtttttaacaatctaacaat

SEQ ID NO: 3689481 - DNA, 23 bp, Homo sapiens
tagttttttttttttttatgtga

SEQ ID NO: 3689482 - DNA, 15 bp, Homo sapiens
tataaaactttcctc

SEQ ID NO: 3689483 - DNA, 17 bp, Homo sapiens
tataaagagaagacgaa

SEQ ID NO: 3689484 - DNA, 22 bp, Homo sapiens
tataatatttttaattaaataa

SEQ ID NO: 3689485 - DNA, 15 bp, Homo sapiens
tatacataaacttaa

SEQ ID NO: 3689486 - DNA, 19 bp, Homo sapiens
tatacatatatatatataa

SEQ ID NO: 3689487 - DNA, 20 bp, Homo sapiens
tatacatcttatagatgcaa

SEQ ID NO: 3689488 - DNA, 22 bp, Homo sapiens
tatagaataaagcctctgtgct

SEQ ID NO: 3689489 - DNA, 14 bp, Homo sapiens
tatagcctggactg

SEQ ID NO: 3689490 - DNA, 17 bp, Homo sapiens
tataggacaaaatgtta

SEQ ID NO: 3689491 - DNA, 14 bp, Homo sapiens
tatagtaggcatgt

SEQ ID NO: 3689492 - DNA, 18 bp, Homo sapiens
tatagtatttgattcaaa

SEQ ID NO: 3689493 - DNA, 21 bp, Homo sapiens
tatagttcatgtctgctatca

SEQ ID NO: 3689494 - DNA, 14 bp, Homo sapiens
tatataacatatat

SEQ ID NO: 3689495 - DNA, 17 bp, Homo sapiens
tatataatatctaaagt

SEQ ID NO: 3689496 - DNA, 14 bp, Homo sapiens
tatatatacatata

SEQ ID NO: 3689497 - DNA, 20 bp, Homo sapiens
tatatatttattttattcta

SEQ ID NO: 3689498 - DNA, 13 bp, Homo sapiens
tatatatttctat

SEQ ID NO: 3689499 - DNA, 12 bp, Homo sapiens
tatatgtatttt

SEQ ID NO: 3689500 - DNA, 15 bp, Homo sapiens
tatattaatgtactt

SEQ ID NO: 3689501 - DNA, 11 bp, Homo sapiens
tatattacaag

SEQ ID NO: 3689502 - DNA, 17 bp, Homo sapiens
tatatttgtaaagctat

SEQ ID NO: 3689503 - DNA, 20 bp, Homo sapiens
tatatttgtgctatagtatt

SEQ ID NO: 3689504 - DNA, 14 bp, Homo sapiens
tatattttaatttg

SEQ ID NO: 3689505 - DNA, 19 bp, Homo sapiens
tatcaaatgcagtatattt

SEQ ID NO: 3689506 - DNA, 21 bp, Homo sapiens
tatcaaatgcagtatatttct

SEQ ID NO: 3689507 - DNA, 14 bp, Homo sapiens
tatcaacttcctaa

SEQ ID NO: 3689508 - DNA, 15 bp, Homo sapiens
tatcacctcattctg

SEQ ID NO: 3689509 - DNA, 19 bp, Homo sapiens
tatcacctcattctgaacc

SEQ ID NO: 3689510 - DNA, 15 bp, Homo sapiens
tatcacttacatttt

SEQ ID NO: 3689511 - DNA, 15 bp, Homo sapiens
tatcacttttctggg

SEQ ID NO: 3689512 - DNA, 17 bp, Homo sapiens
tatcaggtgcccctctt

SEQ ID NO: 3689513 - DNA, 14 bp, Homo sapiens
tatcatattattat

SEQ ID NO: 3689514 - DNA, 19 bp, Homo sapiens
tatccccccatcttgcttc

SEQ ID NO: 3689515 - DNA, 20 bp, Homo sapiens
tatcctaagactaacaaagg

SEQ ID NO: 3689516 - DNA, 15 bp, Homo sapiens
tatctcagggcctgg

SEQ ID NO: 3689517 - DNA, 14 bp, Homo sapiens
tatctccctggaga

SEQ ID NO: 3689518 - DNA, 12 bp, Homo sapiens
tatctcctggaa

SEQ ID NO: 3689519 - DNA, 21 bp, Homo sapiens
tatctgggtaagaagaaagca

SEQ ID NO: 3689520 - DNA, 12 bp, Homo sapiens
tatcttctggat

SEQ ID NO: 3689521 - DNA, 13 bp, Homo sapiens
tatcttctggatt

SEQ ID NO: 3689522 - DNA, 21 bp, Homo sapiens
tatcttctggattagaatgcc

SEQ ID NO: 3689523 - DNA, 11 bp, Homo sapiens
tatcttggcct

SEQ ID NO: 3689524 - DNA, 17 bp, Homo sapiens
tatgaaatactcagggt

SEQ ID NO: 3689525 - DNA, 22 bp, Homo sapiens
tatgactttttataaaatggct

SEQ ID NO: 3689526 - DNA, 17 bp, Homo sapiens
tatgatttggaaaataa

SEQ ID NO: 3689527 - DNA, 21 bp, Homo sapiens
tatgcatggtgccccaggacc

SEQ ID NO: 3689528 - DNA, 23 bp, Homo sapiens
tatgcatggtgccccaggaccag

SEQ ID NO: 3689529 - DNA, 13 bp, Homo sapiens
tatgctgtcatgg

SEQ ID NO: 3689530 - DNA, 19 bp, Homo sapiens
tatgcttaataaaagaaca

SEQ ID NO: 3689531 - DNA, 18 bp, Homo sapiens
tatggaagttgcataatt

SEQ ID NO: 3689532 - DNA, 17 bp, Homo sapiens
tatggtatatatacata

SEQ ID NO: 3689533 - DNA, 10 bp, Homo sapiens
tatgtaccaa

SEQ ID NO: 3689534 - DNA, 14 bp, Homo sapiens
tatgtactagtgtt

SEQ ID NO: 3689535 - DNA, 23 bp, Homo sapiens
tatgtaggtaaaagtagaagcat

SEQ ID NO: 3689536 - DNA, 14 bp, Homo sapiens
tatgtctgtgccat

SEQ ID NO: 3689537 - DNA, 19 bp, Homo sapiens
tatgtgaaaggaacatttt

SEQ ID NO: 3689538 - DNA, 22 bp, Homo sapiens
tatgttaagcagctaaattttc

SEQ ID NO: 3689539 - DNA, 14 bp, Homo sapiens
tatgtttttgtgta

SEQ ID NO: 3689540 - DNA, 23 bp, Homo sapiens
tattaaaggaagcactctgtata

SEQ ID NO: 3689541 - DNA, 15 bp, Homo sapiens
tattaagaactgctg

SEQ ID NO: 3689542 - DNA, 19 bp, Homo sapiens
tattataacaagtgtgtct

SEQ ID NO: 3689543 - DNA, 20 bp, Homo sapiens
tattataacaagtgtgtctt

SEQ ID NO: 3689544 - DNA, 22 bp, Homo sapiens
tattcatagtatactgatttaa

SEQ ID NO: 3689545 - DNA, 13 bp, Homo sapiens
tattcttgtgctt

SEQ ID NO: 3689546 - DNA, 15 bp, Homo sapiens
tattgcattaatttt

SEQ ID NO: 3689547 - DNA, 17 bp, Homo sapiens
tattgccttttaatttt

SEQ ID NO: 3689548 - DNA, 14 bp, Homo sapiens
tattgtctgtctac

SEQ ID NO: 3689549 - DNA, 14 bp, Homo sapiens
tatttaaattacaa

SEQ ID NO: 3689550 - DNA, 23 bp, Homo sapiens
tatttaactggtgcactttgtaa

SEQ ID NO: 3689551 - DNA, 17 bp, Homo sapiens
tatttaagcaacatctt

SEQ ID NO: 3689552 - DNA, 18 bp, Homo sapiens
tatttaagcaacatcttt

SEQ ID NO: 3689553 - DNA, 13 bp, Homo sapiens
tatttaatgtttt

SEQ ID NO: 3689554 - DNA, 17 bp, Homo sapiens
tatttaatgttttaaat

SEQ ID NO: 3689555 - DNA, 14 bp, Homo sapiens
tatttagtttttaa

SEQ ID NO: 3689556 - DNA, 14 bp, Homo sapiens
tatttcaagtgcct

SEQ ID NO: 3689557 - DNA, 22 bp, Homo sapiens
tatttcaagtgcctagactgtt

SEQ ID NO: 3689558 - DNA, 20 bp, Homo sapiens
tatttcagatgtaatgtttt

SEQ ID NO: 3689559 - DNA, 16 bp, Homo sapiens
tatttcttaaacactt

SEQ ID NO: 3689560 - DNA, 19 bp, Homo sapiens
tatttgaggggtttcagaa

SEQ ID NO: 3689561 - DNA, 18 bp, Homo sapiens
tatttgtgctatagtatt

SEQ ID NO: 3689562 - DNA, 23 bp, Homo sapiens
tattttataatgttgtatttaat

SEQ ID NO: 3689563 - DNA, 19 bp, Homo sapiens
tattttattctatgtatgt

SEQ ID NO: 3689564 - DNA, 22 bp, Homo sapiens
tattttccctattagagaagag

SEQ ID NO: 3689565 - DNA, 14 bp, Homo sapiens
tattttctatttta

SEQ ID NO: 3689566 - DNA, 19 bp, Homo sapiens
tatttttatataatatcta

SEQ ID NO: 3689567 - DNA, 12 bp, Homo sapiens
tatttttgtaaa

SEQ ID NO: 3689568 - DNA, 22 bp, Homo sapiens
tatttttgttgttgttgtttgt

SEQ ID NO: 3689569 - DNA, 19 bp, Homo sapiens
tcaaaaaaaaaaaaagata

SEQ ID NO: 3689570 - DNA, 19 bp, Homo sapiens
tcaaaatagaaaagttatt

SEQ ID NO: 3689571 - DNA, 12 bp, Homo sapiens
tcaaaatattta

SEQ ID NO: 3689572 - DNA, 17 bp, Homo sapiens
tccttggcctttcctgg

SEQ ID NO: 3689573 - DNA, 21 bp, Homo sapiens
tccttggcctttcctggaagc

SEQ ID NO: 3689574 - DNA, 14 bp, Homo sapiens
tccttggggcaggc

SEQ ID NO: 3689575 - DNA, 15 bp, Homo sapiens
tccttggggcaggca

SEQ ID NO: 3689576 - DNA, 16 bp, Homo sapiens
tccttggggcaggcag

SEQ ID NO: 3689577 - DNA, 19 bp, Homo sapiens
tcctttcaatggtttgcaa

SEQ ID NO: 3689578 - DNA, 19 bp, Homo sapiens
tcctttctggaagtttctg

SEQ ID NO: 3689579 - DNA, 15 bp, Homo sapiens
tccttttataggtga

SEQ ID NO: 3689580 - DNA, 12 bp, Homo sapiens
tcctttttaagg

SEQ ID NO: 3689581 - DNA, 14 bp, Homo sapiens
tcgaatctctgtgc

SEQ ID NO: 3689582 - DNA, 13 bp, Homo sapiens
tcgagaccagcct

SEQ ID NO: 3689583 - DNA, 17 bp, Homo sapiens
tcgagaccagcctggcc

SEQ ID NO: 3689584 - DNA, 14 bp, Homo sapiens
tcgagctgggaagg

SEQ ID NO: 3689585 - DNA, 22 bp, Homo sapiens
tcgcgaaggtcccacagccctg

SEQ ID NO: 3689586 - DNA, 14 bp, Homo sapiens
tcgctcctgcccac

SEQ ID NO: 3689587 - DNA, 22 bp, Homo sapiens
tcgcttctgtgtatctctttca

SEQ ID NO: 3689588 - DNA, 22 bp, Homo sapiens
tcggcgtggcccaaggctggca

SEQ ID NO: 3689589 - DNA, 16 bp, Homo sapiens
tcgggagacagcatca

SEQ ID NO: 3689590 - DNA, 21 bp, Homo sapiens
tcgggagacagcatcagggtt

SEQ ID NO: 3689591 - DNA, 21 bp, Homo sapiens
tcgggaggtcgaggcaggagg

SEQ ID NO: 3689592 - DNA, 15 bp, Homo sapiens
tcgggcaccagccag

SEQ ID NO: 3689593 - DNA, 17 bp, Homo sapiens
tcggggccatttggccg

SEQ ID NO: 3689594 - DNA, 13 bp, Homo sapiens
tcggtttctccaa

SEQ ID NO: 3689595 - DNA, 17 bp, Homo sapiens
tcgtcccatccagctac

SEQ ID NO: 3689596 - DNA, 15 bp, Homo sapiens
tcgtcttgttgttat

SEQ ID NO: 3689597 - DNA, 18 bp, Homo sapiens
tcgtctttcccatgggga

SEQ ID NO: 3689598 - DNA, 22 bp, Homo sapiens
tcgtgaaagtgcatttttgtaa

SEQ ID NO: 3689599 - DNA, 18 bp, Homo sapiens
tcgtgaactgcagtgatg

SEQ ID NO: 3689600 - DNA, 12 bp, Homo sapiens
tcgtgcctgtgt

SEQ ID NO: 3689601 - DNA, 13 bp, Homo sapiens
tcgtggctgtcaa

SEQ ID NO: 3689602 - DNA, 17 bp, Homo sapiens
tcgtttgaatcacagta

SEQ ID NO: 3689603 - DNA, 18 bp, Homo sapiens
tcgtttttatattaatgt

SEQ ID NO: 3689604 - DNA, 14 bp, Homo sapiens
tctaaacggtgacc

SEQ ID NO: 3689605 - DNA, 14 bp, Homo sapiens
tctaaagttatatt

SEQ ID NO: 3689606 - DNA, 15 bp, Homo sapiens
tctaacaataatatt

SEQ ID NO: 3689607 - DNA, 21 bp, Homo sapiens
tctaacaataatatttcaagt

SEQ ID NO: 3689608 - DNA, 17 bp, Homo sapiens
tctaactggacagcctc

SEQ ID NO: 3689609 - DNA, 19 bp, Homo sapiens
tctaactggacagcctctt

SEQ ID NO: 3689610 - DNA, 15 bp, Homo sapiens
tctaagcctgaaggg

SEQ ID NO: 3689611 - DNA, 13 bp, Homo sapiens
tctaatggaatat

SEQ ID NO: 3689612 - DNA, 16 bp, Homo sapiens
tctaattaaaacactt

SEQ ID NO: 3689613 - DNA, 15 bp, Homo sapiens
tctaattctctgtgg

SEQ ID NO: 3689614 - DNA, 12 bp, Homo sapiens
tctacaggcatt

SEQ ID NO: 3689615 - DNA, 22 bp, Homo sapiens
tctacctgcaggcggggctcct

SEQ ID NO: 3689616 - DNA, 23 bp, Homo sapiens
tctacctgcaggcggggctcctc

SEQ ID NO: 3689617 - DNA, 13 bp, Homo sapiens
tctacgtttcttt

SEQ ID NO: 3689618 - DNA, 14 bp, Homo sapiens
tctacgtttcttta

SEQ ID NO: 3689619 - DNA, 18 bp, Homo sapiens
tctactcagcatttgatt

SEQ ID NO: 3689620 - DNA, 17 bp, Homo sapiens
tctactgtgtgatcagg

SEQ ID NO: 3689621 - DNA, 15 bp, Homo sapiens
tctactttgattctg

SEQ ID NO: 3689622 - DNA, 19 bp, Homo sapiens
tctagaacatccctgccag

SEQ ID NO: 3689623 - DNA, 21 bp, Homo sapiens
tctagaagactgtcagcttcc

SEQ ID NO: 3689624 - DNA, 23 bp, Homo sapiens
tctagagagggaggcaagccctg

SEQ ID NO: 3689625 - DNA, 15 bp, Homo sapiens
tctagatatcgactt

SEQ ID NO: 3689626 - DNA, 19 bp, Homo sapiens
tctagatggctcctctcag

SEQ ID NO: 3689627 - DNA, 20 bp, Homo sapiens
tctagatggctcctctcagt

SEQ ID NO: 3689628 - DNA, 21 bp, Homo sapiens
tctagccagcccctcttcccc

SEQ ID NO: 3689629 - DNA, 21 bp, Homo sapiens
tctagctgggggtgggccagg

SEQ ID NO: 3689630 - DNA, 16 bp, Homo sapiens
tctaggatggggcacg

SEQ ID NO: 3689631 - DNA, 23 bp, Homo sapiens
tctagtcctggatgactcggtct

SEQ ID NO: 3689632 - DNA, 15 bp, Homo sapiens
tctagtctgagcttc

SEQ ID NO: 3689633 - DNA, 14 bp, Homo sapiens
tctagtgccttcta

SEQ ID NO: 3689634 - DNA, 20 bp, Homo sapiens
tctatgagttggacttcagt

SEQ ID NO: 3689635 - DNA, 20 bp, Homo sapiens
tctatgtatgttaatttatt

SEQ ID NO: 3689636 - DNA, 18 bp, Homo sapiens
tctcacctcctgctgggc

SEQ ID NO: 3689637 - DNA, 19 bp, Homo sapiens
tctcacctcctgctgggca

SEQ ID NO: 3689638 - DNA, 20 bp, Homo sapiens
tctcagaccttacacaccat

SEQ ID NO: 3689639 - DNA, 17 bp, Homo sapiens
tctcaggccagagccaa

SEQ ID NO: 3689640 - DNA, 15 bp, Homo sapiens
tctcagggcctggtc

SEQ ID NO: 3689641 - DNA, 14 bp, Homo sapiens
tctcatccccaggg

SEQ ID NO: 3689642 - DNA, 16 bp, Homo sapiens
tctcatgggaagggga

SEQ ID NO: 3689643 - DNA, 21 bp, Homo sapiens
tctcatgggaaggggaggacc

SEQ ID NO: 3689644 - DNA, 15 bp, Homo sapiens
tctcatttgggggcg

SEQ ID NO: 3689645 - DNA, 23 bp, Homo sapiens
tctccaaactgaagcagcctctc

SEQ ID NO: 3689646 - DNA, 15 bp, Homo sapiens
tctccaagcgcctgg

SEQ ID NO: 3689647 - DNA, 17 bp, Homo sapiens
tctccaagcgcctggct

SEQ ID NO: 3689648 - DNA, 23 bp, Homo sapiens
tctccatacccacaatctgagca

SEQ ID NO: 3689649 - DNA, 18 bp, Homo sapiens
tctcccattgtccctctg

SEQ ID NO: 3689650 - DNA, 22 bp, Homo sapiens
tctccccacactaacctgggtt

SEQ ID NO: 3689651 - DNA, 15 bp, Homo sapiens
tctccccagcccaga

SEQ ID NO: 3689652 - DNA, 17 bp, Homo sapiens
tctccccagcccagaga

SEQ ID NO: 3689653 - DNA, 15 bp, Homo sapiens
tctccccaggtccag

SEQ ID NO: 3689654 - DNA, 19 bp, Homo sapiens
tctccccgtgtcctctccc

SEQ ID NO: 3689655 - DNA, 23 bp, Homo sapiens
tctccctgccaagtctcagaaga

SEQ ID NO: 3689656 - DNA, 17 bp, Homo sapiens
tctccctggagaagcac

SEQ ID NO: 3689657 - DNA, 15 bp, Homo sapiens
tctcctatatatttc

SEQ ID NO: 3689658 - DNA, 14 bp, Homo sapiens
tctcctcctgccca

SEQ ID NO: 3689659 - DNA, 23 bp, Homo sapiens
tctcctctctggtggctgggctg

SEQ ID NO: 3689660 - DNA, 19 bp, Homo sapiens
tctcctgaccagggcaagg

SEQ ID NO: 3689661 - DNA, 15 bp, Homo sapiens
tctcctgactggtgc

SEQ ID NO: 3689662 - DNA, 20 bp, Homo sapiens
tctccttaaagagtgtggca

SEQ ID NO: 3689663 - DNA, 12 bp, Homo sapiens
tctccttggagg

SEQ ID NO: 3689664 - DNA, 13 bp, Homo sapiens
tctccttggagga

SEQ ID NO: 3689665 - DNA, 19 bp, Homo sapiens
tctccttggcctttcctgg

SEQ ID NO: 3689666 - DNA, 20 bp, Homo sapiens
tctccttggcctttcctgga

SEQ ID NO: 3689667 - DNA, 21 bp, Homo sapiens
tctccttggcctttcctggaa

SEQ ID NO: 3689668 - DNA, 16 bp, Homo sapiens
tctcgcataggacctt

SEQ ID NO: 3689669 - DNA, 18 bp, Homo sapiens
tctcggatagttgctatt

SEQ ID NO: 3689670 - DNA, 20 bp, Homo sapiens
tctctccgcgggtgggactc

SEQ ID NO: 3689671 - DNA, 18 bp, Homo sapiens
tctctccttggcctttcc

SEQ ID NO: 3689672 - DNA, 22 bp, Homo sapiens
tctctccttggcctttcctgga

SEQ ID NO: 3689673 - DNA, 12 bp, Homo sapiens
tctctctgccca

SEQ ID NO: 3689674 - DNA, 13 bp, Homo sapiens
tctctgacttctg

SEQ ID NO: 3689675 - DNA, 19 bp, Homo sapiens
tctctgacttctgcctgga

SEQ ID NO: 3689676 - DNA, 20 bp, Homo sapiens
tctctgcaggcagcctgcct

SEQ ID NO: 3689677 - DNA, 18 bp, Homo sapiens
tctctgccatatcagtga

SEQ ID NO: 3689678 - DNA, 11 bp, Homo sapiens
tctctgctcca

SEQ ID NO: 3689679 - DNA, 12 bp, Homo sapiens
tctctgctccac

SEQ ID NO: 3689680 - DNA, 15 bp, Homo sapiens
tctctgctccaccac

SEQ ID NO: 3689681 - DNA, 19 bp, Homo sapiens
tctctgggaccaggctcca

SEQ ID NO: 3689682 - DNA, 17 bp, Homo sapiens
tctctgggcctcagttt

SEQ ID NO: 3689683 - DNA, 15 bp, Homo sapiens
tctctggtggctggg

SEQ ID NO: 3689684 - DNA, 16 bp, Homo sapiens
tctctgtacttttcat

SEQ ID NO: 3689685 - DNA, 12 bp, Homo sapiens
tctctgtgcctt

SEQ ID NO: 3689686 - DNA, 13 bp, Homo sapiens
tctcttctgctcc

SEQ ID NO: 3689687 - DNA, 19 bp, Homo sapiens
tctcttctgctccaccctt

SEQ ID NO: 3689688 - DNA, 14 bp, Homo sapiens
tctcttgagagggt

SEQ ID NO: 3689689 - DNA, 16 bp, Homo sapiens
tgagtcctgagcgaaa

SEQ ID NO: 3689690 - DNA, 23 bp, Homo sapiens
tgagtcctgagcgaaaacaggag

SEQ ID NO: 3689691 - DNA, 21 bp, Homo sapiens
tgagtggcaggggacaggagt

SEQ ID NO: 3689692 - DNA, 23 bp, Homo sapiens
tgagtgggggatcacagcctctg

SEQ ID NO: 3689693 - DNA, 20 bp, Homo sapiens
tgagtggttttctttttcct

SEQ ID NO: 3689694 - DNA, 21 bp, Homo sapiens
tgagtggttttctttttcctt

SEQ ID NO: 3689695 - DNA, 19 bp, Homo sapiens
tgagtgttttatgagaaag

SEQ ID NO: 3689696 - DNA, 21 bp, Homo sapiens
tgagtgttttatgagaaagcc

SEQ ID NO: 3689697 - DNA, 19 bp, Homo sapiens
tgagttgattcagctctgc

SEQ ID NO: 3689698 - DNA, 16 bp, Homo sapiens
tgataaagtggaattg

SEQ ID NO: 3689699 - DNA, 19 bp, Homo sapiens
tgatagaaatgccaagcac

SEQ ID NO: 3689700 - DNA, 21 bp, Homo sapiens
tgatagacacatatgaggggg

SEQ ID NO: 3689701 - DNA, 17 bp, Homo sapiens
tgatcatgtacttttta

SEQ ID NO: 3689702 - DNA, 18 bp, Homo sapiens
tgatcattttccccccac

SEQ ID NO: 3689703 - DNA, 19 bp, Homo sapiens
tgatcattttccccccact

SEQ ID NO: 3689704 - DNA, 22 bp, Homo sapiens
tgatcattttccccccactctc

SEQ ID NO: 3689705 - DNA, 19 bp, Homo sapiens
tgatccctgtgttgtctct

SEQ ID NO: 3689706 - DNA, 20 bp, Homo sapiens
tgatccctgtgttgtctcta

SEQ ID NO: 3689707 - DNA, 22 bp, Homo sapiens
tgatcctaatgaatgcataaaa

SEQ ID NO: 3689708 - DNA, 13 bp, Homo sapiens
tgatcctccaaca

SEQ ID NO: 3689709 - DNA, 14 bp, Homo sapiens
tgatcctggaggcc

SEQ ID NO: 3689710 - DNA, 21 bp, Homo sapiens
tgatctgatgcaagcaagaaa

SEQ ID NO: 3689711 - DNA, 17 bp, Homo sapiens
tgatctggaacccagac

SEQ ID NO: 3689712 - DNA, 19 bp, Homo sapiens
tgatctggaacccagactc

SEQ ID NO: 3689713 - DNA, 15 bp, Homo sapiens
tgatctgtgggcaca

SEQ ID NO: 3689714 - DNA, 18 bp, Homo sapiens
tgatgacaaaaaatgttt

SEQ ID NO: 3689715 - DNA, 20 bp, Homo sapiens
tgatgagggggaattcctgg

SEQ ID NO: 3689716 - DNA, 19 bp, Homo sapiens
tgatgaggtattttttcct

SEQ ID NO: 3689717 - DNA, 18 bp, Homo sapiens
tgatgagttaactgtgaa

SEQ ID NO: 3689718 - DNA, 20 bp, Homo sapiens
tgatgagttaactgtgaaat

SEQ ID NO: 3689719 - DNA, 20 bp, Homo sapiens
tgatgatcctaggcatttgc

SEQ ID NO: 3689720 - DNA, 16 bp, Homo sapiens
tgatgcatgtctttta

SEQ ID NO: 3689721 - DNA, 14 bp, Homo sapiens
tgatgcctctgtct

SEQ ID NO: 3689722 - DNA, 23 bp, Homo sapiens
tgatgcgggccagtgctccagcc

SEQ ID NO: 3689723 - DNA, 20 bp, Homo sapiens
tgatgctccctcccctgccc

SEQ ID NO: 3689724 - DNA, 20 bp, Homo sapiens
tgatgctgggagttctaaca

SEQ ID NO: 3689725 - DNA, 14 bp, Homo sapiens
tgatggaagtgggc

SEQ ID NO: 3689726 - DNA, 21 bp, Homo sapiens
tgatggaagtgggccagtcct

SEQ ID NO: 3689727 - DNA, 15 bp, Homo sapiens
tgatggagtgtgagc

SEQ ID NO: 3689728 - DNA, 16 bp, Homo sapiens
tgatggcaacagatct

SEQ ID NO: 3689729 - DNA, 19 bp, Homo sapiens
tgatggcaacagatctgga

SEQ ID NO: 3689730 - DNA, 13 bp, Homo sapiens
tgatgggaaaact

SEQ ID NO: 3689731 - DNA, 17 bp, Homo sapiens
tgatgggattctggaca

SEQ ID NO: 3689732 - DNA, 16 bp, Homo sapiens
tgatggtgatgaaatg

SEQ ID NO: 3689733 - DNA, 17 bp, Homo sapiens
tgatggtgatgaaatgt

SEQ ID NO: 3689734 - DNA, 19 bp, Homo sapiens
tgatgtcaatttctgtgtt

SEQ ID NO: 3689735 - DNA, 23 bp, Homo sapiens
tgatgtcaatttctgtgttgcca

SEQ ID NO: 3689736 - DNA, 23 bp, Homo sapiens
tgatgtggccctggctgccggca

SEQ ID NO: 3689737 - DNA, 17 bp, Homo sapiens
tgatgtgtttacattta

SEQ ID NO: 3689738 - DNA, 17 bp, Homo sapiens
tgatgtttgtggcctca

SEQ ID NO: 3689739 - DNA, 20 bp, Homo sapiens
tgattaaccacttcagctga

SEQ ID NO: 3689740 - DNA, 14 bp, Homo sapiens
tgattacagtgcag

SEQ ID NO: 3689741 - DNA, 16 bp, Homo sapiens
tgattacagtgcagtg

SEQ ID NO: 3689742 - DNA, 13 bp, Homo sapiens
tgattacctgcca

SEQ ID NO: 3689743 - DNA, 15 bp, Homo sapiens
tgattacctgccaat

SEQ ID NO: 3689744 - DNA, 23 bp, Homo sapiens
tgattcaaaatatttaaaaatgt

SEQ ID NO: 3689745 - DNA, 16 bp, Homo sapiens
tgattccgcaccctgc

SEQ ID NO: 3689746 - DNA, 13 bp, Homo sapiens
tgattctcttagg

SEQ ID NO: 3689747 - DNA, 12 bp, Homo sapiens
tgattgacagct

SEQ ID NO: 3689748 - DNA, 17 bp, Homo sapiens
tgattgacagctttgct

SEQ ID NO: 3689749 - DNA, 19 bp, Homo sapiens
tgattggaatagcttctgg

SEQ ID NO: 3689750 - DNA, 20 bp, Homo sapiens
tgattggcaggagttggaag

SEQ ID NO: 3689751 - DNA, 17 bp, Homo sapiens
tgattggtgcaaccctt

SEQ ID NO: 3689752 - DNA, 21 bp, Homo sapiens
tgattggtgcaacccttaccc

SEQ ID NO: 3689753 - DNA, 16 bp, Homo sapiens
tgatttaggagaagcc

SEQ ID NO: 3689754 - DNA, 20 bp, Homo sapiens
tgatttaggagaagccagga

SEQ ID NO: 3689755 - DNA, 22 bp, Homo sapiens
tgatttaggagaagccaggaat

SEQ ID NO: 3689756 - DNA, 19 bp, Homo sapiens
tgattttcacagctttgag

SEQ ID NO: 3689757 - DNA, 13 bp, Homo sapiens
tgattttcattgc

SEQ ID NO: 3689758 - DNA, 18 bp, Homo sapiens
tgcaaaaaaattaaaatg

SEQ ID NO: 3689759 - DNA, 16 bp, Homo sapiens
tgcaaaaaattcttta

SEQ ID NO: 3689760 - DNA, 21 bp, Homo sapiens
tgcaaaaaattctttagagat

SEQ ID NO: 3689761 - DNA, 13 bp, Homo sapiens
tgcaaagaggcaa

SEQ ID NO: 3689762 - DNA, 18 bp, Homo sapiens
tgcaaagtattgtaaatt

SEQ ID NO: 3689763 - DNA, 20 bp, Homo sapiens
tgcaaagtattgtaaattat

SEQ ID NO: 3689764 - DNA, 24 bp, Homo sapiens
tgcaacagggtatggactatctgt

SEQ ID NO: 3689765 - DNA, 17 bp, Homo sapiens
tgcaaccactctgtggc

SEQ ID NO: 3689766 - DNA, 18 bp, Homo sapiens
tgcaaccactctgtggcc

SEQ ID NO: 3689767 - DNA, 20 bp, Homo sapiens
tgcaaccactctgtggccag

SEQ ID NO: 3689768 - DNA, 21 bp, Homo sapiens
tgcaaccactctgtggccagc

SEQ ID NO: 3689769 - DNA, 17 bp, Homo sapiens
tgcaactcaaggacttt

SEQ ID NO: 3689770 - DNA, 15 bp, Homo sapiens
tgcaagcagaggacc

SEQ ID NO: 3689771 - DNA, 22 bp, Homo sapiens
tgcaagcagaggaccagggcct

SEQ ID NO: 3689772 - DNA, 20 bp, Homo sapiens
tgcaaggaagccacagctgg

SEQ ID NO: 3689773 - DNA, 17 bp, Homo sapiens
tgcaaggaccaggactc

SEQ ID NO: 3689774 - DNA, 23 bp, Homo sapiens
tgcaaggtttaggctggtggccc

SEQ ID NO: 3689775 - DNA, 21 bp, Homo sapiens
tgcacaagctgcaccctcagg

SEQ ID NO: 3689776 - DNA, 20 bp, Homo sapiens
tgcacagccactccccggca

SEQ ID NO: 3689777 - DNA, 22 bp, Homo sapiens
tgcacatccgcgtgtgcctgtg

SEQ ID NO: 3689778 - DNA, 14 bp, Homo sapiens
tgcacatgtttcct

SEQ ID NO: 3689779 - DNA, 12 bp, Homo sapiens
tgcaccaccaag

SEQ ID NO: 3689780 - DNA, 18 bp, Homo sapiens
tgcaccaccaagccaagg

SEQ ID NO: 3689781 - DNA, 14 bp, Homo sapiens
tgcaccactgcact

SEQ ID NO: 3689782 - DNA, 18 bp, Homo sapiens
tgcaccccaaagctttcc

SEQ ID NO: 3689783 - DNA, 20 bp, Homo sapiens
tgcaccccaaagctttcctg

SEQ ID NO: 3689784 - DNA, 16 bp, Homo sapiens
tgcaccctcaggcagg

SEQ ID NO: 3689785 - DNA, 12 bp, Homo sapiens
tgcacgtggaga

SEQ ID NO: 3689786 - DNA, 16 bp, Homo sapiens
tgcacgtggagagctg

SEQ ID NO: 3689787 - DNA, 18 bp, Homo sapiens
tgcacgtggagagctggt

SEQ ID NO: 3689788 - DNA, 16 bp, Homo sapiens
tgcactatctttcagc

SEQ ID NO: 3689789 - DNA, 16 bp, Homo sapiens
tgcactgatgctgccc

SEQ ID NO: 3689790 - DNA, 22 bp, Homo sapiens
tgcactgatgctgcccctcatc

SEQ ID NO: 3689791 - DNA, 15 bp, Homo sapiens
tgcacttacttgctt

SEQ ID NO: 3689792 - DNA, 16 bp, Homo sapiens
tgcacttacttgctta

SEQ ID NO: 3689793 - DNA, 18 bp, Homo sapiens
tgcacttacttgcttatt

SEQ ID NO: 3689794 - DNA, 16 bp, Homo sapiens
tgcactttgtaaattc

SEQ ID NO: 3689795 - DNA, 19 bp, Homo sapiens
tgcagaatgtaagtgggcc

SEQ ID NO: 3689796 - DNA, 16 bp, Homo sapiens
tgcagacaggaatctt

SEQ ID NO: 3689797 - DNA, 18 bp, Homo sapiens
tgcagacaggaatcttaa

SEQ ID NO: 3689798 - DNA, 15 bp, Homo sapiens
tgcagaggtaccctg

SEQ ID NO: 3689799 - DNA, 17 bp, Homo sapiens
tgcagaggtaccctggg

SEQ ID NO: 3689800 - DNA, 19 bp, Homo sapiens
tgcagcagggatgccctgg

SEQ ID NO: 3689801 - DNA, 13 bp, Homo sapiens
tgcagcccatgcc

SEQ ID NO: 3689802 - DNA, 18 bp, Homo sapiens
tgcagccggcacagggtc

SEQ ID NO: 3689803 - DNA, 19 bp, Homo sapiens
tgcagccggcacagggtct

SEQ ID NO: 3689804 - DNA, 18 bp, Homo sapiens
tggccggctctggtggcc

SEQ ID NO: 3689805 - DNA, 16 bp, Homo sapiens
tggcctcagctgcctc

SEQ ID NO: 3689806 - DNA, 19 bp, Homo sapiens
tggcctcatgtggctggaa

SEQ ID NO: 3689807 - DNA, 14 bp, Homo sapiens
tggcctcccctgcc

SEQ ID NO: 3689808 - DNA, 17 bp, Homo sapiens
tggcctcccctgccacc

SEQ ID NO: 3689809 - DNA, 19 bp, Homo sapiens
tggcctcccctgccaccag

SEQ ID NO: 3689810 - DNA, 17 bp, Homo sapiens
tggcctgcataggctcc

SEQ ID NO: 3689811 - DNA, 22 bp, Homo sapiens
tggcctgctgcgccccaggccc

SEQ ID NO: 3689812 - DNA, 12 bp, Homo sapiens
tggcctggccag

SEQ ID NO: 3689813 - DNA, 17 bp, Homo sapiens
tggcctggccaggagct

SEQ ID NO: 3689814 - DNA, 18 bp, Homo sapiens
tggcctggccaggagctc

SEQ ID NO: 3689815 - DNA, 14 bp, Homo sapiens
tggcctgtctcatc

SEQ ID NO: 3689816 - DNA, 22 bp, Homo sapiens
tggccttctcctacttagggaa

SEQ ID NO: 3689817 - DNA, 23 bp, Homo sapiens
tggcctttaagcctgcattctta

SEQ ID NO: 3689818 - DNA, 16 bp, Homo sapiens
tggcctttcctggaag

SEQ ID NO: 3689819 - DNA, 17 bp, Homo sapiens
tggcctttcctggaagc

SEQ ID NO: 3689820 - DNA, 14 bp, Homo sapiens
tggcggagagtttt

SEQ ID NO: 3689821 - DNA, 22 bp, Homo sapiens
tggctagaggccagccccaccc

SEQ ID NO: 3689822 - DNA, 15 bp, Homo sapiens
tggctagagtcctca

SEQ ID NO: 3689823 - DNA, 18 bp, Homo sapiens
tggctagtcaagctcctc

SEQ ID NO: 3689824 - DNA, 15 bp, Homo sapiens
tggctccaggccaaa

SEQ ID NO: 3689825 - DNA, 14 bp, Homo sapiens
tggctcccatgacc

SEQ ID NO: 3689826 - DNA, 23 bp, Homo sapiens
tggctcccatgaccatactgagg

SEQ ID NO: 3689827 - DNA, 14 bp, Homo sapiens
tggctccggcctct

SEQ ID NO: 3689828 - DNA, 15 bp, Homo sapiens
tggctccggcctctg

SEQ ID NO: 3689829 - DNA, 19 bp, Homo sapiens
tggctccggcctctgcctt

SEQ ID NO: 3689830 - DNA, 23 bp, Homo sapiens
tggctcctgaggggcatctgccc

SEQ ID NO: 3689831 - DNA, 17 bp, Homo sapiens
tggctgagcccctgtct

SEQ ID NO: 3689832 - DNA, 21 bp, Homo sapiens
tggctggaagatcctgcgggt

SEQ ID NO: 3689833 - DNA, 17 bp, Homo sapiens
tggctgggggcaggagg

SEQ ID NO: 3689834 - DNA, 22 bp, Homo sapiens
tggctgtcaatgggacctgtgg

SEQ ID NO: 3689835 - DNA, 11 bp, Homo sapiens
tggctgtccag

SEQ ID NO: 3689836 - DNA, 15 bp, Homo sapiens
tggcttaatcatttt

SEQ ID NO: 3689837 - DNA, 14 bp, Homo sapiens
tggcttagtgccac

SEQ ID NO: 3689838 - DNA, 14 bp, Homo sapiens
tggcttcacggaag

SEQ ID NO: 3689839 - DNA, 17 bp, Homo sapiens
tggcttcacggaagagc

SEQ ID NO: 3689840 - DNA, 22 bp, Homo sapiens
tggcttcacggaagagccttgc

SEQ ID NO: 3689841 - DNA, 15 bp, Homo sapiens
tggcttctccctggg

SEQ ID NO: 3689842 - DNA, 17 bp, Homo sapiens
tggcttctccctgggga

SEQ ID NO: 3689843 - DNA, 18 bp, Homo sapiens
tggcttctccctggggac

SEQ ID NO: 3689844 - DNA, 16 bp, Homo sapiens
tggctttgcatttctt

SEQ ID NO: 3689845 - DNA, 16 bp, Homo sapiens
tgggaaccgccctcct

SEQ ID NO: 3689846 - DNA, 18 bp, Homo sapiens
tgggaaccgccctcctga

SEQ ID NO: 3689847 - DNA, 15 bp, Homo sapiens
tgggaagcagggaat

SEQ ID NO: 3689848 - DNA, 12 bp, Homo sapiens
tgggaaggttcc

SEQ ID NO: 3689849 - DNA, 14 bp, Homo sapiens
tgggacagggcttc

SEQ ID NO: 3689850 - DNA, 14 bp, Homo sapiens
tgggaccaggctcc

SEQ ID NO: 3689851 - DNA, 13 bp, Homo sapiens
tgggaccctccag

SEQ ID NO: 3689852 - DNA, 23 bp, Homo sapiens
tgggaccctccagtgctggattt

SEQ ID NO: 3689853 - DNA, 23 bp, Homo sapiens
tgggacggtgcccaagccagagg

SEQ ID NO: 3689854 - DNA, 17 bp, Homo sapiens
tgggactcagccttcag

SEQ ID NO: 3689855 - DNA, 19 bp, Homo sapiens
tgggactcttccctgggaa

SEQ ID NO: 3689856 - DNA, 21 bp, Homo sapiens
tgggacttctacccagatgga

SEQ ID NO: 3689857 - DNA, 19 bp, Homo sapiens
tgggagaaatctggcttct

SEQ ID NO: 3689858 - DNA, 18 bp, Homo sapiens
tgggagactgctgagtca

SEQ ID NO: 3689859 - DNA, 20 bp, Homo sapiens
tgggagaggacagggacttc

SEQ ID NO: 3689860 - DNA, 13 bp, Homo sapiens
tgggagccagcct

SEQ ID NO: 3689861 - DNA, 12 bp, Homo sapiens
tgggagccaggg

SEQ ID NO: 3689862 - DNA, 20 bp, Homo sapiens
tgggagccatgccgtctgcc

SEQ ID NO: 3689863 - DNA, 14 bp, Homo sapiens
tgggagccccaggg

SEQ ID NO: 3689864 - DNA, 23 bp, Homo sapiens
tgggagccccagggtcttcccta

SEQ ID NO: 3689865 - DNA, 19 bp, Homo sapiens
tgggagctccactctgctt

SEQ ID NO: 3689866 - DNA, 21 bp, Homo sapiens
tgggaggattgcttgagctca

SEQ ID NO: 3689867 - DNA, 16 bp, Homo sapiens
tgggaggccccactgg

SEQ ID NO: 3689868 - DNA, 18 bp, Homo sapiens
tgggaggctgaggcagga

SEQ ID NO: 3689869 - DNA, 18 bp, Homo sapiens
tgggaggtcaaggctgca

SEQ ID NO: 3689870 - DNA, 18 bp, Homo sapiens
tgggatccgagggcccct

SEQ ID NO: 3689871 - DNA, 21 bp, Homo sapiens
tgggatgttcagcactgtccc

SEQ ID NO: 3689872 - DNA, 21 bp, Homo sapiens
tgggattacaggtgtgagcca

SEQ ID NO: 3689873 - DNA, 16 bp, Homo sapiens
tgggcagagctggctc

SEQ ID NO: 3689874 - DNA, 14 bp, Homo sapiens
tgggcagcagactg

SEQ ID NO: 3689875 - DNA, 17 bp, Homo sapiens
tgggcattgatggggaa

SEQ ID NO: 3689876 - DNA, 18 bp, Homo sapiens
tgggccagacatgccaca

SEQ ID NO: 3689877 - DNA, 19 bp, Homo sapiens
tgggccagacatgccacaa

SEQ ID NO: 3689878 - DNA, 23 bp, Homo sapiens
tgggcccaagacagatgccccag

SEQ ID NO: 3689879 - DNA, 13 bp, Homo sapiens
tgggcccagatct

SEQ ID NO: 3689880 - DNA, 12 bp, Homo sapiens
tgggcccctggc

SEQ ID NO: 3689881 - DNA, 22 bp, Homo sapiens
tgggccctgagtctgggcagct

SEQ ID NO: 3689882 - DNA, 19 bp, Homo sapiens
tgggccggcccccttcctg

SEQ ID NO: 3689883 - DNA, 15 bp, Homo sapiens
tgggcctcggcccct

SEQ ID NO: 3689884 - DNA, 20 bp, Homo sapiens
tgggcctgctccagacctga

SEQ ID NO: 3689885 - DNA, 15 bp, Homo sapiens
tgggcggggcactag

SEQ ID NO: 3689886 - DNA, 19 bp, Homo sapiens
tgggctacatgctggggtc

SEQ ID NO: 3689887 - DNA, 15 bp, Homo sapiens
tgggctgctcctcat

SEQ ID NO: 3689888 - DNA, 12 bp, Homo sapiens
tgggctgtttct

SEQ ID NO: 3689889 - DNA, 13 bp, Homo sapiens
tgggctgtttctg

SEQ ID NO: 3689890 - DNA, 17 bp, Homo sapiens
tgggcttgtctgtagat

SEQ ID NO: 3689891 - DNA, 21 bp, Homo sapiens
tgggcttgtctgtagatttta

SEQ ID NO: 3689892 - DNA, 16 bp, Homo sapiens
tgggcttttccctggg

SEQ ID NO: 3689893 - DNA, 18 bp, Homo sapiens
tgggcttttccctgggtg

SEQ ID NO: 3689894 - DNA, 23 bp, Homo sapiens
tggggaaagcctgaagggcctcc

SEQ ID NO: 3689895 - DNA, 13 bp, Homo sapiens
tggggaaggaggc

SEQ ID NO: 3689896 - DNA, 17 bp, Homo sapiens
tggggacagagcagaac

SEQ ID NO: 3689897 - DNA, 23 bp, Homo sapiens
tggggacggggctcccctggaca

SEQ ID NO: 3689898 - DNA, 17 bp, Homo sapiens
tggggagggcaggtcca

SEQ ID NO: 3689899 - DNA, 22 bp, Homo sapiens
tggggagggcaggtccagctct

SEQ ID NO: 3689900 - DNA, 14 bp, Homo sapiens
tggggaggggctct

SEQ ID NO: 3689901 - DNA, 20 bp, Homo sapiens
tggggatccctcccccccat

SEQ ID NO: 3689902 - DNA, 14 bp, Homo sapiens
tggggcagagcttc

SEQ ID NO: 3689903 - DNA, 12 bp, Homo sapiens
tggggcagggag

SEQ ID NO: 3689904 - DNA, 13 bp, Homo sapiens
tggggcagggagc

SEQ ID NO: 3689905 - DNA, 21 bp, Homo sapiens
tggggcagggagctgggcccg

SEQ ID NO: 3689906 - DNA, 17 bp, Homo sapiens
tggggcatcctgtgcca

SEQ ID NO: 3689907 - DNA, 23 bp, Homo sapiens
tggggccactacctcctttccta

SEQ ID NO: 3689908 - DNA, 14 bp, Homo sapiens
tggggccagatcca

SEQ ID NO: 3689909 - DNA, 15 bp, Homo sapiens
tggggccagatccag

SEQ ID NO: 3689910 - DNA, 18 bp, Homo sapiens
tggggccagatccagcct

SEQ ID NO: 3689911 - DNA, 20 bp, Homo sapiens
tggggccagatccagcctgg

SEQ ID NO: 3689912 - DNA, 15 bp, Homo sapiens
tggggccaggtcacc

SEQ ID NO: 3689913 - DNA, 14 bp, Homo sapiens
tggggcggggcttc

SEQ ID NO: 3689914 - DNA, 13 bp, Homo sapiens
tggggctcctacc

SEQ ID NO: 3689915 - DNA, 21 bp, Homo sapiens
tggggctcctacctgggggca

SEQ ID NO: 3689916 - DNA, 15 bp, Homo sapiens
tggggcttctctggg

SEQ ID NO: 3689917 - DNA, 20 bp, Homo sapiens
tgggggatcacagcctctga

SEQ ID NO: 3689918 - DNA, 21 bp, Homo sapiens
tgggggcgggactcctccctg

SEQ ID NO: 3689919 - DNA, 18 bp, Homo sapiens
tggggtagctagaggaac

SEQ ID NO: 3689920 - DNA, 20 bp, Homo sapiens
ttccagggtccctctgtgta

SEQ ID NO: 3689921 - DNA, 15 bp, Homo sapiens
ttccatccctacccc

SEQ ID NO: 3689922 - DNA, 14 bp, Homo sapiens
ttccatctagtcac

SEQ ID NO: 3689923 - DNA, 24 bp, Homo sapiens
ttccatgaaaatgcaacaacatgt

SEQ ID NO: 3689924 - DNA, 17 bp, Homo sapiens
ttcccaactctagctgg

SEQ ID NO: 3689925 - DNA, 18 bp, Homo sapiens
ttcccaactctagctggg

SEQ ID NO: 3689926 - DNA, 18 bp, Homo sapiens
ttcccacttcccaccctg

SEQ ID NO: 3689927 - DNA, 19 bp, Homo sapiens
ttcccaggaccctgaaggg

SEQ ID NO: 3689928 - DNA, 20 bp, Homo sapiens
ttcccaggaccctgaagggg

SEQ ID NO: 3689929 - DNA, 15 bp, Homo sapiens
ttcccatggggaggg

SEQ ID NO: 3689930 - DNA, 15 bp, Homo sapiens
ttccccacaggtgaa

SEQ ID NO: 3689931 - DNA, 12 bp, Homo sapiens
ttccccagagaa

SEQ ID NO: 3689932 - DNA, 12 bp, Homo sapiens
ttccccccactc

SEQ ID NO: 3689933 - DNA, 21 bp, Homo sapiens
ttccccccactctccccacac

SEQ ID NO: 3689934 - DNA, 17 bp, Homo sapiens
ttcccccttcacaaagc

SEQ ID NO: 3689935 - DNA, 13 bp, Homo sapiens
ttcccctccacca

SEQ ID NO: 3689936 - DNA, 17 bp, Homo sapiens
ttcccctccctggctcc

SEQ ID NO: 3689937 - DNA, 16 bp, Homo sapiens
ttccctaatctatggt

SEQ ID NO: 3689938 - DNA, 21 bp, Homo sapiens
ttccctcaccttggcaccaga

SEQ ID NO: 3689939 - DNA, 12 bp, Homo sapiens
ttccctgcagct

SEQ ID NO: 3689940 - DNA, 14 bp, Homo sapiens
ttccctgcagctga

SEQ ID NO: 3689941 - DNA, 15 bp, Homo sapiens
ttccctgcagctgac

SEQ ID NO: 3689942 - DNA, 15 bp, Homo sapiens
ttcccttcctctgtg

SEQ ID NO: 3689943 - DNA, 12 bp, Homo sapiens
ttcccttggcct

SEQ ID NO: 3689944 - DNA, 15 bp, Homo sapiens
ttcccttggcctcag

SEQ ID NO: 3689945 - DNA, 16 bp, Homo sapiens
ttcccttggcctcaga

SEQ ID NO: 3689946 - DNA, 17 bp, Homo sapiens
ttcccttgtgtcaagac

SEQ ID NO: 3689947 - DNA, 16 bp, Homo sapiens
ttccgtgcgtggcact

SEQ ID NO: 3689948 - DNA, 14 bp, Homo sapiens
ttccgttcattgct

SEQ ID NO: 3689949 - DNA, 18 bp, Homo sapiens
ttccgttcattgctctcc

SEQ ID NO: 3689950 - DNA, 18 bp, Homo sapiens
ttcctaaatattatgaga

SEQ ID NO: 3689951 - DNA, 20 bp, Homo sapiens
ttcctacaagagcagcctgt

SEQ ID NO: 3689952 - DNA, 15 bp, Homo sapiens
ttcctagtgaggaaa

SEQ ID NO: 3689953 - DNA, 15 bp, Homo sapiens
ttcctcagcctgggg

SEQ ID NO: 3689954 - DNA, 13 bp, Homo sapiens
ttcctcattagca

SEQ ID NO: 3689955 - DNA, 12 bp, Homo sapiens
ttcctcccttct

SEQ ID NO: 3689956 - DNA, 14 bp, Homo sapiens
ttcctcccttctgc

SEQ ID NO: 3689957 - DNA, 11 bp, Homo sapiens
ttcctcctgga

SEQ ID NO: 3689958 - DNA, 13 bp, Homo sapiens
ttcctcctggaaa

SEQ ID NO: 3689959 - DNA, 17 bp, Homo sapiens
ttcctctagttctttgt

SEQ ID NO: 3689960 - DNA, 14 bp, Homo sapiens
ttcctctgtgccac

SEQ ID NO: 3689961 - DNA, 18 bp, Homo sapiens
ttcctctgtgccacgctc

SEQ ID NO: 3689962 - DNA, 15 bp, Homo sapiens
ttcctgacattgtct

SEQ ID NO: 3689963 - DNA, 21 bp, Homo sapiens
ttcctggatggggcagagctt

SEQ ID NO: 3689964 - DNA, 23 bp, Homo sapiens
ttcctggatggggcagagcttct

SEQ ID NO: 3689965 - DNA, 21 bp, Homo sapiens
ttcctggcccctcatggcggg

SEQ ID NO: 3689966 - DNA, 16 bp, Homo sapiens
ttcctggccctccact

SEQ ID NO: 3689967 - DNA, 22 bp, Homo sapiens
ttcctgtccagctccaacctgc

SEQ ID NO: 3689968 - DNA, 13 bp, Homo sapiens
ttcctgtgggtgg

SEQ ID NO: 3689969 - DNA, 20 bp, Homo sapiens
ttcctgtgggtggggcttct

SEQ ID NO: 3689970 - DNA, 17 bp, Homo sapiens
ttccttgctttctcttc

SEQ ID NO: 3689971 - DNA, 14 bp, Homo sapiens
ttccttggggcagg

SEQ ID NO: 3689972 - DNA, 13 bp, Homo sapiens
ttcctttaaaaaa

SEQ ID NO: 3689973 - DNA, 14 bp, Homo sapiens
ttcgagaccagcct

SEQ ID NO: 3689974 - DNA, 19 bp, Homo sapiens
ttcgagaccagcctggcca

SEQ ID NO: 3689975 - DNA, 17 bp, Homo sapiens
ttcgcagctgaagtgga

SEQ ID NO: 3689976 - DNA, 20 bp, Homo sapiens
ttcgggaggtcgaggcagga

SEQ ID NO: 3689977 - DNA, 19 bp, Homo sapiens
ttctaaaacttgtatgttt

SEQ ID NO: 3689978 - DNA, 20 bp, Homo sapiens
ttctacccagatggaaaaat

SEQ ID NO: 3689979 - DNA, 23 bp, Homo sapiens
ttctacctgcaggcggggctcct

SEQ ID NO: 3689980 - DNA, 13 bp, Homo sapiens
ttctacgtttctt

SEQ ID NO: 3689981 - DNA, 14 bp, Homo sapiens
ttctacgtttcttt

SEQ ID NO: 3689982 - DNA, 16 bp, Homo sapiens
ttctagagcactgcca

SEQ ID NO: 3689983 - DNA, 19 bp, Homo sapiens
ttctaggcatctctgtact

SEQ ID NO: 3689984 - DNA, 21 bp, Homo sapiens
ttctcacagtgggagccaggg

SEQ ID NO: 3689985 - DNA, 21 bp, Homo sapiens
ttctcactgccatgccagctt

SEQ ID NO: 3689986 - DNA, 17 bp, Homo sapiens
ttctcagggaagtaaga

SEQ ID NO: 3689987 - DNA, 13 bp, Homo sapiens
ttctccctgggga

SEQ ID NO: 3689988 - DNA, 21 bp, Homo sapiens
ttctccttgttgttggttgtt

SEQ ID NO: 3689989 - DNA, 17 bp, Homo sapiens
ttctctaactcctgcca

SEQ ID NO: 3689990 - DNA, 18 bp, Homo sapiens
ttctctaactcctgccat

SEQ ID NO: 3689991 - DNA, 17 bp, Homo sapiens
ttctctactctagggaa

SEQ ID NO: 3689992 - DNA, 10 bp, Homo sapiens
ttctctgcca

SEQ ID NO: 3689993 - DNA, 12 bp, Homo sapiens
ttctctgccagt

SEQ ID NO: 3689994 - DNA, 15 bp, Homo sapiens
ttctctgctccacca

SEQ ID NO: 3689995 - DNA, 18 bp, Homo sapiens
ttctctgtacttttcatt

SEQ ID NO: 3689996 - DNA, 22 bp, Homo sapiens
ttctcttgggtgggacagggct

SEQ ID NO: 3689997 - DNA, 13 bp, Homo sapiens
ttctgaaagtgtt

SEQ ID NO: 3689998 - DNA, 22 bp, Homo sapiens
ttctgaatattttatctttcct

SEQ ID NO: 3689999 - DNA, 13 bp, Homo sapiens
ttctgagaccaaa

SEQ ID NO: 3690000 - DNA, 14 bp, Homo sapiens
ttctgagcctgcct

SEQ ID NO: 3690001 - DNA, 15 bp, Homo sapiens
ttctgagtgatccag

SEQ ID NO: 3690002 - DNA, 14 bp, Homo sapiens
ttctgatcaaggcc

SEQ ID NO: 3690003 - DNA, 22 bp, Homo sapiens
ttctgatcaaggccttattgga

SEQ ID NO: 3690004 - DNA, 18 bp, Homo sapiens
ttctgattccgcaccctg

SEQ ID NO: 3690005 - DNA, 17 bp, Homo sapiens
ttctgcctgccagctgc

SEQ ID NO: 3690006 - DNA, 22 bp, Homo sapiens
ttctgcctgccagctgcactga

SEQ ID NO: 3690007 - DNA, 19 bp, Homo sapiens
ttctgctactggcaaaagg

SEQ ID NO: 3690008 - DNA, 12 bp, Homo sapiens
ttctgctcagct

SEQ ID NO: 3690009 - DNA, 13 bp, Homo sapiens
ttctgctccaccc

SEQ ID NO: 3690010 - DNA, 15 bp, Homo sapiens
ttctgctccaccctt

SEQ ID NO: 3690011 - DNA, 16 bp, Homo sapiens
ttctgctccacccttg

SEQ ID NO: 3690012 - DNA, 17 bp, Homo sapiens
ttctgctccacccttgg

SEQ ID NO: 3690013 - DNA, 20 bp, Homo sapiens
ttctgctccacccttggcct

SEQ ID NO: 3690014 - DNA, 15 bp, Homo sapiens
ttctggaaaatgctt

SEQ ID NO: 3690015 - DNA, 18 bp, Homo sapiens
ttctggaatttgttcaag

SEQ ID NO: 3690016 - DNA, 15 bp, Homo sapiens
ttctgtaagaaacct

SEQ ID NO: 3690017 - DNA, 19 bp, Homo sapiens
ttctgtaagaaacctactg

SEQ ID NO: 3690018 - DNA, 22 bp, Homo sapiens
ttctgtcccaagtctccagaga

SEQ ID NO: 3690019 - DNA, 16 bp, Homo sapiens
ttcttaacaaactctt

SEQ ID NO: 3690020 - DNA, 17 bp, Homo sapiens
ttcttaacaaactcttc

SEQ ID NO: 3690021 - DNA, 17 bp, Homo sapiens
ttcttatgttgcccagt

SEQ ID NO: 3690022 - DNA, 18 bp, Homo sapiens
ttcttcagagtttgtcat

SEQ ID NO: 3690023 - DNA, 15 bp, Homo sapiens
ttcttcatattctaa

SEQ ID NO: 3690024 - DNA, 20 bp, Homo sapiens
ttcttcctggatggggcaga

SEQ ID NO: 3690025 - DNA, 22 bp, Homo sapiens
ttcttcttccaacgtggcccag

SEQ ID NO: 3690026 - DNA, 22 bp, Homo sapiens
ttcttggcttaatcattttcat

SEQ ID NO: 3690027 - DNA, 14 bp, Homo sapiens
ttcttgtgcttttc

SEQ ID NO: 3690028 - DNA, 21 bp, Homo sapiens
ttcttgtggaagacacttgct

SEQ ID NO: 3690029 - DNA, 20 bp, Homo sapiens
ttctttaaaatgtaaagcca

SEQ ID NO: 3690030 - DNA, 16 bp, Homo sapiens
ttctttaaccttgtat

SEQ ID NO: 3690031 - DNA, 21 bp, Homo sapiens
ttctttagagattataacaaa

SEQ ID NO: 3690032 - DNA, 12 bp, Homo sapiens
ttcttttgaatt

SEQ ID NO: 3690033 - DNA, 15 bp, Homo sapiens
ttcttttgaattgtt

SEQ ID NO: 3690034 - DNA, 22 bp, Homo sapiens
ttgaaaggcaggaagggaagcg

SEQ ID NO: 3690035 - DNA, 22 bp, Homo sapiens
ttgaaagtaaaaacctgcttgg

SEQ ID NO: 3690036 - DNA, 18 bp, Homo sapiens
ttgaaatatcctgcttga

SEQ ID NO: 3690037 - DNA, 18 bp, Homo sapiens
ttttctttaaagaagttg

SEQ ID NO: 3690038 - DNA, 16 bp, Homo sapiens
ttttgaattgttacat

SEQ ID NO: 3690039 - DNA, 16 bp, Homo sapiens
ttttgaccctcattct

SEQ ID NO: 3690040 - DNA, 18 bp, Homo sapiens
ttttgaccctcattcttt

SEQ ID NO: 3690041 - DNA, 14 bp, Homo sapiens
ttttgacttaatgt

SEQ ID NO: 3690042 - DNA, 15 bp, Homo sapiens
ttttgacttaatgtg

SEQ ID NO: 3690043 - DNA, 17 bp, Homo sapiens
ttttgacttaatgtgat

SEQ ID NO: 3690044 - DNA, 20 bp, Homo sapiens
ttttggagtgttatgtattt

SEQ ID NO: 3690045 - DNA, 22 bp, Homo sapiens
ttttggctgaaattctcctgga

SEQ ID NO: 3690046 - DNA, 13 bp, Homo sapiens
ttttgtaatgaat

SEQ ID NO: 3690047 - DNA, 11 bp, Homo sapiens
ttttgtaccaa

SEQ ID NO: 3690048 - DNA, 15 bp, Homo sapiens
ttttgtctaattaaa

SEQ ID NO: 3690049 - DNA, 16 bp, Homo sapiens
ttttgttttacaatgt

SEQ ID NO: 3690050 - DNA, 23 bp, Homo sapiens
tttttaaataaaaattactgtgt

SEQ ID NO: 3690051 - DNA, 17 bp, Homo sapiens
tttttaaatattatgct

SEQ ID NO: 3690052 - DNA, 22 bp, Homo sapiens
tttttaaatattatgctgcttt

SEQ ID NO: 3690053 - DNA, 16 bp, Homo sapiens
tttttaaatattttct

SEQ ID NO: 3690054 - DNA, 18 bp, Homo sapiens
tttttaacaatctaacaa

SEQ ID NO: 3690055 - DNA, 19 bp, Homo sapiens
tttttacagctgtgttatt

SEQ ID NO: 3690056 - DNA, 20 bp, Homo sapiens
tttttaccaaagtgtctttt

SEQ ID NO: 3690057 - DNA, 15 bp, Homo sapiens
tttttataatatcca

SEQ ID NO: 3690058 - DNA, 16 bp, Homo sapiens
tttttatgtgatcaat

SEQ ID NO: 3690059 - DNA, 19 bp, Homo sapiens
tttttatttgtttgtgcat

SEQ ID NO: 3690060 - DNA, 20 bp, Homo sapiens
tttttcaaaatagaaaagtt

SEQ ID NO: 3690061 - DNA, 14 bp, Homo sapiens
tttttggtacaaaa

SEQ ID NO: 3690062 - DNA, 20 bp, Homo sapiens
tttttgtaaatgtgtacata

SEQ ID NO: 3690063 - DNA, 12 bp, Homo sapiens
tttttgtaccaa

SEQ ID NO: 3690064 - DNA, 18 bp, Homo sapiens
ttttttcaaaatagaaaa

SEQ ID NO: 3690065 - DNA, 13 bp, Homo sapiens
ttttttggtacaa

SEQ ID NO: 3690066 - DNA, 12 bp, Homo sapiens
ttttttgtagtt

SEQ ID NO: 3690067 - DNA, 11 bp, Homo sapiens
aaaaaaatagt

SEQ ID NO: 3690068 - DNA, 13 bp, Homo sapiens
aaaaaaatgttgt

SEQ ID NO: 3690069 - DNA, 16 bp, Homo sapiens
aaaaacatagaaaaat

SEQ ID NO: 3690070 - DNA, 15 bp, Homo sapiens
aaaaacatattcttg

SEQ ID NO: 3690071 - DNA, 12 bp, Homo sapiens
aaaaacattgcc

SEQ ID NO: 3690072 - DNA, 17 bp, Homo sapiens
aaaaagcataaaaacat

SEQ ID NO: 3690073 - DNA, 14 bp, Homo sapiens
aaaaaggaggaaga

SEQ ID NO: 3690074 - DNA, 15 bp, Homo sapiens
aaaaaggatacataa

SEQ ID NO: 3690075 - DNA, 15 bp, Homo sapiens
aaaaagtcaaacttt

SEQ ID NO: 3690076 - DNA, 22 bp, Homo sapiens
aaaaataaaaaggatctccttt

SEQ ID NO: 3690077 - DNA, 18 bp, Homo sapiens
aaaaatactttttctaat

SEQ ID NO: 3690078 - DNA, 21 bp, Homo sapiens
aaaaatactttttctaatgag

SEQ ID NO: 3690079 - DNA, 13 bp, Homo sapiens
aaaaattaaaatg

SEQ ID NO: 3690080 - DNA, 22 bp, Homo sapiens
aaaaattcagcaaaccattttt

SEQ ID NO: 3690081 - DNA, 23 bp, Homo sapiens
aaaaattgtttcaaaataaaaac

SEQ ID NO: 3690082 - DNA, 22 bp, Homo sapiens
aaaacaaaatttgactaatttt

SEQ ID NO: 3690083 - DNA, 18 bp, Homo sapiens
aaaacaggtcaatacagt

SEQ ID NO: 3690084 - DNA, 15 bp, Homo sapiens
aaaaccaaatgttta

SEQ ID NO: 3690085 - DNA, 14 bp, Homo sapiens
aaaaccaagaagat

SEQ ID NO: 3690086 - DNA, 12 bp, Homo sapiens
aaaacccaagtg

SEQ ID NO: 3690087 - DNA, 21 bp, Homo sapiens
aaaactctacttaatccaatg

SEQ ID NO: 3690088 - DNA, 16 bp, Homo sapiens
aaaactggacctgtat

SEQ ID NO: 3690089 - DNA, 19 bp, Homo sapiens
aaaactggacctgtatatt

SEQ ID NO: 3690090 - DNA, 17 bp, Homo sapiens
aaaacttgcctttcagt

SEQ ID NO: 3690091 - DNA, 12 bp, Homo sapiens
aaaagaagaaga

SEQ ID NO: 3690092 - DNA, 14 bp, Homo sapiens
aaaagctgggcagg

SEQ ID NO: 3690093 - DNA, 14 bp, Homo sapiens
aaaaggatctcctt

SEQ ID NO: 3690094 - DNA, 15 bp, Homo sapiens
aaaaggctgagaagg

SEQ ID NO: 3690095 - DNA, 14 bp, Homo sapiens
aaaaggtttacaga

SEQ ID NO: 3690096 - DNA, 18 bp, Homo sapiens
aaaaggtttacagaattt

SEQ ID NO: 3690097 - DNA, 15 bp, Homo sapiens
aaaagtcaaactttc

SEQ ID NO: 3690098 - DNA, 18 bp, Homo sapiens
aaaagtccaattttaatt

SEQ ID NO: 3690099 - DNA, 15 bp, Homo sapiens
aaaataaaaaatgtg

SEQ ID NO: 3690100 - DNA, 20 bp, Homo sapiens
aaaataaatttatatgaaaa

SEQ ID NO: 3690101 - DNA, 19 bp, Homo sapiens
aaaataacaactatttttg

SEQ ID NO: 3690102 - DNA, 16 bp, Homo sapiens
aaaatacaaacacatg

SEQ ID NO: 3690103 - DNA, 15 bp, Homo sapiens
aaaataccagagcct

SEQ ID NO: 3690104 - DNA, 19 bp, Homo sapiens
aaaataccagagccttcaa

SEQ ID NO: 3690105 - DNA, 21 bp, Homo sapiens
aaaataccagagccttcaagt

SEQ ID NO: 3690106 - DNA, 13 bp, Homo sapiens
aaaatatatgtat

SEQ ID NO: 3690107 - DNA, 19 bp, Homo sapiens
aaaatatttaaaaatgtct

SEQ ID NO: 3690108 - DNA, 23 bp, Homo sapiens
aaaatattttctctgtacttttc

SEQ ID NO: 3690109 - DNA, 13 bp, Homo sapiens
aaaatcagcctgc

SEQ ID NO: 3690110 - DNA, 21 bp, Homo sapiens
aaaatcagcctgctccagctg

SEQ ID NO: 3690111 - DNA, 22 bp, Homo sapiens
aaaatcccttacctcggtgcct

SEQ ID NO: 3690112 - DNA, 16 bp, Homo sapiens
aaaatgcttcttggct

SEQ ID NO: 3690113 - DNA, 16 bp, Homo sapiens
aaaatggaggtggaaa

SEQ ID NO: 3690114 - DNA, 21 bp, Homo sapiens
aaaatggatgccttgaataat

SEQ ID NO: 3690115 - DNA, 23 bp, Homo sapiens
aaaatggatgccttgaataataa

SEQ ID NO: 3690116 - DNA, 21 bp, Homo sapiens
aaaatgtaggcttagtttgtg

SEQ ID NO: 3690117 - DNA, 12 bp, Homo sapiens
aaaattaaaatg

SEQ ID NO: 3690118 - DNA, 16 bp, Homo sapiens
aaaattagacaaatgc

SEQ ID NO: 3690119 - DNA, 13 bp, Homo sapiens
aaaattcttcgca

SEQ ID NO: 3690120 - DNA, 15 bp, Homo sapiens
aaacaaaatttgact

SEQ ID NO: 3690121 - DNA, 17 bp, Homo sapiens
aaacaaaatttgactaa

SEQ ID NO: 3690122 - DNA, 13 bp, Homo sapiens
aaacactttcaaa

SEQ ID NO: 3690123 - DNA, 17 bp, Homo sapiens
aaacaggtcaatacagt

SEQ ID NO: 3690124 - DNA, 21 bp, Homo sapiens
aaacatagaaatggaaatttt

SEQ ID NO: 3690125 - DNA, 22 bp, Homo sapiens
aaacatgagcgctactcttgga

SEQ ID NO: 3690126 - DNA, 17 bp, Homo sapiens
aaacattgcctttgaat

SEQ ID NO: 3690127 - DNA, 19 bp, Homo sapiens
aaacattttcagaaatatt

SEQ ID NO: 3690128 - DNA, 12 bp, Homo sapiens
aaaccaagaaga

SEQ ID NO: 3690129 - DNA, 23 bp, Homo sapiens
aaaccaagtcaagtgaaaaagga

SEQ ID NO: 3690130 - DNA, 12 bp, Homo sapiens
aaaccacacaaa

SEQ ID NO: 3690131 - DNA, 14 bp, Homo sapiens
aaaccacacaaaga

SEQ ID NO: 3690132 - DNA, 17 bp, Homo sapiens
aaaccccatctctacaa

SEQ ID NO: 3690133 - DNA, 19 bp, Homo sapiens
aaacccgacagagggaaga

SEQ ID NO: 3690134 - DNA, 16 bp, Homo sapiens
aaaccgccaaggctgg

SEQ ID NO: 3690135 - DNA, 11 bp, Homo sapiens
aaacctaggtc

SEQ ID NO: 3690136 - DNA, 14 bp, Homo sapiens
aaacctcctgctgt

SEQ ID NO: 3690137 - DNA, 17 bp, Homo sapiens
aaacctcctgctgtgcc

SEQ ID NO: 3690138 - DNA, 22 bp, Homo sapiens
aaacctggttcatatttatact

SEQ ID NO: 3690139 - DNA, 19 bp, Homo sapiens
aaacctgttgaagattatt

SEQ ID NO: 3690140 - DNA, 13 bp, Homo sapiens
aaaccttagtttc

SEQ ID NO: 3690141 - DNA, 15 bp, Homo sapiens
aaacgggctcagcaa

SEQ ID NO: 3690142 - DNA, 12 bp, Homo sapiens
aaacgtgaaaat

SEQ ID NO: 3690143 - DNA, 23 bp, Homo sapiens
aaactcttaaaacccaagtgcct

SEQ ID NO: 3690144 - DNA, 21 bp, Homo sapiens
aaactgaagcagcctctcccc

SEQ ID NO: 3690145 - DNA, 20 bp, Homo sapiens
aaactgtctttaaaagagag

SEQ ID NO: 3690146 - DNA, 13 bp, Homo sapiens
aaagaacatgctt

SEQ ID NO: 3690147 - DNA, 21 bp, Homo sapiens
aaagaagaagaagaaggagag

SEQ ID NO: 3690148 - DNA, 16 bp, Homo sapiens
aaagaagcccccagct

SEQ ID NO: 3690149 - DNA, 20 bp, Homo sapiens
aaagaatatgactttttata

SEQ ID NO: 3690150 - DNA, 17 bp, Homo sapiens
aaagaatggaaggtgga

SEQ ID NO: 3690151 - DNA, 19 bp, Homo sapiens
aaagacctccacttgctta

SEQ ID NO: 3690152 - DNA, 20 bp, Homo sapiens
aaagagagagagagaaaaaa

SEQ ID NO: 3690153 - DNA, 11 bp, Homo sapiens
aaagagcactg

SEQ ID NO: 3690154 - DNA, 12 bp, Homo sapiens
aaagaggctgag

SEQ ID NO: 3690155 - DNA, 19 bp, Homo sapiens
aaagaggctgaggcctgga

SEQ ID NO: 3690156 - DNA, 21 bp, Homo sapiens
aaagaggctgaggcctggact

SEQ ID NO: 3690157 - DNA, 11 bp, Homo sapiens
aaagaggtttt

SEQ ID NO: 3690158 - DNA, 17 bp, Homo sapiens
aaagatgatattaagaa

SEQ ID NO: 3690159 - DNA, 12 bp, Homo sapiens
aaagatgctttt

SEQ ID NO: 3690160 - DNA, 13 bp, Homo sapiens
aaagatgctttta

SEQ ID NO: 3690161 - DNA, 18 bp, Homo sapiens
aaagatttgtgaactgga

SEQ ID NO: 3690162 - DNA, 21 bp, Homo sapiens
aaagatttgtgaactggaaga

SEQ ID NO: 3690163 - DNA, 22 bp, Homo sapiens
aaagatttgtgaactggaagaa

SEQ ID NO: 3690164 - DNA, 14 bp, Homo sapiens
aaagcataaaaaca

SEQ ID NO: 3690165 - DNA, 16 bp, Homo sapiens
aaagcataaaaacatt

SEQ ID NO: 3690166 - DNA, 18 bp, Homo sapiens
aaagcataaaaacatttt

SEQ ID NO: 3690167 - DNA, 13 bp, Homo sapiens
aaagcctgaaggg

SEQ ID NO: 3690168 - DNA, 15 bp, Homo sapiens
aaagctgaaaactgc

SEQ ID NO: 3690169 - DNA, 12 bp, Homo sapiens
aaagctttcctg

SEQ ID NO: 3690170 - DNA, 17 bp, Homo sapiens
aaaggcacctataaaac

SEQ ID NO: 3690171 - DNA, 14 bp, Homo sapiens
aaaggcagctgtgt

SEQ ID NO: 3690172 - DNA, 15 bp, Homo sapiens
aaaggcatgctggag

SEQ ID NO: 3690173 - DNA, 14 bp, Homo sapiens
aaaggccagctggc

SEQ ID NO: 3690174 - DNA, 18 bp, Homo sapiens
aaaggccagctggcagca

SEQ ID NO: 3690175 - DNA, 14 bp, Homo sapiens
aaaggctgagaagg

SEQ ID NO: 3690176 - DNA, 17 bp, Homo sapiens
aaagggtcctgctttct

SEQ ID NO: 3690177 - DNA, 19 bp, Homo sapiens
aaaggtggactggaagggg

SEQ ID NO: 3690178 - DNA, 14 bp, Homo sapiens
aaaggtgttgtccc

SEQ ID NO: 3690179 - DNA, 18 bp, Homo sapiens
aaaggtgttgtcccttct

SEQ ID NO: 3690180 - DNA, 16 bp, Homo sapiens
aaaggtttacagaatt

SEQ ID NO: 3690181 - DNA, 19 bp, Homo sapiens
aaaggtttgcattctcaca

SEQ ID NO: 3690182 - DNA, 18 bp, Homo sapiens
aaagtagaagcatgtttg

SEQ ID NO: 3690183 - DNA, 15 bp, Homo sapiens
aaagtagacaaatgg

SEQ ID NO: 3690184 - DNA, 16 bp, Homo sapiens
aaagtagtcctgtgaa

SEQ ID NO: 3690185 - DNA, 13 bp, Homo sapiens
aaagtattgtaaa

SEQ ID NO: 3690186 - DNA, 15 bp, Homo sapiens
aaagtattgtaaatt

SEQ ID NO: 3690187 - DNA, 20 bp, Homo sapiens
aaagtattgtaaattatatt

SEQ ID NO: 3690188 - DNA, 21 bp, Homo sapiens
aaagtattgtaaattatattt

SEQ ID NO: 3690189 - DNA, 14 bp, Homo sapiens
aacggagaaaggtg

SEQ ID NO: 3690190 - DNA, 22 bp, Homo sapiens
aacggaggcctgcgaccctggg

SEQ ID NO: 3690191 - DNA, 17 bp, Homo sapiens
aacgtccttccacttca

SEQ ID NO: 3690192 - DNA, 12 bp, Homo sapiens
aacgtgaaaatg

SEQ ID NO: 3690193 - DNA, 13 bp, Homo sapiens
aactaccaggtgg

SEQ ID NO: 3690194 - DNA, 20 bp, Homo sapiens
aactagactcccaagctgga

SEQ ID NO: 3690195 - DNA, 17 bp, Homo sapiens
aactagggaagataata

SEQ ID NO: 3690196 - DNA, 22 bp, Homo sapiens
aactatgcatggtgccccagga

SEQ ID NO: 3690197 - DNA, 12 bp, Homo sapiens
aactattttcag

SEQ ID NO: 3690198 - DNA, 13 bp, Homo sapiens
aactcaatatttt

SEQ ID NO: 3690199 - DNA, 14 bp, Homo sapiens
aactcaatattttc

SEQ ID NO: 3690200 - DNA, 20 bp, Homo sapiens
aactcaatattttccatgaa

SEQ ID NO: 3690201 - DNA, 14 bp, Homo sapiens
aactcagatccagg

SEQ ID NO: 3690202 - DNA, 15 bp, Homo sapiens
aactcagatccaggg

SEQ ID NO: 3690203 - DNA, 14 bp, Homo sapiens
aactcagtatttta

SEQ ID NO: 3690204 - DNA, 13 bp, Homo sapiens
aactcctacctga

SEQ ID NO: 3690205 - DNA, 17 bp, Homo sapiens
aactcctacctgaaggc

SEQ ID NO: 3690206 - DNA, 15 bp, Homo sapiens
aactcctgccattct

SEQ ID NO: 3690207 - DNA, 15 bp, Homo sapiens
aactcgtatagcatg

SEQ ID NO: 3690208 - DNA, 19 bp, Homo sapiens
aactcgtatagcatgcatc

SEQ ID NO: 3690209 - DNA, 22 bp, Homo sapiens
aactctacatgtaactatttct

SEQ ID NO: 3690210 - DNA, 23 bp, Homo sapiens
aactctagctgggggtgggccag

SEQ ID NO: 3690211 - DNA, 22 bp, Homo sapiens
aactctgttgcaagtgcaataa

SEQ ID NO: 3690212 - DNA, 20 bp, Homo sapiens
aactcttcagttaattctta

SEQ ID NO: 3690213 - DNA, 18 bp, Homo sapiens
aactgaagcagcctctcc

SEQ ID NO: 3690214 - DNA, 21 bp, Homo sapiens
aactgaagcagcctctcccca

SEQ ID NO: 3690215 - DNA, 17 bp, Homo sapiens
aactgcacactcagtgg

SEQ ID NO: 3690216 - DNA, 18 bp, Homo sapiens
aactgcacactcagtggg

SEQ ID NO: 3690217 - DNA, 17 bp, Homo sapiens
aactgcaggccctggcc

SEQ ID NO: 3690218 - DNA, 20 bp, Homo sapiens
aactgcaggccctggcctcc

SEQ ID NO: 3690219 - DNA, 21 bp, Homo sapiens
aactgctgactgttttctctt

SEQ ID NO: 3690220 - DNA, 12 bp, Homo sapiens
aactggagcccc

SEQ ID NO: 3690221 - DNA, 14 bp, Homo sapiens
aactggcaggcagg

SEQ ID NO: 3690222 - DNA, 18 bp, Homo sapiens
aactggtgcactttgtaa

SEQ ID NO: 3690223 - DNA, 20 bp, Homo sapiens
aactggtgcactttgtaaat

SEQ ID NO: 3690224 - DNA, 21 bp, Homo sapiens
aactgtcaggctgaaaacaat

SEQ ID NO: 3690225 - DNA, 19 bp, Homo sapiens
aactgtgaaataccacaag

SEQ ID NO: 3690226 - DNA, 19 bp, Homo sapiens
aactgttaaatgtggtttc

SEQ ID NO: 3690227 - DNA, 14 bp, Homo sapiens
aactgttacaactt

SEQ ID NO: 3690228 - DNA, 23 bp, Homo sapiens
aacttcccctctaactggacagc

SEQ ID NO: 3690229 - DNA, 16 bp, Homo sapiens
aacttccgttcattgc

SEQ ID NO: 3690230 - DNA, 21 bp, Homo sapiens
aacttgaaatatcctgcttga

SEQ ID NO: 3690231 - DNA, 12 bp, Homo sapiens
aacttgctgggt

SEQ ID NO: 3690232 - DNA, 21 bp, Homo sapiens
aacttggctcgaatctctgtg

SEQ ID NO: 3690233 - DNA, 23 bp, Homo sapiens
aacttggctcgaatctctgtgcc

SEQ ID NO: 3690234 - DNA, 21 bp, Homo sapiens
aacttggggagttaagacctg

SEQ ID NO: 3690235 - DNA, 22 bp, Homo sapiens
aacttggggagttaagacctgg

SEQ ID NO: 3690236 - DNA, 23 bp, Homo sapiens
aacttggggagttaagacctggc

SEQ ID NO: 3690237 - DNA, 16 bp, Homo sapiens
aacttggtcagagcca

SEQ ID NO: 3690238 - DNA, 17 bp, Homo sapiens
aacttggtcagagccac

SEQ ID NO: 3690239 - DNA, 20 bp, Homo sapiens
aacttggtcagagccactct

SEQ ID NO: 3690240 - DNA, 13 bp, Homo sapiens
aactttaagagga

SEQ ID NO: 3690241 - DNA, 15 bp, Homo sapiens
aactttaagaggaca

SEQ ID NO: 3690242 - DNA, 12 bp, Homo sapiens
aagaaaaagatt

SEQ ID NO: 3690243 - DNA, 17 bp, Homo sapiens
aagaaaaatgagcctgg

SEQ ID NO: 3690244 - DNA, 16 bp, Homo sapiens
aagaaaagagctttct

SEQ ID NO: 3690245 - DNA, 16 bp, Homo sapiens
aagaaacccgacagag

SEQ ID NO: 3690246 - DNA, 16 bp, Homo sapiens
aagaaacctactgccc

SEQ ID NO: 3690247 - DNA, 23 bp, Homo sapiens
aagaaagagcaacaatccatctc

SEQ ID NO: 3690248 - DNA, 16 bp, Homo sapiens
aagaaagcaaaagcaa

SEQ ID NO: 3690249 - DNA, 22 bp, Homo sapiens
aagaactgcaggccctggcctc

SEQ ID NO: 3690250 - DNA, 18 bp, Homo sapiens
aagaactttgagctactg

SEQ ID NO: 3690251 - DNA, 12 bp, Homo sapiens
aagaagaaaaag

SEQ ID NO: 3690252 - DNA, 15 bp, Homo sapiens
aagaagcccccagct

SEQ ID NO: 3690253 - DNA, 16 bp, Homo sapiens
aagaagcccccagcta

SEQ ID NO: 3690254 - DNA, 14 bp, Homo sapiens
aagaagctctctcc

SEQ ID NO: 3690255 - DNA, 15 bp, Homo sapiens
aagaagctctctcct

SEQ ID NO: 3690256 - DNA, 21 bp, Homo sapiens
aagaaggagagcaagaaggaa

SEQ ID NO: 3690257 - DNA, 21 bp, Homo sapiens
aagaaggggacaatggcagaa

SEQ ID NO: 3690258 - DNA, 23 bp, Homo sapiens
aagaattctgtgagaaaaaattt

SEQ ID NO: 3690259 - DNA, 14 bp, Homo sapiens
aagacaacaggcat

SEQ ID NO: 3690260 - DNA, 23 bp, Homo sapiens
aagacaatggcttactccaggag

SEQ ID NO: 3690261 - DNA, 22 bp, Homo sapiens
aagacacaaggtgatttcagac

SEQ ID NO: 3690262 - DNA, 14 bp, Homo sapiens
aagacacctggttg

SEQ ID NO: 3690263 - DNA, 18 bp, Homo sapiens
aagacacttgctgagtga

SEQ ID NO: 3690264 - DNA, 18 bp, Homo sapiens
aagacagagaaaacttgc

SEQ ID NO: 3690265 - DNA, 21 bp, Homo sapiens
aagaccaagcttagtcctggg

SEQ ID NO: 3690266 - DNA, 19 bp, Homo sapiens
aagagactgtgccatggtg

SEQ ID NO: 3690267 - DNA, 19 bp, Homo sapiens
aagagagagagagaaaaaa

SEQ ID NO: 3690268 - DNA, 19 bp, Homo sapiens
aagagattgtggtttcatt

SEQ ID NO: 3690269 - DNA, 17 bp, Homo sapiens
aagagcagcctgtggca

SEQ ID NO: 3690270 - DNA, 9 bp, Homo sapiens
aagagccat

SEQ ID NO: 3690271 - DNA, 21 bp, Homo sapiens
aagagcccaaaagagggcaca

SEQ ID NO: 3690272 - DNA, 17 bp, Homo sapiens
aagaggcccgccctgcc

SEQ ID NO: 3690273 - DNA, 23 bp, Homo sapiens
aagagggttttaggtagaaaaac

SEQ ID NO: 3690274 - DNA, 23 bp, Homo sapiens
aagagtgtcctaggagtatcctc

SEQ ID NO: 3690275 - DNA, 19 bp, Homo sapiens
aagataacccttattccat

SEQ ID NO: 3690276 - DNA, 19 bp, Homo sapiens
aagatgatattaagaactg

SEQ ID NO: 3690277 - DNA, 20 bp, Homo sapiens
aagatgcaaggaccaggact

SEQ ID NO: 3690278 - DNA, 17 bp, Homo sapiens
aagatgcttctcactgc

SEQ ID NO: 3690279 - DNA, 22 bp, Homo sapiens
aagatgcttttaacagagtctg

SEQ ID NO: 3690280 - DNA, 18 bp, Homo sapiens
aagattccattttggaaa

SEQ ID NO: 3690281 - DNA, 21 bp, Homo sapiens
aagatttacctcgttctgctc

SEQ ID NO: 3690282 - DNA, 17 bp, Homo sapiens
aagatttggaaagatat

SEQ ID NO: 3690283 - DNA, 16 bp, Homo sapiens
aagcaaaagcaaggga

SEQ ID NO: 3690284 - DNA, 17 bp, Homo sapiens
aagcaattatttttaaa

SEQ ID NO: 3690285 - DNA, 11 bp, Homo sapiens
aagcacagctg

SEQ ID NO: 3690286 - DNA, 21 bp, Homo sapiens
aagcagaggaaggagaggaga

SEQ ID NO: 3690287 - DNA, 13 bp, Homo sapiens
aagcagaggacca

SEQ ID NO: 3690288 - DNA, 18 bp, Homo sapiens
aagcagaggaccagggcc

SEQ ID NO: 3690289 - DNA, 19 bp, Homo sapiens
aagcagaggaccagggcct

SEQ ID NO: 3690290 - DNA, 15 bp, Homo sapiens
aagcagaggaggggc

SEQ ID NO: 3690291 - DNA, 19 bp, Homo sapiens
aagcagatgcaaagaggca

SEQ ID NO: 3690292 - DNA, 21 bp, Homo sapiens
aagcagatgcaaagaggcaag

SEQ ID NO: 3690293 - DNA, 21 bp, Homo sapiens
aagcagccaagctccttggga

SEQ ID NO: 3690294 - DNA, 23 bp, Homo sapiens
aagcaggactttgaggcaagtgt

SEQ ID NO: 3690295 - DNA, 18 bp, Homo sapiens
aagcagtcgtgcctgtgt

SEQ ID NO: 3690296 - DNA, 15 bp, Homo sapiens
aagcataaaaacatt

SEQ ID NO: 3690297 - DNA, 20 bp, Homo sapiens
aagcatgaataacatttaaa

SEQ ID NO: 3690298 - DNA, 20 bp, Homo sapiens
aagccaagggaacctgtgtc

SEQ ID NO: 3690299 - DNA, 12 bp, Homo sapiens
aagccagaagct

SEQ ID NO: 3690300 - DNA, 20 bp, Homo sapiens
aagccagaagctgagcacca

SEQ ID NO: 3690301 - DNA, 22 bp, Homo sapiens
aagccaggaatttcccaggacc

SEQ ID NO: 3690302 - DNA, 15 bp, Homo sapiens
aagccatgctggaaa

SEQ ID NO: 3690303 - DNA, 21 bp, Homo sapiens
aagccatgtactcaagtacca

SEQ ID NO: 3690304 - DNA, 17 bp, Homo sapiens
aagccgagagccttttg

SEQ ID NO: 3690305 - DNA, 23 bp, Homo sapiens
aagcctctcgtcccgtccctccc

SEQ ID NO: 3690306 - DNA, 12 bp, Homo sapiens
aaagtattttgg

SEQ ID NO: 3690307 - DNA, 18 bp, Homo sapiens
aaagtcagtatcatatta

SEQ ID NO: 3690308 - DNA, 20 bp, Homo sapiens
aaagtccaattttaatttag

SEQ ID NO: 3690309 - DNA, 18 bp, Homo sapiens
aaagtcttttttttcctg

SEQ ID NO: 3690310 - DNA, 18 bp, Homo sapiens
aaagtgaattgttgacaa

SEQ ID NO: 3690311 - DNA, 12 bp, Homo sapiens
aaagttaaaaag

SEQ ID NO: 3690312 - DNA, 17 bp, Homo sapiens
aaataaagataaccctt

SEQ ID NO: 3690313 - DNA, 17 bp, Homo sapiens
aaataagtatttctgat

SEQ ID NO: 3690314 - DNA, 18 bp, Homo sapiens
aaataagtatttctgatt

SEQ ID NO: 3690315 - DNA, 17 bp, Homo sapiens
aaataatactgctgaga

SEQ ID NO: 3690316 - DNA, 16 bp, Homo sapiens
aaatactttttctaat

SEQ ID NO: 3690317 - DNA, 19 bp, Homo sapiens
aaatagtgacataatatat

SEQ ID NO: 3690318 - DNA, 21 bp, Homo sapiens
aaatagtgacataatatattc

SEQ ID NO: 3690319 - DNA, 15 bp, Homo sapiens
aaatatatgaacatt

SEQ ID NO: 3690320 - DNA, 20 bp, Homo sapiens
aaatatcctaagactaacaa

SEQ ID NO: 3690321 - DNA, 14 bp, Homo sapiens
aaatatctgctcaa

SEQ ID NO: 3690322 - DNA, 13 bp, Homo sapiens
aaatatttctgag

SEQ ID NO: 3690323 - DNA, 11 bp, Homo sapiens
aaatattttct

SEQ ID NO: 3690324 - DNA, 12 bp, Homo sapiens
aaatattttcta

SEQ ID NO: 3690325 - DNA, 12 bp, Homo sapiens
aaatattttctc

SEQ ID NO: 3690326 - DNA, 15 bp, Homo sapiens
aaatattttctctgt

SEQ ID NO: 3690327 - DNA, 21 bp, Homo sapiens
aaatattttctctgtactttt

SEQ ID NO: 3690328 - DNA, 19 bp, Homo sapiens
aaatcaccacaaactgtaa

SEQ ID NO: 3690329 - DNA, 19 bp, Homo sapiens
aaatcagccgtgtaaccat

SEQ ID NO: 3690330 - DNA, 12 bp, Homo sapiens
aaatcagcctgc

SEQ ID NO: 3690331 - DNA, 18 bp, Homo sapiens
aaatcagcctgctccagc

SEQ ID NO: 3690332 - DNA, 14 bp, Homo sapiens
aaatcattccttag

SEQ ID NO: 3690333 - DNA, 17 bp, Homo sapiens
aaatctgaccaaaacaa

SEQ ID NO: 3690334 - DNA, 12 bp, Homo sapiens
aaatctggaagc

SEQ ID NO: 3690335 - DNA, 21 bp, Homo sapiens
aaatctgtccaaaggaggctg

SEQ ID NO: 3690336 - DNA, 14 bp, Homo sapiens
aaatcttaatactt

SEQ ID NO: 3690337 - DNA, 18 bp, Homo sapiens
aaatgacactttataact

SEQ ID NO: 3690338 - DNA, 22 bp, Homo sapiens
aaatgagcagcccttacagtat

SEQ ID NO: 3690339 - DNA, 16 bp, Homo sapiens
aaatgatcttttcaag

SEQ ID NO: 3690340 - DNA, 14 bp, Homo sapiens
aaatgcagtatatt

SEQ ID NO: 3690341 - DNA, 18 bp, Homo sapiens
aaatgcagtatatttctt

SEQ ID NO: 3690342 - DNA, 22 bp, Homo sapiens
aaatgccatgatgcctctgtct

SEQ ID NO: 3690343 - DNA, 13 bp, Homo sapiens
aaatgcccagctt

SEQ ID NO: 3690344 - DNA, 13 bp, Homo sapiens
aaatgccctcttc

SEQ ID NO: 3690345 - DNA, 22 bp, Homo sapiens
aaatgcctcttaaattatatat

SEQ ID NO: 3690346 - DNA, 17 bp, Homo sapiens
aaatggagctttctgta

SEQ ID NO: 3690347 - DNA, 21 bp, Homo sapiens
aaatggatgccttgaataata

SEQ ID NO: 3690348 - DNA, 15 bp, Homo sapiens
aaatggcctcatgtg

SEQ ID NO: 3690349 - DNA, 21 bp, Homo sapiens
aaatggcctcatgtggctgga

SEQ ID NO: 3690350 - DNA, 21 bp, Homo sapiens
aaatggctgtaatcatttgtt

SEQ ID NO: 3690351 - DNA, 16 bp, Homo sapiens
aaatggggccagatcc

SEQ ID NO: 3690352 - DNA, 22 bp, Homo sapiens
aaatgtaaaatcctacagtgaa

SEQ ID NO: 3690353 - DNA, 17 bp, Homo sapiens
aaatgtacagacatatt

SEQ ID NO: 3690354 - DNA, 16 bp, Homo sapiens
aaatgtattaatgtat

SEQ ID NO: 3690355 - DNA, 12 bp, Homo sapiens
aaatgtcttgct

SEQ ID NO: 3690356 - DNA, 23 bp, Homo sapiens
aaatgtcttgctgttgacatatt

SEQ ID NO: 3690357 - DNA, 12 bp, Homo sapiens
aaattaacactg

SEQ ID NO: 3690358 - DNA, 14 bp, Homo sapiens
aaattacaatttta

SEQ ID NO: 3690359 - DNA, 14 bp, Homo sapiens
aaattactgtgtta

SEQ ID NO: 3690360 - DNA, 20 bp, Homo sapiens
aaattagacaaatgctacat

SEQ ID NO: 3690361 - DNA, 13 bp, Homo sapiens
aaattatatattt

SEQ ID NO: 3690362 - DNA, 17 bp, Homo sapiens
aaattcccgtgttgctt

SEQ ID NO: 3690363 - DNA, 16 bp, Homo sapiens
aaattctcctggaggt

SEQ ID NO: 3690364 - DNA, 13 bp, Homo sapiens
aaattctgagtga

SEQ ID NO: 3690365 - DNA, 21 bp, Homo sapiens
aaattgtttcaaaataaaaac

SEQ ID NO: 3690366 - DNA, 18 bp, Homo sapiens
aaattttgtaatgaattc

SEQ ID NO: 3690367 - DNA, 17 bp, Homo sapiens
aacaaaactgcatttca

SEQ ID NO: 3690368 - DNA, 11 bp, Homo sapiens
aacaaaatttg

SEQ ID NO: 3690369 - DNA, 20 bp, Homo sapiens
aacaaaatttgactaatttt

SEQ ID NO: 3690370 - DNA, 11 bp, Homo sapiens
aacaaaccatc

SEQ ID NO: 3690371 - DNA, 17 bp, Homo sapiens
aacaaagccagaagctg

SEQ ID NO: 3690372 - DNA, 15 bp, Homo sapiens
aacaaattatttttg

SEQ ID NO: 3690373 - DNA, 16 bp, Homo sapiens
aacaataaaatttttt

SEQ ID NO: 3690374 - DNA, 15 bp, Homo sapiens
aacaatggagtattc

SEQ ID NO: 3690375 - DNA, 14 bp, Homo sapiens
aacacacacaaaag

SEQ ID NO: 3690376 - DNA, 19 bp, Homo sapiens
aacacactgaggcagggaa

SEQ ID NO: 3690377 - DNA, 20 bp, Homo sapiens
aacacactgaggcagggaag

SEQ ID NO: 3690378 - DNA, 18 bp, Homo sapiens
aacactagacaagccaga

SEQ ID NO: 3690379 - DNA, 19 bp, Homo sapiens
aacactagacaagccagaa

SEQ ID NO: 3690380 - DNA, 14 bp, Homo sapiens
aacactatagagaa

SEQ ID NO: 3690381 - DNA, 18 bp, Homo sapiens
aacactatatggcagtgt

SEQ ID NO: 3690382 - DNA, 23 bp, Homo sapiens
aacagaaaaatatgtaccaagaa

SEQ ID NO: 3690383 - DNA, 17 bp, Homo sapiens
aacagagtgaaaaatct

SEQ ID NO: 3690384 - DNA, 15 bp, Homo sapiens
aacagagttatagaa

SEQ ID NO: 3690385 - DNA, 22 bp, Homo sapiens
aacagatctggaacctcagcct

SEQ ID NO: 3690386 - DNA, 22 bp, Homo sapiens
aacagctctcttcaatgacata

SEQ ID NO: 3690387 - DNA, 18 bp, Homo sapiens
aacagctgtcacaacttg

SEQ ID NO: 3690388 - DNA, 21 bp, Homo sapiens
aacaggagctgggatcctaag

SEQ ID NO: 3690389 - DNA, 18 bp, Homo sapiens
aacagtagagaacagcaa

SEQ ID NO: 3690390 - DNA, 22 bp, Homo sapiens
aacagtggagctgaattttctg

SEQ ID NO: 3690391 - DNA, 20 bp, Homo sapiens
aacatgaaagtctagaaata

SEQ ID NO: 3690392 - DNA, 22 bp, Homo sapiens
aacatgcataagaaatgtagct

SEQ ID NO: 3690393 - DNA, 22 bp, Homo sapiens
aacatggtaaacgctgtcccta

SEQ ID NO: 3690394 - DNA, 18 bp, Homo sapiens
aacattattttttaatgt

SEQ ID NO: 3690395 - DNA, 21 bp, Homo sapiens
aacatttgtgtaatatgaaat

SEQ ID NO: 3690396 - DNA, 15 bp, Homo sapiens
aaccaaatctggaag

SEQ ID NO: 3690397 - DNA, 13 bp, Homo sapiens
aaccactctgtgg

SEQ ID NO: 3690398 - DNA, 15 bp, Homo sapiens
aaccactctgtggcc

SEQ ID NO: 3690399 - DNA, 20 bp, Homo sapiens
aaccactctgtggccagcct

SEQ ID NO: 3690400 - DNA, 21 bp, Homo sapiens
aaccactctgtggccagcctg

SEQ ID NO: 3690401 - DNA, 18 bp, Homo sapiens
aaccaggcacctcttcct

SEQ ID NO: 3690402 - DNA, 19 bp, Homo sapiens
aaccatcccctccgtggca

SEQ ID NO: 3690403 - DNA, 13 bp, Homo sapiens
aacccaggcagct

SEQ ID NO: 3690404 - DNA, 16 bp, Homo sapiens
aacccaggcagctggc

SEQ ID NO: 3690405 - DNA, 18 bp, Homo sapiens
aacccaggcagctggcag

SEQ ID NO: 3690406 - DNA, 19 bp, Homo sapiens
aacccaggcagctggcagg

SEQ ID NO: 3690407 - DNA, 19 bp, Homo sapiens
aacccccaccccacacttg

SEQ ID NO: 3690408 - DNA, 15 bp, Homo sapiens
aaccccccgactgtg

SEQ ID NO: 3690409 - DNA, 17 bp, Homo sapiens
aacccgtgcccctggga

SEQ ID NO: 3690410 - DNA, 18 bp, Homo sapiens
aacccgtgcccctgggat

SEQ ID NO: 3690411 - DNA, 22 bp, Homo sapiens
aacctcacgcacctcccatcct

SEQ ID NO: 3690412 - DNA, 11 bp, Homo sapiens
aacctcagcct

SEQ ID NO: 3690413 - DNA, 12 bp, Homo sapiens
aacctcagcctg

SEQ ID NO: 3690414 - DNA, 13 bp, Homo sapiens
aacctcagcctgg

SEQ ID NO: 3690415 - DNA, 14 bp, Homo sapiens
aacctcagcctggc

SEQ ID NO: 3690416 - DNA, 15 bp, Homo sapiens
aacctcctgctgtgc

SEQ ID NO: 3690417 - DNA, 19 bp, Homo sapiens
aacctcgcgcttgctggcc

SEQ ID NO: 3690418 - DNA, 14 bp, Homo sapiens
aacctgcaaaaaat

SEQ ID NO: 3690419 - DNA, 11 bp, Homo sapiens
aacctgcttgg

SEQ ID NO: 3690420 - DNA, 18 bp, Homo sapiens
aacctggaccccagcctt

SEQ ID NO: 3690421 - DNA, 21 bp, Homo sapiens
aacctggaccccagccttggt

SEQ ID NO: 3690422 - DNA, 15 bp, Homo sapiens
aacctggttcatatt

SEQ ID NO: 3690423 - DNA, 13 bp, Homo sapiens
aaccttctctatg

SEQ ID NO: 3690424 - DNA, 14 bp, Homo sapiens
aaccttgtataaat

SEQ ID NO: 3690425 - DNA, 16 bp, Homo sapiens
aggcggggctcctcct

SEQ ID NO: 3690426 - DNA, 19 bp, Homo sapiens
aggcggggctcctcctgaa

SEQ ID NO: 3690427 - DNA, 19 bp, Homo sapiens
aggctccaatggggcgggg

SEQ ID NO: 3690428 - DNA, 22 bp, Homo sapiens
aggctccttcctgtgggtgggg

SEQ ID NO: 3690429 - DNA, 23 bp, Homo sapiens
aggctcttctccttggaggacag

SEQ ID NO: 3690430 - DNA, 14 bp, Homo sapiens
aggctgaaaacaat

SEQ ID NO: 3690431 - DNA, 15 bp, Homo sapiens
aggctgaggaaaggc

SEQ ID NO: 3690432 - DNA, 13 bp, Homo sapiens
aggctgaggcctg

SEQ ID NO: 3690433 - DNA, 21 bp, Homo sapiens
aggctgatgtcaatttctgtg

SEQ ID NO: 3690434 - DNA, 17 bp, Homo sapiens
aggctgcagtgagccga

SEQ ID NO: 3690435 - DNA, 18 bp, Homo sapiens
aggctgcccagagctgct

SEQ ID NO: 3690436 - DNA, 20 bp, Homo sapiens
aggctgcccagagctgctgg

SEQ ID NO: 3690437 - DNA, 15 bp, Homo sapiens
aggctgctcagggct

SEQ ID NO: 3690438 - DNA, 13 bp, Homo sapiens
aggctgcttggga

SEQ ID NO: 3690439 - DNA, 15 bp, Homo sapiens
aggctggagagcact

SEQ ID NO: 3690440 - DNA, 13 bp, Homo sapiens
aggctggagccca

SEQ ID NO: 3690441 - DNA, 15 bp, Homo sapiens
aggctggcaggtatg

SEQ ID NO: 3690442 - DNA, 19 bp, Homo sapiens
aggctggccagtccaggct

SEQ ID NO: 3690443 - DNA, 16 bp, Homo sapiens
aggctggtggcccagg

SEQ ID NO: 3690444 - DNA, 15 bp, Homo sapiens
aggctgtcctgtaca

SEQ ID NO: 3690445 - DNA, 21 bp, Homo sapiens
aggctgtcctgtacattgtgg

SEQ ID NO: 3690446 - DNA, 18 bp, Homo sapiens
aggctgtgtttggctttc

SEQ ID NO: 3690447 - DNA, 14 bp, Homo sapiens
aggcttagtttgtg

SEQ ID NO: 3690448 - DNA, 15 bp, Homo sapiens
aggcttctacctgca

SEQ ID NO: 3690449 - DNA, 14 bp, Homo sapiens
aggcttgcccagga

SEQ ID NO: 3690450 - DNA, 14 bp, Homo sapiens
aggcttgttgtgct

SEQ ID NO: 3690451 - DNA, 15 bp, Homo sapiens
aggcttgttgtgctt

SEQ ID NO: 3690452 - DNA, 16 bp, Homo sapiens
aggcttgttgtgcttt

SEQ ID NO: 3690453 - DNA, 23 bp, Homo sapiens
agggaaagggtcctgctttctcc

SEQ ID NO: 3690454 - DNA, 13 bp, Homo sapiens
agggaagaaaaag

SEQ ID NO: 3690455 - DNA, 15 bp, Homo sapiens
agggaagaaaaagca

SEQ ID NO: 3690456 - DNA, 19 bp, Homo sapiens
agggaagaaaaagcaagtg

SEQ ID NO: 3690457 - DNA, 13 bp, Homo sapiens
agggaagctggcc

SEQ ID NO: 3690458 - DNA, 15 bp, Homo sapiens
agggaagtccccagg

SEQ ID NO: 3690459 - DNA, 15 bp, Homo sapiens
agggaatggcacagc

SEQ ID NO: 3690460 - DNA, 15 bp, Homo sapiens
agggaattcctgggg

SEQ ID NO: 3690461 - DNA, 21 bp, Homo sapiens
agggacacctgggagaaatct

SEQ ID NO: 3690462 - DNA, 16 bp, Homo sapiens
agggacagaggcccca

SEQ ID NO: 3690463 - DNA, 20 bp, Homo sapiens
agggacatttccaagctgtt

SEQ ID NO: 3690464 - DNA, 17 bp, Homo sapiens
agggaccaactgggccc

SEQ ID NO: 3690465 - DNA, 23 bp, Homo sapiens
agggacccctgcccttgtcccac

SEQ ID NO: 3690466 - DNA, 14 bp, Homo sapiens
agggacgctttgtc

SEQ ID NO: 3690467 - DNA, 19 bp, Homo sapiens
agggacggccaagaatgta

SEQ ID NO: 3690468 - DNA, 18 bp, Homo sapiens
agggacttcgcagaggca

SEQ ID NO: 3690469 - DNA, 16 bp, Homo sapiens
agggagccatgtttca

SEQ ID NO: 3690470 - DNA, 16 bp, Homo sapiens
agggagcgagggagaa

SEQ ID NO: 3690471 - DNA, 17 bp, Homo sapiens
agggagcggaaagcagc

SEQ ID NO: 3690472 - DNA, 16 bp, Homo sapiens
agggagctgggcccga

SEQ ID NO: 3690473 - DNA, 13 bp, Homo sapiens
agggaggcaagcc

SEQ ID NO: 3690474 - DNA, 15 bp, Homo sapiens
agggaggccccaggg

SEQ ID NO: 3690475 - DNA, 15 bp, Homo sapiens
agggagggcttctgc

SEQ ID NO: 3690476 - DNA, 17 bp, Homo sapiens
agggaggggccggccct

SEQ ID NO: 3690477 - DNA, 23 bp, Homo sapiens
agggaggggccggccctgtgtgc

SEQ ID NO: 3690478 - DNA, 12 bp, Homo sapiens
agggaggggcct

SEQ ID NO: 3690479 - DNA, 20 bp, Homo sapiens
agggatctgccattgggacc

SEQ ID NO: 3690480 - DNA, 19 bp, Homo sapiens
agggattaacctctgcact

SEQ ID NO: 3690481 - DNA, 15 bp, Homo sapiens
agggattcaggctgc

SEQ ID NO: 3690482 - DNA, 16 bp, Homo sapiens
agggattcaggctgct

SEQ ID NO: 3690483 - DNA, 16 bp, Homo sapiens
agggcacaccgccatc

SEQ ID NO: 3690484 - DNA, 15 bp, Homo sapiens
agggcagactggggc

SEQ ID NO: 3690485 - DNA, 21 bp, Homo sapiens
agggcaggaaggagagcctgc

SEQ ID NO: 3690486 - DNA, 23 bp, Homo sapiens
agggcaggaaggagagcctgctg

SEQ ID NO: 3690487 - DNA, 14 bp, Homo sapiens
agggccagagccag

SEQ ID NO: 3690488 - DNA, 19 bp, Homo sapiens
agggccagtcctgcctggc

SEQ ID NO: 3690489 - DNA, 20 bp, Homo sapiens
agggccatgctgaggcctgg

SEQ ID NO: 3690490 - DNA, 16 bp, Homo sapiens
agggccatggctcagg

SEQ ID NO: 3690491 - DNA, 15 bp, Homo sapiens
agggcccagagccca

SEQ ID NO: 3690492 - DNA, 16 bp, Homo sapiens
agggcccagagcccag

SEQ ID NO: 3690493 - DNA, 20 bp, Homo sapiens
agggcccagagcccagctcc

SEQ ID NO: 3690494 - DNA, 21 bp, Homo sapiens
agggcccagagcccagctcca

SEQ ID NO: 3690495 - DNA, 19 bp, Homo sapiens
agggcccctcaccctgcct

SEQ ID NO: 3690496 - DNA, 17 bp, Homo sapiens
agggcctcccagccccc

SEQ ID NO: 3690497 - DNA, 20 bp, Homo sapiens
agggcctcccagcccccaac

SEQ ID NO: 3690498 - DNA, 15 bp, Homo sapiens
agggccttttctggc

SEQ ID NO: 3690499 - DNA, 13 bp, Homo sapiens
agggcggcagggg

SEQ ID NO: 3690500 - DNA, 14 bp, Homo sapiens
agggcgtggctctg

SEQ ID NO: 3690501 - DNA, 19 bp, Homo sapiens
agggcgtggctctgggtgg

SEQ ID NO: 3690502 - DNA, 19 bp, Homo sapiens
agggctcctccctggagct

SEQ ID NO: 3690503 - DNA, 11 bp, Homo sapiens
agggctcctgc

SEQ ID NO: 3690504 - DNA, 16 bp, Homo sapiens
aggggaaaaaaatgtt

SEQ ID NO: 3690505 - DNA, 22 bp, Homo sapiens
aggggacaagggatttgaggtg

SEQ ID NO: 3690506 - DNA, 22 bp, Homo sapiens
aggggactcagccctgaggtga

SEQ ID NO: 3690507 - DNA, 14 bp, Homo sapiens
aggggagcatgctt

SEQ ID NO: 3690508 - DNA, 17 bp, Homo sapiens
aggggcatctgcccctc

SEQ ID NO: 3690509 - DNA, 13 bp, Homo sapiens
aggggcccggcca

SEQ ID NO: 3690510 - DNA, 16 bp, Homo sapiens
aggggccctacctggg

SEQ ID NO: 3690511 - DNA, 14 bp, Homo sapiens
aggggccggccctg

SEQ ID NO: 3690512 - DNA, 17 bp, Homo sapiens
aggggccggccctgtgt

SEQ ID NO: 3690513 - DNA, 19 bp, Homo sapiens
aggggcctaggcctcagcc

SEQ ID NO: 3690514 - DNA, 23 bp, Homo sapiens
aggggcctaggcctcagccagag

SEQ ID NO: 3690515 - DNA, 18 bp, Homo sapiens
aggggcctggagatcctc

SEQ ID NO: 3690516 - DNA, 16 bp, Homo sapiens
aggggcgtctgttccc

SEQ ID NO: 3690517 - DNA, 22 bp, Homo sapiens
aggggcgtctgttcccccttca

SEQ ID NO: 3690518 - DNA, 15 bp, Homo sapiens
aggggctgcttcctc

SEQ ID NO: 3690519 - DNA, 12 bp, Homo sapiens
aggggcttcagg

SEQ ID NO: 3690520 - DNA, 16 bp, Homo sapiens
aggggcttcaggtcca

SEQ ID NO: 3690521 - DNA, 21 bp, Homo sapiens
agggggtcagcccaagattct

SEQ ID NO: 3690522 - DNA, 19 bp, Homo sapiens
aggggtcccagccaccccg

SEQ ID NO: 3690523 - DNA, 21 bp, Homo sapiens
aggggtcggctgaccatgctc

SEQ ID NO: 3690524 - DNA, 21 bp, Homo sapiens
aggggttggtatctcaggtct

SEQ ID NO: 3690525 - DNA, 12 bp, Homo sapiens
agggtccctctg

SEQ ID NO: 3690526 - DNA, 14 bp, Homo sapiens
agggtcctgctttc

SEQ ID NO: 3690527 - DNA, 15 bp, Homo sapiens
agggtcctgctttct

SEQ ID NO: 3690528 - DNA, 14 bp, Homo sapiens
agggtcttcagggg

SEQ ID NO: 3690529 - DNA, 20 bp, Homo sapiens
agggtggctttgcatttctt

SEQ ID NO: 3690530 - DNA, 19 bp, Homo sapiens
agggtgggcttttccctgg

SEQ ID NO: 3690531 - DNA, 23 bp, Homo sapiens
agggtggtctcttcttggggccc

SEQ ID NO: 3690532 - DNA, 21 bp, Homo sapiens
agggttaggaatcctagcact

SEQ ID NO: 3690533 - DNA, 16 bp, Homo sapiens
agggttctaacctttc

SEQ ID NO: 3690534 - DNA, 13 bp, Homo sapiens
aggtaccctgggt

SEQ ID NO: 3690535 - DNA, 17 bp, Homo sapiens
aggtactcctgccaggg

SEQ ID NO: 3690536 - DNA, 23 bp, Homo sapiens
aggtatgaccttctaggaagctc

SEQ ID NO: 3690537 - DNA, 20 bp, Homo sapiens
aggtatggaagggtttgtgg

SEQ ID NO: 3690538 - DNA, 13 bp, Homo sapiens
aggtatgtctgtg

SEQ ID NO: 3690539 - DNA, 16 bp, Homo sapiens
aggtatgtctgtgcca

SEQ ID NO: 3690540 - DNA, 22 bp, Homo sapiens
aggtatgtctgtgccatttctc

SEQ ID NO: 3690541 - DNA, 15 bp, Homo sapiens
aggtattagcaaagc

SEQ ID NO: 3690542 - DNA, 21 bp, Homo sapiens
aggtcaatacagtacaggcag

SEQ ID NO: 3690543 - DNA, 21 bp, Homo sapiens
aggtccaaatgtttatgtttt

SEQ ID NO: 3690544 - DNA, 19 bp, Homo sapiens
aggaaggcttgttgtgctt

SEQ ID NO: 3690545 - DNA, 14 bp, Homo sapiens
aggaagggaagcgt

SEQ ID NO: 3690546 - DNA, 22 bp, Homo sapiens
aggaagggtggctttgcatttc

SEQ ID NO: 3690547 - DNA, 16 bp, Homo sapiens
aggaaggtggatggcc

SEQ ID NO: 3690548 - DNA, 16 bp, Homo sapiens
aggaatattttccaaa

SEQ ID NO: 3690549 - DNA, 20 bp, Homo sapiens
aggaatcccggctccagagc

SEQ ID NO: 3690550 - DNA, 21 bp, Homo sapiens
aggaatcctagcacttgtctc

SEQ ID NO: 3690551 - DNA, 23 bp, Homo sapiens
aggaatcggctggggactgctac

SEQ ID NO: 3690552 - DNA, 15 bp, Homo sapiens
aggaatgaagtaaag

SEQ ID NO: 3690553 - DNA, 14 bp, Homo sapiens
aggacaaaatgtta

SEQ ID NO: 3690554 - DNA, 16 bp, Homo sapiens
aggacaacgaggaagc

SEQ ID NO: 3690555 - DNA, 15 bp, Homo sapiens
aggacagtctggaga

SEQ ID NO: 3690556 - DNA, 12 bp, Homo sapiens
aggaccagctca

SEQ ID NO: 3690557 - DNA, 15 bp, Homo sapiens
aggaccagctcagga

SEQ ID NO: 3690558 - DNA, 16 bp, Homo sapiens
aggaccaggactccct

SEQ ID NO: 3690559 - DNA, 17 bp, Homo sapiens
aggaccaggactccctc

SEQ ID NO: 3690560 - DNA, 13 bp, Homo sapiens
aggaccagggcct

SEQ ID NO: 3690561 - DNA, 19 bp, Homo sapiens
aggaccctgaaggggccat

SEQ ID NO: 3690562 - DNA, 12 bp, Homo sapiens
aggacccttccc

SEQ ID NO: 3690563 - DNA, 20 bp, Homo sapiens
aggacccttcccttgagccc

SEQ ID NO: 3690564 - DNA, 20 bp, Homo sapiens
aggacctcaggtgagaagca

SEQ ID NO: 3690565 - DNA, 12 bp, Homo sapiens
aggactccctcc

SEQ ID NO: 3690566 - DNA, 13 bp, Homo sapiens
aggactccctcct

SEQ ID NO: 3690567 - DNA, 15 bp, Homo sapiens
aggactccctcctca

SEQ ID NO: 3690568 - DNA, 16 bp, Homo sapiens
aggacttgttaaagag

SEQ ID NO: 3690569 - DNA, 21 bp, Homo sapiens
aggacttgttaaagagcactg

SEQ ID NO: 3690570 - DNA, 15 bp, Homo sapiens
aggagaaccactaca

SEQ ID NO: 3690571 - DNA, 11 bp, Homo sapiens
aggagaagcca

SEQ ID NO: 3690572 - DNA, 12 bp, Homo sapiens
aggagaagccag

SEQ ID NO: 3690573 - DNA, 15 bp, Homo sapiens
aggagaagccaggaa

SEQ ID NO: 3690574 - DNA, 17 bp, Homo sapiens
aggagagaaaatatatg

SEQ ID NO: 3690575 - DNA, 19 bp, Homo sapiens
aggagagatagaagcctct

SEQ ID NO: 3690576 - DNA, 12 bp, Homo sapiens
aggagagcctgc

SEQ ID NO: 3690577 - DNA, 18 bp, Homo sapiens
aggagagcctgctgcatg

SEQ ID NO: 3690578 - DNA, 18 bp, Homo sapiens
aggagcaagtgaggccgg

SEQ ID NO: 3690579 - DNA, 16 bp, Homo sapiens
aggagcaccctgtctt

SEQ ID NO: 3690580 - DNA, 17 bp, Homo sapiens
aggagctcttcaggcct

SEQ ID NO: 3690581 - DNA, 11 bp, Homo sapiens
aggagctgcta

SEQ ID NO: 3690582 - DNA, 12 bp, Homo sapiens
aggagctgctgg

SEQ ID NO: 3690583 - DNA, 12 bp, Homo sapiens
aggagctgggga

SEQ ID NO: 3690584 - DNA, 20 bp, Homo sapiens
aggagctggggatccctccc

SEQ ID NO: 3690585 - DNA, 20 bp, Homo sapiens
aggaggcagaggttgcagtg

SEQ ID NO: 3690586 - DNA, 22 bp, Homo sapiens
aggaggcaggcatggccctggg

SEQ ID NO: 3690587 - DNA, 12 bp, Homo sapiens
aggagtggggtg

SEQ ID NO: 3690588 - DNA, 15 bp, Homo sapiens
aggatagatgctggc

SEQ ID NO: 3690589 - DNA, 17 bp, Homo sapiens
aggatagctaactgtaa

SEQ ID NO: 3690590 - DNA, 22 bp, Homo sapiens
aggatcagttttttgttttaca

SEQ ID NO: 3690591 - DNA, 17 bp, Homo sapiens
aggatctcttgagcctg

SEQ ID NO: 3690592 - DNA, 19 bp, Homo sapiens
aggatctcttgagcctggg

SEQ ID NO: 3690593 - DNA, 13 bp, Homo sapiens
aggatctttgtgg

SEQ ID NO: 3690594 - DNA, 18 bp, Homo sapiens
aggatgataagttccttt

SEQ ID NO: 3690595 - DNA, 13 bp, Homo sapiens
aggatggggaggg

SEQ ID NO: 3690596 - DNA, 19 bp, Homo sapiens
aggatggggaggggctctg

SEQ ID NO: 3690597 - DNA, 22 bp, Homo sapiens
aggatggggaggggctctgcgt

SEQ ID NO: 3690598 - DNA, 13 bp, Homo sapiens
aggatggggcacg

SEQ ID NO: 3690599 - DNA, 22 bp, Homo sapiens
aggatggggcacggctctgggg

SEQ ID NO: 3690600 - DNA, 20 bp, Homo sapiens
aggatgtaggggttaacttg

SEQ ID NO: 3690601 - DNA, 19 bp, Homo sapiens
aggatgtcactcagatgga

SEQ ID NO: 3690602 - DNA, 18 bp, Homo sapiens
aggatgtgtttgctttct

SEQ ID NO: 3690603 - DNA, 12 bp, Homo sapiens
aggatttttaga

SEQ ID NO: 3690604 - DNA, 12 bp, Homo sapiens
aggcaagccctg

SEQ ID NO: 3690605 - DNA, 17 bp, Homo sapiens
aggcaagcgaccgaggc

SEQ ID NO: 3690606 - DNA, 20 bp, Homo sapiens
aggcaagcgaccgaggccct

SEQ ID NO: 3690607 - DNA, 21 bp, Homo sapiens
aggcaagcgaccgaggccctc

SEQ ID NO: 3690608 - DNA, 23 bp, Homo sapiens
aggcaagcgaccgaggccctccc

SEQ ID NO: 3690609 - DNA, 14 bp, Homo sapiens
aggcacctcttcct

SEQ ID NO: 3690610 - DNA, 21 bp, Homo sapiens
aggcagactctttatgcttgc

SEQ ID NO: 3690611 - DNA, 22 bp, Homo sapiens
aggcagactctttatgcttgca

SEQ ID NO: 3690612 - DNA, 15 bp, Homo sapiens
aggcagatctgtgcc

SEQ ID NO: 3690613 - DNA, 21 bp, Homo sapiens
aggcagatctgtgccccatgc

SEQ ID NO: 3690614 - DNA, 13 bp, Homo sapiens
aggcagctggcag

SEQ ID NO: 3690615 - DNA, 23 bp, Homo sapiens
aggcagctgtgtctgagcccaac

SEQ ID NO: 3690616 - DNA, 17 bp, Homo sapiens
aggcaggaagggaagcg

SEQ ID NO: 3690617 - DNA, 12 bp, Homo sapiens
aggcaggatggc

SEQ ID NO: 3690618 - DNA, 15 bp, Homo sapiens
aggcaggcatggccc

SEQ ID NO: 3690619 - DNA, 19 bp, Homo sapiens
aggcaggcatggccctggg

SEQ ID NO: 3690620 - DNA, 13 bp, Homo sapiens
aggcagggaagtc

SEQ ID NO: 3690621 - DNA, 19 bp, Homo sapiens
aggcagggaagtccccagg

SEQ ID NO: 3690622 - DNA, 11 bp, Homo sapiens
aggcagggctc

SEQ ID NO: 3690623 - DNA, 24 bp, Homo sapiens
aggcagggctcctccctggagcta

SEQ ID NO: 3690624 - DNA, 18 bp, Homo sapiens
aggcagttgtcctgacct

SEQ ID NO: 3690625 - DNA, 14 bp, Homo sapiens
aggcataggtctct

SEQ ID NO: 3690626 - DNA, 19 bp, Homo sapiens
aggcatgggtgcaaggaaa

SEQ ID NO: 3690627 - DNA, 16 bp, Homo sapiens
aggccaaaggctggtg

SEQ ID NO: 3690628 - DNA, 17 bp, Homo sapiens
aggccaaaggctggtgg

SEQ ID NO: 3690629 - DNA, 14 bp, Homo sapiens
aggccacctcccca

SEQ ID NO: 3690630 - DNA, 15 bp, Homo sapiens
aggccacctccccag

SEQ ID NO: 3690631 - DNA, 21 bp, Homo sapiens
aggccagccccacccaggagg

SEQ ID NO: 3690632 - DNA, 15 bp, Homo sapiens
aggccagctggcagc

SEQ ID NO: 3690633 - DNA, 23 bp, Homo sapiens
aggcccatcccccacctgccagc

SEQ ID NO: 3690634 - DNA, 14 bp, Homo sapiens
aggccccagcctcc

SEQ ID NO: 3690635 - DNA, 12 bp, Homo sapiens
aggccccaggaa

SEQ ID NO: 3690636 - DNA, 13 bp, Homo sapiens
aggcccccacttg

SEQ ID NO: 3690637 - DNA, 18 bp, Homo sapiens
aggcccccacttgcctct

SEQ ID NO: 3690638 - DNA, 19 bp, Homo sapiens
aggcccccagcccagggct

SEQ ID NO: 3690639 - DNA, 14 bp, Homo sapiens
aggcccctcccagt

SEQ ID NO: 3690640 - DNA, 20 bp, Homo sapiens
aggccccttccacgggggct

SEQ ID NO: 3690641 - DNA, 15 bp, Homo sapiens
aggccctcccaaaga

SEQ ID NO: 3690642 - DNA, 20 bp, Homo sapiens
aggccctccctgttccccag

SEQ ID NO: 3690643 - DNA, 23 bp, Homo sapiens
aggccctccctgttccccagaga

SEQ ID NO: 3690644 - DNA, 21 bp, Homo sapiens
aggccctcctctcccatcctt

SEQ ID NO: 3690645 - DNA, 20 bp, Homo sapiens
aggccctctggagtggccac

SEQ ID NO: 3690646 - DNA, 21 bp, Homo sapiens
aggccctctggagtggccact

SEQ ID NO: 3690647 - DNA, 22 bp, Homo sapiens
aggccctctggagtggccacta

SEQ ID NO: 3690648 - DNA, 14 bp, Homo sapiens
aggccctggcctcc

SEQ ID NO: 3690649 - DNA, 15 bp, Homo sapiens
aggccctggcctccc

SEQ ID NO: 3690650 - DNA, 13 bp, Homo sapiens
aggccctgtgccc

SEQ ID NO: 3690651 - DNA, 15 bp, Homo sapiens
aggccgagaagcaag

SEQ ID NO: 3690652 - DNA, 20 bp, Homo sapiens
aggccgaggccatgtgcata

SEQ ID NO: 3690653 - DNA, 16 bp, Homo sapiens
aggcctaccccgcaga

SEQ ID NO: 3690654 - DNA, 22 bp, Homo sapiens
aggcctaccccgcagacacctt

SEQ ID NO: 3690655 - DNA, 13 bp, Homo sapiens
aggcctcagccag

SEQ ID NO: 3690656 - DNA, 15 bp, Homo sapiens
aggcctcagccagag

SEQ ID NO: 3690657 - DNA, 23 bp, Homo sapiens
aggcctgaaagaggctgaggcct

SEQ ID NO: 3690658 - DNA, 19 bp, Homo sapiens
aggcctgggccgctgccac

SEQ ID NO: 3690659 - DNA, 13 bp, Homo sapiens
aggcggagctcca

SEQ ID NO: 3690660 - DNA, 20 bp, Homo sapiens
aggcgggaggaggtgtgagg

SEQ ID NO: 3690661 - DNA, 18 bp, Homo sapiens
aggcggggcgccccaaga

SEQ ID NO: 3690662 - DNA, 20 bp, Homo sapiens
aggcggggcgccccaagagc

SEQ ID NO: 3690663 - DNA, 19 bp, Homo sapiens
agcggatgctccatttcaa

SEQ ID NO: 3690664 - DNA, 14 bp, Homo sapiens
agcggtttcctggt

SEQ ID NO: 3690665 - DNA, 19 bp, Homo sapiens
agcgtatatacttaagaat

SEQ ID NO: 3690666 - DNA, 23 bp, Homo sapiens
agcgtgaaggccgagaagcaaga

SEQ ID NO: 3690667 - DNA, 20 bp, Homo sapiens
agcgtgccgagccagcaaga

SEQ ID NO: 3690668 - DNA, 13 bp, Homo sapiens
agctaacagtgaa

SEQ ID NO: 3690669 - DNA, 17 bp, Homo sapiens
agctaacagtgaagatt

SEQ ID NO: 3690670 - DNA, 15 bp, Homo sapiens
agctaactgtaaatc

SEQ ID NO: 3690671 - DNA, 16 bp, Homo sapiens
agctaagaacctggaa

SEQ ID NO: 3690672 - DNA, 22 bp, Homo sapiens
agctacaggaagcaccccatgc

SEQ ID NO: 3690673 - DNA, 14 bp, Homo sapiens
agctacttggtttg

SEQ ID NO: 3690674 - DNA, 16 bp, Homo sapiens
agctacttggtttgtg

SEQ ID NO: 3690675 - DNA, 12 bp, Homo sapiens
agctagaggaac

SEQ ID NO: 3690676 - DNA, 20 bp, Homo sapiens
agctagaggaaccaaccccc

SEQ ID NO: 3690677 - DNA, 20 bp, Homo sapiens
agctaggatggttctgtgac

SEQ ID NO: 3690678 - DNA, 15 bp, Homo sapiens
agctagtgtctcctc

SEQ ID NO: 3690679 - DNA, 18 bp, Homo sapiens
agctagtgtctcctctct

SEQ ID NO: 3690680 - DNA, 22 bp, Homo sapiens
agctatgggagccccagggtct

SEQ ID NO: 3690681 - DNA, 15 bp, Homo sapiens
agctatttatgggcc

SEQ ID NO: 3690682 - DNA, 22 bp, Homo sapiens
agctatttttatttgtttgtgc

SEQ ID NO: 3690683 - DNA, 18 bp, Homo sapiens
agctcacagtgctgtgtg

SEQ ID NO: 3690684 - DNA, 21 bp, Homo sapiens
agctcactgtgacctccgcct

SEQ ID NO: 3690685 - DNA, 18 bp, Homo sapiens
agctccaacctgcaaaga

SEQ ID NO: 3690686 - DNA, 15 bp, Homo sapiens
agctccaagccccat

SEQ ID NO: 3690687 - DNA, 18 bp, Homo sapiens
agctccactctgcttctc

SEQ ID NO: 3690688 - DNA, 19 bp, Homo sapiens
agctccactctgcttctct

SEQ ID NO: 3690689 - DNA, 13 bp, Homo sapiens
agctccagttcga

SEQ ID NO: 3690690 - DNA, 13 bp, Homo sapiens
agctccattttct

SEQ ID NO: 3690691 - DNA, 14 bp, Homo sapiens
agctcctcctccct

SEQ ID NO: 3690692 - DNA, 15 bp, Homo sapiens
agctcctcctccctg

SEQ ID NO: 3690693 - DNA, 17 bp, Homo sapiens
agctcctcctccctgca

SEQ ID NO: 3690694 - DNA, 21 bp, Homo sapiens
agctcctcctccctgcatctg

SEQ ID NO: 3690695 - DNA, 17 bp, Homo sapiens
agctcctctccccagcc

SEQ ID NO: 3690696 - DNA, 21 bp, Homo sapiens
agctcctctccccagcccaga

SEQ ID NO: 3690697 - DNA, 12 bp, Homo sapiens
agctcctgtggc

SEQ ID NO: 3690698 - DNA, 15 bp, Homo sapiens
agctcctgtggcccc

SEQ ID NO: 3690699 - DNA, 19 bp, Homo sapiens
agctcctgtggccccaccc

SEQ ID NO: 3690700 - DNA, 19 bp, Homo sapiens
agctccttgggaggcccca

SEQ ID NO: 3690701 - DNA, 22 bp, Homo sapiens
agctccttgggaggccccactg

SEQ ID NO: 3690702 - DNA, 18 bp, Homo sapiens
agctctcaaatgtgtgtt

SEQ ID NO: 3690703 - DNA, 17 bp, Homo sapiens
agctctcctgactttta

SEQ ID NO: 3690704 - DNA, 16 bp, Homo sapiens
agctctggaggggagg

SEQ ID NO: 3690705 - DNA, 18 bp, Homo sapiens
agctctggaggggagggg

SEQ ID NO: 3690706 - DNA, 19 bp, Homo sapiens
agctctggaggggaggggg

SEQ ID NO: 3690707 - DNA, 16 bp, Homo sapiens
agctctgtatggtcag

SEQ ID NO: 3690708 - DNA, 19 bp, Homo sapiens
agctctgtatggtcaggat

SEQ ID NO: 3690709 - DNA, 17 bp, Homo sapiens
agctcttcaggcctccc

SEQ ID NO: 3690710 - DNA, 15 bp, Homo sapiens
agctgacttttctgt

SEQ ID NO: 3690711 - DNA, 16 bp, Homo sapiens
agctgagcctgcaggg

SEQ ID NO: 3690712 - DNA, 21 bp, Homo sapiens
agctgagcctgcagggaagcc

SEQ ID NO: 3690713 - DNA, 20 bp, Homo sapiens
agctgagtctccctaaggca

SEQ ID NO: 3690714 - DNA, 18 bp, Homo sapiens
agctgcaccctcaggcag

SEQ ID NO: 3690715 - DNA, 20 bp, Homo sapiens
agctgcactgatgctgcccc

SEQ ID NO: 3690716 - DNA, 14 bp, Homo sapiens
agctgcatctgtct

SEQ ID NO: 3690717 - DNA, 18 bp, Homo sapiens
agctgcatctgtctgaat

SEQ ID NO: 3690718 - DNA, 19 bp, Homo sapiens
agctgccatcgctgtgatg

SEQ ID NO: 3690719 - DNA, 13 bp, Homo sapiens
agctgcccagccc

SEQ ID NO: 3690720 - DNA, 15 bp, Homo sapiens
agctgcccagcccct

SEQ ID NO: 3690721 - DNA, 18 bp, Homo sapiens
agctgcccagcccctcct

SEQ ID NO: 3690722 - DNA, 20 bp, Homo sapiens
agctgcccagcccctcctcc

SEQ ID NO: 3690723 - DNA, 21 bp, Homo sapiens
agctgcccagcccctcctccc

SEQ ID NO: 3690724 - DNA, 15 bp, Homo sapiens
agctgcccctgctgc

SEQ ID NO: 3690725 - DNA, 18 bp, Homo sapiens
agctgcccctgctgctta

SEQ ID NO: 3690726 - DNA, 13 bp, Homo sapiens
agctgcctcactt

SEQ ID NO: 3690727 - DNA, 13 bp, Homo sapiens
agctgcctccagc

SEQ ID NO: 3690728 - DNA, 16 bp, Homo sapiens
agctgcctccagcctg

SEQ ID NO: 3690729 - DNA, 15 bp, Homo sapiens
agctgcgcccccttc

SEQ ID NO: 3690730 - DNA, 18 bp, Homo sapiens
agctgctcctagagggag

SEQ ID NO: 3690731 - DNA, 20 bp, Homo sapiens
agctgctcctagagggaggg

SEQ ID NO: 3690732 - DNA, 17 bp, Homo sapiens
agctgctggcttgcagt

SEQ ID NO: 3690733 - DNA, 21 bp, Homo sapiens
agctggccgagggtcctggct

SEQ ID NO: 3690734 - DNA, 13 bp, Homo sapiens
agctggctctgag

SEQ ID NO: 3690735 - DNA, 14 bp, Homo sapiens
agctggctctgagc

SEQ ID NO: 3690736 - DNA, 21 bp, Homo sapiens
agctggctgactaagccccgt

SEQ ID NO: 3690737 - DNA, 15 bp, Homo sapiens
agctgggccgggacc

SEQ ID NO: 3690738 - DNA, 14 bp, Homo sapiens
agctgggttggaaa

SEQ ID NO: 3690739 - DNA, 16 bp, Homo sapiens
agctgggttggaaaac

SEQ ID NO: 3690740 - DNA, 16 bp, Homo sapiens
agctggttgaggtttc

SEQ ID NO: 3690741 - DNA, 23 bp, Homo sapiens
agctgtcttggaagtctgtctca

SEQ ID NO: 3690742 - DNA, 23 bp, Homo sapiens
agctgtgctgggaagcccggact

SEQ ID NO: 3690743 - DNA, 18 bp, Homo sapiens
agctgtgtctgagcccaa

SEQ ID NO: 3690744 - DNA, 14 bp, Homo sapiens
agctgttagttgct

SEQ ID NO: 3690745 - DNA, 19 bp, Homo sapiens
agctgttcctgttcagtaa

SEQ ID NO: 3690746 - DNA, 17 bp, Homo sapiens
agctgtttatggcctca

SEQ ID NO: 3690747 - DNA, 22 bp, Homo sapiens
agcttagtgagcagtgagcact

SEQ ID NO: 3690748 - DNA, 14 bp, Homo sapiens
agcttatctcaggg

SEQ ID NO: 3690749 - DNA, 19 bp, Homo sapiens
agcttatttcaaaaggaag

SEQ ID NO: 3690750 - DNA, 15 bp, Homo sapiens
agcttcagccaggag

SEQ ID NO: 3690751 - DNA, 17 bp, Homo sapiens
agcttcagccaggagct

SEQ ID NO: 3690752 - DNA, 19 bp, Homo sapiens
agcttcagccaggagctgg

SEQ ID NO: 3690753 - DNA, 20 bp, Homo sapiens
agcttcagccaggagctggg

SEQ ID NO: 3690754 - DNA, 16 bp, Homo sapiens
agcttcattctccttg

SEQ ID NO: 3690755 - DNA, 21 bp, Homo sapiens
agcttcattctccttgttgtt

SEQ ID NO: 3690756 - DNA, 19 bp, Homo sapiens
agcttctcctgaccagggc

SEQ ID NO: 3690757 - DNA, 20 bp, Homo sapiens
agcttgacctgaggctgtgg

SEQ ID NO: 3690758 - DNA, 18 bp, Homo sapiens
agcttgataaagggccaa

SEQ ID NO: 3690759 - DNA, 23 bp, Homo sapiens
agcttggaaactggatgaggtca

SEQ ID NO: 3690760 - DNA, 20 bp, Homo sapiens
agcttgggaaaggtggtgtt

SEQ ID NO: 3690761 - DNA, 23 bp, Homo sapiens
agcttgtccaacccgaggcccgc

SEQ ID NO: 3690762 - DNA, 14 bp, Homo sapiens
agctttcctggtcc

SEQ ID NO: 3690763 - DNA, 12 bp, Homo sapiens
agctttctgtat

SEQ ID NO: 3690764 - DNA, 18 bp, Homo sapiens
agctttgaaaattcagtg

SEQ ID NO: 3690765 - DNA, 19 bp, Homo sapiens
agctttgaaaattcagtgg

SEQ ID NO: 3690766 - DNA, 21 bp, Homo sapiens
agctttgtttgttgtcagctg

SEQ ID NO: 3690767 - DNA, 13 bp, Homo sapiens
aggaaaggccagc

SEQ ID NO: 3690768 - DNA, 14 bp, Homo sapiens
aggaaaggccagct

SEQ ID NO: 3690769 - DNA, 16 bp, Homo sapiens
aggaaaggccagctgg

SEQ ID NO: 3690770 - DNA, 17 bp, Homo sapiens
aggaaaggccagctggc

SEQ ID NO: 3690771 - DNA, 18 bp, Homo sapiens
aggaaaggccagctggca

SEQ ID NO: 3690772 - DNA, 21 bp, Homo sapiens
aggaaatcaacttgcttatca

SEQ ID NO: 3690773 - DNA, 15 bp, Homo sapiens
aggaacggcttcctc

SEQ ID NO: 3690774 - DNA, 16 bp, Homo sapiens
aggaagaacgtttttt

SEQ ID NO: 3690775 - DNA, 14 bp, Homo sapiens
aggaagagggacag

SEQ ID NO: 3690776 - DNA, 16 bp, Homo sapiens
aggaagccacagctgg

SEQ ID NO: 3690777 - DNA, 21 bp, Homo sapiens
aggaagccgtgccctgccccc

SEQ ID NO: 3690778 - DNA, 14 bp, Homo sapiens
aggaagctcagact

SEQ ID NO: 3690779 - DNA, 16 bp, Homo sapiens
aggaagctcagactgg

SEQ ID NO: 3690780 - DNA, 15 bp, Homo sapiens
aggaaggagagcctg

SEQ ID NO: 3690781 - DNA, 14 bp, Homo sapiens
agaaagatgtatat

SEQ ID NO: 3690782 - DNA, 15 bp, Homo sapiens
agaaagccttctttt

SEQ ID NO: 3690783 - DNA, 14 bp, Homo sapiens
agaaagctgacatt

SEQ ID NO: 3690784 - DNA, 14 bp, Homo sapiens
agaaatcaggcctg

SEQ ID NO: 3690785 - DNA, 18 bp, Homo sapiens
agaaatgaaataaaatgg

SEQ ID NO: 3690786 - DNA, 14 bp, Homo sapiens
agaaatgccaagca

SEQ ID NO: 3690787 - DNA, 16 bp, Homo sapiens
agaaatggaaattttg

SEQ ID NO: 3690788 - DNA, 19 bp, Homo sapiens
agaaatgtagctgaagtag

SEQ ID NO: 3690789 - DNA, 13 bp, Homo sapiens
agaaattttcaag

SEQ ID NO: 3690790 - DNA, 19 bp, Homo sapiens
agaacatccctgccagctc

SEQ ID NO: 3690791 - DNA, 16 bp, Homo sapiens
agaaccaaatctggaa

SEQ ID NO: 3690792 - DNA, 17 bp, Homo sapiens
agaaccaggcaacttgg

SEQ ID NO: 3690793 - DNA, 20 bp, Homo sapiens
agaaccaggcaacttgggaa

SEQ ID NO: 3690794 - DNA, 13 bp, Homo sapiens
agaacctcttccc

SEQ ID NO: 3690795 - DNA, 14 bp, Homo sapiens
agaaccttctctat

SEQ ID NO: 3690796 - DNA, 18 bp, Homo sapiens
agaaccttctctatgggg

SEQ ID NO: 3690797 - DNA, 17 bp, Homo sapiens
agaactgaattttggga

SEQ ID NO: 3690798 - DNA, 15 bp, Homo sapiens
agaactgcaggccct

SEQ ID NO: 3690799 - DNA, 11 bp, Homo sapiens
agaagaaagca

SEQ ID NO: 3690800 - DNA, 22 bp, Homo sapiens
agaagaaagcaaaagcaaggga

SEQ ID NO: 3690801 - DNA, 23 bp, Homo sapiens
agaagaaagcaaaagcaagggac

SEQ ID NO: 3690802 - DNA, 12 bp, Homo sapiens
agaagaagaaat

SEQ ID NO: 3690803 - DNA, 22 bp, Homo sapiens
agaagaagcggccaggcggggc

SEQ ID NO: 3690804 - DNA, 12 bp, Homo sapiens
agaagaaggaga

SEQ ID NO: 3690805 - DNA, 19 bp, Homo sapiens
agaagaaggagagcaagaa

SEQ ID NO: 3690806 - DNA, 23 bp, Homo sapiens
agaagacacaaggtgatttcaga

SEQ ID NO: 3690807 - DNA, 20 bp, Homo sapiens
agaagaggttgggcttccat

SEQ ID NO: 3690808 - DNA, 16 bp, Homo sapiens
agaagcagaggaagga

SEQ ID NO: 3690809 - DNA, 17 bp, Homo sapiens
agaagccaaaagattgg

SEQ ID NO: 3690810 - DNA, 20 bp, Homo sapiens
agaagcccgtgtgagaagtg

SEQ ID NO: 3690811 - DNA, 21 bp, Homo sapiens
agaagcctctcgtcccgtccc

SEQ ID NO: 3690812 - DNA, 13 bp, Homo sapiens
agaagcctctggc

SEQ ID NO: 3690813 - DNA, 16 bp, Homo sapiens
agaagcggctggcagc

SEQ ID NO: 3690814 - DNA, 23 bp, Homo sapiens
agaagctccctgaagtaagcaaa

SEQ ID NO: 3690815 - DNA, 14 bp, Homo sapiens
agaagctcctctcc

SEQ ID NO: 3690816 - DNA, 22 bp, Homo sapiens
agaagctcctctccccagccca

SEQ ID NO: 3690817 - DNA, 13 bp, Homo sapiens
agaaggccaagag

SEQ ID NO: 3690818 - DNA, 21 bp, Homo sapiens
agaaggtattagcaaagcaaa

SEQ ID NO: 3690819 - DNA, 14 bp, Homo sapiens
agaagtaacttact

SEQ ID NO: 3690820 - DNA, 17 bp, Homo sapiens
agaagtgaatgctggga

SEQ ID NO: 3690821 - DNA, 21 bp, Homo sapiens
agaagtttgcactatctttca

SEQ ID NO: 3690822 - DNA, 17 bp, Homo sapiens
agaatacgcagaactac

SEQ ID NO: 3690823 - DNA, 18 bp, Homo sapiens
agaatcggctttgcagtg

SEQ ID NO: 3690824 - DNA, 21 bp, Homo sapiens
agaatgtacgtccagcctgcc

SEQ ID NO: 3690825 - DNA, 21 bp, Homo sapiens
agaatgtgtttaaacttggtt

SEQ ID NO: 3690826 - DNA, 13 bp, Homo sapiens
agaattactgtaa

SEQ ID NO: 3690827 - DNA, 14 bp, Homo sapiens
agaattactgtaac

SEQ ID NO: 3690828 - DNA, 20 bp, Homo sapiens
agaattagatttctatagga

SEQ ID NO: 3690829 - DNA, 21 bp, Homo sapiens
agaatttatcacacttctgtg

SEQ ID NO: 3690830 - DNA, 15 bp, Homo sapiens
agaattttgagcagg

SEQ ID NO: 3690831 - DNA, 14 bp, Homo sapiens
agacaaaaagacaa

SEQ ID NO: 3690832 - DNA, 18 bp, Homo sapiens
agacaaaaagacaaacat

SEQ ID NO: 3690833 - DNA, 15 bp, Homo sapiens
agacaacaggcattt

SEQ ID NO: 3690834 - DNA, 15 bp, Homo sapiens
agacaagccagaact

SEQ ID NO: 3690835 - DNA, 20 bp, Homo sapiens
agacaatgtgaaaagaaaaa

SEQ ID NO: 3690836 - DNA, 16 bp, Homo sapiens
agacaattgacaacag

SEQ ID NO: 3690837 - DNA, 13 bp, Homo sapiens
agacacaggccct

SEQ ID NO: 3690838 - DNA, 14 bp, Homo sapiens
agacacccaggact

SEQ ID NO: 3690839 - DNA, 22 bp, Homo sapiens
agacaccttggacatcctcctc

SEQ ID NO: 3690840 - DNA, 19 bp, Homo sapiens
agacactgaccatccactc

SEQ ID NO: 3690841 - DNA, 23 bp, Homo sapiens
agacacttgctgagtgaaggaaa

SEQ ID NO: 3690842 - DNA, 22 bp, Homo sapiens
agacagagaaaacttgcctttc

SEQ ID NO: 3690843 - DNA, 16 bp, Homo sapiens
agacagatgccccaga

SEQ ID NO: 3690844 - DNA, 20 bp, Homo sapiens
agacagcaaggtgtggaggc

SEQ ID NO: 3690845 - DNA, 24 bp, Homo sapiens
agacagcaaggtgtggaggctcct

SEQ ID NO: 3690846 - DNA, 16 bp, Homo sapiens
agacatacttgaaggg

SEQ ID NO: 3690847 - DNA, 23 bp, Homo sapiens
agacatacttgaagggccagagc

SEQ ID NO: 3690848 - DNA, 19 bp, Homo sapiens
agacattctgccaggcccc

SEQ ID NO: 3690849 - DNA, 10 bp, Homo sapiens
agacatttct

SEQ ID NO: 3690850 - DNA, 21 bp, Homo sapiens
agaccaagcttagtcctggga

SEQ ID NO: 3690851 - DNA, 13 bp, Homo sapiens
agaccaagcttgt

SEQ ID NO: 3690852 - DNA, 23 bp, Homo sapiens
agaccacgcccgtcctgcctgtg

SEQ ID NO: 3690853 - DNA, 15 bp, Homo sapiens
agaccaggctgtgtc

SEQ ID NO: 3690854 - DNA, 19 bp, Homo sapiens
agacccccggaacaagcct

SEQ ID NO: 3690855 - DNA, 15 bp, Homo sapiens
agacccgaggaaact

SEQ ID NO: 3690856 - DNA, 22 bp, Homo sapiens
agacctccacttgcttaagtat

SEQ ID NO: 3690857 - DNA, 18 bp, Homo sapiens
agacctgatcctggaggc

SEQ ID NO: 3690858 - DNA, 21 bp, Homo sapiens
agacctgatcctggaggccca

SEQ ID NO: 3690859 - DNA, 14 bp, Homo sapiens
agacctggcagctc

SEQ ID NO: 3690860 - DNA, 15 bp, Homo sapiens
agacctggcagctct

SEQ ID NO: 3690861 - DNA, 16 bp, Homo sapiens
agacctggcagctctg

SEQ ID NO: 3690862 - DNA, 18 bp, Homo sapiens
agacctggcagctctgga

SEQ ID NO: 3690863 - DNA, 18 bp, Homo sapiens
agaccttgttacttctga

SEQ ID NO: 3690864 - DNA, 21 bp, Homo sapiens
agaccttgttacttctgaggt

SEQ ID NO: 3690865 - DNA, 19 bp, Homo sapiens
agacggtttccagggaggg

SEQ ID NO: 3690866 - DNA, 20 bp, Homo sapiens
agactaacaaaggcagctgt

SEQ ID NO: 3690867 - DNA, 23 bp, Homo sapiens
agactaacaaaggcagctgtgtc

SEQ ID NO: 3690868 - DNA, 16 bp, Homo sapiens
agactagattgccttt

SEQ ID NO: 3690869 - DNA, 19 bp, Homo sapiens
agactagattgcctttgtt

SEQ ID NO: 3690870 - DNA, 22 bp, Homo sapiens
agactagtttttattccttgtg

SEQ ID NO: 3690871 - DNA, 17 bp, Homo sapiens
agactcccattcctgaa

SEQ ID NO: 3690872 - DNA, 18 bp, Homo sapiens
agactccttcgtccccag

SEQ ID NO: 3690873 - DNA, 18 bp, Homo sapiens
agactctcctgcctcagc

SEQ ID NO: 3690874 - DNA, 14 bp, Homo sapiens
agactgcagagggg

SEQ ID NO: 3690875 - DNA, 18 bp, Homo sapiens
agactggaacactagaca

SEQ ID NO: 3690876 - DNA, 21 bp, Homo sapiens
agactgtcagcttccaaacat

SEQ ID NO: 3690877 - DNA, 15 bp, Homo sapiens
agactgttactttgg

SEQ ID NO: 3690878 - DNA, 17 bp, Homo sapiens
agacttgtgctcaagga

SEQ ID NO: 3690879 - DNA, 12 bp, Homo sapiens
agagaaaatata

SEQ ID NO: 3690880 - DNA, 15 bp, Homo sapiens
agagaaaatatatgt

SEQ ID NO: 3690881 - DNA, 19 bp, Homo sapiens
agagaaaatatatgtattt

SEQ ID NO: 3690882 - DNA, 18 bp, Homo sapiens
agagaaaggggagcccac

SEQ ID NO: 3690883 - DNA, 23 bp, Homo sapiens
agagaaaggggagcccactgtcc

SEQ ID NO: 3690884 - DNA, 20 bp, Homo sapiens
agagaacctcacgcacctcc

SEQ ID NO: 3690885 - DNA, 10 bp, Homo sapiens
agagaagaga

SEQ ID NO: 3690886 - DNA, 21 bp, Homo sapiens
agagaagagattgtggtttca

SEQ ID NO: 3690887 - DNA, 22 bp, Homo sapiens
agagaatgaaattgctgaaaga

SEQ ID NO: 3690888 - DNA, 23 bp, Homo sapiens
agagaatgataggcttttgttct

SEQ ID NO: 3690889 - DNA, 21 bp, Homo sapiens
actgagccagcttagcaactg

SEQ ID NO: 3690890 - DNA, 12 bp, Homo sapiens
actgagctggct

SEQ ID NO: 3690891 - DNA, 16 bp, Homo sapiens
actgagctggctgact

SEQ ID NO: 3690892 - DNA, 22 bp, Homo sapiens
actgagggaccaactgggccca

SEQ ID NO: 3690893 - DNA, 18 bp, Homo sapiens
actgagttttccatggca

SEQ ID NO: 3690894 - DNA, 19 bp, Homo sapiens
actgatctcgatgcaggtg

SEQ ID NO: 3690895 - DNA, 16 bp, Homo sapiens
actgattacctgccaa

SEQ ID NO: 3690896 - DNA, 13 bp, Homo sapiens
actgatttaattt

SEQ ID NO: 3690897 - DNA, 21 bp, Homo sapiens
actgcagaggggaaagacttc

SEQ ID NO: 3690898 - DNA, 15 bp, Homo sapiens
actgcaggccctggc

SEQ ID NO: 3690899 - DNA, 22 bp, Homo sapiens
actgcataccaacctgggcaat

SEQ ID NO: 3690900 - DNA, 14 bp, Homo sapiens
actgccatgccagc

SEQ ID NO: 3690901 - DNA, 17 bp, Homo sapiens
actgcccaggcactgca

SEQ ID NO: 3690902 - DNA, 22 bp, Homo sapiens
actgcccggcagggtcctagaa

SEQ ID NO: 3690903 - DNA, 20 bp, Homo sapiens
actgccgtcagtgctgtgct

SEQ ID NO: 3690904 - DNA, 16 bp, Homo sapiens
actgccttcgcttctt

SEQ ID NO: 3690905 - DNA, 21 bp, Homo sapiens
actgccttcgcttcttgcctc

SEQ ID NO: 3690906 - DNA, 19 bp, Homo sapiens
actgcgactttctgcctgg

SEQ ID NO: 3690907 - DNA, 22 bp, Homo sapiens
actgcgactttctgcctggagt

SEQ ID NO: 3690908 - DNA, 14 bp, Homo sapiens
actgctacctctga

SEQ ID NO: 3690909 - DNA, 17 bp, Homo sapiens
actgctacctctgagaa

SEQ ID NO: 3690910 - DNA, 20 bp, Homo sapiens
actgctacctttcaaagctt

SEQ ID NO: 3690911 - DNA, 14 bp, Homo sapiens
actgctgtttcacg

SEQ ID NO: 3690912 - DNA, 13 bp, Homo sapiens
actgcttggagct

SEQ ID NO: 3690913 - DNA, 18 bp, Homo sapiens
actgcttggagctgagca

SEQ ID NO: 3690914 - DNA, 13 bp, Homo sapiens
actggaagaaagc

SEQ ID NO: 3690915 - DNA, 21 bp, Homo sapiens
actggcaggcaggctcccagg

SEQ ID NO: 3690916 - DNA, 21 bp, Homo sapiens
actggcccctactttgtggca

SEQ ID NO: 3690917 - DNA, 17 bp, Homo sapiens
actgggccctgagtctg

SEQ ID NO: 3690918 - DNA, 15 bp, Homo sapiens
actggggcatcctgt

SEQ ID NO: 3690919 - DNA, 15 bp, Homo sapiens
actggtaggaccaag

SEQ ID NO: 3690920 - DNA, 16 bp, Homo sapiens
actggtgcactttgta

SEQ ID NO: 3690921 - DNA, 18 bp, Homo sapiens
actggtgcactttgtaaa

SEQ ID NO: 3690922 - DNA, 20 bp, Homo sapiens
actggtgcactttgtaaatt

SEQ ID NO: 3690923 - DNA, 12 bp, Homo sapiens
actgtaaatcat

SEQ ID NO: 3690924 - DNA, 13 bp, Homo sapiens
actgtaagggatt

SEQ ID NO: 3690925 - DNA, 18 bp, Homo sapiens
actgtacaataaaaacat

SEQ ID NO: 3690926 - DNA, 15 bp, Homo sapiens
actgtatctaggcaa

SEQ ID NO: 3690927 - DNA, 22 bp, Homo sapiens
actgtatctaggcaacatagta

SEQ ID NO: 3690928 - DNA, 14 bp, Homo sapiens
actgtcctgggcct

SEQ ID NO: 3690929 - DNA, 18 bp, Homo sapiens
actgtctttaaaagagag

SEQ ID NO: 3690930 - DNA, 16 bp, Homo sapiens
actgtgaaccggctcc

SEQ ID NO: 3690931 - DNA, 16 bp, Homo sapiens
actgtgaagagaacca

SEQ ID NO: 3690932 - DNA, 12 bp, Homo sapiens
actgtgccatgg

SEQ ID NO: 3690933 - DNA, 17 bp, Homo sapiens
actgtgtttcgtgaact

SEQ ID NO: 3690934 - DNA, 19 bp, Homo sapiens
actgtgtttcgtgaactgc

SEQ ID NO: 3690935 - DNA, 22 bp, Homo sapiens
actgttacaacttgtatttcca

SEQ ID NO: 3690936 - DNA, 15 bp, Homo sapiens
actgttactgggccc

SEQ ID NO: 3690937 - DNA, 15 bp, Homo sapiens
actgttactttggca

SEQ ID NO: 3690938 - DNA, 20 bp, Homo sapiens
actgttgcccttctgtccaa

SEQ ID NO: 3690939 - DNA, 15 bp, Homo sapiens
actgttttgaggaat

SEQ ID NO: 3690940 - DNA, 14 bp, Homo sapiens
acttaactatctgt

SEQ ID NO: 3690941 - DNA, 17 bp, Homo sapiens
acttaagaatacacagg

SEQ ID NO: 3690942 - DNA, 19 bp, Homo sapiens
acttaagcaaaagaaaaag

SEQ ID NO: 3690943 - DNA, 13 bp, Homo sapiens
acttacttgctta

SEQ ID NO: 3690944 - DNA, 15 bp, Homo sapiens
acttacttgcttatt

SEQ ID NO: 3690945 - DNA, 16 bp, Homo sapiens
acttacttgcttattt

SEQ ID NO: 3690946 - DNA, 15 bp, Homo sapiens
acttaggtgtggggg

SEQ ID NO: 3690947 - DNA, 21 bp, Homo sapiens
acttattaacaattaggcaga

SEQ ID NO: 3690948 - DNA, 15 bp, Homo sapiens
acttatttaaactct

SEQ ID NO: 3690949 - DNA, 22 bp, Homo sapiens
acttcatagaaacctctctatt

SEQ ID NO: 3690950 - DNA, 18 bp, Homo sapiens
acttcattttcagagtga

SEQ ID NO: 3690951 - DNA, 13 bp, Homo sapiens
acttcccaccctg

SEQ ID NO: 3690952 - DNA, 21 bp, Homo sapiens
acttcccctctaactggacag

SEQ ID NO: 3690953 - DNA, 16 bp, Homo sapiens
acttccgttcattgct

SEQ ID NO: 3690954 - DNA, 17 bp, Homo sapiens
acttcctattttcttga

SEQ ID NO: 3690955 - DNA, 22 bp, Homo sapiens
acttctacccagatggaaaaat

SEQ ID NO: 3690956 - DNA, 12 bp, Homo sapiens
acttctgcctgg

SEQ ID NO: 3690957 - DNA, 16 bp, Homo sapiens
acttctgcctggagac

SEQ ID NO: 3690958 - DNA, 18 bp, Homo sapiens
acttcttcttctttgttt

SEQ ID NO: 3690959 - DNA, 20 bp, Homo sapiens
acttcttgaaggtgctgacg

SEQ ID NO: 3690960 - DNA, 18 bp, Homo sapiens
acttgaactgttgccctt

SEQ ID NO: 3690961 - DNA, 15 bp, Homo sapiens
acttgaagggccaga

SEQ ID NO: 3690962 - DNA, 17 bp, Homo sapiens
acttgaagggccagagc

SEQ ID NO: 3690963 - DNA, 22 bp, Homo sapiens
acttgaagggccagagccaggg

SEQ ID NO: 3690964 - DNA, 15 bp, Homo sapiens
acttgaccctgagct

SEQ ID NO: 3690965 - DNA, 12 bp, Homo sapiens
acttgcctcttc

SEQ ID NO: 3690966 - DNA, 17 bp, Homo sapiens
acttgcctcttccttga

SEQ ID NO: 3690967 - DNA, 22 bp, Homo sapiens
acttgctcaggtacttgtaaat

SEQ ID NO: 3690968 - DNA, 18 bp, Homo sapiens
acttggctcgaatctctg

SEQ ID NO: 3690969 - DNA, 20 bp, Homo sapiens
acttggctcgaatctctgtg

SEQ ID NO: 3690970 - DNA, 22 bp, Homo sapiens
acttggctcgaatctctgtgcc

SEQ ID NO: 3690971 - DNA, 15 bp, Homo sapiens
acttgggccactgtg

SEQ ID NO: 3690972 - DNA, 16 bp, Homo sapiens
acttggtaattgtact

SEQ ID NO: 3690973 - DNA, 12 bp, Homo sapiens
acttggtttgtg

SEQ ID NO: 3690974 - DNA, 18 bp, Homo sapiens
acttgtaaatgtggtaaa

SEQ ID NO: 3690975 - DNA, 13 bp, Homo sapiens
acttgtctcagga

SEQ ID NO: 3690976 - DNA, 23 bp, Homo sapiens
acttgtgtcccatgatccctgtg

SEQ ID NO: 3690977 - DNA, 18 bp, Homo sapiens
actttagaaagctgacat

SEQ ID NO: 3690978 - DNA, 21 bp, Homo sapiens
actttattgccttttaatttt

SEQ ID NO: 3690979 - DNA, 13 bp, Homo sapiens
actttctgcctgg

SEQ ID NO: 3690980 - DNA, 20 bp, Homo sapiens
actttcttctgaatatttta

SEQ ID NO: 3690981 - DNA, 16 bp, Homo sapiens
actttggcaatttcct

SEQ ID NO: 3690982 - DNA, 14 bp, Homo sapiens
acttttcattctct

SEQ ID NO: 3690983 - DNA, 18 bp, Homo sapiens
acttttcattctctttta

SEQ ID NO: 3690984 - DNA, 20 bp, Homo sapiens
acttttcattctcttttaat

SEQ ID NO: 3690985 - DNA, 12 bp, Homo sapiens
actttttataaa

SEQ ID NO: 3690986 - DNA, 16 bp, Homo sapiens
acttttttaaatattt

SEQ ID NO: 3690987 - DNA, 12 bp, Homo sapiens
agaaaaaaacaa

SEQ ID NO: 3690988 - DNA, 17 bp, Homo sapiens
agaaaaaatattttccc

SEQ ID NO: 3690989 - DNA, 17 bp, Homo sapiens
agaaaaaatattttcct

SEQ ID NO: 3690990 - DNA, 23 bp, Homo sapiens
agaaaaaatattttcctgccagg

SEQ ID NO: 3690991 - DNA, 18 bp, Homo sapiens
agaaaaagcaagtgttca

SEQ ID NO: 3690992 - DNA, 20 bp, Homo sapiens
agaaaaagcaataacctcaa

SEQ ID NO: 3690993 - DNA, 20 bp, Homo sapiens
agaaaaattcagcaaaccat

SEQ ID NO: 3690994 - DNA, 20 bp, Homo sapiens
agaaaacaaaaaaacctcta

SEQ ID NO: 3690995 - DNA, 13 bp, Homo sapiens
agaaaacaaaact

SEQ ID NO: 3690996 - DNA, 21 bp, Homo sapiens
agaaaacaaaactgcatttca

SEQ ID NO: 3690997 - DNA, 18 bp, Homo sapiens
agaaaacttgcctttcag

SEQ ID NO: 3690998 - DNA, 11 bp, Homo sapiens
agaaaagttat

SEQ ID NO: 3690999 - DNA, 14 bp, Homo sapiens
agaaaatatatgta

SEQ ID NO: 3691000 - DNA, 15 bp, Homo sapiens
agaaaatatatgtat

SEQ ID NO: 3691001 - DNA, 17 bp, Homo sapiens
agaaaatatatgtattt

SEQ ID NO: 3691002 - DNA, 17 bp, Homo sapiens
agaaacacactgaggca

SEQ ID NO: 3691003 - DNA, 16 bp, Homo sapiens
accttggcaccagaca

SEQ ID NO: 3691004 - DNA, 12 bp, Homo sapiens
accttgtataaa

SEQ ID NO: 3691005 - DNA, 15 bp, Homo sapiens
accttgttacttctg

SEQ ID NO: 3691006 - DNA, 14 bp, Homo sapiens
acctttaagaattt

SEQ ID NO: 3691007 - DNA, 21 bp, Homo sapiens
acctttagaaactcaaaaact

SEQ ID NO: 3691008 - DNA, 20 bp, Homo sapiens
acctttatcacctcattctg

SEQ ID NO: 3691009 - DNA, 22 bp, Homo sapiens
acctttctaacccactaagtaa

SEQ ID NO: 3691010 - DNA, 23 bp, Homo sapiens
accttttttcaacagtgaagaca

SEQ ID NO: 3691011 - DNA, 12 bp, Homo sapiens
acgaggaagccc

SEQ ID NO: 3691012 - DNA, 23 bp, Homo sapiens
acgatacgctactataaagagaa

SEQ ID NO: 3691013 - DNA, 16 bp, Homo sapiens
acgcccgtcctgcctg

SEQ ID NO: 3691014 - DNA, 19 bp, Homo sapiens
acgcccgtcctgcctgtgg

SEQ ID NO: 3691015 - DNA, 16 bp, Homo sapiens
acggaagagccttgcg

SEQ ID NO: 3691016 - DNA, 19 bp, Homo sapiens
acggagagcgcctgcccct

SEQ ID NO: 3691017 - DNA, 22 bp, Homo sapiens
acggcaggacaacgaggaagcc

SEQ ID NO: 3691018 - DNA, 16 bp, Homo sapiens
acggccaagaatgtac

SEQ ID NO: 3691019 - DNA, 17 bp, Homo sapiens
acggccagggagaagct

SEQ ID NO: 3691020 - DNA, 23 bp, Homo sapiens
acggccagggagaagctcctctc

SEQ ID NO: 3691021 - DNA, 23 bp, Homo sapiens
acggggcagtactcctccctggg

SEQ ID NO: 3691022 - DNA, 15 bp, Homo sapiens
acggggcgggccctg

SEQ ID NO: 3691023 - DNA, 18 bp, Homo sapiens
acgggggctgtggctctg

SEQ ID NO: 3691024 - DNA, 17 bp, Homo sapiens
acggttttactgcagct

SEQ ID NO: 3691025 - DNA, 20 bp, Homo sapiens
acgtatgtttttgtgtattt

SEQ ID NO: 3691026 - DNA, 21 bp, Homo sapiens
acgtgacacaaacacacacaa

SEQ ID NO: 3691027 - DNA, 21 bp, Homo sapiens
acgtgaccggacttttctgca

SEQ ID NO: 3691028 - DNA, 15 bp, Homo sapiens
acgtgagagtgtctt

SEQ ID NO: 3691029 - DNA, 15 bp, Homo sapiens
acgtggcccagagaa

SEQ ID NO: 3691030 - DNA, 18 bp, Homo sapiens
acgtggttggggccctgc

SEQ ID NO: 3691031 - DNA, 18 bp, Homo sapiens
acgttggagaagcccgtg

SEQ ID NO: 3691032 - DNA, 20 bp, Homo sapiens
actaaaaagagactgtgcca

SEQ ID NO: 3691033 - DNA, 20 bp, Homo sapiens
actaaactacattgttctta

SEQ ID NO: 3691034 - DNA, 17 bp, Homo sapiens
actaaagccaaacatat

SEQ ID NO: 3691035 - DNA, 18 bp, Homo sapiens
actaacaaaggcagctgt

SEQ ID NO: 3691036 - DNA, 20 bp, Homo sapiens
actaacaaaggcagctgtgt

SEQ ID NO: 3691037 - DNA, 23 bp, Homo sapiens
actaactatgcatggtgccccag

SEQ ID NO: 3691038 - DNA, 13 bp, Homo sapiens
actaagcagagga

SEQ ID NO: 3691039 - DNA, 15 bp, Homo sapiens
actaagcagaggagg

SEQ ID NO: 3691040 - DNA, 19 bp, Homo sapiens
actaagcagaggaggggcc

SEQ ID NO: 3691041 - DNA, 21 bp, Homo sapiens
actaaggggcccggccagcca

SEQ ID NO: 3691042 - DNA, 21 bp, Homo sapiens
actaattatactactttgtta

SEQ ID NO: 3691043 - DNA, 19 bp, Homo sapiens
actacaggtattttcatca

SEQ ID NO: 3691044 - DNA, 18 bp, Homo sapiens
actactgacatgtggggc

SEQ ID NO: 3691045 - DNA, 18 bp, Homo sapiens
actaggaaatccattcac

SEQ ID NO: 3691046 - DNA, 20 bp, Homo sapiens
actaggcccccacttgcctc

SEQ ID NO: 3691047 - DNA, 17 bp, Homo sapiens
actagggaagataatat

SEQ ID NO: 3691048 - DNA, 15 bp, Homo sapiens
actagggagccatgt

SEQ ID NO: 3691049 - DNA, 19 bp, Homo sapiens
actagggagccatgtttca

SEQ ID NO: 3691050 - DNA, 17 bp, Homo sapiens
actagggattcaggctg

SEQ ID NO: 3691051 - DNA, 21 bp, Homo sapiens
actagggattcaggctgcttg

SEQ ID NO: 3691052 - DNA, 13 bp, Homo sapiens
actataaagagaa

SEQ ID NO: 3691053 - DNA, 22 bp, Homo sapiens
actatcatgtcaaacgtgaaaa

SEQ ID NO: 3691054 - DNA, 14 bp, Homo sapiens
actatctgttccct

SEQ ID NO: 3691055 - DNA, 20 bp, Homo sapiens
actatgcatggtgccccagg

SEQ ID NO: 3691056 - DNA, 21 bp, Homo sapiens
actatggataaactaaacacg

SEQ ID NO: 3691057 - DNA, 24 bp, Homo sapiens
actatggataaactaaacacgtga

SEQ ID NO: 3691058 - DNA, 13 bp, Homo sapiens
actatgttgataa

SEQ ID NO: 3691059 - DNA, 17 bp, Homo sapiens
actattccttttctgta

SEQ ID NO: 3691060 - DNA, 23 bp, Homo sapiens
actattgggtatgaactaaaaag

SEQ ID NO: 3691061 - DNA, 13 bp, Homo sapiens
actatttcttcag

SEQ ID NO: 3691062 - DNA, 21 bp, Homo sapiens
actcaaatggggccagatcca

SEQ ID NO: 3691063 - DNA, 23 bp, Homo sapiens
actcaaatggggccagatccagc

SEQ ID NO: 3691064 - DNA, 11 bp, Homo sapiens
actcaagccaa

SEQ ID NO: 3691065 - DNA, 14 bp, Homo sapiens
actcaagccaagca

SEQ ID NO: 3691066 - DNA, 12 bp, Homo sapiens
actcaatatttt

SEQ ID NO: 3691067 - DNA, 19 bp, Homo sapiens
actcacatggctatgtttt

SEQ ID NO: 3691068 - DNA, 15 bp, Homo sapiens
actcactttcccttg

SEQ ID NO: 3691069 - DNA, 23 bp, Homo sapiens
actcactttcccttgtgtcaaga

SEQ ID NO: 3691070 - DNA, 22 bp, Homo sapiens
actcagtgggctgtttctgctt

SEQ ID NO: 3691071 - DNA, 17 bp, Homo sapiens
actcatccgcctggccc

SEQ ID NO: 3691072 - DNA, 16 bp, Homo sapiens
actcatttacaactga

SEQ ID NO: 3691073 - DNA, 13 bp, Homo sapiens
actccagcctggg

SEQ ID NO: 3691074 - DNA, 15 bp, Homo sapiens
actccaggccctcct

SEQ ID NO: 3691075 - DNA, 15 bp, Homo sapiens
actccatccagctac

SEQ ID NO: 3691076 - DNA, 20 bp, Homo sapiens
actcccattcctgaagaacc

SEQ ID NO: 3691077 - DNA, 19 bp, Homo sapiens
actccctcctcacctctgg

SEQ ID NO: 3691078 - DNA, 22 bp, Homo sapiens
actccctcctcacctctggact

SEQ ID NO: 3691079 - DNA, 15 bp, Homo sapiens
actcccttcccataa

SEQ ID NO: 3691080 - DNA, 22 bp, Homo sapiens
actccgagaggtgggccagtct

SEQ ID NO: 3691081 - DNA, 17 bp, Homo sapiens
actccgttggccactcc

SEQ ID NO: 3691082 - DNA, 21 bp, Homo sapiens
actccgttggccactccgaga

SEQ ID NO: 3691083 - DNA, 21 bp, Homo sapiens
actcctacctgaaggcagggc

SEQ ID NO: 3691084 - DNA, 22 bp, Homo sapiens
actcctacctgaaggcagggct

SEQ ID NO: 3691085 - DNA, 23 bp, Homo sapiens
actcctacctgaaggcagggctc

SEQ ID NO: 3691086 - DNA, 13 bp, Homo sapiens
actcctgccaggg

SEQ ID NO: 3691087 - DNA, 23 bp, Homo sapiens
actcctgccagggaactggcctg

SEQ ID NO: 3691088 - DNA, 20 bp, Homo sapiens
actcgggtttctctgtggct

SEQ ID NO: 3691089 - DNA, 12 bp, Homo sapiens
actcggtttctc

SEQ ID NO: 3691090 - DNA, 13 bp, Homo sapiens
actctaccctccc

SEQ ID NO: 3691091 - DNA, 18 bp, Homo sapiens
actctaccctcccacccc

SEQ ID NO: 3691092 - DNA, 13 bp, Homo sapiens
actctaccctctt

SEQ ID NO: 3691093 - DNA, 21 bp, Homo sapiens
actctaccctcttagaaaaac

SEQ ID NO: 3691094 - DNA, 19 bp, Homo sapiens
actctacttaatccaatgg

SEQ ID NO: 3691095 - DNA, 20 bp, Homo sapiens
actctagctgggggtgggcc

SEQ ID NO: 3691096 - DNA, 15 bp, Homo sapiens
actctagggaaaaac

SEQ ID NO: 3691097 - DNA, 11 bp, Homo sapiens
actctccccac

SEQ ID NO: 3691098 - DNA, 12 bp, Homo sapiens
actctccccaca

SEQ ID NO: 3691099 - DNA, 14 bp, Homo sapiens
actctccccacact

SEQ ID NO: 3691100 - DNA, 15 bp, Homo sapiens
actctccccacacta

SEQ ID NO: 3691101 - DNA, 14 bp, Homo sapiens
actctgagtgtttt

SEQ ID NO: 3691102 - DNA, 20 bp, Homo sapiens
actctgagtgttttatgaga

SEQ ID NO: 3691103 - DNA, 16 bp, Homo sapiens
actctgcttctctgac

SEQ ID NO: 3691104 - DNA, 18 bp, Homo sapiens
actctgcttctctgactt

SEQ ID NO: 3691105 - DNA, 20 bp, Homo sapiens
actctgcttctctgacttct

SEQ ID NO: 3691106 - DNA, 16 bp, Homo sapiens
actctgtggccagcct

SEQ ID NO: 3691107 - DNA, 20 bp, Homo sapiens
actctgtggccagcctggca

SEQ ID NO: 3691108 - DNA, 15 bp, Homo sapiens
actcttcactcttca

SEQ ID NO: 3691109 - DNA, 16 bp, Homo sapiens
actcttcactcttcaa

SEQ ID NO: 3691110 - DNA, 17 bp, Homo sapiens
actcttcagttaattct

SEQ ID NO: 3691111 - DNA, 18 bp, Homo sapiens
actcttcagttaattctt

SEQ ID NO: 3691112 - DNA, 18 bp, Homo sapiens
actctttagttgatttaa

SEQ ID NO: 3691113 - DNA, 18 bp, Homo sapiens
actctttatgcttgcaaa

SEQ ID NO: 3691114 - DNA, 21 bp, Homo sapiens
actgaaaaaaaaaaagaagaa

SEQ ID NO: 3691115 - DNA, 22 bp, Homo sapiens
actgaaaaaaaaaaagaagaag

SEQ ID NO: 3691116 - DNA, 23 bp, Homo sapiens
actgaaaaaaaaaaagaagaaga

SEQ ID NO: 3691117 - DNA, 20 bp, Homo sapiens
actgaaaaggaggggtctgg

SEQ ID NO: 3691118 - DNA, 14 bp, Homo sapiens
actgaaatctgtca

SEQ ID NO: 3691119 - DNA, 15 bp, Homo sapiens
actgaattttgggac

SEQ ID NO: 3691120 - DNA, 22 bp, Homo sapiens
accatgggtgtggatggcagtg

SEQ ID NO: 3691121 - DNA, 21 bp, Homo sapiens
accattctgactcggtttctc

SEQ ID NO: 3691122 - DNA, 18 bp, Homo sapiens
acccaaaaactgtcttta

SEQ ID NO: 3691123 - DNA, 11 bp, Homo sapiens
acccaaagctg

SEQ ID NO: 3691124 - DNA, 13 bp, Homo sapiens
acccaatcccagt

SEQ ID NO: 3691125 - DNA, 17 bp, Homo sapiens
acccacaatctgagcac

SEQ ID NO: 3691126 - DNA, 14 bp, Homo sapiens
acccacctccctgc

SEQ ID NO: 3691127 - DNA, 15 bp, Homo sapiens
acccacctccctgcc

SEQ ID NO: 3691128 - DNA, 17 bp, Homo sapiens
acccactaagtaacctc

SEQ ID NO: 3691129 - DNA, 23 bp, Homo sapiens
acccaggacttatttaaactctg

SEQ ID NO: 3691130 - DNA, 12 bp, Homo sapiens
acccaggcagct

SEQ ID NO: 3691131 - DNA, 14 bp, Homo sapiens
acccaggcagctgg

SEQ ID NO: 3691132 - DNA, 15 bp, Homo sapiens
acccaggcagctggc

SEQ ID NO: 3691133 - DNA, 16 bp, Homo sapiens
acccaggcagctggca

SEQ ID NO: 3691134 - DNA, 18 bp, Homo sapiens
acccaggcagctggcagg

SEQ ID NO: 3691135 - DNA, 18 bp, Homo sapiens
acccagtagggtttgaca

SEQ ID NO: 3691136 - DNA, 18 bp, Homo sapiens
acccagtcacctctgtct

SEQ ID NO: 3691137 - DNA, 17 bp, Homo sapiens
acccagtgcagaatgta

SEQ ID NO: 3691138 - DNA, 18 bp, Homo sapiens
acccagtgcagaatgtaa

SEQ ID NO: 3691139 - DNA, 18 bp, Homo sapiens
acccagtgcccccactga

SEQ ID NO: 3691140 - DNA, 18 bp, Homo sapiens
accccaaagctttcctgc

SEQ ID NO: 3691141 - DNA, 17 bp, Homo sapiens
accccaaggagggagat

SEQ ID NO: 3691142 - DNA, 15 bp, Homo sapiens
acccccaccccacac

SEQ ID NO: 3691143 - DNA, 13 bp, Homo sapiens
acccccttctctg

SEQ ID NO: 3691144 - DNA, 16 bp, Homo sapiens
acccccttctctgctc

SEQ ID NO: 3691145 - DNA, 20 bp, Homo sapiens
acccccttctctgctccacc

SEQ ID NO: 3691146 - DNA, 15 bp, Homo sapiens
accccgcagacacct

SEQ ID NO: 3691147 - DNA, 17 bp, Homo sapiens
accccgggctctctgct

SEQ ID NO: 3691148 - DNA, 18 bp, Homo sapiens
accccgggctctctgctg

SEQ ID NO: 3691149 - DNA, 19 bp, Homo sapiens
acccctgcgtcgagctggg

SEQ ID NO: 3691150 - DNA, 16 bp, Homo sapiens
acccctgggggctctc

SEQ ID NO: 3691151 - DNA, 14 bp, Homo sapiens
accccttagcctcc

SEQ ID NO: 3691152 - DNA, 18 bp, Homo sapiens
accccttagcctccctga

SEQ ID NO: 3691153 - DNA, 19 bp, Homo sapiens
accccttcctcagcctggg

SEQ ID NO: 3691154 - DNA, 21 bp, Homo sapiens
acccgacagagggaagaaaag

SEQ ID NO: 3691155 - DNA, 14 bp, Homo sapiens
accctattgctgct

SEQ ID NO: 3691156 - DNA, 15 bp, Homo sapiens
accctcaggcaggtg

SEQ ID NO: 3691157 - DNA, 13 bp, Homo sapiens
accctcattcttt

SEQ ID NO: 3691158 - DNA, 13 bp, Homo sapiens
accctcccacccc

SEQ ID NO: 3691159 - DNA, 14 bp, Homo sapiens
accctcccaccccc

SEQ ID NO: 3691160 - DNA, 12 bp, Homo sapiens
accctcctgctg

SEQ ID NO: 3691161 - DNA, 19 bp, Homo sapiens
accctcctgctgagctgcc

SEQ ID NO: 3691162 - DNA, 18 bp, Homo sapiens
accctgaaagccctgagc

SEQ ID NO: 3691163 - DNA, 22 bp, Homo sapiens
accctgatttaggagaagccag

SEQ ID NO: 3691164 - DNA, 18 bp, Homo sapiens
accctgccttatcttgca

SEQ ID NO: 3691165 - DNA, 15 bp, Homo sapiens
accctgggccctggg

SEQ ID NO: 3691166 - DNA, 18 bp, Homo sapiens
accctgggccctgggctg

SEQ ID NO: 3691167 - DNA, 20 bp, Homo sapiens
accctgggccctgggctgga

SEQ ID NO: 3691168 - DNA, 18 bp, Homo sapiens
accctgggggcacaggag

SEQ ID NO: 3691169 - DNA, 23 bp, Homo sapiens
accctgggtgtccccgctgctgt

SEQ ID NO: 3691170 - DNA, 18 bp, Homo sapiens
accctggtggttgctgtt

SEQ ID NO: 3691171 - DNA, 23 bp, Homo sapiens
accctgtaaaatggaggtggaaa

SEQ ID NO: 3691172 - DNA, 19 bp, Homo sapiens
acccttaccccttagcctc

SEQ ID NO: 3691173 - DNA, 20 bp, Homo sapiens
acccttcccttgagccctct

SEQ ID NO: 3691174 - DNA, 11 bp, Homo sapiens
acccttggcct

SEQ ID NO: 3691175 - DNA, 15 bp, Homo sapiens
accgaggggcctttg

SEQ ID NO: 3691176 - DNA, 21 bp, Homo sapiens
accgaggggcctttgttctgg

SEQ ID NO: 3691177 - DNA, 18 bp, Homo sapiens
accgccatcctctgcctc

SEQ ID NO: 3691178 - DNA, 13 bp, Homo sapiens
accgccctcctga

SEQ ID NO: 3691179 - DNA, 21 bp, Homo sapiens
accgcctccccacctccaggc

SEQ ID NO: 3691180 - DNA, 12 bp, Homo sapiens
accggcaggtgc

SEQ ID NO: 3691181 - DNA, 21 bp, Homo sapiens
accgtcaggtactcctgccag

SEQ ID NO: 3691182 - DNA, 17 bp, Homo sapiens
accgtgtctgtctggca

SEQ ID NO: 3691183 - DNA, 20 bp, Homo sapiens
acctacccctgacttctgtt

SEQ ID NO: 3691184 - DNA, 15 bp, Homo sapiens
acctacctgttgagc

SEQ ID NO: 3691185 - DNA, 19 bp, Homo sapiens
acctactgcccaggcactg

SEQ ID NO: 3691186 - DNA, 23 bp, Homo sapiens
acctactgcccaggcactgcaaa

SEQ ID NO: 3691187 - DNA, 15 bp, Homo sapiens
acctaggtctccagt

SEQ ID NO: 3691188 - DNA, 13 bp, Homo sapiens
acctatcacttac

SEQ ID NO: 3691189 - DNA, 18 bp, Homo sapiens
acctatcacttacatttt

SEQ ID NO: 3691190 - DNA, 23 bp, Homo sapiens
acctattatccttctacttgtcc

SEQ ID NO: 3691191 - DNA, 18 bp, Homo sapiens
acctatttcttaaacact

SEQ ID NO: 3691192 - DNA, 15 bp, Homo sapiens
acctcacgcacctcc

SEQ ID NO: 3691193 - DNA, 16 bp, Homo sapiens
acctcacgcacctccc

SEQ ID NO: 3691194 - DNA, 19 bp, Homo sapiens
acctcacgcacctcccatc

SEQ ID NO: 3691195 - DNA, 13 bp, Homo sapiens
acctcagcctggc

SEQ ID NO: 3691196 - DNA, 14 bp, Homo sapiens
acctcagcctggcc

SEQ ID NO: 3691197 - DNA, 20 bp, Homo sapiens
acctcagcctggccagacac

SEQ ID NO: 3691198 - DNA, 19 bp, Homo sapiens
acctcagttcccttggcct

SEQ ID NO: 3691199 - DNA, 23 bp, Homo sapiens
acctcagttcccttggcctcaga

SEQ ID NO: 3691200 - DNA, 14 bp, Homo sapiens
acctccaggctttc

SEQ ID NO: 3691201 - DNA, 20 bp, Homo sapiens
acctcccacaaaggagagct

SEQ ID NO: 3691202 - DNA, 15 bp, Homo sapiens
acctcccatcctaat

SEQ ID NO: 3691203 - DNA, 15 bp, Homo sapiens
acctccccagcattc

SEQ ID NO: 3691204 - DNA, 13 bp, Homo sapiens
acctccccagcct

SEQ ID NO: 3691205 - DNA, 17 bp, Homo sapiens
acctccctatactgctt

SEQ ID NO: 3691206 - DNA, 13 bp, Homo sapiens
acctccctgcctc

SEQ ID NO: 3691207 - DNA, 12 bp, Homo sapiens
acctcctgctgg

SEQ ID NO: 3691208 - DNA, 16 bp, Homo sapiens
acctcctgctgggcag

SEQ ID NO: 3691209 - DNA, 14 bp, Homo sapiens
acctcgctgagggc

SEQ ID NO: 3691210 - DNA, 14 bp, Homo sapiens
acctctgagaagac

SEQ ID NO: 3691211 - DNA, 18 bp, Homo sapiens
acctctgcacaagctgca

SEQ ID NO: 3691212 - DNA, 19 bp, Homo sapiens
acctctggactggctagag

SEQ ID NO: 3691213 - DNA, 14 bp, Homo sapiens
acctcttccccaga

SEQ ID NO: 3691214 - DNA, 23 bp, Homo sapiens
acctcttccccagaaaggagact

SEQ ID NO: 3691215 - DNA, 13 bp, Homo sapiens
acctcttggcttt

SEQ ID NO: 3691216 - DNA, 16 bp, Homo sapiens
acctgaaggcagggct

SEQ ID NO: 3691217 - DNA, 20 bp, Homo sapiens
acctgaaggcagggctcctc

SEQ ID NO: 3691218 - DNA, 23 bp, Homo sapiens
acctgaccaggggccctacctgg

SEQ ID NO: 3691219 - DNA, 12 bp, Homo sapiens
acctgaggctgt

SEQ ID NO: 3691220 - DNA, 13 bp, Homo sapiens
acctgcaaaaaat

SEQ ID NO: 3691221 - DNA, 16 bp, Homo sapiens
acctgcaaagatctgt

SEQ ID NO: 3691222 - DNA, 22 bp, Homo sapiens
acctgcaaagatctgtcctcag

SEQ ID NO: 3691223 - DNA, 13 bp, Homo sapiens
acctgcaggcggg

SEQ ID NO: 3691224 - DNA, 20 bp, Homo sapiens
acctgcaggcggggctcctc

SEQ ID NO: 3691225 - DNA, 23 bp, Homo sapiens
acctgcttggtgtgtaggttccg

SEQ ID NO: 3691226 - DNA, 18 bp, Homo sapiens
acctggaacttggggagt

SEQ ID NO: 3691227 - DNA, 16 bp, Homo sapiens
acctggaccccagcct

SEQ ID NO: 3691228 - DNA, 19 bp, Homo sapiens
acctggaccccagccttgg

SEQ ID NO: 3691229 - DNA, 19 bp, Homo sapiens
acctggggaaagcctgaag

SEQ ID NO: 3691230 - DNA, 17 bp, Homo sapiens
acctgggggcagaactc

SEQ ID NO: 3691231 - DNA, 21 bp, Homo sapiens
acctggggtgtgggaggcccg

SEQ ID NO: 3691232 - DNA, 20 bp, Homo sapiens
acctgggttgcagacaggaa

SEQ ID NO: 3691233 - DNA, 20 bp, Homo sapiens
acctgtcaaacaaagccaga

SEQ ID NO: 3691234 - DNA, 22 bp, Homo sapiens
acctgttgagcatcacagaatg

SEQ ID NO: 3691235 - DNA, 21 bp, Homo sapiens
acctgtttatgagatgctggt

SEQ ID NO: 3691236 - DNA, 16 bp, Homo sapiens
accttcatgcccttct

SEQ ID NO: 3691237 - DNA, 22 bp, Homo sapiens
accttctctatggggcatcctc

SEQ ID NO: 3691238 - DNA, 19 bp, Homo sapiens
accttggacatcctcctcc

SEQ ID NO: 3691239 - DNA, 12 bp, Homo sapiens
aagcctctggct

SEQ ID NO: 3691240 - DNA, 23 bp, Homo sapiens
aagcctctggctagaggccagcc

SEQ ID NO: 3691241 - DNA, 21 bp, Homo sapiens
aagcctgaagggcctcccagc

SEQ ID NO: 3691242 - DNA, 21 bp, Homo sapiens
aagcctgaaggggcgtctgtt

SEQ ID NO: 3691243 - DNA, 13 bp, Homo sapiens
aagcctgtgcaaa

SEQ ID NO: 3691244 - DNA, 17 bp, Homo sapiens
aagcctgtgcaaaaaaa

SEQ ID NO: 3691245 - DNA, 20 bp, Homo sapiens
aagcgagtcgggtccccaac

SEQ ID NO: 3691246 - DNA, 20 bp, Homo sapiens
aagcggatgctccatttcaa

SEQ ID NO: 3691247 - DNA, 23 bp, Homo sapiens
aagcgtgaaggccgagaagcaag

SEQ ID NO: 3691248 - DNA, 18 bp, Homo sapiens
aagctatttatgggcccc

SEQ ID NO: 3691249 - DNA, 13 bp, Homo sapiens
aagctccaagccc

SEQ ID NO: 3691250 - DNA, 13 bp, Homo sapiens
aagctcctcctcc

SEQ ID NO: 3691251 - DNA, 16 bp, Homo sapiens
aagctcctcctccctg

SEQ ID NO: 3691252 - DNA, 18 bp, Homo sapiens
aagctcctcctccctgca

SEQ ID NO: 3691253 - DNA, 20 bp, Homo sapiens
aagctcctctccccagccca

SEQ ID NO: 3691254 - DNA, 22 bp, Homo sapiens
aagctcctctccccagcccaga

SEQ ID NO: 3691255 - DNA, 17 bp, Homo sapiens
aagctgacattgccaaa

SEQ ID NO: 3691256 - DNA, 21 bp, Homo sapiens
aagctgcaccctcaggcaggt

SEQ ID NO: 3691257 - DNA, 21 bp, Homo sapiens
aagctggccgagggtcctggc

SEQ ID NO: 3691258 - DNA, 14 bp, Homo sapiens
aagctgtgctggga

SEQ ID NO: 3691259 - DNA, 13 bp, Homo sapiens
aagctgttcctgt

SEQ ID NO: 3691260 - DNA, 16 bp, Homo sapiens
aagcttagtcctggga

SEQ ID NO: 3691261 - DNA, 17 bp, Homo sapiens
aagcttagtcctgggag

SEQ ID NO: 3691262 - DNA, 19 bp, Homo sapiens
aagcttagtcctgggagag

SEQ ID NO: 3691263 - DNA, 19 bp, Homo sapiens
aaggaaagatttgtgaact

SEQ ID NO: 3691264 - DNA, 12 bp, Homo sapiens
aaggaccaggac

SEQ ID NO: 3691265 - DNA, 21 bp, Homo sapiens
aaggacttcctgtccagctcc

SEQ ID NO: 3691266 - DNA, 22 bp, Homo sapiens
aaggacttcctgtccagctcca

SEQ ID NO: 3691267 - DNA, 20 bp, Homo sapiens
caggaatcccggctccagag

SEQ ID NO: 3691268 - DNA, 22 bp, Homo sapiens
caggaatcccggctccagagca

SEQ ID NO: 3691269 - DNA, 14 bp, Homo sapiens
caggaatcttaagg

SEQ ID NO: 3691270 - DNA, 19 bp, Homo sapiens
caggaatttcccaggaccc

SEQ ID NO: 3691271 - DNA, 20 bp, Homo sapiens
caggaatttcccaggaccct

SEQ ID NO: 3691272 - DNA, 15 bp, Homo sapiens
caggacaacgaggaa

SEQ ID NO: 3691273 - DNA, 16 bp, Homo sapiens
caggacaacgaggaag

SEQ ID NO: 3691274 - DNA, 14 bp, Homo sapiens
caggaccagctcag

SEQ ID NO: 3691275 - DNA, 15 bp, Homo sapiens
caggaccagctcagg

SEQ ID NO: 3691276 - DNA, 17 bp, Homo sapiens
caggaccagctcaggac

SEQ ID NO: 3691277 - DNA, 19 bp, Homo sapiens
caggaccagctcaggacag

SEQ ID NO: 3691278 - DNA, 14 bp, Homo sapiens
caggaccctgaagg

SEQ ID NO: 3691279 - DNA, 13 bp, Homo sapiens
caggacctcaggt

SEQ ID NO: 3691280 - DNA, 13 bp, Homo sapiens
caggactccctcc

SEQ ID NO: 3691281 - DNA, 23 bp, Homo sapiens
caggactccctcctcacctctgg

SEQ ID NO: 3691282 - DNA, 17 bp, Homo sapiens
caggagcaagtgaggcc

SEQ ID NO: 3691283 - DNA, 21 bp, Homo sapiens
caggagcaccctgtcttctta

SEQ ID NO: 3691284 - DNA, 23 bp, Homo sapiens
caggagctcttcaggcctccctc

SEQ ID NO: 3691285 - DNA, 15 bp, Homo sapiens
caggagctgggcaga

SEQ ID NO: 3691286 - DNA, 20 bp, Homo sapiens
caggaggcagaggttgcagt

SEQ ID NO: 3691287 - DNA, 12 bp, Homo sapiens
caggaggcaggc

SEQ ID NO: 3691288 - DNA, 21 bp, Homo sapiens
caggagttcgagaccagcctg

SEQ ID NO: 3691289 - DNA, 15 bp, Homo sapiens
caggatctttgactg

SEQ ID NO: 3691290 - DNA, 19 bp, Homo sapiens
caggatggggaggggctct

SEQ ID NO: 3691291 - DNA, 21 bp, Homo sapiens
caggcagagggcatcggggcc

SEQ ID NO: 3691292 - DNA, 14 bp, Homo sapiens
caggcagatccagg

SEQ ID NO: 3691293 - DNA, 13 bp, Homo sapiens
caggcagatctgt

SEQ ID NO: 3691294 - DNA, 15 bp, Homo sapiens
caggcagcacagaga

SEQ ID NO: 3691295 - DNA, 11 bp, Homo sapiens
caggcagctgg

SEQ ID NO: 3691296 - DNA, 12 bp, Homo sapiens
caggcagctggc

SEQ ID NO: 3691297 - DNA, 13 bp, Homo sapiens
caggcagctggca

SEQ ID NO: 3691298 - DNA, 20 bp, Homo sapiens
caggcaggaaggctgagagg

SEQ ID NO: 3691299 - DNA, 16 bp, Homo sapiens
caggcaggctcccagg

SEQ ID NO: 3691300 - DNA, 17 bp, Homo sapiens
caggcagggctgactct

SEQ ID NO: 3691301 - DNA, 20 bp, Homo sapiens
caggcagtgatgctggatgc

SEQ ID NO: 3691302 - DNA, 22 bp, Homo sapiens
caggcagtgatgctggatgctc

SEQ ID NO: 3691303 - DNA, 14 bp, Homo sapiens
caggcatggccctg

SEQ ID NO: 3691304 - DNA, 19 bp, Homo sapiens
caggccaaagtgccggtga

SEQ ID NO: 3691305 - DNA, 19 bp, Homo sapiens
caggccacctccccagcat

SEQ ID NO: 3691306 - DNA, 15 bp, Homo sapiens
caggccccaggaagc

SEQ ID NO: 3691307 - DNA, 16 bp, Homo sapiens
caggccccaggaagcc

SEQ ID NO: 3691308 - DNA, 17 bp, Homo sapiens
caggccccaggaagccg

SEQ ID NO: 3691309 - DNA, 13 bp, Homo sapiens
caggcccccaagc

SEQ ID NO: 3691310 - DNA, 19 bp, Homo sapiens
caggcccccaagcctgcag

SEQ ID NO: 3691311 - DNA, 23 bp, Homo sapiens
caggccctccctgttccccagag

SEQ ID NO: 3691312 - DNA, 16 bp, Homo sapiens
caggccctcctctccc

SEQ ID NO: 3691313 - DNA, 17 bp, Homo sapiens
caggccctggcctcccc

SEQ ID NO: 3691314 - DNA, 13 bp, Homo sapiens
caggcctccctct

SEQ ID NO: 3691315 - DNA, 14 bp, Homo sapiens
caggcctccctctc

SEQ ID NO: 3691316 - DNA, 16 bp, Homo sapiens
caggcctccctctctc

SEQ ID NO: 3691317 - DNA, 19 bp, Homo sapiens
caggcctccctctctcttc

SEQ ID NO: 3691318 - DNA, 22 bp, Homo sapiens
caggcctccctctctcttctgc

SEQ ID NO: 3691319 - DNA, 15 bp, Homo sapiens
caggcctgaaagagg

SEQ ID NO: 3691320 - DNA, 22 bp, Homo sapiens
caggcctgaaagaggctgaggc

SEQ ID NO: 3691321 - DNA, 23 bp, Homo sapiens
caggcgctgcccacctgccggcc

SEQ ID NO: 3691322 - DNA, 15 bp, Homo sapiens
caggcggggctcctc

SEQ ID NO: 3691323 - DNA, 14 bp, Homo sapiens
caggctccaatggg

SEQ ID NO: 3691324 - DNA, 16 bp, Homo sapiens
caggctcccagggaca

SEQ ID NO: 3691325 - DNA, 22 bp, Homo sapiens
caggctcccagggacacctggg

SEQ ID NO: 3691326 - DNA, 15 bp, Homo sapiens
caggctcttagcagc

SEQ ID NO: 3691327 - DNA, 16 bp, Homo sapiens
caggctgcccagagct

SEQ ID NO: 3691328 - DNA, 17 bp, Homo sapiens
caggctgcccagagctg

SEQ ID NO: 3691329 - DNA, 17 bp, Homo sapiens
caggctgctcagggctg

SEQ ID NO: 3691330 - DNA, 17 bp, Homo sapiens
caggctggagagcactg

SEQ ID NO: 3691331 - DNA, 21 bp, Homo sapiens
caggctggagagcactgccag

SEQ ID NO: 3691332 - DNA, 19 bp, Homo sapiens
caggctggccagtccaggc

SEQ ID NO: 3691333 - DNA, 20 bp, Homo sapiens
cagggaacattggagctgac

SEQ ID NO: 3691334 - DNA, 13 bp, Homo sapiens
cagggaagctggc

SEQ ID NO: 3691335 - DNA, 18 bp, Homo sapiens
cagggaagtccccaggcc

SEQ ID NO: 3691336 - DNA, 23 bp, Homo sapiens
cagggaagtccccaggccccagg

SEQ ID NO: 3691337 - DNA, 14 bp, Homo sapiens
cagggacagaggcc

SEQ ID NO: 3691338 - DNA, 13 bp, Homo sapiens
cagggagaagctc

SEQ ID NO: 3691339 - DNA, 19 bp, Homo sapiens
cagggagcggaaagcagct

SEQ ID NO: 3691340 - DNA, 15 bp, Homo sapiens
cagggagctgggccc

SEQ ID NO: 3691341 - DNA, 19 bp, Homo sapiens
cagggagctgggcccgaca

SEQ ID NO: 3691342 - DNA, 17 bp, Homo sapiens
cagggaggccctgtgcc

SEQ ID NO: 3691343 - DNA, 19 bp, Homo sapiens
cagggaggggccggccctg

SEQ ID NO: 3691344 - DNA, 21 bp, Homo sapiens
cagggaggggccggccctgtg

SEQ ID NO: 3691345 - DNA, 13 bp, Homo sapiens
cagggatgccctg

SEQ ID NO: 3691346 - DNA, 20 bp, Homo sapiens
cagggatgccctggaggtgg

SEQ ID NO: 3691347 - DNA, 18 bp, Homo sapiens
cagggcaaggccccttcc

SEQ ID NO: 3691348 - DNA, 19 bp, Homo sapiens
cagggcaaggccccttcca

SEQ ID NO: 3691349 - DNA, 16 bp, Homo sapiens
cagggccatgctgagg

SEQ ID NO: 3691350 - DNA, 21 bp, Homo sapiens
cagggccatgctgaggcctgg

SEQ ID NO: 3691351 - DNA, 22 bp, Homo sapiens
cagggccatgctgaggcctggg

SEQ ID NO: 3691352 - DNA, 23 bp, Homo sapiens
cagggccatgctgaggcctgggc

SEQ ID NO: 3691353 - DNA, 16 bp, Homo sapiens
cagggccatggctcag

SEQ ID NO: 3691354 - DNA, 12 bp, Homo sapiens
cagggcccagag

SEQ ID NO: 3691355 - DNA, 14 bp, Homo sapiens
cagggcccagagcc

SEQ ID NO: 3691356 - DNA, 21 bp, Homo sapiens
cagggcccagagcccagctcc

SEQ ID NO: 3691357 - DNA, 18 bp, Homo sapiens
cagggcccctcaccctgc

SEQ ID NO: 3691358 - DNA, 21 bp, Homo sapiens
cagggcccctcaccctgcctt

SEQ ID NO: 3691359 - DNA, 11 bp, Homo sapiens
cagggcctttt

SEQ ID NO: 3691360 - DNA, 20 bp, Homo sapiens
cagggccttttctggcaccg

SEQ ID NO: 3691361 - DNA, 14 bp, Homo sapiens
cagggctagtgact

SEQ ID NO: 3691362 - DNA, 15 bp, Homo sapiens
cagggctagtgactt

SEQ ID NO: 3691363 - DNA, 18 bp, Homo sapiens
cagggctagtgacttgtg

SEQ ID NO: 3691364 - DNA, 14 bp, Homo sapiens
cagggctcctccct

SEQ ID NO: 3691365 - DNA, 19 bp, Homo sapiens
cagggctcctccctggagc

SEQ ID NO: 3691366 - DNA, 17 bp, Homo sapiens
caggggaaaatcagcct

SEQ ID NO: 3691367 - DNA, 16 bp, Homo sapiens
caggggacaggagtcc

SEQ ID NO: 3691368 - DNA, 17 bp, Homo sapiens
caggggactcagccctg

SEQ ID NO: 3691369 - DNA, 20 bp, Homo sapiens
caggggactcagccctgagg

SEQ ID NO: 3691370 - DNA, 23 bp, Homo sapiens
caggggactcagccctgaggtga

SEQ ID NO: 3691371 - DNA, 14 bp, Homo sapiens
caggggccctacct

SEQ ID NO: 3691372 - DNA, 15 bp, Homo sapiens
caggggccctacctg

SEQ ID NO: 3691373 - DNA, 18 bp, Homo sapiens
caggggccctacctgggg

SEQ ID NO: 3691374 - DNA, 15 bp, Homo sapiens
caggggcctggagat

SEQ ID NO: 3691375 - DNA, 22 bp, Homo sapiens
caggggcctggagatcctcctg

SEQ ID NO: 3691376 - DNA, 23 bp, Homo sapiens
caggggcctggagatcctcctgc

SEQ ID NO: 3691377 - DNA, 18 bp, Homo sapiens
caggggctgcttcctcct

SEQ ID NO: 3691378 - DNA, 13 bp, Homo sapiens
caggggtttctcg

SEQ ID NO: 3691379 - DNA, 13 bp, Homo sapiens
cagggtccctctg

SEQ ID NO: 3691380 - DNA, 13 bp, Homo sapiens
cagggtctgctct

SEQ ID NO: 3691381 - DNA, 22 bp, Homo sapiens
cagggtctgctctttctctgcc

SEQ ID NO: 3691382 - DNA, 17 bp, Homo sapiens
cagggtcttccctacct

SEQ ID NO: 3691383 - DNA, 21 bp, Homo sapiens
cagggttgggcccagatctgg

SEQ ID NO: 3691384 - DNA, 18 bp, Homo sapiens
caggtactcctgccaggg

SEQ ID NO: 3691385 - DNA, 15 bp, Homo sapiens
caggtagctgcccct

SEQ ID NO: 3691386 - DNA, 16 bp, Homo sapiens
caggtagctgcccctg

SEQ ID NO: 3691387 - DNA, 18 bp, Homo sapiens
caggtagctgcccctggc

SEQ ID NO: 3691388 - DNA, 19 bp, Homo sapiens
caggtagctgcccctggct

SEQ ID NO: 3691389 - DNA, 22 bp, Homo sapiens
caggtagctgcccctggctctg

SEQ ID NO: 3691390 - DNA, 20 bp, Homo sapiens
caggtatgaccttctaggaa

SEQ ID NO: 3691391 - DNA, 22 bp, Homo sapiens
caggtcaatacagtacaggcag

SEQ ID NO: 3691392 - DNA, 23 bp, Homo sapiens
caggtcaatacagtacaggcagc

SEQ ID NO: 3691393 - DNA, 14 bp, Homo sapiens
caggtccagctctg

SEQ ID NO: 3691394 - DNA, 19 bp, Homo sapiens
caggtgaaagtttttctga

SEQ ID NO: 3691395 - DNA, 20 bp, Homo sapiens
caggtgaaagtttttctgaa

SEQ ID NO: 3691396 - DNA, 15 bp, Homo sapiens
caggtgcctttcaaa

SEQ ID NO: 3691397 - DNA, 23 bp, Homo sapiens
caggtggggagtcagggacccct

SEQ ID NO: 3691398 - DNA, 20 bp, Homo sapiens
caggtggttatggagagggt

SEQ ID NO: 3691399 - DNA, 12 bp, Homo sapiens
caggtgtgcccc

SEQ ID NO: 3691400 - DNA, 20 bp, Homo sapiens
caggttctccgttagctcct

SEQ ID NO: 3691401 - DNA, 21 bp, Homo sapiens
caggttctccgttagctcctg

SEQ ID NO: 3691402 - DNA, 23 bp, Homo sapiens
caggttctccgttagctcctgtg

SEQ ID NO: 3691403 - DNA, 24 bp, Homo sapiens
caggttctccgttagctcctgtgg

SEQ ID NO: 3691404 - DNA, 20 bp, Homo sapiens
cagtaacgcgtcttcctgag

SEQ ID NO: 3691405 - DNA, 14 bp, Homo sapiens
cagtaactgtcagg

SEQ ID NO: 3691406 - DNA, 19 bp, Homo sapiens
cagtaattaatatctcctg

SEQ ID NO: 3691407 - DNA, 12 bp, Homo sapiens
cagtacaggcag

SEQ ID NO: 3691408 - DNA, 16 bp, Homo sapiens
cagtacaggcagcaca

SEQ ID NO: 3691409 - DNA, 14 bp, Homo sapiens
cagtactcctccct

SEQ ID NO: 3691410 - DNA, 19 bp, Homo sapiens
cagtactttggaggcccct

SEQ ID NO: 3691411 - DNA, 20 bp, Homo sapiens
cagtactttggaggccccta

SEQ ID NO: 3691412 - DNA, 20 bp, Homo sapiens
cagtagaccttgttacttct

SEQ ID NO: 3691413 - DNA, 16 bp, Homo sapiens
cagtagattttccaaa

SEQ ID NO: 3691414 - DNA, 15 bp, Homo sapiens
cagtatgatttataa

SEQ ID NO: 3691415 - DNA, 20 bp, Homo sapiens
cagtcaagaagaaaaaggtt

SEQ ID NO: 3691416 - DNA, 18 bp, Homo sapiens
cagtccaaatgtcctcca

SEQ ID NO: 3691417 - DNA, 17 bp, Homo sapiens
cagtccaccctgcctgc

SEQ ID NO: 3691418 - DNA, 15 bp, Homo sapiens
cagtccaggctgccg

SEQ ID NO: 3691419 - DNA, 13 bp, Homo sapiens
cagtcctgcctgg

SEQ ID NO: 3691420 - DNA, 21 bp, Homo sapiens
cagtcctggttgtctgaaccc

SEQ ID NO: 3691421 - DNA, 14 bp, Homo sapiens
catctgctggtccg

SEQ ID NO: 3691422 - DNA, 19 bp, Homo sapiens
catctgctggtccgtggga

SEQ ID NO: 3691423 - DNA, 21 bp, Homo sapiens
catcttaggttggcaaaaagg

SEQ ID NO: 3691424 - DNA, 22 bp, Homo sapiens
catcttaggttggcaaaaaggc

SEQ ID NO: 3691425 - DNA, 13 bp, Homo sapiens
catcttgcacaca

SEQ ID NO: 3691426 - DNA, 16 bp, Homo sapiens
catcttgcctccaggt

SEQ ID NO: 3691427 - DNA, 23 bp, Homo sapiens
catcttgcctccaggtgcagagg

SEQ ID NO: 3691428 - DNA, 11 bp, Homo sapiens
catcttggggg

SEQ ID NO: 3691429 - DNA, 17 bp, Homo sapiens
catctttgccttgggct

SEQ ID NO: 3691430 - DNA, 21 bp, Homo sapiens
catctttttaacctgcaaaat

SEQ ID NO: 3691431 - DNA, 16 bp, Homo sapiens
catgaagccaggtgtg

SEQ ID NO: 3691432 - DNA, 22 bp, Homo sapiens
catgaagcgagtcgggtcccca

SEQ ID NO: 3691433 - DNA, 18 bp, Homo sapiens
catgaaggtttctgaaaa

SEQ ID NO: 3691434 - DNA, 18 bp, Homo sapiens
catgaataacatttaaat

SEQ ID NO: 3691435 - DNA, 19 bp, Homo sapiens
catgaataacatttaaatt

SEQ ID NO: 3691436 - DNA, 14 bp, Homo sapiens
catgactatggata

SEQ ID NO: 3691437 - DNA, 18 bp, Homo sapiens
catgagactcagtgcaga

SEQ ID NO: 3691438 - DNA, 15 bp, Homo sapiens
catgatggcaacaga

SEQ ID NO: 3691439 - DNA, 19 bp, Homo sapiens
catgatggcaacagatctg

SEQ ID NO: 3691440 - DNA, 14 bp, Homo sapiens
catgcaagcagagg

SEQ ID NO: 3691441 - DNA, 13 bp, Homo sapiens
catgcactgtgaa

SEQ ID NO: 3691442 - DNA, 20 bp, Homo sapiens
catgcactgtgaaggaccct

SEQ ID NO: 3691443 - DNA, 14 bp, Homo sapiens
catgcagcatctaa

SEQ ID NO: 3691444 - DNA, 19 bp, Homo sapiens
catgcagcccatgcccacc

SEQ ID NO: 3691445 - DNA, 23 bp, Homo sapiens
catgcagcccatgcccacctgcc

SEQ ID NO: 3691446 - DNA, 22 bp, Homo sapiens
catgcagtgctctttgtagcta

SEQ ID NO: 3691447 - DNA, 20 bp, Homo sapiens
catgcataagaaatgtagct

SEQ ID NO: 3691448 - DNA, 22 bp, Homo sapiens
catgcatctgtttattctatag

SEQ ID NO: 3691449 - DNA, 13 bp, Homo sapiens
catgcattgagct

SEQ ID NO: 3691450 - DNA, 14 bp, Homo sapiens
catgcattgagctg

SEQ ID NO: 3691451 - DNA, 16 bp, Homo sapiens
catgcattgagctgcc

SEQ ID NO: 3691452 - DNA, 22 bp, Homo sapiens
catgcattgagctgcctccagc

SEQ ID NO: 3691453 - DNA, 19 bp, Homo sapiens
catgccactacactccagc

SEQ ID NO: 3691454 - DNA, 21 bp, Homo sapiens
catgcccacctgcccatcaca

SEQ ID NO: 3691455 - DNA, 20 bp, Homo sapiens
catgcctgtagctttcctgg

SEQ ID NO: 3691456 - DNA, 22 bp, Homo sapiens
catgcctgtagctttcctggtc

SEQ ID NO: 3691457 - DNA, 16 bp, Homo sapiens
catgcctgtccagcct

SEQ ID NO: 3691458 - DNA, 21 bp, Homo sapiens
catgcgccccctccgccctgc

SEQ ID NO: 3691459 - DNA, 23 bp, Homo sapiens
catgcgctcagggccatgctgag

SEQ ID NO: 3691460 - DNA, 18 bp, Homo sapiens
catgctcatctgctggtc

SEQ ID NO: 3691461 - DNA, 16 bp, Homo sapiens
catgctcctggcccac

SEQ ID NO: 3691462 - DNA, 17 bp, Homo sapiens
catgctgaggcctgggc

SEQ ID NO: 3691463 - DNA, 18 bp, Homo sapiens
catgctggaacctgcaaa

SEQ ID NO: 3691464 - DNA, 15 bp, Homo sapiens
catgcttccctgcag

SEQ ID NO: 3691465 - DNA, 18 bp, Homo sapiens
catgcttccctgcagctg

SEQ ID NO: 3691466 - DNA, 15 bp, Homo sapiens
catggacagaagaag

SEQ ID NO: 3691467 - DNA, 21 bp, Homo sapiens
catggacagaagaaggcagca

SEQ ID NO: 3691468 - DNA, 12 bp, Homo sapiens
catggccctggg

SEQ ID NO: 3691469 - DNA, 17 bp, Homo sapiens
catggcgggactggaga

SEQ ID NO: 3691470 - DNA, 18 bp, Homo sapiens
catggcgggactggagaa

SEQ ID NO: 3691471 - DNA, 16 bp, Homo sapiens
catggctccggcctct

SEQ ID NO: 3691472 - DNA, 17 bp, Homo sapiens
catgggaaggggaggac

SEQ ID NO: 3691473 - DNA, 23 bp, Homo sapiens
catggggagggattctggttcca

SEQ ID NO: 3691474 - DNA, 16 bp, Homo sapiens
catgggtgtggatggc

SEQ ID NO: 3691475 - DNA, 17 bp, Homo sapiens
catgggtgtggatggca

SEQ ID NO: 3691476 - DNA, 18 bp, Homo sapiens
catgggtgtggatggcag

SEQ ID NO: 3691477 - DNA, 14 bp, Homo sapiens
catggtcctttctg

SEQ ID NO: 3691478 - DNA, 22 bp, Homo sapiens
catggtggacccagcgggcagg

SEQ ID NO: 3691479 - DNA, 19 bp, Homo sapiens
catggttaccatgggtgtg

SEQ ID NO: 3691480 - DNA, 18 bp, Homo sapiens
catgtaaccggcatgttt

SEQ ID NO: 3691481 - DNA, 19 bp, Homo sapiens
catgtaactatttcttcag

SEQ ID NO: 3691482 - DNA, 17 bp, Homo sapiens
catgtactcaagtacca

SEQ ID NO: 3691483 - DNA, 21 bp, Homo sapiens
catgtacttgtttgcaagcag

SEQ ID NO: 3691484 - DNA, 15 bp, Homo sapiens
catgtataatatttt

SEQ ID NO: 3691485 - DNA, 20 bp, Homo sapiens
catgtataatatttttaatt

SEQ ID NO: 3691486 - DNA, 14 bp, Homo sapiens
catgtcaaacgtga

SEQ ID NO: 3691487 - DNA, 20 bp, Homo sapiens
catgtcaccggatcctgggt

SEQ ID NO: 3691488 - DNA, 15 bp, Homo sapiens
catgtcttttaaaat

SEQ ID NO: 3691489 - DNA, 18 bp, Homo sapiens
catgtgcatagtttcttt

SEQ ID NO: 3691490 - DNA, 15 bp, Homo sapiens
catgtggctggaaga

SEQ ID NO: 3691491 - DNA, 17 bp, Homo sapiens
catgtggggccaggtca

SEQ ID NO: 3691492 - DNA, 15 bp, Homo sapiens
catgttgggaaactt

SEQ ID NO: 3691493 - DNA, 20 bp, Homo sapiens
catgttgggaaacttggctc

SEQ ID NO: 3691494 - DNA, 12 bp, Homo sapiens
catgtttataaa

SEQ ID NO: 3691495 - DNA, 23 bp, Homo sapiens
catgtttataaatcttatgctct

SEQ ID NO: 3691496 - DNA, 14 bp, Homo sapiens
catgtttccagcag

SEQ ID NO: 3691497 - DNA, 17 bp, Homo sapiens
catgttttcaactgcca

SEQ ID NO: 3691498 - DNA, 17 bp, Homo sapiens
cattactataagaactt

SEQ ID NO: 3691499 - DNA, 18 bp, Homo sapiens
cattagaccaagcttgtc

SEQ ID NO: 3691500 - DNA, 19 bp, Homo sapiens
cattagccagatttgtctt

SEQ ID NO: 3691501 - DNA, 23 bp, Homo sapiens
cattatgatgtgggtcaaggaat

SEQ ID NO: 3691502 - DNA, 22 bp, Homo sapiens
cattattcgtagatattggaca

SEQ ID NO: 3691503 - DNA, 23 bp, Homo sapiens
cattcacagttctttgggccaga

SEQ ID NO: 3691504 - DNA, 20 bp, Homo sapiens
cattcagcagcaaattttca

SEQ ID NO: 3691505 - DNA, 22 bp, Homo sapiens
cattccagcccctctggtcgct

SEQ ID NO: 3691506 - DNA, 20 bp, Homo sapiens
aggtccagccccccaggctg

SEQ ID NO: 3691507 - DNA, 15 bp, Homo sapiens
aggtccagctctgga

SEQ ID NO: 3691508 - DNA, 18 bp, Homo sapiens
aggtccagctctggaggg

SEQ ID NO: 3691509 - DNA, 23 bp, Homo sapiens
aggtccagctctggaggggaggg

SEQ ID NO: 3691510 - DNA, 23 bp, Homo sapiens
aggtcccacagccctgagatggg

SEQ ID NO: 3691511 - DNA, 20 bp, Homo sapiens
aggtcccctcgtcccatcca

SEQ ID NO: 3691512 - DNA, 15 bp, Homo sapiens
aggtgagaaaaaaac

SEQ ID NO: 3691513 - DNA, 16 bp, Homo sapiens
aggtgagaagcagagg

SEQ ID NO: 3691514 - DNA, 13 bp, Homo sapiens
aggtgcccctctt

SEQ ID NO: 3691515 - DNA, 23 bp, Homo sapiens
aggtgcccctcttccaaaggcag

SEQ ID NO: 3691516 - DNA, 16 bp, Homo sapiens
aggtgcggccaccacc

SEQ ID NO: 3691517 - DNA, 16 bp, Homo sapiens
aggtgctgacggccag

SEQ ID NO: 3691518 - DNA, 18 bp, Homo sapiens
aggtgctgatgtcaaagt

SEQ ID NO: 3691519 - DNA, 20 bp, Homo sapiens
aggtgctgatgtcaaagtgt

SEQ ID NO: 3691520 - DNA, 20 bp, Homo sapiens
aggtgtgagccactgcaccc

SEQ ID NO: 3691521 - DNA, 20 bp, Homo sapiens
aggtgtggaggctcctgtgg

SEQ ID NO: 3691522 - DNA, 22 bp, Homo sapiens
aggtgtggaggctcctgtggta

SEQ ID NO: 3691523 - DNA, 21 bp, Homo sapiens
aggtgttgccaaatatgtcct

SEQ ID NO: 3691524 - DNA, 16 bp, Homo sapiens
aggtgttggtgacaat

SEQ ID NO: 3691525 - DNA, 15 bp, Homo sapiens
aggttcagccaaggt

SEQ ID NO: 3691526 - DNA, 22 bp, Homo sapiens
aggttccgtatctccctggaga

SEQ ID NO: 3691527 - DNA, 23 bp, Homo sapiens
aggttccgtatctccctggagaa

SEQ ID NO: 3691528 - DNA, 20 bp, Homo sapiens
aggttctccgttagctcctg

SEQ ID NO: 3691529 - DNA, 17 bp, Homo sapiens
aggttctgcctgctttg

SEQ ID NO: 3691530 - DNA, 14 bp, Homo sapiens
aggtttacagaatt

SEQ ID NO: 3691531 - DNA, 20 bp, Homo sapiens
aggtttaggctggtggccca

SEQ ID NO: 3691532 - DNA, 23 bp, Homo sapiens
aggtttttaaacactaaaatata

SEQ ID NO: 3691533 - DNA, 14 bp, Homo sapiens
agtaaaaacctgct

SEQ ID NO: 3691534 - DNA, 13 bp, Homo sapiens
agtaaaagacatt

SEQ ID NO: 3691535 - DNA, 22 bp, Homo sapiens
agtaaatgttatcttatactgt

SEQ ID NO: 3691536 - DNA, 16 bp, Homo sapiens
agtaacgcgtcttcct

SEQ ID NO: 3691537 - DNA, 14 bp, Homo sapiens
agtaaggcatgtta

SEQ ID NO: 3691538 - DNA, 16 bp, Homo sapiens
agtaataaactgtgtt

SEQ ID NO: 3691539 - DNA, 21 bp, Homo sapiens
agtaattaatatctcctggaa

SEQ ID NO: 3691540 - DNA, 19 bp, Homo sapiens
agtaatttattgtctgtct

SEQ ID NO: 3691541 - DNA, 17 bp, Homo sapiens
agtacaggcagcacaga

SEQ ID NO: 3691542 - DNA, 18 bp, Homo sapiens
agtaccaatgggaagcag

SEQ ID NO: 3691543 - DNA, 21 bp, Homo sapiens
agtaccaatgggaagcaggga

SEQ ID NO: 3691544 - DNA, 22 bp, Homo sapiens
agtaccaatgggaagcagggaa

SEQ ID NO: 3691545 - DNA, 19 bp, Homo sapiens
agtactcctccctgggggc

SEQ ID NO: 3691546 - DNA, 16 bp, Homo sapiens
agtacttttttaaata

SEQ ID NO: 3691547 - DNA, 15 bp, Homo sapiens
agtagctctcctgac

SEQ ID NO: 3691548 - DNA, 18 bp, Homo sapiens
agtagttatataattgtt

SEQ ID NO: 3691549 - DNA, 22 bp, Homo sapiens
agtatatttcttcgttcttttt

SEQ ID NO: 3691550 - DNA, 15 bp, Homo sapiens
agtatcacttttctg

SEQ ID NO: 3691551 - DNA, 23 bp, Homo sapiens
agtattctcggatagttgctatt

SEQ ID NO: 3691552 - DNA, 16 bp, Homo sapiens
agtatttctgattttg

SEQ ID NO: 3691553 - DNA, 14 bp, Homo sapiens
agtcaacaagcctg

SEQ ID NO: 3691554 - DNA, 13 bp, Homo sapiens
agtcacaaagact

SEQ ID NO: 3691555 - DNA, 12 bp, Homo sapiens
agtcacaaagag

SEQ ID NO: 3691556 - DNA, 16 bp, Homo sapiens
agtcacaacagagtga

SEQ ID NO: 3691557 - DNA, 18 bp, Homo sapiens
agtcacaacagagtgaaa

SEQ ID NO: 3691558 - DNA, 15 bp, Homo sapiens
agtcaccacttattt

SEQ ID NO: 3691559 - DNA, 16 bp, Homo sapiens
agtcagggacccctgc

SEQ ID NO: 3691560 - DNA, 14 bp, Homo sapiens
agtcatctcaacca

SEQ ID NO: 3691561 - DNA, 16 bp, Homo sapiens
agtcatcttgcacaca

SEQ ID NO: 3691562 - DNA, 20 bp, Homo sapiens
agtcatcttgcacacacttt

SEQ ID NO: 3691563 - DNA, 12 bp, Homo sapiens
agtcatggagaa

SEQ ID NO: 3691564 - DNA, 22 bp, Homo sapiens
agtcattcagcagcaaattttc

SEQ ID NO: 3691565 - DNA, 18 bp, Homo sapiens
agtcattgtatgttatta

SEQ ID NO: 3691566 - DNA, 16 bp, Homo sapiens
agtccaaatgtcctcc

SEQ ID NO: 3691567 - DNA, 17 bp, Homo sapiens
agtccaggctgccgtgg

SEQ ID NO: 3691568 - DNA, 19 bp, Homo sapiens
agtcccttcccctccctgg

SEQ ID NO: 3691569 - DNA, 21 bp, Homo sapiens
agtcccttcccctccctggct

SEQ ID NO: 3691570 - DNA, 23 bp, Homo sapiens
agtcccttcccctccctggctcc

SEQ ID NO: 3691571 - DNA, 20 bp, Homo sapiens
agtccgtgctgacagctgct

SEQ ID NO: 3691572 - DNA, 22 bp, Homo sapiens
agtccgtgctgacagctgctcc

SEQ ID NO: 3691573 - DNA, 23 bp, Homo sapiens
agtccgtgctgacagctgctcct

SEQ ID NO: 3691574 - DNA, 18 bp, Homo sapiens
agtcctcactcccagtcc

SEQ ID NO: 3691575 - DNA, 14 bp, Homo sapiens
agtcctcccaagct

SEQ ID NO: 3691576 - DNA, 17 bp, Homo sapiens
agtcctcccaagctgtg

SEQ ID NO: 3691577 - DNA, 19 bp, Homo sapiens
agtcctcccaagctgtgct

SEQ ID NO: 3691578 - DNA, 22 bp, Homo sapiens
agtcctcccaagctgtgctggg

SEQ ID NO: 3691579 - DNA, 21 bp, Homo sapiens
agtcctgcctggccaggcaga

SEQ ID NO: 3691580 - DNA, 18 bp, Homo sapiens
agtcctggatgttgtgtg

SEQ ID NO: 3691581 - DNA, 23 bp, Homo sapiens
agtcctgggagaggacagggact

SEQ ID NO: 3691582 - DNA, 22 bp, Homo sapiens
cagaatgttgattacagtgcag

SEQ ID NO: 3691583 - DNA, 18 bp, Homo sapiens
cagacacaggccctccct

SEQ ID NO: 3691584 - DNA, 12 bp, Homo sapiens
cagacacccagg

SEQ ID NO: 3691585 - DNA, 17 bp, Homo sapiens
cagacacccaggactta

SEQ ID NO: 3691586 - DNA, 14 bp, Homo sapiens
cagacaccttggac

SEQ ID NO: 3691587 - DNA, 18 bp, Homo sapiens
cagacaccttggacatcc

SEQ ID NO: 3691588 - DNA, 19 bp, Homo sapiens
cagacacgagccacctcac

SEQ ID NO: 3691589 - DNA, 11 bp, Homo sapiens
cagacagatga

SEQ ID NO: 3691590 - DNA, 18 bp, Homo sapiens
cagacagatgaggctttc

SEQ ID NO: 3691591 - DNA, 21 bp, Homo sapiens
cagacagatggaaaagggaga

SEQ ID NO: 3691592 - DNA, 14 bp, Homo sapiens
cagacaggctctta

SEQ ID NO: 3691593 - DNA, 18 bp, Homo sapiens
cagacaggctcttagcag

SEQ ID NO: 3691594 - DNA, 20 bp, Homo sapiens
cagacaggctcttagcagct

SEQ ID NO: 3691595 - DNA, 15 bp, Homo sapiens
cagacatatttaact

SEQ ID NO: 3691596 - DNA, 21 bp, Homo sapiens
cagacattctgccaggccccc

SEQ ID NO: 3691597 - DNA, 14 bp, Homo sapiens
cagaccacaaaact

SEQ ID NO: 3691598 - DNA, 13 bp, Homo sapiens
cagacctgatcct

SEQ ID NO: 3691599 - DNA, 14 bp, Homo sapiens
cagactcagacatt

SEQ ID NO: 3691600 - DNA, 14 bp, Homo sapiens
cagactggggcatc

SEQ ID NO: 3691601 - DNA, 22 bp, Homo sapiens
cagactggggcatcctgtgcca

SEQ ID NO: 3691602 - DNA, 18 bp, Homo sapiens
cagagaaaggggagccca

SEQ ID NO: 3691603 - DNA, 20 bp, Homo sapiens
cagagaagccaaaagattgg

SEQ ID NO: 3691604 - DNA, 12 bp, Homo sapiens
cagagaataaaa

SEQ ID NO: 3691605 - DNA, 21 bp, Homo sapiens
cagagacatacttgaagggcc

SEQ ID NO: 3691606 - DNA, 23 bp, Homo sapiens
cagagacatacttgaagggccag

SEQ ID NO: 3691607 - DNA, 16 bp, Homo sapiens
cagagaccaggctgtg

SEQ ID NO: 3691608 - DNA, 19 bp, Homo sapiens
cagagagaaatcaggcctg

SEQ ID NO: 3691609 - DNA, 23 bp, Homo sapiens
cagagagaaatcaggcctgatga

SEQ ID NO: 3691610 - DNA, 18 bp, Homo sapiens
cagagaggactgtaggga

SEQ ID NO: 3691611 - DNA, 19 bp, Homo sapiens
cagagatccaaaagaagcc

SEQ ID NO: 3691612 - DNA, 21 bp, Homo sapiens
cagagatccaaaagaagcccc

SEQ ID NO: 3691613 - DNA, 20 bp, Homo sapiens
cagagatgcaccaccaagcc

SEQ ID NO: 3691614 - DNA, 21 bp, Homo sapiens
cagagccaaggggcttcaggt

SEQ ID NO: 3691615 - DNA, 12 bp, Homo sapiens
cagagccactct

SEQ ID NO: 3691616 - DNA, 13 bp, Homo sapiens
cagagcccagctc

SEQ ID NO: 3691617 - DNA, 19 bp, Homo sapiens
cagagccttcaagtgccaa

SEQ ID NO: 3691618 - DNA, 21 bp, Homo sapiens
cagagccttcaagtgccaaac

SEQ ID NO: 3691619 - DNA, 9 bp, Homo sapiens
cagagctgg

SEQ ID NO: 3691620 - DNA, 20 bp, Homo sapiens
cagagctgggatgtttctgt

SEQ ID NO: 3691621 - DNA, 22 bp, Homo sapiens
cagagctgtttatggcctcagc

SEQ ID NO: 3691622 - DNA, 21 bp, Homo sapiens
cagagcttctcctgaccaggg

SEQ ID NO: 3691623 - DNA, 13 bp, Homo sapiens
cagaggaaggaga

SEQ ID NO: 3691624 - DNA, 19 bp, Homo sapiens
cagaggaggggccgctgcc

SEQ ID NO: 3691625 - DNA, 20 bp, Homo sapiens
cagaggccagaggcccccag

SEQ ID NO: 3691626 - DNA, 14 bp, Homo sapiens
cagaggccccagcc

SEQ ID NO: 3691627 - DNA, 17 bp, Homo sapiens
cagaggccccagcctcc

SEQ ID NO: 3691628 - DNA, 19 bp, Homo sapiens
cagaggcccccagcccagg

SEQ ID NO: 3691629 - DNA, 15 bp, Homo sapiens
cagaggccttgctgt

SEQ ID NO: 3691630 - DNA, 13 bp, Homo sapiens
cagaggtaccctg

SEQ ID NO: 3691631 - DNA, 17 bp, Homo sapiens
cagaggtaccctgggtg

SEQ ID NO: 3691632 - DNA, 23 bp, Homo sapiens
cagagtcggaacggagaaaggtg

SEQ ID NO: 3691633 - DNA, 21 bp, Homo sapiens
cagagtgaaaaatcttaagta

SEQ ID NO: 3691634 - DNA, 11 bp, Homo sapiens
cagagtgccac

SEQ ID NO: 3691635 - DNA, 23 bp, Homo sapiens
cagagtggcctggccaggagctc

SEQ ID NO: 3691636 - DNA, 22 bp, Homo sapiens
cagataaggtaaaatgccatga

SEQ ID NO: 3691637 - DNA, 22 bp, Homo sapiens
cagatcaaagtatgtatgtttt

SEQ ID NO: 3691638 - DNA, 13 bp, Homo sapiens
cagatccagcctg

SEQ ID NO: 3691639 - DNA, 14 bp, Homo sapiens
cagatccagcctgg

SEQ ID NO: 3691640 - DNA, 15 bp, Homo sapiens
cagatccagcctggg

SEQ ID NO: 3691641 - DNA, 12 bp, Homo sapiens
cagatccaggac

SEQ ID NO: 3691642 - DNA, 14 bp, Homo sapiens
cagatccagggaca

SEQ ID NO: 3691643 - DNA, 23 bp, Homo sapiens
cagatccagggacagaggcccca

SEQ ID NO: 3691644 - DNA, 15 bp, Homo sapiens
cagatctggaacctc

SEQ ID NO: 3691645 - DNA, 19 bp, Homo sapiens
cagatctggaacctcagcc

SEQ ID NO: 3691646 - DNA, 18 bp, Homo sapiens
cagatctggtcccttgca

SEQ ID NO: 3691647 - DNA, 12 bp, Homo sapiens
cagatctgtgcc

SEQ ID NO: 3691648 - DNA, 13 bp, Homo sapiens
cagatctgtgccc

SEQ ID NO: 3691649 - DNA, 14 bp, Homo sapiens
cagatctgtgcccc

SEQ ID NO: 3691650 - DNA, 15 bp, Homo sapiens
cagatctgtgcccca

SEQ ID NO: 3691651 - DNA, 21 bp, Homo sapiens
cagatctgtgccccatgcctg

SEQ ID NO: 3691652 - DNA, 23 bp, Homo sapiens
cagatctgtgccccatgcctgtc

SEQ ID NO: 3691653 - DNA, 21 bp, Homo sapiens
cagatcttccgtggtcagagt

SEQ ID NO: 3691654 - DNA, 22 bp, Homo sapiens
cagatcttccgtggtcagagtg

SEQ ID NO: 3691655 - DNA, 23 bp, Homo sapiens
cagatcttccgtggtcagagtgc

SEQ ID NO: 3691656 - DNA, 18 bp, Homo sapiens
cagatgccccagagctgt

SEQ ID NO: 3691657 - DNA, 17 bp, Homo sapiens
cagatggaaaaataaca

SEQ ID NO: 3691658 - DNA, 20 bp, Homo sapiens
cagatggaaccgcaggaagc

SEQ ID NO: 3691659 - DNA, 14 bp, Homo sapiens
cagatgtaatgttt

SEQ ID NO: 3691660 - DNA, 15 bp, Homo sapiens
cagatgtaatgtttt

SEQ ID NO: 3691661 - DNA, 22 bp, Homo sapiens
cagattgggcggggcttctctt

SEQ ID NO: 3691662 - DNA, 11 bp, Homo sapiens
cagcaaaccat

SEQ ID NO: 3691663 - DNA, 21 bp, Homo sapiens
cagcaaaccatttttaaagta

SEQ ID NO: 3691664 - DNA, 13 bp, Homo sapiens
cagcaaattttca

SEQ ID NO: 3691665 - DNA, 22 bp, Homo sapiens
cagcaaggtgtggaggctcctg

SEQ ID NO: 3691666 - DNA, 17 bp, Homo sapiens
cagcacagcttgacctg

SEQ ID NO: 3691667 - DNA, 22 bp, Homo sapiens
cagcacagcttgacctgaggct

SEQ ID NO: 3691668 - DNA, 15 bp, Homo sapiens
cagcaccgaggggcc

SEQ ID NO: 3691669 - DNA, 13 bp, Homo sapiens
cagcaccttgtgc

SEQ ID NO: 3691670 - DNA, 13 bp, Homo sapiens
cagcactgtccct

SEQ ID NO: 3691671 - DNA, 19 bp, Homo sapiens
cagcactttgggaggctga

SEQ ID NO: 3691672 - DNA, 20 bp, Homo sapiens
cagcagactgtgtttcgtga

SEQ ID NO: 3691673 - DNA, 18 bp, Homo sapiens
cagcagcctggaccctgt

SEQ ID NO: 3691674 - DNA, 23 bp, Homo sapiens
cagcagggaaaatgcagcaggga

SEQ ID NO: 3691675 - DNA, 18 bp, Homo sapiens
cagcagggatgccctgga

SEQ ID NO: 3691676 - DNA, 19 bp, Homo sapiens
cagcagtttccgaggctga

SEQ ID NO: 3691677 - DNA, 20 bp, Homo sapiens
cagcattccagcccctctgg

SEQ ID NO: 3691678 - DNA, 20 bp, Homo sapiens
cagcatttgattaacatttg

SEQ ID NO: 3691679 - DNA, 16 bp, Homo sapiens
cagccaaagcctcctc

SEQ ID NO: 3691680 - DNA, 23 bp, Homo sapiens
cagccaaggttttataaggctga

SEQ ID NO: 3691681 - DNA, 11 bp, Homo sapiens
cagccaccccg

SEQ ID NO: 3691682 - DNA, 20 bp, Homo sapiens
cagccaccccgggctctctg

SEQ ID NO: 3691683 - DNA, 12 bp, Homo sapiens
cagccagcacct

SEQ ID NO: 3691684 - DNA, 13 bp, Homo sapiens
cagccagcacctg

SEQ ID NO: 3691685 - DNA, 14 bp, Homo sapiens
cagccaggagctgg

SEQ ID NO: 3691686 - DNA, 16 bp, Homo sapiens
cagccaggagctgggc

SEQ ID NO: 3691687 - DNA, 16 bp, Homo sapiens
cagccagtgacctgag

SEQ ID NO: 3691688 - DNA, 19 bp, Homo sapiens
cagccagtgacctgaggaa

SEQ ID NO: 3691689 - DNA, 15 bp, Homo sapiens
cagcccaagattctt

SEQ ID NO: 3691690 - DNA, 12 bp, Homo sapiens
cagcccaccctg

SEQ ID NO: 3691691 - DNA, 13 bp, Homo sapiens
cagcccaccctgc

SEQ ID NO: 3691692 - DNA, 14 bp, Homo sapiens
cagcccaccctgct

SEQ ID NO: 3691693 - DNA, 11 bp, Homo sapiens
cagcccagaga

SEQ ID NO: 3691694 - DNA, 22 bp, Homo sapiens
cagcccagagacatacttgaag

SEQ ID NO: 3691695 - DNA, 19 bp, Homo sapiens
cagcccagggctcctgcac

SEQ ID NO: 3691696 - DNA, 16 bp, Homo sapiens
cagcccatgcccacct

SEQ ID NO: 3691697 - DNA, 17 bp, Homo sapiens
cagcccatgcccacctg

SEQ ID NO: 3691698 - DNA, 12 bp, Homo sapiens
cagccccaccca

SEQ ID NO: 3691699 - DNA, 17 bp, Homo sapiens
cagcccccaaccccaag

SEQ ID NO: 3691700 - DNA, 18 bp, Homo sapiens
cagcccccaaccccaaga

SEQ ID NO: 3691701 - DNA, 14 bp, Homo sapiens
cagcccctctggtc

SEQ ID NO: 3691702 - DNA, 16 bp, Homo sapiens
cagcccctctggtcgc

SEQ ID NO: 3691703 - DNA, 18 bp, Homo sapiens
cagcccctctggtcgctc

SEQ ID NO: 3691704 - DNA, 23 bp, Homo sapiens
cagccgccattgccaccaggaga

SEQ ID NO: 3691705 - DNA, 18 bp, Homo sapiens
cagcctccctgaagcctt

SEQ ID NO: 3691706 - DNA, 17 bp, Homo sapiens
cagcctctgaaaaccaa

SEQ ID NO: 3691707 - DNA, 13 bp, Homo sapiens
cagcctctgccac

SEQ ID NO: 3691708 - DNA, 21 bp, Homo sapiens
cagcctcttctgtcccaagtc

SEQ ID NO: 3691709 - DNA, 22 bp, Homo sapiens
cagcctcttctgtcccaagtct

SEQ ID NO: 3691710 - DNA, 14 bp, Homo sapiens
cagcctgccccgga

SEQ ID NO: 3691711 - DNA, 19 bp, Homo sapiens
cagcctgctccagctgttc

SEQ ID NO: 3691712 - DNA, 20 bp, Homo sapiens
cagcctgctccagctgttca

SEQ ID NO: 3691713 - DNA, 13 bp, Homo sapiens
cagcctggccaga

SEQ ID NO: 3691714 - DNA, 18 bp, Homo sapiens
cagcctggccagacacag

SEQ ID NO: 3691715 - DNA, 17 bp, Homo sapiens
cagcctgggcagccagg

SEQ ID NO: 3691716 - DNA, 20 bp, Homo sapiens
cagcctggtggcccagctat

SEQ ID NO: 3691717 - DNA, 14 bp, Homo sapiens
cagcctgtgtcttt

SEQ ID NO: 3691718 - DNA, 13 bp, Homo sapiens
cagccttgccaga

SEQ ID NO: 3691719 - DNA, 15 bp, Homo sapiens
cagccttgccagaga

SEQ ID NO: 3691720 - DNA, 23 bp, Homo sapiens
cagccttggtgggggagcctctg

SEQ ID NO: 3691721 - DNA, 22 bp, Homo sapiens
cagcctttatcaagcttagtga

SEQ ID NO: 3691722 - DNA, 19 bp, Homo sapiens
cagcctttgatcaggtggg

SEQ ID NO: 3691723 - DNA, 17 bp, Homo sapiens
cagcgactccgttggcc

SEQ ID NO: 3691724 - DNA, 22 bp, Homo sapiens
cagcgactccgttggccactcc

SEQ ID NO: 3691725 - DNA, 18 bp, Homo sapiens
cagcgcccctcagcctct

SEQ ID NO: 3691726 - DNA, 14 bp, Homo sapiens
cagcgcctttccca

SEQ ID NO: 3691727 - DNA, 22 bp, Homo sapiens
cagcggaggtgtggagccgagg

SEQ ID NO: 3691728 - DNA, 20 bp, Homo sapiens
cagcgggcaggttctgcctg

SEQ ID NO: 3691729 - DNA, 21 bp, Homo sapiens
cagcgtcagctgctccctggc

SEQ ID NO: 3691730 - DNA, 16 bp, Homo sapiens
cagcgtgccgagccag

SEQ ID NO: 3691731 - DNA, 16 bp, Homo sapiens
cagctaagaacctgga

SEQ ID NO: 3691732 - DNA, 16 bp, Homo sapiens
cagctacacagagctt

SEQ ID NO: 3691733 - DNA, 17 bp, Homo sapiens
cagctatgggagcccca

SEQ ID NO: 3691734 - DNA, 18 bp, Homo sapiens
cagctatgggagccccag

SEQ ID NO: 3691735 - DNA, 20 bp, Homo sapiens
cagctatgggagccccaggg

SEQ ID NO: 3691736 - DNA, 22 bp, Homo sapiens
cagctatgggagccccagggtc

SEQ ID NO: 3691737 - DNA, 19 bp, Homo sapiens
cagctcaaaggcacagtga

SEQ ID NO: 3691738 - DNA, 15 bp, Homo sapiens
cagctcaagagatcc

SEQ ID NO: 3691739 - DNA, 13 bp, Homo sapiens
cagctcaggacag

SEQ ID NO: 3691740 - DNA, 19 bp, Homo sapiens
cagctcaggacagatgcca

SEQ ID NO: 3691741 - DNA, 22 bp, Homo sapiens
cagctcaggacagatgccacac

SEQ ID NO: 3691742 - DNA, 16 bp, Homo sapiens
cagctccagttggagt

SEQ ID NO: 3691743 - DNA, 15 bp, Homo sapiens
cagctctgcaagaat

SEQ ID NO: 3691744 - DNA, 16 bp, Homo sapiens
cagctctgcaagaatt

SEQ ID NO: 3691745 - DNA, 23 bp, Homo sapiens
cagctctggacagccccaccctg

SEQ ID NO: 3691746 - DNA, 21 bp, Homo sapiens
cagctctgtgggccctaccct

SEQ ID NO: 3691747 - DNA, 20 bp, Homo sapiens
cagctgaccgggtcacacaa

SEQ ID NO: 3691748 - DNA, 12 bp, Homo sapiens
cagctgcactga

SEQ ID NO: 3691749 - DNA, 16 bp, Homo sapiens
cagctgcatctgtctg

SEQ ID NO: 3691750 - DNA, 22 bp, Homo sapiens
cagctgcccagcccctcctccc

SEQ ID NO: 3691751 - DNA, 17 bp, Homo sapiens
cagctgcctcacttcct

SEQ ID NO: 3691752 - DNA, 18 bp, Homo sapiens
cagctgctccctggcatt

SEQ ID NO: 3691753 - DNA, 15 bp, Homo sapiens
cagctggcagcagag

SEQ ID NO: 3691754 - DNA, 13 bp, Homo sapiens
cagctggcaggag

SEQ ID NO: 3691755 - DNA, 20 bp, Homo sapiens
cagctgggccgggacccagg

SEQ ID NO: 3691756 - DNA, 23 bp, Homo sapiens
cagctgggccgggacccagggcc

SEQ ID NO: 3691757 - DNA, 11 bp, Homo sapiens
cagctgtgctt

SEQ ID NO: 3691758 - DNA, 14 bp, Homo sapiens
cagctgtgtctgag

SEQ ID NO: 3691759 - DNA, 15 bp, Homo sapiens
cagctgtgtctgagc

SEQ ID NO: 3691760 - DNA, 20 bp, Homo sapiens
cagctgtgtctgagcccaac

SEQ ID NO: 3691761 - DNA, 17 bp, Homo sapiens
cagcttaggggctgctg

SEQ ID NO: 3691762 - DNA, 15 bp, Homo sapiens
cagcttctcctgtgt

SEQ ID NO: 3691763 - DNA, 21 bp, Homo sapiens
cagcttgacctgaggctgtgg

SEQ ID NO: 3691764 - DNA, 15 bp, Homo sapiens
cagctttgaggaaca

SEQ ID NO: 3691765 - DNA, 14 bp, Homo sapiens
cagctttgctgctg

SEQ ID NO: 3691766 - DNA, 16 bp, Homo sapiens
caggaaccacaccaca

SEQ ID NO: 3691767 - DNA, 15 bp, Homo sapiens
caggaagcaccccat

SEQ ID NO: 3691768 - DNA, 21 bp, Homo sapiens
caggaagccgtgccctgcccc

SEQ ID NO: 3691769 - DNA, 12 bp, Homo sapiens
caggaagctcag

SEQ ID NO: 3691770 - DNA, 14 bp, Homo sapiens
caggaaggagagcc

SEQ ID NO: 3691771 - DNA, 15 bp, Homo sapiens
caggaaggagagcct

SEQ ID NO: 3691772 - DNA, 17 bp, Homo sapiens
caggaaggagagcctgc

SEQ ID NO: 3691773 - DNA, 19 bp, Homo sapiens
caggaatattgtcatcctt

SEQ ID NO: 3691774 - DNA, 14 bp, Homo sapiens
caggaatcccggct

SEQ ID NO: 3691775 - DNA, 22 bp, Homo sapiens
cattgtcgtataggcatgtaaa

SEQ ID NO: 3691776 - DNA, 19 bp, Homo sapiens
cattgtctcctatatattt

SEQ ID NO: 3691777 - DNA, 19 bp, Homo sapiens
cattgttcttattctggca

SEQ ID NO: 3691778 - DNA, 20 bp, Homo sapiens
cattgttcttattctggcat

SEQ ID NO: 3691779 - DNA, 18 bp, Homo sapiens
catttcattagccatgca

SEQ ID NO: 3691780 - DNA, 12 bp, Homo sapiens
catttccaagct

SEQ ID NO: 3691781 - DNA, 14 bp, Homo sapiens
catttccaagctgt

SEQ ID NO: 3691782 - DNA, 23 bp, Homo sapiens
catttctaattaaccttactaat

SEQ ID NO: 3691783 - DNA, 17 bp, Homo sapiens
catttctgaactgttac

SEQ ID NO: 3691784 - DNA, 15 bp, Homo sapiens
catttcttgtgttct

SEQ ID NO: 3691785 - DNA, 17 bp, Homo sapiens
catttgatgcatgtctt

SEQ ID NO: 3691786 - DNA, 23 bp, Homo sapiens
catttggattggggtccctctaa

SEQ ID NO: 3691787 - DNA, 15 bp, Homo sapiens
catttggccggctct

SEQ ID NO: 3691788 - DNA, 22 bp, Homo sapiens
catttggggtagctagaggaac

SEQ ID NO: 3691789 - DNA, 22 bp, Homo sapiens
catttgtgttttgaaagcccaa

SEQ ID NO: 3691790 - DNA, 19 bp, Homo sapiens
cattttattttttcttgca

SEQ ID NO: 3691791 - DNA, 14 bp, Homo sapiens
cattttcagagtga

SEQ ID NO: 3691792 - DNA, 15 bp, Homo sapiens
cattttccccccact

SEQ ID NO: 3691793 - DNA, 20 bp, Homo sapiens
cattttccccccactctccc

SEQ ID NO: 3691794 - DNA, 23 bp, Homo sapiens
catttttaaagtagaagagggtt

SEQ ID NO: 3691795 - DNA, 12 bp, Homo sapiens
catttttatcta

SEQ ID NO: 3691796 - DNA, 18 bp, Homo sapiens
catttttgaatacaggca

SEQ ID NO: 3691797 - DNA, 20 bp, Homo sapiens
catttttgaatacaggcata

SEQ ID NO: 3691798 - DNA, 21 bp, Homo sapiens
catttttgtggttttgagaaa

SEQ ID NO: 3691799 - DNA, 11 bp, Homo sapiens
ccaaaaacaaa

SEQ ID NO: 3691800 - DNA, 23 bp, Homo sapiens
ccaaaatgtaggcttagtttgtg

SEQ ID NO: 3691801 - DNA, 13 bp, Homo sapiens
ccaaacctggttc

SEQ ID NO: 3691802 - DNA, 22 bp, Homo sapiens
ccaaacttctgaactttggaag

SEQ ID NO: 3691803 - DNA, 19 bp, Homo sapiens
ccaaagctagggtggccct

SEQ ID NO: 3691804 - DNA, 23 bp, Homo sapiens
ccaaagctagggtggcccttgca

SEQ ID NO: 3691805 - DNA, 21 bp, Homo sapiens
ccaaagctgagcctgcaggga

SEQ ID NO: 3691806 - DNA, 16 bp, Homo sapiens
ccaaagctttcctgcc

SEQ ID NO: 3691807 - DNA, 17 bp, Homo sapiens
ccaaagctttcctgccc

SEQ ID NO: 3691808 - DNA, 20 bp, Homo sapiens
ccaaagctttcctgccccag

SEQ ID NO: 3691809 - DNA, 18 bp, Homo sapiens
ccaaaggaggctggcagg

SEQ ID NO: 3691810 - DNA, 12 bp, Homo sapiens
ccaaaggcagcg

SEQ ID NO: 3691811 - DNA, 21 bp, Homo sapiens
ccaaaggctggtggcaagtgc

SEQ ID NO: 3691812 - DNA, 21 bp, Homo sapiens
ccaaagtgccggtgagaccca

SEQ ID NO: 3691813 - DNA, 15 bp, Homo sapiens
ccaaatatgtcctgg

SEQ ID NO: 3691814 - DNA, 22 bp, Homo sapiens
ccaaatcaaaagactttttcct

SEQ ID NO: 3691815 - DNA, 14 bp, Homo sapiens
ccaaatcacccaat

SEQ ID NO: 3691816 - DNA, 18 bp, Homo sapiens
ccaaatcacccaatccca

SEQ ID NO: 3691817 - DNA, 20 bp, Homo sapiens
ccaaatcacccaatcccagt

SEQ ID NO: 3691818 - DNA, 21 bp, Homo sapiens
ccaaatccttagatctggcat

SEQ ID NO: 3691819 - DNA, 22 bp, Homo sapiens
ccaaatctcaatgaagccagct

SEQ ID NO: 3691820 - DNA, 14 bp, Homo sapiens
ccaaatctggaagc

SEQ ID NO: 3691821 - DNA, 12 bp, Homo sapiens
ccaacaaaccat

SEQ ID NO: 3691822 - DNA, 13 bp, Homo sapiens
ccaacaaaccatc

SEQ ID NO: 3691823 - DNA, 13 bp, Homo sapiens
ccaacacttccag

SEQ ID NO: 3691824 - DNA, 15 bp, Homo sapiens
ccaacaggagctggg

SEQ ID NO: 3691825 - DNA, 13 bp, Homo sapiens
ccaacccccaccc

SEQ ID NO: 3691826 - DNA, 19 bp, Homo sapiens
ccaacccccaccccacact

SEQ ID NO: 3691827 - DNA, 20 bp, Homo sapiens
ccaacccccaccccacactt

SEQ ID NO: 3691828 - DNA, 23 bp, Homo sapiens
ccaaccccctgtaaggttccatc

SEQ ID NO: 3691829 - DNA, 20 bp, Homo sapiens
ccaacccgtgcccctgggat

SEQ ID NO: 3691830 - DNA, 16 bp, Homo sapiens
ccaaccgtgtctgtct

SEQ ID NO: 3691831 - DNA, 22 bp, Homo sapiens
ccaacggagagcgcctgcccct

SEQ ID NO: 3691832 - DNA, 20 bp, Homo sapiens
ccaacggccctgcagccagc

SEQ ID NO: 3691833 - DNA, 21 bp, Homo sapiens
ccaactctagctgggggtggg

SEQ ID NO: 3691834 - DNA, 16 bp, Homo sapiens
ccaactgggcccaaga

SEQ ID NO: 3691835 - DNA, 17 bp, Homo sapiens
ccaactgggcccaagac

SEQ ID NO: 3691836 - DNA, 22 bp, Homo sapiens
ccaagacagatgccccagagct

SEQ ID NO: 3691837 - DNA, 24 bp, Homo sapiens
ccaagacagatgccccagagctgt

SEQ ID NO: 3691838 - DNA, 22 bp, Homo sapiens
ccaagagcccaaaagagggcac

SEQ ID NO: 3691839 - DNA, 22 bp, Homo sapiens
ccaagagctgaggcaattctaa

SEQ ID NO: 3691840 - DNA, 13 bp, Homo sapiens
ccaagattcttca

SEQ ID NO: 3691841 - DNA, 18 bp, Homo sapiens
ccaagcacttctttttct

SEQ ID NO: 3691842 - DNA, 18 bp, Homo sapiens
ccaagcaggaagctcaga

SEQ ID NO: 3691843 - DNA, 22 bp, Homo sapiens
ccaagcatcttgggggggtggc

SEQ ID NO: 3691844 - DNA, 22 bp, Homo sapiens
ccaagccaagggaacctgtgtc

SEQ ID NO: 3691845 - DNA, 17 bp, Homo sapiens
ccaagccagaggctggg

SEQ ID NO: 3691846 - DNA, 19 bp, Homo sapiens
ccaagccagaggctgggtt

SEQ ID NO: 3691847 - DNA, 19 bp, Homo sapiens
ccaagctccttgggaggcc

SEQ ID NO: 3691848 - DNA, 13 bp, Homo sapiens
ccaagctgtgctg

SEQ ID NO: 3691849 - DNA, 17 bp, Homo sapiens
ccaagcttagtcctggg

SEQ ID NO: 3691850 - DNA, 19 bp, Homo sapiens
ccaagcttagtcctgggag

SEQ ID NO: 3691851 - DNA, 23 bp, Homo sapiens
ccaagcttgtccaacccgaggcc

SEQ ID NO: 3691852 - DNA, 15 bp, Homo sapiens
ccaaggagctgctat

SEQ ID NO: 3691853 - DNA, 22 bp, Homo sapiens
ccaaggagctgctatagcctgg

SEQ ID NO: 3691854 - DNA, 14 bp, Homo sapiens
ccaaggctggcagg

SEQ ID NO: 3691855 - DNA, 14 bp, Homo sapiens
ccaaggctggggga

SEQ ID NO: 3691856 - DNA, 18 bp, Homo sapiens
ccaagggaacctgtgtcc

SEQ ID NO: 3691857 - DNA, 19 bp, Homo sapiens
ccaagggaacctgtgtccg

SEQ ID NO: 3691858 - DNA, 21 bp, Homo sapiens
ccaaggtgctgatgtcaaagt

SEQ ID NO: 3691859 - DNA, 13 bp, Homo sapiens
ccaaggtgggagg

SEQ ID NO: 3691860 - DNA, 18 bp, Homo sapiens
ccaaggtgggaggattgc

SEQ ID NO: 3691861 - DNA, 20 bp, Homo sapiens
ccaagtacttaactatctgt

SEQ ID NO: 3691862 - DNA, 16 bp, Homo sapiens
ccaagtctcagaagag

SEQ ID NO: 3691863 - DNA, 16 bp, Homo sapiens
ccaagtctccagagag

SEQ ID NO: 3691864 - DNA, 22 bp, Homo sapiens
agagccaggggggtgaggagct

SEQ ID NO: 3691865 - DNA, 23 bp, Homo sapiens
agagccaggggggtgaggagctg

SEQ ID NO: 3691866 - DNA, 15 bp, Homo sapiens
agagccttcaagtgc

SEQ ID NO: 3691867 - DNA, 20 bp, Homo sapiens
agagccttcaagtgccaaac

SEQ ID NO: 3691868 - DNA, 15 bp, Homo sapiens
agagcgcctgcccct

SEQ ID NO: 3691869 - DNA, 20 bp, Homo sapiens
agagcgcctgcccctcccag

SEQ ID NO: 3691870 - DNA, 16 bp, Homo sapiens
agagctggtgcccgga

SEQ ID NO: 3691871 - DNA, 21 bp, Homo sapiens
agagctgtttatggcctcagc

SEQ ID NO: 3691872 - DNA, 17 bp, Homo sapiens
agagcttctcctgacca

SEQ ID NO: 3691873 - DNA, 19 bp, Homo sapiens
agagcttctcctgaccagg

SEQ ID NO: 3691874 - DNA, 22 bp, Homo sapiens
agagctttcttcccgaacccca

SEQ ID NO: 3691875 - DNA, 17 bp, Homo sapiens
agaggacagtctggaga

SEQ ID NO: 3691876 - DNA, 17 bp, Homo sapiens
agaggaccagggccttt

SEQ ID NO: 3691877 - DNA, 22 bp, Homo sapiens
agaggactgtagggagggcggc

SEQ ID NO: 3691878 - DNA, 20 bp, Homo sapiens
agaggaggggccgctgccac

SEQ ID NO: 3691879 - DNA, 22 bp, Homo sapiens
agaggaggggccgctgccaccc

SEQ ID NO: 3691880 - DNA, 22 bp, Homo sapiens
agaggattaggttccatccttt

SEQ ID NO: 3691881 - DNA, 24 bp, Homo sapiens
agaggcaccactaaaagatcgcag

SEQ ID NO: 3691882 - DNA, 13 bp, Homo sapiens
agaggccagaggc

SEQ ID NO: 3691883 - DNA, 17 bp, Homo sapiens
agaggcccccagcccag

SEQ ID NO: 3691884 - DNA, 20 bp, Homo sapiens
agaggcccccagcccagggc

SEQ ID NO: 3691885 - DNA, 22 bp, Homo sapiens
agaggcccccagcccagggctc

SEQ ID NO: 3691886 - DNA, 17 bp, Homo sapiens
agaggctgaggcctgga

SEQ ID NO: 3691887 - DNA, 20 bp, Homo sapiens
agagggacggccaagaatgt

SEQ ID NO: 3691888 - DNA, 22 bp, Homo sapiens
agagggacggccaagaatgtac

SEQ ID NO: 3691889 - DNA, 20 bp, Homo sapiens
agagggaggggcctaggcct

SEQ ID NO: 3691890 - DNA, 16 bp, Homo sapiens
agagggtatttttgta

SEQ ID NO: 3691891 - DNA, 15 bp, Homo sapiens
agagggtgtcatcta

SEQ ID NO: 3691892 - DNA, 17 bp, Homo sapiens
agaggtaccctgggtgt

SEQ ID NO: 3691893 - DNA, 22 bp, Homo sapiens
agaggtccagccccccaggctg

SEQ ID NO: 3691894 - DNA, 22 bp, Homo sapiens
agaggtgtttttataatatcca

SEQ ID NO: 3691895 - DNA, 14 bp, Homo sapiens
agagtagttatata

SEQ ID NO: 3691896 - DNA, 22 bp, Homo sapiens
agagtgatagtcttttgctttt

SEQ ID NO: 3691897 - DNA, 15 bp, Homo sapiens
agagtggcctggcca

SEQ ID NO: 3691898 - DNA, 16 bp, Homo sapiens
agagtggcctggccag

SEQ ID NO: 3691899 - DNA, 18 bp, Homo sapiens
agagtgtagactgtggct

SEQ ID NO: 3691900 - DNA, 21 bp, Homo sapiens
agagttagtcgccctacagaa

SEQ ID NO: 3691901 - DNA, 23 bp, Homo sapiens
agagttagtcgccctacagaaaa

SEQ ID NO: 3691902 - DNA, 21 bp, Homo sapiens
agataaagatgatattaagaa

SEQ ID NO: 3691903 - DNA, 13 bp, Homo sapiens
agataactaggaa

SEQ ID NO: 3691904 - DNA, 18 bp, Homo sapiens
agataattctagctttga

SEQ ID NO: 3691905 - DNA, 21 bp, Homo sapiens
agataattgtttcattcatcc

SEQ ID NO: 3691906 - DNA, 19 bp, Homo sapiens
agataggcttaacaaatgg

SEQ ID NO: 3691907 - DNA, 14 bp, Homo sapiens
agatattggacaaa

SEQ ID NO: 3691908 - DNA, 16 bp, Homo sapiens
agatattggacaaaga

SEQ ID NO: 3691909 - DNA, 17 bp, Homo sapiens
agatcaaagtatgtatg

SEQ ID NO: 3691910 - DNA, 15 bp, Homo sapiens
agatcaagagatcaa

SEQ ID NO: 3691911 - DNA, 15 bp, Homo sapiens
agatcagcctgggca

SEQ ID NO: 3691912 - DNA, 13 bp, Homo sapiens
agatccagcctgg

SEQ ID NO: 3691913 - DNA, 12 bp, Homo sapiens
agatcctcctgc

SEQ ID NO: 3691914 - DNA, 14 bp, Homo sapiens
agatcgcagtttgc

SEQ ID NO: 3691915 - DNA, 18 bp, Homo sapiens
agatctctgctttggaaa

SEQ ID NO: 3691916 - DNA, 15 bp, Homo sapiens
agatctggaacctca

SEQ ID NO: 3691917 - DNA, 13 bp, Homo sapiens
agatctggcatgt

SEQ ID NO: 3691918 - DNA, 19 bp, Homo sapiens
agatctgtcctcagccttg

SEQ ID NO: 3691919 - DNA, 13 bp, Homo sapiens
agatctgtgcccc

SEQ ID NO: 3691920 - DNA, 16 bp, Homo sapiens
agatctgtgccccatg

SEQ ID NO: 3691921 - DNA, 19 bp, Homo sapiens
agatctgtgccccatgcct

SEQ ID NO: 3691922 - DNA, 17 bp, Homo sapiens
agatcttccgtggtcag

SEQ ID NO: 3691923 - DNA, 20 bp, Homo sapiens
agatcttccgtggtcagagt

SEQ ID NO: 3691924 - DNA, 16 bp, Homo sapiens
agatgaatgccgtgga

SEQ ID NO: 3691925 - DNA, 16 bp, Homo sapiens
agatgcaaagaggcaa

SEQ ID NO: 3691926 - DNA, 18 bp, Homo sapiens
agatgcaaagaggcaaga

SEQ ID NO: 3691927 - DNA, 15 bp, Homo sapiens
agatgcccaaatcct

SEQ ID NO: 3691928 - DNA, 14 bp, Homo sapiens
agatgctggcccag

SEQ ID NO: 3691929 - DNA, 15 bp, Homo sapiens
agatgctggcccagg

SEQ ID NO: 3691930 - DNA, 17 bp, Homo sapiens
agatgctggcccagggc

SEQ ID NO: 3691931 - DNA, 20 bp, Homo sapiens
agatgctggcccagggccca

SEQ ID NO: 3691932 - DNA, 21 bp, Homo sapiens
agatgctggcccagggcccag

SEQ ID NO: 3691933 - DNA, 22 bp, Homo sapiens
agatgctggcccagggcccaga

SEQ ID NO: 3691934 - DNA, 18 bp, Homo sapiens
agatgcttctcactgcca

SEQ ID NO: 3691935 - DNA, 17 bp, Homo sapiens
agatggaaaaataacaa

SEQ ID NO: 3691936 - DNA, 21 bp, Homo sapiens
agatggaaaaataacaactat

SEQ ID NO: 3691937 - DNA, 18 bp, Homo sapiens
agatggaaccgcaggaag

SEQ ID NO: 3691938 - DNA, 20 bp, Homo sapiens
agatggaaccgcaggaagct

SEQ ID NO: 3691939 - DNA, 20 bp, Homo sapiens
agatgggccggcccccttcc

SEQ ID NO: 3691940 - DNA, 22 bp, Homo sapiens
agatgggccggcccccttcctg

SEQ ID NO: 3691941 - DNA, 22 bp, Homo sapiens
agatgggtggatcacttgaggt

SEQ ID NO: 3691942 - DNA, 15 bp, Homo sapiens
agatgtaaattgaag

SEQ ID NO: 3691943 - DNA, 23 bp, Homo sapiens
agatgtaatgttttctttgcaaa

SEQ ID NO: 3691944 - DNA, 22 bp, Homo sapiens
agattacccaaaaactgtcttt

SEQ ID NO: 3691945 - DNA, 14 bp, Homo sapiens
agattaggtcttgc

SEQ ID NO: 3691946 - DNA, 15 bp, Homo sapiens
agattaggtcttgct

SEQ ID NO: 3691947 - DNA, 17 bp, Homo sapiens
agattaggtcttgctgg

SEQ ID NO: 3691948 - DNA, 21 bp, Homo sapiens
agattaggtcttgctggaaga

SEQ ID NO: 3691949 - DNA, 15 bp, Homo sapiens
agattctactttgaa

SEQ ID NO: 3691950 - DNA, 15 bp, Homo sapiens
agattgacgacaagt

SEQ ID NO: 3691951 - DNA, 16 bp, Homo sapiens
agattgcaccactgca

SEQ ID NO: 3691952 - DNA, 19 bp, Homo sapiens
agatttgtgaactggaaga

SEQ ID NO: 3691953 - DNA, 22 bp, Homo sapiens
agattttttcagacttgtcaag

SEQ ID NO: 3691954 - DNA, 12 bp, Homo sapiens
agcaaaagaaaa

SEQ ID NO: 3691955 - DNA, 18 bp, Homo sapiens
agcaaaaggctgagaagg

SEQ ID NO: 3691956 - DNA, 17 bp, Homo sapiens
agcaaaccatttttaaa

SEQ ID NO: 3691957 - DNA, 23 bp, Homo sapiens
agcaaaccatttttaaagtagaa

SEQ ID NO: 3691958 - DNA, 22 bp, Homo sapiens
agcaaatcaccacaaactgtaa

SEQ ID NO: 3691959 - DNA, 22 bp, Homo sapiens
agcaacaaagattgagaagcca

SEQ ID NO: 3691960 - DNA, 16 bp, Homo sapiens
agcaagaaggaaagat

SEQ ID NO: 3691961 - DNA, 18 bp, Homo sapiens
agcaagcagtagcatttg

SEQ ID NO: 3691962 - DNA, 16 bp, Homo sapiens
agcaaggtgtggaggc

SEQ ID NO: 3691963 - DNA, 13 bp, Homo sapiens
agcaagtgaggcc

SEQ ID NO: 3691964 - DNA, 16 bp, Homo sapiens
agcaagtgttcactgc

SEQ ID NO: 3691965 - DNA, 21 bp, Homo sapiens
agcaagtgttcactgctcctt

SEQ ID NO: 3691966 - DNA, 18 bp, Homo sapiens
ccaccacagccagcacct

SEQ ID NO: 3691967 - DNA, 19 bp, Homo sapiens
ccaccaggccacctcccca

SEQ ID NO: 3691968 - DNA, 19 bp, Homo sapiens
ccaccaggtgcctttcaaa

SEQ ID NO: 3691969 - DNA, 17 bp, Homo sapiens
ccacccacctccctgcc

SEQ ID NO: 3691970 - DNA, 19 bp, Homo sapiens
ccacccacctccctgcctc

SEQ ID NO: 3691971 - DNA, 17 bp, Homo sapiens
ccacccaggagggaggg

SEQ ID NO: 3691972 - DNA, 13 bp, Homo sapiens
ccacccccttctc

SEQ ID NO: 3691973 - DNA, 23 bp, Homo sapiens
ccacccccttctctgctccacca

SEQ ID NO: 3691974 - DNA, 14 bp, Homo sapiens
ccaccccgggctct

SEQ ID NO: 3691975 - DNA, 17 bp, Homo sapiens
ccaccccgggctctctg

SEQ ID NO: 3691976 - DNA, 18 bp, Homo sapiens
ccaccccgggctctctgc

SEQ ID NO: 3691977 - DNA, 14 bp, Homo sapiens
ccaccccttcctca

SEQ ID NO: 3691978 - DNA, 23 bp, Homo sapiens
ccaccccttcctcagcctggggt

SEQ ID NO: 3691979 - DNA, 16 bp, Homo sapiens
ccaccctgaaagccct

SEQ ID NO: 3691980 - DNA, 20 bp, Homo sapiens
ccaccctgggccctgggctg

SEQ ID NO: 3691981 - DNA, 16 bp, Homo sapiens
ccacccttggcctgtc

SEQ ID NO: 3691982 - DNA, 23 bp, Homo sapiens
ccacctgcccatcacagggttgg

SEQ ID NO: 3691983 - DNA, 19 bp, Homo sapiens
ccacctgtcaaacaaagcc

SEQ ID NO: 3691984 - DNA, 20 bp, Homo sapiens
ccacctgtcaaacaaagcca

SEQ ID NO: 3691985 - DNA, 20 bp, Homo sapiens
ccacgcccgtcctgcctgtg

SEQ ID NO: 3691986 - DNA, 20 bp, Homo sapiens
ccacgctcctctgtttgttt

SEQ ID NO: 3691987 - DNA, 22 bp, Homo sapiens
ccactaaaagatcgcagtttgc

SEQ ID NO: 3691988 - DNA, 18 bp, Homo sapiens
ccactaagcagaggaggg

SEQ ID NO: 3691989 - DNA, 19 bp, Homo sapiens
ccactaagcagaggagggg

SEQ ID NO: 3691990 - DNA, 22 bp, Homo sapiens
ccactacatgcagcccatgccc

SEQ ID NO: 3691991 - DNA, 17 bp, Homo sapiens
ccactcaagccaagcag

SEQ ID NO: 3691992 - DNA, 22 bp, Homo sapiens
ccactcactaggcccccacttg

SEQ ID NO: 3691993 - DNA, 15 bp, Homo sapiens
ccactccccggcatg

SEQ ID NO: 3691994 - DNA, 16 bp, Homo sapiens
ccactctaccctccca

SEQ ID NO: 3691995 - DNA, 19 bp, Homo sapiens
ccactctaccctcccaccc

SEQ ID NO: 3691996 - DNA, 20 bp, Homo sapiens
ccactctaccctcccacccc

SEQ ID NO: 3691997 - DNA, 17 bp, Homo sapiens
ccactctatgagttgga

SEQ ID NO: 3691998 - DNA, 17 bp, Homo sapiens
ccactctgcttctctga

SEQ ID NO: 3691999 - DNA, 13 bp, Homo sapiens
ccactctgtggcc

SEQ ID NO: 3692000 - DNA, 19 bp, Homo sapiens
ccactctgtggccagcctg

SEQ ID NO: 3692001 - DNA, 23 bp, Homo sapiens
ccactctgtggccagcctggcat

SEQ ID NO: 3692002 - DNA, 14 bp, Homo sapiens
ccactgagctggct

SEQ ID NO: 3692003 - DNA, 16 bp, Homo sapiens
ccactgagctggctga

SEQ ID NO: 3692004 - DNA, 17 bp, Homo sapiens
ccactgagctggctgac

SEQ ID NO: 3692005 - DNA, 20 bp, Homo sapiens
ccactgcactccagcctggg

SEQ ID NO: 3692006 - DNA, 23 bp, Homo sapiens
ccactgcatcgtttcatcttcca

SEQ ID NO: 3692007 - DNA, 12 bp, Homo sapiens
ccactgccatgt

SEQ ID NO: 3692008 - DNA, 12 bp, Homo sapiens
ccactgccttcg

SEQ ID NO: 3692009 - DNA, 15 bp, Homo sapiens
ccactgccttcgctt

SEQ ID NO: 3692010 - DNA, 18 bp, Homo sapiens
ccactgccttcgcttctt

SEQ ID NO: 3692011 - DNA, 23 bp, Homo sapiens
ccactgccttcgcttcttgcctc

SEQ ID NO: 3692012 - DNA, 20 bp, Homo sapiens
ccactgtcctgggcctgcag

SEQ ID NO: 3692013 - DNA, 20 bp, Homo sapiens
ccactgtgaaccggctccca

SEQ ID NO: 3692014 - DNA, 12 bp, Homo sapiens
ccacttcccctc

SEQ ID NO: 3692015 - DNA, 17 bp, Homo sapiens
ccacttgcctcttcctt

SEQ ID NO: 3692016 - DNA, 17 bp, Homo sapiens
ccactttcttattctgt

SEQ ID NO: 3692017 - DNA, 16 bp, Homo sapiens
ccagaaaacaaaactg

SEQ ID NO: 3692018 - DNA, 16 bp, Homo sapiens
ccagaaaggagactag

SEQ ID NO: 3692019 - DNA, 20 bp, Homo sapiens
ccagaagctgagcaccaggg

SEQ ID NO: 3692020 - DNA, 14 bp, Homo sapiens
ccagacacaggccc

SEQ ID NO: 3692021 - DNA, 13 bp, Homo sapiens
ccagacacccagg

SEQ ID NO: 3692022 - DNA, 13 bp, Homo sapiens
ccagacagcaagg

SEQ ID NO: 3692023 - DNA, 18 bp, Homo sapiens
ccagacagcaaggtgtgg

SEQ ID NO: 3692024 - DNA, 14 bp, Homo sapiens
ccagacatgccaca

SEQ ID NO: 3692025 - DNA, 24 bp, Homo sapiens
ccagacctgatcctggaggcccag

SEQ ID NO: 3692026 - DNA, 18 bp, Homo sapiens
ccagagacatacttgaag

SEQ ID NO: 3692027 - DNA, 23 bp, Homo sapiens
ccagagacatacttgaagggcca

SEQ ID NO: 3692028 - DNA, 20 bp, Homo sapiens
ccagagaccaggctgtgtcc

SEQ ID NO: 3692029 - DNA, 22 bp, Homo sapiens
ccagagcaggaaattcagccca

SEQ ID NO: 3692030 - DNA, 13 bp, Homo sapiens
ccagagccaaggg

SEQ ID NO: 3692031 - DNA, 12 bp, Homo sapiens
ccagagcccagc

SEQ ID NO: 3692032 - DNA, 15 bp, Homo sapiens
ccagagcccagctcc

SEQ ID NO: 3692033 - DNA, 12 bp, Homo sapiens
ccagagccttca

SEQ ID NO: 3692034 - DNA, 18 bp, Homo sapiens
ccagagccttcaagtgcc

SEQ ID NO: 3692035 - DNA, 19 bp, Homo sapiens
ccagagccttcaagtgcca

SEQ ID NO: 3692036 - DNA, 22 bp, Homo sapiens
ccagagccttcaagtgccaaac

SEQ ID NO: 3692037 - DNA, 19 bp, Homo sapiens
ccagagctgtttatggcct

SEQ ID NO: 3692038 - DNA, 22 bp, Homo sapiens
ccagaggcccccagcccagggc

SEQ ID NO: 3692039 - DNA, 19 bp, Homo sapiens
ccagaggttgtgcactgtt

SEQ ID NO: 3692040 - DNA, 17 bp, Homo sapiens
ccagagtggcctggcca

SEQ ID NO: 3692041 - DNA, 18 bp, Homo sapiens
ccagagtggcctggccag

SEQ ID NO: 3692042 - DNA, 13 bp, Homo sapiens
ccagatccagcct

SEQ ID NO: 3692043 - DNA, 14 bp, Homo sapiens
ccagatccagcctg

SEQ ID NO: 3692044 - DNA, 13 bp, Homo sapiens
ccagatctggtcc

SEQ ID NO: 3692045 - DNA, 13 bp, Homo sapiens
ccagattcttcag

SEQ ID NO: 3692046 - DNA, 14 bp, Homo sapiens
ccagattcttcagc

SEQ ID NO: 3692047 - DNA, 13 bp, Homo sapiens
ccagattgacgac

SEQ ID NO: 3692048 - DNA, 15 bp, Homo sapiens
ccagatttgtctttt

SEQ ID NO: 3692049 - DNA, 15 bp, Homo sapiens
ccagcaaacaaaatg

SEQ ID NO: 3692050 - DNA, 15 bp, Homo sapiens
ccagcacctggcatc

SEQ ID NO: 3692051 - DNA, 16 bp, Homo sapiens
ccagcaccttgtgcct

SEQ ID NO: 3692052 - DNA, 19 bp, Homo sapiens
ccagcaccttgtgcctggg

SEQ ID NO: 3692053 - DNA, 17 bp, Homo sapiens
ccagcagcgcctttccc

SEQ ID NO: 3692054 - DNA, 15 bp, Homo sapiens
ccagcattccagccc

SEQ ID NO: 3692055 - DNA, 19 bp, Homo sapiens
ccagcattccagcccctct

SEQ ID NO: 3692056 - DNA, 21 bp, Homo sapiens
ccagcattccagcccctctgg

SEQ ID NO: 3692057 - DNA, 18 bp, Homo sapiens
ccagccaaagcctcctcc

SEQ ID NO: 3692058 - DNA, 13 bp, Homo sapiens
ccagccaccccgg

SEQ ID NO: 3692059 - DNA, 18 bp, Homo sapiens
ccagcccagacagcaagg

SEQ ID NO: 3692060 - DNA, 11 bp, Homo sapiens
ccagcccagag

SEQ ID NO: 3692061 - DNA, 14 bp, Homo sapiens
ccagcccagagaca

SEQ ID NO: 3692062 - DNA, 23 bp, Homo sapiens
ccagcccagagacatacttgaag

SEQ ID NO: 3692063 - DNA, 13 bp, Homo sapiens
ccagcccagggct

SEQ ID NO: 3692064 - DNA, 14 bp, Homo sapiens
ccagcccagggctc

SEQ ID NO: 3692065 - DNA, 21 bp, Homo sapiens
ccagcccagggctcctgcact

SEQ ID NO: 3692066 - DNA, 17 bp, Homo sapiens
ccagccccacccaggag

SEQ ID NO: 3692067 - DNA, 18 bp, Homo sapiens
ccagccccacccaggagg

SEQ ID NO: 3692068 - DNA, 22 bp, Homo sapiens
ccagcccctctggtcgctcctg

SEQ ID NO: 3692069 - DNA, 18 bp, Homo sapiens
ccagccgccatgctcctg

SEQ ID NO: 3692070 - DNA, 23 bp, Homo sapiens
ccagccgccattgccaccaggag

SEQ ID NO: 3692071 - DNA, 20 bp, Homo sapiens
ccagcctatcaggtgcccct

SEQ ID NO: 3692072 - DNA, 15 bp, Homo sapiens
ccagcctccctgaag

SEQ ID NO: 3692073 - DNA, 17 bp, Homo sapiens
ccagcctccctgaagcc

SEQ ID NO: 3692074 - DNA, 21 bp, Homo sapiens
ccagcctccctgaagcctttg

SEQ ID NO: 3692075 - DNA, 14 bp, Homo sapiens
ccagcctggcatca

SEQ ID NO: 3692076 - DNA, 17 bp, Homo sapiens
ccagcctggtggcccag

SEQ ID NO: 3692077 - DNA, 18 bp, Homo sapiens
ccagcgatctctccactg

SEQ ID NO: 3692078 - DNA, 13 bp, Homo sapiens
ccagcgcccctca

SEQ ID NO: 3692079 - DNA, 17 bp, Homo sapiens
ccagcgcccctcagcct

SEQ ID NO: 3692080 - DNA, 18 bp, Homo sapiens
ccagctaagaacctggaa

SEQ ID NO: 3692081 - DNA, 15 bp, Homo sapiens
ccagctattaccaca

SEQ ID NO: 3692082 - DNA, 13 bp, Homo sapiens
ccagctcaggaca

SEQ ID NO: 3692083 - DNA, 23 bp, Homo sapiens
ccagctcaggacagatgccacac

SEQ ID NO: 3692084 - DNA, 20 bp, Homo sapiens
ccagctctgtgggccctacc

SEQ ID NO: 3692085 - DNA, 13 bp, Homo sapiens
ccagctggcagca

SEQ ID NO: 3692086 - DNA, 14 bp, Homo sapiens
ccagctggcagcag

SEQ ID NO: 3692087 - DNA, 15 bp, Homo sapiens
ccagctggcagcaga

SEQ ID NO: 3692088 - DNA, 20 bp, Homo sapiens
ccagctggcagcagagtgtg

SEQ ID NO: 3692089 - DNA, 17 bp, Homo sapiens
ccagctgggttggaaaa

SEQ ID NO: 3692090 - DNA, 19 bp, Homo sapiens
ccagcttaaaggggctaga

SEQ ID NO: 3692091 - DNA, 16 bp, Homo sapiens
ccagcttatctcaggg

SEQ ID NO: 3692092 - DNA, 19 bp, Homo sapiens
ccaggaatttcccaggacc

SEQ ID NO: 3692093 - DNA, 15 bp, Homo sapiens
ccaggaccatcatcc

SEQ ID NO: 3692094 - DNA, 14 bp, Homo sapiens
ccaggaccctgaag

SEQ ID NO: 3692095 - DNA, 17 bp, Homo sapiens
ccaggactccctcctca

SEQ ID NO: 3692096 - DNA, 18 bp, Homo sapiens
ccaggactccctcctcac

SEQ ID NO: 3692097 - DNA, 22 bp, Homo sapiens
ccaggactccctcctcacctct

SEQ ID NO: 3692098 - DNA, 21 bp, Homo sapiens
ccaggagaaccactacatgca

SEQ ID NO: 3692099 - DNA, 16 bp, Homo sapiens
ccaggagaagttgagg

SEQ ID NO: 3692100 - DNA, 21 bp, Homo sapiens
ccaggagcaagtgaggccgga

SEQ ID NO: 3692101 - DNA, 21 bp, Homo sapiens
ccaggagctcttcaggcctcc

SEQ ID NO: 3692102 - DNA, 23 bp, Homo sapiens
ccaggagctcttcaggcctccct

SEQ ID NO: 3692103 - DNA, 21 bp, Homo sapiens
ccaggatgataagttcctttc

SEQ ID NO: 3692104 - DNA, 19 bp, Homo sapiens
ccaggatggggaggggctc

SEQ ID NO: 3692105 - DNA, 23 bp, Homo sapiens
ccaggatggggaggggctctgcg

SEQ ID NO: 3692106 - DNA, 16 bp, Homo sapiens
ccaggcacctcttcct

SEQ ID NO: 3692107 - DNA, 12 bp, Homo sapiens
ccaggcactgca

SEQ ID NO: 3692108 - DNA, 20 bp, Homo sapiens
ccaggcagatctgtgcccca

SEQ ID NO: 3692109 - DNA, 13 bp, Homo sapiens
ccaggcagctggc

SEQ ID NO: 3692110 - DNA, 18 bp, Homo sapiens
ccaggcagctggcaggag

SEQ ID NO: 3692111 - DNA, 13 bp, Homo sapiens
ccaggcatggtgg

SEQ ID NO: 3692112 - DNA, 19 bp, Homo sapiens
ccaggcccccaagcctgca

SEQ ID NO: 3692113 - DNA, 19 bp, Homo sapiens
ccaggcctgaaagaggctg

SEQ ID NO: 3692114 - DNA, 22 bp, Homo sapiens
ccaggcggggcgccccaagagc

SEQ ID NO: 3692115 - DNA, 13 bp, Homo sapiens
ccaggctgcccag

SEQ ID NO: 3692116 - DNA, 16 bp, Homo sapiens
ccaggctgcccagagc

SEQ ID NO: 3692117 - DNA, 15 bp, Homo sapiens
ccaggctgccgtggg

SEQ ID NO: 3692118 - DNA, 18 bp, Homo sapiens
ccaggctgccgtggggcc

SEQ ID NO: 3692119 - DNA, 19 bp, Homo sapiens
ccaggctgctcagggctgg

SEQ ID NO: 3692120 - DNA, 18 bp, Homo sapiens
ccaggctggagtgcagtg

SEQ ID NO: 3692121 - DNA, 21 bp, Homo sapiens
ccagggaactggcctgctgcg

SEQ ID NO: 3692122 - DNA, 17 bp, Homo sapiens
ccagggaagctggccga

SEQ ID NO: 3692123 - DNA, 18 bp, Homo sapiens
ccagggacacctgggaga

SEQ ID NO: 3692124 - DNA, 22 bp, Homo sapiens
ccagggagcttgaaagttttca

SEQ ID NO: 3692125 - DNA, 14 bp, Homo sapiens
ccagggaggggccg

SEQ ID NO: 3692126 - DNA, 13 bp, Homo sapiens
ccagggcccagag

SEQ ID NO: 3692127 - DNA, 22 bp, Homo sapiens
ccagggcccagagcccagctcc

SEQ ID NO: 3692128 - DNA, 22 bp, Homo sapiens
ccagggcccctcaccctgcctt

SEQ ID NO: 3692129 - DNA, 14 bp, Homo sapiens
ccagggctcctgca

SEQ ID NO: 3692130 - DNA, 20 bp, Homo sapiens
ccagggctcctgcacttact

SEQ ID NO: 3692131 - DNA, 15 bp, Homo sapiens
ccaggggccctacct

SEQ ID NO: 3692132 - DNA, 20 bp, Homo sapiens
ccaggggctgcttcctcctg

SEQ ID NO: 3692133 - DNA, 23 bp, Homo sapiens
ccaggggctgcttcctcctggaa

SEQ ID NO: 3692134 - DNA, 18 bp, Homo sapiens
ccagggggtctcacccat

SEQ ID NO: 3692135 - DNA, 20 bp, Homo sapiens
ccaggtcaccctttgctgtg

SEQ ID NO: 3692136 - DNA, 22 bp, Homo sapiens
ccaggtgcagaggtaccctggg

SEQ ID NO: 3692137 - DNA, 14 bp, Homo sapiens
ccaggtgtgcccct

SEQ ID NO: 3692138 - DNA, 22 bp, Homo sapiens
ccaggttctccgttagctcctg

SEQ ID NO: 3692139 - DNA, 21 bp, Homo sapiens
ccagtaacgcgtcttcctgag

SEQ ID NO: 3692140 - DNA, 17 bp, Homo sapiens
ccagtccccccaccctc

SEQ ID NO: 3692141 - DNA, 17 bp, Homo sapiens
ccagtcctgcctggcca

SEQ ID NO: 3692142 - DNA, 22 bp, Homo sapiens
ccagtcctgcctggccaggcag

SEQ ID NO: 3692143 - DNA, 16 bp, Homo sapiens
ccagtctgtggatcag

SEQ ID NO: 3692144 - DNA, 18 bp, Homo sapiens
ccagtgacagacaggctc

SEQ ID NO: 3692145 - DNA, 19 bp, Homo sapiens
ccagtgacagacaggctct

SEQ ID NO: 3692146 - DNA, 15 bp, Homo sapiens
ccagtgacctgagga

SEQ ID NO: 3692147 - DNA, 17 bp, Homo sapiens
ccagtgaggatgacagt

SEQ ID NO: 3692148 - DNA, 15 bp, Homo sapiens
ccagtgcagaatgta

SEQ ID NO: 3692149 - DNA, 14 bp, Homo sapiens
ccagtgcccccact

SEQ ID NO: 3692150 - DNA, 16 bp, Homo sapiens
ccagtggaggtttgtc

SEQ ID NO: 3692151 - DNA, 23 bp, Homo sapiens
ccataatgctaatttaaagagac

SEQ ID NO: 3692152 - DNA, 19 bp, Homo sapiens
ccataattgctttgccaaa

SEQ ID NO: 3692153 - DNA, 20 bp, Homo sapiens
ccataattgctttgccaaaa

SEQ ID NO: 3692154 - DNA, 21 bp, Homo sapiens
ccatacccacaatctgagcac

SEQ ID NO: 3692155 - DNA, 15 bp, Homo sapiens
ccatatccctggttg

SEQ ID NO: 3692156 - DNA, 22 bp, Homo sapiens
ccatatgctccaggatctttga

SEQ ID NO: 3692157 - DNA, 15 bp, Homo sapiens
ccatccaaggccagg

SEQ ID NO: 3692158 - DNA, 16 bp, Homo sapiens
ccatccactctaccct

SEQ ID NO: 3692159 - DNA, 15 bp, Homo sapiens
ccatcctccagcagg

SEQ ID NO: 3692160 - DNA, 17 bp, Homo sapiens
ccatcctccagcaggga

SEQ ID NO: 3692161 - DNA, 13 bp, Homo sapiens
ccatcctggctgc

SEQ ID NO: 3692162 - DNA, 18 bp, Homo sapiens
ccatctcacctcctgctg

SEQ ID NO: 3692163 - DNA, 19 bp, Homo sapiens
ccatctcacctcctgctgg

SEQ ID NO: 3692164 - DNA, 20 bp, Homo sapiens
ccatctgcacccccctgggc

SEQ ID NO: 3692165 - DNA, 14 bp, Homo sapiens
ccatgaccatactg

SEQ ID NO: 3692166 - DNA, 14 bp, Homo sapiens
ccatgatccctgtg

SEQ ID NO: 3692167 - DNA, 17 bp, Homo sapiens
ccatgatccctgtgttg

SEQ ID NO: 3692168 - DNA, 14 bp, Homo sapiens
ccatgatgcctctg

SEQ ID NO: 3692169 - DNA, 19 bp, Homo sapiens
ccatgcaagcagaggacca

SEQ ID NO: 3692170 - DNA, 23 bp, Homo sapiens
ccatgcaagcagaggaccagggc

SEQ ID NO: 3692171 - DNA, 15 bp, Homo sapiens
ccatgcactgtgaag

SEQ ID NO: 3692172 - DNA, 21 bp, Homo sapiens
ccatgcactgtgaaggaccct

SEQ ID NO: 3692173 - DNA, 19 bp, Homo sapiens
ccatgcaggggtcagtgca

SEQ ID NO: 3692174 - DNA, 16 bp, Homo sapiens
ccatgcccacctgccc

SEQ ID NO: 3692175 - DNA, 17 bp, Homo sapiens
ccatgccgtctgccgga

SEQ ID NO: 3692176 - DNA, 13 bp, Homo sapiens
ccatgcctgtcca

SEQ ID NO: 3692177 - DNA, 14 bp, Homo sapiens
ccatgcctgtccag

SEQ ID NO: 3692178 - DNA, 18 bp, Homo sapiens
ccatgcctgtccagcctg

SEQ ID NO: 3692179 - DNA, 20 bp, Homo sapiens
ccatgcgccccctccgccct

SEQ ID NO: 3692180 - DNA, 21 bp, Homo sapiens
ccctgatttaggagaagccag

SEQ ID NO: 3692181 - DNA, 23 bp, Homo sapiens
ccctgatttaggagaagccagga

SEQ ID NO: 3692182 - DNA, 21 bp, Homo sapiens
ccctgcatctgaccagcagcg

SEQ ID NO: 3692183 - DNA, 14 bp, Homo sapiens
ccctgccaccaggc

SEQ ID NO: 3692184 - DNA, 20 bp, Homo sapiens
ccctgccactcactaggccc

SEQ ID NO: 3692185 - DNA, 21 bp, Homo sapiens
cctagaaattccccaccctga

SEQ ID NO: 3692186 - DNA, 17 bp, Homo sapiens
cctagcagcccaccctg

SEQ ID NO: 3692187 - DNA, 18 bp, Homo sapiens
cctaggcctcagccagag

SEQ ID NO: 3692188 - DNA, 20 bp, Homo sapiens
cctaggcctcagccagagaa

SEQ ID NO: 3692189 - DNA, 15 bp, Homo sapiens
cctagggaatgaact

SEQ ID NO: 3692190 - DNA, 14 bp, Homo sapiens
cctagtcccttccc

SEQ ID NO: 3692191 - DNA, 15 bp, Homo sapiens
cctagtcccttcccc

SEQ ID NO: 3692192 - DNA, 16 bp, Homo sapiens
cctagtcccttcccct

SEQ ID NO: 3692193 - DNA, 12 bp, Homo sapiens
cctataaaacag

SEQ ID NO: 3692194 - DNA, 20 bp, Homo sapiens
cctataaaacaggtcaatac

SEQ ID NO: 3692195 - DNA, 20 bp, Homo sapiens
cctatgcttaataaaagaac

SEQ ID NO: 3692196 - DNA, 21 bp, Homo sapiens
cctatgcttaataaaagaaca

SEQ ID NO: 3692197 - DNA, 18 bp, Homo sapiens
cctcaaggtgcggggaga

SEQ ID NO: 3692198 - DNA, 18 bp, Homo sapiens
cctcacctctggactggc

SEQ ID NO: 3692199 - DNA, 15 bp, Homo sapiens
cctcaccttggcacc

SEQ ID NO: 3692200 - DNA, 21 bp, Homo sapiens
cctcaccttggcaccagacac

SEQ ID NO: 3692201 - DNA, 14 bp, Homo sapiens
cctcactaattttt

SEQ ID NO: 3692202 - DNA, 15 bp, Homo sapiens
cctcagcctccctgg

SEQ ID NO: 3692203 - DNA, 16 bp, Homo sapiens
cctcagcctctgccac

SEQ ID NO: 3692204 - DNA, 11 bp, Homo sapiens
cctcagcctgg

SEQ ID NO: 3692205 - DNA, 15 bp, Homo sapiens
cctcagcctggccag

SEQ ID NO: 3692206 - DNA, 16 bp, Homo sapiens
cctcagcctggccaga

SEQ ID NO: 3692207 - DNA, 22 bp, Homo sapiens
cctcagcctggccagacacagg

SEQ ID NO: 3692208 - DNA, 15 bp, Homo sapiens
cctcagcctggggtt

SEQ ID NO: 3692209 - DNA, 17 bp, Homo sapiens
cctcagccttgccagag

SEQ ID NO: 3692210 - DNA, 13 bp, Homo sapiens
cctcagctgcctc

SEQ ID NO: 3692211 - DNA, 16 bp, Homo sapiens
cctcagctgcctcact

SEQ ID NO: 3692212 - DNA, 19 bp, Homo sapiens
cctcagctgcctcacttcc

SEQ ID NO: 3692213 - DNA, 18 bp, Homo sapiens
cctcaggcaggtgggatg

SEQ ID NO: 3692214 - DNA, 17 bp, Homo sapiens
cctcaggtgagaagcag

SEQ ID NO: 3692215 - DNA, 22 bp, Homo sapiens
cctcaggtgagaagcagaggaa

SEQ ID NO: 3692216 - DNA, 15 bp, Homo sapiens
cctcatggcgggact

SEQ ID NO: 3692217 - DNA, 19 bp, Homo sapiens
cctcatggcgggactggag

SEQ ID NO: 3692218 - DNA, 21 bp, Homo sapiens
cctcatggcgggactggagaa

SEQ ID NO: 3692219 - DNA, 13 bp, Homo sapiens
cctcatgtggctg

SEQ ID NO: 3692220 - DNA, 15 bp, Homo sapiens
cctcatgtggctgga

SEQ ID NO: 3692221 - DNA, 12 bp, Homo sapiens
cctcattctgaa

SEQ ID NO: 3692222 - DNA, 11 bp, Homo sapiens
cctccaagcct

SEQ ID NO: 3692223 - DNA, 22 bp, Homo sapiens
cctccaagtcacaaagagatgt

SEQ ID NO: 3692224 - DNA, 12 bp, Homo sapiens
cctccagcctgg

SEQ ID NO: 3692225 - DNA, 14 bp, Homo sapiens
cctccagcctggtg

SEQ ID NO: 3692226 - DNA, 14 bp, Homo sapiens
cctccaggtgcaga

SEQ ID NO: 3692227 - DNA, 17 bp, Homo sapiens
cctccaggtgcagaggt

SEQ ID NO: 3692228 - DNA, 16 bp, Homo sapiens
cctccagtgctggatt

SEQ ID NO: 3692229 - DNA, 13 bp, Homo sapiens
cctcccaagctgt

SEQ ID NO: 3692230 - DNA, 19 bp, Homo sapiens
cctcccaatttcagactcc

SEQ ID NO: 3692231 - DNA, 16 bp, Homo sapiens
cctcccataattgctt

SEQ ID NO: 3692232 - DNA, 22 bp, Homo sapiens
cctcccataattgctttgccaa

SEQ ID NO: 3692233 - DNA, 15 bp, Homo sapiens
cctcccccccatgca

SEQ ID NO: 3692234 - DNA, 19 bp, Homo sapiens
cctccctgaagcctttgca

SEQ ID NO: 3692235 - DNA, 12 bp, Homo sapiens
cctccctgcctc

SEQ ID NO: 3692236 - DNA, 14 bp, Homo sapiens
cctccctgcctcca

SEQ ID NO: 3692237 - DNA, 15 bp, Homo sapiens
cctccctgcctccag

SEQ ID NO: 3692238 - DNA, 12 bp, Homo sapiens
cctccctggagc

SEQ ID NO: 3692239 - DNA, 14 bp, Homo sapiens
cctccctggctccc

SEQ ID NO: 3692240 - DNA, 14 bp, Homo sapiens
cctccctgggggcg

SEQ ID NO: 3692241 - DNA, 17 bp, Homo sapiens
cctccctgggggcggga

SEQ ID NO: 3692242 - DNA, 20 bp, Homo sapiens
cctccctgggggtggggctc

SEQ ID NO: 3692243 - DNA, 22 bp, Homo sapiens
cctccctgggggtggggctcct

SEQ ID NO: 3692244 - DNA, 17 bp, Homo sapiens
cctcccttctgctactg

SEQ ID NO: 3692245 - DNA, 19 bp, Homo sapiens
cctccctttcctccgcctg

SEQ ID NO: 3692246 - DNA, 14 bp, Homo sapiens
cctccgccaggcga

SEQ ID NO: 3692247 - DNA, 23 bp, Homo sapiens
cctccgccattctcaagccctgc

SEQ ID NO: 3692248 - DNA, 14 bp, Homo sapiens
cctccgcctcctgg

SEQ ID NO: 3692249 - DNA, 16 bp, Homo sapiens
cctccgcctgtccaca

SEQ ID NO: 3692250 - DNA, 14 bp, Homo sapiens
cctcctcacctctg

SEQ ID NO: 3692251 - DNA, 16 bp, Homo sapiens
cctcctcacctctgga

SEQ ID NO: 3692252 - DNA, 21 bp, Homo sapiens
cctcctccagccgccatgctc

SEQ ID NO: 3692253 - DNA, 19 bp, Homo sapiens
cctcctcccacccggctgc

SEQ ID NO: 3692254 - DNA, 15 bp, Homo sapiens
cctcctgaaggaggc

SEQ ID NO: 3692255 - DNA, 23 bp, Homo sapiens
cctcctgaaggaggcggggctct

SEQ ID NO: 3692256 - DNA, 20 bp, Homo sapiens
cctcctgactcatccgcctg

SEQ ID NO: 3692257 - DNA, 22 bp, Homo sapiens
cctcctgactcatccgcctggc

SEQ ID NO: 3692258 - DNA, 17 bp, Homo sapiens
cctcctgcccacctgtc

SEQ ID NO: 3692259 - DNA, 12 bp, Homo sapiens
cctcctgctgag

SEQ ID NO: 3692260 - DNA, 21 bp, Homo sapiens
cctcgcaactgtccacgcgtg

SEQ ID NO: 3692261 - DNA, 14 bp, Homo sapiens
cctcggtgtggaga

SEQ ID NO: 3692262 - DNA, 22 bp, Homo sapiens
cctcgtcccatccagctaccac

SEQ ID NO: 3692263 - DNA, 18 bp, Homo sapiens
cctcgtgaaagtgcattt

SEQ ID NO: 3692264 - DNA, 15 bp, Homo sapiens
cctctcagtactttg

SEQ ID NO: 3692265 - DNA, 12 bp, Homo sapiens
cctctccccagc

SEQ ID NO: 3692266 - DNA, 14 bp, Homo sapiens
cctctccccagccc

SEQ ID NO: 3692267 - DNA, 19 bp, Homo sapiens
cctctccccagcccagaga

SEQ ID NO: 3692268 - DNA, 21 bp, Homo sapiens
cctctccccaggtccagctct

SEQ ID NO: 3692269 - DNA, 20 bp, Homo sapiens
cctctcgtcccgtccctccc

SEQ ID NO: 3692270 - DNA, 19 bp, Homo sapiens
cctctctcttctgctccac

SEQ ID NO: 3692271 - DNA, 22 bp, Homo sapiens
cctctctcttctgctccaccct

SEQ ID NO: 3692272 - DNA, 16 bp, Homo sapiens
cctctctggtggctgg

SEQ ID NO: 3692273 - DNA, 19 bp, Homo sapiens
cctctctggtggctgggct

SEQ ID NO: 3692274 - DNA, 15 bp, Homo sapiens
cctctggaatgcatg

SEQ ID NO: 3692275 - DNA, 15 bp, Homo sapiens
cctctggactggcta

SEQ ID NO: 3692276 - DNA, 18 bp, Homo sapiens
cctctggactggctagag

SEQ ID NO: 3692277 - DNA, 12 bp, Homo sapiens
cctctggctaga

SEQ ID NO: 3692278 - DNA, 19 bp, Homo sapiens
cctctggtcgctcctgccc

SEQ ID NO: 3692279 - DNA, 20 bp, Homo sapiens
cctctggtcgctcctgccca

SEQ ID NO: 3692280 - DNA, 21 bp, Homo sapiens
cctctgtgccacgctcctctg

SEQ ID NO: 3692281 - DNA, 14 bp, Homo sapiens
cctctgtggccagc

SEQ ID NO: 3692282 - DNA, 23 bp, Homo sapiens
cctctgtttgtttggctgtccag

SEQ ID NO: 3692283 - DNA, 23 bp, Homo sapiens
cctcttaaattatatatttattt

SEQ ID NO: 3692284 - DNA, 18 bp, Homo sapiens
cctcttccaaaggcagcg

SEQ ID NO: 3692285 - DNA, 13 bp, Homo sapiens
cctcttccccaga

SEQ ID NO: 3692286 - DNA, 22 bp, Homo sapiens
cctcttccccagaaaggagact

SEQ ID NO: 3692287 - DNA, 15 bp, Homo sapiens
cctcttgagcagtgg

SEQ ID NO: 3692288 - DNA, 16 bp, Homo sapiens
cctcttgagcagtggc

SEQ ID NO: 3692289 - DNA, 17 bp, Homo sapiens
cctcttgagcagtggct

SEQ ID NO: 3692290 - DNA, 11 bp, Homo sapiens
cctctttgctt

SEQ ID NO: 3692291 - DNA, 13 bp, Homo sapiens
cctctttgctttg

SEQ ID NO: 3692292 - DNA, 14 bp, Homo sapiens
cctctttgctttgc

SEQ ID NO: 3692293 - DNA, 21 bp, Homo sapiens
cctgaaaatgtttttctgcca

SEQ ID NO: 3692294 - DNA, 15 bp, Homo sapiens
cctgaaagaggctga

SEQ ID NO: 3692295 - DNA, 13 bp, Homo sapiens
cctgaaagccctg

SEQ ID NO: 3692296 - DNA, 13 bp, Homo sapiens
cctgaagaaccag

SEQ ID NO: 3692297 - DNA, 17 bp, Homo sapiens
cctgaagatgggagcct

SEQ ID NO: 3692298 - DNA, 21 bp, Homo sapiens
cctgaaggaggcggggctcta

SEQ ID NO: 3692299 - DNA, 18 bp, Homo sapiens
cctgaaggcagggctcct

SEQ ID NO: 3692300 - DNA, 19 bp, Homo sapiens
cctgaaggcagggctcctc

SEQ ID NO: 3692301 - DNA, 15 bp, Homo sapiens
ccatgctgaggcctg

SEQ ID NO: 3692302 - DNA, 16 bp, Homo sapiens
ccatgctgaggcctgg

SEQ ID NO: 3692303 - DNA, 18 bp, Homo sapiens
ccatgctgaggcctgggc

SEQ ID NO: 3692304 - DNA, 19 bp, Homo sapiens
ccatgctgaggcctgggcc

SEQ ID NO: 3692305 - DNA, 20 bp, Homo sapiens
ccatgctggtggaaagatag

SEQ ID NO: 3692306 - DNA, 19 bp, Homo sapiens
ccatgcttacgtgatcctc

SEQ ID NO: 3692307 - DNA, 14 bp, Homo sapiens
ccatggccccaggc

SEQ ID NO: 3692308 - DNA, 15 bp, Homo sapiens
ccatggccccaggcc

SEQ ID NO: 3692309 - DNA, 16 bp, Homo sapiens
ccatggctcagggtgg

SEQ ID NO: 3692310 - DNA, 12 bp, Homo sapiens
ccatggggaggg

SEQ ID NO: 3692311 - DNA, 20 bp, Homo sapiens
ccatgggtgtggatggcagt

SEQ ID NO: 3692312 - DNA, 22 bp, Homo sapiens
ccatgtcaccggatcctgggtg

SEQ ID NO: 3692313 - DNA, 23 bp, Homo sapiens
ccatgtcaccggatcctgggtgg

SEQ ID NO: 3692314 - DNA, 19 bp, Homo sapiens
ccatgttggccaggctggt

SEQ ID NO: 3692315 - DNA, 17 bp, Homo sapiens
ccattagccagatttgt

SEQ ID NO: 3692316 - DNA, 17 bp, Homo sapiens
ctcagtgggctgtttct

SEQ ID NO: 3692317 - DNA, 15 bp, Homo sapiens
ctcagttcccttggc

SEQ ID NO: 3692318 - DNA, 16 bp, Homo sapiens
ctcagttcccttggcc

SEQ ID NO: 3692319 - DNA, 18 bp, Homo sapiens
ctcagttcccttggcctc

SEQ ID NO: 3692320 - DNA, 18 bp, Homo sapiens
ctcagttctcttgctttc

SEQ ID NO: 3692321 - DNA, 16 bp, Homo sapiens
ctcagttgattttctg

SEQ ID NO: 3692322 - DNA, 23 bp, Homo sapiens
ctcatccccaggggtcccagcca

SEQ ID NO: 3692323 - DNA, 18 bp, Homo sapiens
ctcatggcgggactggag

SEQ ID NO: 3692324 - DNA, 19 bp, Homo sapiens
ctcatggcgggactggaga

SEQ ID NO: 3692325 - DNA, 20 bp, Homo sapiens
ctcatggcgggactggagaa

SEQ ID NO: 3692326 - DNA, 13 bp, Homo sapiens
ctcatgtggctgg

SEQ ID NO: 3692327 - DNA, 15 bp, Homo sapiens
ctcatgtggctggaa

SEQ ID NO: 3692328 - DNA, 16 bp, Homo sapiens
ctcatgtgtgcaacag

SEQ ID NO: 3692329 - DNA, 20 bp, Homo sapiens
ctcatgttttcaactgccaa

SEQ ID NO: 3692330 - DNA, 12 bp, Homo sapiens
ctcattctttag

SEQ ID NO: 3692331 - DNA, 20 bp, Homo sapiens
ctcatttggggtagctagag

SEQ ID NO: 3692332 - DNA, 18 bp, Homo sapiens
ctccaaactgaagcagcc

SEQ ID NO: 3692333 - DNA, 14 bp, Homo sapiens
ctccaaatttttct

SEQ ID NO: 3692334 - DNA, 21 bp, Homo sapiens
ctccaatggggcggggcttct

SEQ ID NO: 3692335 - DNA, 14 bp, Homo sapiens
ctccacccttggcc

SEQ ID NO: 3692336 - DNA, 13 bp, Homo sapiens
ctaaatggcctca

SEQ ID NO: 3692337 - DNA, 14 bp, Homo sapiens
ctaacaaaggcagc

SEQ ID NO: 3692338 - DNA, 17 bp, Homo sapiens
ctaacaaaggcagctgt

SEQ ID NO: 3692339 - DNA, 20 bp, Homo sapiens
ctaacaaaggcagctgtgtc

SEQ ID NO: 3692340 - DNA, 14 bp, Homo sapiens
ctaactggacagcc

SEQ ID NO: 3692341 - DNA, 22 bp, Homo sapiens
ctaactggacagcctcttctgt

SEQ ID NO: 3692342 - DNA, 13 bp, Homo sapiens
ctaactgtaaatc

SEQ ID NO: 3692343 - DNA, 15 bp, Homo sapiens
ctaactgtaaatcat

SEQ ID NO: 3692344 - DNA, 17 bp, Homo sapiens
ctaactgtaaatcatgt

SEQ ID NO: 3692345 - DNA, 11 bp, Homo sapiens
ctaagagccat

SEQ ID NO: 3692346 - DNA, 18 bp, Homo sapiens
ctaagagtgtcctaggag

SEQ ID NO: 3692347 - DNA, 18 bp, Homo sapiens
ctaagcagaggaggggcc

SEQ ID NO: 3692348 - DNA, 17 bp, Homo sapiens
ctaaggaggggaaaaaa

SEQ ID NO: 3692349 - DNA, 20 bp, Homo sapiens
ctaaggaggggaaaaaaatg

SEQ ID NO: 3692350 - DNA, 20 bp, Homo sapiens
ctaaggcatgtgtgaaacat

SEQ ID NO: 3692351 - DNA, 12 bp, Homo sapiens
ctaaggggcccg

SEQ ID NO: 3692352 - DNA, 18 bp, Homo sapiens
ctaaggggcccggccagc

SEQ ID NO: 3692353 - DNA, 17 bp, Homo sapiens
ctaatccaggcagatcc

SEQ ID NO: 3692354 - DNA, 18 bp, Homo sapiens
ctaatccaggcagatcca

SEQ ID NO: 3692355 - DNA, 18 bp, Homo sapiens
ctaatcccgattcaccct

SEQ ID NO: 3692356 - DNA, 16 bp, Homo sapiens
ctaatcctctttttct

SEQ ID NO: 3692357 - DNA, 19 bp, Homo sapiens
ctaatctagatatcgactt

SEQ ID NO: 3692358 - DNA, 19 bp, Homo sapiens
ctaatgaatgcataaaatg

SEQ ID NO: 3692359 - DNA, 23 bp, Homo sapiens
ctaatgaggagagaaaatatatg

SEQ ID NO: 3692360 - DNA, 19 bp, Homo sapiens
ctaatgctcacctttatca

SEQ ID NO: 3692361 - DNA, 18 bp, Homo sapiens
ctaatggcatgagaaata

SEQ ID NO: 3692362 - DNA, 18 bp, Homo sapiens
ctaatgtgaattgttcct

SEQ ID NO: 3692363 - DNA, 18 bp, Homo sapiens
ctaattaaccttactaat

SEQ ID NO: 3692364 - DNA, 16 bp, Homo sapiens
ctaattatactacttt

SEQ ID NO: 3692365 - DNA, 13 bp, Homo sapiens
ctaattgacttta

SEQ ID NO: 3692366 - DNA, 15 bp, Homo sapiens
ctaatttaaagagac

SEQ ID NO: 3692367 - DNA, 20 bp, Homo sapiens
ctaattttacatgtttataa

SEQ ID NO: 3692368 - DNA, 21 bp, Homo sapiens
ctaatttttgtattttttagt

SEQ ID NO: 3692369 - DNA, 19 bp, Homo sapiens
ctacaagagcagcctgtgg

SEQ ID NO: 3692370 - DNA, 21 bp, Homo sapiens
ctacaagagcagcctgtggca

SEQ ID NO: 3692371 - DNA, 23 bp, Homo sapiens
ctacaagagcagcctgtggcatc

SEQ ID NO: 3692372 - DNA, 18 bp, Homo sapiens
ctacagaaaacccagcta

SEQ ID NO: 3692373 - DNA, 23 bp, Homo sapiens
ctacagatgatagaggattttat

SEQ ID NO: 3692374 - DNA, 22 bp, Homo sapiens
ctacagattgggcggggcttct

SEQ ID NO: 3692375 - DNA, 22 bp, Homo sapiens
ctacaggagagatagaagcctc

SEQ ID NO: 3692376 - DNA, 13 bp, Homo sapiens
ctacaggatattt

SEQ ID NO: 3692377 - DNA, 19 bp, Homo sapiens
ctacaggtattttcatcaa

SEQ ID NO: 3692378 - DNA, 19 bp, Homo sapiens
ctacagtgaaatgagcagc

SEQ ID NO: 3692379 - DNA, 21 bp, Homo sapiens
ctacagttgaaaaacagctga

SEQ ID NO: 3692380 - DNA, 21 bp, Homo sapiens
ctacatgcagcccatgcccac

SEQ ID NO: 3692381 - DNA, 15 bp, Homo sapiens
ctacatttctgcaga

SEQ ID NO: 3692382 - DNA, 13 bp, Homo sapiens
ctaccaaatctca

SEQ ID NO: 3692383 - DNA, 20 bp, Homo sapiens
ctaccatttgtgttttgaaa

SEQ ID NO: 3692384 - DNA, 17 bp, Homo sapiens
ctaccccctaagagcca

SEQ ID NO: 3692385 - DNA, 15 bp, Homo sapiens
ctaccccgcagacac

SEQ ID NO: 3692386 - DNA, 20 bp, Homo sapiens
ctaccccgcagacaccttgg

SEQ ID NO: 3692387 - DNA, 12 bp, Homo sapiens
ctaccctcccac

SEQ ID NO: 3692388 - DNA, 12 bp, Homo sapiens
ctaccctcctgc

SEQ ID NO: 3692389 - DNA, 19 bp, Homo sapiens
ctaccctcctgctgagctg

SEQ ID NO: 3692390 - DNA, 13 bp, Homo sapiens
ctacctcaggcag

SEQ ID NO: 3692391 - DNA, 14 bp, Homo sapiens
ctacctcaggcagg

SEQ ID NO: 3692392 - DNA, 23 bp, Homo sapiens
ctacctcaggcaggaagggcagg

SEQ ID NO: 3692393 - DNA, 13 bp, Homo sapiens
ctacctctgagaa

SEQ ID NO: 3692394 - DNA, 15 bp, Homo sapiens
ctacctgaaggcagg

SEQ ID NO: 3692395 - DNA, 18 bp, Homo sapiens
ctacctgaaggcagggct

SEQ ID NO: 3692396 - DNA, 20 bp, Homo sapiens
ctacctgaaggcagggctcc

SEQ ID NO: 3692397 - DNA, 20 bp, Homo sapiens
ctacctgattggtgcaaccc

SEQ ID NO: 3692398 - DNA, 18 bp, Homo sapiens
ctacctgcaggcggggct

SEQ ID NO: 3692399 - DNA, 21 bp, Homo sapiens
ctacctggggaaagcctgaag

SEQ ID NO: 3692400 - DNA, 12 bp, Homo sapiens
ctacctgggggc

SEQ ID NO: 3692401 - DNA, 13 bp, Homo sapiens
ctacctgggggca

SEQ ID NO: 3692402 - DNA, 16 bp, Homo sapiens
ctacctttcaaagctt

SEQ ID NO: 3692403 - DNA, 13 bp, Homo sapiens
ctacgccaggaga

SEQ ID NO: 3692404 - DNA, 21 bp, Homo sapiens
ctacgccaggagaagttgagg

SEQ ID NO: 3692405 - DNA, 12 bp, Homo sapiens
ctacgtttcttt

SEQ ID NO: 3692406 - DNA, 14 bp, Homo sapiens
ctacgtttctttaa

SEQ ID NO: 3692407 - DNA, 14 bp, Homo sapiens
ctactataaagaga

SEQ ID NO: 3692408 - DNA, 22 bp, Homo sapiens
ctactcttggatgggacatttt

SEQ ID NO: 3692409 - DNA, 20 bp, Homo sapiens
ctactgacatgtggggccag

SEQ ID NO: 3692410 - DNA, 15 bp, Homo sapiens
ctacttggtttgtgt

SEQ ID NO: 3692411 - DNA, 17 bp, Homo sapiens
ctacttggtttgtgttc

SEQ ID NO: 3692412 - DNA, 15 bp, Homo sapiens
ctactttaagtgata

SEQ ID NO: 3692413 - DNA, 17 bp, Homo sapiens
ctactttgtggcaatct

SEQ ID NO: 3692414 - DNA, 20 bp, Homo sapiens
ctactttgttaggattttca

SEQ ID NO: 3692415 - DNA, 18 bp, Homo sapiens
ctacttttttcattttgt

SEQ ID NO: 3692416 - DNA, 19 bp, Homo sapiens
ctagaaattccccaccctg

SEQ ID NO: 3692417 - DNA, 23 bp, Homo sapiens
ctagaagggccagtcctgcctgg

SEQ ID NO: 3692418 - DNA, 17 bp, Homo sapiens
ctagactgttactttgg

SEQ ID NO: 3692419 - DNA, 18 bp, Homo sapiens
ctagagcactgccaccag

SEQ ID NO: 3692420 - DNA, 14 bp, Homo sapiens
ctagagcagggatt

SEQ ID NO: 3692421 - DNA, 15 bp, Homo sapiens
ctagagcagggatta

SEQ ID NO: 3692422 - DNA, 19 bp, Homo sapiens
ctagaggccagccccaccc

SEQ ID NO: 3692423 - DNA, 20 bp, Homo sapiens
ctagaggccagccccaccca

SEQ ID NO: 3692424 - DNA, 15 bp, Homo sapiens
ctagagtcctcactc

SEQ ID NO: 3692425 - DNA, 19 bp, Homo sapiens
ctagagtctgaacagctgt

SEQ ID NO: 3692426 - DNA, 20 bp, Homo sapiens
ctagagtctgaacagctgta

SEQ ID NO: 3692427 - DNA, 14 bp, Homo sapiens
ctagatggctcctc

SEQ ID NO: 3692428 - DNA, 18 bp, Homo sapiens
ctagatggctcctctcag

SEQ ID NO: 3692429 - DNA, 23 bp, Homo sapiens
ctagcagcagggagggcttctgc

SEQ ID NO: 3692430 - DNA, 23 bp, Homo sapiens
ctagcagcccaccctgctgctgg

SEQ ID NO: 3692431 - DNA, 18 bp, Homo sapiens
ctagccagcccctcttcc

SEQ ID NO: 3692432 - DNA, 20 bp, Homo sapiens
ctagcctgatgagattttta

SEQ ID NO: 3692433 - DNA, 19 bp, Homo sapiens
ctagctgggggtgggccag

SEQ ID NO: 3692434 - DNA, 21 bp, Homo sapiens
ctagctgggggtgggccaggc

SEQ ID NO: 3692435 - DNA, 22 bp, Homo sapiens
ctagctgggggtgggccaggct

SEQ ID NO: 3692436 - DNA, 22 bp, Homo sapiens
ctaggatagctaactgtaaatc

SEQ ID NO: 3692437 - DNA, 21 bp, Homo sapiens
ctaggatggggcacggctctg

SEQ ID NO: 3692438 - DNA, 22 bp, Homo sapiens
ctaggatggggcacggctctgg

SEQ ID NO: 3692439 - DNA, 14 bp, Homo sapiens
ctaggatggttctg

SEQ ID NO: 3692440 - DNA, 16 bp, Homo sapiens
ctaggatggttctgtg

SEQ ID NO: 3692441 - DNA, 14 bp, Homo sapiens
ctaggattgggcct

SEQ ID NO: 3692442 - DNA, 13 bp, Homo sapiens
ctaggcaacatag

SEQ ID NO: 3692443 - DNA, 21 bp, Homo sapiens
ctaggcataggtctctttgct

SEQ ID NO: 3692444 - DNA, 15 bp, Homo sapiens
ctaggcccccacttg

SEQ ID NO: 3692445 - DNA, 22 bp, Homo sapiens
ctaggcccccacttgcctcttc

SEQ ID NO: 3692446 - DNA, 16 bp, Homo sapiens
ctaggcctcagccaga

SEQ ID NO: 3692447 - DNA, 24 bp, Homo sapiens
ctaggcgattttgtctaccatttg

SEQ ID NO: 3692448 - DNA, 18 bp, Homo sapiens
ctagggattcaggctgct

SEQ ID NO: 3692449 - DNA, 12 bp, Homo sapiens
ctaggtctccag

SEQ ID NO: 3692450 - DNA, 13 bp, Homo sapiens
ctaggtctccagt

SEQ ID NO: 3692451 - DNA, 16 bp, Homo sapiens
ctagtcaagctcctcc

SEQ ID NO: 3692452 - DNA, 23 bp, Homo sapiens
ctagtcaagctcctcctccctgc

SEQ ID NO: 3692453 - DNA, 20 bp, Homo sapiens
ctagtcaatcaagtctgttt

SEQ ID NO: 3692454 - DNA, 13 bp, Homo sapiens
ctcctctcagtac

SEQ ID NO: 3692455 - DNA, 18 bp, Homo sapiens
ctcctctcccatccttga

SEQ ID NO: 3692456 - DNA, 22 bp, Homo sapiens
ctcctctccccagcccagagac

SEQ ID NO: 3692457 - DNA, 14 bp, Homo sapiens
ctcctgaatgaggc

SEQ ID NO: 3692458 - DNA, 23 bp, Homo sapiens
ctcctgaccagggcaaggcccct

SEQ ID NO: 3692459 - DNA, 15 bp, Homo sapiens
ctcctgactcatccg

SEQ ID NO: 3692460 - DNA, 15 bp, Homo sapiens
ctcctgactggtgct

SEQ ID NO: 3692461 - DNA, 21 bp, Homo sapiens
ctcctgaggggcatctgcccc

SEQ ID NO: 3692462 - DNA, 18 bp, Homo sapiens
ctcctgattaaggcgtgg

SEQ ID NO: 3692463 - DNA, 23 bp, Homo sapiens
ctcctgattaaggcgtggcttct

SEQ ID NO: 3692464 - DNA, 15 bp, Homo sapiens
ctcctgcacttactt

SEQ ID NO: 3692465 - DNA, 18 bp, Homo sapiens
ctcctgcacttacttgct

SEQ ID NO: 3692466 - DNA, 19 bp, Homo sapiens
ctcctgcacttacttgctt

SEQ ID NO: 3692467 - DNA, 18 bp, Homo sapiens
ctcctgccagggaactgg

SEQ ID NO: 3692468 - DNA, 19 bp, Homo sapiens
ctcctgccattcttctggt

SEQ ID NO: 3692469 - DNA, 22 bp, Homo sapiens
ctcctgcctcagcctccctggt

SEQ ID NO: 3692470 - DNA, 22 bp, Homo sapiens
ctcctgcgggggcgaggcccct

SEQ ID NO: 3692471 - DNA, 14 bp, Homo sapiens
ctcctgctgtgcct

SEQ ID NO: 3692472 - DNA, 19 bp, Homo sapiens
ctcctggcccactgcatcg

SEQ ID NO: 3692473 - DNA, 22 bp, Homo sapiens
ctcctgtggtagtcctcccaag

SEQ ID NO: 3692474 - DNA, 18 bp, Homo sapiens
ctccttccaacaggagct

SEQ ID NO: 3692475 - DNA, 19 bp, Homo sapiens
ctccttcccattggctttc

SEQ ID NO: 3692476 - DNA, 17 bp, Homo sapiens
ctccttcctgtgggtgg

SEQ ID NO: 3692477 - DNA, 16 bp, Homo sapiens
ctccttgctgcattga

SEQ ID NO: 3692478 - DNA, 13 bp, Homo sapiens
ctccttgggaggc

SEQ ID NO: 3692479 - DNA, 16 bp, Homo sapiens
ctccttgggaggcccc

SEQ ID NO: 3692480 - DNA, 22 bp, Homo sapiens
ctccttgggaggccccactggg

SEQ ID NO: 3692481 - DNA, 16 bp, Homo sapiens
ctccttgtaaagactg

SEQ ID NO: 3692482 - DNA, 13 bp, Homo sapiens
ctcgaatctctgt

SEQ ID NO: 3692483 - DNA, 15 bp, Homo sapiens
ctcgaatctctgtgc

SEQ ID NO: 3692484 - DNA, 23 bp, Homo sapiens
ctcgcctgacaaccactggtctg

SEQ ID NO: 3692485 - DNA, 16 bp, Homo sapiens
ctcgcgcttgctggcc

SEQ ID NO: 3692486 - DNA, 15 bp, Homo sapiens
ctcggcccctcccac

SEQ ID NO: 3692487 - DNA, 20 bp, Homo sapiens
ctcgggtctccccacctgca

SEQ ID NO: 3692488 - DNA, 13 bp, Homo sapiens
ctcgtcccatcca

SEQ ID NO: 3692489 - DNA, 21 bp, Homo sapiens
ctcgtcccatccagctaccac

SEQ ID NO: 3692490 - DNA, 16 bp, Homo sapiens
ctcgtgcatccctgag

SEQ ID NO: 3692491 - DNA, 23 bp, Homo sapiens
ctcgttcttatttaatctccatt

SEQ ID NO: 3692492 - DNA, 14 bp, Homo sapiens
ctctaactggacag

SEQ ID NO: 3692493 - DNA, 20 bp, Homo sapiens
ctctaccatcccctgtagag

SEQ ID NO: 3692494 - DNA, 14 bp, Homo sapiens
ctctaccctcccac

SEQ ID NO: 3692495 - DNA, 15 bp, Homo sapiens
ctctaccctcccacc

SEQ ID NO: 3692496 - DNA, 18 bp, Homo sapiens
ctctacttaatccaatgg

SEQ ID NO: 3692497 - DNA, 15 bp, Homo sapiens
ctctactttgattct

SEQ ID NO: 3692498 - DNA, 16 bp, Homo sapiens
ctctagagcagggatt

SEQ ID NO: 3692499 - DNA, 21 bp, Homo sapiens
ctctaggatggggcacggctc

SEQ ID NO: 3692500 - DNA, 23 bp, Homo sapiens
ctctagggaaaaaccagcgtgtg

SEQ ID NO: 3692501 - DNA, 14 bp, Homo sapiens
ctctagtgccttct

SEQ ID NO: 3692502 - DNA, 15 bp, Homo sapiens
ctctagttctttgtt

SEQ ID NO: 3692503 - DNA, 15 bp, Homo sapiens
ctctatttttaatca

SEQ ID NO: 3692504 - DNA, 20 bp, Homo sapiens
ctctcaaatgtgtgttcctg

SEQ ID NO: 3692505 - DNA, 22 bp, Homo sapiens
ctctcagaccttacacaccatt

SEQ ID NO: 3692506 - DNA, 18 bp, Homo sapiens
ctctcagtactttggagg

SEQ ID NO: 3692507 - DNA, 20 bp, Homo sapiens
ctctcatgttttcaactgcc

SEQ ID NO: 3692508 - DNA, 18 bp, Homo sapiens
ctctcccattgtccctct

SEQ ID NO: 3692509 - DNA, 12 bp, Homo sapiens
ctctccccacac

SEQ ID NO: 3692510 - DNA, 13 bp, Homo sapiens
ctctccccacact

SEQ ID NO: 3692511 - DNA, 15 bp, Homo sapiens
ctctccccagcccag

SEQ ID NO: 3692512 - DNA, 19 bp, Homo sapiens
ctctccccagcccagagac

SEQ ID NO: 3692513 - DNA, 23 bp, Homo sapiens
ctctccccaggtccagctctgga

SEQ ID NO: 3692514 - DNA, 14 bp, Homo sapiens
ctctccgcgggtgg

SEQ ID NO: 3692515 - DNA, 15 bp, Homo sapiens
ctctcctgcctcagc

SEQ ID NO: 3692516 - DNA, 21 bp, Homo sapiens
ctctccttggcctttcctgga

SEQ ID NO: 3692517 - DNA, 13 bp, Homo sapiens
ctctctgctgtac

SEQ ID NO: 3692518 - DNA, 19 bp, Homo sapiens
ctctctggtggctgggctg

SEQ ID NO: 3692519 - DNA, 14 bp, Homo sapiens
ctctcttctgctcc

SEQ ID NO: 3692520 - DNA, 18 bp, Homo sapiens
ctctcttctgctccaccc

SEQ ID NO: 3692521 - DNA, 23 bp, Homo sapiens
ctctgaaaaggaacggcttcctc

SEQ ID NO: 3692522 - DNA, 19 bp, Homo sapiens
ctctgacttctgcctggag

SEQ ID NO: 3692523 - DNA, 17 bp, Homo sapiens
ctctgagtgttttatga

SEQ ID NO: 3692524 - DNA, 19 bp, Homo sapiens
ctctgagtgttttatgaga

SEQ ID NO: 3692525 - DNA, 10 bp, Homo sapiens
ctctgcacaa

SEQ ID NO: 3692526 - DNA, 14 bp, Homo sapiens
ctctgcacaagctg

SEQ ID NO: 3692527 - DNA, 18 bp, Homo sapiens
ctctgcacaagctgcacc

SEQ ID NO: 3692528 - DNA, 20 bp, Homo sapiens
ctctgcacaagctgcaccct

SEQ ID NO: 3692529 - DNA, 21 bp, Homo sapiens
ctctgcacaagctgcaccctc

SEQ ID NO: 3692530 - DNA, 16 bp, Homo sapiens
ctctgcactactgaca

SEQ ID NO: 3692531 - DNA, 17 bp, Homo sapiens
ctctgccccatcctcca

SEQ ID NO: 3692532 - DNA, 21 bp, Homo sapiens
ctctgcgttggcttctccctg

SEQ ID NO: 3692533 - DNA, 13 bp, Homo sapiens
ctctgcttctctg

SEQ ID NO: 3692534 - DNA, 15 bp, Homo sapiens
ctctgcttctctgac

SEQ ID NO: 3692535 - DNA, 15 bp, Homo sapiens
ctctggacagcccca

SEQ ID NO: 3692536 - DNA, 18 bp, Homo sapiens
ctctggacagccccaccc

SEQ ID NO: 3692537 - DNA, 19 bp, Homo sapiens
ctctggactggctagagtc

SEQ ID NO: 3692538 - DNA, 16 bp, Homo sapiens
ctctggaggggagggg

SEQ ID NO: 3692539 - DNA, 14 bp, Homo sapiens
ctctggagtggcca

SEQ ID NO: 3692540 - DNA, 15 bp, Homo sapiens
ctctggagtggccac

SEQ ID NO: 3692541 - DNA, 16 bp, Homo sapiens
ctctggagtggccact

SEQ ID NO: 3692542 - DNA, 22 bp, Homo sapiens
ctctggctagaggccagcccca

SEQ ID NO: 3692543 - DNA, 19 bp, Homo sapiens
ctctggggtaggctgctcc

SEQ ID NO: 3692544 - DNA, 14 bp, Homo sapiens
ctctgggtgggcgg

SEQ ID NO: 3692545 - DNA, 14 bp, Homo sapiens
ctctgggtgggcgt

SEQ ID NO: 3692546 - DNA, 20 bp, Homo sapiens
ctctggtcgctcctgcccac

SEQ ID NO: 3692547 - DNA, 19 bp, Homo sapiens
ctctggtggccactgagct

SEQ ID NO: 3692548 - DNA, 22 bp, Homo sapiens
ctctggtggccactgagctggc

SEQ ID NO: 3692549 - DNA, 23 bp, Homo sapiens
ctctggtggccactgagctggct

SEQ ID NO: 3692550 - DNA, 19 bp, Homo sapiens
ctctggtggctgggctgct

SEQ ID NO: 3692551 - DNA, 18 bp, Homo sapiens
ctctgtctcccaggctgg

SEQ ID NO: 3692552 - DNA, 14 bp, Homo sapiens
ctctgtcttctgga

SEQ ID NO: 3692553 - DNA, 14 bp, Homo sapiens
ctctgttgtaagaa

SEQ ID NO: 3692554 - DNA, 14 bp, Homo sapiens
ctcttaaattatat

SEQ ID NO: 3692555 - DNA, 19 bp, Homo sapiens
ctcttactgttttgaggaa

SEQ ID NO: 3692556 - DNA, 13 bp, Homo sapiens
ctcttagaaaaac

SEQ ID NO: 3692557 - DNA, 19 bp, Homo sapiens
ctcttagcagcttccagat

SEQ ID NO: 3692558 - DNA, 15 bp, Homo sapiens
ctcttcaaatgcctg

SEQ ID NO: 3692559 - DNA, 15 bp, Homo sapiens
ctcttcaggcctccc

SEQ ID NO: 3692560 - DNA, 20 bp, Homo sapiens
ctcttcaggcctccctctct

SEQ ID NO: 3692561 - DNA, 14 bp, Homo sapiens
ctcttcagttaatt

SEQ ID NO: 3692562 - DNA, 17 bp, Homo sapiens
ctcttcagttaattctt

SEQ ID NO: 3692563 - DNA, 18 bp, Homo sapiens
ctcttcagttaattctta

SEQ ID NO: 3692564 - DNA, 16 bp, Homo sapiens
ctcttccaaaggcagc

SEQ ID NO: 3692565 - DNA, 12 bp, Homo sapiens
ctcttccccaga

SEQ ID NO: 3692566 - DNA, 22 bp, Homo sapiens
ctcttccctgcgcctgtgatgc

SEQ ID NO: 3692567 - DNA, 12 bp, Homo sapiens
ctcttccctggg

SEQ ID NO: 3692568 - DNA, 13 bp, Homo sapiens
ctcttccctggga

SEQ ID NO: 3692569 - DNA, 14 bp, Homo sapiens
ctcttccctgggaa

SEQ ID NO: 3692570 - DNA, 23 bp, Homo sapiens
ctcttccttgaagaactgcaggc

SEQ ID NO: 3692571 - DNA, 18 bp, Homo sapiens
ctgcaggccctggcctcc

SEQ ID NO: 3692572 - DNA, 14 bp, Homo sapiens
ctgcaggcggggct

SEQ ID NO: 3692573 - DNA, 16 bp, Homo sapiens
ctgcaggcggggctcc

SEQ ID NO: 3692574 - DNA, 18 bp, Homo sapiens
ctgcaggcggggctcctc

SEQ ID NO: 3692575 - DNA, 20 bp, Homo sapiens
ctgcaggcggggctcctcct

SEQ ID NO: 3692576 - DNA, 23 bp, Homo sapiens
ctgcaggcggggctcctcctgaa

SEQ ID NO: 3692577 - DNA, 23 bp, Homo sapiens
ctgcagggccatggctcagggtg

SEQ ID NO: 3692578 - DNA, 16 bp, Homo sapiens
ctgcataccaacctgg

SEQ ID NO: 3692579 - DNA, 14 bp, Homo sapiens
ctgcataggctcct

SEQ ID NO: 3692580 - DNA, 20 bp, Homo sapiens
ctgcataggctccttcctgt

SEQ ID NO: 3692581 - DNA, 16 bp, Homo sapiens
ctgcatcgtttcatct

SEQ ID NO: 3692582 - DNA, 22 bp, Homo sapiens
ctgcatcgtttcatcttccaac

SEQ ID NO: 3692583 - DNA, 17 bp, Homo sapiens
ctgcatctgaccagcag

SEQ ID NO: 3692584 - DNA, 21 bp, Homo sapiens
ctgcatctgaccagcagcgcc

SEQ ID NO: 3692585 - DNA, 15 bp, Homo sapiens
ctgccaaaatgctct

SEQ ID NO: 3692586 - DNA, 16 bp, Homo sapiens
ctgccaaaatgctcta

SEQ ID NO: 3692587 - DNA, 15 bp, Homo sapiens
ctgccaaggccagag

SEQ ID NO: 3692588 - DNA, 19 bp, Homo sapiens
ctgccaattgctaccgaga

SEQ ID NO: 3692589 - DNA, 13 bp, Homo sapiens
ctgccaccaggcc

SEQ ID NO: 3692590 - DNA, 14 bp, Homo sapiens
ctgccaccaggcca

SEQ ID NO: 3692591 - DNA, 15 bp, Homo sapiens
ctgccaccaggccac

SEQ ID NO: 3692592 - DNA, 23 bp, Homo sapiens
ctgccaccaggccacctccccag

SEQ ID NO: 3692593 - DNA, 17 bp, Homo sapiens
ctgccacccacctccct

SEQ ID NO: 3692594 - DNA, 19 bp, Homo sapiens
ctgccacccacctccctgc

SEQ ID NO: 3692595 - DNA, 20 bp, Homo sapiens
ctgccacccacctccctgcc

SEQ ID NO: 3692596 - DNA, 22 bp, Homo sapiens
ctgccaggacccaccactggaa

SEQ ID NO: 3692597 - DNA, 11 bp, Homo sapiens
ctgccaggcat

SEQ ID NO: 3692598 - DNA, 15 bp, Homo sapiens
ctgccagggaactgg

SEQ ID NO: 3692599 - DNA, 19 bp, Homo sapiens
ctgccagggaactggcctg

SEQ ID NO: 3692600 - DNA, 23 bp, Homo sapiens
ctgccagggaactggcctgctgc

SEQ ID NO: 3692601 - DNA, 19 bp, Homo sapiens
ctgccagtgacagacaggc

SEQ ID NO: 3692602 - DNA, 20 bp, Homo sapiens
ctgccatctagccagcccct

SEQ ID NO: 3692603 - DNA, 16 bp, Homo sapiens
ctgccattcttctggt

SEQ ID NO: 3692604 - DNA, 17 bp, Homo sapiens
ctgccattcttctggtg

SEQ ID NO: 3692605 - DNA, 15 bp, Homo sapiens
ctgccatttctgaga

SEQ ID NO: 3692606 - DNA, 15 bp, Homo sapiens
ctgcccacctgccgg

SEQ ID NO: 3692607 - DNA, 12 bp, Homo sapiens
ctgcccagagct

SEQ ID NO: 3692608 - DNA, 14 bp, Homo sapiens
ctgcccaggcactg

SEQ ID NO: 3692609 - DNA, 15 bp, Homo sapiens
ctgcccaggcactgc

SEQ ID NO: 3692610 - DNA, 18 bp, Homo sapiens
ctgcccatcacagggttg

SEQ ID NO: 3692611 - DNA, 15 bp, Homo sapiens
ctgccccaggcctga

SEQ ID NO: 3692612 - DNA, 17 bp, Homo sapiens
ctgccccatcctccagc

SEQ ID NO: 3692613 - DNA, 15 bp, Homo sapiens
ctgcccctcagagac

SEQ ID NO: 3692614 - DNA, 15 bp, Homo sapiens
ctgcccctcccagaa

SEQ ID NO: 3692615 - DNA, 13 bp, Homo sapiens
ctgcccggcaggg

SEQ ID NO: 3692616 - DNA, 17 bp, Homo sapiens
ctgcccgggctcccaca

SEQ ID NO: 3692617 - DNA, 15 bp, Homo sapiens
ctgccctcttactgt

SEQ ID NO: 3692618 - DNA, 17 bp, Homo sapiens
ctgccctggcagggtca

SEQ ID NO: 3692619 - DNA, 16 bp, Homo sapiens
ctgccctgtttctgtt

SEQ ID NO: 3692620 - DNA, 23 bp, Homo sapiens
ctgcccttgtcccactcaagcca

SEQ ID NO: 3692621 - DNA, 21 bp, Homo sapiens
ctgccggacccggaggccgag

SEQ ID NO: 3692622 - DNA, 17 bp, Homo sapiens
ctgcctacgccaggaga

SEQ ID NO: 3692623 - DNA, 14 bp, Homo sapiens
ctgcctcacttcct

SEQ ID NO: 3692624 - DNA, 19 bp, Homo sapiens
ctgcctcagcctccctggt

SEQ ID NO: 3692625 - DNA, 13 bp, Homo sapiens
ctgcctccagcct

SEQ ID NO: 3692626 - DNA, 22 bp, Homo sapiens
ctgcctccagcctggtggccca

SEQ ID NO: 3692627 - DNA, 14 bp, Homo sapiens
ctgcctgagggtgg

SEQ ID NO: 3692628 - DNA, 19 bp, Homo sapiens
ctgcctgagggtgggcttt

SEQ ID NO: 3692629 - DNA, 13 bp, Homo sapiens
ctgcctggccagg

SEQ ID NO: 3692630 - DNA, 15 bp, Homo sapiens
ctgcctggccaggca

SEQ ID NO: 3692631 - DNA, 16 bp, Homo sapiens
ctgcctggccaggcag

SEQ ID NO: 3692632 - DNA, 23 bp, Homo sapiens
ctgcctgtggcgccgtctccagg

SEQ ID NO: 3692633 - DNA, 15 bp, Homo sapiens
ctgccttatcttgca

SEQ ID NO: 3692634 - DNA, 17 bp, Homo sapiens
ctgccttatcttgcacc

SEQ ID NO: 3692635 - DNA, 13 bp, Homo sapiens
ctgccttcgcttc

SEQ ID NO: 3692636 - DNA, 15 bp, Homo sapiens
ctgccttcgcttctt

SEQ ID NO: 3692637 - DNA, 21 bp, Homo sapiens
ctgccttcgcttcttgcctct

SEQ ID NO: 3692638 - DNA, 18 bp, Homo sapiens
ctgcctttgatgttacag

SEQ ID NO: 3692639 - DNA, 20 bp, Homo sapiens
ctgcctttgcaccacgggac

SEQ ID NO: 3692640 - DNA, 13 bp, Homo sapiens
ctgcgaccctggg

SEQ ID NO: 3692641 - DNA, 22 bp, Homo sapiens
ctgcgaccctgggggcacagga

SEQ ID NO: 3692642 - DNA, 23 bp, Homo sapiens
ctgcgtcgagctgggaaggttcc

SEQ ID NO: 3692643 - DNA, 20 bp, Homo sapiens
ctgcgtgccagtcaagaaga

SEQ ID NO: 3692644 - DNA, 21 bp, Homo sapiens
ctgcgttggcttctccctggg

SEQ ID NO: 3692645 - DNA, 16 bp, Homo sapiens
ctgctacctctgagaa

SEQ ID NO: 3692646 - DNA, 17 bp, Homo sapiens
ctgctacctctgagaag

SEQ ID NO: 3692647 - DNA, 19 bp, Homo sapiens
ctgctacctttcaaagctt

SEQ ID NO: 3692648 - DNA, 15 bp, Homo sapiens
ctgctatatccactg

SEQ ID NO: 3692649 - DNA, 22 bp, Homo sapiens
ctgctcagctgcgcccccttct

SEQ ID NO: 3692650 - DNA, 13 bp, Homo sapiens
ctgctcagcttct

SEQ ID NO: 3692651 - DNA, 16 bp, Homo sapiens
ctgctcagcttctcct

SEQ ID NO: 3692652 - DNA, 21 bp, Homo sapiens
ctgctccacccttggcctgtc

SEQ ID NO: 3692653 - DNA, 19 bp, Homo sapiens
ctgggaggtcaaggctgca

SEQ ID NO: 3692654 - DNA, 21 bp, Homo sapiens
ctgggaggtcaaggctgcagt

SEQ ID NO: 3692655 - DNA, 17 bp, Homo sapiens
ctgggatcctaagggct

SEQ ID NO: 3692656 - DNA, 16 bp, Homo sapiens
ctgggcagaaggccaa

SEQ ID NO: 3692657 - DNA, 19 bp, Homo sapiens
ctgggcagctgtcccttgc

SEQ ID NO: 3692658 - DNA, 20 bp, Homo sapiens
ctgggcccgacatggctccg

SEQ ID NO: 3692659 - DNA, 13 bp, Homo sapiens
ctgggccctgggc

SEQ ID NO: 3692660 - DNA, 15 bp, Homo sapiens
ctgggccctgggctg

SEQ ID NO: 3692661 - DNA, 16 bp, Homo sapiens
ctgggccgctgccacg

SEQ ID NO: 3692662 - DNA, 14 bp, Homo sapiens
ctgggcctcagttt

SEQ ID NO: 3692663 - DNA, 15 bp, Homo sapiens
ctgggctgctcctga

SEQ ID NO: 3692664 - DNA, 18 bp, Homo sapiens
ctgggcttgtctgtagat

SEQ ID NO: 3692665 - DNA, 17 bp, Homo sapiens
ctggggaaagcctgaag

SEQ ID NO: 3692666 - DNA, 19 bp, Homo sapiens
ctggggaaataacagctgt

SEQ ID NO: 3692667 - DNA, 19 bp, Homo sapiens
ctggggctaggctggagcc

SEQ ID NO: 3692668 - DNA, 15 bp, Homo sapiens
ctgggggaagaagct

SEQ ID NO: 3692669 - DNA, 13 bp, Homo sapiens
ctgggggcacagg

SEQ ID NO: 3692670 - DNA, 16 bp, Homo sapiens
ctggggggacccagtg

SEQ ID NO: 3692671 - DNA, 21 bp, Homo sapiens
ctggggggacccagtgcagaa

SEQ ID NO: 3692672 - DNA, 17 bp, Homo sapiens
ctgggggtgggccaggc

SEQ ID NO: 3692673 - DNA, 15 bp, Homo sapiens
ctgggggtggggctc

SEQ ID NO: 3692674 - DNA, 15 bp, Homo sapiens
ctggggtaggctgct

SEQ ID NO: 3692675 - DNA, 23 bp, Homo sapiens
ctggggtaggctgctccctgagg

SEQ ID NO: 3692676 - DNA, 13 bp, Homo sapiens
ctggggtggggtc

SEQ ID NO: 3692677 - DNA, 19 bp, Homo sapiens
ctggggtgtgggaggcccg

SEQ ID NO: 3692678 - DNA, 20 bp, Homo sapiens
ctgggtaactagggaagata

SEQ ID NO: 3692679 - DNA, 14 bp, Homo sapiens
ctgggtaagaagaa

SEQ ID NO: 3692680 - DNA, 16 bp, Homo sapiens
ctgggtaagaagaaag

SEQ ID NO: 3692681 - DNA, 17 bp, Homo sapiens
ctgggtaagaagaaagc

SEQ ID NO: 3692682 - DNA, 15 bp, Homo sapiens
ctgggtacttcttga

SEQ ID NO: 3692683 - DNA, 17 bp, Homo sapiens
ctgggtacttcttgaag

SEQ ID NO: 3692684 - DNA, 21 bp, Homo sapiens
ctgggtccaggggatgggagg

SEQ ID NO: 3692685 - DNA, 15 bp, Homo sapiens
ctgggtgctccctac

SEQ ID NO: 3692686 - DNA, 13 bp, Homo sapiens
ctgggtggagcag

SEQ ID NO: 3692687 - DNA, 14 bp, Homo sapiens
ctgggtggagcagg

SEQ ID NO: 3692688 - DNA, 22 bp, Homo sapiens
ctgggtggagcaggactcccac

SEQ ID NO: 3692689 - DNA, 20 bp, Homo sapiens
ctgggtgggcgtggcctgca

SEQ ID NO: 3692690 - DNA, 22 bp, Homo sapiens
ctgggtgggcgtggcctgcata

SEQ ID NO: 3692691 - DNA, 13 bp, Homo sapiens
cttgcctctgtgc

SEQ ID NO: 3692692 - DNA, 14 bp, Homo sapiens
cttgcctctgtgct

SEQ ID NO: 3692693 - DNA, 16 bp, Homo sapiens
cttgcctctgtgctgt

SEQ ID NO: 3692694 - DNA, 13 bp, Homo sapiens
cttgcctcttcct

SEQ ID NO: 3692695 - DNA, 13 bp, Homo sapiens
cttgcctgcaggg

SEQ ID NO: 3692696 - DNA, 14 bp, Homo sapiens
cttgcctgcagggc

SEQ ID NO: 3692697 - DNA, 15 bp, Homo sapiens
cttgcctttcagtat

SEQ ID NO: 3692698 - DNA, 12 bp, Homo sapiens
cttgctgagtga

SEQ ID NO: 3692699 - DNA, 16 bp, Homo sapiens
cttgctgagtgaagga

SEQ ID NO: 3692700 - DNA, 20 bp, Homo sapiens
cttgctgttgacatatttaa

SEQ ID NO: 3692701 - DNA, 17 bp, Homo sapiens
cttgcttgcctgcaggg

SEQ ID NO: 3692702 - DNA, 15 bp, Homo sapiens
cttggaagtctgtct

SEQ ID NO: 3692703 - DNA, 19 bp, Homo sapiens
cttggaagtctgtctcagg

SEQ ID NO: 3692704 - DNA, 16 bp, Homo sapiens
cttggacatcctcctc

SEQ ID NO: 3692705 - DNA, 21 bp, Homo sapiens
cttggacatcctcctcccacc

SEQ ID NO: 3692706 - DNA, 15 bp, Homo sapiens
cttggaggccagcca

SEQ ID NO: 3692707 - DNA, 21 bp, Homo sapiens
cttggcaccagacacccagga

SEQ ID NO: 3692708 - DNA, 23 bp, Homo sapiens
cttggcctgtctcatccccaggg

SEQ ID NO: 3692709 - DNA, 20 bp, Homo sapiens
cttggctcgaatctctgtgc

SEQ ID NO: 3692710 - DNA, 14 bp, Homo sapiens
cttggctttgttga

SEQ ID NO: 3692711 - DNA, 12 bp, Homo sapiens
cttggctttttc

SEQ ID NO: 3692712 - DNA, 22 bp, Homo sapiens
cttgggaggccccactggggaa

SEQ ID NO: 3692713 - DNA, 14 bp, Homo sapiens
cttgggcagagctg

SEQ ID NO: 3692714 - DNA, 20 bp, Homo sapiens
cttgggcagagctggctctg

SEQ ID NO: 3692715 - DNA, 22 bp, Homo sapiens
cttgggcagagctggctctgag

SEQ ID NO: 3692716 - DNA, 14 bp, Homo sapiens
cttgggcagcatcc

SEQ ID NO: 3692717 - DNA, 19 bp, Homo sapiens
cttggggagttaagacctg

SEQ ID NO: 3692718 - DNA, 20 bp, Homo sapiens
cttggggagttaagacctgg

SEQ ID NO: 3692719 - DNA, 14 bp, Homo sapiens
cttggggcaggcag

SEQ ID NO: 3692720 - DNA, 15 bp, Homo sapiens
cttggggcaggcagt

SEQ ID NO: 3692721 - DNA, 18 bp, Homo sapiens
cttggggctcacacacct

SEQ ID NO: 3692722 - DNA, 18 bp, Homo sapiens
cttgggggggtggccgct

SEQ ID NO: 3692723 - DNA, 17 bp, Homo sapiens
cttgggtgggacagggc

SEQ ID NO: 3692724 - DNA, 14 bp, Homo sapiens
cttggtcagagcca

SEQ ID NO: 3692725 - DNA, 17 bp, Homo sapiens
cttggtgggggagcctc

SEQ ID NO: 3692726 - DNA, 17 bp, Homo sapiens
cttggtgtgtaggttcc

SEQ ID NO: 3692727 - DNA, 14 bp, Homo sapiens
cttggtttatgtct

SEQ ID NO: 3692728 - DNA, 23 bp, Homo sapiens
cttggtttatgtcttgttcttga

SEQ ID NO: 3692729 - DNA, 21 bp, Homo sapiens
cttgtaggtatgtctgtgcca

SEQ ID NO: 3692730 - DNA, 13 bp, Homo sapiens
cttgtatttccaa

SEQ ID NO: 3692731 - DNA, 19 bp, Homo sapiens
cttgtcaagcctgtgcaaa

SEQ ID NO: 3692732 - DNA, 16 bp, Homo sapiens
cttgtcccactcaagc

SEQ ID NO: 3692733 - DNA, 20 bp, Homo sapiens
cttgtcccctcctcactccc

SEQ ID NO: 3692734 - DNA, 20 bp, Homo sapiens
cttgtctcaggactctgaaa

SEQ ID NO: 3692735 - DNA, 14 bp, Homo sapiens
cttgtgtcccatga

SEQ ID NO: 3692736 - DNA, 15 bp, Homo sapiens
cttgttacttctgag

SEQ ID NO: 3692737 - DNA, 13 bp, Homo sapiens
cttgttccagctc

SEQ ID NO: 3692738 - DNA, 14 bp, Homo sapiens
cttgttcttgagat

SEQ ID NO: 3692739 - DNA, 15 bp, Homo sapiens
cttgttcttgagatt

SEQ ID NO: 3692740 - DNA, 20 bp, Homo sapiens
cttgttgttggttgtttttt

SEQ ID NO: 3692741 - DNA, 12 bp, Homo sapiens
cttgtttctgca

SEQ ID NO: 3692742 - DNA, 18 bp, Homo sapiens
cttgtttctgcatctttt

SEQ ID NO: 3692743 - DNA, 20 bp, Homo sapiens
cttgtttctgcatctttttg

SEQ ID NO: 3692744 - DNA, 18 bp, Homo sapiens
cttgtttgctcacctggg

SEQ ID NO: 3692745 - DNA, 23 bp, Homo sapiens
ctgaacctatttcttaaacactt

SEQ ID NO: 3692746 - DNA, 22 bp, Homo sapiens
ctgaagcagatgcaaagaggca

SEQ ID NO: 3692747 - DNA, 23 bp, Homo sapiens
ctgaagcctttgcattttggaga

SEQ ID NO: 3692748 - DNA, 18 bp, Homo sapiens
ctgaaggaggcggggctc

SEQ ID NO: 3692749 - DNA, 16 bp, Homo sapiens
ctgaaggcagggctcc

SEQ ID NO: 3692750 - DNA, 18 bp, Homo sapiens
ctgaaggcagggctcctc

SEQ ID NO: 3692751 - DNA, 16 bp, Homo sapiens
ctgaagggcctcccag

SEQ ID NO: 3692752 - DNA, 17 bp, Homo sapiens
ctgaagggcctcccagc

SEQ ID NO: 3692753 - DNA, 21 bp, Homo sapiens
ctgaaggggttctcacagtgg

SEQ ID NO: 3692754 - DNA, 17 bp, Homo sapiens
ctgaatgaggcggagct

SEQ ID NO: 3692755 - DNA, 22 bp, Homo sapiens
ctgaatgaggcggagctccagg

SEQ ID NO: 3692756 - DNA, 20 bp, Homo sapiens
ctgaatggtgcgtgaaggct

SEQ ID NO: 3692757 - DNA, 12 bp, Homo sapiens
ctgaattttctg

SEQ ID NO: 3692758 - DNA, 12 bp, Homo sapiens
ctgacagctgct

SEQ ID NO: 3692759 - DNA, 13 bp, Homo sapiens
ctgacagctgctc

SEQ ID NO: 3692760 - DNA, 15 bp, Homo sapiens
ctgacagctgctcct

SEQ ID NO: 3692761 - DNA, 23 bp, Homo sapiens
ctgacagctgctcctagagggag

SEQ ID NO: 3692762 - DNA, 16 bp, Homo sapiens
ctgacattgccaaaaa

SEQ ID NO: 3692763 - DNA, 20 bp, Homo sapiens
ctgacattgccaaaaaggat

SEQ ID NO: 3692764 - DNA, 21 bp, Homo sapiens
ctgacattgccaaaaaggata

SEQ ID NO: 3692765 - DNA, 14 bp, Homo sapiens
ctgaccagcagcgc

SEQ ID NO: 3692766 - DNA, 15 bp, Homo sapiens
ctgaccagcagcgcc

SEQ ID NO: 3692767 - DNA, 21 bp, Homo sapiens
ctgaccagcagcgcctttccc

SEQ ID NO: 3692768 - DNA, 15 bp, Homo sapiens
ctgaccagggcaagg

SEQ ID NO: 3692769 - DNA, 17 bp, Homo sapiens
ctgaccaggggccctac

SEQ ID NO: 3692770 - DNA, 15 bp, Homo sapiens
ctgaccatccactct

SEQ ID NO: 3692771 - DNA, 22 bp, Homo sapiens
ctgaccatgctcatctgctggt

SEQ ID NO: 3692772 - DNA, 23 bp, Homo sapiens
ctgacccagtgcccccactgacc

SEQ ID NO: 3692773 - DNA, 14 bp, Homo sapiens
ctgaccccagccca

SEQ ID NO: 3692774 - DNA, 15 bp, Homo sapiens
ctgaccccagcccag

SEQ ID NO: 3692775 - DNA, 16 bp, Homo sapiens
ctgaccccagcccaga

SEQ ID NO: 3692776 - DNA, 21 bp, Homo sapiens
ctgaccccagcccagacagca

SEQ ID NO: 3692777 - DNA, 18 bp, Homo sapiens
ctgaccgaaacagcgctg

SEQ ID NO: 3692778 - DNA, 16 bp, Homo sapiens
ctgacctccacagctt

SEQ ID NO: 3692779 - DNA, 20 bp, Homo sapiens
ctgacggccagggagaagct

SEQ ID NO: 3692780 - DNA, 20 bp, Homo sapiens
ctgactaagccccgtctgac

SEQ ID NO: 3692781 - DNA, 23 bp, Homo sapiens
ctgactagaagggccagtcctgc

SEQ ID NO: 3692782 - DNA, 19 bp, Homo sapiens
ctgactagagtgatgactg

SEQ ID NO: 3692783 - DNA, 21 bp, Homo sapiens
ctgactagagtgatgactgct

SEQ ID NO: 3692784 - DNA, 17 bp, Homo sapiens
ctgactcggtttctcca

SEQ ID NO: 3692785 - DNA, 21 bp, Homo sapiens
ctgactctaggtgcccttgga

SEQ ID NO: 3692786 - DNA, 16 bp, Homo sapiens
ctgactggtgctgcag

SEQ ID NO: 3692787 - DNA, 22 bp, Homo sapiens
ctgactgttcttggtaactgat

SEQ ID NO: 3692788 - DNA, 18 bp, Homo sapiens
ctgactgttttctcttga

SEQ ID NO: 3692789 - DNA, 18 bp, Homo sapiens
ctgacttaagcaaaagaa

SEQ ID NO: 3692790 - DNA, 24 bp, Homo sapiens
ctgacttaagcaaaagaaaaagat

SEQ ID NO: 3692791 - DNA, 15 bp, Homo sapiens
ctgacttctgcctgg

SEQ ID NO: 3692792 - DNA, 19 bp, Homo sapiens
ctgacttctgcctggagac

SEQ ID NO: 3692793 - DNA, 12 bp, Homo sapiens
ctgagaaactct

SEQ ID NO: 3692794 - DNA, 19 bp, Homo sapiens
ctgagatacatacagaatt

SEQ ID NO: 3692795 - DNA, 15 bp, Homo sapiens
ctgagatggaaaagt

SEQ ID NO: 3692796 - DNA, 23 bp, Homo sapiens
ctgagatgggccggcccccttcc

SEQ ID NO: 3692797 - DNA, 16 bp, Homo sapiens
ctgagcacgctaccaa

SEQ ID NO: 3692798 - DNA, 13 bp, Homo sapiens
ctgagcccctgtc

SEQ ID NO: 3692799 - DNA, 16 bp, Homo sapiens
ctgagcccctgtctag

SEQ ID NO: 3692800 - DNA, 13 bp, Homo sapiens
ctgagcgcctcca

SEQ ID NO: 3692801 - DNA, 14 bp, Homo sapiens
ctgagctggctgac

SEQ ID NO: 3692802 - DNA, 20 bp, Homo sapiens
ctgagctggctgactaagcc

SEQ ID NO: 3692803 - DNA, 21 bp, Homo sapiens
ctgagctggctgactaagccc

SEQ ID NO: 3692804 - DNA, 15 bp, Homo sapiens
ctgaggaaaggccag

SEQ ID NO: 3692805 - DNA, 18 bp, Homo sapiens
ctgaggaaaggccagctg

SEQ ID NO: 3692806 - DNA, 14 bp, Homo sapiens
ctgaggcagggaag

SEQ ID NO: 3692807 - DNA, 12 bp, Homo sapiens
ctgaggcctgga

SEQ ID NO: 3692808 - DNA, 19 bp, Homo sapiens
ctgaggcctggactttcct

SEQ ID NO: 3692809 - DNA, 14 bp, Homo sapiens
ctgaggcctgggcc

SEQ ID NO: 3692810 - DNA, 20 bp, Homo sapiens
ctgaggctgtggtcacagcg

SEQ ID NO: 3692811 - DNA, 12 bp, Homo sapiens
ctgagggaccaa

SEQ ID NO: 3692812 - DNA, 16 bp, Homo sapiens
ctgagggaccaactgg

SEQ ID NO: 3692813 - DNA, 19 bp, Homo sapiens
ctgagggaccaactgggcc

SEQ ID NO: 3692814 - DNA, 20 bp, Homo sapiens
ctgagggcagactggggcat

SEQ ID NO: 3692815 - DNA, 20 bp, Homo sapiens
ctgaggggcatctgcccctc

SEQ ID NO: 3692816 - DNA, 16 bp, Homo sapiens
ctgagggtctgggcgg

SEQ ID NO: 3692817 - DNA, 18 bp, Homo sapiens
ctgagggtctgggcggcg

SEQ ID NO: 3692818 - DNA, 14 bp, Homo sapiens
ctgagggtgggctt

SEQ ID NO: 3692819 - DNA, 13 bp, Homo sapiens
ctgaggtgggagg

SEQ ID NO: 3692820 - DNA, 22 bp, Homo sapiens
ctgaggtgggaggatctcttga

SEQ ID NO: 3692821 - DNA, 20 bp, Homo sapiens
ctgagtagctggaattacag

SEQ ID NO: 3692822 - DNA, 21 bp, Homo sapiens
ctgagtatctcctcgcaagct

SEQ ID NO: 3692823 - DNA, 22 bp, Homo sapiens
ctgagtatctcctcgcaagctg

SEQ ID NO: 3692824 - DNA, 15 bp, Homo sapiens
ctgagtcctgagcga

SEQ ID NO: 3692825 - DNA, 22 bp, Homo sapiens
ctgagtctgggcagctgtccct

SEQ ID NO: 3692826 - DNA, 16 bp, Homo sapiens
ctgagtggcaggggac

SEQ ID NO: 3692827 - DNA, 20 bp, Homo sapiens
ctgagttttccatggcagga

SEQ ID NO: 3692828 - DNA, 12 bp, Homo sapiens
ctgatcaaggcc

SEQ ID NO: 3692829 - DNA, 18 bp, Homo sapiens
ctgatctttgtatattac

SEQ ID NO: 3692830 - DNA, 18 bp, Homo sapiens
ctgatgagggggaattcc

SEQ ID NO: 3692831 - DNA, 15 bp, Homo sapiens
ctgtgacccatctgt

SEQ ID NO: 3692832 - DNA, 18 bp, Homo sapiens
ctgtgacccatctgtagt

SEQ ID NO: 3692833 - DNA, 15 bp, Homo sapiens
ctgtgaccctctttg

SEQ ID NO: 3692834 - DNA, 15 bp, Homo sapiens
ctgtgagacccccac

SEQ ID NO: 3692835 - DNA, 18 bp, Homo sapiens
ctgtgagacccccacacc

SEQ ID NO: 3692836 - DNA, 19 bp, Homo sapiens
ctgtgagacccccacacct

SEQ ID NO: 3692837 - DNA, 12 bp, Homo sapiens
ctgtgaggctgt

SEQ ID NO: 3692838 - DNA, 17 bp, Homo sapiens
ctgtgaggctgtcctgt

SEQ ID NO: 3692839 - DNA, 17 bp, Homo sapiens
ctgtgaggcttgcccag

SEQ ID NO: 3692840 - DNA, 16 bp, Homo sapiens
ctgtgattgtgcctac

SEQ ID NO: 3692841 - DNA, 15 bp, Homo sapiens
ctgtgcaaaaaaatt

SEQ ID NO: 3692842 - DNA, 18 bp, Homo sapiens
ctgtgcaacggtctcctg

SEQ ID NO: 3692843 - DNA, 22 bp, Homo sapiens
ctgtgcaacggtctcctgactg

SEQ ID NO: 3692844 - DNA, 19 bp, Homo sapiens
ctgtgccaccccttcctca

SEQ ID NO: 3692845 - DNA, 21 bp, Homo sapiens
ctgtgccccatgcctgtccag

SEQ ID NO: 3692846 - DNA, 21 bp, Homo sapiens
ctgtgcctcgcatcctatgct

SEQ ID NO: 3692847 - DNA, 22 bp, Homo sapiens
ctgtggagctccactgccatgt

SEQ ID NO: 3692848 - DNA, 15 bp, Homo sapiens
ctgtggccagcctgg

SEQ ID NO: 3692849 - DNA, 19 bp, Homo sapiens
ctgtggccagcctggcatc

SEQ ID NO: 3692850 - DNA, 21 bp, Homo sapiens
ctgtggccagcctggcatcag

SEQ ID NO: 3692851 - DNA, 22 bp, Homo sapiens
ctgtggccagctgcatctgtct

SEQ ID NO: 3692852 - DNA, 18 bp, Homo sapiens
ctgtggctccaggccaaa

SEQ ID NO: 3692853 - DNA, 13 bp, Homo sapiens
ctgtggctctggg

SEQ ID NO: 3692854 - DNA, 13 bp, Homo sapiens
ctgtgggtggggc

SEQ ID NO: 3692855 - DNA, 16 bp, Homo sapiens
ctgtgggtggggcttc

SEQ ID NO: 3692856 - DNA, 20 bp, Homo sapiens
ctgtgggtggggcttctctg

SEQ ID NO: 3692857 - DNA, 20 bp, Homo sapiens
ctgtggtagtcctcccaagc

SEQ ID NO: 3692858 - DNA, 23 bp, Homo sapiens
ctgtggtagtcctcccaagctgt

SEQ ID NO: 3692859 - DNA, 21 bp, Homo sapiens
ctgtgtatatggtatatatac

SEQ ID NO: 3692860 - DNA, 19 bp, Homo sapiens
ctgtgtcagcatagaagta

SEQ ID NO: 3692861 - DNA, 13 bp, Homo sapiens
ctgtgtccatgcg

SEQ ID NO: 3692862 - DNA, 18 bp, Homo sapiens
ctgtgtccatgcgctcag

SEQ ID NO: 3692863 - DNA, 19 bp, Homo sapiens
ctgtgtccatgcgctcagg

SEQ ID NO: 3692864 - DNA, 21 bp, Homo sapiens
ctgtgtccatgcgctcagggc

SEQ ID NO: 3692865 - DNA, 11 bp, Homo sapiens
ctgtgtctgag

SEQ ID NO: 3692866 - DNA, 13 bp, Homo sapiens
ctgtgtctgagcc

SEQ ID NO: 3692867 - DNA, 16 bp, Homo sapiens
ctgtgtctgagcccaa

SEQ ID NO: 3692868 - DNA, 17 bp, Homo sapiens
ctgtgtctgagcccaac

SEQ ID NO: 3692869 - DNA, 21 bp, Homo sapiens
ctgtgtctttaaatgctgctt

SEQ ID NO: 3692870 - DNA, 20 bp, Homo sapiens
ctgtgtgtcccaggcaggga

SEQ ID NO: 3692871 - DNA, 17 bp, Homo sapiens
ctgtgtgtgtcccctca

SEQ ID NO: 3692872 - DNA, 22 bp, Homo sapiens
ctgtgttgtctctagagcaggg

SEQ ID NO: 3692873 - DNA, 23 bp, Homo sapiens
gaaatggtccgctttcctggagc

SEQ ID NO: 3692874 - DNA, 14 bp, Homo sapiens
gaaattctcctgga

SEQ ID NO: 3692875 - DNA, 15 bp, Homo sapiens
gaaattctcctggag

SEQ ID NO: 3692876 - DNA, 16 bp, Homo sapiens
gaaattctcctggagg

SEQ ID NO: 3692877 - DNA, 14 bp, Homo sapiens
gaacaaattatttt

SEQ ID NO: 3692878 - DNA, 13 bp, Homo sapiens
gaacaagcctaaa

SEQ ID NO: 3692879 - DNA, 15 bp, Homo sapiens
gaacacaatgtgtat

SEQ ID NO: 3692880 - DNA, 14 bp, Homo sapiens
gaacacactccatc

SEQ ID NO: 3692881 - DNA, 16 bp, Homo sapiens
gaacacgcgtatttac

SEQ ID NO: 3692882 - DNA, 18 bp, Homo sapiens
gaacactagacaagccag

SEQ ID NO: 3692883 - DNA, 20 bp, Homo sapiens
gaacactagacaagccagaa

SEQ ID NO: 3692884 - DNA, 23 bp, Homo sapiens
gaacagggaacattggagctgac

SEQ ID NO: 3692885 - DNA, 17 bp, Homo sapiens
gaacccagactcagaca

SEQ ID NO: 3692886 - DNA, 11 bp, Homo sapiens
gaacccaggca

SEQ ID NO: 3692887 - DNA, 18 bp, Homo sapiens
gaacccaggcagctggca

SEQ ID NO: 3692888 - DNA, 20 bp, Homo sapiens
gaacccaggcagctggcagg

SEQ ID NO: 3692889 - DNA, 14 bp, Homo sapiens
gaaccgcaggaagc

SEQ ID NO: 3692890 - DNA, 18 bp, Homo sapiens
gaaccggctcccaccctc

SEQ ID NO: 3692891 - DNA, 20 bp, Homo sapiens
gaacctcacgcacctcccat

SEQ ID NO: 3692892 - DNA, 12 bp, Homo sapiens
gaacctcagcct

SEQ ID NO: 3692893 - DNA, 13 bp, Homo sapiens
gaacctcagcctg

SEQ ID NO: 3692894 - DNA, 21 bp, Homo sapiens
gaacctcagcctggccagaca

SEQ ID NO: 3692895 - DNA, 16 bp, Homo sapiens
gaacctgcaaaaaata

SEQ ID NO: 3692896 - DNA, 16 bp, Homo sapiens
gaacctggaccccagc

SEQ ID NO: 3692897 - DNA, 19 bp, Homo sapiens
gaacctggaccccagcctt

SEQ ID NO: 3692898 - DNA, 18 bp, Homo sapiens
gaaccttgtcccagccag

SEQ ID NO: 3692899 - DNA, 22 bp, Homo sapiens
gaactaaaaagagactgtgcca

SEQ ID NO: 3692900 - DNA, 16 bp, Homo sapiens
gaactcaaatggggcc

SEQ ID NO: 3692901 - DNA, 13 bp, Homo sapiens
gaactcagatcca

SEQ ID NO: 3692902 - DNA, 18 bp, Homo sapiens
gaactcagatccagggac

SEQ ID NO: 3692903 - DNA, 19 bp, Homo sapiens
gaactcagatccagggaca

SEQ ID NO: 3692904 - DNA, 14 bp, Homo sapiens
gaactccaggccct

SEQ ID NO: 3692905 - DNA, 17 bp, Homo sapiens
gaactcctacctgaagg

SEQ ID NO: 3692906 - DNA, 18 bp, Homo sapiens
gaactcctacctgaaggc

SEQ ID NO: 3692907 - DNA, 12 bp, Homo sapiens
gaactgcaggcc

SEQ ID NO: 3692908 - DNA, 23 bp, Homo sapiens
gaactgcaggccctggcctcccc

SEQ ID NO: 3692909 - DNA, 12 bp, Homo sapiens
gaactgcagtga

SEQ ID NO: 3692910 - DNA, 16 bp, Homo sapiens
gaactggaagaaagca

SEQ ID NO: 3692911 - DNA, 14 bp, Homo sapiens
gaactggagggtga

SEQ ID NO: 3692912 - DNA, 15 bp, Homo sapiens
gaactggcctgctgc

SEQ ID NO: 3692913 - DNA, 15 bp, Homo sapiens
gaacttgaccctgag

SEQ ID NO: 3692914 - DNA, 23 bp, Homo sapiens
gaacttgctgggtggttctctgg

SEQ ID NO: 3692915 - DNA, 18 bp, Homo sapiens
gaagaaattaaggaacat

SEQ ID NO: 3692916 - DNA, 22 bp, Homo sapiens
gaagaaccagtccccccaccct

SEQ ID NO: 3692917 - DNA, 18 bp, Homo sapiens
gaagaaggggacaatggc

SEQ ID NO: 3692918 - DNA, 21 bp, Homo sapiens
gaagagagtccatatttcaat

SEQ ID NO: 3692919 - DNA, 17 bp, Homo sapiens
gaagagggttttaggta

SEQ ID NO: 3692920 - DNA, 20 bp, Homo sapiens
gaagataatattaaggaaga

SEQ ID NO: 3692921 - DNA, 14 bp, Homo sapiens
gaagatcctgcggg

SEQ ID NO: 3692922 - DNA, 16 bp, Homo sapiens
gaagcaccataacttt

SEQ ID NO: 3692923 - DNA, 21 bp, Homo sapiens
gaagcaccccatgccaaagct

SEQ ID NO: 3692924 - DNA, 21 bp, Homo sapiens
gaagcactacaccttgccttg

SEQ ID NO: 3692925 - DNA, 15 bp, Homo sapiens
gaagcagaggaagga

SEQ ID NO: 3692926 - DNA, 20 bp, Homo sapiens
gaagcagggaattcctgggg

SEQ ID NO: 3692927 - DNA, 21 bp, Homo sapiens
gaagccaggaatttcccagga

SEQ ID NO: 3692928 - DNA, 19 bp, Homo sapiens
cttttaaaatgcaatgtaa

SEQ ID NO: 3692929 - DNA, 22 bp, Homo sapiens
cttttaacagagtctgaaccta

SEQ ID NO: 3692930 - DNA, 19 bp, Homo sapiens
cttttataggtgagaaaaa

SEQ ID NO: 3692931 - DNA, 21 bp, Homo sapiens
cttttataggtgagaaaaaaa

SEQ ID NO: 3692932 - DNA, 22 bp, Homo sapiens
cttttataggtgagaaaaaaac

SEQ ID NO: 3692933 - DNA, 17 bp, Homo sapiens
cttttatttcttaaaca

SEQ ID NO: 3692934 - DNA, 14 bp, Homo sapiens
cttttccctgggtg

SEQ ID NO: 3692935 - DNA, 12 bp, Homo sapiens
cttttctggcac

SEQ ID NO: 3692936 - DNA, 17 bp, Homo sapiens
cttttctttaaagaagt

SEQ ID NO: 3692937 - DNA, 18 bp, Homo sapiens
cttttctttaaagaagtt

SEQ ID NO: 3692938 - DNA, 13 bp, Homo sapiens
cttttgaacccag

SEQ ID NO: 3692939 - DNA, 14 bp, Homo sapiens
cttttgaacccagg

SEQ ID NO: 3692940 - DNA, 18 bp, Homo sapiens
cttttgaacccaggagtt

SEQ ID NO: 3692941 - DNA, 20 bp, Homo sapiens
cttttgaacccaggagttca

SEQ ID NO: 3692942 - DNA, 14 bp, Homo sapiens
cttttgaattgtta

SEQ ID NO: 3692943 - DNA, 11 bp, Homo sapiens
cttttgctttt

SEQ ID NO: 3692944 - DNA, 16 bp, Homo sapiens
ctttttaacctgcaaa

SEQ ID NO: 3692945 - DNA, 15 bp, Homo sapiens
ctttttaataaaaag

SEQ ID NO: 3692946 - DNA, 23 bp, Homo sapiens
ctttttccaaatgcttctattta

SEQ ID NO: 3692947 - DNA, 22 bp, Homo sapiens
ctttttctaatgaggagagaaa

SEQ ID NO: 3692948 - DNA, 17 bp, Homo sapiens
cttttttaaatattttc

SEQ ID NO: 3692949 - DNA, 19 bp, Homo sapiens
cttttttagtaacaattca

SEQ ID NO: 3692950 - DNA, 13 bp, Homo sapiens
cttttttgttttg

SEQ ID NO: 3692951 - DNA, 22 bp, Homo sapiens
cttttttgttttttcaaaatag

SEQ ID NO: 3692952 - DNA, 16 bp, Homo sapiens
ctttttttccttttta

SEQ ID NO: 3692953 - DNA, 22 bp, Homo sapiens
ctttttttttttttttttttga

SEQ ID NO: 3692954 - DNA, 13 bp, Homo sapiens
gaaaaaaatgttg

SEQ ID NO: 3692955 - DNA, 17 bp, Homo sapiens
gaaaaatagcaacttgt

SEQ ID NO: 3692956 - DNA, 16 bp, Homo sapiens
gaaaaatatcttggcc

SEQ ID NO: 3692957 - DNA, 19 bp, Homo sapiens
gaaaagacaaacagtagag

SEQ ID NO: 3692958 - DNA, 19 bp, Homo sapiens
gaaaaggaacggcttcctc

SEQ ID NO: 3692959 - DNA, 23 bp, Homo sapiens
gaaaagtggcgtgggagccagcc

SEQ ID NO: 3692960 - DNA, 22 bp, Homo sapiens
gaaaatatatgtatttttatat

SEQ ID NO: 3692961 - DNA, 15 bp, Homo sapiens
gaaaattaacactgc

SEQ ID NO: 3692962 - DNA, 20 bp, Homo sapiens
gaaacacactgaggcaggga

SEQ ID NO: 3692963 - DNA, 23 bp, Homo sapiens
gaaacacactgaggcagggaagt

SEQ ID NO: 3692964 - DNA, 22 bp, Homo sapiens
gaaacactgggcttctagaacc

SEQ ID NO: 3692965 - DNA, 21 bp, Homo sapiens
gaaaccattatgaagaagaga

SEQ ID NO: 3692966 - DNA, 16 bp, Homo sapiens
gaaacccgacagaggg

SEQ ID NO: 3692967 - DNA, 13 bp, Homo sapiens
gaaacctactgcc

SEQ ID NO: 3692968 - DNA, 20 bp, Homo sapiens
gaaactaattgactttagaa

SEQ ID NO: 3692969 - DNA, 21 bp, Homo sapiens
gaaagaaacccgacagaggga

SEQ ID NO: 3692970 - DNA, 14 bp, Homo sapiens
gaaagacagagctg

SEQ ID NO: 3692971 - DNA, 20 bp, Homo sapiens
gaaagaggctgaggcctgga

SEQ ID NO: 3692972 - DNA, 11 bp, Homo sapiens
gaaaggagact

SEQ ID NO: 3692973 - DNA, 19 bp, Homo sapiens
gaaaggcaggaagggaagc

SEQ ID NO: 3692974 - DNA, 19 bp, Homo sapiens
gaaaggccagctggcagca

SEQ ID NO: 3692975 - DNA, 15 bp, Homo sapiens
gaaaggggagcccac

SEQ ID NO: 3692976 - DNA, 18 bp, Homo sapiens
gaaagggtcctgctttct

SEQ ID NO: 3692977 - DNA, 19 bp, Homo sapiens
gaaaggtaggaagagaggt

SEQ ID NO: 3692978 - DNA, 14 bp, Homo sapiens
gaaagtgcattttt

SEQ ID NO: 3692979 - DNA, 22 bp, Homo sapiens
gaaagttttcagaacctcttcc

SEQ ID NO: 3692980 - DNA, 18 bp, Homo sapiens
gaaatacaaaaatactca

SEQ ID NO: 3692981 - DNA, 16 bp, Homo sapiens
gaaataccacaagcct

SEQ ID NO: 3692982 - DNA, 15 bp, Homo sapiens
gaaatcaggcctgat

SEQ ID NO: 3692983 - DNA, 14 bp, Homo sapiens
gaaatccattcaca

SEQ ID NO: 3692984 - DNA, 23 bp, Homo sapiens
gaaatctggcttctggccaggaa

SEQ ID NO: 3692985 - DNA, 20 bp, Homo sapiens
gaaatctgtcaagagtagtt

SEQ ID NO: 3692986 - DNA, 15 bp, Homo sapiens
cttcagtaagccgtg

SEQ ID NO: 3692987 - DNA, 23 bp, Homo sapiens
cttcagtaagccgtgattttcat

SEQ ID NO: 3692988 - DNA, 18 bp, Homo sapiens
cttcagtctggactatat

SEQ ID NO: 3692989 - DNA, 18 bp, Homo sapiens
cttcattctgagaccaaa

SEQ ID NO: 3692990 - DNA, 17 bp, Homo sapiens
cttcattttcagagtga

SEQ ID NO: 3692991 - DNA, 17 bp, Homo sapiens
cttcattttttattcct

SEQ ID NO: 3692992 - DNA, 14 bp, Homo sapiens
cttccaaaggcagc

SEQ ID NO: 3692993 - DNA, 15 bp, Homo sapiens
cttccaaaggcagcg

SEQ ID NO: 3692994 - DNA, 13 bp, Homo sapiens
cttccaacacatt

SEQ ID NO: 3692995 - DNA, 12 bp, Homo sapiens
cttccatcccta

SEQ ID NO: 3692996 - DNA, 16 bp, Homo sapiens
cttccatctctgactt

SEQ ID NO: 3692997 - DNA, 21 bp, Homo sapiens
cttccatgcctgtagctttcc

SEQ ID NO: 3692998 - DNA, 17 bp, Homo sapiens
cttccctcaccttggca

SEQ ID NO: 3692999 - DNA, 14 bp, Homo sapiens
cttccctgcagctg

SEQ ID NO: 3693000 - DNA, 17 bp, Homo sapiens
cttccctgcagctgacc

SEQ ID NO: 3693001 - DNA, 15 bp, Homo sapiens
cttcccttgagccct

SEQ ID NO: 3693002 - DNA, 23 bp, Homo sapiens
cttccgtggtcagagtgccactg

SEQ ID NO: 3693003 - DNA, 15 bp, Homo sapiens
cttccgttcattgct

SEQ ID NO: 3693004 - DNA, 22 bp, Homo sapiens
cttcctaaatattatgagatgc

SEQ ID NO: 3693005 - DNA, 18 bp, Homo sapiens
cttcctacaagagcagcc

SEQ ID NO: 3693006 - DNA, 21 bp, Homo sapiens
cttcctacaagagcagcctgt

SEQ ID NO: 3693007 - DNA, 24 bp, Homo sapiens
cttcctacaagagcagcctgtggc

SEQ ID NO: 3693008 - DNA, 14 bp, Homo sapiens
cttcctcagcctgg

SEQ ID NO: 3693009 - DNA, 17 bp, Homo sapiens
cttcctcagcctggggt

SEQ ID NO: 3693010 - DNA, 13 bp, Homo sapiens
cttcctcctggaa

SEQ ID NO: 3693011 - DNA, 14 bp, Homo sapiens
cttcctctgtgcca

SEQ ID NO: 3693012 - DNA, 15 bp, Homo sapiens
cttcctctgtgccac

SEQ ID NO: 3693013 - DNA, 17 bp, Homo sapiens
cttcctgcaaccactct

SEQ ID NO: 3693014 - DNA, 20 bp, Homo sapiens
cttcctgcaaccactctgtg

SEQ ID NO: 3693015 - DNA, 22 bp, Homo sapiens
cttcctgcaaccactctgtggc

SEQ ID NO: 3693016 - DNA, 22 bp, Homo sapiens
cttcctggatggggcagagctt

SEQ ID NO: 3693017 - DNA, 22 bp, Homo sapiens
cttccttgaagaactgcaggcc

SEQ ID NO: 3693018 - DNA, 12 bp, Homo sapiens
cttcgcagaggc

SEQ ID NO: 3693019 - DNA, 14 bp, Homo sapiens
cttcgcagaggcaa

SEQ ID NO: 3693020 - DNA, 15 bp, Homo sapiens
cttcgcataaagaag

SEQ ID NO: 3693021 - DNA, 15 bp, Homo sapiens
cttcgcttcttgcct

SEQ ID NO: 3693022 - DNA, 18 bp, Homo sapiens
cttcgcttcttgcctctg

SEQ ID NO: 3693023 - DNA, 21 bp, Homo sapiens
cttcgggaggtcgaggcagga

SEQ ID NO: 3693024 - DNA, 21 bp, Homo sapiens
cttcgtctttcccatggggag

SEQ ID NO: 3693025 - DNA, 13 bp, Homo sapiens
cttcgttcttttt

SEQ ID NO: 3693026 - DNA, 19 bp, Homo sapiens
cttcgttctttttaagtta

SEQ ID NO: 3693027 - DNA, 21 bp, Homo sapiens
cttctaaaacttgtatgttta

SEQ ID NO: 3693028 - DNA, 22 bp, Homo sapiens
cttctaaaggtgttgtcccttc

SEQ ID NO: 3693029 - DNA, 23 bp, Homo sapiens
cttctaaaggtgttgtcccttct

SEQ ID NO: 3693030 - DNA, 21 bp, Homo sapiens
cttctacttctgcccttgcca

SEQ ID NO: 3693031 - DNA, 13 bp, Homo sapiens
cttctagagtttt

SEQ ID NO: 3693032 - DNA, 15 bp, Homo sapiens
cttctagagttttat

SEQ ID NO: 3693033 - DNA, 22 bp, Homo sapiens
cttctaggatagctaactgtaa

SEQ ID NO: 3693034 - DNA, 18 bp, Homo sapiens
gatgacagtgacacccag

SEQ ID NO: 3693035 - DNA, 13 bp, Homo sapiens
gatgagaaaacag

SEQ ID NO: 3693036 - DNA, 18 bp, Homo sapiens
gatgaggcttcttcctgg

SEQ ID NO: 3693037 - DNA, 21 bp, Homo sapiens
gatgagggggaattcctggaa

SEQ ID NO: 3693038 - DNA, 18 bp, Homo sapiens
gatgagttaactgtgaaa

SEQ ID NO: 3693039 - DNA, 20 bp, Homo sapiens
gatgataagttcctttcctt

SEQ ID NO: 3693040 - DNA, 18 bp, Homo sapiens
gatgatagaggattttat

SEQ ID NO: 3693041 - DNA, 15 bp, Homo sapiens
gatgcaaagaggcaa

SEQ ID NO: 3693042 - DNA, 17 bp, Homo sapiens
gatgcaaagaggcaaga

SEQ ID NO: 3693043 - DNA, 17 bp, Homo sapiens
gatgcaaggaccaggac

SEQ ID NO: 3693044 - DNA, 16 bp, Homo sapiens
gatgcaccaccaagcc

SEQ ID NO: 3693045 - DNA, 22 bp, Homo sapiens
gatgcaggtggatctccttgag

SEQ ID NO: 3693046 - DNA, 14 bp, Homo sapiens
gatgcatgtctttt

SEQ ID NO: 3693047 - DNA, 15 bp, Homo sapiens
gatgccacacaagga

SEQ ID NO: 3693048 - DNA, 17 bp, Homo sapiens
gatgcccaaatccttag

SEQ ID NO: 3693049 - DNA, 22 bp, Homo sapiens
gatgccttttttgtagtttttt

SEQ ID NO: 3693050 - DNA, 13 bp, Homo sapiens
gatgctccctccc

SEQ ID NO: 3693051 - DNA, 20 bp, Homo sapiens
gatgctccctcccctgccct

SEQ ID NO: 3693052 - DNA, 21 bp, Homo sapiens
gatgctccctcccctgccctg

SEQ ID NO: 3693053 - DNA, 12 bp, Homo sapiens
gatgctgcccct

SEQ ID NO: 3693054 - DNA, 16 bp, Homo sapiens
gatgctggatgctcct

SEQ ID NO: 3693055 - DNA, 18 bp, Homo sapiens
gatgctggatgctccttc

SEQ ID NO: 3693056 - DNA, 12 bp, Homo sapiens
gatgctggccca

SEQ ID NO: 3693057 - DNA, 19 bp, Homo sapiens
gatgctggcccagggccca

SEQ ID NO: 3693058 - DNA, 19 bp, Homo sapiens
gatgctgggagttctaaca

SEQ ID NO: 3693059 - DNA, 18 bp, Homo sapiens
gatggaaaaactgaggct

SEQ ID NO: 3693060 - DNA, 18 bp, Homo sapiens
gatggaaaagtgtccttc

SEQ ID NO: 3693061 - DNA, 19 bp, Homo sapiens
gatggaaccgcaggaagct

SEQ ID NO: 3693062 - DNA, 16 bp, Homo sapiens
gatggcaacagatctg

SEQ ID NO: 3693063 - DNA, 17 bp, Homo sapiens
gatggcaacagatctgg

SEQ ID NO: 3693064 - DNA, 22 bp, Homo sapiens
gatggcaacagatctggaacct

SEQ ID NO: 3693065 - DNA, 12 bp, Homo sapiens
gatggctcctct

SEQ ID NO: 3693066 - DNA, 21 bp, Homo sapiens
gatggctttgaatgcggccca

SEQ ID NO: 3693067 - DNA, 21 bp, Homo sapiens
gacagacaggctcttagcagc

SEQ ID NO: 3693068 - DNA, 16 bp, Homo sapiens
gacagagaggactgta

SEQ ID NO: 3693069 - DNA, 19 bp, Homo sapiens
gacagagaggactgtaggg

SEQ ID NO: 3693070 - DNA, 13 bp, Homo sapiens
gacagagggaaga

SEQ ID NO: 3693071 - DNA, 21 bp, Homo sapiens
gacagatctctgctttggaaa

SEQ ID NO: 3693072 - DNA, 20 bp, Homo sapiens
gacagatgaatgccgtggat

SEQ ID NO: 3693073 - DNA, 20 bp, Homo sapiens
gacagatgaggctttccatg

SEQ ID NO: 3693074 - DNA, 19 bp, Homo sapiens
gacagatgccccagagctg

SEQ ID NO: 3693075 - DNA, 20 bp, Homo sapiens
gacagatgccccagagctgt

SEQ ID NO: 3693076 - DNA, 11 bp, Homo sapiens
gacagcaaggt

SEQ ID NO: 3693077 - DNA, 19 bp, Homo sapiens
gacagcaaggtgtggaggc

SEQ ID NO: 3693078 - DNA, 20 bp, Homo sapiens
gacagcaaggtgtggaggct

SEQ ID NO: 3693079 - DNA, 21 bp, Homo sapiens
gacagcaaggtgtggaggctc

SEQ ID NO: 3693080 - DNA, 11 bp, Homo sapiens
gacagcctctt

SEQ ID NO: 3693081 - DNA, 21 bp, Homo sapiens
gacagctgctcctagagggag

SEQ ID NO: 3693082 - DNA, 16 bp, Homo sapiens
gacagctttgctgctg

SEQ ID NO: 3693083 - DNA, 18 bp, Homo sapiens
gacaggatgtgtttgctt

SEQ ID NO: 3693084 - DNA, 18 bp, Homo sapiens
gacagggacttcgcagag

SEQ ID NO: 3693085 - DNA, 11 bp, Homo sapiens
gacagggcttc

SEQ ID NO: 3693086 - DNA, 17 bp, Homo sapiens
gacagggtttcaccatg

SEQ ID NO: 3693087 - DNA, 13 bp, Homo sapiens
gacagtgctgttg

SEQ ID NO: 3693088 - DNA, 18 bp, Homo sapiens
gacagtgctgttgaagat

SEQ ID NO: 3693089 - DNA, 18 bp, Homo sapiens
gacatacttgaagggcca

SEQ ID NO: 3693090 - DNA, 22 bp, Homo sapiens
gacatacttgaagggccagagc

SEQ ID NO: 3693091 - DNA, 18 bp, Homo sapiens
gacatatttaatgtttta

SEQ ID NO: 3693092 - DNA, 22 bp, Homo sapiens
gacatatttaatgttttaaatg

SEQ ID NO: 3693093 - DNA, 16 bp, Homo sapiens
gacatcacagggtggg

SEQ ID NO: 3693094 - DNA, 20 bp, Homo sapiens
gacatctgattggcagatga

SEQ ID NO: 3693095 - DNA, 19 bp, Homo sapiens
gacatggctccggcctctg

SEQ ID NO: 3693096 - DNA, 17 bp, Homo sapiens
gacatgtggggccaggt

SEQ ID NO: 3693097 - DNA, 18 bp, Homo sapiens
gacattgccaaaaaggat

SEQ ID NO: 3693098 - DNA, 21 bp, Homo sapiens
gacatttctctaactcctgcc

SEQ ID NO: 3693099 - DNA, 11 bp, Homo sapiens
gacattttatt

SEQ ID NO: 3693100 - DNA, 19 bp, Homo sapiens
gacatttttgtctgtccta

SEQ ID NO: 3693101 - DNA, 19 bp, Homo sapiens
gaccaactgggcccaagac

SEQ ID NO: 3693102 - DNA, 15 bp, Homo sapiens
gaccaagcaggaagc

SEQ ID NO: 3693103 - DNA, 19 bp, Homo sapiens
gaccaagcaggaagctcag

SEQ ID NO: 3693104 - DNA, 20 bp, Homo sapiens
gaccaagcaggaagctcaga

SEQ ID NO: 3693105 - DNA, 19 bp, Homo sapiens
gaccaagcttagtcctggg

SEQ ID NO: 3693106 - DNA, 21 bp, Homo sapiens
gaccaagtgatgtgtttacat

SEQ ID NO: 3693107 - DNA, 18 bp, Homo sapiens
gaccagccgtgagcatgt

SEQ ID NO: 3693108 - DNA, 22 bp, Homo sapiens
gaccagccgtgagcatgtttgg

SEQ ID NO: 3693109 - DNA, 12 bp, Homo sapiens
gaccagcctggc

SEQ ID NO: 3693110 - DNA, 18 bp, Homo sapiens
gaccagcctggccaacat

SEQ ID NO: 3693111 - DNA, 14 bp, Homo sapiens
gaccaggactccct

SEQ ID NO: 3693112 - DNA, 19 bp, Homo sapiens
gaccaggactccctcctca

SEQ ID NO: 3693113 - DNA, 23 bp, Homo sapiens
gaccaggactccctcctcacctc

SEQ ID NO: 3693114 - DNA, 19 bp, Homo sapiens
gaccagggcaaggcccctt

SEQ ID NO: 3693115 - DNA, 21 bp, Homo sapiens
gaccagggcaaggccccttcc

SEQ ID NO: 3693116 - DNA, 19 bp, Homo sapiens
gaggttttaaaaaaatccc

SEQ ID NO: 3693117 - DNA, 13 bp, Homo sapiens
gagtacccagcct

SEQ ID NO: 3693118 - DNA, 20 bp, Homo sapiens
gagtactatatttgtgaata

SEQ ID NO: 3693119 - DNA, 22 bp, Homo sapiens
gagtagaaagacagagctggga

SEQ ID NO: 3693120 - DNA, 17 bp, Homo sapiens
gagtcagggacccctgc

SEQ ID NO: 3693121 - DNA, 18 bp, Homo sapiens
gagtcagggacccctgcc

SEQ ID NO: 3693122 - DNA, 22 bp, Homo sapiens
gagtcagggacccctgcccttg

SEQ ID NO: 3693123 - DNA, 17 bp, Homo sapiens
gagtcctcactcccagt

SEQ ID NO: 3693124 - DNA, 17 bp, Homo sapiens
gagtcgtggggtgtgct

SEQ ID NO: 3693125 - DNA, 22 bp, Homo sapiens
gagtcgtggggtgtgctgggag

SEQ ID NO: 3693126 - DNA, 14 bp, Homo sapiens
gagtctgaagcaga

SEQ ID NO: 3693127 - DNA, 15 bp, Homo sapiens
gagtctgaagcagat

SEQ ID NO: 3693128 - DNA, 22 bp, Homo sapiens
gagtgaaaaatcttaagtacca

SEQ ID NO: 3693129 - DNA, 23 bp, Homo sapiens
gagtgaaaaatcttaagtaccaa

SEQ ID NO: 3693130 - DNA, 22 bp, Homo sapiens
gagtgacacccaagagggctgc

SEQ ID NO: 3693131 - DNA, 19 bp, Homo sapiens
gagtggcaggggacaggag

SEQ ID NO: 3693132 - DNA, 23 bp, Homo sapiens
gagtggcaggggacaggagtcca

SEQ ID NO: 3693133 - DNA, 11 bp, Homo sapiens
gagtggccact

SEQ ID NO: 3693134 - DNA, 14 bp, Homo sapiens
gagtggcctggcca

SEQ ID NO: 3693135 - DNA, 19 bp, Homo sapiens
gagtggcctggccaggagc

SEQ ID NO: 3693136 - DNA, 14 bp, Homo sapiens
gagttaagacctgg

SEQ ID NO: 3693137 - DNA, 19 bp, Homo sapiens
gagttcaggtagctgcccc

SEQ ID NO: 3693138 - DNA, 18 bp, Homo sapiens
gagttcgagaccagcctg

SEQ ID NO: 3693139 - DNA, 23 bp, Homo sapiens
gagttgacttgacagaacactgt

SEQ ID NO: 3693140 - DNA, 16 bp, Homo sapiens
gagttgatctggaacc

SEQ ID NO: 3693141 - DNA, 19 bp, Homo sapiens
gagttgatctggaacccag

SEQ ID NO: 3693142 - DNA, 18 bp, Homo sapiens
gagtttgtcgctcatgtg

SEQ ID NO: 3693143 - DNA, 22 bp, Homo sapiens
gagtttgtcgctcatgtgtgca

SEQ ID NO: 3693144 - DNA, 20 bp, Homo sapiens
gataaagatgatattaagaa

SEQ ID NO: 3693145 - DNA, 16 bp, Homo sapiens
gataaagcagctcagg

SEQ ID NO: 3693146 - DNA, 17 bp, Homo sapiens
gataacccttattccat

SEQ ID NO: 3693147 - DNA, 13 bp, Homo sapiens
gataaggaaatca

SEQ ID NO: 3693148 - DNA, 18 bp, Homo sapiens
gataattctagctttgag

SEQ ID NO: 3693149 - DNA, 13 bp, Homo sapiens
gatacacacacac

SEQ ID NO: 3693150 - DNA, 18 bp, Homo sapiens
gatacagtcaacaagcct

SEQ ID NO: 3693151 - DNA, 19 bp, Homo sapiens
gatacagtcaacaagcctg

SEQ ID NO: 3693152 - DNA, 22 bp, Homo sapiens
gatacgctactataaagagaag

SEQ ID NO: 3693153 - DNA, 19 bp, Homo sapiens
gatagaaatgccaagcact

SEQ ID NO: 3693154 - DNA, 18 bp, Homo sapiens
gatagatgctggcccagg

SEQ ID NO: 3693155 - DNA, 20 bp, Homo sapiens
gatagctaactgtaaatcat

SEQ ID NO: 3693156 - DNA, 13 bp, Homo sapiens
gatcaaggcctta

SEQ ID NO: 3693157 - DNA, 15 bp, Homo sapiens
gatcaaggtgaaata

SEQ ID NO: 3693158 - DNA, 13 bp, Homo sapiens
gatcatgtacttt

SEQ ID NO: 3693159 - DNA, 15 bp, Homo sapiens
gatcattttcccccc

SEQ ID NO: 3693160 - DNA, 19 bp, Homo sapiens
gatcattttccccccactc

SEQ ID NO: 3693161 - DNA, 13 bp, Homo sapiens
gatccaaaagaag

SEQ ID NO: 3693162 - DNA, 19 bp, Homo sapiens
gatccaaaagaagccccca

SEQ ID NO: 3693163 - DNA, 20 bp, Homo sapiens
gatccaaaagaagcccccag

SEQ ID NO: 3693164 - DNA, 22 bp, Homo sapiens
gatccaaaagaagcccccagct

SEQ ID NO: 3693165 - DNA, 23 bp, Homo sapiens
gatccaaaagaagcccccagcta

SEQ ID NO: 3693166 - DNA, 12 bp, Homo sapiens
gatccagcctgg

SEQ ID NO: 3693167 - DNA, 12 bp, Homo sapiens
gatccaggacta

SEQ ID NO: 3693168 - DNA, 13 bp, Homo sapiens
gatccagggacag

SEQ ID NO: 3693169 - DNA, 22 bp, Homo sapiens
gatccagggacagaggccccag

SEQ ID NO: 3693170 - DNA, 21 bp, Homo sapiens
gatcccaagtagaatctcagt

SEQ ID NO: 3693171 - DNA, 19 bp, Homo sapiens
gatccctcccccccatgca

SEQ ID NO: 3693172 - DNA, 21 bp, Homo sapiens
gatccctcccccccatgcact

SEQ ID NO: 3693173 - DNA, 17 bp, Homo sapiens
gatccgactgctttgga

SEQ ID NO: 3693174 - DNA, 18 bp, Homo sapiens
gatccgactgctttggac

SEQ ID NO: 3693175 - DNA, 20 bp, Homo sapiens
gatccgactgctttggacct

SEQ ID NO: 3693176 - DNA, 16 bp, Homo sapiens
gatccgcaagagtaaa

SEQ ID NO: 3693177 - DNA, 18 bp, Homo sapiens
gatcctaggcatttgctg

SEQ ID NO: 3693178 - DNA, 15 bp, Homo sapiens
gatcctcctgcagac

SEQ ID NO: 3693179 - DNA, 15 bp, Homo sapiens
gatcctctcacctca

SEQ ID NO: 3693180 - DNA, 19 bp, Homo sapiens
gatcctctcacctcagcct

SEQ ID NO: 3693181 - DNA, 18 bp, Homo sapiens
gatcgcagtttgcctggt

SEQ ID NO: 3693182 - DNA, 14 bp, Homo sapiens
gatctcggtttgcc

SEQ ID NO: 3693183 - DNA, 16 bp, Homo sapiens
gatctcttgagcctgg

SEQ ID NO: 3693184 - DNA, 17 bp, Homo sapiens
gatctgatgcaagcaag

SEQ ID NO: 3693185 - DNA, 16 bp, Homo sapiens
gatctggaacctcagc

SEQ ID NO: 3693186 - DNA, 21 bp, Homo sapiens
gatctggaacctcagcctggc

SEQ ID NO: 3693187 - DNA, 23 bp, Homo sapiens
gatctggaacctcagcctggcca

SEQ ID NO: 3693188 - DNA, 12 bp, Homo sapiens
gatctggcatgt

SEQ ID NO: 3693189 - DNA, 17 bp, Homo sapiens
gatctgtcctcagcctt

SEQ ID NO: 3693190 - DNA, 18 bp, Homo sapiens
gatctgtgccccatgcct

SEQ ID NO: 3693191 - DNA, 16 bp, Homo sapiens
gatctttgactgaaaa

SEQ ID NO: 3693192 - DNA, 14 bp, Homo sapiens
gatctttgtggcca

SEQ ID NO: 3693193 - DNA, 15 bp, Homo sapiens
gatctttgtggccaa

SEQ ID NO: 3693194 - DNA, 16 bp, Homo sapiens
gatctttgtggccaag

SEQ ID NO: 3693195 - DNA, 18 bp, Homo sapiens
gatgaaaaatatttctga

SEQ ID NO: 3693196 - DNA, 19 bp, Homo sapiens
gcccaggctggagtgcagt

SEQ ID NO: 3693197 - DNA, 16 bp, Homo sapiens
gcccagggagcggaaa

SEQ ID NO: 3693198 - DNA, 20 bp, Homo sapiens
gcccagggagcggaaagcag

SEQ ID NO: 3693199 - DNA, 17 bp, Homo sapiens
gcccagggcccagagcc

SEQ ID NO: 3693200 - DNA, 18 bp, Homo sapiens
gcccagggcccagagccc

SEQ ID NO: 3693201 - DNA, 19 bp, Homo sapiens
gcccagggcccagagccca

SEQ ID NO: 3693202 - DNA, 21 bp, Homo sapiens
gcccagggcccagagcccagc

SEQ ID NO: 3693203 - DNA, 20 bp, Homo sapiens
gcccagtgcatggtggccag

SEQ ID NO: 3693204 - DNA, 19 bp, Homo sapiens
gcccagttcaccctgattt

SEQ ID NO: 3693205 - DNA, 14 bp, Homo sapiens
gcccatgcccacct

SEQ ID NO: 3693206 - DNA, 15 bp, Homo sapiens
gccccacatgtccag

SEQ ID NO: 3693207 - DNA, 11 bp, Homo sapiens
gccccacccag

SEQ ID NO: 3693208 - DNA, 15 bp, Homo sapiens
gccccacccaggagg

SEQ ID NO: 3693209 - DNA, 14 bp, Homo sapiens
gccccaccctgggc

SEQ ID NO: 3693210 - DNA, 15 bp, Homo sapiens
gccccaccctgggcc

SEQ ID NO: 3693211 - DNA, 16 bp, Homo sapiens
gccccaccctgggccc

SEQ ID NO: 3693212 - DNA, 13 bp, Homo sapiens
gccccactgggga

SEQ ID NO: 3693213 - DNA, 12 bp, Homo sapiens
gccccagagctg

SEQ ID NO: 3693214 - DNA, 23 bp, Homo sapiens
gccccagagctgtttatggcctc

SEQ ID NO: 3693215 - DNA, 13 bp, Homo sapiens
gccccagcacagc

SEQ ID NO: 3693216 - DNA, 14 bp, Homo sapiens
gccccaggaagccg

SEQ ID NO: 3693217 - DNA, 11 bp, Homo sapiens
gccccaggacc

SEQ ID NO: 3693218 - DNA, 18 bp, Homo sapiens
gccccaggaccagctcag

SEQ ID NO: 3693219 - DNA, 23 bp, Homo sapiens
gccccaggaccagctcaggacag

SEQ ID NO: 3693220 - DNA, 23 bp, Homo sapiens
gccccagggtcttccctacctca

SEQ ID NO: 3693221 - DNA, 16 bp, Homo sapiens
gccccatgcctgtcca

SEQ ID NO: 3693222 - DNA, 12 bp, Homo sapiens
gcccccactgac

SEQ ID NO: 3693223 - DNA, 14 bp, Homo sapiens
gcccccacttgcct

SEQ ID NO: 3693224 - DNA, 21 bp, Homo sapiens
gcccccacttgcctcttcctt

SEQ ID NO: 3693225 - DNA, 21 bp, Homo sapiens
gcccccagcccagggctcctg

SEQ ID NO: 3693226 - DNA, 22 bp, Homo sapiens
gcccccagcccagggctcctgc

SEQ ID NO: 3693227 - DNA, 15 bp, Homo sapiens
gcccccagctaagaa

SEQ ID NO: 3693228 - DNA, 22 bp, Homo sapiens
gcccccagctaagaacctggaa

SEQ ID NO: 3693229 - DNA, 20 bp, Homo sapiens
gccccccaggctgcccagag

SEQ ID NO: 3693230 - DNA, 21 bp, Homo sapiens
gccccccaggctgcccagagc

SEQ ID NO: 3693231 - DNA, 16 bp, Homo sapiens
gccccctccgccctgc

SEQ ID NO: 3693232 - DNA, 18 bp, Homo sapiens
gcccccttcctggcccct

SEQ ID NO: 3693233 - DNA, 15 bp, Homo sapiens
gccccgtctgacccc

SEQ ID NO: 3693234 - DNA, 20 bp, Homo sapiens
gcccctatgtagtccgtgct

SEQ ID NO: 3693235 - DNA, 21 bp, Homo sapiens
gcccctcatctctctgcccaa

SEQ ID NO: 3693236 - DNA, 20 bp, Homo sapiens
gcccctcatggcgggactgg

SEQ ID NO: 3693237 - DNA, 13 bp, Homo sapiens
gcccctccaagtc

SEQ ID NO: 3693238 - DNA, 22 bp, Homo sapiens
gcccctcccacacccaaagctg

SEQ ID NO: 3693239 - DNA, 23 bp, Homo sapiens
gcccctcccacacccaaagctga

SEQ ID NO: 3693240 - DNA, 14 bp, Homo sapiens
gcccctctccaagc

SEQ ID NO: 3693241 - DNA, 23 bp, Homo sapiens
gcccctctccaagcgcctggctt

SEQ ID NO: 3693242 - DNA, 14 bp, Homo sapiens
gcccctctggtcgc

SEQ ID NO: 3693243 - DNA, 19 bp, Homo sapiens
gcccctctggtcgctcctg

SEQ ID NO: 3693244 - DNA, 20 bp, Homo sapiens
gcccctctggtcgctcctgc

SEQ ID NO: 3693245 - DNA, 19 bp, Homo sapiens
gcccctgtctagagaggga

SEQ ID NO: 3693246 - DNA, 18 bp, Homo sapiens
gccccttccacgggggct

SEQ ID NO: 3693247 - DNA, 22 bp, Homo sapiens
gcccgacatggctccggcctct

SEQ ID NO: 3693248 - DNA, 17 bp, Homo sapiens
gcccgcatgcggcccag

SEQ ID NO: 3693249 - DNA, 17 bp, Homo sapiens
gcccgggctcccacacc

SEQ ID NO: 3693250 - DNA, 14 bp, Homo sapiens
gcccgtcctgcctg

SEQ ID NO: 3693251 - DNA, 18 bp, Homo sapiens
gccctaccctcctgctga

SEQ ID NO: 3693252 - DNA, 14 bp, Homo sapiens
gccctacctgggga

SEQ ID NO: 3693253 - DNA, 22 bp, Homo sapiens
gccctacctggggaaagcctga

SEQ ID NO: 3693254 - DNA, 17 bp, Homo sapiens
gccctcctctcccattg

SEQ ID NO: 3693255 - DNA, 12 bp, Homo sapiens
gccctcctgatt

SEQ ID NO: 3693256 - DNA, 21 bp, Homo sapiens
gccctccttcccattggcttt

SEQ ID NO: 3693257 - DNA, 19 bp, Homo sapiens
gccctcgggtctccccacc

SEQ ID NO: 3693258 - DNA, 16 bp, Homo sapiens
gccctgagctttctgc

SEQ ID NO: 3693259 - DNA, 17 bp, Homo sapiens
gccctgagtctgggcag

SEQ ID NO: 3693260 - DNA, 11 bp, Homo sapiens
gccctgccact

SEQ ID NO: 3693261 - DNA, 12 bp, Homo sapiens
gccctgccactc

SEQ ID NO: 3693262 - DNA, 17 bp, Homo sapiens
gccctgcctgagggtgg

SEQ ID NO: 3693263 - DNA, 13 bp, Homo sapiens
gccctggaggtgg

SEQ ID NO: 3693264 - DNA, 16 bp, Homo sapiens
gccctggcctcccctg

SEQ ID NO: 3693265 - DNA, 17 bp, Homo sapiens
gccctggcctcccctgc

SEQ ID NO: 3693266 - DNA, 19 bp, Homo sapiens
gccctggcctcccctgcca

SEQ ID NO: 3693267 - DNA, 21 bp, Homo sapiens
gccctggcctcccctgccacc

SEQ ID NO: 3693268 - DNA, 14 bp, Homo sapiens
gccctgggctggaa

SEQ ID NO: 3693269 - DNA, 18 bp, Homo sapiens
gccctggtccagggaagc

SEQ ID NO: 3693270 - DNA, 20 bp, Homo sapiens
gccctggtccagggaagctg

SEQ ID NO: 3693271 - DNA, 22 bp, Homo sapiens
gccctgtgccccttgacaactg

SEQ ID NO: 3693272 - DNA, 13 bp, Homo sapiens
gccctgtgctcca

SEQ ID NO: 3693273 - DNA, 12 bp, Homo sapiens
gccctgtgtgca

SEQ ID NO: 3693274 - DNA, 14 bp, Homo sapiens
gccctgtgtgcagg

SEQ ID NO: 3693275 - DNA, 16 bp, Homo sapiens
gccctgttgacacagg

SEQ ID NO: 3693276 - DNA, 19 bp, Homo sapiens
gccctgttgacacaggtct

SEQ ID NO: 3693277 - DNA, 21 bp, Homo sapiens
gccctgttgacacaggtcttt

SEQ ID NO: 3693278 - DNA, 14 bp, Homo sapiens
gccctgtttctgtt

SEQ ID NO: 3693279 - DNA, 17 bp, Homo sapiens
gcccttcctgctgcgca

SEQ ID NO: 3693280 - DNA, 14 bp, Homo sapiens
gcccttctgtccaa

SEQ ID NO: 3693281 - DNA, 19 bp, Homo sapiens
gcccttgcagttcagcacc

SEQ ID NO: 3693282 - DNA, 20 bp, Homo sapiens
gcccttgcagttcagcacca

SEQ ID NO: 3693283 - DNA, 12 bp, Homo sapiens
gcccttgtccca

SEQ ID NO: 3693284 - DNA, 21 bp, Homo sapiens
gcccttgtcccactcaagcca

SEQ ID NO: 3693285 - DNA, 24 bp, Homo sapiens
gcccttgtcccactcaagccaagc

SEQ ID NO: 3693286 - DNA, 13 bp, Homo sapiens
gccgagaagcaag

SEQ ID NO: 3693287 - DNA, 18 bp, Homo sapiens
gccgaggccatgtgcata

SEQ ID NO: 3693288 - DNA, 14 bp, Homo sapiens
gccgatagagggac

SEQ ID NO: 3693289 - DNA, 18 bp, Homo sapiens
gccgccattgccaccagg

SEQ ID NO: 3693290 - DNA, 17 bp, Homo sapiens
gccgctgccacccacct

SEQ ID NO: 3693291 - DNA, 12 bp, Homo sapiens
gccgctgccacg

SEQ ID NO: 3693292 - DNA, 13 bp, Homo sapiens
gccggcacagggt

SEQ ID NO: 3693293 - DNA, 21 bp, Homo sapiens
gccggcacagggtctgctctt

SEQ ID NO: 3693294 - DNA, 16 bp, Homo sapiens
gccggcacggcccgtg

SEQ ID NO: 3693295 - DNA, 18 bp, Homo sapiens
gccggcccccttcctggc

SEQ ID NO: 3693296 - DNA, 20 bp, Homo sapiens
gccggcccccttcctggccc

SEQ ID NO: 3693297 - DNA, 20 bp, Homo sapiens
gccggccctggggctaggct

SEQ ID NO: 3693298 - DNA, 16 bp, Homo sapiens
gccggccctgtgtgca

SEQ ID NO: 3693299 - DNA, 12 bp, Homo sapiens
gccggctctggt

SEQ ID NO: 3693300 - DNA, 19 bp, Homo sapiens
gccggggactcccaggctg

SEQ ID NO: 3693301 - DNA, 21 bp, Homo sapiens
gccgtctccaggggctgcttc

SEQ ID NO: 3693302 - DNA, 14 bp, Homo sapiens
gccgtgccctgccc

SEQ ID NO: 3693303 - DNA, 23 bp, Homo sapiens
gccgtggattgcacgtggcctct

SEQ ID NO: 3693304 - DNA, 20 bp, Homo sapiens
gcctagactgttactttggc

SEQ ID NO: 3693305 - DNA, 16 bp, Homo sapiens
gcctcagccagagaag

SEQ ID NO: 3693306 - DNA, 17 bp, Homo sapiens
gcctcagcctccctggt

SEQ ID NO: 3693307 - DNA, 19 bp, Homo sapiens
gcctcagctgcctcacttc

SEQ ID NO: 3693308 - DNA, 17 bp, Homo sapiens
gcctcatggccagcgcc

SEQ ID NO: 3693309 - DNA, 13 bp, Homo sapiens
gcctcatgtggct

SEQ ID NO: 3693310 - DNA, 17 bp, Homo sapiens
gcctcatgtggctggaa

SEQ ID NO: 3693311 - DNA, 18 bp, Homo sapiens
gcctcatgtggctggaag

SEQ ID NO: 3693312 - DNA, 14 bp, Homo sapiens
gcctccagcctggt

SEQ ID NO: 3693313 - DNA, 15 bp, Homo sapiens
gcctccaggtgcaga

SEQ ID NO: 3693314 - DNA, 15 bp, Homo sapiens
gcctccatccaaggc

SEQ ID NO: 3693315 - DNA, 18 bp, Homo sapiens
gcaccaggggtttctcgc

SEQ ID NO: 3693316 - DNA, 15 bp, Homo sapiens
gcaccattctgactc

SEQ ID NO: 3693317 - DNA, 13 bp, Homo sapiens
gcacccccctggg

SEQ ID NO: 3693318 - DNA, 15 bp, Homo sapiens
gcaccctcaggcagg

SEQ ID NO: 3693319 - DNA, 19 bp, Homo sapiens
gcaccctcaggcaggtggg

SEQ ID NO: 3693320 - DNA, 15 bp, Homo sapiens
gcaccctgcctacgc

SEQ ID NO: 3693321 - DNA, 21 bp, Homo sapiens
gcaccctgcctacgccaggag

SEQ ID NO: 3693322 - DNA, 16 bp, Homo sapiens
gcacctaatccaggca

SEQ ID NO: 3693323 - DNA, 14 bp, Homo sapiens
gcacctcttccttg

SEQ ID NO: 3693324 - DNA, 20 bp, Homo sapiens
gcacctcttccttgatgttt

SEQ ID NO: 3693325 - DNA, 15 bp, Homo sapiens
gcacgctaccaaatc

SEQ ID NO: 3693326 - DNA, 16 bp, Homo sapiens
gcacgtggagagctgg

SEQ ID NO: 3693327 - DNA, 18 bp, Homo sapiens
gcacgtggagagctggtg

SEQ ID NO: 3693328 - DNA, 20 bp, Homo sapiens
gcacgtggagagctggtgcc

SEQ ID NO: 3693329 - DNA, 16 bp, Homo sapiens
gcactaggtaggcttc

SEQ ID NO: 3693330 - DNA, 15 bp, Homo sapiens
gcactccagcctggg

SEQ ID NO: 3693331 - DNA, 13 bp, Homo sapiens
gcactgatgctgc

SEQ ID NO: 3693332 - DNA, 18 bp, Homo sapiens
gcactgatgctgcccctc

SEQ ID NO: 3693333 - DNA, 22 bp, Homo sapiens
gcactgatgctgcccctcatct

SEQ ID NO: 3693334 - DNA, 15 bp, Homo sapiens
gcactttgtaaattc

SEQ ID NO: 3693335 - DNA, 15 bp, Homo sapiens
gcagaaatctagaag

SEQ ID NO: 3693336 - DNA, 20 bp, Homo sapiens
gcagaactcctacctgaagg

SEQ ID NO: 3693337 - DNA, 13 bp, Homo sapiens
gcagagctggctc

SEQ ID NO: 3693338 - DNA, 17 bp, Homo sapiens
gcagagctggctctgag

SEQ ID NO: 3693339 - DNA, 16 bp, Homo sapiens
gcagagcttctcctga

SEQ ID NO: 3693340 - DNA, 22 bp, Homo sapiens
gcagaggacagtctggagaagg

SEQ ID NO: 3693341 - DNA, 21 bp, Homo sapiens
gcagaggaggggccgctgcca

SEQ ID NO: 3693342 - DNA, 21 bp, Homo sapiens
gcagaggcaagcgaccgaggc

SEQ ID NO: 3693343 - DNA, 21 bp, Homo sapiens
gccaccccgggctctctgctg

SEQ ID NO: 3693344 - DNA, 12 bp, Homo sapiens
gccaccccttcc

SEQ ID NO: 3693345 - DNA, 17 bp, Homo sapiens
gccaccccttcctcagc

SEQ ID NO: 3693346 - DNA, 22 bp, Homo sapiens
gccaccccttcctcagcctggg

SEQ ID NO: 3693347 - DNA, 22 bp, Homo sapiens
gccacgttggagaagcccgtgt

SEQ ID NO: 3693348 - DNA, 13 bp, Homo sapiens
gccactaagcaga

SEQ ID NO: 3693349 - DNA, 15 bp, Homo sapiens
gccactctatgagtt

SEQ ID NO: 3693350 - DNA, 13 bp, Homo sapiens
gccactgagctgg

SEQ ID NO: 3693351 - DNA, 16 bp, Homo sapiens
gccactgagctggctg

SEQ ID NO: 3693352 - DNA, 17 bp, Homo sapiens
gccactgagctggctga

SEQ ID NO: 3693353 - DNA, 18 bp, Homo sapiens
gccactgccttcgcttct

SEQ ID NO: 3693354 - DNA, 22 bp, Homo sapiens
gccactgccttcgcttcttgcc

SEQ ID NO: 3693355 - DNA, 21 bp, Homo sapiens
gccacttgtgtgtgcgtgtca

SEQ ID NO: 3693356 - DNA, 23 bp, Homo sapiens
gccacttttgactagggattcag

SEQ ID NO: 3693357 - DNA, 16 bp, Homo sapiens
gccagacacaggccct

SEQ ID NO: 3693358 - DNA, 17 bp, Homo sapiens
gccagacacaggccctc

SEQ ID NO: 3693359 - DNA, 18 bp, Homo sapiens
gccagacatgccacaagg

SEQ ID NO: 3693360 - DNA, 13 bp, Homo sapiens
gccagagaagcta

SEQ ID NO: 3693361 - DNA, 20 bp, Homo sapiens
gccagagatccaaaagaagc

SEQ ID NO: 3693362 - DNA, 15 bp, Homo sapiens
gccagaggcccccag

SEQ ID NO: 3693363 - DNA, 16 bp, Homo sapiens
gccagaggcccccagc

SEQ ID NO: 3693364 - DNA, 19 bp, Homo sapiens
gccagaggcccccagccca

SEQ ID NO: 3693365 - DNA, 23 bp, Homo sapiens
gccagaggcccccagcccagggc

SEQ ID NO: 3693366 - DNA, 14 bp, Homo sapiens
gccagagtggcctg

SEQ ID NO: 3693367 - DNA, 15 bp, Homo sapiens
gccagagtggcctgg

SEQ ID NO: 3693368 - DNA, 14 bp, Homo sapiens
gccagatccagcct

SEQ ID NO: 3693369 - DNA, 20 bp, Homo sapiens
gccagatttgtctttttgtt

SEQ ID NO: 3693370 - DNA, 14 bp, Homo sapiens
gccagcacctggca

SEQ ID NO: 3693371 - DNA, 13 bp, Homo sapiens
gccagccccaccc

SEQ ID NO: 3693372 - DNA, 15 bp, Homo sapiens
gccagccccacccag

SEQ ID NO: 3693373 - DNA, 17 bp, Homo sapiens
gccagccccacccagga

SEQ ID NO: 3693374 - DNA, 20 bp, Homo sapiens
gccagcccctcttccccaat

SEQ ID NO: 3693375 - DNA, 18 bp, Homo sapiens
gccagcgcccctcagcct

SEQ ID NO: 3693376 - DNA, 17 bp, Homo sapiens
gccagcggtttcctggt

SEQ ID NO: 3693377 - DNA, 13 bp, Homo sapiens
gccaggaatattg

SEQ ID NO: 3693378 - DNA, 19 bp, Homo sapiens
gccaggaatttcccaggac

SEQ ID NO: 3693379 - DNA, 21 bp, Homo sapiens
gccaggaatttcccaggaccc

SEQ ID NO: 3693380 - DNA, 22 bp, Homo sapiens
gccaggaatttcccaggaccct

SEQ ID NO: 3693381 - DNA, 19 bp, Homo sapiens
gccaggcccccaagcctgc

SEQ ID NO: 3693382 - DNA, 16 bp, Homo sapiens
gccaggcgagatgggg

SEQ ID NO: 3693383 - DNA, 19 bp, Homo sapiens
gccaggcggggcgccccaa

SEQ ID NO: 3693384 - DNA, 17 bp, Homo sapiens
gccagggaactggcctg

SEQ ID NO: 3693385 - DNA, 20 bp, Homo sapiens
gccagggaactggcctgctg

SEQ ID NO: 3693386 - DNA, 14 bp, Homo sapiens
gccagggagaagct

SEQ ID NO: 3693387 - DNA, 22 bp, Homo sapiens
gccagggcccctcaccctgcct

SEQ ID NO: 3693388 - DNA, 22 bp, Homo sapiens
gccaggggaaaatcagcctgct

SEQ ID NO: 3693389 - DNA, 19 bp, Homo sapiens
gccaggggggtgaggagct

SEQ ID NO: 3693390 - DNA, 22 bp, Homo sapiens
gccaggtcaccctttgctgtga

SEQ ID NO: 3693391 - DNA, 23 bp, Homo sapiens
gccaggttctccgttagctcctg

SEQ ID NO: 3693392 - DNA, 19 bp, Homo sapiens
gccagtaacgcgtcttcct

SEQ ID NO: 3693393 - DNA, 21 bp, Homo sapiens
gccagtaacgcgtcttcctga

SEQ ID NO: 3693394 - DNA, 22 bp, Homo sapiens
gccagtaacgcgtcttcctgag

SEQ ID NO: 3693395 - DNA, 13 bp, Homo sapiens
gccagtccaggct

SEQ ID NO: 3693396 - DNA, 14 bp, Homo sapiens
gccagtcctgcctg

SEQ ID NO: 3693397 - DNA, 20 bp, Homo sapiens
gccagtcctgcctggccagg

SEQ ID NO: 3693398 - DNA, 11 bp, Homo sapiens
gccagtcctgg

SEQ ID NO: 3693399 - DNA, 14 bp, Homo sapiens
gccagtcctggttg

SEQ ID NO: 3693400 - DNA, 19 bp, Homo sapiens
gccagtcctggttgtctga

SEQ ID NO: 3693401 - DNA, 20 bp, Homo sapiens
gccagtcctggttgtctgaa

SEQ ID NO: 3693402 - DNA, 14 bp, Homo sapiens
gccagtgacagaca

SEQ ID NO: 3693403 - DNA, 20 bp, Homo sapiens
gccagtgacctgaggaagcg

SEQ ID NO: 3693404 - DNA, 19 bp, Homo sapiens
gccagtgatgctaaaggtt

SEQ ID NO: 3693405 - DNA, 15 bp, Homo sapiens
gccatcctctgcctc

SEQ ID NO: 3693406 - DNA, 15 bp, Homo sapiens
gccatctagccagcc

SEQ ID NO: 3693407 - DNA, 23 bp, Homo sapiens
gccatctagccagcccctcttcc

SEQ ID NO: 3693408 - DNA, 17 bp, Homo sapiens
gccatgatggcaacaga

SEQ ID NO: 3693409 - DNA, 18 bp, Homo sapiens
gccatgccgtctgccgga

SEQ ID NO: 3693410 - DNA, 24 bp, Homo sapiens
gccatgctcctggcccactgcatc

SEQ ID NO: 3693411 - DNA, 13 bp, Homo sapiens
gccatgctgaggc

SEQ ID NO: 3693412 - DNA, 20 bp, Homo sapiens
gccatgctgaggcctgggcc

SEQ ID NO: 3693413 - DNA, 21 bp, Homo sapiens
gccatgctgaggcctgggccg

SEQ ID NO: 3693414 - DNA, 17 bp, Homo sapiens
gccatggctcagggtgg

SEQ ID NO: 3693415 - DNA, 12 bp, Homo sapiens
gccatgtgcata

SEQ ID NO: 3693416 - DNA, 20 bp, Homo sapiens
gccattagccagatttgtct

SEQ ID NO: 3693417 - DNA, 18 bp, Homo sapiens
gccattgccaccaggaga

SEQ ID NO: 3693418 - DNA, 18 bp, Homo sapiens
gccattgggaccctccag

SEQ ID NO: 3693419 - DNA, 22 bp, Homo sapiens
gccattgggaccctccagtgct

SEQ ID NO: 3693420 - DNA, 15 bp, Homo sapiens
gcccaacccttctaa

SEQ ID NO: 3693421 - DNA, 21 bp, Homo sapiens
gcccaagacagatgccccaga

SEQ ID NO: 3693422 - DNA, 23 bp, Homo sapiens
gcccaagacagatgccccagagc

SEQ ID NO: 3693423 - DNA, 16 bp, Homo sapiens
gcccaagccagaggct

SEQ ID NO: 3693424 - DNA, 17 bp, Homo sapiens
gcccaaggtgctgatgt

SEQ ID NO: 3693425 - DNA, 22 bp, Homo sapiens
gcccaattcttacaaacatgtg

SEQ ID NO: 3693426 - DNA, 18 bp, Homo sapiens
gcccacccggtgggaccc

SEQ ID NO: 3693427 - DNA, 17 bp, Homo sapiens
gcccaccctgctgctgg

SEQ ID NO: 3693428 - DNA, 18 bp, Homo sapiens
gcccaccctgctgctggt

SEQ ID NO: 3693429 - DNA, 20 bp, Homo sapiens
gcccacctgcccatcacagg

SEQ ID NO: 3693430 - DNA, 24 bp, Homo sapiens
gcccactgtcctgggcctgcagaa

SEQ ID NO: 3693431 - DNA, 20 bp, Homo sapiens
gcccagagacatacttgaag

SEQ ID NO: 3693432 - DNA, 14 bp, Homo sapiens
gcccagagcccagc

SEQ ID NO: 3693433 - DNA, 17 bp, Homo sapiens
gcccagagcccagctcc

SEQ ID NO: 3693434 - DNA, 18 bp, Homo sapiens
gcccagctattaccacac

SEQ ID NO: 3693435 - DNA, 21 bp, Homo sapiens
gcccaggagcaagtgaggccg

SEQ ID NO: 3693436 - DNA, 15 bp, Homo sapiens
gcccaggatggcttt

SEQ ID NO: 3693437 - DNA, 15 bp, Homo sapiens
gcccaggcactgcaa

SEQ ID NO: 3693438 - DNA, 21 bp, Homo sapiens
ggccagaggcccccagcccag

SEQ ID NO: 3693439 - DNA, 15 bp, Homo sapiens
ggccagagtggcctg

SEQ ID NO: 3693440 - DNA, 18 bp, Homo sapiens
ggccagagtggcctggcc

SEQ ID NO: 3693441 - DNA, 16 bp, Homo sapiens
ggccagatccagcctg

SEQ ID NO: 3693442 - DNA, 14 bp, Homo sapiens
ggccagccccaccc

SEQ ID NO: 3693443 - DNA, 13 bp, Homo sapiens
ggccagcctggca

SEQ ID NO: 3693444 - DNA, 16 bp, Homo sapiens
ggccagcctggcatca

SEQ ID NO: 3693445 - DNA, 16 bp, Homo sapiens
gcctctttccctagga

SEQ ID NO: 3693446 - DNA, 14 bp, Homo sapiens
gcctgaagggcctc

SEQ ID NO: 3693447 - DNA, 18 bp, Homo sapiens
gcctgaagggcctcccag

SEQ ID NO: 3693448 - DNA, 12 bp, Homo sapiens
gcctgagggtgg

SEQ ID NO: 3693449 - DNA, 19 bp, Homo sapiens
gcctgaggtcatcggcgtg

SEQ ID NO: 3693450 - DNA, 16 bp, Homo sapiens
gcctgaggtcccctcg

SEQ ID NO: 3693451 - DNA, 16 bp, Homo sapiens
gcctgatcctccaaca

SEQ ID NO: 3693452 - DNA, 19 bp, Homo sapiens
gcctgatgagatttttaaa

SEQ ID NO: 3693453 - DNA, 19 bp, Homo sapiens
gcctgatgctccctcccct

SEQ ID NO: 3693454 - DNA, 15 bp, Homo sapiens
gcctgcagggaagcc

SEQ ID NO: 3693455 - DNA, 14 bp, Homo sapiens
gcctgcagggccat

SEQ ID NO: 3693456 - DNA, 16 bp, Homo sapiens
gcctgcagggccatgg

SEQ ID NO: 3693457 - DNA, 18 bp, Homo sapiens
gcctgcagggccatggct

SEQ ID NO: 3693458 - DNA, 15 bp, Homo sapiens
gcctgccagctgcac

SEQ ID NO: 3693459 - DNA, 16 bp, Homo sapiens
gcctgcccctcccaga

SEQ ID NO: 3693460 - DNA, 14 bp, Homo sapiens
gcctgcgaccctgg

SEQ ID NO: 3693461 - DNA, 23 bp, Homo sapiens
gcctgcgaccctgggggcacagg

SEQ ID NO: 3693462 - DNA, 15 bp, Homo sapiens
gcctgctccagacct

SEQ ID NO: 3693463 - DNA, 13 bp, Homo sapiens
gcctgctccagct

SEQ ID NO: 3693464 - DNA, 16 bp, Homo sapiens
gcctgctccagctgtt

SEQ ID NO: 3693465 - DNA, 10 bp, Homo sapiens
gcctgctgca

SEQ ID NO: 3693466 - DNA, 11 bp, Homo sapiens
gcctgctgcat

SEQ ID NO: 3693467 - DNA, 17 bp, Homo sapiens
gcctgctgcgccccagg

SEQ ID NO: 3693468 - DNA, 18 bp, Homo sapiens
gcctgctgcgccccaggc

SEQ ID NO: 3693469 - DNA, 14 bp, Homo sapiens
gcctggactttcct

SEQ ID NO: 3693470 - DNA, 17 bp, Homo sapiens
gcctggactttcctgca

SEQ ID NO: 3693471 - DNA, 22 bp, Homo sapiens
gcctggagatcctcctgcagac

SEQ ID NO: 3693472 - DNA, 20 bp, Homo sapiens
gcctggccaacatggcgaaa

SEQ ID NO: 3693473 - DNA, 13 bp, Homo sapiens
gcctggccagaca

SEQ ID NO: 3693474 - DNA, 14 bp, Homo sapiens
gcctggccagacac

SEQ ID NO: 3693475 - DNA, 21 bp, Homo sapiens
gcctggccagacacaggccct

SEQ ID NO: 3693476 - DNA, 23 bp, Homo sapiens
gcctggccaggcagatctgtgcc

SEQ ID NO: 3693477 - DNA, 17 bp, Homo sapiens
gcctgggcagccaggct

SEQ ID NO: 3693478 - DNA, 16 bp, Homo sapiens
gcctgggccgctgcca

SEQ ID NO: 3693479 - DNA, 16 bp, Homo sapiens
gcctggggtggggtca

SEQ ID NO: 3693480 - DNA, 22 bp, Homo sapiens
gcctggggtggggtcatgccct

SEQ ID NO: 3693481 - DNA, 21 bp, Homo sapiens
gcctggggtgttagtggcacc

SEQ ID NO: 3693482 - DNA, 20 bp, Homo sapiens
gcctgggtgacaaagcgaga

SEQ ID NO: 3693483 - DNA, 14 bp, Homo sapiens
gcctggtggcccag

SEQ ID NO: 3693484 - DNA, 16 bp, Homo sapiens
gcctggtggcccagct

SEQ ID NO: 3693485 - DNA, 15 bp, Homo sapiens
gcctgtaatcctagc

SEQ ID NO: 3693486 - DNA, 20 bp, Homo sapiens
gcctgtagctttcctggtcc

SEQ ID NO: 3693487 - DNA, 16 bp, Homo sapiens
gcctgtccacagcccc

SEQ ID NO: 3693488 - DNA, 12 bp, Homo sapiens
gcctgtccagcc

SEQ ID NO: 3693489 - DNA, 13 bp, Homo sapiens
gcctgtccagcct

SEQ ID NO: 3693490 - DNA, 18 bp, Homo sapiens
gcctgtctcatccccagg

SEQ ID NO: 3693491 - DNA, 19 bp, Homo sapiens
gcctgtctcatccccaggg

SEQ ID NO: 3693492 - DNA, 12 bp, Homo sapiens
gcctgtgtccat

SEQ ID NO: 3693493 - DNA, 14 bp, Homo sapiens
gcctgtgtccatgc

SEQ ID NO: 3693494 - DNA, 19 bp, Homo sapiens
gcctgtgtccatgcgctca

SEQ ID NO: 3693495 - DNA, 21 bp, Homo sapiens
gcctgtgtccatgcgctcagg

SEQ ID NO: 3693496 - DNA, 23 bp, Homo sapiens
gcctgtgtccatgcgctcagggc

SEQ ID NO: 3693497 - DNA, 15 bp, Homo sapiens
gcctgttacaggaat

SEQ ID NO: 3693498 - DNA, 22 bp, Homo sapiens
gcctgtttggcgtttcccagag

SEQ ID NO: 3693499 - DNA, 21 bp, Homo sapiens
gccttaaaattacttggcttt

SEQ ID NO: 3693500 - DNA, 22 bp, Homo sapiens
gccttatcttgcaccccaaagc

SEQ ID NO: 3693501 - DNA, 14 bp, Homo sapiens
gccttcaagtgcca

SEQ ID NO: 3693502 - DNA, 19 bp, Homo sapiens
gccttcggacaactcagtc

SEQ ID NO: 3693503 - DNA, 20 bp, Homo sapiens
gccttggtgggggagcctct

SEQ ID NO: 3693504 - DNA, 21 bp, Homo sapiens
gccttggtgggggagcctctg

SEQ ID NO: 3693505 - DNA, 18 bp, Homo sapiens
gcctttcccaactctagc

SEQ ID NO: 3693506 - DNA, 19 bp, Homo sapiens
gcctttcccaactctagct

SEQ ID NO: 3693507 - DNA, 14 bp, Homo sapiens
gcctttgaatgtta

SEQ ID NO: 3693508 - DNA, 15 bp, Homo sapiens
gcctttgaatgttaa

SEQ ID NO: 3693509 - DNA, 20 bp, Homo sapiens
gcctttgaatgttaattttt

SEQ ID NO: 3693510 - DNA, 17 bp, Homo sapiens
gcctttgatgttacaga

SEQ ID NO: 3693511 - DNA, 13 bp, Homo sapiens
gcctttgggaaat

SEQ ID NO: 3693512 - DNA, 15 bp, Homo sapiens
gccttttctggcacc

SEQ ID NO: 3693513 - DNA, 23 bp, Homo sapiens
gcgacactaaaggaggaggagcc

SEQ ID NO: 3693514 - DNA, 18 bp, Homo sapiens
gcgactccgttggccact

SEQ ID NO: 3693515 - DNA, 16 bp, Homo sapiens
gcgactttctgcctgg

SEQ ID NO: 3693516 - DNA, 22 bp, Homo sapiens
gcgcatcttgcctccaggtgca

SEQ ID NO: 3693517 - DNA, 14 bp, Homo sapiens
gcgccccaagagcc

SEQ ID NO: 3693518 - DNA, 21 bp, Homo sapiens
gcgccccctccgccctgccac

SEQ ID NO: 3693519 - DNA, 12 bp, Homo sapiens
gcgcccccttct

SEQ ID NO: 3693520 - DNA, 20 bp, Homo sapiens
gcgcccccttctttgcagct

SEQ ID NO: 3693521 - DNA, 18 bp, Homo sapiens
gcgcctgcccctcccaga

SEQ ID NO: 3693522 - DNA, 11 bp, Homo sapiens
gcgcctggctt

SEQ ID NO: 3693523 - DNA, 12 bp, Homo sapiens
gcgcctgtgacc

SEQ ID NO: 3693524 - DNA, 16 bp, Homo sapiens
gcgcctgtgatgctgg

SEQ ID NO: 3693525 - DNA, 19 bp, Homo sapiens
gcgctgcccacctgccggc

SEQ ID NO: 3693526 - DNA, 22 bp, Homo sapiens
gcgctgtttttgttgtgtgtgc

SEQ ID NO: 3693527 - DNA, 15 bp, Homo sapiens
gcggaaagcagctca

SEQ ID NO: 3693528 - DNA, 16 bp, Homo sapiens
gcggcaggggcctgga

SEQ ID NO: 3693529 - DNA, 18 bp, Homo sapiens
gcggctccccctggacgg

SEQ ID NO: 3693530 - DNA, 22 bp, Homo sapiens
gcgggccctgcctgagggtggg

SEQ ID NO: 3693531 - DNA, 24 bp, Homo sapiens
gcggggcactaggtaggcttctac

SEQ ID NO: 3693532 - DNA, 14 bp, Homo sapiens
gcggggctctagga

SEQ ID NO: 3693533 - DNA, 15 bp, Homo sapiens
gcggggcttctctcc

SEQ ID NO: 3693534 - DNA, 14 bp, Homo sapiens
gcggtgggggagga

SEQ ID NO: 3693535 - DNA, 13 bp, Homo sapiens
gcggtttcctggt

SEQ ID NO: 3693536 - DNA, 17 bp, Homo sapiens
gcgtctgttcccccttc

SEQ ID NO: 3693537 - DNA, 12 bp, Homo sapiens
gcgtcttcctga

SEQ ID NO: 3693538 - DNA, 13 bp, Homo sapiens
gcgtcttcctgag

SEQ ID NO: 3693539 - DNA, 21 bp, Homo sapiens
gcgtggagggaggccccaggg

SEQ ID NO: 3693540 - DNA, 22 bp, Homo sapiens
gcgtggagggaggccccagggg

SEQ ID NO: 3693541 - DNA, 23 bp, Homo sapiens
gcgtggctctgggtgggcggggc

SEQ ID NO: 3693542 - DNA, 16 bp, Homo sapiens
gcgtggcttctgcagg

SEQ ID NO: 3693543 - DNA, 16 bp, Homo sapiens
gcgtgtgcctgtgtgc

SEQ ID NO: 3693544 - DNA, 17 bp, Homo sapiens
gcgtgtgcctgtgtgcg

SEQ ID NO: 3693545 - DNA, 14 bp, Homo sapiens
gcgttggcttctcc

SEQ ID NO: 3693546 - DNA, 16 bp, Homo sapiens
gcgttggcttctccct

SEQ ID NO: 3693547 - DNA, 21 bp, Homo sapiens
gcgttggcttctccctgggga

SEQ ID NO: 3693548 - DNA, 18 bp, Homo sapiens
gctaaaacaccttggctt

SEQ ID NO: 3693549 - DNA, 13 bp, Homo sapiens
gctaaattttctg

SEQ ID NO: 3693550 - DNA, 20 bp, Homo sapiens
gctaacacggtgaaaccccg

SEQ ID NO: 3693551 - DNA, 16 bp, Homo sapiens
gctaagaacctggaac

SEQ ID NO: 3693552 - DNA, 22 bp, Homo sapiens
gctaaggaggggaaaaaaatgt

SEQ ID NO: 3693553 - DNA, 23 bp, Homo sapiens
gctacagattgggcggggcttct

SEQ ID NO: 3693554 - DNA, 20 bp, Homo sapiens
gctacaggaagcaccccatg

SEQ ID NO: 3693555 - DNA, 23 bp, Homo sapiens
gctacaggaagcaccccatgcca

SEQ ID NO: 3693556 - DNA, 16 bp, Homo sapiens
gctacatgctggggtc

SEQ ID NO: 3693557 - DNA, 15 bp, Homo sapiens
gctactataaagaga

SEQ ID NO: 3693558 - DNA, 18 bp, Homo sapiens
gctactgccgtcagtgct

SEQ ID NO: 3693559 - DNA, 23 bp, Homo sapiens
gctactggcaaaaggatctttgt

SEQ ID NO: 3693560 - DNA, 20 bp, Homo sapiens
gctagaggccagccccaccc

SEQ ID NO: 3693561 - DNA, 16 bp, Homo sapiens
gctagtcaagctcctc

SEQ ID NO: 3693562 - DNA, 15 bp, Homo sapiens
gctgctcctagaggg

SEQ ID NO: 3693563 - DNA, 21 bp, Homo sapiens
gctgctcgcgaaggtcccaca

SEQ ID NO: 3693564 - DNA, 15 bp, Homo sapiens
gctgctgaaggctca

SEQ ID NO: 3693565 - DNA, 15 bp, Homo sapiens
gctgctggtgcacag

SEQ ID NO: 3693566 - DNA, 16 bp, Homo sapiens
gctgcttaagtgcatg

SEQ ID NO: 3693567 - DNA, 16 bp, Homo sapiens
gctgcttcctcctgga

SEQ ID NO: 3693568 - DNA, 17 bp, Homo sapiens
gctgcttcctcctggaa

SEQ ID NO: 3693569 - DNA, 22 bp, Homo sapiens
gctgctttaacagtggagctga

SEQ ID NO: 3693570 - DNA, 12 bp, Homo sapiens
gctgcttttcct

SEQ ID NO: 3693571 - DNA, 15 bp, Homo sapiens
gctggaagatcctgc

SEQ ID NO: 3693572 - DNA, 18 bp, Homo sapiens
gctggaagatcctgcggg

SEQ ID NO: 3693573 - DNA, 16 bp, Homo sapiens
gctggagcccagggag

SEQ ID NO: 3693574 - DNA, 18 bp, Homo sapiens
gctggagtacccagccta

SEQ ID NO: 3693575 - DNA, 14 bp, Homo sapiens
gctggagtgcagta

SEQ ID NO: 3693576 - DNA, 15 bp, Homo sapiens
gctggagtgcagtga

SEQ ID NO: 3693577 - DNA, 12 bp, Homo sapiens
gctggcaggagt

SEQ ID NO: 3693578 - DNA, 17 bp, Homo sapiens
gctggccagtccaggct

SEQ ID NO: 3693579 - DNA, 15 bp, Homo sapiens
gctggccgagggtcc

SEQ ID NO: 3693580 - DNA, 19 bp, Homo sapiens
gctggctgactaagccccg

SEQ ID NO: 3693581 - DNA, 14 bp, Homo sapiens
gctgggaagcccgg

SEQ ID NO: 3693582 - DNA, 15 bp, Homo sapiens
gctgggaagcccgga

SEQ ID NO: 3693583 - DNA, 22 bp, Homo sapiens
gctgggaagcccggactgacca

SEQ ID NO: 3693584 - DNA, 23 bp, Homo sapiens
gctgggaagcccggactgaccaa

SEQ ID NO: 3693585 - DNA, 12 bp, Homo sapiens
gctgggactcag

SEQ ID NO: 3693586 - DNA, 14 bp, Homo sapiens
gctgggactcagcc

SEQ ID NO: 3693587 - DNA, 20 bp, Homo sapiens
gctgggagctccactctgct

SEQ ID NO: 3693588 - DNA, 19 bp, Homo sapiens
gctgggcagaaggccaaga

SEQ ID NO: 3693589 - DNA, 14 bp, Homo sapiens
gctgggcaggttgg

SEQ ID NO: 3693590 - DNA, 23 bp, Homo sapiens
gctgggggaagaagctctctcct

SEQ ID NO: 3693591 - DNA, 13 bp, Homo sapiens
gctgggggcagga

SEQ ID NO: 3693592 - DNA, 20 bp, Homo sapiens
gctgggggcaggagggccct

SEQ ID NO: 3693593 - DNA, 18 bp, Homo sapiens
gctgggggtgggccaggc

SEQ ID NO: 3693594 - DNA, 23 bp, Homo sapiens
gctgggtggcaccagcagcctgg

SEQ ID NO: 3693595 - DNA, 17 bp, Homo sapiens
gctggtacaacggaggc

SEQ ID NO: 3693596 - DNA, 19 bp, Homo sapiens
gctggtccagggctagtga

SEQ ID NO: 3693597 - DNA, 16 bp, Homo sapiens
gctggtccgtgggacg

SEQ ID NO: 3693598 - DNA, 20 bp, Homo sapiens
gctggtgcacagccactccc

SEQ ID NO: 3693599 - DNA, 22 bp, Homo sapiens
gctgtaatcatttgtttacatt

SEQ ID NO: 3693600 - DNA, 22 bp, Homo sapiens
gctgtcaatgggacctgtggct

SEQ ID NO: 3693601 - DNA, 22 bp, Homo sapiens
gctgtccttacccatctgcacc

SEQ ID NO: 3693602 - DNA, 14 bp, Homo sapiens
gctgtcctttctag

SEQ ID NO: 3693603 - DNA, 15 bp, Homo sapiens
gctgtgaggctgtcc

SEQ ID NO: 3693604 - DNA, 17 bp, Homo sapiens
gctgtgaggcttgccca

SEQ ID NO: 3693605 - DNA, 19 bp, Homo sapiens
gctgtgaggcttgcccagg

SEQ ID NO: 3693606 - DNA, 17 bp, Homo sapiens
gctgtgctatggtgctc

SEQ ID NO: 3693607 - DNA, 19 bp, Homo sapiens
gctgtgctgggaagcccgg

SEQ ID NO: 3693608 - DNA, 15 bp, Homo sapiens
gctgtgtctgagccc

SEQ ID NO: 3693609 - DNA, 23 bp, Homo sapiens
gctgtgtgtcccaggcagggaga

SEQ ID NO: 3693610 - DNA, 23 bp, Homo sapiens
gctgtgtttggctttcagggagg

SEQ ID NO: 3693611 - DNA, 20 bp, Homo sapiens
gctgttagggacatttccaa

SEQ ID NO: 3693612 - DNA, 20 bp, Homo sapiens
gctgttctcattgccagtga

SEQ ID NO: 3693613 - DNA, 23 bp, Homo sapiens
gctgttgacatatttaatgtttt

SEQ ID NO: 3693614 - DNA, 15 bp, Homo sapiens
gctgttggtgggacc

SEQ ID NO: 3693615 - DNA, 15 bp, Homo sapiens
gctgtttatggcctc

SEQ ID NO: 3693616 - DNA, 16 bp, Homo sapiens
gctgtttatggcctca

SEQ ID NO: 3693617 - DNA, 17 bp, Homo sapiens
gctgtttatggcctcag

SEQ ID NO: 3693618 - DNA, 20 bp, Homo sapiens
gctgtttctgcttatttcat

SEQ ID NO: 3693619 - DNA, 16 bp, Homo sapiens
gcttaagtgcatgcat

SEQ ID NO: 3693620 - DNA, 17 bp, Homo sapiens
gcttaataaaagaacat

SEQ ID NO: 3693621 - DNA, 21 bp, Homo sapiens
gcttaatcattttcattccta

SEQ ID NO: 3693622 - DNA, 13 bp, Homo sapiens
gcttatctcaggg

SEQ ID NO: 3693623 - DNA, 17 bp, Homo sapiens
gcttatgaatatattta

SEQ ID NO: 3693624 - DNA, 16 bp, Homo sapiens
gcttatttttctgtga

SEQ ID NO: 3693625 - DNA, 19 bp, Homo sapiens
gcttcacggaagagccttg

SEQ ID NO: 3693626 - DNA, 20 bp, Homo sapiens
gcttcacggaagagccttgc

SEQ ID NO: 3693627 - DNA, 23 bp, Homo sapiens
gcttccagattgacgacaagtgc

SEQ ID NO: 3693628 - DNA, 11 bp, Homo sapiens
gcttccatgcc

SEQ ID NO: 3693629 - DNA, 14 bp, Homo sapiens
gcttccctgcagct

SEQ ID NO: 3693630 - DNA, 16 bp, Homo sapiens
gcttcctcctggaaat

SEQ ID NO: 3693631 - DNA, 15 bp, Homo sapiens
gcttctacctgcagg

SEQ ID NO: 3693632 - DNA, 22 bp, Homo sapiens
gcttctcactgccatgccagct

SEQ ID NO: 3693633 - DNA, 14 bp, Homo sapiens
gcttctccctgggg

SEQ ID NO: 3693634 - DNA, 16 bp, Homo sapiens
gcttctccctggggac

SEQ ID NO: 3693635 - DNA, 21 bp, Homo sapiens
gcttctccctggggacggggc

SEQ ID NO: 3693636 - DNA, 11 bp, Homo sapiens
gcttctcctga

SEQ ID NO: 3693637 - DNA, 19 bp, Homo sapiens
gcttctcctgaccagggca

SEQ ID NO: 3693638 - DNA, 20 bp, Homo sapiens
gcttctcctgcgggggcgag

SEQ ID NO: 3693639 - DNA, 15 bp, Homo sapiens
gcttctcctgtgtga

SEQ ID NO: 3693640 - DNA, 20 bp, Homo sapiens
gcttctctccgcgggtggga

SEQ ID NO: 3693641 - DNA, 22 bp, Homo sapiens
gcttctctccgcgggtgggact

SEQ ID NO: 3693642 - DNA, 13 bp, Homo sapiens
gcttctctgggac

SEQ ID NO: 3693643 - DNA, 23 bp, Homo sapiens
gcttctcttgggtgggacagggc

SEQ ID NO: 3693644 - DNA, 23 bp, Homo sapiens
gcttctggaatttgttcaagttt

SEQ ID NO: 3693645 - DNA, 16 bp, Homo sapiens
gcttctggccaggaag

SEQ ID NO: 3693646 - DNA, 20 bp, Homo sapiens
gcttcttcctggatggggca

SEQ ID NO: 3693647 - DNA, 12 bp, Homo sapiens
gcttcttgcctc

SEQ ID NO: 3693648 - DNA, 13 bp, Homo sapiens
gcttcttgcctct

SEQ ID NO: 3693649 - DNA, 16 bp, Homo sapiens
gcttcttgcctctgtg

SEQ ID NO: 3693650 - DNA, 17 bp, Homo sapiens
gcttcttgcctctgtgc

SEQ ID NO: 3693651 - DNA, 19 bp, Homo sapiens
gcttcttgcctctgtgctg

SEQ ID NO: 3693652 - DNA, 13 bp, Homo sapiens
gcttgaacccagg

SEQ ID NO: 3693653 - DNA, 22 bp, Homo sapiens
gcttgatggaagtgggccagtc

SEQ ID NO: 3693654 - DNA, 19 bp, Homo sapiens
gcttgatgggattctggac

SEQ ID NO: 3693655 - DNA, 13 bp, Homo sapiens
gcttgcccaggag

SEQ ID NO: 3693656 - DNA, 15 bp, Homo sapiens
gcttgcccaggagca

SEQ ID NO: 3693657 - DNA, 17 bp, Homo sapiens
gcttgcctgcagggcca

SEQ ID NO: 3693658 - DNA, 17 bp, Homo sapiens
gcttgggcagcatcccc

SEQ ID NO: 3693659 - DNA, 23 bp, Homo sapiens
gcttgtaggtatgtctgtgccat

SEQ ID NO: 3693660 - DNA, 16 bp, Homo sapiens
gcttgttgtgctttta

SEQ ID NO: 3693661 - DNA, 13 bp, Homo sapiens
gctttaacagtgg

SEQ ID NO: 3693662 - DNA, 16 bp, Homo sapiens
gctttaacagtggagc

SEQ ID NO: 3693663 - DNA, 14 bp, Homo sapiens
gctttcacattgta

SEQ ID NO: 3693664 - DNA, 15 bp, Homo sapiens
gctttccatgggacc

SEQ ID NO: 3693665 - DNA, 11 bp, Homo sapiens
gctttcctgcc

SEQ ID NO: 3693666 - DNA, 13 bp, Homo sapiens
gctttcctggagc

SEQ ID NO: 3693667 - DNA, 13 bp, Homo sapiens
gctttctgctcag

SEQ ID NO: 3693668 - DNA, 19 bp, Homo sapiens
gctttctgctcagcttctc

SEQ ID NO: 3693669 - DNA, 21 bp, Homo sapiens
gctttctgctcagcttctcct

SEQ ID NO: 3693670 - DNA, 15 bp, Homo sapiens
gctttgaaacagaaa

SEQ ID NO: 3693671 - DNA, 18 bp, Homo sapiens
gctttgccaaaataccag

SEQ ID NO: 3693672 - DNA, 18 bp, Homo sapiens
gctttggaatgctccagg

SEQ ID NO: 3693673 - DNA, 13 bp, Homo sapiens
gctttggcttctt

SEQ ID NO: 3693674 - DNA, 20 bp, Homo sapiens
gcttttccctgggtggagca

SEQ ID NO: 3693675 - DNA, 20 bp, Homo sapiens
gcttttccttggggcaggca

SEQ ID NO: 3693676 - DNA, 23 bp, Homo sapiens
ggctctcatgttttcaactgcca

SEQ ID NO: 3693677 - DNA, 14 bp, Homo sapiens
ggctctgggtgggc

SEQ ID NO: 3693678 - DNA, 20 bp, Homo sapiens
ggctctgggtgggcggggca

SEQ ID NO: 3693679 - DNA, 14 bp, Homo sapiens
ggctctggtggcca

SEQ ID NO: 3693680 - DNA, 20 bp, Homo sapiens
ggctcttctccttggaggac

SEQ ID NO: 3693681 - DNA, 14 bp, Homo sapiens
ggctgaaattctcc

SEQ ID NO: 3693682 - DNA, 15 bp, Homo sapiens
ggctgaccatgctca

SEQ ID NO: 3693683 - DNA, 16 bp, Homo sapiens
ggctgaggcctggact

SEQ ID NO: 3693684 - DNA, 24 bp, Homo sapiens
ggctgatgtcaatttctgtgttgc

SEQ ID NO: 3693685 - DNA, 13 bp, Homo sapiens
ggctgcagaggcc

SEQ ID NO: 3693686 - DNA, 15 bp, Homo sapiens
ggctgccaaggccag

SEQ ID NO: 3693687 - DNA, 22 bp, Homo sapiens
ggctgccatctcacctcctgct

SEQ ID NO: 3693688 - DNA, 14 bp, Homo sapiens
ggctgcccagagct

SEQ ID NO: 3693689 - DNA, 18 bp, Homo sapiens
ggctgcccagagctgctg

SEQ ID NO: 3693690 - DNA, 16 bp, Homo sapiens
ggctgctccctgaggg

SEQ ID NO: 3693691 - DNA, 15 bp, Homo sapiens
ggctggaagatcctg

SEQ ID NO: 3693692 - DNA, 19 bp, Homo sapiens
ggctggaagatcctgcggg

SEQ ID NO: 3693693 - DNA, 22 bp, Homo sapiens
ggctggaagatcctgcgggtgg

SEQ ID NO: 3693694 - DNA, 20 bp, Homo sapiens
ggctggagtgcagtggcgca

SEQ ID NO: 3693695 - DNA, 16 bp, Homo sapiens
ggctggccagtccagg

SEQ ID NO: 3693696 - DNA, 16 bp, Homo sapiens
ggctgggggcaggagg

SEQ ID NO: 3693697 - DNA, 17 bp, Homo sapiens
ggctgggggcaggaggg

SEQ ID NO: 3693698 - DNA, 20 bp, Homo sapiens
ggctggtacaacggaggcct

SEQ ID NO: 3693699 - DNA, 22 bp, Homo sapiens
ggctgtcctgtacattgtggga

SEQ ID NO: 3693700 - DNA, 14 bp, Homo sapiens
ggctgtggctctgg

SEQ ID NO: 3693701 - DNA, 15 bp, Homo sapiens
ggctgtggctctggg

SEQ ID NO: 3693702 - DNA, 13 bp, Homo sapiens
ggcttagtgccac

SEQ ID NO: 3693703 - DNA, 15 bp, Homo sapiens
ggcttagtgccaccc

SEQ ID NO: 3693704 - DNA, 22 bp, Homo sapiens
ggcttagtttgtgtgttgtctc

SEQ ID NO: 3693705 - DNA, 20 bp, Homo sapiens
ggcttcacggaagagccttg

SEQ ID NO: 3693706 - DNA, 16 bp, Homo sapiens
ggcttctccctgggga

SEQ ID NO: 3693707 - DNA, 17 bp, Homo sapiens
ggcttctccctggggac

SEQ ID NO: 3693708 - DNA, 18 bp, Homo sapiens
ggcttctccctggggacg

SEQ ID NO: 3693709 - DNA, 22 bp, Homo sapiens
ggcttctctccgcgggtgggac

SEQ ID NO: 3693710 - DNA, 13 bp, Homo sapiens
ggcttctctggga

SEQ ID NO: 3693711 - DNA, 18 bp, Homo sapiens
ggcttctctgggaccagg

SEQ ID NO: 3693712 - DNA, 18 bp, Homo sapiens
ggcttctcttgggtggga

SEQ ID NO: 3693713 - DNA, 19 bp, Homo sapiens
ggcttctcttgggtgggac

SEQ ID NO: 3693714 - DNA, 12 bp, Homo sapiens
ggcttctgcagg

SEQ ID NO: 3693715 - DNA, 14 bp, Homo sapiens
ggcttgcccaggag

SEQ ID NO: 3693716 - DNA, 22 bp, Homo sapiens
ggcttggggctcacacacctgt

SEQ ID NO: 3693717 - DNA, 22 bp, Homo sapiens
ggctttcccacttcccaccctg

SEQ ID NO: 3693718 - DNA, 23 bp, Homo sapiens
ggctttcccacttcccaccctgc

SEQ ID NO: 3693719 - DNA, 13 bp, Homo sapiens
ggctttgcatttc

SEQ ID NO: 3693720 - DNA, 13 bp, Homo sapiens
ggcttttccctgg

SEQ ID NO: 3693721 - DNA, 18 bp, Homo sapiens
ggctttttccaaatgctt

SEQ ID NO: 3693722 - DNA, 18 bp, Homo sapiens
gggaaccgccctcctgat

SEQ ID NO: 3693723 - DNA, 15 bp, Homo sapiens
gggaacctgtgtccg

SEQ ID NO: 3693724 - DNA, 12 bp, Homo sapiens
gggaagcaggga

SEQ ID NO: 3693725 - DNA, 18 bp, Homo sapiens
gggaaggttccatgaagc

SEQ ID NO: 3693726 - DNA, 17 bp, Homo sapiens
gggacagaggccccagc

SEQ ID NO: 3693727 - DNA, 17 bp, Homo sapiens
gggacatttccaagctg

SEQ ID NO: 3693728 - DNA, 16 bp, Homo sapiens
gggacccagtgcagaa

SEQ ID NO: 3693729 - DNA, 13 bp, Homo sapiens
gggacggggctcc

SEQ ID NO: 3693730 - DNA, 20 bp, Homo sapiens
gggacggggctcccctggac

SEQ ID NO: 3693731 - DNA, 16 bp, Homo sapiens
gggactcctccctggg

SEQ ID NO: 3693732 - DNA, 21 bp, Homo sapiens
gggactcctccctgggggtgg

SEQ ID NO: 3693733 - DNA, 16 bp, Homo sapiens
gggactcttccctggg

SEQ ID NO: 3693734 - DNA, 18 bp, Homo sapiens
gggactcttccctgggaa

SEQ ID NO: 3693735 - DNA, 20 bp, Homo sapiens
gggacttcgcagaggcaagc

SEQ ID NO: 3693736 - DNA, 12 bp, Homo sapiens
gggagaagctcc

SEQ ID NO: 3693737 - DNA, 12 bp, Homo sapiens
gggagccagggc

SEQ ID NO: 3693738 - DNA, 21 bp, Homo sapiens
gggagcccactgtcctgggcc

SEQ ID NO: 3693739 - DNA, 19 bp, Homo sapiens
gggagctccactctgcttc

SEQ ID NO: 3693740 - DNA, 19 bp, Homo sapiens
gggagctgggcccgacatg

SEQ ID NO: 3693741 - DNA, 23 bp, Homo sapiens
gggaggatctcttgagcctggga

SEQ ID NO: 3693742 - DNA, 21 bp, Homo sapiens
gggaggattgcttgagctcag

SEQ ID NO: 3693743 - DNA, 23 bp, Homo sapiens
gggaggattgcttgagctcagga

SEQ ID NO: 3693744 - DNA, 20 bp, Homo sapiens
gggaggcagaggttgcagtg

SEQ ID NO: 3693745 - DNA, 19 bp, Homo sapiens
gggaggccaaggtgggagg

SEQ ID NO: 3693746 - DNA, 11 bp, Homo sapiens
gggaggcccca

SEQ ID NO: 3693747 - DNA, 18 bp, Homo sapiens
gggaggccccactgggga

SEQ ID NO: 3693748 - DNA, 17 bp, Homo sapiens
gggaggtttggggggca

SEQ ID NO: 3693749 - DNA, 17 bp, Homo sapiens
gggagttaagacctggc

SEQ ID NO: 3693750 - DNA, 20 bp, Homo sapiens
gggatccctcccccccatgc

SEQ ID NO: 3693751 - DNA, 19 bp, Homo sapiens
gggatctggtcctacccat

SEQ ID NO: 3693752 - DNA, 16 bp, Homo sapiens
gggatgccctggaggt

SEQ ID NO: 3693753 - DNA, 12 bp, Homo sapiens
gggatgggaggt

SEQ ID NO: 3693754 - DNA, 14 bp, Homo sapiens
gggattcaggctgc

SEQ ID NO: 3693755 - DNA, 15 bp, Homo sapiens
gggattcaggctgct

SEQ ID NO: 3693756 - DNA, 16 bp, Homo sapiens
gggattcaggctgctt

SEQ ID NO: 3693757 - DNA, 16 bp, Homo sapiens
gggcaaggccccttcc

SEQ ID NO: 3693758 - DNA, 18 bp, Homo sapiens
gggcacacacacccgccc

SEQ ID NO: 3693759 - DNA, 13 bp, Homo sapiens
gggcacaggaggc

SEQ ID NO: 3693760 - DNA, 20 bp, Homo sapiens
gggcagaactcctacctgaa

SEQ ID NO: 3693761 - DNA, 17 bp, Homo sapiens
gggcagagctggctctg

SEQ ID NO: 3693762 - DNA, 13 bp, Homo sapiens
gggcagccaggct

SEQ ID NO: 3693763 - DNA, 11 bp, Homo sapiens
gggcagggagc

SEQ ID NO: 3693764 - DNA, 20 bp, Homo sapiens
gggcagggagctgggcccga

SEQ ID NO: 3693765 - DNA, 22 bp, Homo sapiens
gggcaggtccagctctgtgggc

SEQ ID NO: 3693766 - DNA, 18 bp, Homo sapiens
gggcattgatggggaagg

SEQ ID NO: 3693767 - DNA, 22 bp, Homo sapiens
gggccactggtccccaacaatg

SEQ ID NO: 3693768 - DNA, 20 bp, Homo sapiens
gggccactgtggtggcagtg

SEQ ID NO: 3693769 - DNA, 11 bp, Homo sapiens
gggccagagcc

SEQ ID NO: 3693770 - DNA, 12 bp, Homo sapiens
gggccagagcca

SEQ ID NO: 3693771 - DNA, 19 bp, Homo sapiens
gggccagtcctgcctggcc

SEQ ID NO: 3693772 - DNA, 20 bp, Homo sapiens
gggccagtcctgcctggcca

SEQ ID NO: 3693773 - DNA, 21 bp, Homo sapiens
gggccagtcctgcctggccag

SEQ ID NO: 3693774 - DNA, 22 bp, Homo sapiens
gggccagtcctgcctggccagg

SEQ ID NO: 3693775 - DNA, 15 bp, Homo sapiens
gggccagtcctggtt

SEQ ID NO: 3693776 - DNA, 14 bp, Homo sapiens
gggccagtgctcca

SEQ ID NO: 3693777 - DNA, 15 bp, Homo sapiens
gggccatgctgaggc

SEQ ID NO: 3693778 - DNA, 19 bp, Homo sapiens
gggccatggctcagggtgg

SEQ ID NO: 3693779 - DNA, 23 bp, Homo sapiens
gggcccaagacagatgccccaga

SEQ ID NO: 3693780 - DNA, 19 bp, Homo sapiens
gggcccacgtggttggggc

SEQ ID NO: 3693781 - DNA, 13 bp, Homo sapiens
gggcccagagccc

SEQ ID NO: 3693782 - DNA, 17 bp, Homo sapiens
gggcccagagcccagct

SEQ ID NO: 3693783 - DNA, 13 bp, Homo sapiens
gggcccagatctg

SEQ ID NO: 3693784 - DNA, 22 bp, Homo sapiens
gggcccagtgcatggtggccag

SEQ ID NO: 3693785 - DNA, 11 bp, Homo sapiens
gggcccctggc

SEQ ID NO: 3693786 - DNA, 14 bp, Homo sapiens
gggccctacctggg

SEQ ID NO: 3693787 - DNA, 15 bp, Homo sapiens
gggccctacctgggg

SEQ ID NO: 3693788 - DNA, 16 bp, Homo sapiens
gggccctacctgggga

SEQ ID NO: 3693789 - DNA, 14 bp, Homo sapiens
gggccctgagtctg

SEQ ID NO: 3693790 - DNA, 19 bp, Homo sapiens
gggccctgccctggcaggg

SEQ ID NO: 3693791 - DNA, 15 bp, Homo sapiens
gggccctgcctgagg

SEQ ID NO: 3693792 - DNA, 18 bp, Homo sapiens
gggcccttacctgtgacc

SEQ ID NO: 3693793 - DNA, 14 bp, Homo sapiens
gggccgctgccacc

SEQ ID NO: 3693794 - DNA, 15 bp, Homo sapiens
gggccggcccccttc

SEQ ID NO: 3693795 - DNA, 23 bp, Homo sapiens
gggtgctgtgaggcttgcccagg

SEQ ID NO: 3693796 - DNA, 16 bp, Homo sapiens
gggtgggacagggctt

SEQ ID NO: 3693797 - DNA, 14 bp, Homo sapiens
gggtgggccaggct

SEQ ID NO: 3693798 - DNA, 19 bp, Homo sapiens
gggtgggccaggctgatgg

SEQ ID NO: 3693799 - DNA, 17 bp, Homo sapiens
gggtggggtcatgccct

SEQ ID NO: 3693800 - DNA, 21 bp, Homo sapiens
gggtggggtcatgccctcctc

SEQ ID NO: 3693801 - DNA, 15 bp, Homo sapiens
gggtgtcttgggcag

SEQ ID NO: 3693802 - DNA, 23 bp, Homo sapiens
gggtgtcttgggcagagctggct

SEQ ID NO: 3693803 - DNA, 15 bp, Homo sapiens
gggtgtggatggcag

SEQ ID NO: 3693804 - DNA, 17 bp, Homo sapiens
gggtgtggatggcagtg

SEQ ID NO: 3693805 - DNA, 13 bp, Homo sapiens
gggtgtgggaggc

SEQ ID NO: 3693806 - DNA, 16 bp, Homo sapiens
gggtgtgggaggcccg

SEQ ID NO: 3693807 - DNA, 17 bp, Homo sapiens
gggttaacttggtcaga

SEQ ID NO: 3693808 - DNA, 14 bp, Homo sapiens
gggttcaagagact

SEQ ID NO: 3693809 - DNA, 21 bp, Homo sapiens
gggttctgcctgccagctgca

SEQ ID NO: 3693810 - DNA, 12 bp, Homo sapiens
gggttgggccca

SEQ ID NO: 3693811 - DNA, 20 bp, Homo sapiens
gggtttcaccatgttggcca

SEQ ID NO: 3693812 - DNA, 17 bp, Homo sapiens
ggtaaaaactgcagtgt

SEQ ID NO: 3693813 - DNA, 14 bp, Homo sapiens
ggtaagaagaaagc

SEQ ID NO: 3693814 - DNA, 15 bp, Homo sapiens
ggtacaaaaataaat

SEQ ID NO: 3693815 - DNA, 14 bp, Homo sapiens
ggtacaacggaggc

SEQ ID NO: 3693816 - DNA, 11 bp, Homo sapiens
ggtagaacaca

SEQ ID NO: 3693817 - DNA, 15 bp, Homo sapiens
ggaggcggggctcta

SEQ ID NO: 3693818 - DNA, 16 bp, Homo sapiens
ggaggctcctgtggta

SEQ ID NO: 3693819 - DNA, 14 bp, Homo sapiens
taatcatttgttta

SEQ ID NO: 3693820 - DNA, 19 bp, Homo sapiens
taatcatttgtttacattt

SEQ ID NO: 3693821 - DNA, 21 bp, Homo sapiens
taatcatttgtttacatttga

SEQ ID NO: 3693822 - DNA, 17 bp, Homo sapiens
taatccaggcagatcca

SEQ ID NO: 3693823 - DNA, 23 bp, Homo sapiens
taatccaggcagatccaggacta

SEQ ID NO: 3693824 - DNA, 21 bp, Homo sapiens
taatcccagcattttgggaag

SEQ ID NO: 3693825 - DNA, 20 bp, Homo sapiens
taatgaatcgtaatgaagtt

SEQ ID NO: 3693826 - DNA, 22 bp, Homo sapiens
taatgatgacaaaaaatgtttt

SEQ ID NO: 3693827 - DNA, 17 bp, Homo sapiens
taatgctatgcaaaaaa

SEQ ID NO: 3693828 - DNA, 17 bp, Homo sapiens
taatgctatttgaacaa

SEQ ID NO: 3693829 - DNA, 17 bp, Homo sapiens
taatggcatgagaaata

SEQ ID NO: 3693830 - DNA, 15 bp, Homo sapiens
taatggggtcctggc

SEQ ID NO: 3693831 - DNA, 17 bp, Homo sapiens
taatggggtcctggcca

SEQ ID NO: 3693832 - DNA, 15 bp, Homo sapiens
taatggtttgaatat

SEQ ID NO: 3693833 - DNA, 16 bp, Homo sapiens
taatgttttaaatgta

SEQ ID NO: 3693834 - DNA, 17 bp, Homo sapiens
taatgttttaaatgtac

SEQ ID NO: 3693835 - DNA, 22 bp, Homo sapiens
taatgttttctttgcaaagtat

SEQ ID NO: 3693836 - DNA, 21 bp, Homo sapiens
taattaaataaaaatctgtgg

SEQ ID NO: 3693837 - DNA, 22 bp, Homo sapiens
taattgctgtgtgtcccaggca

SEQ ID NO: 3693838 - DNA, 12 bp, Homo sapiens
taattgctttga

SEQ ID NO: 3693839 - DNA, 13 bp, Homo sapiens
taatttaaagaga

SEQ ID NO: 3693840 - DNA, 14 bp, Homo sapiens
taatttaaagagac

SEQ ID NO: 3693841 - DNA, 20 bp, Homo sapiens
taatttagtaaatgttatct

SEQ ID NO: 3693842 - DNA, 17 bp, Homo sapiens
taatttattaattgctt

SEQ ID NO: 3693843 - DNA, 18 bp, Homo sapiens
taatttattaattgcttt

SEQ ID NO: 3693844 - DNA, 20 bp, Homo sapiens
taatttattgtctgtctaca

SEQ ID NO: 3693845 - DNA, 17 bp, Homo sapiens
taatttctaagtgtaag

SEQ ID NO: 3693846 - DNA, 22 bp, Homo sapiens
taatttgatagtattgtgcata

SEQ ID NO: 3693847 - DNA, 19 bp, Homo sapiens
taatttttaatgatgacaa

SEQ ID NO: 3693848 - DNA, 16 bp, Homo sapiens
taatttttcctatatt

SEQ ID NO: 3693849 - DNA, 17 bp, Homo sapiens
taattttttggtacaaa

SEQ ID NO: 3693850 - DNA, 12 bp, Homo sapiens
tacaaaaataaa

SEQ ID NO: 3693851 - DNA, 17 bp, Homo sapiens
tacaaaaataaatttat

SEQ ID NO: 3693852 - DNA, 17 bp, Homo sapiens
tacaaacatgtggttaa

SEQ ID NO: 3693853 - DNA, 16 bp, Homo sapiens
tacaaccaatggaatg

SEQ ID NO: 3693854 - DNA, 18 bp, Homo sapiens
tacaactcaaaaaacatt

SEQ ID NO: 3693855 - DNA, 16 bp, Homo sapiens
tacaagagcagcctgt

SEQ ID NO: 3693856 - DNA, 20 bp, Homo sapiens
tacaagagcagcctgtggca

SEQ ID NO: 3693857 - DNA, 16 bp, Homo sapiens
tacaagtttatatata

SEQ ID NO: 3693858 - DNA, 17 bp, Homo sapiens
tacacaatggtttttaa

SEQ ID NO: 3693859 - DNA, 18 bp, Homo sapiens
tacacagtaagtcattta

SEQ ID NO: 3693860 - DNA, 22 bp, Homo sapiens
tacagaaaagacaaacagtaga

SEQ ID NO: 3693861 - DNA, 15 bp, Homo sapiens
tacagaattactgta

SEQ ID NO: 3693862 - DNA, 19 bp, Homo sapiens
tacagacatatttaactgg

SEQ ID NO: 3693863 - DNA, 17 bp, Homo sapiens
tacagctgtgttattct

SEQ ID NO: 3693864 - DNA, 15 bp, Homo sapiens
tacaggcatagagtt

SEQ ID NO: 3693865 - DNA, 21 bp, Homo sapiens
tacagtagattttccaaatgt

SEQ ID NO: 3693866 - DNA, 15 bp, Homo sapiens
tacagtatctcaggg

SEQ ID NO: 3693867 - DNA, 20 bp, Homo sapiens
tacagttgaaaaacagctga

SEQ ID NO: 3693868 - DNA, 16 bp, Homo sapiens
tacataattcactctg

SEQ ID NO: 3693869 - DNA, 15 bp, Homo sapiens
tacatacaccagcat

SEQ ID NO: 3693870 - DNA, 12 bp, Homo sapiens
tacatacagaat

SEQ ID NO: 3693871 - DNA, 16 bp, Homo sapiens
tacatgtggcccaaca

SEQ ID NO: 3693872 - DNA, 15 bp, Homo sapiens
tacatgtttataaat

SEQ ID NO: 3693873 - DNA, 14 bp, Homo sapiens
tacatttactgaaa

SEQ ID NO: 3693874 - DNA, 15 bp, Homo sapiens
tacatttactgaaat

SEQ ID NO: 3693875 - DNA, 22 bp, Homo sapiens
tacatttttgtggttttgagaa

SEQ ID NO: 3693876 - DNA, 20 bp, Homo sapiens
taccaaagtgtcttttgaca

SEQ ID NO: 3693877 - DNA, 21 bp, Homo sapiens
taccaaagtgtcttttgacat

SEQ ID NO: 3693878 - DNA, 14 bp, Homo sapiens
taccaatgggaagc

SEQ ID NO: 3693879 - DNA, 15 bp, Homo sapiens
taccaatgggaagca

SEQ ID NO: 3693880 - DNA, 18 bp, Homo sapiens
taccacaagcctgagaac

SEQ ID NO: 3693881 - DNA, 23 bp, Homo sapiens
taaaaatgtcttgctgttgacat

SEQ ID NO: 3693882 - DNA, 17 bp, Homo sapiens
taaaaattactgtgtta

SEQ ID NO: 3693883 - DNA, 14 bp, Homo sapiens
taaaacaaaatttg

SEQ ID NO: 3693884 - DNA, 15 bp, Homo sapiens
taaaacaaaatttga

SEQ ID NO: 3693885 - DNA, 17 bp, Homo sapiens
taaaacactttcaaaac

SEQ ID NO: 3693886 - DNA, 23 bp, Homo sapiens
taaaacgttagttaatccctttg

SEQ ID NO: 3693887 - DNA, 17 bp, Homo sapiens
taaaactggctttggct

SEQ ID NO: 3693888 - DNA, 15 bp, Homo sapiens
taaaactttcctcgc

SEQ ID NO: 3693889 - DNA, 17 bp, Homo sapiens
taaaactttcctcgcct

SEQ ID NO: 3693890 - DNA, 14 bp, Homo sapiens
taaaagaaatgtat

SEQ ID NO: 3693891 - DNA, 18 bp, Homo sapiens
taaaagaacatgcttgaa

SEQ ID NO: 3693892 - DNA, 13 bp, Homo sapiens
taaaagatcgcag

SEQ ID NO: 3693893 - DNA, 14 bp, Homo sapiens
taaaagatgctttt

SEQ ID NO: 3693894 - DNA, 18 bp, Homo sapiens
taaaatcctacagtgaaa

SEQ ID NO: 3693895 - DNA, 19 bp, Homo sapiens
taaaatcctacagtgaaat

SEQ ID NO: 3693896 - DNA, 22 bp, Homo sapiens
taaaatggatgccttgaataat

SEQ ID NO: 3693897 - DNA, 18 bp, Homo sapiens
taaaatggtttgtcctga

SEQ ID NO: 3693898 - DNA, 23 bp, Homo sapiens
taaaatgtaaagccatgctggaa

SEQ ID NO: 3693899 - DNA, 19 bp, Homo sapiens
taaaattaaagctgaaaac

SEQ ID NO: 3693900 - DNA, 17 bp, Homo sapiens
taaaattacttggcttt

SEQ ID NO: 3693901 - DNA, 23 bp, Homo sapiens
taaaattcttcgcataaagaaga

SEQ ID NO: 3693902 - DNA, 22 bp, Homo sapiens
taaacacacagatacacacaca

SEQ ID NO: 3693903 - DNA, 20 bp, Homo sapiens
taaacacttatcttctggat

SEQ ID NO: 3693904 - DNA, 21 bp, Homo sapiens
taaacacttatcttctggatt

SEQ ID NO: 3693905 - DNA, 15 bp, Homo sapiens
taaacctcagttatt

SEQ ID NO: 3693906 - DNA, 12 bp, Homo sapiens
taaactgtgttt

SEQ ID NO: 3693907 - DNA, 22 bp, Homo sapiens
taaacttggtttttaaaaaact

SEQ ID NO: 3693908 - DNA, 20 bp, Homo sapiens
taaagaaaaatatcttggcc

SEQ ID NO: 3693909 - DNA, 14 bp, Homo sapiens
taaagaaggtttca

SEQ ID NO: 3693910 - DNA, 12 bp, Homo sapiens
taaagagaagac

SEQ ID NO: 3693911 - DNA, 21 bp, Homo sapiens
taaagataacccttattccat

SEQ ID NO: 3693912 - DNA, 17 bp, Homo sapiens
taaaggcttaggcatgt

SEQ ID NO: 3693913 - DNA, 18 bp, Homo sapiens
taaaggggtctgaaattt

SEQ ID NO: 3693914 - DNA, 14 bp, Homo sapiens
taaagtgaattgtt

SEQ ID NO: 3693915 - DNA, 19 bp, Homo sapiens
taaatattatgctgcttta

SEQ ID NO: 3693916 - DNA, 22 bp, Homo sapiens
taaatcatgatgctagccagca

SEQ ID NO: 3693917 - DNA, 15 bp, Homo sapiens
taaatctgacccagt

SEQ ID NO: 3693918 - DNA, 16 bp, Homo sapiens
taaatctgacccagtg

SEQ ID NO: 3693919 - DNA, 22 bp, Homo sapiens
taaatgccctcttctcgtgcct

SEQ ID NO: 3693920 - DNA, 16 bp, Homo sapiens
taaatgcctcttaaat

SEQ ID NO: 3693921 - DNA, 21 bp, Homo sapiens
taaatgcctcttaaattatat

SEQ ID NO: 3693922 - DNA, 11 bp, Homo sapiens
taaatgctgct

SEQ ID NO: 3693923 - DNA, 12 bp, Homo sapiens
taaatggcctca

SEQ ID NO: 3693924 - DNA, 23 bp, Homo sapiens
taaatggcctcatgtggctggaa

SEQ ID NO: 3693925 - DNA, 18 bp, Homo sapiens
taaatgtacagacatatt

SEQ ID NO: 3693926 - DNA, 13 bp, Homo sapiens
taaatgtggtaaa

SEQ ID NO: 3693927 - DNA, 14 bp, Homo sapiens
taaattatatattt

SEQ ID NO: 3693928 - DNA, 21 bp, Homo sapiens
taaattccatatgctccagga

SEQ ID NO: 3693929 - DNA, 16 bp, Homo sapiens
taaattcctctttgct

SEQ ID NO: 3693930 - DNA, 17 bp, Homo sapiens
taaattcctctttgctt

SEQ ID NO: 3693931 - DNA, 19 bp, Homo sapiens
taaattcctctttgctttg

SEQ ID NO: 3693932 - DNA, 20 bp, Homo sapiens
taaattcctctttgctttgc

SEQ ID NO: 3693933 - DNA, 22 bp, Homo sapiens
taaatttaagcttaagccataa

SEQ ID NO: 3693934 - DNA, 15 bp, Homo sapiens
taaattttctgaaac

SEQ ID NO: 3693935 - DNA, 15 bp, Homo sapiens
taaattttgtaatga

SEQ ID NO: 3693936 - DNA, 14 bp, Homo sapiens
taacaaaggcagct

SEQ ID NO: 3693937 - DNA, 21 bp, Homo sapiens
taacaaatggagctttctgta

SEQ ID NO: 3693938 - DNA, 16 bp, Homo sapiens
taacaactatgatttg

SEQ ID NO: 3693939 - DNA, 17 bp, Homo sapiens
taacaataatatttcaa

SEQ ID NO: 3693940 - DNA, 17 bp, Homo sapiens
taacaattcagatccag

SEQ ID NO: 3693941 - DNA, 18 bp, Homo sapiens
taacaccatgattaacca

SEQ ID NO: 3693942 - DNA, 12 bp, Homo sapiens
taacagctgtgg

SEQ ID NO: 3693943 - DNA, 11 bp, Homo sapiens
taacagtggag

SEQ ID NO: 3693944 - DNA, 15 bp, Homo sapiens
taacatttaaattcc

SEQ ID NO: 3693945 - DNA, 15 bp, Homo sapiens
taacgcgtcttcctg

SEQ ID NO: 3693946 - DNA, 22 bp, Homo sapiens
taacgtgtatctttaagaaaaa

SEQ ID NO: 3693947 - DNA, 22 bp, Homo sapiens
gtgtgacaattctgtttttaat

SEQ ID NO: 3693948 - DNA, 21 bp, Homo sapiens
gtgtgagaagtgaatgctggg

SEQ ID NO: 3693949 - DNA, 23 bp, Homo sapiens
gtgtgcacatccgcgtgtgcctg

SEQ ID NO: 3693950 - DNA, 23 bp, Homo sapiens
gtgtgcactaaggggcccggcca

SEQ ID NO: 3693951 - DNA, 21 bp, Homo sapiens
gtgtggagaagcggctggcag

SEQ ID NO: 3693952 - DNA, 15 bp, Homo sapiens
gtgtggaggctcctg

SEQ ID NO: 3693953 - DNA, 16 bp, Homo sapiens
gtgtggaggctcctgt

SEQ ID NO: 3693954 - DNA, 17 bp, Homo sapiens
gtgtggaggctcctgtg

SEQ ID NO: 3693955 - DNA, 12 bp, Homo sapiens
gtgtggggaggg

SEQ ID NO: 3693956 - DNA, 16 bp, Homo sapiens
gtgtgggtacctgtat

SEQ ID NO: 3693957 - DNA, 18 bp, Homo sapiens
gtgtgtcccaggcaggga

SEQ ID NO: 3693958 - DNA, 15 bp, Homo sapiens
gtgtgtgtgtgtgca

SEQ ID NO: 3693959 - DNA, 14 bp, Homo sapiens
gtgttagtggcacc

SEQ ID NO: 3693960 - DNA, 15 bp, Homo sapiens
gtgttagtggcaccg

SEQ ID NO: 3693961 - DNA, 14 bp, Homo sapiens
gtgttatgtatttc

SEQ ID NO: 3693962 - DNA, 16 bp, Homo sapiens
gtgttattctttgcgt

SEQ ID NO: 3693963 - DNA, 23 bp, Homo sapiens
gtgttctgtttgttattgttttg

SEQ ID NO: 3693964 - DNA, 17 bp, Homo sapiens
gtgttgccaaatatgtc

SEQ ID NO: 3693965 - DNA, 15 bp, Homo sapiens
gtgttgtctcttgag

SEQ ID NO: 3693966 - DNA, 18 bp, Homo sapiens
gtgtttctgtaagaaacc

SEQ ID NO: 3693967 - DNA, 13 bp, Homo sapiens
gtgtttgctttct

SEQ ID NO: 3693968 - DNA, 18 bp, Homo sapiens
gttaaattccatatgctc

SEQ ID NO: 3693969 - DNA, 18 bp, Homo sapiens
gttaagacaacaggcatt

SEQ ID NO: 3693970 - DNA, 16 bp, Homo sapiens
gttaagttttcttgtt

SEQ ID NO: 3693971 - DNA, 20 bp, Homo sapiens
gttaagttttcttgtttctg

SEQ ID NO: 3693972 - DNA, 14 bp, Homo sapiens
gttaatttatttag

SEQ ID NO: 3693973 - DNA, 16 bp, Homo sapiens
gttaatttatttagtt

SEQ ID NO: 3693974 - DNA, 18 bp, Homo sapiens
gttaattttattcaagaa

SEQ ID NO: 3693975 - DNA, 18 bp, Homo sapiens
gttaattttttggtacaa

SEQ ID NO: 3693976 - DNA, 21 bp, Homo sapiens
gttaattttttggtacaaaaa

SEQ ID NO: 3693977 - DNA, 21 bp, Homo sapiens
gttacagcacaaaatgatggc

SEQ ID NO: 3693978 - DNA, 14 bp, Homo sapiens
gttactgggccctg

SEQ ID NO: 3693979 - DNA, 17 bp, Homo sapiens
gttactgggccctgagt

SEQ ID NO: 3693980 - DNA, 15 bp, Homo sapiens
gttagattttgcatt

SEQ ID NO: 3693981 - DNA, 14 bp, Homo sapiens
gttagctcctgtgg

SEQ ID NO: 3693982 - DNA, 17 bp, Homo sapiens
gttagttaatccctttg

SEQ ID NO: 3693983 - DNA, 10 bp, Homo sapiens
gttatatttc

SEQ ID NO: 3693984 - DNA, 23 bp, Homo sapiens
gttatgtatttcctggatgtttg

SEQ ID NO: 3693985 - DNA, 16 bp, Homo sapiens
gttcaacccacagcta

SEQ ID NO: 3693986 - DNA, 12 bp, Homo sapiens
gttcaagttttg

SEQ ID NO: 3693987 - DNA, 15 bp, Homo sapiens
gttcagcactgtccc

SEQ ID NO: 3693988 - DNA, 19 bp, Homo sapiens
gttcaggggactcagccct

SEQ ID NO: 3693989 - DNA, 14 bp, Homo sapiens
gttcatagcccagt

SEQ ID NO: 3693990 - DNA, 19 bp, Homo sapiens
gttcatatttatactttgc

SEQ ID NO: 3693991 - DNA, 14 bp, Homo sapiens
gttccagctctttg

SEQ ID NO: 3693992 - DNA, 13 bp, Homo sapiens
gttccccagagaa

SEQ ID NO: 3693993 - DNA, 14 bp, Homo sapiens
gttccccagagaaa

SEQ ID NO: 3693994 - DNA, 13 bp, Homo sapiens
gttcccttggcct

SEQ ID NO: 3693995 - DNA, 16 bp, Homo sapiens
gttcgagaccagcctg

SEQ ID NO: 3693996 - DNA, 16 bp, Homo sapiens
gttctatgcttcctcg

SEQ ID NO: 3693997 - DNA, 19 bp, Homo sapiens
gttctccgttagctcctgt

SEQ ID NO: 3693998 - DNA, 22 bp, Homo sapiens
gttctccgttagctcctgtggc

SEQ ID NO: 3693999 - DNA, 15 bp, Homo sapiens
gttctctcttctcca

SEQ ID NO: 3694000 - DNA, 14 bp, Homo sapiens
gttctgctcagagg

SEQ ID NO: 3694001 - DNA, 22 bp, Homo sapiens
gttctgctcagaggccttgctg

SEQ ID NO: 3694002 - DNA, 14 bp, Homo sapiens
gttctggggggacc

SEQ ID NO: 3694003 - DNA, 21 bp, Homo sapiens
gttctggggggacccagtgca

SEQ ID NO: 3694004 - DNA, 18 bp, Homo sapiens
gttctgtgacccatctgt

SEQ ID NO: 3694005 - DNA, 21 bp, Homo sapiens
gttctgtgacccatctgtagt

SEQ ID NO: 3694006 - DNA, 22 bp, Homo sapiens
gttcttattaccctgattgaat

SEQ ID NO: 3694007 - DNA, 11 bp, Homo sapiens
gttcttcctgc

SEQ ID NO: 3694008 - DNA, 17 bp, Homo sapiens
gttcttgagattttgta

SEQ ID NO: 3694009 - DNA, 16 bp, Homo sapiens
gttcttggtaactgat

SEQ ID NO: 3694010 - DNA, 16 bp, Homo sapiens
gttctttgggccagac

SEQ ID NO: 3694011 - DNA, 17 bp, Homo sapiens
gttctttgggccagaca

SEQ ID NO: 3694012 - DNA, 22 bp, Homo sapiens
gttgaagggaggtggcaagagt

SEQ ID NO: 3694013 - DNA, 14 bp, Homo sapiens
gttgacatatttaa

SEQ ID NO: 3694014 - DNA, 23 bp, Homo sapiens
gttgacatatttaatgttttaaa

SEQ ID NO: 3694015 - DNA, 23 bp, Homo sapiens
gttgattcggtatccccccatct

SEQ ID NO: 3694016 - DNA, 14 bp, Homo sapiens
gttgcagacaggaa

SEQ ID NO: 3694017 - DNA, 20 bp, Homo sapiens
gttgccaaatatgtcctggg

SEQ ID NO: 3694018 - DNA, 14 bp, Homo sapiens
gtcccttgcctcaa

SEQ ID NO: 3694019 - DNA, 14 bp, Homo sapiens
gtccgctttcctgg

SEQ ID NO: 3694020 - DNA, 16 bp, Homo sapiens
gtccgctttcctggag

SEQ ID NO: 3694021 - DNA, 21 bp, Homo sapiens
gtccgtgctgacagctgctcc

SEQ ID NO: 3694022 - DNA, 22 bp, Homo sapiens
gtccgtgctgacagctgctcct

SEQ ID NO: 3694023 - DNA, 23 bp, Homo sapiens
gtcctagaaattccccaccctga

SEQ ID NO: 3694024 - DNA, 12 bp, Homo sapiens
gtcctaggagta

SEQ ID NO: 3694025 - DNA, 19 bp, Homo sapiens
gtcctaggagtatcctcat

SEQ ID NO: 3694026 - DNA, 16 bp, Homo sapiens
gtcctcactcccagtc

SEQ ID NO: 3694027 - DNA, 20 bp, Homo sapiens
gtcctcagccttgccagaga

SEQ ID NO: 3694028 - DNA, 14 bp, Homo sapiens
gtcctcccaagctg

SEQ ID NO: 3694029 - DNA, 18 bp, Homo sapiens
gtcctcccaagctgtgct

SEQ ID NO: 3694030 - DNA, 21 bp, Homo sapiens
gtcctcccaatttcagactcc

SEQ ID NO: 3694031 - DNA, 18 bp, Homo sapiens
gtcctctccctgccaagt

SEQ ID NO: 3694032 - DNA, 15 bp, Homo sapiens
gtcctgacctgtctc

SEQ ID NO: 3694033 - DNA, 14 bp, Homo sapiens
gtcctgcctggcca

SEQ ID NO: 3694034 - DNA, 20 bp, Homo sapiens
gtcctgcctggccaggcaga

SEQ ID NO: 3694035 - DNA, 14 bp, Homo sapiens
gtcctgctttctcc

SEQ ID NO: 3694036 - DNA, 15 bp, Homo sapiens
gtcctggccatccca

SEQ ID NO: 3694037 - DNA, 11 bp, Homo sapiens
gtcctggctcc

SEQ ID NO: 3694038 - DNA, 14 bp, Homo sapiens
gtcctggctcctga

SEQ ID NO: 3694039 - DNA, 15 bp, Homo sapiens
gtcctgggagaggac

SEQ ID NO: 3694040 - DNA, 19 bp, Homo sapiens
gtcctgggagaggacaggg

SEQ ID NO: 3694041 - DNA, 22 bp, Homo sapiens
gtcctgggagaggacagggact

SEQ ID NO: 3694042 - DNA, 24 bp, Homo sapiens
gtcctgggagaggacagggacttc

SEQ ID NO: 3694043 - DNA, 14 bp, Homo sapiens
gtcctgggcctgca

SEQ ID NO: 3694044 - DNA, 17 bp, Homo sapiens
gtcctgggcctgcagaa

SEQ ID NO: 3694045 - DNA, 14 bp, Homo sapiens
gtcctggttgtctg

SEQ ID NO: 3694046 - DNA, 22 bp, Homo sapiens
gtcctggttgtctgaacccagg

SEQ ID NO: 3694047 - DNA, 23 bp, Homo sapiens
gtcctggttgtctgaacccaggc

SEQ ID NO: 3694048 - DNA, 22 bp, Homo sapiens
gtcctttctagagcactgccac

SEQ ID NO: 3694049 - DNA, 13 bp, Homo sapiens
gtcgagctgggaa

SEQ ID NO: 3694050 - DNA, 14 bp, Homo sapiens
gtcgggcaccagcc

SEQ ID NO: 3694051 - DNA, 12 bp, Homo sapiens
gtcgtgcctgtg

SEQ ID NO: 3694052 - DNA, 14 bp, Homo sapiens
gtcgtgcctgtgtc

SEQ ID NO: 3694053 - DNA, 18 bp, Homo sapiens
gtcgtgcctgtgtccatg

SEQ ID NO: 3694054 - DNA, 21 bp, Homo sapiens
gtcgtggggtgtgctgggagc

SEQ ID NO: 3694055 - DNA, 17 bp, Homo sapiens
gtctacatttctgcaga

SEQ ID NO: 3694056 - DNA, 15 bp, Homo sapiens
gtctacttgctcagg

SEQ ID NO: 3694057 - DNA, 21 bp, Homo sapiens
gtctagagagggaggcaagcc

SEQ ID NO: 3694058 - DNA, 19 bp, Homo sapiens
gtctcaaaaaaagaaaaag

SEQ ID NO: 3694059 - DNA, 14 bp, Homo sapiens
gtctcagaagaggt

SEQ ID NO: 3694060 - DNA, 19 bp, Homo sapiens
gtctcagttctcttgcttt

SEQ ID NO: 3694061 - DNA, 13 bp, Homo sapiens
gtctcatccccag

SEQ ID NO: 3694062 - DNA, 19 bp, Homo sapiens
gtctccagagagaaatcag

SEQ ID NO: 3694063 - DNA, 21 bp, Homo sapiens
gtctccaggggctgcttcctc

SEQ ID NO: 3694064 - DNA, 20 bp, Homo sapiens
gtctcccaggtgcatttctt

SEQ ID NO: 3694065 - DNA, 19 bp, Homo sapiens
gtctccccacctgcactcc

SEQ ID NO: 3694066 - DNA, 20 bp, Homo sapiens
gtctcctgactggtgctgca

SEQ ID NO: 3694067 - DNA, 18 bp, Homo sapiens
gtctctagagcagggatt

SEQ ID NO: 3694068 - DNA, 16 bp, Homo sapiens
gtctctgctctgctca

SEQ ID NO: 3694069 - DNA, 15 bp, Homo sapiens
gtctgaacagctgta

SEQ ID NO: 3694070 - DNA, 16 bp, Homo sapiens
gtctgaacccaggcag

SEQ ID NO: 3694071 - DNA, 17 bp, Homo sapiens
gtctgaacccaggcagc

SEQ ID NO: 3694072 - DNA, 16 bp, Homo sapiens
gtctgaccccagccca

SEQ ID NO: 3694073 - DNA, 18 bp, Homo sapiens
gtctgaccccagcccaga

SEQ ID NO: 3694074 - DNA, 16 bp, Homo sapiens
gtctgagcccaaccct

SEQ ID NO: 3694075 - DNA, 21 bp, Homo sapiens
gtctgcatttcggtggctagt

SEQ ID NO: 3694076 - DNA, 16 bp, Homo sapiens
gtctgctatcattatt

SEQ ID NO: 3694077 - DNA, 15 bp, Homo sapiens
gtctgctctttctct

SEQ ID NO: 3694078 - DNA, 20 bp, Homo sapiens
gtctgctctttctctgccag

SEQ ID NO: 3694079 - DNA, 16 bp, Homo sapiens
gtctggagaaggtatt

SEQ ID NO: 3694080 - DNA, 13 bp, Homo sapiens
gtctggtggcccc

SEQ ID NO: 3694081 - DNA, 23 bp, Homo sapiens
gtctgtatttatgtgtgaggagc

SEQ ID NO: 3694082 - DNA, 16 bp, Homo sapiens
gtctgtcaatcacagt

SEQ ID NO: 3694083 - DNA, 11 bp, Homo sapiens
gtctgtgccat

SEQ ID NO: 3694084 - DNA, 15 bp, Homo sapiens
gtctgtgccatttct

SEQ ID NO: 3694085 - DNA, 16 bp, Homo sapiens
gtctgtgccatttctc

SEQ ID NO: 3694086 - DNA, 20 bp, Homo sapiens
gtctgtgccatttctcaggg

SEQ ID NO: 3694087 - DNA, 23 bp, Homo sapiens
gtctgtgccatttctcagggaag

SEQ ID NO: 3694088 - DNA, 13 bp, Homo sapiens
gtctgtggatcag

SEQ ID NO: 3694089 - DNA, 12 bp, Homo sapiens
gtctgtttactg

SEQ ID NO: 3694090 - DNA, 12 bp, Homo sapiens
gtcttgaatttc

SEQ ID NO: 3694091 - DNA, 14 bp, Homo sapiens
gtcttgctctgtct

SEQ ID NO: 3694092 - DNA, 19 bp, Homo sapiens
gtcttgctggaagacagag

SEQ ID NO: 3694093 - DNA, 21 bp, Homo sapiens
gtcttgctggaagacagagaa

SEQ ID NO: 3694094 - DNA, 17 bp, Homo sapiens
gtcttggaagtctgtct

SEQ ID NO: 3694095 - DNA, 21 bp, Homo sapiens
gtcttgggcagagctggctct

SEQ ID NO: 3694096 - DNA, 15 bp, Homo sapiens
gtctttaaaagagag

SEQ ID NO: 3694097 - DNA, 15 bp, Homo sapiens
gtctttaaatgctgc

SEQ ID NO: 3694098 - DNA, 14 bp, Homo sapiens
gtctttatttgtat

SEQ ID NO: 3694099 - DNA, 11 bp, Homo sapiens
gtctttcagta

SEQ ID NO: 3694100 - DNA, 22 bp, Homo sapiens
gtggctgtcaatgggacctgtg

SEQ ID NO: 3694101 - DNA, 17 bp, Homo sapiens
gtggctttgcatttctt

SEQ ID NO: 3694102 - DNA, 21 bp, Homo sapiens
gtggctttgcatttcttgtgt

SEQ ID NO: 3694103 - DNA, 17 bp, Homo sapiens
gtgggaactcactttcc

SEQ ID NO: 3694104 - DNA, 14 bp, Homo sapiens
gtgggacagggctt

SEQ ID NO: 3694105 - DNA, 17 bp, Homo sapiens
gtgggacagggcttctc

SEQ ID NO: 3694106 - DNA, 20 bp, Homo sapiens
gtgggacagggcttctcctg

SEQ ID NO: 3694107 - DNA, 20 bp, Homo sapiens
gtgggactcttccctgggaa

SEQ ID NO: 3694108 - DNA, 23 bp, Homo sapiens
gtgggaggatctcttgagcctgg

SEQ ID NO: 3694109 - DNA, 23 bp, Homo sapiens
gtgggatgttcagcactgtccct

SEQ ID NO: 3694110 - DNA, 16 bp, Homo sapiens
gtgggccagtcctggt

SEQ ID NO: 3694111 - DNA, 19 bp, Homo sapiens
gtgggccagtcctggttgt

SEQ ID NO: 3694112 - DNA, 16 bp, Homo sapiens
gtgggccagtctgtgg

SEQ ID NO: 3694113 - DNA, 22 bp, Homo sapiens
gtgggccctaccctcctgctga

SEQ ID NO: 3694114 - DNA, 19 bp, Homo sapiens
gtgggctacatgctggggt

SEQ ID NO: 3694115 - DNA, 14 bp, Homo sapiens
gtggggcagggagc

SEQ ID NO: 3694116 - DNA, 17 bp, Homo sapiens
gtggggccgccgcctct

SEQ ID NO: 3694117 - DNA, 13 bp, Homo sapiens
gtgggggagcctc

SEQ ID NO: 3694118 - DNA, 15 bp, Homo sapiens
gtggggttctaggca

SEQ ID NO: 3694119 - DNA, 14 bp, Homo sapiens
gtgggtcaaggaat

SEQ ID NO: 3694120 - DNA, 16 bp, Homo sapiens
gtgggtccctctgccc

SEQ ID NO: 3694121 - DNA, 14 bp, Homo sapiens
gtgggtggggcttc

SEQ ID NO: 3694122 - DNA, 12 bp, Homo sapiens
gtggtaaccctg

SEQ ID NO: 3694123 - DNA, 24 bp, Homo sapiens
gtggtagtcctcccaagctgtgct

SEQ ID NO: 3694124 - DNA, 20 bp, Homo sapiens
gtggtctcttcttggggccc

SEQ ID NO: 3694125 - DNA, 23 bp, Homo sapiens
gtggtctcttcttggggcccagt

SEQ ID NO: 3694126 - DNA, 20 bp, Homo sapiens
gtggtctgttggcaggctgg

SEQ ID NO: 3694127 - DNA, 19 bp, Homo sapiens
gtggtggtaaccctggtgg

SEQ ID NO: 3694128 - DNA, 23 bp, Homo sapiens
gtggttaatgccatggacagaag

SEQ ID NO: 3694129 - DNA, 18 bp, Homo sapiens
gtggttatggagagggtg

SEQ ID NO: 3694130 - DNA, 15 bp, Homo sapiens
gtgtaaaaaaaccac

SEQ ID NO: 3694131 - DNA, 19 bp, Homo sapiens
gtgtcacccaaaccggcag

SEQ ID NO: 3694132 - DNA, 21 bp, Homo sapiens
gtgtcactcaaggcggtgctt

SEQ ID NO: 3694133 - DNA, 20 bp, Homo sapiens
gtgtccatgcgctcagggcc

SEQ ID NO: 3694134 - DNA, 23 bp, Homo sapiens
gtgtcccctcacgcaagtgccag

SEQ ID NO: 3694135 - DNA, 17 bp, Homo sapiens
gtgtcctctccctgcca

SEQ ID NO: 3694136 - DNA, 19 bp, Homo sapiens
gtgtcctctccctgccaag

SEQ ID NO: 3694137 - DNA, 22 bp, Homo sapiens
gtgtctccccgtgtcctctccc

SEQ ID NO: 3694138 - DNA, 14 bp, Homo sapiens
gtgtctgagcccaa

SEQ ID NO: 3694139 - DNA, 13 bp, Homo sapiens
gtgtctgtattta

SEQ ID NO: 3694140 - DNA, 14 bp, Homo sapiens
gtgtctgtatttat

SEQ ID NO: 3694141 - DNA, 23 bp, Homo sapiens
gtgtcttgggcagagctggctct

SEQ ID NO: 3694142 - DNA, 24 bp, Homo sapiens
tcacagggttgggcccagatctgg

SEQ ID NO: 3694143 - DNA, 18 bp, Homo sapiens
tcacagtctcagttctct

SEQ ID NO: 3694144 - DNA, 19 bp, Homo sapiens
tcacagtctcagttctctt

SEQ ID NO: 3694145 - DNA, 20 bp, Homo sapiens
tcacagttctttgggccaga

SEQ ID NO: 3694146 - DNA, 19 bp, Homo sapiens
tcacatgtgccctctgcca

SEQ ID NO: 3694147 - DNA, 22 bp, Homo sapiens
tcacattagaagacaattgaca

SEQ ID NO: 3694148 - DNA, 21 bp, Homo sapiens
tcacccatgcaagcagaggac

SEQ ID NO: 3694149 - DNA, 13 bp, Homo sapiens
tcaccctgcctta

SEQ ID NO: 3694150 - DNA, 15 bp, Homo sapiens
tcaccctgccttatc

SEQ ID NO: 3694151 - DNA, 15 bp, Homo sapiens
tcaccctttgctgtg

SEQ ID NO: 3694152 - DNA, 12 bp, Homo sapiens
tcacctcctgct

SEQ ID NO: 3694153 - DNA, 14 bp, Homo sapiens
tcacctcctgctgg

SEQ ID NO: 3694154 - DNA, 19 bp, Homo sapiens
tcacctggggtgtgggagg

SEQ ID NO: 3694155 - DNA, 19 bp, Homo sapiens
tcaccttggcaccagacac

SEQ ID NO: 3694156 - DNA, 20 bp, Homo sapiens
tcacgcaagtgccagggctg

SEQ ID NO: 3694157 - DNA, 20 bp, Homo sapiens
tcacgcctgtaatcctagca

SEQ ID NO: 3694158 - DNA, 17 bp, Homo sapiens
tcacggaagagccttgc

SEQ ID NO: 3694159 - DNA, 18 bp, Homo sapiens
tcacggggcccttacctg

SEQ ID NO: 3694160 - DNA, 15 bp, Homo sapiens
tcactaatttttgta

SEQ ID NO: 3694161 - DNA, 18 bp, Homo sapiens
tcactacaagtcagctcc

SEQ ID NO: 3694162 - DNA, 19 bp, Homo sapiens
tcactaggcccccacttgc

SEQ ID NO: 3694163 - DNA, 22 bp, Homo sapiens
tcactaggcccccacttgcctc

SEQ ID NO: 3694164 - DNA, 23 bp, Homo sapiens
tcactaggcccccacttgcctct

SEQ ID NO: 3694165 - DNA, 17 bp, Homo sapiens
tcactctgagtgtttta

SEQ ID NO: 3694166 - DNA, 17 bp, Homo sapiens
tcactgagttttccatg

SEQ ID NO: 3694167 - DNA, 18 bp, Homo sapiens
tcactgccatgccagctt

SEQ ID NO: 3694168 - DNA, 23 bp, Homo sapiens
tcacttaagttgagatttttgct

SEQ ID NO: 3694169 - DNA, 19 bp, Homo sapiens
tcacttagaacctttctgt

SEQ ID NO: 3694170 - DNA, 20 bp, Homo sapiens
tcacttagaacctttctgtg

SEQ ID NO: 3694171 - DNA, 13 bp, Homo sapiens
tcacttttctgta

SEQ ID NO: 3694172 - DNA, 15 bp, Homo sapiens
tcagaacctcttccc

SEQ ID NO: 3694173 - DNA, 18 bp, Homo sapiens
tcagaacctcttccccag

SEQ ID NO: 3694174 - DNA, 12 bp, Homo sapiens
tcagaaccttgt

SEQ ID NO: 3694175 - DNA, 20 bp, Homo sapiens
tcagaaccttgtcccagcca

SEQ ID NO: 3694176 - DNA, 14 bp, Homo sapiens
tcagacttgtcaag

SEQ ID NO: 3694177 - DNA, 13 bp, Homo sapiens
tcagaggccttgc

SEQ ID NO: 3694178 - DNA, 15 bp, Homo sapiens
tcagaggccttgctg

SEQ ID NO: 3694179 - DNA, 23 bp, Homo sapiens
tcagagtgacacccaagagggct

SEQ ID NO: 3694180 - DNA, 12 bp, Homo sapiens
tcagagtgccac

SEQ ID NO: 3694181 - DNA, 16 bp, Homo sapiens
tcagatccagggacag

SEQ ID NO: 3694182 - DNA, 20 bp, Homo sapiens
tcagatggaaccgcaggaag

SEQ ID NO: 3694183 - DNA, 22 bp, Homo sapiens
tcagatggaaccgcaggaagct

SEQ ID NO: 3694184 - DNA, 15 bp, Homo sapiens
tcagcaaaagatgct

SEQ ID NO: 3694185 - DNA, 22 bp, Homo sapiens
tcagcaaaccatttttaaagta

SEQ ID NO: 3694186 - DNA, 13 bp, Homo sapiens
tcagcaccaccct

SEQ ID NO: 3694187 - DNA, 23 bp, Homo sapiens
tcagcaccaccctagtcccttcc

SEQ ID NO: 3694188 - DNA, 12 bp, Homo sapiens
tcagcactgtcc

SEQ ID NO: 3694189 - DNA, 15 bp, Homo sapiens
tcagcattattgaaa

SEQ ID NO: 3694190 - DNA, 13 bp, Homo sapiens
tcagccaggagct

SEQ ID NO: 3694191 - DNA, 15 bp, Homo sapiens
tcagcccaagattct

SEQ ID NO: 3694192 - DNA, 16 bp, Homo sapiens
tcagcccaagattctt

SEQ ID NO: 3694193 - DNA, 17 bp, Homo sapiens
tcagcccaagattcttc

SEQ ID NO: 3694194 - DNA, 18 bp, Homo sapiens
tcagcccaagattcttca

SEQ ID NO: 3694195 - DNA, 23 bp, Homo sapiens
tcagccctgaggtgaaagggagc

SEQ ID NO: 3694196 - DNA, 18 bp, Homo sapiens
tcagcctgctccagctgt

SEQ ID NO: 3694197 - DNA, 12 bp, Homo sapiens
tcagcctggcca

SEQ ID NO: 3694198 - DNA, 14 bp, Homo sapiens
tcagcctggccaga

SEQ ID NO: 3694199 - DNA, 15 bp, Homo sapiens
tcagcctggccagac

SEQ ID NO: 3694200 - DNA, 16 bp, Homo sapiens
tcagcctggccagaca

SEQ ID NO: 3694201 - DNA, 15 bp, Homo sapiens
tcagccttgccagag

SEQ ID NO: 3694202 - DNA, 17 bp, Homo sapiens
tcagccttgccagagat

SEQ ID NO: 3694203 - DNA, 19 bp, Homo sapiens
tcagcgactccgttggcca

SEQ ID NO: 3694204 - DNA, 13 bp, Homo sapiens
tcagctccagctg

SEQ ID NO: 3694205 - DNA, 23 bp, Homo sapiens
tcagctctgcaagaattgaagca

SEQ ID NO: 3694206 - DNA, 15 bp, Homo sapiens
tcagctgaacctggg

SEQ ID NO: 3694207 - DNA, 16 bp, Homo sapiens
tcagctgaacctgggt

SEQ ID NO: 3694208 - DNA, 14 bp, Homo sapiens
tcagctgcctcact

SEQ ID NO: 3694209 - DNA, 18 bp, Homo sapiens
tcagcttaggggctgctg

SEQ ID NO: 3694210 - DNA, 18 bp, Homo sapiens
tcaggaacagctatggga

SEQ ID NO: 3694211 - DNA, 12 bp, Homo sapiens
tcaggacactaa

SEQ ID NO: 3694212 - DNA, 13 bp, Homo sapiens
tcaggacactaat

SEQ ID NO: 3694213 - DNA, 16 bp, Homo sapiens
tcaggactctgaaaag

SEQ ID NO: 3694214 - DNA, 19 bp, Homo sapiens
tcaggactctgaaaaggaa

SEQ ID NO: 3694215 - DNA, 22 bp, Homo sapiens
tcaggagcaccctgtcttctta

SEQ ID NO: 3694216 - DNA, 13 bp, Homo sapiens
tcaggcaggaagg

SEQ ID NO: 3694217 - DNA, 20 bp, Homo sapiens
tcaggcctgatgagggggaa

SEQ ID NO: 3694218 - DNA, 16 bp, Homo sapiens
tcaggctgaaaacaat

SEQ ID NO: 3694219 - DNA, 13 bp, Homo sapiens
tcagggccatgct

SEQ ID NO: 3694220 - DNA, 18 bp, Homo sapiens
tcagggccatgctgaggc

SEQ ID NO: 3694221 - DNA, 15 bp, Homo sapiens
tcagggtcatagcat

SEQ ID NO: 3694222 - DNA, 23 bp, Homo sapiens
tcagggtggtctcttcttggggc

SEQ ID NO: 3694223 - DNA, 21 bp, Homo sapiens
tcagggtgtgggatctgagga

SEQ ID NO: 3694224 - DNA, 16 bp, Homo sapiens
tcaggtactcctgcca

SEQ ID NO: 3694225 - DNA, 15 bp, Homo sapiens
tcaggtgagaagcag

SEQ ID NO: 3694226 - DNA, 13 bp, Homo sapiens
tcaggtgcccctc

SEQ ID NO: 3694227 - DNA, 15 bp, Homo sapiens
tcagtaactgtcagg

SEQ ID NO: 3694228 - DNA, 14 bp, Homo sapiens
tcagtactttttta

SEQ ID NO: 3694229 - DNA, 17 bp, Homo sapiens
tcagtgcagcagaggac

SEQ ID NO: 3694230 - DNA, 13 bp, Homo sapiens
tcagtgctgtgct

SEQ ID NO: 3694231 - DNA, 16 bp, Homo sapiens
tcagtgctgtgctgtg

SEQ ID NO: 3694232 - DNA, 18 bp, Homo sapiens
tcagttcccttggcctca

SEQ ID NO: 3694233 - DNA, 20 bp, Homo sapiens
tcagttcccttggcctcaga

SEQ ID NO: 3694234 - DNA, 19 bp, Homo sapiens
tcagtttgctagcagaaat

SEQ ID NO: 3694235 - DNA, 18 bp, Homo sapiens
tcatagactcctttgcta

SEQ ID NO: 3694236 - DNA, 15 bp, Homo sapiens
tcatatactgccatg

SEQ ID NO: 3694237 - DNA, 20 bp, Homo sapiens
tcatatggaaaaaatgtatg

SEQ ID NO: 3694238 - DNA, 17 bp, Homo sapiens
tcatccccacaatctgg

SEQ ID NO: 3694239 - DNA, 21 bp, Homo sapiens
tcatccccacaatctggctta

SEQ ID NO: 3694240 - DNA, 15 bp, Homo sapiens
tcatccgcctggccc

SEQ ID NO: 3694241 - DNA, 18 bp, Homo sapiens
tcatctagcgcaattgaa

SEQ ID NO: 3694242 - DNA, 16 bp, Homo sapiens
tcatctctctgcccaa

SEQ ID NO: 3694243 - DNA, 23 bp, Homo sapiens
tcatctgaaggggcaaattcttt

SEQ ID NO: 3694244 - DNA, 21 bp, Homo sapiens
tcatctgattggacaggcatg

SEQ ID NO: 3694245 - DNA, 19 bp, Homo sapiens
tcatctgctggtccgtggg

SEQ ID NO: 3694246 - DNA, 16 bp, Homo sapiens
tcatcttgaccaagca

SEQ ID NO: 3694247 - DNA, 19 bp, Homo sapiens
tcatcttgaccaagcagga

SEQ ID NO: 3694248 - DNA, 21 bp, Homo sapiens
tcatgaatcactgcacctctt

SEQ ID NO: 3694249 - DNA, 13 bp, Homo sapiens
tcatgcagtgctc

SEQ ID NO: 3694250 - DNA, 13 bp, Homo sapiens
tcatgccctcctc

SEQ ID NO: 3694251 - DNA, 14 bp, Homo sapiens
tcatgccctcctct

SEQ ID NO: 3694252 - DNA, 15 bp, Homo sapiens
tcatgcccttctgat

SEQ ID NO: 3694253 - DNA, 20 bp, Homo sapiens
tcatgctggaacctgcaaaa

SEQ ID NO: 3694254 - DNA, 23 bp, Homo sapiens
tcatggatgggggaactcagatc

SEQ ID NO: 3694255 - DNA, 15 bp, Homo sapiens
tcatgtgaaatgttt

SEQ ID NO: 3694256 - DNA, 12 bp, Homo sapiens
tcattactataa

SEQ ID NO: 3694257 - DNA, 12 bp, Homo sapiens
tcattattatta

SEQ ID NO: 3694258 - DNA, 19 bp, Homo sapiens
tcattcagcagcaaatttt

SEQ ID NO: 3694259 - DNA, 23 bp, Homo sapiens
tcattcagcagcaaattttcagc

SEQ ID NO: 3694260 - DNA, 15 bp, Homo sapiens
tcattcgggatgatt

SEQ ID NO: 3694261 - DNA, 20 bp, Homo sapiens
tatctgtttcctgacattgt

SEQ ID NO: 3694262 - DNA, 14 bp, Homo sapiens
tatcttctggatta

SEQ ID NO: 3694263 - DNA, 18 bp, Homo sapiens
tatgaccttctaggaagc

SEQ ID NO: 3694264 - DNA, 18 bp, Homo sapiens
tatgatgtgggtcaagga

SEQ ID NO: 3694265 - DNA, 16 bp, Homo sapiens
tatgcaaaaaattctt

SEQ ID NO: 3694266 - DNA, 20 bp, Homo sapiens
tatgcatggtgccccaggac

SEQ ID NO: 3694267 - DNA, 15 bp, Homo sapiens
tatgctgtcatggtc

SEQ ID NO: 3694268 - DNA, 17 bp, Homo sapiens
tatgcttaataaaagaa

SEQ ID NO: 3694269 - DNA, 20 bp, Homo sapiens
tatgcttaataaaagaacat

SEQ ID NO: 3694270 - DNA, 16 bp, Homo sapiens
tatgcttgcaaaaact

SEQ ID NO: 3694271 - DNA, 19 bp, Homo sapiens
tatggaagggtttgtggct

SEQ ID NO: 3694272 - DNA, 13 bp, Homo sapiens
tatggactatctg

SEQ ID NO: 3694273 - DNA, 18 bp, Homo sapiens
tatggactatctgtctgg

SEQ ID NO: 3694274 - DNA, 16 bp, Homo sapiens
tatggcagtgtctttc

SEQ ID NO: 3694275 - DNA, 19 bp, Homo sapiens
tatggcctcagctgcctca

SEQ ID NO: 3694276 - DNA, 15 bp, Homo sapiens
tatgggagccccagg

SEQ ID NO: 3694277 - DNA, 18 bp, Homo sapiens
tatggtggatgaggcttc

SEQ ID NO: 3694278 - DNA, 23 bp, Homo sapiens
tatgtaggagctgcagttcttgt

SEQ ID NO: 3694279 - DNA, 17 bp, Homo sapiens
tatgtattgggcagcag

SEQ ID NO: 3694280 - DNA, 11 bp, Homo sapiens
tatgtatttcc

SEQ ID NO: 3694281 - DNA, 17 bp, Homo sapiens
tatgtgaaaggaacatt

SEQ ID NO: 3694282 - DNA, 20 bp, Homo sapiens
tatgtgaaaggaacattttt

SEQ ID NO: 3694283 - DNA, 16 bp, Homo sapiens
tatgtgtgaggagctg

SEQ ID NO: 3694284 - DNA, 21 bp, Homo sapiens
tatgtgtgaggagctgctggc

SEQ ID NO: 3694285 - DNA, 20 bp, Homo sapiens
tatgtttccatggttaccat

SEQ ID NO: 3694286 - DNA, 18 bp, Homo sapiens
tatgtttttgtgtatttg

SEQ ID NO: 3694287 - DNA, 21 bp, Homo sapiens
tattaagaactgctgtttcac

SEQ ID NO: 3694288 - DNA, 17 bp, Homo sapiens
tattaatttatgcagaa

SEQ ID NO: 3694289 - DNA, 17 bp, Homo sapiens
tattagtattgtgaata

SEQ ID NO: 3694290 - DNA, 14 bp, Homo sapiens
tattatatttgaca

SEQ ID NO: 3694291 - DNA, 16 bp, Homo sapiens
tattcaatcaaaattt

SEQ ID NO: 3694292 - DNA, 15 bp, Homo sapiens
tattctaaaaccatt

SEQ ID NO: 3694293 - DNA, 21 bp, Homo sapiens
tattgacaaccgagaaggttt

SEQ ID NO: 3694294 - DNA, 14 bp, Homo sapiens
tattgcgctgctac

SEQ ID NO: 3694295 - DNA, 15 bp, Homo sapiens
tattgtctgtctaca

SEQ ID NO: 3694296 - DNA, 12 bp, Homo sapiens
tatttaaaaatg

SEQ ID NO: 3694297 - DNA, 13 bp, Homo sapiens
tatttaaaaatgt

SEQ ID NO: 3694298 - DNA, 16 bp, Homo sapiens
tatttaaaaatgtctt

SEQ ID NO: 3694299 - DNA, 18 bp, Homo sapiens
tatttaaaaatgtcttgc

SEQ ID NO: 3694300 - DNA, 18 bp, Homo sapiens
tatttaaattacaatttt

SEQ ID NO: 3694301 - DNA, 15 bp, Homo sapiens
tatttaatctccatt

SEQ ID NO: 3694302 - DNA, 18 bp, Homo sapiens
tatttaatgttttaaatg

SEQ ID NO: 3694303 - DNA, 21 bp, Homo sapiens
tatttaatgttttaaatgtac

SEQ ID NO: 3694304 - DNA, 22 bp, Homo sapiens
tatttatgggcccctggcactc

SEQ ID NO: 3694305 - DNA, 13 bp, Homo sapiens
tatttatttaatt

SEQ ID NO: 3694306 - DNA, 11 bp, Homo sapiens
tatttcaagtg

SEQ ID NO: 3694307 - DNA, 12 bp, Homo sapiens
tatttcaagtgc

SEQ ID NO: 3694308 - DNA, 13 bp, Homo sapiens
tatttcagatgta

SEQ ID NO: 3694309 - DNA, 16 bp, Homo sapiens
tatttcagatgtaatg

SEQ ID NO: 3694310 - DNA, 18 bp, Homo sapiens
tatttccaaacctggttc

SEQ ID NO: 3694311 - DNA, 18 bp, Homo sapiens
tatttcctggatgtttgg

SEQ ID NO: 3694312 - DNA, 19 bp, Homo sapiens
tatttcttcgttcttttta

SEQ ID NO: 3694313 - DNA, 23 bp, Homo sapiens
tagaccatgtcttatcttgtttc

SEQ ID NO: 3694314 - DNA, 18 bp, Homo sapiens
tagaccccatacaagttt

SEQ ID NO: 3694315 - DNA, 22 bp, Homo sapiens
tagactattccttttctgtata

SEQ ID NO: 3694316 - DNA, 22 bp, Homo sapiens
tagactgccatcattgatgatc

SEQ ID NO: 3694317 - DNA, 18 bp, Homo sapiens
tagagactggaacactag

SEQ ID NO: 3694318 - DNA, 17 bp, Homo sapiens
tagagatgctaaaattc

SEQ ID NO: 3694319 - DNA, 16 bp, Homo sapiens
tagagcactgccacca

SEQ ID NO: 3694320 - DNA, 23 bp, Homo sapiens
tagagggacggccaagaatgtac

SEQ ID NO: 3694321 - DNA, 13 bp, Homo sapiens
tagagggaggggc

SEQ ID NO: 3694322 - DNA, 13 bp, Homo sapiens
tagagtcctcact

SEQ ID NO: 3694323 - DNA, 17 bp, Homo sapiens
tagagtctgaacagctg

SEQ ID NO: 3694324 - DNA, 17 bp, Homo sapiens
tagagtgtagactgtgg

SEQ ID NO: 3694325 - DNA, 16 bp, Homo sapiens
tagatcacgagatcaa

SEQ ID NO: 3694326 - DNA, 16 bp, Homo sapiens
tagatgctggcccagg

SEQ ID NO: 3694327 - DNA, 18 bp, Homo sapiens
tagatgctggcccagggc

SEQ ID NO: 3694328 - DNA, 22 bp, Homo sapiens
tagatgctggcccagggcccag

SEQ ID NO: 3694329 - DNA, 14 bp, Homo sapiens
tagatggctcctct

SEQ ID NO: 3694330 - DNA, 13 bp, Homo sapiens
tagatgtttcaca

SEQ ID NO: 3694331 - DNA, 18 bp, Homo sapiens
tagattaggtcttgctgg

SEQ ID NO: 3694332 - DNA, 15 bp, Homo sapiens
tagcacttgtctcag

SEQ ID NO: 3694333 - DNA, 21 bp, Homo sapiens
tagcagcccaccctgctgctg

SEQ ID NO: 3694334 - DNA, 16 bp, Homo sapiens
tagcattttgctaaat

SEQ ID NO: 3694335 - DNA, 22 bp, Homo sapiens
tagcattttgctaaatgtgaat

SEQ ID NO: 3694336 - DNA, 17 bp, Homo sapiens
tagccacaccaggatag

SEQ ID NO: 3694337 - DNA, 18 bp, Homo sapiens
tagcctgaggtcccctcg

SEQ ID NO: 3694338 - DNA, 14 bp, Homo sapiens
tagcctggactgct

SEQ ID NO: 3694339 - DNA, 13 bp, Homo sapiens
tagcgctgttttt

SEQ ID NO: 3694340 - DNA, 13 bp, Homo sapiens
tagctagaggaac

SEQ ID NO: 3694341 - DNA, 15 bp, Homo sapiens
tagctagaggaacca

SEQ ID NO: 3694342 - DNA, 13 bp, Homo sapiens
tagctcctgtggc

SEQ ID NO: 3694343 - DNA, 22 bp, Homo sapiens
tagctcctgtggccccaccctg

SEQ ID NO: 3694344 - DNA, 20 bp, Homo sapiens
tagctgggggtgggccaggc

SEQ ID NO: 3694345 - DNA, 15 bp, Homo sapiens
tagcttggaaactgg

SEQ ID NO: 3694346 - DNA, 20 bp, Homo sapiens
taggaaaacctcaagcagta

SEQ ID NO: 3694347 - DNA, 12 bp, Homo sapiens
taggaagagagg

SEQ ID NO: 3694348 - DNA, 16 bp, Homo sapiens
taggaagagaggtcca

SEQ ID NO: 3694349 - DNA, 22 bp, Homo sapiens
taggaagcccctgagtcctgag

SEQ ID NO: 3694350 - DNA, 17 bp, Homo sapiens
taggaccaagcatcttg

SEQ ID NO: 3694351 - DNA, 13 bp, Homo sapiens
taggacccttccc

SEQ ID NO: 3694352 - DNA, 12 bp, Homo sapiens
taggagaagcca

SEQ ID NO: 3694353 - DNA, 15 bp, Homo sapiens
taggagaagccagga

SEQ ID NO: 3694354 - DNA, 19 bp, Homo sapiens
taggatagctaactgtaaa

SEQ ID NO: 3694355 - DNA, 22 bp, Homo sapiens
taggatggggcacggctctggg

SEQ ID NO: 3694356 - DNA, 20 bp, Homo sapiens
taggcaaatgtttaaacatt

SEQ ID NO: 3694357 - DNA, 18 bp, Homo sapiens
taggcattaacacaaagg

SEQ ID NO: 3694358 - DNA, 19 bp, Homo sapiens
taggcatttttaccatcac

SEQ ID NO: 3694359 - DNA, 14 bp, Homo sapiens
taggcccccacttg

SEQ ID NO: 3694360 - DNA, 22 bp, Homo sapiens
taggcctcagccagagaagcta

SEQ ID NO: 3694361 - DNA, 22 bp, Homo sapiens
taggctccttcctgtgggtggg

SEQ ID NO: 3694362 - DNA, 15 bp, Homo sapiens
taggctgctccctga

SEQ ID NO: 3694363 - DNA, 16 bp, Homo sapiens
taggcttctacctgca

SEQ ID NO: 3694364 - DNA, 11 bp, Homo sapiens
tagggaaaaac

SEQ ID NO: 3694365 - DNA, 19 bp, Homo sapiens
tagggaaaaaccagcgtgt

SEQ ID NO: 3694366 - DNA, 13 bp, Homo sapiens
tagggaagataat

SEQ ID NO: 3694367 - DNA, 17 bp, Homo sapiens
tagggacatttccaagc

SEQ ID NO: 3694368 - DNA, 18 bp, Homo sapiens
tagggacctcagaggttt

SEQ ID NO: 3694369 - DNA, 18 bp, Homo sapiens
tagggagggcggcagggg

SEQ ID NO: 3694370 - DNA, 21 bp, Homo sapiens
tccctggagctagtgtctcct

SEQ ID NO: 3694371 - DNA, 23 bp, Homo sapiens
tccctgggaaccgccctcctgat

SEQ ID NO: 3694372 - DNA, 19 bp, Homo sapiens
tccctgggtggagcaggac

SEQ ID NO: 3694373 - DNA, 20 bp, Homo sapiens
tcccttcccctccctggctc

SEQ ID NO: 3694374 - DNA, 21 bp, Homo sapiens
tcccttcccctccctggctcc

SEQ ID NO: 3694375 - DNA, 13 bp, Homo sapiens
tcccttctgctac

SEQ ID NO: 3694376 - DNA, 15 bp, Homo sapiens
tcccttctgctactg

SEQ ID NO: 3694377 - DNA, 12 bp, Homo sapiens
tcccttgcctca

SEQ ID NO: 3694378 - DNA, 20 bp, Homo sapiens
tcccttgcctcaatgccagt

SEQ ID NO: 3694379 - DNA, 14 bp, Homo sapiens
tcccttggcctcag

SEQ ID NO: 3694380 - DNA, 15 bp, Homo sapiens
tcccttgtgtcaaga

SEQ ID NO: 3694381 - DNA, 22 bp, Homo sapiens
tccctttccaaatgcccagctt

SEQ ID NO: 3694382 - DNA, 23 bp, Homo sapiens
tccctttccttccatccctaccc

SEQ ID NO: 3694383 - DNA, 16 bp, Homo sapiens
tccgagaggtgggcca

SEQ ID NO: 3694384 - DNA, 13 bp, Homo sapiens
tccgagggcccct

SEQ ID NO: 3694385 - DNA, 16 bp, Homo sapiens
tccgagggcccctctc

SEQ ID NO: 3694386 - DNA, 20 bp, Homo sapiens
tccgcaagagtaaaggaaat

SEQ ID NO: 3694387 - DNA, 16 bp, Homo sapiens
tccgccctgccactca

SEQ ID NO: 3694388 - DNA, 11 bp, Homo sapiens
tccgcctgtcc

SEQ ID NO: 3694389 - DNA, 15 bp, Homo sapiens
tccgcgggtgggact

SEQ ID NO: 3694390 - DNA, 16 bp, Homo sapiens
tccgctttcctggagc

SEQ ID NO: 3694391 - DNA, 19 bp, Homo sapiens
tccggaaactagtgtacat

SEQ ID NO: 3694392 - DNA, 19 bp, Homo sapiens
tccggcctctgcctttgca

SEQ ID NO: 3694393 - DNA, 17 bp, Homo sapiens
tccggtccctgtcccag

SEQ ID NO: 3694394 - DNA, 22 bp, Homo sapiens
tccgtaggtagatgtgtaacct

SEQ ID NO: 3694395 - DNA, 23 bp, Homo sapiens
tccgtatctccctggagaagcac

SEQ ID NO: 3694396 - DNA, 17 bp, Homo sapiens
tccgtgctgacagctgc

SEQ ID NO: 3694397 - DNA, 16 bp, Homo sapiens
tccgtgggacggtgcc

SEQ ID NO: 3694398 - DNA, 23 bp, Homo sapiens
tccgtgggacggtgcccaagcca

SEQ ID NO: 3694399 - DNA, 14 bp, Homo sapiens
tccgtggtcagagt

SEQ ID NO: 3694400 - DNA, 16 bp, Homo sapiens
tccgttagctcctgtg

SEQ ID NO: 3694401 - DNA, 19 bp, Homo sapiens
tccgttagctcctgtggcc

SEQ ID NO: 3694402 - DNA, 14 bp, Homo sapiens
tcctaaatattatg

SEQ ID NO: 3694403 - DNA, 21 bp, Homo sapiens
tcctaaatattatgagatgct

SEQ ID NO: 3694404 - DNA, 23 bp, Homo sapiens
tcctaagactaacaaaggcagct

SEQ ID NO: 3694405 - DNA, 14 bp, Homo sapiens
tcctaatatcaaat

SEQ ID NO: 3694406 - DNA, 14 bp, Homo sapiens
tcctaatcatccaa

SEQ ID NO: 3694407 - DNA, 19 bp, Homo sapiens
tcctacacttgagagaaaa

SEQ ID NO: 3694408 - DNA, 13 bp, Homo sapiens
tcctacagtgaaa

SEQ ID NO: 3694409 - DNA, 12 bp, Homo sapiens
tcctacctgggg

SEQ ID NO: 3694410 - DNA, 14 bp, Homo sapiens
tcctacctgggggc

SEQ ID NO: 3694411 - DNA, 16 bp, Homo sapiens
tcctagaaattcccca

SEQ ID NO: 3694412 - DNA, 21 bp, Homo sapiens
tcctagaaattccccaccctg

SEQ ID NO: 3694413 - DNA, 18 bp, Homo sapiens
tcctaggagtatcctcat

SEQ ID NO: 3694414 - DNA, 13 bp, Homo sapiens
tcctaggcatttg

SEQ ID NO: 3694415 - DNA, 16 bp, Homo sapiens
tcctatatatttctat

SEQ ID NO: 3694416 - DNA, 20 bp, Homo sapiens
tcctatatatttctattatt

SEQ ID NO: 3694417 - DNA, 15 bp, Homo sapiens
tcctatgcttaataa

SEQ ID NO: 3694418 - DNA, 13 bp, Homo sapiens
tcctatgctttga

SEQ ID NO: 3694419 - DNA, 12 bp, Homo sapiens
tcctcacctctg

SEQ ID NO: 3694420 - DNA, 13 bp, Homo sapiens
tcctcacctctgg

SEQ ID NO: 3694421 - DNA, 22 bp, Homo sapiens
tcctcacctctggactggctag

SEQ ID NO: 3694422 - DNA, 17 bp, Homo sapiens
tcctcactcccagtcca

SEQ ID NO: 3694423 - DNA, 21 bp, Homo sapiens
tcctcactcccttcccataag

SEQ ID NO: 3694424 - DNA, 13 bp, Homo sapiens
tcctcagcctggg

SEQ ID NO: 3694425 - DNA, 21 bp, Homo sapiens
tcctcagccttgccagagatc

SEQ ID NO: 3694426 - DNA, 17 bp, Homo sapiens
tcctcattccttgtctt

SEQ ID NO: 3694427 - DNA, 23 bp, Homo sapiens
tcctcatttggggtagctagagg

SEQ ID NO: 3694428 - DNA, 13 bp, Homo sapiens
tcctccaacagct

SEQ ID NO: 3694429 - DNA, 14 bp, Homo sapiens
tcctccagaagcct

SEQ ID NO: 3694430 - DNA, 20 bp, Homo sapiens
tcctccagaagcctctggct

SEQ ID NO: 3694431 - DNA, 22 bp, Homo sapiens
tcctccagaagcctctggctag

SEQ ID NO: 3694432 - DNA, 17 bp, Homo sapiens
tcctcccaagctgtgct

SEQ ID NO: 3694433 - DNA, 13 bp, Homo sapiens
tcctccctggagc

SEQ ID NO: 3694434 - DNA, 13 bp, Homo sapiens
tcctccctggggg

SEQ ID NO: 3694435 - DNA, 17 bp, Homo sapiens
tcctccctgggggcggg

SEQ ID NO: 3694436 - DNA, 13 bp, Homo sapiens
tcctcccttctgc

SEQ ID NO: 3694437 - DNA, 15 bp, Homo sapiens
tcctcccttctgcta

SEQ ID NO: 3694438 - DNA, 16 bp, Homo sapiens
tcctcccttctgctac

SEQ ID NO: 3694439 - DNA, 12 bp, Homo sapiens
tcctcctgccca

SEQ ID NO: 3694440 - DNA, 15 bp, Homo sapiens
tcctcgcaagctggg

SEQ ID NO: 3694441 - DNA, 16 bp, Homo sapiens
tcctcgcaagctgggt

SEQ ID NO: 3694442 - DNA, 17 bp, Homo sapiens
tcctctcacctcagcct

SEQ ID NO: 3694443 - DNA, 17 bp, Homo sapiens
tcctctcccatccttga

SEQ ID NO: 3694444 - DNA, 22 bp, Homo sapiens
tcctctcccattgtccctctgc

SEQ ID NO: 3694445 - DNA, 18 bp, Homo sapiens
tcctctccccagcccaga

SEQ ID NO: 3694446 - DNA, 21 bp, Homo sapiens
tcctctccccagcccagagac

SEQ ID NO: 3694447 - DNA, 23 bp, Homo sapiens
tcctctccccagcccagagacat

SEQ ID NO: 3694448 - DNA, 14 bp, Homo sapiens
tcctctccctgcca

SEQ ID NO: 3694449 - DNA, 13 bp, Homo sapiens
tcctctgcctcaa

SEQ ID NO: 3694450 - DNA, 17 bp, Homo sapiens
tcctgaaacaacttgga

SEQ ID NO: 3694451 - DNA, 13 bp, Homo sapiens
tcctgaagaacca

SEQ ID NO: 3694452 - DNA, 18 bp, Homo sapiens
tcctgaccagggcaaggc

SEQ ID NO: 3694453 - DNA, 19 bp, Homo sapiens
tcctgactcatccgcctgg

SEQ ID NO: 3694454 - DNA, 20 bp, Homo sapiens
tcctgactcatccgcctggc

SEQ ID NO: 3694455 - DNA, 13 bp, Homo sapiens
tcctgactggtgc

SEQ ID NO: 3694456 - DNA, 13 bp, Homo sapiens
tcctgacttttaa

SEQ ID NO: 3694457 - DNA, 19 bp, Homo sapiens
tcctgagcgaaaacaggag

SEQ ID NO: 3694458 - DNA, 15 bp, Homo sapiens
tcctgaggggcatct

SEQ ID NO: 3694459 - DNA, 22 bp, Homo sapiens
tcctgaggggcatctgcccctc

SEQ ID NO: 3694460 - DNA, 15 bp, Homo sapiens
tcctgagtggtgcca

SEQ ID NO: 3694461 - DNA, 20 bp, Homo sapiens
tcctgataaagcacagctgt

SEQ ID NO: 3694462 - DNA, 21 bp, Homo sapiens
tcctgccagggaactggcctg

SEQ ID NO: 3694463 - DNA, 20 bp, Homo sapiens
tcctgcctcagcctccctgg

SEQ ID NO: 3694464 - DNA, 17 bp, Homo sapiens
tcctgcgggggcgaggc

SEQ ID NO: 3694465 - DNA, 13 bp, Homo sapiens
tcctgcgggtggg

SEQ ID NO: 3694466 - DNA, 15 bp, Homo sapiens
tcctgctgagctgcc

SEQ ID NO: 3694467 - DNA, 20 bp, Homo sapiens
tcctgctgagctgcccctgc

SEQ ID NO: 3694468 - DNA, 13 bp, Homo sapiens
tcctgctgtgcct

SEQ ID NO: 3694469 - DNA, 13 bp, Homo sapiens
tcctgctttctcc

SEQ ID NO: 3694470 - DNA, 22 bp, Homo sapiens
tcctggaacctggaccccagcc

SEQ ID NO: 3694471 - DNA, 15 bp, Homo sapiens
tcctggaggcccagt

SEQ ID NO: 3694472 - DNA, 16 bp, Homo sapiens
tcctggaggtcttttc

SEQ ID NO: 3694473 - DNA, 23 bp, Homo sapiens
tcctggatggggcagagcttctc

SEQ ID NO: 3694474 - DNA, 18 bp, Homo sapiens
tcctggatgttgtgtgta

SEQ ID NO: 3694475 - DNA, 16 bp, Homo sapiens
tcctggccatcccaca

SEQ ID NO: 3694476 - DNA, 20 bp, Homo sapiens
tcctggccatcccacaagtg

SEQ ID NO: 3694477 - DNA, 23 bp, Homo sapiens
tcctggcccctcatggcgggact

SEQ ID NO: 3694478 - DNA, 19 bp, Homo sapiens
tcctggccctccactcctc

SEQ ID NO: 3694479 - DNA, 12 bp, Homo sapiens
tcctggctgcgg

SEQ ID NO: 3694480 - DNA, 21 bp, Homo sapiens
tcctgggagaggacagggact

SEQ ID NO: 3694481 - DNA, 12 bp, Homo sapiens
tcctgggcctgc

SEQ ID NO: 3694482 - DNA, 13 bp, Homo sapiens
tcctgggcctgca

SEQ ID NO: 3694483 - DNA, 15 bp, Homo sapiens
tcctgggcctgcaga

SEQ ID NO: 3694484 - DNA, 23 bp, Homo sapiens
tcctggggtataaaactttcctc

SEQ ID NO: 3694485 - DNA, 15 bp, Homo sapiens
tcctgggtggtctgc

SEQ ID NO: 3694486 - DNA, 20 bp, Homo sapiens
tcctgtacattgtgggatgt

SEQ ID NO: 3694487 - DNA, 22 bp, Homo sapiens
tctcagaaccttgtcccagcca

SEQ ID NO: 3694488 - DNA, 14 bp, Homo sapiens
tctcagctcactgt

SEQ ID NO: 3694489 - DNA, 20 bp, Homo sapiens
tctcaggactctgaaaagga

SEQ ID NO: 3694490 - DNA, 13 bp, Homo sapiens
tctcagggcctgg

SEQ ID NO: 3694491 - DNA, 17 bp, Homo sapiens
tctcagtactttggagg

SEQ ID NO: 3694492 - DNA, 23 bp, Homo sapiens
tctcagttctcttgctttcacat

SEQ ID NO: 3694493 - DNA, 20 bp, Homo sapiens
tctcatcaacttaaaagtca

SEQ ID NO: 3694494 - DNA, 17 bp, Homo sapiens
tctcatgttttcaactg

SEQ ID NO: 3694495 - DNA, 22 bp, Homo sapiens
tctccaaactgaagcagcctct

SEQ ID NO: 3694496 - DNA, 16 bp, Homo sapiens
tctccaagcgcctggc

SEQ ID NO: 3694497 - DNA, 21 bp, Homo sapiens
tctccagagagaaatcaggcc

SEQ ID NO: 3694498 - DNA, 23 bp, Homo sapiens
tctccagagagaaatcaggcctg

SEQ ID NO: 3694499 - DNA, 17 bp, Homo sapiens
tctccaggggctgcttc

SEQ ID NO: 3694500 - DNA, 22 bp, Homo sapiens
tctccaggggctgcttcctcct

SEQ ID NO: 3694501 - DNA, 22 bp, Homo sapiens
tctccatacccacaatctgagc

SEQ ID NO: 3694502 - DNA, 17 bp, Homo sapiens
tctcccattgtccctct

SEQ ID NO: 3694503 - DNA, 20 bp, Homo sapiens
tctcccgaagtcctctgtgg

SEQ ID NO: 3694504 - DNA, 21 bp, Homo sapiens
tctcccgaagtcctctgtggc

SEQ ID NO: 3694505 - DNA, 15 bp, Homo sapiens
tctccctggagaagc

SEQ ID NO: 3694506 - DNA, 12 bp, Homo sapiens
tctccctgggga

SEQ ID NO: 3694507 - DNA, 21 bp, Homo sapiens
tctccctggggacggggctcc

SEQ ID NO: 3694508 - DNA, 21 bp, Homo sapiens
tctcctacttagggaagaaaa

SEQ ID NO: 3694509 - DNA, 18 bp, Homo sapiens
tctcctatatatttctat

SEQ ID NO: 3694510 - DNA, 22 bp, Homo sapiens
tctcctatatatttctattatt

SEQ ID NO: 3694511 - DNA, 16 bp, Homo sapiens
tctcctcgcaagctgg

SEQ ID NO: 3694512 - DNA, 20 bp, Homo sapiens
tctcctcgttcttatttaat

SEQ ID NO: 3694513 - DNA, 11 bp, Homo sapiens
tctcctggagg

SEQ ID NO: 3694514 - DNA, 23 bp, Homo sapiens
tctcgatgcaggtggatctcctt

SEQ ID NO: 3694515 - DNA, 23 bp, Homo sapiens
tgaacaagtgggccattagccag

SEQ ID NO: 3694516 - DNA, 17 bp, Homo sapiens
tgaacacagatcattct

SEQ ID NO: 3694517 - DNA, 13 bp, Homo sapiens
tgaacccaggcag

SEQ ID NO: 3694518 - DNA, 15 bp, Homo sapiens
tgaacccaggcagct

SEQ ID NO: 3694519 - DNA, 17 bp, Homo sapiens
tgaacccaggcagctgg

SEQ ID NO: 3694520 - DNA, 17 bp, Homo sapiens
tgaactaaaaagagact

SEQ ID NO: 3694521 - DNA, 13 bp, Homo sapiens
tgaactgcagtga

SEQ ID NO: 3694522 - DNA, 16 bp, Homo sapiens
tgaactggaagaaagc

SEQ ID NO: 3694523 - DNA, 11 bp, Homo sapiens
tgaactgttac

SEQ ID NO: 3694524 - DNA, 22 bp, Homo sapiens
tgaactgttacaacttgtattt

SEQ ID NO: 3694525 - DNA, 14 bp, Homo sapiens
tgaactttggaagc

SEQ ID NO: 3694526 - DNA, 16 bp, Homo sapiens
tgaagaactgcaggcc

SEQ ID NO: 3694527 - DNA, 15 bp, Homo sapiens
tgaagatgggagcct

SEQ ID NO: 3694528 - DNA, 19 bp, Homo sapiens
tgaagatttgaggacttgt

SEQ ID NO: 3694529 - DNA, 19 bp, Homo sapiens
tgaagcagatgcaaagagg

SEQ ID NO: 3694530 - DNA, 22 bp, Homo sapiens
tgaagcagatgcaaagaggcaa

SEQ ID NO: 3694531 - DNA, 15 bp, Homo sapiens
tgaagcagcctctcc

SEQ ID NO: 3694532 - DNA, 23 bp, Homo sapiens
tgaagccagctcacagtgctgtg

SEQ ID NO: 3694533 - DNA, 19 bp, Homo sapiens
tgaaggaggcggggctcta

SEQ ID NO: 3694534 - DNA, 23 bp, Homo sapiens
tgaaggaggcggggctctaggat

SEQ ID NO: 3694535 - DNA, 23 bp, Homo sapiens
tgaaggcagggctcctccctgga

SEQ ID NO: 3694536 - DNA, 17 bp, Homo sapiens
tgaagggccagagccag

SEQ ID NO: 3694537 - DNA, 10 bp, Homo sapiens
tgaaggggcg

SEQ ID NO: 3694538 - DNA, 15 bp, Homo sapiens
tgaaggtgctgacgg

SEQ ID NO: 3694539 - DNA, 18 bp, Homo sapiens
tgaaggtttctgaaaatt

SEQ ID NO: 3694540 - DNA, 13 bp, Homo sapiens
tgaagtaagcaaa

SEQ ID NO: 3694541 - DNA, 22 bp, Homo sapiens
tgaagtttttttgctgctgcct

SEQ ID NO: 3694542 - DNA, 18 bp, Homo sapiens
tgaataacatttaaattc

SEQ ID NO: 3694543 - DNA, 16 bp, Homo sapiens
tgaataataagcagga

SEQ ID NO: 3694544 - DNA, 12 bp, Homo sapiens
tgaataatacag

SEQ ID NO: 3694545 - DNA, 22 bp, Homo sapiens
tgaatctttgactgaagccgtg

SEQ ID NO: 3694546 - DNA, 19 bp, Homo sapiens
tgaatgaggcggagctcca

SEQ ID NO: 3694547 - DNA, 14 bp, Homo sapiens
tgaatgcataaaat

SEQ ID NO: 3694548 - DNA, 21 bp, Homo sapiens
tgaatgccactgccttcgctt

SEQ ID NO: 3694549 - DNA, 14 bp, Homo sapiens
tgaatgccgtggat

SEQ ID NO: 3694550 - DNA, 14 bp, Homo sapiens
tgaatgctgggact

SEQ ID NO: 3694551 - DNA, 15 bp, Homo sapiens
tgaatgctgggactc

SEQ ID NO: 3694552 - DNA, 16 bp, Homo sapiens
tgaatgtgtgatgtga

SEQ ID NO: 3694553 - DNA, 16 bp, Homo sapiens
tgaatgttaatttttt

SEQ ID NO: 3694554 - DNA, 18 bp, Homo sapiens
tgaattcctagaattaaa

SEQ ID NO: 3694555 - DNA, 21 bp, Homo sapiens
tgacaacgtttcagcgactcc

SEQ ID NO: 3694556 - DNA, 16 bp, Homo sapiens
tgacaattctgttttt

SEQ ID NO: 3694557 - DNA, 17 bp, Homo sapiens
tgacacaaacacacaca

SEQ ID NO: 3694558 - DNA, 18 bp, Homo sapiens
tgacacaggtctttccta

SEQ ID NO: 3694559 - DNA, 15 bp, Homo sapiens
tgacagacaggctct

SEQ ID NO: 3694560 - DNA, 13 bp, Homo sapiens
tgacagctgctcc

SEQ ID NO: 3694561 - DNA, 15 bp, Homo sapiens
tgacagctgctccta

SEQ ID NO: 3694562 - DNA, 18 bp, Homo sapiens
tgacagctgctcctagag

SEQ ID NO: 3694563 - DNA, 22 bp, Homo sapiens
tgacagctgctcctagagggag

SEQ ID NO: 3694564 - DNA, 13 bp, Homo sapiens
tgacagctttgct

SEQ ID NO: 3694565 - DNA, 14 bp, Homo sapiens
tgacagctttgctg

SEQ ID NO: 3694566 - DNA, 21 bp, Homo sapiens
tgacagctttgctgctgaagg

SEQ ID NO: 3694567 - DNA, 13 bp, Homo sapiens
tgacatatttaat

SEQ ID NO: 3694568 - DNA, 16 bp, Homo sapiens
tgacatatttaatgtt

SEQ ID NO: 3694569 - DNA, 17 bp, Homo sapiens
tgacatgtggggccagg

SEQ ID NO: 3694570 - DNA, 18 bp, Homo sapiens
tgacatgtggggccaggt

SEQ ID NO: 3694571 - DNA, 18 bp, Homo sapiens
tgacattgccaaaaagga

SEQ ID NO: 3694572 - DNA, 20 bp, Homo sapiens
tgacatttcattagccatgc

SEQ ID NO: 3694573 - DNA, 16 bp, Homo sapiens
tgacattttatttttt

SEQ ID NO: 3694574 - DNA, 24 bp, Homo sapiens
tgaccaaatcacccaatcccagtt

SEQ ID NO: 3694575 - DNA, 19 bp, Homo sapiens
tgaccaagactgagccagc

SEQ ID NO: 3694576 - DNA, 21 bp, Homo sapiens
tgaccaagcaggaagctcaga

SEQ ID NO: 3694577 - DNA, 13 bp, Homo sapiens
tgaccacccacct

SEQ ID NO: 3694578 - DNA, 15 bp, Homo sapiens
tgaccagcagcgcct

SEQ ID NO: 3694579 - DNA, 17 bp, Homo sapiens
tgaccagccgtgagcat

SEQ ID NO: 3694580 - DNA, 15 bp, Homo sapiens
tgaccagggcaaggc

SEQ ID NO: 3694581 - DNA, 20 bp, Homo sapiens
tgaccaggggccctacctgg

SEQ ID NO: 3694582 - DNA, 18 bp, Homo sapiens
tgaccatgctcatctgct

SEQ ID NO: 3694583 - DNA, 17 bp, Homo sapiens
tgacccagtgcccccac

SEQ ID NO: 3694584 - DNA, 20 bp, Homo sapiens
tgaccccagcccagacagca

SEQ ID NO: 3694585 - DNA, 15 bp, Homo sapiens
tgaccctcattcttt

SEQ ID NO: 3694586 - DNA, 14 bp, Homo sapiens
tgaccctgagctga

SEQ ID NO: 3694587 - DNA, 19 bp, Homo sapiens
tgaccgaaacagcgctggg

SEQ ID NO: 3694588 - DNA, 19 bp, Homo sapiens
tgaccggacttttctgcaa

SEQ ID NO: 3694589 - DNA, 19 bp, Homo sapiens
tgacctccgcctcctgggt

SEQ ID NO: 3694590 - DNA, 14 bp, Homo sapiens
tgacctgaggaagc

SEQ ID NO: 3694591 - DNA, 12 bp, Homo sapiens
tgacctgaggct

SEQ ID NO: 3694592 - DNA, 20 bp, Homo sapiens
tgacgacaagtgctgaacag

SEQ ID NO: 3694593 - DNA, 21 bp, Homo sapiens
tgactaagccccgtctgaccc

SEQ ID NO: 3694594 - DNA, 15 bp, Homo sapiens
tgactaatggcatga

SEQ ID NO: 3694595 - DNA, 18 bp, Homo sapiens
tgactaattttacatgtt

SEQ ID NO: 3694596 - DNA, 22 bp, Homo sapiens
tgactaattttacatgtttata

SEQ ID NO: 3694597 - DNA, 21 bp, Homo sapiens
tgactagaagggccagtcctg

SEQ ID NO: 3694598 - DNA, 13 bp, Homo sapiens
tgactagggagcc

SEQ ID NO: 3694599 - DNA, 17 bp, Homo sapiens
tgactagggagccatgt

SEQ ID NO: 3694600 - DNA, 21 bp, Homo sapiens
tgactagggagccatgtttca

SEQ ID NO: 3694601 - DNA, 18 bp, Homo sapiens
tgactagggattcaggct

SEQ ID NO: 3694602 - DNA, 15 bp, Homo sapiens
tgactcatccgcctg

SEQ ID NO: 3694603 - DNA, 21 bp, Homo sapiens
tgactcatccgcctggcccgg

SEQ ID NO: 3694604 - DNA, 17 bp, Homo sapiens
tgactcgggggtgggga

SEQ ID NO: 3694605 - DNA, 17 bp, Homo sapiens
tgactgaagccgtgcct

SEQ ID NO: 3694606 - DNA, 19 bp, Homo sapiens
tgactgccctcttactgtt

SEQ ID NO: 3694607 - DNA, 21 bp, Homo sapiens
tgactgccctcttactgtttt

SEQ ID NO: 3694608 - DNA, 21 bp, Homo sapiens
tttaagcctgcattcttaaca

SEQ ID NO: 3694609 - DNA, 20 bp, Homo sapiens
tttaataaaaaggcacctat

SEQ ID NO: 3694610 - DNA, 23 bp, Homo sapiens
tttaatataaagtagtcctgtga

SEQ ID NO: 3694611 - DNA, 18 bp, Homo sapiens
tttaatctgttatgtact

SEQ ID NO: 3694612 - DNA, 15 bp, Homo sapiens
tttaatgctatttga

SEQ ID NO: 3694613 - DNA, 18 bp, Homo sapiens
tttaatttagtaaatgtt

SEQ ID NO: 3694614 - DNA, 22 bp, Homo sapiens
tttaatttattaattgctttga

SEQ ID NO: 3694615 - DNA, 17 bp, Homo sapiens
tttaattttttaaataa

SEQ ID NO: 3694616 - DNA, 14 bp, Homo sapiens
tttacatctatgtg

SEQ ID NO: 3694617 - DNA, 17 bp, Homo sapiens
tttactgttatttaatt

SEQ ID NO: 3694618 - DNA, 21 bp, Homo sapiens
tttagagatgctaaaattctt

SEQ ID NO: 3694619 - DNA, 18 bp, Homo sapiens
tttaggctggtggcccag

SEQ ID NO: 3694620 - DNA, 12 bp, Homo sapiens
tttagtaaatgt

SEQ ID NO: 3694621 - DNA, 15 bp, Homo sapiens
tttagtaatttcttt

SEQ ID NO: 3694622 - DNA, 20 bp, Homo sapiens
tttagtttgtactcagtgga

SEQ ID NO: 3694623 - DNA, 15 bp, Homo sapiens
tttagttttctctta

SEQ ID NO: 3694624 - DNA, 16 bp, Homo sapiens
tttagtttttaacaat

SEQ ID NO: 3694625 - DNA, 19 bp, Homo sapiens
tttataagtcattgtatgt

SEQ ID NO: 3694626 - DNA, 22 bp, Homo sapiens
tttatataatatctaaagttat

SEQ ID NO: 3694627 - DNA, 16 bp, Homo sapiens
tttatattaatgtact

SEQ ID NO: 3694628 - DNA, 17 bp, Homo sapiens
tttatcacacttctgtg

SEQ ID NO: 3694629 - DNA, 14 bp, Homo sapiens
tttatcagcaaaaa

SEQ ID NO: 3694630 - DNA, 14 bp, Homo sapiens
tttatctgtttcct

SEQ ID NO: 3694631 - DNA, 16 bp, Homo sapiens
tttatgtgatcaattt

SEQ ID NO: 3694632 - DNA, 18 bp, Homo sapiens
tttattctatgtatgtta

SEQ ID NO: 3694633 - DNA, 23 bp, Homo sapiens
tttattgccttttaatttttaat

SEQ ID NO: 3694634 - DNA, 19 bp, Homo sapiens
tttatttaaattacaattt

SEQ ID NO: 3694635 - DNA, 19 bp, Homo sapiens
tttatttagttccttgagt

SEQ ID NO: 3694636 - DNA, 15 bp, Homo sapiens
tttatttagttttta

SEQ ID NO: 3694637 - DNA, 23 bp, Homo sapiens
tttcaaaaggaagggtggctttg

SEQ ID NO: 3694638 - DNA, 21 bp, Homo sapiens
tttcaaaataagtatttctga

SEQ ID NO: 3694639 - DNA, 21 bp, Homo sapiens
tttcaaaatagaaaagttatt

SEQ ID NO: 3694640 - DNA, 14 bp, Homo sapiens
tttcaaatttagaa

SEQ ID NO: 3694641 - DNA, 22 bp, Homo sapiens
tttcaagagtctaatagtcttt

SEQ ID NO: 3694642 - DNA, 22 bp, Homo sapiens
tttcaagcagtcgtgcctgtgt

SEQ ID NO: 3694643 - DNA, 12 bp, Homo sapiens
tttcaagtgcct

SEQ ID NO: 3694644 - DNA, 22 bp, Homo sapiens
tttcaagtgcctagactgttac

SEQ ID NO: 3694645 - DNA, 14 bp, Homo sapiens
tttcacaaggtctt

SEQ ID NO: 3694646 - DNA, 18 bp, Homo sapiens
tttcacattagaagacaa

SEQ ID NO: 3694647 - DNA, 19 bp, Homo sapiens
tttcacattagaagacaat

SEQ ID NO: 3694648 - DNA, 16 bp, Homo sapiens
tttcacattcttggct

SEQ ID NO: 3694649 - DNA, 19 bp, Homo sapiens
tttcagaacctcttcccca

SEQ ID NO: 3694650 - DNA, 11 bp, Homo sapiens
tttcagactcc

SEQ ID NO: 3694651 - DNA, 15 bp, Homo sapiens
tttcagacttgtcaa

SEQ ID NO: 3694652 - DNA, 23 bp, Homo sapiens
tttcagagtgacacccaagaggg

SEQ ID NO: 3694653 - DNA, 15 bp, Homo sapiens
tttcagatgtaatgt

SEQ ID NO: 3694654 - DNA, 16 bp, Homo sapiens
tttcagatgtaatgtt

SEQ ID NO: 3694655 - DNA, 18 bp, Homo sapiens
tttcagatgtaatgtttt

SEQ ID NO: 3694656 - DNA, 19 bp, Homo sapiens
tttcagtacttttttaaat

SEQ ID NO: 3694657 - DNA, 17 bp, Homo sapiens
tttcagtgaaagcatca

SEQ ID NO: 3694658 - DNA, 19 bp, Homo sapiens
tttcattagccatgcaaca

SEQ ID NO: 3694659 - DNA, 15 bp, Homo sapiens
tttcattcatcctga

SEQ ID NO: 3694660 - DNA, 21 bp, Homo sapiens
tttccaagctgttagttgctg

SEQ ID NO: 3694661 - DNA, 19 bp, Homo sapiens
tttccacaaaatctgtcca

SEQ ID NO: 3694662 - DNA, 23 bp, Homo sapiens
tttccaccacagccagcacctgg

SEQ ID NO: 3694663 - DNA, 21 bp, Homo sapiens
tttccagcagaagacaaaaag

SEQ ID NO: 3694664 - DNA, 17 bp, Homo sapiens
tttccatgaaaatgcaa

SEQ ID NO: 3694665 - DNA, 21 bp, Homo sapiens
tttccatggcaggaaggcttg

SEQ ID NO: 3694666 - DNA, 19 bp, Homo sapiens
tttccatgggaccacaact

SEQ ID NO: 3694667 - DNA, 23 bp, Homo sapiens
tttcccacttcccaccctgcccc

SEQ ID NO: 3694668 - DNA, 17 bp, Homo sapiens
tttccccccactctccc

SEQ ID NO: 3694669 - DNA, 16 bp, Homo sapiens
tttccctattagagaa

SEQ ID NO: 3694670 - DNA, 12 bp, Homo sapiens
tttccctgggtg

SEQ ID NO: 3694671 - DNA, 15 bp, Homo sapiens
tttcctaaggctgca

SEQ ID NO: 3694672 - DNA, 14 bp, Homo sapiens
tttcctccgcctgt

SEQ ID NO: 3694673 - DNA, 22 bp, Homo sapiens
tttcctcttagtcgagccaagt

SEQ ID NO: 3694674 - DNA, 21 bp, Homo sapiens
tttcctgaaacaacttggaaa

SEQ ID NO: 3694675 - DNA, 21 bp, Homo sapiens
tttcctgataaagcacagctg

SEQ ID NO: 3694676 - DNA, 11 bp, Homo sapiens
tttcctggagc

SEQ ID NO: 3694677 - DNA, 19 bp, Homo sapiens
tttccttccatccctaccc

SEQ ID NO: 3694678 - DNA, 13 bp, Homo sapiens
tttcgtggggagg

SEQ ID NO: 3694679 - DNA, 19 bp, Homo sapiens
tttctaatgaggagagaaa

SEQ ID NO: 3694680 - DNA, 15 bp, Homo sapiens
tttctaattaacctt

SEQ ID NO: 3694681 - DNA, 20 bp, Homo sapiens
tttctagaacatccctgcca

SEQ ID NO: 3694682 - DNA, 22 bp, Homo sapiens
tttctagaacatccctgccagc

SEQ ID NO: 3694683 - DNA, 16 bp, Homo sapiens
tttctagagcactgcc

SEQ ID NO: 3694684 - DNA, 15 bp, Homo sapiens
tttctattttaagac

SEQ ID NO: 3694685 - DNA, 21 bp, Homo sapiens
tttctcagggaagtaagatgt

SEQ ID NO: 3694686 - DNA, 15 bp, Homo sapiens
tttctctgtactttt

SEQ ID NO: 3694687 - DNA, 16 bp, Homo sapiens
tttctctgtacttttc

SEQ ID NO: 3694688 - DNA, 16 bp, Homo sapiens
tttctctgtggctcca

SEQ ID NO: 3694689 - DNA, 15 bp, Homo sapiens
tttctgatcaaggcc

SEQ ID NO: 3694690 - DNA, 15 bp, Homo sapiens
tttctgctcagcttc

SEQ ID NO: 3694691 - DNA, 19 bp, Homo sapiens
tttctgctcagcttctcct

SEQ ID NO: 3694692 - DNA, 17 bp, Homo sapiens
tttctggtgccatttct

SEQ ID NO: 3694693 - DNA, 17 bp, Homo sapiens
tttcttattgcgctgct

SEQ ID NO: 3694694 - DNA, 12 bp, Homo sapiens
tttcttcatgag

SEQ ID NO: 3694695 - DNA, 14 bp, Homo sapiens
tttcttgtgttctg

SEQ ID NO: 3694696 - DNA, 13 bp, Homo sapiens
tttcttgtttctg

SEQ ID NO: 3694697 - DNA, 17 bp, Homo sapiens
tttgaatataaacacta

SEQ ID NO: 3694698 - DNA, 12 bp, Homo sapiens
tttgaatgttaa

SEQ ID NO: 3694699 - DNA, 16 bp, Homo sapiens
tttgactaattttaca

SEQ ID NO: 3694700 - DNA, 15 bp, Homo sapiens
tttgactgaaaaaaa

SEQ ID NO: 3694701 - DNA, 14 bp, Homo sapiens
tttgacttaatgtg

SEQ ID NO: 3694702 - DNA, 15 bp, Homo sapiens
tttgactttcttctg

SEQ ID NO: 3694703 - DNA, 18 bp, Homo sapiens
tttgactttcttctgaat

SEQ ID NO: 3694704 - DNA, 22 bp, Homo sapiens
tttgactttcttctgaatattt

SEQ ID NO: 3694705 - DNA, 17 bp, Homo sapiens
tttgagatcagcctggg

SEQ ID NO: 3694706 - DNA, 18 bp, Homo sapiens
tttgagattaagaatgcc

SEQ ID NO: 3694707 - DNA, 21 bp, Homo sapiens
tttgatgaggtattttttcct

SEQ ID NO: 3694708 - DNA, 21 bp, Homo sapiens
tttgattgaataatgccacca

SEQ ID NO: 3694709 - DNA, 19 bp, Homo sapiens
tttgcaaagtattgtaaat

SEQ ID NO: 3694710 - DNA, 14 bp, Homo sapiens
tttgcaaggaagcc

SEQ ID NO: 3694711 - DNA, 23 bp, Homo sapiens
tttgccaaaattcatttctaatt

SEQ ID NO: 3694712 - DNA, 16 bp, Homo sapiens
tttgccacctctgccc

SEQ ID NO: 3694713 - DNA, 16 bp, Homo sapiens
tttgccagtgggaact

SEQ ID NO: 3694714 - DNA, 21 bp, Homo sapiens
tttgctgtgaggctgtcctgt

SEQ ID NO: 3694715 - DNA, 15 bp, Homo sapiens
tttgctttctgctca

SEQ ID NO: 3694716 - DNA, 15 bp, Homo sapiens
tttgctttgctttct

SEQ ID NO: 3694717 - DNA, 18 bp, Homo sapiens
tttgctttgctttctgct

SEQ ID NO: 3694718 - DNA, 20 bp, Homo sapiens
tttggaaaagtggcgtggga

SEQ ID NO: 3694719 - DNA, 14 bp, Homo sapiens
tttgggttctgcct

SEQ ID NO: 3694720 - DNA, 16 bp, Homo sapiens
tttgggttctgcctgc

SEQ ID NO: 3694721 - DNA, 13 bp, Homo sapiens
tttggtacaaaaa

SEQ ID NO: 3694722 - DNA, 14 bp, Homo sapiens
tttggtgagaacct

SEQ ID NO: 3694723 - DNA, 15 bp, Homo sapiens
tttgtaaagtttccg

SEQ ID NO: 3694724 - DNA, 11 bp, Homo sapiens
tttgtaaattc

SEQ ID NO: 3694725 - DNA, 17 bp, Homo sapiens
tttgtaagttatgtttt

SEQ ID NO: 3694726 - DNA, 19 bp, Homo sapiens
ttgatgtggccctggctgc

SEQ ID NO: 3694727 - DNA, 16 bp, Homo sapiens
ttgatgtttgtggcct

SEQ ID NO: 3694728 - DNA, 17 bp, Homo sapiens
ttgatgtttgtggcctc

SEQ ID NO: 3694729 - DNA, 20 bp, Homo sapiens
ttgatgtttgtggcctcaga

SEQ ID NO: 3694730 - DNA, 23 bp, Homo sapiens
ttgattcggtatccccccatctt

SEQ ID NO: 3694731 - DNA, 20 bp, Homo sapiens
ttgcaaagtattgtaaatta

SEQ ID NO: 3694732 - DNA, 14 bp, Homo sapiens
ttgcaccactgcac

SEQ ID NO: 3694733 - DNA, 16 bp, Homo sapiens
ttgcaccactgcactc

SEQ ID NO: 3694734 - DNA, 18 bp, Homo sapiens
ttgcagacaggaatctta

SEQ ID NO: 3694735 - DNA, 20 bp, Homo sapiens
ttgcagtgtggtgagatcat

SEQ ID NO: 3694736 - DNA, 16 bp, Homo sapiens
ttgcagttcagcacca

SEQ ID NO: 3694737 - DNA, 14 bp, Homo sapiens
ttgccaaaatacca

SEQ ID NO: 3694738 - DNA, 23 bp, Homo sapiens
ttgccaaaataccagagccttca

SEQ ID NO: 3694739 - DNA, 17 bp, Homo sapiens
ttgccaaatatgtcctg

SEQ ID NO: 3694740 - DNA, 16 bp, Homo sapiens
ttgccaccaggagaac

SEQ ID NO: 3694741 - DNA, 16 bp, Homo sapiens
ttgcccttctgtccaa

SEQ ID NO: 3694742 - DNA, 23 bp, Homo sapiens
ttgcctaggcgattttgtctacc

SEQ ID NO: 3694743 - DNA, 20 bp, Homo sapiens
ttgcctcatggccagcgccc

SEQ ID NO: 3694744 - DNA, 12 bp, Homo sapiens
ttgcctccaggt

SEQ ID NO: 3694745 - DNA, 16 bp, Homo sapiens
ttgccttaactggagc

SEQ ID NO: 3694746 - DNA, 22 bp, Homo sapiens
ttgccttccagaaaacaaaact

SEQ ID NO: 3694747 - DNA, 16 bp, Homo sapiens
ttgccttgctgtttgt

SEQ ID NO: 3694748 - DNA, 20 bp, Homo sapiens
ttgccttgggctgctcctca

SEQ ID NO: 3694749 - DNA, 21 bp, Homo sapiens
ttgcgtagctctcaaatgtgt

SEQ ID NO: 3694750 - DNA, 21 bp, Homo sapiens
ttgcgtggaattgtgctgagt

SEQ ID NO: 3694751 - DNA, 18 bp, Homo sapiens
ttgctatcaacaataaaa

SEQ ID NO: 3694752 - DNA, 14 bp, Homo sapiens
ttgctctgtctccc

SEQ ID NO: 3694753 - DNA, 14 bp, Homo sapiens
ttgctgaaagatct

SEQ ID NO: 3694754 - DNA, 14 bp, Homo sapiens
ttgctgcttgaggc

SEQ ID NO: 3694755 - DNA, 16 bp, Homo sapiens
ttgctgcttgaggcaa

SEQ ID NO: 3694756 - DNA, 17 bp, Homo sapiens
ttgctggaagacagaga

SEQ ID NO: 3694757 - DNA, 19 bp, Homo sapiens
ttgctggaagacagagaaa

SEQ ID NO: 3694758 - DNA, 20 bp, Homo sapiens
ttgctgggtggttctctggg

SEQ ID NO: 3694759 - DNA, 15 bp, Homo sapiens
ttgctgtgaggctgt

SEQ ID NO: 3694760 - DNA, 20 bp, Homo sapiens
ttgctgttttcctcccttct

SEQ ID NO: 3694761 - DNA, 16 bp, Homo sapiens
ttgcttaagtatacct

SEQ ID NO: 3694762 - DNA, 15 bp, Homo sapiens
ttgcttcaaactgag

SEQ ID NO: 3694763 - DNA, 20 bp, Homo sapiens
ttgctttctgctcagcttct

SEQ ID NO: 3694764 - DNA, 11 bp, Homo sapiens
ttgctttgagc

SEQ ID NO: 3694765 - DNA, 16 bp, Homo sapiens
ttggaatgctccaggc

SEQ ID NO: 3694766 - DNA, 14 bp, Homo sapiens
ttggacatcctcct

SEQ ID NO: 3694767 - DNA, 13 bp, Homo sapiens
ttggacggcctga

SEQ ID NO: 3694768 - DNA, 15 bp, Homo sapiens
ttggagagtttcctg

SEQ ID NO: 3694769 - DNA, 20 bp, Homo sapiens
ttggagccccaggggacaag

SEQ ID NO: 3694770 - DNA, 15 bp, Homo sapiens
ttggaggccagccag

SEQ ID NO: 3694771 - DNA, 17 bp, Homo sapiens
ttggatgggacattttt

SEQ ID NO: 3694772 - DNA, 14 bp, Homo sapiens
ttggattggggtcc

SEQ ID NO: 3694773 - DNA, 17 bp, Homo sapiens
ttggcaccagacaccca

SEQ ID NO: 3694774 - DNA, 20 bp, Homo sapiens
ttggcaccagacacccagga

SEQ ID NO: 3694775 - DNA, 12 bp, Homo sapiens
ttggcctcagaa

SEQ ID NO: 3694776 - DNA, 16 bp, Homo sapiens
ttggcctttcctggaa

SEQ ID NO: 3694777 - DNA, 20 bp, Homo sapiens
ttggctcgaatctctgtgcc

SEQ ID NO: 3694778 - DNA, 20 bp, Homo sapiens
ttggctgaaattctcctgga

SEQ ID NO: 3694779 - DNA, 21 bp, Homo sapiens
ttggctgaaattctcctggag

SEQ ID NO: 3694780 - DNA, 12 bp, Homo sapiens
ttggctgtccag

SEQ ID NO: 3694781 - DNA, 22 bp, Homo sapiens
ttggctttgggttgcaggacct

SEQ ID NO: 3694782 - DNA, 13 bp, Homo sapiens
ttgggattaatat

SEQ ID NO: 3694783 - DNA, 16 bp, Homo sapiens
ttgggcctgctccaga

SEQ ID NO: 3694784 - DNA, 19 bp, Homo sapiens
ttgggcctgctccagacct

SEQ ID NO: 3694785 - DNA, 17 bp, Homo sapiens
ttggggagttaagacct

SEQ ID NO: 3694786 - DNA, 20 bp, Homo sapiens
ttggggagttaagacctggc

SEQ ID NO: 3694787 - DNA, 13 bp, Homo sapiens
ttgggggggtggc

SEQ ID NO: 3694788 - DNA, 23 bp, Homo sapiens
ttgggtgggacagggcttctcct

SEQ ID NO: 3694789 - DNA, 20 bp, Homo sapiens
ttggtaactgattacctgcc

SEQ ID NO: 3694790 - DNA, 15 bp, Homo sapiens
ttggtacaaaaataa

SEQ ID NO: 3694791 - DNA, 17 bp, Homo sapiens
ttggtatctcaggtctg

SEQ ID NO: 3694792 - DNA, 18 bp, Homo sapiens
ttggtgggggagcctctg

SEQ ID NO: 3694793 - DNA, 19 bp, Homo sapiens
ttggtgggggagcctctgg

SEQ ID NO: 3694794 - DNA, 14 bp, Homo sapiens
ttggtgtacagact

SEQ ID NO: 3694795 - DNA, 13 bp, Homo sapiens
ttggtgttgacat

SEQ ID NO: 3694796 - DNA, 12 bp, Homo sapiens
ttgtaaatgcct

SEQ ID NO: 3694797 - DNA, 12 bp, Homo sapiens
ttgtaaattata

SEQ ID NO: 3694798 - DNA, 14 bp, Homo sapiens
ttgtaaattatatt

SEQ ID NO: 3694799 - DNA, 23 bp, Homo sapiens
ttgtaaattattaatttatgcag

SEQ ID NO: 3694800 - DNA, 16 bp, Homo sapiens
ttgtacagtttaaaat

SEQ ID NO: 3694801 - DNA, 23 bp, Homo sapiens
ttgtagagaacacgcgtatttac

SEQ ID NO: 3694802 - DNA, 22 bp, Homo sapiens
ttgtagattaggtcttgctgga

SEQ ID NO: 3694803 - DNA, 23 bp, Homo sapiens
ttgtagattaggtcttgctggaa

SEQ ID NO: 3694804 - DNA, 15 bp, Homo sapiens
ttgtagctaacagtg

SEQ ID NO: 3694805 - DNA, 17 bp, Homo sapiens
ttgtagctaacagtgaa

SEQ ID NO: 3694806 - DNA, 19 bp, Homo sapiens
ttgtaggtatgtctgtgcc

SEQ ID NO: 3694807 - DNA, 20 bp, Homo sapiens
ttgtaggtatgtctgtgcca

SEQ ID NO: 3694808 - DNA, 21 bp, Homo sapiens
ttgtaggtatgtctgtgccat

SEQ ID NO: 3694809 - DNA, 22 bp, Homo sapiens
ttgtaggtatgtctgtgccatt

SEQ ID NO: 3694810 - DNA, 13 bp, Homo sapiens
ttgtattacagat

SEQ ID NO: 3694811 - DNA, 17 bp, Homo sapiens
ttgtattatttttgtag

SEQ ID NO: 3694812 - DNA, 16 bp, Homo sapiens
ttgtccctctgcccca

SEQ ID NO: 3694813 - DNA, 23 bp, Homo sapiens
ttgtcctgatgcttttgtctaat

SEQ ID NO: 3694814 - DNA, 18 bp, Homo sapiens
ttgtcctttttcaggaga

SEQ ID NO: 3694815 - DNA, 17 bp, Homo sapiens
ttgtctgaacccaggca

SEQ ID NO: 3694816 - DNA, 22 bp, Homo sapiens
ttgtctgaacccaggcagctgg

SEQ ID NO: 3694817 - DNA, 18 bp, Homo sapiens
ttgtctgtctacatttct

SEQ ID NO: 3694818 - DNA, 12 bp, Homo sapiens
ttgtgaactgga

SEQ ID NO: 3694819 - DNA, 15 bp, Homo sapiens
ttgtggaagacactt

SEQ ID NO: 3694820 - DNA, 21 bp, Homo sapiens
ttgtggaagacacttgctgag

SEQ ID NO: 3694821 - DNA, 22 bp, Homo sapiens
ttgtggaggagctcaggacact

SEQ ID NO: 3694822 - DNA, 11 bp, Homo sapiens
ttgtggcctca

SEQ ID NO: 3694823 - DNA, 12 bp, Homo sapiens
ttgtgtaaaaaa

SEQ ID NO: 3694824 - DNA, 15 bp, Homo sapiens
ttgtgtgttgtctct

SEQ ID NO: 3694825 - DNA, 19 bp, Homo sapiens
ttgttaatggtttgaatat

SEQ ID NO: 3694826 - DNA, 22 bp, Homo sapiens
ttgttaatttttcctatattgc

SEQ ID NO: 3694827 - DNA, 13 bp, Homo sapiens
ttgttgtgctttt

SEQ ID NO: 3694828 - DNA, 17 bp, Homo sapiens
ttgtttctctgttgtaa

SEQ ID NO: 3694829 - DNA, 19 bp, Homo sapiens
ttgtttgctcacctggggt

SEQ ID NO: 3694830 - DNA, 22 bp, Homo sapiens
ttgtttgtaaatgcctcttaaa

SEQ ID NO: 3694831 - DNA, 13 bp, Homo sapiens
ttgttttaaaact

SEQ ID NO: 3694832 - DNA, 12 bp, Homo sapiens
ttgttttacaat

SEQ ID NO: 3694833 - DNA, 22 bp, Homo sapiens
ttgttttggctgaaattctcct

SEQ ID NO: 3694834 - DNA, 21 bp, Homo sapiens
ttgttttttcaaaatagaaaa

SEQ ID NO: 3694835 - DNA, 17 bp, Homo sapiens
tttaaaagatgctttta

SEQ ID NO: 3694836 - DNA, 17 bp, Homo sapiens
tttaaaatgtaaagcca

SEQ ID NO: 3694837 - DNA, 18 bp, Homo sapiens
tttaaaatgtaaagccat

SEQ ID NO: 3694838 - DNA, 14 bp, Homo sapiens
tttaaatattttct

SEQ ID NO: 3694839 - DNA, 17 bp, Homo sapiens
tttaaatattttctatt

SEQ ID NO: 3694840 - DNA, 14 bp, Homo sapiens
tttaaatgctgctt

SEQ ID NO: 3694841 - DNA, 20 bp, Homo sapiens
tttaaatgtacagacatatt

SEQ ID NO: 3694842 - DNA, 13 bp, Homo sapiens
tttaaattacaat

SEQ ID NO: 3694843 - DNA, 16 bp, Homo sapiens
tttaacaatctaacaa

SEQ ID NO: 3694844 - DNA, 22 bp, Homo sapiens
tttaactggtgcactttgtaaa

SEQ ID NO: 3694845 - DNA, 14 bp, Homo sapiens
ttcctttccttttc

SEQ ID NO: 3694846 - DNA, 21 bp, Homo sapiens
ttccttttctgtataaagttc

SEQ ID NO: 3694847 - DNA, 20 bp, Homo sapiens
ttccttttgaacgccccccc

SEQ ID NO: 3694848 - DNA, 20 bp, Homo sapiens
ttcgatgggcccaattctta

SEQ ID NO: 3694849 - DNA, 14 bp, Homo sapiens
ttcgcataaagaag

SEQ ID NO: 3694850 - DNA, 15 bp, Homo sapiens
ttcgtagatattgga

SEQ ID NO: 3694851 - DNA, 22 bp, Homo sapiens
ttctaaaggtgttgtcccttct

SEQ ID NO: 3694852 - DNA, 23 bp, Homo sapiens
ttctaatgaggagagaaaatata

SEQ ID NO: 3694853 - DNA, 22 bp, Homo sapiens
ttctacctgcaggcggggctcc

SEQ ID NO: 3694854 - DNA, 13 bp, Homo sapiens
ttctacgccaggg

SEQ ID NO: 3694855 - DNA, 21 bp, Homo sapiens
ttctagaacatccctgccagc

SEQ ID NO: 3694856 - DNA, 22 bp, Homo sapiens
ttctagaacatccctgccagct

SEQ ID NO: 3694857 - DNA, 21 bp, Homo sapiens
ttctagaatttatcacacttc

SEQ ID NO: 3694858 - DNA, 22 bp, Homo sapiens
ttctagagttttatagcctgga

SEQ ID NO: 3694859 - DNA, 20 bp, Homo sapiens
ttctaggcatctctgtactt

SEQ ID NO: 3694860 - DNA, 16 bp, Homo sapiens
ttctatagttattaag

SEQ ID NO: 3694861 - DNA, 14 bp, Homo sapiens
ttctatgtatgtta

SEQ ID NO: 3694862 - DNA, 17 bp, Homo sapiens
ttctatgtatgttaatt

SEQ ID NO: 3694863 - DNA, 14 bp, Homo sapiens
ttctcaagccctgc

SEQ ID NO: 3694864 - DNA, 15 bp, Homo sapiens
ttctcaagccctgca

SEQ ID NO: 3694865 - DNA, 19 bp, Homo sapiens
ttctcacagtgggagccag

SEQ ID NO: 3694866 - DNA, 22 bp, Homo sapiens
ttctcacagtgggagccagggc

SEQ ID NO: 3694867 - DNA, 16 bp, Homo sapiens
ttctcaggtgttgcca

SEQ ID NO: 3694868 - DNA, 17 bp, Homo sapiens
ttctcaggtgttgccaa

SEQ ID NO: 3694869 - DNA, 19 bp, Homo sapiens
ttctcaggtgttgccaaat

SEQ ID NO: 3694870 - DNA, 19 bp, Homo sapiens
ttctccgttagctcctgtg

SEQ ID NO: 3694871 - DNA, 22 bp, Homo sapiens
ttctcctacttagggaagaaaa

SEQ ID NO: 3694872 - DNA, 10 bp, Homo sapiens
ttctcctgga

SEQ ID NO: 3694873 - DNA, 19 bp, Homo sapiens
ttctcgctgtcctttctag

SEQ ID NO: 3694874 - DNA, 16 bp, Homo sapiens
ttctctaactcctgcc

SEQ ID NO: 3694875 - DNA, 16 bp, Homo sapiens
ttctctccgcgggtgg

SEQ ID NO: 3694876 - DNA, 19 bp, Homo sapiens
ttctctccgcgggtgggac

SEQ ID NO: 3694877 - DNA, 16 bp, Homo sapiens
ttctctgacttctgcc

SEQ ID NO: 3694878 - DNA, 22 bp, Homo sapiens
ttctctgagtatctcctcgcaa

SEQ ID NO: 3694879 - DNA, 13 bp, Homo sapiens
ttctctgccagtg

SEQ ID NO: 3694880 - DNA, 14 bp, Homo sapiens
ttctctgctccacc

SEQ ID NO: 3694881 - DNA, 12 bp, Homo sapiens
ttctctgggacc

SEQ ID NO: 3694882 - DNA, 17 bp, Homo sapiens
ttctctgggaccaggct

SEQ ID NO: 3694883 - DNA, 20 bp, Homo sapiens
ttctctgggaccaggctcca

SEQ ID NO: 3694884 - DNA, 14 bp, Homo sapiens
ttctctgtactttt

SEQ ID NO: 3694885 - DNA, 21 bp, Homo sapiens
ttctctgtacttttcattctc

SEQ ID NO: 3694886 - DNA, 23 bp, Homo sapiens
ttctcttccctgcgcctgtgatg

SEQ ID NO: 3694887 - DNA, 13 bp, Homo sapiens
ttctcttgggtgg

SEQ ID NO: 3694888 - DNA, 23 bp, Homo sapiens
ttctcttgggtgggacagggctt

SEQ ID NO: 3694889 - DNA, 19 bp, Homo sapiens
ttctgactcggtttctcca

SEQ ID NO: 3694890 - DNA, 15 bp, Homo sapiens
ttctgatcaaggcct

SEQ ID NO: 3694891 - DNA, 20 bp, Homo sapiens
ttctgattcccctccaccaa

SEQ ID NO: 3694892 - DNA, 13 bp, Homo sapiens
ttctgcaggaatc

SEQ ID NO: 3694893 - DNA, 12 bp, Homo sapiens
ttctgcctgcca

SEQ ID NO: 3694894 - DNA, 23 bp, Homo sapiens
ttctgcctttgatgttacagatt

SEQ ID NO: 3694895 - DNA, 17 bp, Homo sapiens
ttctgcttatttcatct

SEQ ID NO: 3694896 - DNA, 19 bp, Homo sapiens
ttctgcttatttcatctgt

SEQ ID NO: 3694897 - DNA, 13 bp, Homo sapiens
ttctggaaaatgc

SEQ ID NO: 3694898 - DNA, 18 bp, Homo sapiens
ttctggaaaatgcttctt

SEQ ID NO: 3694899 - DNA, 14 bp, Homo sapiens
ttctggaatttgtt

SEQ ID NO: 3694900 - DNA, 17 bp, Homo sapiens
ttctggaatttgttcaa

SEQ ID NO: 3694901 - DNA, 20 bp, Homo sapiens
ttctggaatttgttcaagtt

SEQ ID NO: 3694902 - DNA, 21 bp, Homo sapiens
ttctggattccccatctcagg

SEQ ID NO: 3694903 - DNA, 20 bp, Homo sapiens
ttctggtgctactccatgca

SEQ ID NO: 3694904 - DNA, 22 bp, Homo sapiens
ttctggtgctactccatgcagg

SEQ ID NO: 3694905 - DNA, 21 bp, Homo sapiens
ttctgtactgttactgggccc

SEQ ID NO: 3694906 - DNA, 13 bp, Homo sapiens
ttctgtcccaagt

SEQ ID NO: 3694907 - DNA, 15 bp, Homo sapiens
ttctgtcccaagtct

SEQ ID NO: 3694908 - DNA, 17 bp, Homo sapiens
ttctgtcccaagtctcc

SEQ ID NO: 3694909 - DNA, 16 bp, Homo sapiens
ttctgtgacccatctg

SEQ ID NO: 3694910 - DNA, 17 bp, Homo sapiens
ttctgtgacccatctgt

SEQ ID NO: 3694911 - DNA, 14 bp, Homo sapiens
ttctgtgtatctct

SEQ ID NO: 3694912 - DNA, 13 bp, Homo sapiens
ttctgtttttaat

SEQ ID NO: 3694913 - DNA, 17 bp, Homo sapiens
ttcttaaacaaatgtat

SEQ ID NO: 3694914 - DNA, 17 bp, Homo sapiens
ttcttaaacacttgcaa

SEQ ID NO: 3694915 - DNA, 20 bp, Homo sapiens
ttcttaaccctttccagagt

SEQ ID NO: 3694916 - DNA, 15 bp, Homo sapiens
ttcttacaaacatgt

SEQ ID NO: 3694917 - DNA, 19 bp, Homo sapiens
ttcttattgcgctgctacc

SEQ ID NO: 3694918 - DNA, 18 bp, Homo sapiens
ttcttcagcttgatcctg

SEQ ID NO: 3694919 - DNA, 15 bp, Homo sapiens
ttcttgagattttgt

SEQ ID NO: 3694920 - DNA, 16 bp, Homo sapiens
ttcttgcaaatacctc

SEQ ID NO: 3694921 - DNA, 15 bp, Homo sapiens
ttcttgcctctgtgc

SEQ ID NO: 3694922 - DNA, 16 bp, Homo sapiens
ttcttgcctctgtgct

SEQ ID NO: 3694923 - DNA, 19 bp, Homo sapiens
ttcttggggcccagtgcat

SEQ ID NO: 3694924 - DNA, 12 bp, Homo sapiens
ttctttagagat

SEQ ID NO: 3694925 - DNA, 13 bp, Homo sapiens
ttctttagagatg

SEQ ID NO: 3694926 - DNA, 12 bp, Homo sapiens
ttctttgcaaag

SEQ ID NO: 3694927 - DNA, 19 bp, Homo sapiens
ttctttttttcctttttaa

SEQ ID NO: 3694928 - DNA, 22 bp, Homo sapiens
ttcttttttttttttttgagac

SEQ ID NO: 3694929 - DNA, 15 bp, Homo sapiens
ttgaaacagaaaaat

SEQ ID NO: 3694930 - DNA, 17 bp, Homo sapiens
ttgaaagttttcagaac

SEQ ID NO: 3694931 - DNA, 21 bp, Homo sapiens
ttgaaataactggaacaaatt

SEQ ID NO: 3694932 - DNA, 20 bp, Homo sapiens
ttgaactcttcactcttcaa

SEQ ID NO: 3694933 - DNA, 23 bp, Homo sapiens
tccagccccccaggctgcccaga

SEQ ID NO: 3694934 - DNA, 15 bp, Homo sapiens
tccagcccctctggt

SEQ ID NO: 3694935 - DNA, 23 bp, Homo sapiens
tccagcccctctggtcgctcctg

SEQ ID NO: 3694936 - DNA, 19 bp, Homo sapiens
tccagccgccattgccacc

SEQ ID NO: 3694937 - DNA, 11 bp, Homo sapiens
tccagcctggg

SEQ ID NO: 3694938 - DNA, 24 bp, Homo sapiens
tccagcctgggtgacagagcaagt

SEQ ID NO: 3694939 - DNA, 19 bp, Homo sapiens
tccagcctggtggcccagc

SEQ ID NO: 3694940 - DNA, 22 bp, Homo sapiens
tccagcctggtggcccagctat

SEQ ID NO: 3694941 - DNA, 23 bp, Homo sapiens
tccagcctggtggcccagctatt

SEQ ID NO: 3694942 - DNA, 19 bp, Homo sapiens
tccagctccaacctgcaaa

SEQ ID NO: 3694943 - DNA, 20 bp, Homo sapiens
tccagctctggaggggaggg

SEQ ID NO: 3694944 - DNA, 20 bp, Homo sapiens
tccaggatctttgactgaaa

SEQ ID NO: 3694945 - DNA, 16 bp, Homo sapiens
tccaggcagatccagg

SEQ ID NO: 3694946 - DNA, 18 bp, Homo sapiens
tccaggcagatccaggac

SEQ ID NO: 3694947 - DNA, 19 bp, Homo sapiens
tccaggcagatccaggact

SEQ ID NO: 3694948 - DNA, 20 bp, Homo sapiens
tccaggcagatccaggacta

SEQ ID NO: 3694949 - DNA, 22 bp, Homo sapiens
tccaggcgcgccgacgcctgtg

SEQ ID NO: 3694950 - DNA, 16 bp, Homo sapiens
tccagggaagctggcc

SEQ ID NO: 3694951 - DNA, 23 bp, Homo sapiens
tccagggacagaggccccagcct

SEQ ID NO: 3694952 - DNA, 22 bp, Homo sapiens
tccagggaggggccggccctgt

SEQ ID NO: 3694953 - DNA, 17 bp, Homo sapiens
tccagggtccctctgtg

SEQ ID NO: 3694954 - DNA, 15 bp, Homo sapiens
tccaggtgcagaggt

SEQ ID NO: 3694955 - DNA, 15 bp, Homo sapiens
tccaggtgtgcccct

SEQ ID NO: 3694956 - DNA, 18 bp, Homo sapiens
tccaggtttaagctgtta

SEQ ID NO: 3694957 - DNA, 15 bp, Homo sapiens
tccagtcacatgccc

SEQ ID NO: 3694958 - DNA, 22 bp, Homo sapiens
tccagtggaggtttgtcgggca

SEQ ID NO: 3694959 - DNA, 13 bp, Homo sapiens
tccatccaaggcc

SEQ ID NO: 3694960 - DNA, 14 bp, Homo sapiens
tccatccctacccc

SEQ ID NO: 3694961 - DNA, 18 bp, Homo sapiens
tccatccctaccccctaa

SEQ ID NO: 3694962 - DNA, 23 bp, Homo sapiens
tccatgcctgtagctttcctggt

SEQ ID NO: 3694963 - DNA, 18 bp, Homo sapiens
tccatgtacttgtttgca

SEQ ID NO: 3694964 - DNA, 22 bp, Homo sapiens
tccattttcttattgcgctgct

SEQ ID NO: 3694965 - DNA, 19 bp, Homo sapiens
tcccaagtagaatctcagt

SEQ ID NO: 3694966 - DNA, 13 bp, Homo sapiens
tcccacaccccaa

SEQ ID NO: 3694967 - DNA, 14 bp, Homo sapiens
tcccacagccctga

SEQ ID NO: 3694968 - DNA, 22 bp, Homo sapiens
tcccacccccttctctgctcca

SEQ ID NO: 3694969 - DNA, 16 bp, Homo sapiens
tcccacttcccaccct

SEQ ID NO: 3694970 - DNA, 19 bp, Homo sapiens
tcccagaacacactccatc

SEQ ID NO: 3694971 - DNA, 18 bp, Homo sapiens
tcccagatacttgggggg

SEQ ID NO: 3694972 - DNA, 13 bp, Homo sapiens
tcccagccacccc

SEQ ID NO: 3694973 - DNA, 14 bp, Homo sapiens
tcccagccaccccg

SEQ ID NO: 3694974 - DNA, 24 bp, Homo sapiens
tcccagccaccccgggctctctgc

SEQ ID NO: 3694975 - DNA, 21 bp, Homo sapiens
tcccagcccccaaccccaaga

SEQ ID NO: 3694976 - DNA, 16 bp, Homo sapiens
tcccaggaccctgaag

SEQ ID NO: 3694977 - DNA, 11 bp, Homo sapiens
tcccaggctgg

SEQ ID NO: 3694978 - DNA, 12 bp, Homo sapiens
tcccaggctgga

SEQ ID NO: 3694979 - DNA, 20 bp, Homo sapiens
tcccagtaagggcgtggctc

SEQ ID NO: 3694980 - DNA, 19 bp, Homo sapiens
tcccagtgccgagaaggaa

SEQ ID NO: 3694981 - DNA, 14 bp, Homo sapiens
tcccatggggaggg

SEQ ID NO: 3694982 - DNA, 13 bp, Homo sapiens
tcccattcctgaa

SEQ ID NO: 3694983 - DNA, 19 bp, Homo sapiens
tcccattgtccctctgccc

SEQ ID NO: 3694984 - DNA, 23 bp, Homo sapiens
tcccatttctacctaagtcagct

SEQ ID NO: 3694985 - DNA, 12 bp, Homo sapiens
tccccaccctga

SEQ ID NO: 3694986 - DNA, 23 bp, Homo sapiens
tccccaccctgaaagccctgagc

SEQ ID NO: 3694987 - DNA, 17 bp, Homo sapiens
tccccacctccaggctt

SEQ ID NO: 3694988 - DNA, 13 bp, Homo sapiens
tccccacctgcac

SEQ ID NO: 3694989 - DNA, 17 bp, Homo sapiens
tccccagaaaggagact

SEQ ID NO: 3694990 - DNA, 23 bp, Homo sapiens
tccccagagaaaggggagcccac

SEQ ID NO: 3694991 - DNA, 12 bp, Homo sapiens
tccccagcccag

SEQ ID NO: 3694992 - DNA, 15 bp, Homo sapiens
tccccagcccagaga

SEQ ID NO: 3694993 - DNA, 23 bp, Homo sapiens
tccccagcctttgatcaggtggg

SEQ ID NO: 3694994 - DNA, 13 bp, Homo sapiens
tccccaggcccca

SEQ ID NO: 3694995 - DNA, 17 bp, Homo sapiens
tccccaggggtcccagc

SEQ ID NO: 3694996 - DNA, 20 bp, Homo sapiens
tccccaggggtcccagccac

SEQ ID NO: 3694997 - DNA, 23 bp, Homo sapiens
tccccaggggtcccagccacccc

SEQ ID NO: 3694998 - DNA, 16 bp, Homo sapiens
tccccaggtccagctc

SEQ ID NO: 3694999 - DNA, 16 bp, Homo sapiens
tccccagttgccgtct

SEQ ID NO: 3695000 - DNA, 15 bp, Homo sapiens
tcccccaacccccac

SEQ ID NO: 3695001 - DNA, 21 bp, Homo sapiens
tcccccaacccccaccccaca

SEQ ID NO: 3695002 - DNA, 22 bp, Homo sapiens
tcccccaacccccaccccacac

SEQ ID NO: 3695003 - DNA, 21 bp, Homo sapiens
tccccccactctccccacact

SEQ ID NO: 3695004 - DNA, 12 bp, Homo sapiens
tccccccatctt

SEQ ID NO: 3695005 - DNA, 17 bp, Homo sapiens
tcccccccatgcactgt

SEQ ID NO: 3695006 - DNA, 18 bp, Homo sapiens
tcccccccatgcactgtg

SEQ ID NO: 3695007 - DNA, 16 bp, Homo sapiens
tccccctggacggggc

SEQ ID NO: 3695008 - DNA, 20 bp, Homo sapiens
tccccctggacggggcgggc

SEQ ID NO: 3695009 - DNA, 22 bp, Homo sapiens
tcccccttcacaaagcccaagg

SEQ ID NO: 3695010 - DNA, 21 bp, Homo sapiens
tccccgcagtgtgcactaagg

SEQ ID NO: 3695011 - DNA, 15 bp, Homo sapiens
tgagatgctggcttg

SEQ ID NO: 3695012 - DNA, 17 bp, Homo sapiens
tgagatgctggcttggg

SEQ ID NO: 3695013 - DNA, 21 bp, Homo sapiens
tgagatggaaaagtgtccttc

SEQ ID NO: 3695014 - DNA, 23 bp, Homo sapiens
tgagatgggccggcccccttcct

SEQ ID NO: 3695015 - DNA, 12 bp, Homo sapiens
tgagcagtggct

SEQ ID NO: 3695016 - DNA, 15 bp, Homo sapiens
tgagcatcacagaat

SEQ ID NO: 3695017 - DNA, 21 bp, Homo sapiens
tgagcccctgtctagagaggg

SEQ ID NO: 3695018 - DNA, 22 bp, Homo sapiens
tgagcccctgtctagagaggga

SEQ ID NO: 3695019 - DNA, 15 bp, Homo sapiens
tgagcctgcagggaa

SEQ ID NO: 3695020 - DNA, 16 bp, Homo sapiens
tgagcctggcaagaat

SEQ ID NO: 3695021 - DNA, 14 bp, Homo sapiens
tgagcctgggaggt

SEQ ID NO: 3695022 - DNA, 15 bp, Homo sapiens
tgagcgaaaacagga

SEQ ID NO: 3695023 - DNA, 17 bp, Homo sapiens
tgagcgaaaacaggaga

SEQ ID NO: 3695024 - DNA, 21 bp, Homo sapiens
tgagctactgccgtcagtgct

SEQ ID NO: 3695025 - DNA, 24 bp, Homo sapiens
tgagctgaccagccgtgagcatgt

SEQ ID NO: 3695026 - DNA, 12 bp, Homo sapiens
tgagctgcccct

SEQ ID NO: 3695027 - DNA, 14 bp, Homo sapiens
tgagctgcccctgc

SEQ ID NO: 3695028 - DNA, 19 bp, Homo sapiens
tgagctgcccctgctgctt

SEQ ID NO: 3695029 - DNA, 15 bp, Homo sapiens
tgagctgcctccagc

SEQ ID NO: 3695030 - DNA, 17 bp, Homo sapiens
tgagctgcctccagcct

SEQ ID NO: 3695031 - DNA, 18 bp, Homo sapiens
tgagctgcctccagcctg

SEQ ID NO: 3695032 - DNA, 19 bp, Homo sapiens
tgagctgctgactgccaat

SEQ ID NO: 3695033 - DNA, 23 bp, Homo sapiens
tgagcttaagaattttgagcagg

SEQ ID NO: 3695034 - DNA, 21 bp, Homo sapiens
tgagcttatttcaaaaggaag

SEQ ID NO: 3695035 - DNA, 15 bp, Homo sapiens
tgaggaaaggccagc

SEQ ID NO: 3695036 - DNA, 19 bp, Homo sapiens
tgaggaaaggccagctggc

SEQ ID NO: 3695037 - DNA, 22 bp, Homo sapiens
tgaggaagcgtgaaggccgaga

SEQ ID NO: 3695038 - DNA, 18 bp, Homo sapiens
tgaggacttgttaaagag

SEQ ID NO: 3695039 - DNA, 15 bp, Homo sapiens
tgaggagctgctggc

SEQ ID NO: 3695040 - DNA, 20 bp, Homo sapiens
tgaggagctggggatccctc

SEQ ID NO: 3695041 - DNA, 22 bp, Homo sapiens
tgaggcagggaagtccccaggc

SEQ ID NO: 3695042 - DNA, 18 bp, Homo sapiens
tgaggccggagaggagtt

SEQ ID NO: 3695043 - DNA, 17 bp, Homo sapiens
tgaggcctggactttcc

SEQ ID NO: 3695044 - DNA, 19 bp, Homo sapiens
tgaggcctggactttcctg

SEQ ID NO: 3695045 - DNA, 20 bp, Homo sapiens
tgaggcctggactttcctgc

SEQ ID NO: 3695046 - DNA, 22 bp, Homo sapiens
tgaggcctgggccgctgccacg

SEQ ID NO: 3695047 - DNA, 15 bp, Homo sapiens
tgaggcggagctcca

SEQ ID NO: 3695048 - DNA, 13 bp, Homo sapiens
tgaggctgtcctg

SEQ ID NO: 3695049 - DNA, 13 bp, Homo sapiens
tgaggcttagaga

SEQ ID NO: 3695050 - DNA, 14 bp, Homo sapiens
tgaggcttcttcct

SEQ ID NO: 3695051 - DNA, 15 bp, Homo sapiens
tgaggcttcttcctg

SEQ ID NO: 3695052 - DNA, 23 bp, Homo sapiens
tgaggcttcttcctggatggggc

SEQ ID NO: 3695053 - DNA, 15 bp, Homo sapiens
tgaggcttgcccagg

SEQ ID NO: 3695054 - DNA, 18 bp, Homo sapiens
tgaggcttgcccaggagc

SEQ ID NO: 3695055 - DNA, 18 bp, Homo sapiens
tgagggcagactggggca

SEQ ID NO: 3695056 - DNA, 22 bp, Homo sapiens
tgagggggaatagtctagatgg

SEQ ID NO: 3695057 - DNA, 18 bp, Homo sapiens
tgagggggaattcctgga

SEQ ID NO: 3695058 - DNA, 22 bp, Homo sapiens
tgaggggtccctagcagcccac

SEQ ID NO: 3695059 - DNA, 22 bp, Homo sapiens
tgagggtgggcttttccctggg

SEQ ID NO: 3695060 - DNA, 12 bp, Homo sapiens
tgaggtgggagg

SEQ ID NO: 3695061 - DNA, 13 bp, Homo sapiens
tgaggtgggagga

SEQ ID NO: 3695062 - DNA, 21 bp, Homo sapiens
tgaggtgggaggatctcttga

SEQ ID NO: 3695063 - DNA, 19 bp, Homo sapiens
tgagtccagaagtttgaga

SEQ ID NO: 3695064 - DNA, 13 bp, Homo sapiens
tgagtggcagggg

SEQ ID NO: 3695065 - DNA, 21 bp, Homo sapiens
tgagtgggtgaataatacagt

SEQ ID NO: 3695066 - DNA, 15 bp, Homo sapiens
tgagttaactgtgaa

SEQ ID NO: 3695067 - DNA, 15 bp, Homo sapiens
tgagttcaggtagct

SEQ ID NO: 3695068 - DNA, 16 bp, Homo sapiens
tgagttcaggtagctg

SEQ ID NO: 3695069 - DNA, 16 bp, Homo sapiens
tgagttgattcagctc

SEQ ID NO: 3695070 - DNA, 20 bp, Homo sapiens
tgagtttgtcgctcatgtgt

SEQ ID NO: 3695071 - DNA, 22 bp, Homo sapiens
tgatagacacatatgaggggga

SEQ ID NO: 3695072 - DNA, 15 bp, Homo sapiens
tgatagggaactggg

SEQ ID NO: 3695073 - DNA, 13 bp, Homo sapiens
tgatcaaggcctt

SEQ ID NO: 3695074 - DNA, 14 bp, Homo sapiens
tgatcactgtgaaa

SEQ ID NO: 3695075 - DNA, 16 bp, Homo sapiens
tgatcattttcccccc

SEQ ID NO: 3695076 - DNA, 20 bp, Homo sapiens
tgatcattttccccccactc

SEQ ID NO: 3695077 - DNA, 18 bp, Homo sapiens
tgatcctggaggcccagt

SEQ ID NO: 3695078 - DNA, 20 bp, Homo sapiens
tgatcctgtattcagacaga

SEQ ID NO: 3695079 - DNA, 13 bp, Homo sapiens
tgatctggaaccc

SEQ ID NO: 3695080 - DNA, 20 bp, Homo sapiens
tgatgacaaaaaatgtttta

SEQ ID NO: 3695081 - DNA, 22 bp, Homo sapiens
tgatgagggggaattcctggaa

SEQ ID NO: 3695082 - DNA, 22 bp, Homo sapiens
tgatgaggtattttttcctttt

SEQ ID NO: 3695083 - DNA, 19 bp, Homo sapiens
tgatgagttaactgtgaaa

SEQ ID NO: 3695084 - DNA, 14 bp, Homo sapiens
tgatgatcctaggc

SEQ ID NO: 3695085 - DNA, 14 bp, Homo sapiens
tgatgctccctccc

SEQ ID NO: 3695086 - DNA, 15 bp, Homo sapiens
tgatgctccctcccc

SEQ ID NO: 3695087 - DNA, 16 bp, Homo sapiens
tgatgctccctcccct

SEQ ID NO: 3695088 - DNA, 22 bp, Homo sapiens
tgatgctccctcccctgccctg

SEQ ID NO: 3695089 - DNA, 19 bp, Homo sapiens
tgatgctgctatatccact

SEQ ID NO: 3695090 - DNA, 17 bp, Homo sapiens
tgatggaagtgggccag

SEQ ID NO: 3695091 - DNA, 22 bp, Homo sapiens
tgatggaagtgggccagtcctg

SEQ ID NO: 3695092 - DNA, 23 bp, Homo sapiens
tgatggcaacagatctggaacct

SEQ ID NO: 3695093 - DNA, 24 bp, Homo sapiens
tgatgggattctggacaggatgtg

SEQ ID NO: 3695094 - DNA, 20 bp, Homo sapiens
tgatggtgtggcctgtggct

SEQ ID NO: 3695095 - DNA, 14 bp, Homo sapiens
tgatgtcaaagtgt

SEQ ID NO: 3695096 - DNA, 17 bp, Homo sapiens
tgatgtcaatttctgtg

SEQ ID NO: 3695097 - DNA, 18 bp, Homo sapiens
tgatgtcaatttctgtgt

SEQ ID NO: 3695098 - DNA, 18 bp, Homo sapiens
tgatgtgggtcaaggaat

SEQ ID NO: 3695099 - DNA, 11 bp, Homo sapiens
tgatgtttgtg

SEQ ID NO: 3695100 - DNA, 19 bp, Homo sapiens
tgattaaccacttcagctg

SEQ ID NO: 3695101 - DNA, 14 bp, Homo sapiens
tgattacctgccaa

SEQ ID NO: 3695102 - DNA, 14 bp, Homo sapiens
tgattcaaaatatt

SEQ ID NO: 3695103 - DNA, 19 bp, Homo sapiens
tgattcaaaatatttaaaa

SEQ ID NO: 3695104 - DNA, 14 bp, Homo sapiens
tgattcagctctgc

SEQ ID NO: 3695105 - DNA, 18 bp, Homo sapiens
tgattccgcaccctgcct

SEQ ID NO: 3695106 - DNA, 19 bp, Homo sapiens
tgattccgcaccctgccta

SEQ ID NO: 3695107 - DNA, 21 bp, Homo sapiens
tgattctgataatgctcactt

SEQ ID NO: 3695108 - DNA, 13 bp, Homo sapiens
tgattgacagctt

SEQ ID NO: 3695109 - DNA, 15 bp, Homo sapiens
tgattggcagatgag

SEQ ID NO: 3695110 - DNA, 14 bp, Homo sapiens
tgcaaaaaattctt

SEQ ID NO: 3695111 - DNA, 18 bp, Homo sapiens
tgcaaaaaattctttaga

SEQ ID NO: 3695112 - DNA, 12 bp, Homo sapiens
tgcaaagatctg

SEQ ID NO: 3695113 - DNA, 17 bp, Homo sapiens
tgcaaagtattgtaaat

SEQ ID NO: 3695114 - DNA, 13 bp, Homo sapiens
tgcaaccactctg

SEQ ID NO: 3695115 - DNA, 19 bp, Homo sapiens
tgcaaccactctgtggcca

SEQ ID NO: 3695116 - DNA, 23 bp, Homo sapiens
tgcaaccactctgtggccagcct

SEQ ID NO: 3695117 - DNA, 15 bp, Homo sapiens
tgcaacccttacccc

SEQ ID NO: 3695118 - DNA, 17 bp, Homo sapiens
tgcaacccttacccctt

SEQ ID NO: 3695119 - DNA, 16 bp, Homo sapiens
tgcaacttgtaaatgt

SEQ ID NO: 3695120 - DNA, 18 bp, Homo sapiens
tgcaacttgtaaatgtgg

SEQ ID NO: 3695121 - DNA, 17 bp, Homo sapiens
tgcaagcagaggaccag

SEQ ID NO: 3695122 - DNA, 19 bp, Homo sapiens
tgcaagcaggactttgagg

SEQ ID NO: 3695123 - DNA, 14 bp, Homo sapiens
tgcaaggaccagga

SEQ ID NO: 3695124 - DNA, 15 bp, Homo sapiens
tgcaaggaccaggac

SEQ ID NO: 3695125 - DNA, 19 bp, Homo sapiens
tgcaataaatctgacccag

SEQ ID NO: 3695126 - DNA, 20 bp, Homo sapiens
tgcaataaatctgacccagt

SEQ ID NO: 3695127 - DNA, 15 bp, Homo sapiens
agaagcggctggcag

SEQ ID NO: 3695128 - DNA, 18 bp, Homo sapiens
agaagctcctctccccag

SEQ ID NO: 3695129 - DNA, 20 bp, Homo sapiens
agaagctcctctccccagcc

SEQ ID NO: 3695130 - DNA, 20 bp, Homo sapiens
agaagctgagcaccagggga

SEQ ID NO: 3695131 - DNA, 19 bp, Homo sapiens
agaagtgaatgctgggact

SEQ ID NO: 3695132 - DNA, 17 bp, Homo sapiens
agaagtgcccttcctgc

SEQ ID NO: 3695133 - DNA, 13 bp, Homo sapiens
agaagtttgcact

SEQ ID NO: 3695134 - DNA, 18 bp, Homo sapiens
agaataggcattaacaca

SEQ ID NO: 3695135 - DNA, 16 bp, Homo sapiens
agaatatgacttttta

SEQ ID NO: 3695136 - DNA, 13 bp, Homo sapiens
agaatcccaaaga

SEQ ID NO: 3695137 - DNA, 19 bp, Homo sapiens
agaatcttggtttgccttc

SEQ ID NO: 3695138 - DNA, 20 bp, Homo sapiens
agaatgaaattgctgaaaga

SEQ ID NO: 3695139 - DNA, 20 bp, Homo sapiens
agaattactgtaactgatta

SEQ ID NO: 3695140 - DNA, 20 bp, Homo sapiens
agaattataattagttcctc

SEQ ID NO: 3695141 - DNA, 22 bp, Homo sapiens
agaatttagtttgtactcagtg

SEQ ID NO: 3695142 - DNA, 15 bp, Homo sapiens
agacaaaaagacaaa

SEQ ID NO: 3695143 - DNA, 14 bp, Homo sapiens
agacaacaggcatt

SEQ ID NO: 3695144 - DNA, 18 bp, Homo sapiens
agacaacaggcattttct

SEQ ID NO: 3695145 - DNA, 15 bp, Homo sapiens
agacaagcatggaaa

SEQ ID NO: 3695146 - DNA, 18 bp, Homo sapiens
agacaatttgcacatctt

SEQ ID NO: 3695147 - DNA, 12 bp, Homo sapiens
agacacaggccc

SEQ ID NO: 3695148 - DNA, 15 bp, Homo sapiens
agacacccaggactt

SEQ ID NO: 3695149 - DNA, 20 bp, Homo sapiens
agacagagaaaacttgcctt

SEQ ID NO: 3695150 - DNA, 12 bp, Homo sapiens
agacagagctgg

SEQ ID NO: 3695151 - DNA, 12 bp, Homo sapiens
agacagtcttgc

SEQ ID NO: 3695152 - DNA, 17 bp, Homo sapiens
agacatacttgaagggc

SEQ ID NO: 3695153 - DNA, 20 bp, Homo sapiens
agacatacttgaagggccag

SEQ ID NO: 3695154 - DNA, 14 bp, Homo sapiens
agacatatttaact

SEQ ID NO: 3695155 - DNA, 15 bp, Homo sapiens
agacatatttaactg

SEQ ID NO: 3695156 - DNA, 14 bp, Homo sapiens
agacattctgccag

SEQ ID NO: 3695157 - DNA, 15 bp, Homo sapiens
agacattctgccagg

SEQ ID NO: 3695158 - DNA, 15 bp, Homo sapiens
agacattggcaccta

SEQ ID NO: 3695159 - DNA, 16 bp, Homo sapiens
agaccaagcttgtcca

SEQ ID NO: 3695160 - DNA, 20 bp, Homo sapiens
agaccacgcccgtcctgcct

SEQ ID NO: 3695161 - DNA, 19 bp, Homo sapiens
agaccagcctggccaacat

SEQ ID NO: 3695162 - DNA, 14 bp, Homo sapiens
agacccccacacct

SEQ ID NO: 3695163 - DNA, 15 bp, Homo sapiens
agacctgatcctgga

SEQ ID NO: 3695164 - DNA, 22 bp, Homo sapiens
agacctgatcctggaggcccag

SEQ ID NO: 3695165 - DNA, 23 bp, Homo sapiens
agacctgatcctggaggcccagt

SEQ ID NO: 3695166 - DNA, 23 bp, Homo sapiens
agacctggcagctctggacagcc

SEQ ID NO: 3695167 - DNA, 19 bp, Homo sapiens
agaccttgttacttctgag

SEQ ID NO: 3695168 - DNA, 22 bp, Homo sapiens
agaccttgttacttctgaggta

SEQ ID NO: 3695169 - DNA, 22 bp, Homo sapiens
agaccttttggcccaatctctg

SEQ ID NO: 3695170 - DNA, 16 bp, Homo sapiens
agacggtttccaggga

SEQ ID NO: 3695171 - DNA, 17 bp, Homo sapiens
agactatattgtacaca

SEQ ID NO: 3695172 - DNA, 23 bp, Homo sapiens
agactcccattcctgaagaacca

SEQ ID NO: 3695173 - DNA, 15 bp, Homo sapiens
agactggaacactag

SEQ ID NO: 3695174 - DNA, 12 bp, Homo sapiens
agactgtgccat

SEQ ID NO: 3695175 - DNA, 16 bp, Homo sapiens
agacttagggcaccag

SEQ ID NO: 3695176 - DNA, 16 bp, Homo sapiens
agagaaaaaaaaaata

SEQ ID NO: 3695177 - DNA, 16 bp, Homo sapiens
agagaaaacttgcctt

SEQ ID NO: 3695178 - DNA, 16 bp, Homo sapiens
agagaaatcaggcctg

SEQ ID NO: 3695179 - DNA, 17 bp, Homo sapiens
agagaaatcaggcctga

SEQ ID NO: 3695180 - DNA, 22 bp, Homo sapiens
agagaacctcacgcacctccca

SEQ ID NO: 3695181 - DNA, 23 bp, Homo sapiens
agagaacctcacgcacctcccat

SEQ ID NO: 3695182 - DNA, 21 bp, Homo sapiens
agagacagctacacagagctt

SEQ ID NO: 3695183 - DNA, 13 bp, Homo sapiens
agagactctcctg

SEQ ID NO: 3695184 - DNA, 14 bp, Homo sapiens
agagactgaaatta

SEQ ID NO: 3695185 - DNA, 18 bp, Homo sapiens
agagagaaatcaggcctg

SEQ ID NO: 3695186 - DNA, 17 bp, Homo sapiens
agagagggaggcaagcc

SEQ ID NO: 3695187 - DNA, 18 bp, Homo sapiens
agagatccaaaagaagcc

SEQ ID NO: 3695188 - DNA, 21 bp, Homo sapiens
agagatcccaagtagaatctc

SEQ ID NO: 3695189 - DNA, 13 bp, Homo sapiens
agagcaagaagga

SEQ ID NO: 3695190 - DNA, 15 bp, Homo sapiens
agagcaagaaggaaa

SEQ ID NO: 3695191 - DNA, 13 bp, Homo sapiens
agagcccagctcc

SEQ ID NO: 3695192 - DNA, 14 bp, Homo sapiens
agagccttcaagtg

SEQ ID NO: 3695193 - DNA, 19 bp, Homo sapiens
agagccttcaagtgccaaa

SEQ ID NO: 3695194 - DNA, 21 bp, Homo sapiens
agagccttgcggaaggttcta

SEQ ID NO: 3695195 - DNA, 15 bp, Homo sapiens
agagccttttgtgca

SEQ ID NO: 3695196 - DNA, 13 bp, Homo sapiens
agagctggtgccc

SEQ ID NO: 3695197 - DNA, 20 bp, Homo sapiens
agagctgtttatggcctcag

SEQ ID NO: 3695198 - DNA, 13 bp, Homo sapiens
agagcttctcctg

SEQ ID NO: 3695199 - DNA, 14 bp, Homo sapiens
agagcttctcctga

SEQ ID NO: 3695200 - DNA, 15 bp, Homo sapiens
agagcttctcctgac

SEQ ID NO: 3695201 - DNA, 16 bp, Homo sapiens
agaggaaggggtgctg

SEQ ID NO: 3695202 - DNA, 22 bp, Homo sapiens
agaggaaggggtgctgtgaggc

SEQ ID NO: 3695203 - DNA, 18 bp, Homo sapiens
agaggacagtctggagaa

SEQ ID NO: 3695204 - DNA, 20 bp, Homo sapiens
agaggacagtctggagaagg

SEQ ID NO: 3695205 - DNA, 12 bp, Homo sapiens
agaggaggggcc

SEQ ID NO: 3695206 - DNA, 14 bp, Homo sapiens
agaggaggggccgc

SEQ ID NO: 3695207 - DNA, 16 bp, Homo sapiens
agaggccagccccacc

SEQ ID NO: 3695208 - DNA, 17 bp, Homo sapiens
agaggccagccccaccc

SEQ ID NO: 3695209 - DNA, 18 bp, Homo sapiens
agaggccagccccaccca

SEQ ID NO: 3695210 - DNA, 12 bp, Homo sapiens
agaggccccagc

SEQ ID NO: 3695211 - DNA, 14 bp, Homo sapiens
agaggccccagcct

SEQ ID NO: 3695212 - DNA, 15 bp, Homo sapiens
agaggccccagcctc

SEQ ID NO: 3695213 - DNA, 16 bp, Homo sapiens
agaggcccccagccca

SEQ ID NO: 3695214 - DNA, 21 bp, Homo sapiens
agaggcccccagcccagggct

SEQ ID NO: 3695215 - DNA, 13 bp, Homo sapiens
agaggcggggcta

SEQ ID NO: 3695216 - DNA, 15 bp, Homo sapiens
agaggcggggctaca

SEQ ID NO: 3695217 - DNA, 18 bp, Homo sapiens
agaggctgaggcctggac

SEQ ID NO: 3695218 - DNA, 22 bp, Homo sapiens
agaggctgttcccaccaggctg

SEQ ID NO: 3695219 - DNA, 15 bp, Homo sapiens
agagggaagaaaaga

SEQ ID NO: 3695220 - DNA, 21 bp, Homo sapiens
agagggacggccaagaatgta

SEQ ID NO: 3695221 - DNA, 13 bp, Homo sapiens
agaggtgggccag

SEQ ID NO: 3695222 - DNA, 21 bp, Homo sapiens
agaggtgggccagtctgtgga

SEQ ID NO: 3695223 - DNA, 24 bp, Homo sapiens
agaggtgggccagtctgtggatca

SEQ ID NO: 3695224 - DNA, 20 bp, Homo sapiens
agaggttgggcttccatgcc

SEQ ID NO: 3695225 - DNA, 21 bp, Homo sapiens
agagtaaaggaaataagagca

SEQ ID NO: 3695226 - DNA, 13 bp, Homo sapiens
agagtctgaacag

SEQ ID NO: 3695227 - DNA, 16 bp, Homo sapiens
agagtctgaacagctg

SEQ ID NO: 3695228 - DNA, 21 bp, Homo sapiens
agagtgacacccaagagggct

SEQ ID NO: 3695229 - DNA, 23 bp, Homo sapiens
agagtgacacccaagagggctgc

SEQ ID NO: 3695230 - DNA, 20 bp, Homo sapiens
agagtgatagtcttttgctt

SEQ ID NO: 3695231 - DNA, 14 bp, Homo sapiens
agagtggcctggcc

SEQ ID NO: 3695232 - DNA, 19 bp, Homo sapiens
agagtggggatatgattta

SEQ ID NO: 3695233 - DNA, 22 bp, Homo sapiens
agagtgtcttcacggcaggaca

SEQ ID NO: 3695234 - DNA, 14 bp, Homo sapiens
agagtgtgcctgaa

SEQ ID NO: 3695235 - DNA, 13 bp, Homo sapiens
agagtttcctgaa

SEQ ID NO: 3695236 - DNA, 17 bp, Homo sapiens
agataacccttattcca

SEQ ID NO: 3695237 - DNA, 18 bp, Homo sapiens
agataacccttattccat

SEQ ID NO: 3695238 - DNA, 14 bp, Homo sapiens
agatacatacagaa

SEQ ID NO: 3695239 - DNA, 21 bp, Homo sapiens
agataccttgaaaggcaggaa

SEQ ID NO: 3695240 - DNA, 13 bp, Homo sapiens
agatcagcctggg

SEQ ID NO: 3695241 - DNA, 12 bp, Homo sapiens
agatccaggact

SEQ ID NO: 3695242 - DNA, 13 bp, Homo sapiens
agatccaggacta

SEQ ID NO: 3695243 - DNA, 22 bp, Homo sapiens
agatccagggacagaggcccca

SEQ ID NO: 3695244 - DNA, 15 bp, Homo sapiens
agctgggaaggttcc

SEQ ID NO: 3695245 - DNA, 17 bp, Homo sapiens
agctgggatgtttctgt

SEQ ID NO: 3695246 - DNA, 17 bp, Homo sapiens
agctgggattacaggtg

SEQ ID NO: 3695247 - DNA, 18 bp, Homo sapiens
agctgggggtgggccagg

SEQ ID NO: 3695248 - DNA, 19 bp, Homo sapiens
agctgggggtgggccaggc

SEQ ID NO: 3695249 - DNA, 21 bp, Homo sapiens
agctgggggtgggccaggctg

SEQ ID NO: 3695250 - DNA, 20 bp, Homo sapiens
agctgggtaatcgatggggg

SEQ ID NO: 3695251 - DNA, 11 bp, Homo sapiens
agctgtagtgg

SEQ ID NO: 3695252 - DNA, 20 bp, Homo sapiens
agctgtgctgggaagcccgg

SEQ ID NO: 3695253 - DNA, 15 bp, Homo sapiens
agctgtgtctgagcc

SEQ ID NO: 3695254 - DNA, 16 bp, Homo sapiens
agctgttcctgttcag

SEQ ID NO: 3695255 - DNA, 19 bp, Homo sapiens
agctgtttatggcctcagc

SEQ ID NO: 3695256 - DNA, 15 bp, Homo sapiens
agcttagtcctggga

SEQ ID NO: 3695257 - DNA, 20 bp, Homo sapiens
agcttagtcctgggagagga

SEQ ID NO: 3695258 - DNA, 13 bp, Homo sapiens
agcttagtgagca

SEQ ID NO: 3695259 - DNA, 12 bp, Homo sapiens
agcttatctcag

SEQ ID NO: 3695260 - DNA, 15 bp, Homo sapiens
agcttatctcagggg

SEQ ID NO: 3695261 - DNA, 17 bp, Homo sapiens
agcttatttttctgtga

SEQ ID NO: 3695262 - DNA, 17 bp, Homo sapiens
agcttcccctctctcct

SEQ ID NO: 3695263 - DNA, 20 bp, Homo sapiens
agcttctcctgaccagggca

SEQ ID NO: 3695264 - DNA, 21 bp, Homo sapiens
agcttctggaatttgttcaag

SEQ ID NO: 3695265 - DNA, 16 bp, Homo sapiens
agcttgaaagttttca

SEQ ID NO: 3695266 - DNA, 17 bp, Homo sapiens
agcttgaaagttttcag

SEQ ID NO: 3695267 - DNA, 14 bp, Homo sapiens
agcttgacctgagg

SEQ ID NO: 3695268 - DNA, 16 bp, Homo sapiens
agcttgacctgaggct

SEQ ID NO: 3695269 - DNA, 12 bp, Homo sapiens
agctttcctgcc

SEQ ID NO: 3695270 - DNA, 13 bp, Homo sapiens
agctttcctgccc

SEQ ID NO: 3695271 - DNA, 14 bp, Homo sapiens
agctttcctgcccc

SEQ ID NO: 3695272 - DNA, 15 bp, Homo sapiens
agctttcctgcccca

SEQ ID NO: 3695273 - DNA, 20 bp, Homo sapiens
agctttcctggtccctcacc

SEQ ID NO: 3695274 - DNA, 12 bp, Homo sapiens
agctttgaaaat

SEQ ID NO: 3695275 - DNA, 15 bp, Homo sapiens
agctttgaggaacat

SEQ ID NO: 3695276 - DNA, 17 bp, Homo sapiens
agctttgaggaacatgc

SEQ ID NO: 3695277 - DNA, 23 bp, Homo sapiens
agctttgtttgttgtcagctgaa

SEQ ID NO: 3695278 - DNA, 21 bp, Homo sapiens
aggaaaggccagctggcagca

SEQ ID NO: 3695279 - DNA, 22 bp, Homo sapiens
aggaaaggccagctggcagcag

SEQ ID NO: 3695280 - DNA, 19 bp, Homo sapiens
aggaaattcagcccaccag

SEQ ID NO: 3695281 - DNA, 17 bp, Homo sapiens
aggaaccacaccacatc

SEQ ID NO: 3695282 - DNA, 18 bp, Homo sapiens
aggaagcaccccatgcca

SEQ ID NO: 3695283 - DNA, 18 bp, Homo sapiens
aggaagccacagctggtg

SEQ ID NO: 3695284 - DNA, 20 bp, Homo sapiens
aggaagctcagactggttga

SEQ ID NO: 3695285 - DNA, 17 bp, Homo sapiens
aggaagctgctccgtgc

SEQ ID NO: 3695286 - DNA, 23 bp, Homo sapiens
aggaagctttggtgagaacctgg

SEQ ID NO: 3695287 - DNA, 18 bp, Homo sapiens
aggaaggagagcctgctg

SEQ ID NO: 3695288 - DNA, 22 bp, Homo sapiens
aggaaggctgagaggagagaga

SEQ ID NO: 3695289 - DNA, 17 bp, Homo sapiens
aggaagggcaggaagga

SEQ ID NO: 3695290 - DNA, 22 bp, Homo sapiens
aggaaggggtgctgtgaggctt

SEQ ID NO: 3695291 - DNA, 16 bp, Homo sapiens
aggaagggtggctttg

SEQ ID NO: 3695292 - DNA, 21 bp, Homo sapiens
aggaagtgttgaagggaggtg

SEQ ID NO: 3695293 - DNA, 23 bp, Homo sapiens
aggaatcccggctccagagcagg

SEQ ID NO: 3695294 - DNA, 18 bp, Homo sapiens
aggaatcctagcacttgt

SEQ ID NO: 3695295 - DNA, 22 bp, Homo sapiens
aggaatctttaaaagatgcttt

SEQ ID NO: 3695296 - DNA, 22 bp, Homo sapiens
aggaatgttttgtagctctagg

SEQ ID NO: 3695297 - DNA, 23 bp, Homo sapiens
aggaattaagttagggaatggca

SEQ ID NO: 3695298 - DNA, 18 bp, Homo sapiens
aggacagtctggagaagg

SEQ ID NO: 3695299 - DNA, 19 bp, Homo sapiens
aggacagtctggagaaggt

SEQ ID NO: 3695300 - DNA, 17 bp, Homo sapiens
aggaccaagcatcttgg

SEQ ID NO: 3695301 - DNA, 18 bp, Homo sapiens
aggaccagctcaggacag

SEQ ID NO: 3695302 - DNA, 13 bp, Homo sapiens
aggaccaggactc

SEQ ID NO: 3695303 - DNA, 21 bp, Homo sapiens
aggaccaggactccctcctca

SEQ ID NO: 3695304 - DNA, 15 bp, Homo sapiens
aggaccagggccttt

SEQ ID NO: 3695305 - DNA, 14 bp, Homo sapiens
aggactccctcctc

SEQ ID NO: 3695306 - DNA, 17 bp, Homo sapiens
aggactccctcctcacc

SEQ ID NO: 3695307 - DNA, 19 bp, Homo sapiens
aggactccctcctcacctc

SEQ ID NO: 3695308 - DNA, 20 bp, Homo sapiens
aggacttgttaaagagcact

SEQ ID NO: 3695309 - DNA, 20 bp, Homo sapiens
aggagaatcgcttgaaccca

SEQ ID NO: 3695310 - DNA, 20 bp, Homo sapiens
aggagaatggtgtgaacccg

SEQ ID NO: 3695311 - DNA, 20 bp, Homo sapiens
aggagaattgcttgaacctg

SEQ ID NO: 3695312 - DNA, 14 bp, Homo sapiens
aggagagcctgctg

SEQ ID NO: 3695313 - DNA, 15 bp, Homo sapiens
aggagaggagagggg

SEQ ID NO: 3695314 - DNA, 16 bp, Homo sapiens
aggagaggggcacagg

SEQ ID NO: 3695315 - DNA, 20 bp, Homo sapiens
aggagcaagtgaggccggag

SEQ ID NO: 3695316 - DNA, 17 bp, Homo sapiens
aggagcaccctgtcttc

SEQ ID NO: 3695317 - DNA, 18 bp, Homo sapiens
aggagcaccctgtcttct

SEQ ID NO: 3695318 - DNA, 21 bp, Homo sapiens
aggagctcttcaggcctccct

SEQ ID NO: 3695319 - DNA, 16 bp, Homo sapiens
aggagctgcagttctt

SEQ ID NO: 3695320 - DNA, 21 bp, Homo sapiens
aggagctgctatagcctgggg

SEQ ID NO: 3695321 - DNA, 14 bp, Homo sapiens
aggagctgctggct

SEQ ID NO: 3695322 - DNA, 16 bp, Homo sapiens
aggagctgctggcttg

SEQ ID NO: 3695323 - DNA, 17 bp, Homo sapiens
aggagctgctggcttgc

SEQ ID NO: 3695324 - DNA, 18 bp, Homo sapiens
aggagctgggatcctaag

SEQ ID NO: 3695325 - DNA, 21 bp, Homo sapiens
aggagctggggatccctcccc

SEQ ID NO: 3695326 - DNA, 12 bp, Homo sapiens
aggaggcggggc

SEQ ID NO: 3695327 - DNA, 18 bp, Homo sapiens
aggaggcggggctctagg

SEQ ID NO: 3695328 - DNA, 15 bp, Homo sapiens
aggagggagggggct

SEQ ID NO: 3695329 - DNA, 19 bp, Homo sapiens
aggaggggaaaaaaatgtt

SEQ ID NO: 3695330 - DNA, 13 bp, Homo sapiens
aggaggggccgct

SEQ ID NO: 3695331 - DNA, 20 bp, Homo sapiens
aggaggtgtgaggaggaggc

SEQ ID NO: 3695332 - DNA, 14 bp, Homo sapiens
aggatagagactgg

SEQ ID NO: 3695333 - DNA, 14 bp, Homo sapiens
aggatagatgctgg

SEQ ID NO: 3695334 - DNA, 18 bp, Homo sapiens
aggatagatgctggccca

SEQ ID NO: 3695335 - DNA, 23 bp, Homo sapiens
aggatagctaactgtaaatcatg

SEQ ID NO: 3695336 - DNA, 22 bp, Homo sapiens
aggatattttggggggcagaga

SEQ ID NO: 3695337 - DNA, 13 bp, Homo sapiens
aggatcagttttt

SEQ ID NO: 3695338 - DNA, 16 bp, Homo sapiens
aggatctccttttttc

SEQ ID NO: 3695339 - DNA, 18 bp, Homo sapiens
aggatctcttgagcctgg

SEQ ID NO: 3695340 - DNA, 22 bp, Homo sapiens
aggatctcttgagcctgggagg

SEQ ID NO: 3695341 - DNA, 18 bp, Homo sapiens
aggatcttttgaacccag

SEQ ID NO: 3695342 - DNA, 18 bp, Homo sapiens
aggatggggaggggctct

SEQ ID NO: 3695343 - DNA, 20 bp, Homo sapiens
aggatggggcacggctctgg

SEQ ID NO: 3695344 - DNA, 23 bp, Homo sapiens
aggatgtaataaagaattttatt

SEQ ID NO: 3695345 - DNA, 17 bp, Homo sapiens
aggatgtgtttgctttc

SEQ ID NO: 3695346 - DNA, 19 bp, Homo sapiens
aggatgtgtttgctttctg

SEQ ID NO: 3695347 - DNA, 13 bp, Homo sapiens
aggattttatacc

SEQ ID NO: 3695348 - DNA, 21 bp, Homo sapiens
aggattttttttaatgtttaa

SEQ ID NO: 3695349 - DNA, 17 bp, Homo sapiens
aggcaactcatcttagg

SEQ ID NO: 3695350 - DNA, 16 bp, Homo sapiens
aggcagatctgtgccc

SEQ ID NO: 3695351 - DNA, 20 bp, Homo sapiens
aggcagatctgtgccccatg

SEQ ID NO: 3695352 - DNA, 23 bp, Homo sapiens
aggcagatctgtgccccatgcct

SEQ ID NO: 3695353 - DNA, 19 bp, Homo sapiens
aggcagcgtgccgagccag

SEQ ID NO: 3695354 - DNA, 21 bp, Homo sapiens
aggcagcgtgccgagccagca

SEQ ID NO: 3695355 - DNA, 14 bp, Homo sapiens
aggcagctggcagg

SEQ ID NO: 3695356 - DNA, 15 bp, Homo sapiens
aggcagctggcagga

SEQ ID NO: 3695357 - DNA, 12 bp, Homo sapiens
aggcagctgtgt

SEQ ID NO: 3695358 - DNA, 14 bp, Homo sapiens
aggcagctgtgtct

SEQ ID NO: 3695359 - DNA, 17 bp, Homo sapiens
aggcagctgtgtctgag

SEQ ID NO: 3695360 - DNA, 19 bp, Homo sapiens
agggcaggtccagctctgt

SEQ ID NO: 3695361 - DNA, 24 bp, Homo sapiens
agggcaggtccagctctgtgggcc

SEQ ID NO: 3695362 - DNA, 11 bp, Homo sapiens
agggccagagc

SEQ ID NO: 3695363 - DNA, 15 bp, Homo sapiens
agggccagagccagg

SEQ ID NO: 3695364 - DNA, 13 bp, Homo sapiens
agggccagtcctg

SEQ ID NO: 3695365 - DNA, 22 bp, Homo sapiens
agggccagtcctgcctggccag

SEQ ID NO: 3695366 - DNA, 19 bp, Homo sapiens
agggccatgctgaggcctg

SEQ ID NO: 3695367 - DNA, 21 bp, Homo sapiens
agggccatgctgaggcctggg

SEQ ID NO: 3695368 - DNA, 22 bp, Homo sapiens
agggccatgctgaggcctgggc

SEQ ID NO: 3695369 - DNA, 13 bp, Homo sapiens
agggcccagagcc

SEQ ID NO: 3695370 - DNA, 18 bp, Homo sapiens
agggcccagagcccagct

SEQ ID NO: 3695371 - DNA, 19 bp, Homo sapiens
agggccttttctggcaccg

SEQ ID NO: 3695372 - DNA, 20 bp, Homo sapiens
agggccttttctggcaccgc

SEQ ID NO: 3695373 - DNA, 14 bp, Homo sapiens
agggcggagcgcct

SEQ ID NO: 3695374 - DNA, 15 bp, Homo sapiens
agggcggcaggggcc

SEQ ID NO: 3695375 - DNA, 15 bp, Homo sapiens
agggcgtggctctgg

SEQ ID NO: 3695376 - DNA, 20 bp, Homo sapiens
agggcgtggctctgggtggg

SEQ ID NO: 3695377 - DNA, 15 bp, Homo sapiens
agggctcctccctgg

SEQ ID NO: 3695378 - DNA, 13 bp, Homo sapiens
agggcttctcctg

SEQ ID NO: 3695379 - DNA, 15 bp, Homo sapiens
agggcttctcctgcg

SEQ ID NO: 3695380 - DNA, 18 bp, Homo sapiens
aggggacgtgagagaagg

SEQ ID NO: 3695381 - DNA, 24 bp, Homo sapiens
aggggagcatgcttccctgcagct

SEQ ID NO: 3695382 - DNA, 13 bp, Homo sapiens
aggggagcccact

SEQ ID NO: 3695383 - DNA, 17 bp, Homo sapiens
aggggagcccactgtcc

SEQ ID NO: 3695384 - DNA, 18 bp, Homo sapiens
aggggaggccagaggaga

SEQ ID NO: 3695385 - DNA, 15 bp, Homo sapiens
aggggcatctgcccc

SEQ ID NO: 3695386 - DNA, 16 bp, Homo sapiens
aggggcatctgcccct

SEQ ID NO: 3695387 - DNA, 22 bp, Homo sapiens
aggggcatctgcccctccccca

SEQ ID NO: 3695388 - DNA, 14 bp, Homo sapiens
aggggcccgtggga

SEQ ID NO: 3695389 - DNA, 14 bp, Homo sapiens
aggggccctacctg

SEQ ID NO: 3695390 - DNA, 17 bp, Homo sapiens
aggggccgctgccaccc

SEQ ID NO: 3695391 - DNA, 22 bp, Homo sapiens
aggggccgctgccacccacctc

SEQ ID NO: 3695392 - DNA, 14 bp, Homo sapiens
aggggcctggagat

SEQ ID NO: 3695393 - DNA, 21 bp, Homo sapiens
aggggcgtctgttcccccttc

SEQ ID NO: 3695394 - DNA, 22 bp, Homo sapiens
aggggctgctgacctccacagc

SEQ ID NO: 3695395 - DNA, 16 bp, Homo sapiens
aggggctgcttcctcc

SEQ ID NO: 3695396 - DNA, 20 bp, Homo sapiens
agggggatccgactgctttg

SEQ ID NO: 3695397 - DNA, 20 bp, Homo sapiens
aggggtcagtgcagcagagg

SEQ ID NO: 3695398 - DNA, 17 bp, Homo sapiens
aggggtgctgtgaggct

SEQ ID NO: 3695399 - DNA, 21 bp, Homo sapiens
aggggttaacttggtcagagc

SEQ ID NO: 3695400 - DNA, 22 bp, Homo sapiens
aggggttggtatctcaggtctg

SEQ ID NO: 3695401 - DNA, 15 bp, Homo sapiens
agggtccctctgtgt

SEQ ID NO: 3695402 - DNA, 20 bp, Homo sapiens
agggtccctctgtgtatttg

SEQ ID NO: 3695403 - DNA, 16 bp, Homo sapiens
agggtcctgctttctc

SEQ ID NO: 3695404 - DNA, 16 bp, Homo sapiens
agggtcctggctcctg

SEQ ID NO: 3695405 - DNA, 18 bp, Homo sapiens
agggtgagaggaagggtg

SEQ ID NO: 3695406 - DNA, 18 bp, Homo sapiens
agggtggcccttgcagtt

SEQ ID NO: 3695407 - DNA, 21 bp, Homo sapiens
agggtggctgggtccagggga

SEQ ID NO: 3695408 - DNA, 12 bp, Homo sapiens
agggtggctttg

SEQ ID NO: 3695409 - DNA, 15 bp, Homo sapiens
agggtggctttgcat

SEQ ID NO: 3695410 - DNA, 22 bp, Homo sapiens
agggtgtccggtccctgtccca

SEQ ID NO: 3695411 - DNA, 15 bp, Homo sapiens
agggttgggcccaga

SEQ ID NO: 3695412 - DNA, 14 bp, Homo sapiens
agggtttgtggctg

SEQ ID NO: 3695413 - DNA, 12 bp, Homo sapiens
aggtaccctggg

SEQ ID NO: 3695414 - DNA, 20 bp, Homo sapiens
aggtaccctgggtgtccccg

SEQ ID NO: 3695415 - DNA, 14 bp, Homo sapiens
aggtactcctgcca

SEQ ID NO: 3695416 - DNA, 22 bp, Homo sapiens
aggtactcctgccagggaactg

SEQ ID NO: 3695417 - DNA, 19 bp, Homo sapiens
aggtagctgcccctggctc

SEQ ID NO: 3695418 - DNA, 18 bp, Homo sapiens
aggtcaatacagtacagg

SEQ ID NO: 3695419 - DNA, 14 bp, Homo sapiens
aggtccaaatgttt

SEQ ID NO: 3695420 - DNA, 16 bp, Homo sapiens
aggtccagctctggag

SEQ ID NO: 3695421 - DNA, 14 bp, Homo sapiens
aggtccagctctgt

SEQ ID NO: 3695422 - DNA, 15 bp, Homo sapiens
aggtccagctctgtg

SEQ ID NO: 3695423 - DNA, 16 bp, Homo sapiens
aggtccagctctgtgg

SEQ ID NO: 3695424 - DNA, 18 bp, Homo sapiens
aggtccagctctgtgggc

SEQ ID NO: 3695425 - DNA, 14 bp, Homo sapiens
aggtcccacagccc

SEQ ID NO: 3695426 - DNA, 21 bp, Homo sapiens
aggtctccagttggctttact

SEQ ID NO: 3695427 - DNA, 18 bp, Homo sapiens
aggtcttgctggaagaca

SEQ ID NO: 3695428 - DNA, 19 bp, Homo sapiens
aggtcttgctggaagacag

SEQ ID NO: 3695429 - DNA, 11 bp, Homo sapiens
aggtctttcct

SEQ ID NO: 3695430 - DNA, 18 bp, Homo sapiens
aggtcttttctagtctga

SEQ ID NO: 3695431 - DNA, 21 bp, Homo sapiens
aggtgaaagggagctatcagg

SEQ ID NO: 3695432 - DNA, 12 bp, Homo sapiens
aggtgcagaggt

SEQ ID NO: 3695433 - DNA, 21 bp, Homo sapiens
aggtgcagaggtaccctgggt

SEQ ID NO: 3695434 - DNA, 15 bp, Homo sapiens
aggtgcctttcaaat

SEQ ID NO: 3695435 - DNA, 17 bp, Homo sapiens
aggtgctgacggccagg

SEQ ID NO: 3695436 - DNA, 23 bp, Homo sapiens
aggtgctgatgtcaaagtgtaac

SEQ ID NO: 3695437 - DNA, 16 bp, Homo sapiens
aggtggactggaaggg

SEQ ID NO: 3695438 - DNA, 15 bp, Homo sapiens
aggtggatggcccca

SEQ ID NO: 3695439 - DNA, 23 bp, Homo sapiens
aggtggatggccccagcacagct

SEQ ID NO: 3695440 - DNA, 14 bp, Homo sapiens
aggtggctgagccc

SEQ ID NO: 3695441 - DNA, 17 bp, Homo sapiens
aggtggctgagcccctg

SEQ ID NO: 3695442 - DNA, 12 bp, Homo sapiens
aggtgggaggat

SEQ ID NO: 3695443 - DNA, 13 bp, Homo sapiens
aggtggggagtca

SEQ ID NO: 3695444 - DNA, 13 bp, Homo sapiens
aggtgtgaggagg

SEQ ID NO: 3695445 - DNA, 14 bp, Homo sapiens
aggtgtgcccctcc

SEQ ID NO: 3695446 - DNA, 19 bp, Homo sapiens
aggtgtgcccctccaagtc

SEQ ID NO: 3695447 - DNA, 20 bp, Homo sapiens
aggtgtggagccgaggccta

SEQ ID NO: 3695448 - DNA, 16 bp, Homo sapiens
aggtgtggaggctcct

SEQ ID NO: 3695449 - DNA, 17 bp, Homo sapiens
aggtgtggaggctcctg

SEQ ID NO: 3695450 - DNA, 18 bp, Homo sapiens
aggtgtggaggctcctgt

SEQ ID NO: 3695451 - DNA, 19 bp, Homo sapiens
aggtgtggaggctcctgtg

SEQ ID NO: 3695452 - DNA, 21 bp, Homo sapiens
aggtgtggaggctcctgtggt

SEQ ID NO: 3695453 - DNA, 15 bp, Homo sapiens
aggtgttgtcccttc

SEQ ID NO: 3695454 - DNA, 16 bp, Homo sapiens
aggtgttgtcccttct

SEQ ID NO: 3695455 - DNA, 16 bp, Homo sapiens
aggttaaggctgagga

SEQ ID NO: 3695456 - DNA, 19 bp, Homo sapiens
aggttcacctgcagcgagt

SEQ ID NO: 3695457 - DNA, 19 bp, Homo sapiens
aggttcagccaaggtttta

SEQ ID NO: 3695458 - DNA, 16 bp, Homo sapiens
aggttccatcctttac

SEQ ID NO: 3695459 - DNA, 18 bp, Homo sapiens
aggttccgtatctccctg

SEQ ID NO: 3695460 - DNA, 19 bp, Homo sapiens
aggttctccgttagctcct

SEQ ID NO: 3695461 - DNA, 14 bp, Homo sapiens
aggttctgcctgct

SEQ ID NO: 3695462 - DNA, 19 bp, Homo sapiens
aggttgggcttccatgcct

SEQ ID NO: 3695463 - DNA, 15 bp, Homo sapiens
aggtttctgaaaatt

SEQ ID NO: 3695464 - DNA, 23 bp, Homo sapiens
aggtttgtcgggcaccagccagc

SEQ ID NO: 3695465 - DNA, 17 bp, Homo sapiens
aggttttataaggctga

SEQ ID NO: 3695466 - DNA, 13 bp, Homo sapiens
agtaaaaatacaa

SEQ ID NO: 3695467 - DNA, 19 bp, Homo sapiens
agtaaaaatacaaaaatta

SEQ ID NO: 3695468 - DNA, 10 bp, Homo sapiens
agtaaatgtt

SEQ ID NO: 3695469 - DNA, 18 bp, Homo sapiens
agtaacaattcagatcca

SEQ ID NO: 3695470 - DNA, 18 bp, Homo sapiens
agtaacgcgtcttcctga

SEQ ID NO: 3695471 - DNA, 17 bp, Homo sapiens
agtaactgtcaggctga

SEQ ID NO: 3695472 - DNA, 17 bp, Homo sapiens
agtaagaaatttgcagt

SEQ ID NO: 3695473 - DNA, 20 bp, Homo sapiens
agtaagccgtgattttcatt

SEQ ID NO: 3695474 - DNA, 18 bp, Homo sapiens
agtaattaatatctcctg

SEQ ID NO: 3695475 - DNA, 14 bp, Homo sapiens
agtacaggcagcac

SEQ ID NO: 3695476 - DNA, 18 bp, Homo sapiens
agtacaggcagcacagag

SEQ ID NO: 3695477 - DNA, 16 bp, Homo sapiens
aagagaggtccagccc

SEQ ID NO: 3695478 - DNA, 16 bp, Homo sapiens
aagagattgtggtttc

SEQ ID NO: 3695479 - DNA, 19 bp, Homo sapiens
aagagcaatgtgtggctga

SEQ ID NO: 3695480 - DNA, 13 bp, Homo sapiens
aagagcagcctgt

SEQ ID NO: 3695481 - DNA, 14 bp, Homo sapiens
aagagcagcctgtg

SEQ ID NO: 3695482 - DNA, 18 bp, Homo sapiens
aagagcagcctgtggcat

SEQ ID NO: 3695483 - DNA, 19 bp, Homo sapiens
aagagcagcctgtggcatc

SEQ ID NO: 3695484 - DNA, 14 bp, Homo sapiens
aagaggcaagaggc

SEQ ID NO: 3695485 - DNA, 21 bp, Homo sapiens
aagaggcccgccctgcccggg

SEQ ID NO: 3695486 - DNA, 16 bp, Homo sapiens
aagagggcacaccgcc

SEQ ID NO: 3695487 - DNA, 22 bp, Homo sapiens
aagagggttttaggtagaaaaa

SEQ ID NO: 3695488 - DNA, 22 bp, Homo sapiens
aagaggttgggcttccatgcct

SEQ ID NO: 3695489 - DNA, 23 bp, Homo sapiens
aagagtgatagtcttttgctttt

SEQ ID NO: 3695490 - DNA, 17 bp, Homo sapiens
aagatctgtcctcagcc

SEQ ID NO: 3695491 - DNA, 18 bp, Homo sapiens
aagatctgtcctcagcct

SEQ ID NO: 3695492 - DNA, 12 bp, Homo sapiens
aagatgctttta

SEQ ID NO: 3695493 - DNA, 14 bp, Homo sapiens
aagatgtaaattga

SEQ ID NO: 3695494 - DNA, 18 bp, Homo sapiens
aagatttgtgaactggaa

SEQ ID NO: 3695495 - DNA, 20 bp, Homo sapiens
aagatttgtgaactggaaga

SEQ ID NO: 3695496 - DNA, 22 bp, Homo sapiens
aagatttgtgaactggaagaaa

SEQ ID NO: 3695497 - DNA, 11 bp, Homo sapiens
aagcaaaagaa

SEQ ID NO: 3695498 - DNA, 14 bp, Homo sapiens
aagcaaaaggctga

SEQ ID NO: 3695499 - DNA, 18 bp, Homo sapiens
aagcaaaaggctgagaag

SEQ ID NO: 3695500 - DNA, 21 bp, Homo sapiens
aagcaaaaggctgagaaggaa

SEQ ID NO: 3695501 - DNA, 14 bp, Homo sapiens
aagcaccccatgcc

SEQ ID NO: 3695502 - DNA, 19 bp, Homo sapiens
aagcactacaccttgcctt

SEQ ID NO: 3695503 - DNA, 20 bp, Homo sapiens
aagcagaggaggggccgctg

SEQ ID NO: 3695504 - DNA, 14 bp, Homo sapiens
aagcagatgcaaag

SEQ ID NO: 3695505 - DNA, 16 bp, Homo sapiens
aagcagctaaattttc

SEQ ID NO: 3695506 - DNA, 11 bp, Homo sapiens
aagcaggaagc

SEQ ID NO: 3695507 - DNA, 13 bp, Homo sapiens
aagcaggaagctc

SEQ ID NO: 3695508 - DNA, 16 bp, Homo sapiens
aagcaggaagctcaga

SEQ ID NO: 3695509 - DNA, 17 bp, Homo sapiens
aagcataaaaacatttt

SEQ ID NO: 3695510 - DNA, 23 bp, Homo sapiens
aagcatgaataacatttaaattc

SEQ ID NO: 3695511 - DNA, 14 bp, Homo sapiens
aagccaagcagcca

SEQ ID NO: 3695512 - DNA, 16 bp, Homo sapiens
aagccaagcagccaag

SEQ ID NO: 3695513 - DNA, 17 bp, Homo sapiens
aagccaagcagccaagc

SEQ ID NO: 3695514 - DNA, 13 bp, Homo sapiens
aagccagaagctg

SEQ ID NO: 3695515 - DNA, 15 bp, Homo sapiens
aagccagaggctggg

SEQ ID NO: 3695516 - DNA, 16 bp, Homo sapiens
aagccagaggctgggt

SEQ ID NO: 3695517 - DNA, 17 bp, Homo sapiens
aagccagttagtaaact

SEQ ID NO: 3695518 - DNA, 21 bp, Homo sapiens
aagccagttagtaaacttcct

SEQ ID NO: 3695519 - DNA, 16 bp, Homo sapiens
aagccccacatgtcca

SEQ ID NO: 3695520 - DNA, 23 bp, Homo sapiens
aagcccccagctaagaacctgga

SEQ ID NO: 3695521 - DNA, 21 bp, Homo sapiens
aagccccgtctgaccccagcc

SEQ ID NO: 3695522 - DNA, 19 bp, Homo sapiens
aagccctgagctttctgct

SEQ ID NO: 3695523 - DNA, 22 bp, Homo sapiens
aagccctgttgacacaggtctt

SEQ ID NO: 3695524 - DNA, 15 bp, Homo sapiens
aagcctcctccagcc

SEQ ID NO: 3695525 - DNA, 19 bp, Homo sapiens
aagcctcctccagccgcca

SEQ ID NO: 3695526 - DNA, 14 bp, Homo sapiens
aagcctctggctag

SEQ ID NO: 3695527 - DNA, 17 bp, Homo sapiens
aagcctgaagggcctcc

SEQ ID NO: 3695528 - DNA, 20 bp, Homo sapiens
aagcctgaagggcctcccag

SEQ ID NO: 3695529 - DNA, 19 bp, Homo sapiens
aagcggccaggcggggcgc

SEQ ID NO: 3695530 - DNA, 17 bp, Homo sapiens
aagctaagatgggtgga

SEQ ID NO: 3695531 - DNA, 19 bp, Homo sapiens
aagctagggtggcccttgc

SEQ ID NO: 3695532 - DNA, 22 bp, Homo sapiens
aagctagggtggcccttgcagt

SEQ ID NO: 3695533 - DNA, 18 bp, Homo sapiens
aagctataaattcctctt

SEQ ID NO: 3695534 - DNA, 21 bp, Homo sapiens
aagctataaattcctctttgc

SEQ ID NO: 3695535 - DNA, 15 bp, Homo sapiens
aagctcctcctccct

SEQ ID NO: 3695536 - DNA, 16 bp, Homo sapiens
aagctcctctccccag

SEQ ID NO: 3695537 - DNA, 18 bp, Homo sapiens
aagctcctctccccagcc

SEQ ID NO: 3695538 - DNA, 11 bp, Homo sapiens
aagctgagcct

SEQ ID NO: 3695539 - DNA, 13 bp, Homo sapiens
aagctgcaccctc

SEQ ID NO: 3695540 - DNA, 20 bp, Homo sapiens
aagctgcaccctcaggcagg

SEQ ID NO: 3695541 - DNA, 18 bp, Homo sapiens
aagctggtctttgagcga

SEQ ID NO: 3695542 - DNA, 13 bp, Homo sapiens
aagctgtcttgga

SEQ ID NO: 3695543 - DNA, 23 bp, Homo sapiens
aagctgtcttggaagtctgtctc

SEQ ID NO: 3695544 - DNA, 21 bp, Homo sapiens
aagctttcctgccccaggcct

SEQ ID NO: 3695545 - DNA, 22 bp, Homo sapiens
aagctttcctgccccaggcctg

SEQ ID NO: 3695546 - DNA, 19 bp, Homo sapiens
aagctttggtgagaacctg

SEQ ID NO: 3695547 - DNA, 22 bp, Homo sapiens
aagctttggtgagaacctgggt

SEQ ID NO: 3695548 - DNA, 15 bp, Homo sapiens
aaggaaagatttgtg

SEQ ID NO: 3695549 - DNA, 17 bp, Homo sapiens
aaggaaagatttgtgaa

SEQ ID NO: 3695550 - DNA, 20 bp, Homo sapiens
aaggaagcactctgtatatt

SEQ ID NO: 3695551 - DNA, 22 bp, Homo sapiens
aaggaagccacagctggtggta

SEQ ID NO: 3695552 - DNA, 13 bp, Homo sapiens
aaggaccaggact

SEQ ID NO: 3695553 - DNA, 12 bp, Homo sapiens
aaggagctgcta

SEQ ID NO: 3695554 - DNA, 14 bp, Homo sapiens
aaggagctgctata

SEQ ID NO: 3695555 - DNA, 20 bp, Homo sapiens
aaggaggaagagaaaaaata

SEQ ID NO: 3695556 - DNA, 14 bp, Homo sapiens
aaggatacataatg

SEQ ID NO: 3695557 - DNA, 15 bp, Homo sapiens
aaggatagatgctgg

SEQ ID NO: 3695558 - DNA, 20 bp, Homo sapiens
aaggatagatgctggcccag

SEQ ID NO: 3695559 - DNA, 13 bp, Homo sapiens
aaggatctccttt

SEQ ID NO: 3695560 - DNA, 18 bp, Homo sapiens
aaggatctttgtggccaa

SEQ ID NO: 3695561 - DNA, 11 bp, Homo sapiens
aaggcagctgt

SEQ ID NO: 3695562 - DNA, 15 bp, Homo sapiens
aaggcaggaagggaa

SEQ ID NO: 3695563 - DNA, 22 bp, Homo sapiens
aaggcagggctcctccctggag

SEQ ID NO: 3695564 - DNA, 23 bp, Homo sapiens
aaggcagtagaactccaggccct

SEQ ID NO: 3695565 - DNA, 19 bp, Homo sapiens
aaggcatgtgtgaaacata

SEQ ID NO: 3695566 - DNA, 19 bp, Homo sapiens
aaggcgtggcttctgcagg

SEQ ID NO: 3695567 - DNA, 13 bp, Homo sapiens
aaggctaaaaagt

SEQ ID NO: 3695568 - DNA, 19 bp, Homo sapiens
aaggctgagaggagagaga

SEQ ID NO: 3695569 - DNA, 16 bp, Homo sapiens
aaggctgatgtcaatt

SEQ ID NO: 3695570 - DNA, 22 bp, Homo sapiens
aaggctggtacaacggaggcct

SEQ ID NO: 3695571 - DNA, 15 bp, Homo sapiens
aagggatctggtcct

SEQ ID NO: 3695572 - DNA, 13 bp, Homo sapiens
aagggccagagcc

SEQ ID NO: 3695573 - DNA, 14 bp, Homo sapiens
aagggccagagcca

SEQ ID NO: 3695574 - DNA, 22 bp, Homo sapiens
aagggccagtcctgcctggcca

SEQ ID NO: 3695575 - DNA, 16 bp, Homo sapiens
aagggcctcccagccc

SEQ ID NO: 3695576 - DNA, 17 bp, Homo sapiens
aagggcgtggctctggg

SEQ ID NO: 3695577 - DNA, 19 bp, Homo sapiens
aagggcgtggctctgggtg

SEQ ID NO: 3695578 - DNA, 20 bp, Homo sapiens
aagggcgtggctctgggtgg

SEQ ID NO: 3695579 - DNA, 16 bp, Homo sapiens
aaggggagcccactgt

SEQ ID NO: 3695580 - DNA, 13 bp, Homo sapiens
aaggggaggaccc

SEQ ID NO: 3695581 - DNA, 16 bp, Homo sapiens
aaggggtctgaaattt

SEQ ID NO: 3695582 - DNA, 14 bp, Homo sapiens
aaggggtgctgtga

SEQ ID NO: 3695583 - DNA, 20 bp, Homo sapiens
aagggtttgtggctgggggc

SEQ ID NO: 3695584 - DNA, 14 bp, Homo sapiens
aaggtaaaatgcca

SEQ ID NO: 3695585 - DNA, 13 bp, Homo sapiens
aaggtaggaagag

SEQ ID NO: 3695586 - DNA, 14 bp, Homo sapiens
aaggtcccacagcc

SEQ ID NO: 3695587 - DNA, 19 bp, Homo sapiens
aaggtcccacagccctgag

SEQ ID NO: 3695588 - DNA, 20 bp, Homo sapiens
aaggtcccacagccctgaga

SEQ ID NO: 3695589 - DNA, 12 bp, Homo sapiens
aaggtctttcag

SEQ ID NO: 3695590 - DNA, 18 bp, Homo sapiens
aaggtctttcagtacttt

SEQ ID NO: 3695591 - DNA, 19 bp, Homo sapiens
aaggtgatttcagactgca

SEQ ID NO: 3695592 - DNA, 20 bp, Homo sapiens
aaggtggactggaaggggcc

SEQ ID NO: 3695593 - DNA, 15 bp, Homo sapiens
aaggtggtgtttctg

SEQ ID NO: 3695594 - DNA, 17 bp, Homo sapiens
acaatgtgaaaagaaaa

SEQ ID NO: 3695595 - DNA, 21 bp, Homo sapiens
acaattaggcagactctttat

SEQ ID NO: 3695596 - DNA, 20 bp, Homo sapiens
acaatttaaagcaaaggagt

SEQ ID NO: 3695597 - DNA, 18 bp, Homo sapiens
acacaaacgggctcagca

SEQ ID NO: 3695598 - DNA, 16 bp, Homo sapiens
acacaatggtttttaa

SEQ ID NO: 3695599 - DNA, 12 bp, Homo sapiens
acacacacacac

SEQ ID NO: 3695600 - DNA, 13 bp, Homo sapiens
acacacacacaca

SEQ ID NO: 3695601 - DNA, 15 bp, Homo sapiens
acacacacacacaca

SEQ ID NO: 3695602 - DNA, 16 bp, Homo sapiens
acacagatacacacac

SEQ ID NO: 3695603 - DNA, 17 bp, Homo sapiens
acacagatacacacaca

SEQ ID NO: 3695604 - DNA, 22 bp, Homo sapiens
acacagcacttcaaagaagctg

SEQ ID NO: 3695605 - DNA, 14 bp, Homo sapiens
acacaggtctttcc

SEQ ID NO: 3695606 - DNA, 16 bp, Homo sapiens
acacaggtctttccta

SEQ ID NO: 3695607 - DNA, 11 bp, Homo sapiens
acacatttcac

SEQ ID NO: 3695608 - DNA, 14 bp, Homo sapiens
acaccagcattcct

SEQ ID NO: 3695609 - DNA, 13 bp, Homo sapiens
acaccattttgta

SEQ ID NO: 3695610 - DNA, 17 bp, Homo sapiens
acacccaagagggctgc

SEQ ID NO: 3695611 - DNA, 23 bp, Homo sapiens
acacctcagttcccttggcctca

SEQ ID NO: 3695612 - DNA, 18 bp, Homo sapiens
acacctctgcacaagctg

SEQ ID NO: 3695613 - DNA, 21 bp, Homo sapiens
acacctctgcacaagctgcac

SEQ ID NO: 3695614 - DNA, 20 bp, Homo sapiens
acacctgtagcacttactgg

SEQ ID NO: 3695615 - DNA, 20 bp, Homo sapiens
acaccttggacatcctcctc

SEQ ID NO: 3695616 - DNA, 22 bp, Homo sapiens
acaccttggacatcctcctccc

SEQ ID NO: 3695617 - DNA, 23 bp, Homo sapiens
acaccttggacatcctcctccca

SEQ ID NO: 3695618 - DNA, 22 bp, Homo sapiens
acaccttggcttgttattgcct

SEQ ID NO: 3695619 - DNA, 23 bp, Homo sapiens
acacgcgggcgcgatcccacaca

SEQ ID NO: 3695620 - DNA, 16 bp, Homo sapiens
acactagacaagccag

SEQ ID NO: 3695621 - DNA, 15 bp, Homo sapiens
acactatagagaacc

SEQ ID NO: 3695622 - DNA, 15 bp, Homo sapiens
acactcaaaagctgg

SEQ ID NO: 3695623 - DNA, 17 bp, Homo sapiens
acactgaccatccactc

SEQ ID NO: 3695624 - DNA, 14 bp, Homo sapiens
acactgaggcaggg

SEQ ID NO: 3695625 - DNA, 16 bp, Homo sapiens
acactgaggcagggaa

SEQ ID NO: 3695626 - DNA, 17 bp, Homo sapiens
acactgaggcagggaag

SEQ ID NO: 3695627 - DNA, 13 bp, Homo sapiens
acactgtcttgaa

SEQ ID NO: 3695628 - DNA, 14 bp, Homo sapiens
acacttatcttctg

SEQ ID NO: 3695629 - DNA, 23 bp, Homo sapiens
acacttctgtgagacccccacac

SEQ ID NO: 3695630 - DNA, 13 bp, Homo sapiens
acacttgctgagt

SEQ ID NO: 3695631 - DNA, 14 bp, Homo sapiens
acacttggtaattg

SEQ ID NO: 3695632 - DNA, 19 bp, Homo sapiens
acagaaaaatatgtaccaa

SEQ ID NO: 3695633 - DNA, 16 bp, Homo sapiens
acagagaggactgtag

SEQ ID NO: 3695634 - DNA, 15 bp, Homo sapiens
acagaggccccagcc

SEQ ID NO: 3695635 - DNA, 18 bp, Homo sapiens
acagaggccccagcctcc

SEQ ID NO: 3695636 - DNA, 17 bp, Homo sapiens
acagagtgaaaaatctt

SEQ ID NO: 3695637 - DNA, 21 bp, Homo sapiens
acagagtgaaaaatcttaagt

SEQ ID NO: 3695638 - DNA, 15 bp, Homo sapiens
acagatacacacaca

SEQ ID NO: 3695639 - DNA, 16 bp, Homo sapiens
acagatatcagtgtct

SEQ ID NO: 3695640 - DNA, 22 bp, Homo sapiens
acagatctctgctttggaaatc

SEQ ID NO: 3695641 - DNA, 22 bp, Homo sapiens
acagatctggaacctcagcctg

SEQ ID NO: 3695642 - DNA, 18 bp, Homo sapiens
acagatgccacacaagga

SEQ ID NO: 3695643 - DNA, 13 bp, Homo sapiens
acagatgccccag

SEQ ID NO: 3695644 - DNA, 14 bp, Homo sapiens
acagatgccccaga

SEQ ID NO: 3695645 - DNA, 22 bp, Homo sapiens
acagatgccccagagctgttta

SEQ ID NO: 3695646 - DNA, 18 bp, Homo sapiens
acagatgccttttttgta

SEQ ID NO: 3695647 - DNA, 19 bp, Homo sapiens
acagatgccttttttgtag

SEQ ID NO: 3695648 - DNA, 14 bp, Homo sapiens
acagcaaggtgtgg

SEQ ID NO: 3695649 - DNA, 21 bp, Homo sapiens
acagccagtgggagatgttag

SEQ ID NO: 3695650 - DNA, 18 bp, Homo sapiens
acagcccaaagaaggaaa

SEQ ID NO: 3695651 - DNA, 13 bp, Homo sapiens
acagccccaccct

SEQ ID NO: 3695652 - DNA, 18 bp, Homo sapiens
acagcctcttctgtccca

SEQ ID NO: 3695653 - DNA, 14 bp, Homo sapiens
acagcctgtgtctt

SEQ ID NO: 3695654 - DNA, 18 bp, Homo sapiens
acagcctgtgtctttaaa

SEQ ID NO: 3695655 - DNA, 16 bp, Homo sapiens
acagcggaggtgtgga

SEQ ID NO: 3695656 - DNA, 13 bp, Homo sapiens
acagctacacaga

SEQ ID NO: 3695657 - DNA, 21 bp, Homo sapiens
acagctacttggtttgtgttc

SEQ ID NO: 3695658 - DNA, 20 bp, Homo sapiens
acagctgctcctagagggag

SEQ ID NO: 3695659 - DNA, 21 bp, Homo sapiens
acagctgctcctagagggagg

SEQ ID NO: 3695660 - DNA, 12 bp, Homo sapiens
acagctgtgtta

SEQ ID NO: 3695661 - DNA, 22 bp, Homo sapiens
acagctgtgttattctttgcgt

SEQ ID NO: 3695662 - DNA, 17 bp, Homo sapiens
acagcttcagccaggag

SEQ ID NO: 3695663 - DNA, 15 bp, Homo sapiens
acagcttgacctgag

SEQ ID NO: 3695664 - DNA, 21 bp, Homo sapiens
acagcttgacctgaggctgtg

SEQ ID NO: 3695665 - DNA, 22 bp, Homo sapiens
acagcttgacctgaggctgtgg

SEQ ID NO: 3695666 - DNA, 15 bp, Homo sapiens
acagctttgaggaac

SEQ ID NO: 3695667 - DNA, 15 bp, Homo sapiens
acaggaagcacccca

SEQ ID NO: 3695668 - DNA, 13 bp, Homo sapiens
acaggagctggga

SEQ ID NO: 3695669 - DNA, 18 bp, Homo sapiens
acaggatgtgtttgcttt

SEQ ID NO: 3695670 - DNA, 11 bp, Homo sapiens
acagggcttct

SEQ ID NO: 3695671 - DNA, 16 bp, Homo sapiens
acagggcttctcctgc

SEQ ID NO: 3695672 - DNA, 23 bp, Homo sapiens
acagggtctgctctttctctgcc

SEQ ID NO: 3695673 - DNA, 21 bp, Homo sapiens
acaggtctttcctaaggctgc

SEQ ID NO: 3695674 - DNA, 21 bp, Homo sapiens
acaggtgaaagtttttctgaa

SEQ ID NO: 3695675 - DNA, 17 bp, Homo sapiens
acagtaagtcatttaac

SEQ ID NO: 3695676 - DNA, 13 bp, Homo sapiens
acagtgaagacag

SEQ ID NO: 3695677 - DNA, 21 bp, Homo sapiens
acagtgaagacagaagtttgc

SEQ ID NO: 3695678 - DNA, 17 bp, Homo sapiens
acagtgaaggctgtcct

SEQ ID NO: 3695679 - DNA, 14 bp, Homo sapiens
acagtgcagtgcgc

SEQ ID NO: 3695680 - DNA, 16 bp, Homo sapiens
acagtgctgttgaaga

SEQ ID NO: 3695681 - DNA, 17 bp, Homo sapiens
acagtgggaactggagg

SEQ ID NO: 3695682 - DNA, 16 bp, Homo sapiens
acagtgggagccaggg

SEQ ID NO: 3695683 - DNA, 18 bp, Homo sapiens
acagttctttgggccaga

SEQ ID NO: 3695684 - DNA, 15 bp, Homo sapiens
acagttgaaaaacag

SEQ ID NO: 3695685 - DNA, 20 bp, Homo sapiens
acagttgaaaaacagctgag

SEQ ID NO: 3695686 - DNA, 18 bp, Homo sapiens
acagttgcagcccttgtg

SEQ ID NO: 3695687 - DNA, 14 bp, Homo sapiens
acataaacttaaaa

SEQ ID NO: 3695688 - DNA, 22 bp, Homo sapiens
acataaatcttaatacttgaac

SEQ ID NO: 3695689 - DNA, 23 bp, Homo sapiens
acataaggcttttcctgttctgg

SEQ ID NO: 3695690 - DNA, 19 bp, Homo sapiens
acataatgggccactgaaa

SEQ ID NO: 3695691 - DNA, 17 bp, Homo sapiens
acataattcactctgag

SEQ ID NO: 3695692 - DNA, 14 bp, Homo sapiens
acatacaccagcat

SEQ ID NO: 3695693 - DNA, 18 bp, Homo sapiens
acatacttgaagggccag

SEQ ID NO: 3695694 - DNA, 21 bp, Homo sapiens
acatacttgaagggccagagc

SEQ ID NO: 3695695 - DNA, 22 bp, Homo sapiens
acatacttgaagggccagagcc

SEQ ID NO: 3695696 - DNA, 17 bp, Homo sapiens
acatagaaagttcatgg

SEQ ID NO: 3695697 - DNA, 15 bp, Homo sapiens
acatatatatatata

SEQ ID NO: 3695698 - DNA, 14 bp, Homo sapiens
acatatgaggggga

SEQ ID NO: 3695699 - DNA, 15 bp, Homo sapiens
acatatttaactggt

SEQ ID NO: 3695700 - DNA, 18 bp, Homo sapiens
acatatttaactggtgca

SEQ ID NO: 3695701 - DNA, 13 bp, Homo sapiens
acatatttaatgt

SEQ ID NO: 3695702 - DNA, 18 bp, Homo sapiens
acatcattactataagaa

SEQ ID NO: 3695703 - DNA, 16 bp, Homo sapiens
acatccctgccagctc

SEQ ID NO: 3695704 - DNA, 21 bp, Homo sapiens
acatccgcgtgtgcctgtgtg

SEQ ID NO: 3695705 - DNA, 17 bp, Homo sapiens
acatcctccgtccagcc

SEQ ID NO: 3695706 - DNA, 13 bp, Homo sapiens
acatctaagcctg

SEQ ID NO: 3695707 - DNA, 21 bp, Homo sapiens
acatctaagcctgaaggggcg

SEQ ID NO: 3695708 - DNA, 19 bp, Homo sapiens
acatctatgtgtatgttga

SEQ ID NO: 3695709 - DNA, 14 bp, Homo sapiens
acatgaattaaagt

SEQ ID NO: 3695710 - DNA, 20 bp, Homo sapiens
acatgcagcccatgcccacc

SEQ ID NO: 3695711 - DNA, 19 bp, Homo sapiens
agtgttgaagggaggtggc

SEQ ID NO: 3695712 - DNA, 21 bp, Homo sapiens
agtgttttatgagaaagcctt

SEQ ID NO: 3695713 - DNA, 20 bp, Homo sapiens
agttaacacaatgtgaattt

SEQ ID NO: 3695714 - DNA, 18 bp, Homo sapiens
agttaactgtgaaatacc

SEQ ID NO: 3695715 - DNA, 15 bp, Homo sapiens
agttaagacaacagg

SEQ ID NO: 3695716 - DNA, 23 bp, Homo sapiens
agttactatcatgtcaaacgtga

SEQ ID NO: 3695717 - DNA, 17 bp, Homo sapiens
agttagggaatggcaca

SEQ ID NO: 3695718 - DNA, 18 bp, Homo sapiens
agttattaagttctttaa

SEQ ID NO: 3695719 - DNA, 20 bp, Homo sapiens
agttcaggtagctgcccctg

SEQ ID NO: 3695720 - DNA, 17 bp, Homo sapiens
agttcatgtctgctatc

SEQ ID NO: 3695721 - DNA, 23 bp, Homo sapiens
agttcctcattagcattttgcta

SEQ ID NO: 3695722 - DNA, 12 bp, Homo sapiens
agttctgggtgc

SEQ ID NO: 3695723 - DNA, 15 bp, Homo sapiens
agttctttgggccag

SEQ ID NO: 3695724 - DNA, 19 bp, Homo sapiens
agttctttgttcatagccc

SEQ ID NO: 3695725 - DNA, 21 bp, Homo sapiens
agttctttgttcatagcccag

SEQ ID NO: 3695726 - DNA, 22 bp, Homo sapiens
agttctttgttcatagcccagt

SEQ ID NO: 3695727 - DNA, 19 bp, Homo sapiens
agttgaggggagcatgctt

SEQ ID NO: 3695728 - DNA, 15 bp, Homo sapiens
agttgatctggaacc

SEQ ID NO: 3695729 - DNA, 20 bp, Homo sapiens
agttgatctggaacccagac

SEQ ID NO: 3695730 - DNA, 21 bp, Homo sapiens
agttgatctggaacccagact

SEQ ID NO: 3695731 - DNA, 23 bp, Homo sapiens
agttgatctggaacccagactca

SEQ ID NO: 3695732 - DNA, 18 bp, Homo sapiens
agttgccgtctaggattg

SEQ ID NO: 3695733 - DNA, 18 bp, Homo sapiens
agttgttttttgtgtttc

SEQ ID NO: 3695734 - DNA, 21 bp, Homo sapiens
agttgttttttgtgtttccat

SEQ ID NO: 3695735 - DNA, 16 bp, Homo sapiens
agtttaggccttggct

SEQ ID NO: 3695736 - DNA, 16 bp, Homo sapiens
agtttatttttaaaga

SEQ ID NO: 3695737 - DNA, 17 bp, Homo sapiens
agtttccgtgcgtggca

SEQ ID NO: 3695738 - DNA, 20 bp, Homo sapiens
agtttccgtgcgtggcactc

SEQ ID NO: 3695739 - DNA, 22 bp, Homo sapiens
agtttctggtgccatttctgaa

SEQ ID NO: 3695740 - DNA, 20 bp, Homo sapiens
agtttgagatcagcctgggc

SEQ ID NO: 3695741 - DNA, 21 bp, Homo sapiens
agtttgtcgctcatgtgtgca

SEQ ID NO: 3695742 - DNA, 14 bp, Homo sapiens
agtttgtgtgttgt

SEQ ID NO: 3695743 - DNA, 22 bp, Homo sapiens
agtttgtttaaacacttatctt

SEQ ID NO: 3695744 - DNA, 14 bp, Homo sapiens
agttttagttttct

SEQ ID NO: 3695745 - DNA, 19 bp, Homo sapiens
agttttatagcctggactg

SEQ ID NO: 3695746 - DNA, 22 bp, Homo sapiens
agttttccatggcaggaaggct

SEQ ID NO: 3695747 - DNA, 10 bp, Homo sapiens
agttttccta

SEQ ID NO: 3695748 - DNA, 13 bp, Homo sapiens
agttttcttgttt

SEQ ID NO: 3695749 - DNA, 15 bp, Homo sapiens
agttttcttgtttct

SEQ ID NO: 3695750 - DNA, 23 bp, Homo sapiens
agttttcttgtttctgcatcttt

SEQ ID NO: 3695751 - DNA, 23 bp, Homo sapiens
ataaaaacattgcctttgaatgt

SEQ ID NO: 3695752 - DNA, 11 bp, Homo sapiens
ataaaaaggca

SEQ ID NO: 3695753 - DNA, 12 bp, Homo sapiens
ataaaaaggcac

SEQ ID NO: 3695754 - DNA, 18 bp, Homo sapiens
ataaaacaggtcaataca

SEQ ID NO: 3695755 - DNA, 12 bp, Homo sapiens
ataaaagaacat

SEQ ID NO: 3695756 - DNA, 16 bp, Homo sapiens
ataaaattaaagctga

SEQ ID NO: 3695757 - DNA, 16 bp, Homo sapiens
ataaactttaatataa

SEQ ID NO: 3695758 - DNA, 22 bp, Homo sapiens
ataaataggtcaatacaaatgt

SEQ ID NO: 3695759 - DNA, 15 bp, Homo sapiens
ataaatctgacccag

SEQ ID NO: 3695760 - DNA, 18 bp, Homo sapiens
ataacaaatttttcaaat

SEQ ID NO: 3695761 - DNA, 20 bp, Homo sapiens
ataacaactatttttgttgt

SEQ ID NO: 3695762 - DNA, 12 bp, Homo sapiens
ataacatttaaa

SEQ ID NO: 3695763 - DNA, 22 bp, Homo sapiens
ataaggaaatcaacttgcttat

SEQ ID NO: 3695764 - DNA, 24 bp, Homo sapiens
ataaggaaatcaacttgcttatca

SEQ ID NO: 3695765 - DNA, 16 bp, Homo sapiens
ataaggtaaaatgcca

SEQ ID NO: 3695766 - DNA, 14 bp, Homo sapiens
ataagtatttctga

SEQ ID NO: 3695767 - DNA, 16 bp, Homo sapiens
ataagtcattgtatgt

SEQ ID NO: 3695768 - DNA, 16 bp, Homo sapiens
ataagttcctttcctt

SEQ ID NO: 3695769 - DNA, 20 bp, Homo sapiens
ataatatctaaagttatatt

SEQ ID NO: 3695770 - DNA, 14 bp, Homo sapiens
ataatatttcaagt

SEQ ID NO: 3695771 - DNA, 16 bp, Homo sapiens
ataatatttcaagtgc

SEQ ID NO: 3695772 - DNA, 20 bp, Homo sapiens
ataatatttcaagtgcctag

SEQ ID NO: 3695773 - DNA, 23 bp, Homo sapiens
ataatgactgccctgtttctgtt

SEQ ID NO: 3695774 - DNA, 16 bp, Homo sapiens
ataatggctaactttt

SEQ ID NO: 3695775 - DNA, 21 bp, Homo sapiens
ataatgggccactgaaatctg

SEQ ID NO: 3695776 - DNA, 22 bp, Homo sapiens
ataatgggccactgaaatctgt

SEQ ID NO: 3695777 - DNA, 19 bp, Homo sapiens
ataatggggtcctggccat

SEQ ID NO: 3695778 - DNA, 12 bp, Homo sapiens
ataattgttgaa

SEQ ID NO: 3695779 - DNA, 18 bp, Homo sapiens
atacaccagcattccttt

SEQ ID NO: 3695780 - DNA, 21 bp, Homo sapiens
atacactatgaagatgtttca

SEQ ID NO: 3695781 - DNA, 20 bp, Homo sapiens
atacagaattactgtaactg

SEQ ID NO: 3695782 - DNA, 19 bp, Homo sapiens
atacagtacaggcagcaca

SEQ ID NO: 3695783 - DNA, 15 bp, Homo sapiens
atacagtcaacaagc

SEQ ID NO: 3695784 - DNA, 13 bp, Homo sapiens
atacatatatata

SEQ ID NO: 3695785 - DNA, 12 bp, Homo sapiens
ataccagagcct

SEQ ID NO: 3695786 - DNA, 21 bp, Homo sapiens
ataccagagccttcaagtgcc

SEQ ID NO: 3695787 - DNA, 22 bp, Homo sapiens
ataccagagccttcaagtgcca

SEQ ID NO: 3695788 - DNA, 23 bp, Homo sapiens
ataccagagccttcaagtgccaa

SEQ ID NO: 3695789 - DNA, 18 bp, Homo sapiens
atacccacaatctgagca

SEQ ID NO: 3695790 - DNA, 19 bp, Homo sapiens
atacctcctccctaatgct

SEQ ID NO: 3695791 - DNA, 19 bp, Homo sapiens
atacgctactataaagaga

SEQ ID NO: 3695792 - DNA, 16 bp, Homo sapiens
atacggggtcttgctc

SEQ ID NO: 3695793 - DNA, 21 bp, Homo sapiens
atactattaaaaaggtttaca

SEQ ID NO: 3695794 - DNA, 22 bp, Homo sapiens
atactgctgagatacatacaga

SEQ ID NO: 3695795 - DNA, 13 bp, Homo sapiens
atactgtacaata

SEQ ID NO: 3695796 - DNA, 20 bp, Homo sapiens
atactgtacaataaaaacat

SEQ ID NO: 3695797 - DNA, 17 bp, Homo sapiens
atacttgaagggccaga

SEQ ID NO: 3695798 - DNA, 21 bp, Homo sapiens
atacttgaagggccagagcca

SEQ ID NO: 3695799 - DNA, 14 bp, Homo sapiens
atactttgtaaata

SEQ ID NO: 3695800 - DNA, 14 bp, Homo sapiens
atagaaaagttatt

SEQ ID NO: 3695801 - DNA, 12 bp, Homo sapiens
atagaaatggaa

SEQ ID NO: 3695802 - DNA, 23 bp, Homo sapiens
atagaaatggaaattttgctatc

SEQ ID NO: 3695803 - DNA, 16 bp, Homo sapiens
atagaatagcctgagg

SEQ ID NO: 3695804 - DNA, 23 bp, Homo sapiens
atagaatagcctgaggtcccctc

SEQ ID NO: 3695805 - DNA, 20 bp, Homo sapiens
atagacaatttgcacatctt

SEQ ID NO: 3695806 - DNA, 18 bp, Homo sapiens
atagatgctgtgtatatg

SEQ ID NO: 3695807 - DNA, 13 bp, Homo sapiens
atagcatgcatct

SEQ ID NO: 3695808 - DNA, 14 bp, Homo sapiens
atagctaactgtaa

SEQ ID NO: 3695809 - DNA, 16 bp, Homo sapiens
atagctaactgtaaat

SEQ ID NO: 3695810 - DNA, 17 bp, Homo sapiens
atagctaactgtaaatc

SEQ ID NO: 3695811 - DNA, 15 bp, Homo sapiens
atagctacaggaagc

SEQ ID NO: 3695812 - DNA, 14 bp, Homo sapiens
ataggacctttcca

SEQ ID NO: 3695813 - DNA, 16 bp, Homo sapiens
ataggatttttagaat

SEQ ID NO: 3695814 - DNA, 11 bp, Homo sapiens
ataggctcctt

SEQ ID NO: 3695815 - DNA, 15 bp, Homo sapiens
ataggctccttcctg

SEQ ID NO: 3695816 - DNA, 18 bp, Homo sapiens
ataggtgagaaaaaaaca

SEQ ID NO: 3695817 - DNA, 14 bp, Homo sapiens
atagtaaaaataaa

SEQ ID NO: 3695818 - DNA, 20 bp, Homo sapiens
atagtatttgattcaaaata

SEQ ID NO: 3695819 - DNA, 22 bp, Homo sapiens
atagtatttgattcaaaatatt

SEQ ID NO: 3695820 - DNA, 20 bp, Homo sapiens
atagtctagatggctcctct

SEQ ID NO: 3695821 - DNA, 17 bp, Homo sapiens
atagtcttttgcttttg

SEQ ID NO: 3695822 - DNA, 23 bp, Homo sapiens
atagttggaggtgattccagtga

SEQ ID NO: 3695823 - DNA, 13 bp, Homo sapiens
atagtttgacagg

SEQ ID NO: 3695824 - DNA, 19 bp, Homo sapiens
atataaagtagtcctgtga

SEQ ID NO: 3695825 - DNA, 14 bp, Homo sapiens
atataaatgtggag

SEQ ID NO: 3695826 - DNA, 16 bp, Homo sapiens
atataacatatatgga

SEQ ID NO: 3695827 - DNA, 17 bp, Homo sapiens
atgttttctttgcaaag

SEQ ID NO: 3695828 - DNA, 19 bp, Homo sapiens
attaaaggcataaatgact

SEQ ID NO: 3695829 - DNA, 19 bp, Homo sapiens
attaacaattaggcagact

SEQ ID NO: 3695830 - DNA, 11 bp, Homo sapiens
attaacactgc

SEQ ID NO: 3695831 - DNA, 17 bp, Homo sapiens
attaaccacttcagctg

SEQ ID NO: 3695832 - DNA, 17 bp, Homo sapiens
attaaccttactaatta

SEQ ID NO: 3695833 - DNA, 20 bp, Homo sapiens
attaactacagaaaagacaa

SEQ ID NO: 3695834 - DNA, 19 bp, Homo sapiens
attaagaactgctgtttca

SEQ ID NO: 3695835 - DNA, 17 bp, Homo sapiens
attaatatctcctggaa

SEQ ID NO: 3695836 - DNA, 16 bp, Homo sapiens
attaatgtacttgttt

SEQ ID NO: 3695837 - DNA, 12 bp, Homo sapiens
attaattgcttt

SEQ ID NO: 3695838 - DNA, 13 bp, Homo sapiens
attacaattttat

SEQ ID NO: 3695839 - DNA, 14 bp, Homo sapiens
attacaattttatc

SEQ ID NO: 3695840 - DNA, 19 bp, Homo sapiens
attacacttggtaattgta

SEQ ID NO: 3695841 - DNA, 21 bp, Homo sapiens
attactcccaggatcagcaga

SEQ ID NO: 3695842 - DNA, 22 bp, Homo sapiens
attacttcactatacaaacaaa

SEQ ID NO: 3695843 - DNA, 21 bp, Homo sapiens
attaggcagactctttatgct

SEQ ID NO: 3695844 - DNA, 14 bp, Homo sapiens
attaggtcttgctg

SEQ ID NO: 3695845 - DNA, 21 bp, Homo sapiens
attagtttcacatgatatacc

SEQ ID NO: 3695846 - DNA, 14 bp, Homo sapiens
attatagtttgaca

SEQ ID NO: 3695847 - DNA, 15 bp, Homo sapiens
attatatttgacatg

SEQ ID NO: 3695848 - DNA, 16 bp, Homo sapiens
attatcctaagggaag

SEQ ID NO: 3695849 - DNA, 20 bp, Homo sapiens
attatcctcctgttctgaaa

SEQ ID NO: 3695850 - DNA, 12 bp, Homo sapiens
attatgatattt

SEQ ID NO: 3695851 - DNA, 13 bp, Homo sapiens
attatgctgcttt

SEQ ID NO: 3695852 - DNA, 13 bp, Homo sapiens
attattaattgca

SEQ ID NO: 3695853 - DNA, 16 bp, Homo sapiens
attcaaaatatttaaa

SEQ ID NO: 3695854 - DNA, 20 bp, Homo sapiens
attcagacagatgaggcttt

SEQ ID NO: 3695855 - DNA, 14 bp, Homo sapiens
attcagcaaaccat

SEQ ID NO: 3695856 - DNA, 15 bp, Homo sapiens
attcagcaaaccatt

SEQ ID NO: 3695857 - DNA, 18 bp, Homo sapiens
attcagctctgcaagaat

SEQ ID NO: 3695858 - DNA, 16 bp, Homo sapiens
attcaggctgcttggg

SEQ ID NO: 3695859 - DNA, 12 bp, Homo sapiens
attcatttctaa

SEQ ID NO: 3695860 - DNA, 13 bp, Homo sapiens
attccagcccctc

SEQ ID NO: 3695861 - DNA, 17 bp, Homo sapiens
attccagcccctctggt

SEQ ID NO: 3695862 - DNA, 13 bp, Homo sapiens
attccattttgga

SEQ ID NO: 3695863 - DNA, 18 bp, Homo sapiens
attccccatctcaggcca

SEQ ID NO: 3695864 - DNA, 23 bp, Homo sapiens
attccggaaactagtgtacattt

SEQ ID NO: 3695865 - DNA, 16 bp, Homo sapiens
attcctagaattaaac

SEQ ID NO: 3695866 - DNA, 18 bp, Homo sapiens
attcctggaacctggacc

SEQ ID NO: 3695867 - DNA, 20 bp, Homo sapiens
attccttagataccttgaaa

SEQ ID NO: 3695868 - DNA, 12 bp, Homo sapiens
attccttgtgaa

SEQ ID NO: 3695869 - DNA, 15 bp, Homo sapiens
attctaagtgaaatt

SEQ ID NO: 3695870 - DNA, 15 bp, Homo sapiens
attctagctttgagc

SEQ ID NO: 3695871 - DNA, 13 bp, Homo sapiens
attctatgtatgt

SEQ ID NO: 3695872 - DNA, 16 bp, Homo sapiens
attctatgtatgttaa

SEQ ID NO: 3695873 - DNA, 19 bp, Homo sapiens
attctcatgggaaggggag

SEQ ID NO: 3695874 - DNA, 11 bp, Homo sapiens
attctcctgga

SEQ ID NO: 3695875 - DNA, 16 bp, Homo sapiens
attctggttccagggt

SEQ ID NO: 3695876 - DNA, 20 bp, Homo sapiens
attcttccaacacatttcac

SEQ ID NO: 3695877 - DNA, 21 bp, Homo sapiens
attcttcgcataaagaagaag

SEQ ID NO: 3695878 - DNA, 20 bp, Homo sapiens
attcttctggtgctactcca

SEQ ID NO: 3695879 - DNA, 22 bp, Homo sapiens
attctttagagattataacaaa

SEQ ID NO: 3695880 - DNA, 14 bp, Homo sapiens
attgacactgacta

SEQ ID NO: 3695881 - DNA, 13 bp, Homo sapiens
attgacagctttg

SEQ ID NO: 3695882 - DNA, 18 bp, Homo sapiens
attgacagctttgctgct

SEQ ID NO: 3695883 - DNA, 22 bp, Homo sapiens
attgactgccctcttactgttt

SEQ ID NO: 3695884 - DNA, 21 bp, Homo sapiens
attgactttagaaagctgaca

SEQ ID NO: 3695885 - DNA, 21 bp, Homo sapiens
attgagctgcctccagcctgg

SEQ ID NO: 3695886 - DNA, 22 bp, Homo sapiens
attgagctgcctccagcctggt

SEQ ID NO: 3695887 - DNA, 18 bp, Homo sapiens
attgatcattttcccccc

SEQ ID NO: 3695888 - DNA, 14 bp, Homo sapiens
attgatccaggaga

SEQ ID NO: 3695889 - DNA, 13 bp, Homo sapiens
attgatggggaag

SEQ ID NO: 3695890 - DNA, 19 bp, Homo sapiens
attgcacgtggcctcttga

SEQ ID NO: 3695891 - DNA, 23 bp, Homo sapiens
attgcacgtggcctcttgagcag

SEQ ID NO: 3695892 - DNA, 16 bp, Homo sapiens
attgccaaaaaggata

SEQ ID NO: 3695893 - DNA, 17 bp, Homo sapiens
attgccttttaattttt

SEQ ID NO: 3695894 - DNA, 18 bp, Homo sapiens
attgctgtgtgtcccagg

SEQ ID NO: 3695895 - DNA, 12 bp, Homo sapiens
attgctttgagc

SEQ ID NO: 3695896 - DNA, 23 bp, Homo sapiens
attgctttgccaaaataccagag

SEQ ID NO: 3695897 - DNA, 18 bp, Homo sapiens
attgctttgtgacttctt

SEQ ID NO: 3695898 - DNA, 20 bp, Homo sapiens
attgctttgtgacttcttct

SEQ ID NO: 3695899 - DNA, 17 bp, Homo sapiens
attggacaaagaacctt

SEQ ID NO: 3695900 - DNA, 22 bp, Homo sapiens
attggagctgactgttcttggt

SEQ ID NO: 3695901 - DNA, 16 bp, Homo sapiens
attggcaaactagaat

SEQ ID NO: 3695902 - DNA, 19 bp, Homo sapiens
attggctttctctccttgg

SEQ ID NO: 3695903 - DNA, 18 bp, Homo sapiens
attggtaaagaatggaag

SEQ ID NO: 3695904 - DNA, 21 bp, Homo sapiens
attgtactaaagccaaacata

SEQ ID NO: 3695905 - DNA, 17 bp, Homo sapiens
attgtccctctgcccca

SEQ ID NO: 3695906 - DNA, 20 bp, Homo sapiens
attgtctcctatatatttct

SEQ ID NO: 3695907 - DNA, 23 bp, Homo sapiens
attgtgaaataaaactggctttg

SEQ ID NO: 3695908 - DNA, 15 bp, Homo sapiens
attgtttgctgctat

SEQ ID NO: 3695909 - DNA, 13 bp, Homo sapiens
atttaaacacaca

SEQ ID NO: 3695910 - DNA, 14 bp, Homo sapiens
atttaaacacacag

SEQ ID NO: 3695911 - DNA, 22 bp, Homo sapiens
atttaaaggcttaggcatgttc

SEQ ID NO: 3695912 - DNA, 23 bp, Homo sapiens
atttaactggtgcactttgtaaa

SEQ ID NO: 3695913 - DNA, 12 bp, Homo sapiens
atttaatgtttt

SEQ ID NO: 3695914 - DNA, 23 bp, Homo sapiens
atttaatgttttaaatgtacaga

SEQ ID NO: 3695915 - DNA, 17 bp, Homo sapiens
atttacaggttcttagg

SEQ ID NO: 3695916 - DNA, 19 bp, Homo sapiens
atttagaccccatacaagt

SEQ ID NO: 3695917 - DNA, 17 bp, Homo sapiens
atttaggagaagccagg

SEQ ID NO: 3695918 - DNA, 18 bp, Homo sapiens
atttagtttgtactcagt

SEQ ID NO: 3695919 - DNA, 13 bp, Homo sapiens
atttatactttgc

SEQ ID NO: 3695920 - DNA, 16 bp, Homo sapiens
atttatatatgtatct

SEQ ID NO: 3695921 - DNA, 11 bp, Homo sapiens
atttatatgaa

SEQ ID NO: 3695922 - DNA, 16 bp, Homo sapiens
atttatgggcccctgg

SEQ ID NO: 3695923 - DNA, 18 bp, Homo sapiens
atttatgggcccctggca

SEQ ID NO: 3695924 - DNA, 19 bp, Homo sapiens
atttatgggcccctggcac

SEQ ID NO: 3695925 - DNA, 19 bp, Homo sapiens
atttatgtgtgaggagctg

SEQ ID NO: 3695926 - DNA, 15 bp, Homo sapiens
atttattaattgctt

SEQ ID NO: 3695927 - DNA, 18 bp, Homo sapiens
atttattaattgctttga

SEQ ID NO: 3695928 - DNA, 14 bp, Homo sapiens
atttattgagtttt

SEQ ID NO: 3695929 - DNA, 24 bp, Homo sapiens
atttattgcagaggatgttcataa

SEQ ID NO: 3695930 - DNA, 14 bp, Homo sapiens
atttattgtctgtc

SEQ ID NO: 3695931 - DNA, 22 bp, Homo sapiens
atttattttattctatgtatgt

SEQ ID NO: 3695932 - DNA, 16 bp, Homo sapiens
atttcaagtgcctaga

SEQ ID NO: 3695933 - DNA, 15 bp, Homo sapiens
atttcacttttctgt

SEQ ID NO: 3695934 - DNA, 20 bp, Homo sapiens
atttcagactgcagagggga

SEQ ID NO: 3695935 - DNA, 17 bp, Homo sapiens
atttcagatgtaatgtt

SEQ ID NO: 3695936 - DNA, 12 bp, Homo sapiens
atttcatctgtt

SEQ ID NO: 3695937 - DNA, 13 bp, Homo sapiens
atttcatctgttc

SEQ ID NO: 3695938 - DNA, 12 bp, Homo sapiens
atttccaagctg

SEQ ID NO: 3695939 - DNA, 21 bp, Homo sapiens
atttccaagctgttagttgct

SEQ ID NO: 3695940 - DNA, 13 bp, Homo sapiens
atttcccaggacc

SEQ ID NO: 3695941 - DNA, 16 bp, Homo sapiens
atttcctggccctcca

SEQ ID NO: 3695942 - DNA, 14 bp, Homo sapiens
atttctataaatag

SEQ ID NO: 3695943 - DNA, 22 bp, Homo sapiens
atttctattattaattgcaaaa

SEQ ID NO: 3695944 - DNA, 12 bp, Homo sapiens
caccctgggccc

SEQ ID NO: 3695945 - DNA, 15 bp, Homo sapiens
caccctggtgggcca

SEQ ID NO: 3695946 - DNA, 15 bp, Homo sapiens
caccctgtcttctta

SEQ ID NO: 3695947 - DNA, 12 bp, Homo sapiens
cacccttggcct

SEQ ID NO: 3695948 - DNA, 13 bp, Homo sapiens
cacccttggcctg

SEQ ID NO: 3695949 - DNA, 18 bp, Homo sapiens
cacccttggcctgtctca

SEQ ID NO: 3695950 - DNA, 23 bp, Homo sapiens
cacccttggcctgtctcatcccc

SEQ ID NO: 3695951 - DNA, 13 bp, Homo sapiens
caccgaggggcct

SEQ ID NO: 3695952 - DNA, 14 bp, Homo sapiens
caccgaggggcctt

SEQ ID NO: 3695953 - DNA, 16 bp, Homo sapiens
caccgccatcctctgc

SEQ ID NO: 3695954 - DNA, 19 bp, Homo sapiens
caccgccatcctctgcctc

SEQ ID NO: 3695955 - DNA, 15 bp, Homo sapiens
caccggatcctgggt

SEQ ID NO: 3695956 - DNA, 21 bp, Homo sapiens
caccggatcctgggtggtctg

SEQ ID NO: 3695957 - DNA, 18 bp, Homo sapiens
caccgtcaggtactcctg

SEQ ID NO: 3695958 - DNA, 21 bp, Homo sapiens
cacctaatccaggcagatcca

SEQ ID NO: 3695959 - DNA, 16 bp, Homo sapiens
cacctagtaagtgcct

SEQ ID NO: 3695960 - DNA, 18 bp, Homo sapiens
cacctagtaagtgcctgc

SEQ ID NO: 3695961 - DNA, 14 bp, Homo sapiens
cacctataaaacag

SEQ ID NO: 3695962 - DNA, 16 bp, Homo sapiens
cacctataaaacaggt

SEQ ID NO: 3695963 - DNA, 21 bp, Homo sapiens
cacctcagttcccttggcctc

SEQ ID NO: 3695964 - DNA, 21 bp, Homo sapiens
cacctcatccccaaccccctg

SEQ ID NO: 3695965 - DNA, 14 bp, Homo sapiens
cacctcattctgaa

SEQ ID NO: 3695966 - DNA, 22 bp, Homo sapiens
cacctcattctgaaccctttcg

SEQ ID NO: 3695967 - DNA, 20 bp, Homo sapiens
cacctccctatactgcttgg

SEQ ID NO: 3695968 - DNA, 15 bp, Homo sapiens
cacctccctgcctcc

SEQ ID NO: 3695969 - DNA, 19 bp, Homo sapiens
cacctctggactggctaga

SEQ ID NO: 3695970 - DNA, 20 bp, Homo sapiens
cacctcttggctttgttgat

SEQ ID NO: 3695971 - DNA, 13 bp, Homo sapiens
cacctctttgtca

SEQ ID NO: 3695972 - DNA, 20 bp, Homo sapiens
cacctgcactccatccagct

SEQ ID NO: 3695973 - DNA, 22 bp, Homo sapiens
cacctgccagcggtttcctggt

SEQ ID NO: 3695974 - DNA, 22 bp, Homo sapiens
cacctggggtgtgggaggcccg

SEQ ID NO: 3695975 - DNA, 15 bp, Homo sapiens
caccttatatttacg

SEQ ID NO: 3695976 - DNA, 13 bp, Homo sapiens
caccttgtgcctg

SEQ ID NO: 3695977 - DNA, 16 bp, Homo sapiens
caccttgtgcctgggg

SEQ ID NO: 3695978 - DNA, 17 bp, Homo sapiens
caccttgtgcctggggt

SEQ ID NO: 3695979 - DNA, 18 bp, Homo sapiens
caccttgtgcctggggtg

SEQ ID NO: 3695980 - DNA, 11 bp, Homo sapiens
cacgcaagtgc

SEQ ID NO: 3695981 - DNA, 12 bp, Homo sapiens
cacgcacctccc

SEQ ID NO: 3695982 - DNA, 14 bp, Homo sapiens
cacgcacctcccat

SEQ ID NO: 3695983 - DNA, 20 bp, Homo sapiens
cacgcccgtcctgcctgtgg

SEQ ID NO: 3695984 - DNA, 19 bp, Homo sapiens
cacgcctgtaatcctagca

SEQ ID NO: 3695985 - DNA, 22 bp, Homo sapiens
cacgctaatcccgattcaccct

SEQ ID NO: 3695986 - DNA, 16 bp, Homo sapiens
cacggaagagccttgc

SEQ ID NO: 3695987 - DNA, 23 bp, Homo sapiens
cacggcaggacaacgaggaagcc

SEQ ID NO: 3695988 - DNA, 18 bp, Homo sapiens
cacgggacatcacagggt

SEQ ID NO: 3695989 - DNA, 22 bp, Homo sapiens
cacgggggctgtggctctgggt

SEQ ID NO: 3695990 - DNA, 14 bp, Homo sapiens
cacgtgacacaaac

SEQ ID NO: 3695991 - DNA, 13 bp, Homo sapiens
cacgtggagagct

SEQ ID NO: 3695992 - DNA, 20 bp, Homo sapiens
cacgtggcctcttgagcagt

SEQ ID NO: 3695993 - DNA, 17 bp, Homo sapiens
cactaagcagaggaggg

SEQ ID NO: 3695994 - DNA, 18 bp, Homo sapiens
cactaagcagaggagggg

SEQ ID NO: 3695995 - DNA, 21 bp, Homo sapiens
cactaagcagaggaggggccg

SEQ ID NO: 3695996 - DNA, 12 bp, Homo sapiens
cactaaggggcc

SEQ ID NO: 3695997 - DNA, 19 bp, Homo sapiens
cactaatttttgtattatt

SEQ ID NO: 3695998 - DNA, 20 bp, Homo sapiens
cactaatttttgtattattt

SEQ ID NO: 3695999 - DNA, 23 bp, Homo sapiens
cactaatttttgtattatttttg

SEQ ID NO: 3696000 - DNA, 15 bp, Homo sapiens
cactacatgcagccc

SEQ ID NO: 3696001 - DNA, 17 bp, Homo sapiens
cactaggcccccacttg

SEQ ID NO: 3696002 - DNA, 22 bp, Homo sapiens
cactaggcccccacttgcctct

SEQ ID NO: 3696003 - DNA, 23 bp, Homo sapiens
cactaggcccccacttgcctctt

SEQ ID NO: 3696004 - DNA, 15 bp, Homo sapiens
cactatacaaacaaa

SEQ ID NO: 3696005 - DNA, 14 bp, Homo sapiens
cactatctttcagc

SEQ ID NO: 3696006 - DNA, 18 bp, Homo sapiens
cactcaaaagctgggcag

SEQ ID NO: 3696007 - DNA, 12 bp, Homo sapiens
cactcaagccaa

SEQ ID NO: 3696008 - DNA, 16 bp, Homo sapiens
cactcaagccaagcag

SEQ ID NO: 3696009 - DNA, 13 bp, Homo sapiens
cactccagcctgg

SEQ ID NO: 3696010 - DNA, 15 bp, Homo sapiens
cactccagcctgggt

SEQ ID NO: 3696011 - DNA, 14 bp, Homo sapiens
cactcccctagggg

SEQ ID NO: 3696012 - DNA, 19 bp, Homo sapiens
cactcccttcccataagct

SEQ ID NO: 3696013 - DNA, 20 bp, Homo sapiens
cactcgggtttctctgtggc

SEQ ID NO: 3696014 - DNA, 17 bp, Homo sapiens
cactcgtgcatccctga

SEQ ID NO: 3696015 - DNA, 18 bp, Homo sapiens
cactctaccctcccaccc

SEQ ID NO: 3696016 - DNA, 19 bp, Homo sapiens
cactctaccctcccacccc

SEQ ID NO: 3696017 - DNA, 13 bp, Homo sapiens
cactctatgagtt

SEQ ID NO: 3696018 - DNA, 12 bp, Homo sapiens
cactctccccac

SEQ ID NO: 3696019 - DNA, 21 bp, Homo sapiens
cactctccccacactaacctg

SEQ ID NO: 3696020 - DNA, 12 bp, Homo sapiens
cactctgcttct

SEQ ID NO: 3696021 - DNA, 14 bp, Homo sapiens
cactctgcttctct

SEQ ID NO: 3696022 - DNA, 18 bp, Homo sapiens
cactctgcttctctgact

SEQ ID NO: 3696023 - DNA, 19 bp, Homo sapiens
cactctgcttctctgactt

SEQ ID NO: 3696024 - DNA, 19 bp, Homo sapiens
cactctgtggccagcctgg

SEQ ID NO: 3696025 - DNA, 20 bp, Homo sapiens
cactctgtggccagcctggc

SEQ ID NO: 3696026 - DNA, 14 bp, Homo sapiens
cactgaccagaact

SEQ ID NO: 3696027 - DNA, 13 bp, Homo sapiens
cactgaggcaggg

SEQ ID NO: 3696028 - DNA, 12 bp, Homo sapiens
cactgatgctgc

SEQ ID NO: 3696029 - DNA, 16 bp, Homo sapiens
cactgcactccagcct

SEQ ID NO: 3696030 - DNA, 20 bp, Homo sapiens
cactgcactccagcctgggt

SEQ ID NO: 3696031 - DNA, 16 bp, Homo sapiens
cactgcataccaacct

SEQ ID NO: 3696032 - DNA, 12 bp, Homo sapiens
cactggaagcag

SEQ ID NO: 3696033 - DNA, 13 bp, Homo sapiens
cactgggcttcta

SEQ ID NO: 3696034 - DNA, 18 bp, Homo sapiens
cactgtcccttgcctcaa

SEQ ID NO: 3696035 - DNA, 18 bp, Homo sapiens
cactgtcctgggcctgca

SEQ ID NO: 3696036 - DNA, 20 bp, Homo sapiens
cactgtgaaccggctcccac

SEQ ID NO: 3696037 - DNA, 15 bp, Homo sapiens
cactgtgaaggaccc

SEQ ID NO: 3696038 - DNA, 14 bp, Homo sapiens
cactgtgctttcag

SEQ ID NO: 3696039 - DNA, 13 bp, Homo sapiens
cactgtggtggca

SEQ ID NO: 3696040 - DNA, 14 bp, Homo sapiens
cacttatcttctgg

SEQ ID NO: 3696041 - DNA, 15 bp, Homo sapiens
cacttatcttctgga

SEQ ID NO: 3696042 - DNA, 18 bp, Homo sapiens
cacttgaggtcaggagtt

SEQ ID NO: 3696043 - DNA, 12 bp, Homo sapiens
cacttgcaacct

SEQ ID NO: 3696044 - DNA, 12 bp, Homo sapiens
cacttgcctctt

SEQ ID NO: 3696045 - DNA, 13 bp, Homo sapiens
cacttgcctcttc

SEQ ID NO: 3696046 - DNA, 20 bp, Homo sapiens
cacttgctgagtgaaggaaa

SEQ ID NO: 3696047 - DNA, 15 bp, Homo sapiens
cacttggtaattgta

SEQ ID NO: 3696048 - DNA, 17 bp, Homo sapiens
cacttgtctcaggactc

SEQ ID NO: 3696049 - DNA, 17 bp, Homo sapiens
cactttcagtgaaagca

SEQ ID NO: 3696050 - DNA, 18 bp, Homo sapiens
cactttcagtgaaagcat

SEQ ID NO: 3696051 - DNA, 18 bp, Homo sapiens
cactttcccttgtgtcaa

SEQ ID NO: 3696052 - DNA, 23 bp, Homo sapiens
cactttgggaggccaaggagggc

SEQ ID NO: 3696053 - DNA, 20 bp, Homo sapiens
cactttgtttcgtggggagg

SEQ ID NO: 3696054 - DNA, 24 bp, Homo sapiens
cagaaagaagtggggacagagcag

SEQ ID NO: 3696055 - DNA, 18 bp, Homo sapiens
cagaacacactccatcag

SEQ ID NO: 3696056 - DNA, 19 bp, Homo sapiens
cagaacacggctcacgctt

SEQ ID NO: 3696057 - DNA, 20 bp, Homo sapiens
cagaacaggtgttggtgaca

SEQ ID NO: 3696058 - DNA, 24 bp, Homo sapiens
cagaacaggtgttggtgacaattg

SEQ ID NO: 3696059 - DNA, 15 bp, Homo sapiens
cagaacctcttcccc

SEQ ID NO: 3696060 - DNA, 16 bp, Homo sapiens
cagaacctcttcccca

SEQ ID NO: 3696061 - DNA, 16 bp, Homo sapiens
cagtactttggaggcc

SEQ ID NO: 3696062 - DNA, 21 bp, Homo sapiens
cagtacttttttaaatatttt

SEQ ID NO: 3696063 - DNA, 23 bp, Homo sapiens
cagtacttttttaaatattttct

SEQ ID NO: 3696064 - DNA, 18 bp, Homo sapiens
cagtagattttccaaatg

SEQ ID NO: 3696065 - DNA, 15 bp, Homo sapiens
cagtagggtttgaca

SEQ ID NO: 3696066 - DNA, 22 bp, Homo sapiens
cagtaggttatttagcttggga

SEQ ID NO: 3696067 - DNA, 13 bp, Homo sapiens
cagtatctcaggg

SEQ ID NO: 3696068 - DNA, 15 bp, Homo sapiens
cagtattgacactga

SEQ ID NO: 3696069 - DNA, 14 bp, Homo sapiens
cagtcaagaagaaa

SEQ ID NO: 3696070 - DNA, 19 bp, Homo sapiens
cagtcacaacagagtgaaa

SEQ ID NO: 3696071 - DNA, 21 bp, Homo sapiens
cagtcatcttgaccaagcagg

SEQ ID NO: 3696072 - DNA, 22 bp, Homo sapiens
cagtcattcagcagcaaatttt

SEQ ID NO: 3696073 - DNA, 22 bp, Homo sapiens
cagtccaaatgtcctccagaag

SEQ ID NO: 3696074 - DNA, 18 bp, Homo sapiens
cagtccaggctgccgtgg

SEQ ID NO: 3696075 - DNA, 12 bp, Homo sapiens
cagtcctgcctg

SEQ ID NO: 3696076 - DNA, 14 bp, Homo sapiens
cagtcctgcctggc

SEQ ID NO: 3696077 - DNA, 16 bp, Homo sapiens
cagtcctgcctggcca

SEQ ID NO: 3696078 - DNA, 17 bp, Homo sapiens
cagtcctggttgtctga

SEQ ID NO: 3696079 - DNA, 18 bp, Homo sapiens
cagtcctggttgtctgaa

SEQ ID NO: 3696080 - DNA, 14 bp, Homo sapiens
cagtcgtgcctgtg

SEQ ID NO: 3696081 - DNA, 17 bp, Homo sapiens
cagtcgtgcctgtgtcc

SEQ ID NO: 3696082 - DNA, 13 bp, Homo sapiens
cagtgaagacaga

SEQ ID NO: 3696083 - DNA, 14 bp, Homo sapiens
cagtgaagacagaa

SEQ ID NO: 3696084 - DNA, 15 bp, Homo sapiens
cagtgaagacagaag

SEQ ID NO: 3696085 - DNA, 14 bp, Homo sapiens
cagtgacaaaccat

SEQ ID NO: 3696086 - DNA, 18 bp, Homo sapiens
cagtgacagacaggctct

SEQ ID NO: 3696087 - DNA, 14 bp, Homo sapiens
cagtgacctgagga

SEQ ID NO: 3696088 - DNA, 18 bp, Homo sapiens
cagtgacctgaggaagcg

SEQ ID NO: 3696089 - DNA, 22 bp, Homo sapiens
cagtgagcttggaaaggaccag

SEQ ID NO: 3696090 - DNA, 18 bp, Homo sapiens
cagtgatgctggatgctc

SEQ ID NO: 3696091 - DNA, 12 bp, Homo sapiens
cagtgcagaatg

SEQ ID NO: 3696092 - DNA, 22 bp, Homo sapiens
cagtgcagaatgtaagtgggcc

SEQ ID NO: 3696093 - DNA, 15 bp, Homo sapiens
cagtgcagcagagga

SEQ ID NO: 3696094 - DNA, 16 bp, Homo sapiens
cagtgcagcagaggac

SEQ ID NO: 3696095 - DNA, 18 bp, Homo sapiens
cagtgcatggtggccaga

SEQ ID NO: 3696096 - DNA, 15 bp, Homo sapiens
cagtgcccccactga

SEQ ID NO: 3696097 - DNA, 22 bp, Homo sapiens
cagtgcccccactgaccagaac

SEQ ID NO: 3696098 - DNA, 18 bp, Homo sapiens
cagtgccgagaaggaagc

SEQ ID NO: 3696099 - DNA, 13 bp, Homo sapiens
cagtgctccagcc

SEQ ID NO: 3696100 - DNA, 13 bp, Homo sapiens
cagtgctggattt

SEQ ID NO: 3696101 - DNA, 19 bp, Homo sapiens
cagtgctggatttgatgag

SEQ ID NO: 3696102 - DNA, 21 bp, Homo sapiens
cagtgctggatttgatgagtt

SEQ ID NO: 3696103 - DNA, 22 bp, Homo sapiens
cagtgctgtgctgtgctatggt

SEQ ID NO: 3696104 - DNA, 15 bp, Homo sapiens
cagtgggagatgtta

SEQ ID NO: 3696105 - DNA, 17 bp, Homo sapiens
cagtgggagatgttaga

SEQ ID NO: 3696106 - DNA, 22 bp, Homo sapiens
cagtgggctgtttctgcttatt

SEQ ID NO: 3696107 - DNA, 19 bp, Homo sapiens
cagtgtgcactaaggggcc

SEQ ID NO: 3696108 - DNA, 23 bp, Homo sapiens
cagtgtgcactaaggggcccggc

SEQ ID NO: 3696109 - DNA, 23 bp, Homo sapiens
cagtgtggggagggcaggtccag

SEQ ID NO: 3696110 - DNA, 15 bp, Homo sapiens
cagttattacatgta

SEQ ID NO: 3696111 - DNA, 13 bp, Homo sapiens
cagttcaccctga

SEQ ID NO: 3696112 - DNA, 13 bp, Homo sapiens
cagttcccttggc

SEQ ID NO: 3696113 - DNA, 17 bp, Homo sapiens
cagttcccttggcctca

SEQ ID NO: 3696114 - DNA, 18 bp, Homo sapiens
cagttcccttggcctcag

SEQ ID NO: 3696115 - DNA, 15 bp, Homo sapiens
cagttcctttcaatg

SEQ ID NO: 3696116 - DNA, 13 bp, Homo sapiens
cagttcttcctgc

SEQ ID NO: 3696117 - DNA, 16 bp, Homo sapiens
cagttcttcctgcaac

SEQ ID NO: 3696118 - DNA, 23 bp, Homo sapiens
cagttcttcctgcaaccactctg

SEQ ID NO: 3696119 - DNA, 19 bp, Homo sapiens
cagttcttgtggaagacac

SEQ ID NO: 3696120 - DNA, 16 bp, Homo sapiens
cagttctttgggccag

SEQ ID NO: 3696121 - DNA, 17 bp, Homo sapiens
cagttgattttctggat

SEQ ID NO: 3696122 - DNA, 21 bp, Homo sapiens
cagtttatttttaaagataga

SEQ ID NO: 3696123 - DNA, 21 bp, Homo sapiens
cataaggccagtatgatttat

SEQ ID NO: 3696124 - DNA, 22 bp, Homo sapiens
cataatgctaatttaaagagac

SEQ ID NO: 3696125 - DNA, 19 bp, Homo sapiens
cataatgggccactgaaat

SEQ ID NO: 3696126 - DNA, 23 bp, Homo sapiens
cataatgggccactgaaatctgt

SEQ ID NO: 3696127 - DNA, 22 bp, Homo sapiens
cataatggggtcctggccatcc

SEQ ID NO: 3696128 - DNA, 21 bp, Homo sapiens
cataattcactctgagtgttt

SEQ ID NO: 3696129 - DNA, 19 bp, Homo sapiens
cataattgctttgccaaaa

SEQ ID NO: 3696130 - DNA, 13 bp, Homo sapiens
catacaccagcat

SEQ ID NO: 3696131 - DNA, 14 bp, Homo sapiens
catacaccagcatt

SEQ ID NO: 3696132 - DNA, 23 bp, Homo sapiens
catacagaattactgtaactgat

SEQ ID NO: 3696133 - DNA, 17 bp, Homo sapiens
catacttgaagggccag

SEQ ID NO: 3696134 - DNA, 11 bp, Homo sapiens
catagaaaaat

SEQ ID NO: 3696135 - DNA, 23 bp, Homo sapiens
catagatcagcaaaccggggcct

SEQ ID NO: 3696136 - DNA, 20 bp, Homo sapiens
catagcttgataaagggcca

SEQ ID NO: 3696137 - DNA, 18 bp, Homo sapiens
cataggacctttccacca

SEQ ID NO: 3696138 - DNA, 11 bp, Homo sapiens
cataggctcct

SEQ ID NO: 3696139 - DNA, 20 bp, Homo sapiens
catagtagtttttacagctg

SEQ ID NO: 3696140 - DNA, 15 bp, Homo sapiens
catagtttctttatt

SEQ ID NO: 3696141 - DNA, 16 bp, Homo sapiens
catagtttctttattt

SEQ ID NO: 3696142 - DNA, 17 bp, Homo sapiens
catagtttctttatttt

SEQ ID NO: 3696143 - DNA, 12 bp, Homo sapiens
catatatattac

SEQ ID NO: 3696144 - DNA, 14 bp, Homo sapiens
catatgctccagga

SEQ ID NO: 3696145 - DNA, 17 bp, Homo sapiens
catattctaaaaccatt

SEQ ID NO: 3696146 - DNA, 18 bp, Homo sapiens
catatttaatgttttaaa

SEQ ID NO: 3696147 - DNA, 13 bp, Homo sapiens
catatttatactt

SEQ ID NO: 3696148 - DNA, 22 bp, Homo sapiens
catcaaccccccgactgtgctg

SEQ ID NO: 3696149 - DNA, 13 bp, Homo sapiens
catcacagggtgg

SEQ ID NO: 3696150 - DNA, 19 bp, Homo sapiens
catcacagggtgggcctcg

SEQ ID NO: 3696151 - DNA, 17 bp, Homo sapiens
catcaccttaggcaggg

SEQ ID NO: 3696152 - DNA, 17 bp, Homo sapiens
catcactgagttttcca

SEQ ID NO: 3696153 - DNA, 23 bp, Homo sapiens
catcactgagttttccatggcag

SEQ ID NO: 3696154 - DNA, 21 bp, Homo sapiens
catcatgctggaacctgcaaa

SEQ ID NO: 3696155 - DNA, 12 bp, Homo sapiens
catcattattat

SEQ ID NO: 3696156 - DNA, 19 bp, Homo sapiens
catcattgatgatcactgt

SEQ ID NO: 3696157 - DNA, 18 bp, Homo sapiens
catccactctaccctccc

SEQ ID NO: 3696158 - DNA, 19 bp, Homo sapiens
catccactctaccctccca

SEQ ID NO: 3696159 - DNA, 16 bp, Homo sapiens
catccccacaatctgg

SEQ ID NO: 3696160 - DNA, 19 bp, Homo sapiens
catccccacaatctggctt

SEQ ID NO: 3696161 - DNA, 11 bp, Homo sapiens
catccccaggg

SEQ ID NO: 3696162 - DNA, 14 bp, Homo sapiens
catcccctgtagag

SEQ ID NO: 3696163 - DNA, 21 bp, Homo sapiens
catcccctgtagagtgggagc

SEQ ID NO: 3696164 - DNA, 12 bp, Homo sapiens
catccctacccc

SEQ ID NO: 3696165 - DNA, 13 bp, Homo sapiens
catccgcctggcc

SEQ ID NO: 3696166 - DNA, 14 bp, Homo sapiens
catccgcctggccc

SEQ ID NO: 3696167 - DNA, 17 bp, Homo sapiens
catccgcgtgtgcctgt

SEQ ID NO: 3696168 - DNA, 20 bp, Homo sapiens
catcctccgtccagccgcca

SEQ ID NO: 3696169 - DNA, 13 bp, Homo sapiens
catcctctgcctc

SEQ ID NO: 3696170 - DNA, 14 bp, Homo sapiens
catcctctgcctca

SEQ ID NO: 3696171 - DNA, 11 bp, Homo sapiens
catcctggctg

SEQ ID NO: 3696172 - DNA, 13 bp, Homo sapiens
catcctggctgcg

SEQ ID NO: 3696173 - DNA, 19 bp, Homo sapiens
catcctgtttgtatgaaat

SEQ ID NO: 3696174 - DNA, 16 bp, Homo sapiens
catcgctggaaaacag

SEQ ID NO: 3696175 - DNA, 14 bp, Homo sapiens
catcggggccattt

SEQ ID NO: 3696176 - DNA, 21 bp, Homo sapiens
catcggggccatttggccggc

SEQ ID NO: 3696177 - DNA, 20 bp, Homo sapiens
catctatgtgtatgttgact

SEQ ID NO: 3696178 - DNA, 18 bp, Homo sapiens
ccatggggagggattctg

SEQ ID NO: 3696179 - DNA, 16 bp, Homo sapiens
ccatgggtgtggatgg

SEQ ID NO: 3696180 - DNA, 17 bp, Homo sapiens
ccatgggtgtggatggc

SEQ ID NO: 3696181 - DNA, 22 bp, Homo sapiens
ccatggttaccatgggtgtgga

SEQ ID NO: 3696182 - DNA, 13 bp, Homo sapiens
ccatgtctgcatt

SEQ ID NO: 3696183 - DNA, 19 bp, Homo sapiens
ccatgtgcatagtttcttt

SEQ ID NO: 3696184 - DNA, 21 bp, Homo sapiens
ccatgtgcatagtttctttat

SEQ ID NO: 3696185 - DNA, 18 bp, Homo sapiens
ccatgttttgtttacggt

SEQ ID NO: 3696186 - DNA, 13 bp, Homo sapiens
ccattcctgaaga

SEQ ID NO: 3696187 - DNA, 17 bp, Homo sapiens
ccattctcaagccctgc

SEQ ID NO: 3696188 - DNA, 14 bp, Homo sapiens
ccattcttctggtg

SEQ ID NO: 3696189 - DNA, 20 bp, Homo sapiens
ccattgcactccagcctggg

SEQ ID NO: 3696190 - DNA, 17 bp, Homo sapiens
ccattgggaccctccag

SEQ ID NO: 3696191 - DNA, 17 bp, Homo sapiens
ccatttcaattgctttg

SEQ ID NO: 3696192 - DNA, 14 bp, Homo sapiens
ccatttggccggct

SEQ ID NO: 3696193 - DNA, 23 bp, Homo sapiens
ccattttcttattgcgctgctac

SEQ ID NO: 3696194 - DNA, 12 bp, Homo sapiens
ccattttggaaa

SEQ ID NO: 3696195 - DNA, 16 bp, Homo sapiens
cccaaaagagggcaca

SEQ ID NO: 3696196 - DNA, 20 bp, Homo sapiens
cccaaagacctccacttgct

SEQ ID NO: 3696197 - DNA, 16 bp, Homo sapiens
cccaaagctgagcctg

SEQ ID NO: 3696198 - DNA, 14 bp, Homo sapiens
cccaaagctttcct

SEQ ID NO: 3696199 - DNA, 16 bp, Homo sapiens
cccaaagctttcctgc

SEQ ID NO: 3696200 - DNA, 13 bp, Homo sapiens
cccaacccccacc

SEQ ID NO: 3696201 - DNA, 14 bp, Homo sapiens
cccaacccccaccc

SEQ ID NO: 3696202 - DNA, 23 bp, Homo sapiens
cccaactacccccagctgtgctt

SEQ ID NO: 3696203 - DNA, 15 bp, Homo sapiens
cccaactctagctgg

SEQ ID NO: 3696204 - DNA, 21 bp, Homo sapiens
cccaactctagctgggggtgg

SEQ ID NO: 3696205 - DNA, 20 bp, Homo sapiens
cccaagacagatgccccaga

SEQ ID NO: 3696206 - DNA, 21 bp, Homo sapiens
cccaagacagatgccccagag

SEQ ID NO: 3696207 - DNA, 16 bp, Homo sapiens
cccaagccagaggctg

SEQ ID NO: 3696208 - DNA, 12 bp, Homo sapiens
cccaagctgtgc

SEQ ID NO: 3696209 - DNA, 16 bp, Homo sapiens
cccaaggctggcaggt

SEQ ID NO: 3696210 - DNA, 13 bp, Homo sapiens
cccaagggatctg

SEQ ID NO: 3696211 - DNA, 14 bp, Homo sapiens
cccaatcccagttc

SEQ ID NO: 3696212 - DNA, 23 bp, Homo sapiens
cccaatcccagttcttcctgcaa

SEQ ID NO: 3696213 - DNA, 13 bp, Homo sapiens
cccacaagtggtg

SEQ ID NO: 3696214 - DNA, 23 bp, Homo sapiens
cccacaagtggtggtaaccctgg

SEQ ID NO: 3696215 - DNA, 15 bp, Homo sapiens
cccacaatctgagca

SEQ ID NO: 3696216 - DNA, 22 bp, Homo sapiens
cccacaccgtcaggtactcctg

SEQ ID NO: 3696217 - DNA, 13 bp, Homo sapiens
cccacacctcagt

SEQ ID NO: 3696218 - DNA, 15 bp, Homo sapiens
cccacatgtccagca

SEQ ID NO: 3696219 - DNA, 22 bp, Homo sapiens
cccaccaggctgctcagggctg

SEQ ID NO: 3696220 - DNA, 12 bp, Homo sapiens
cccaccccacac

SEQ ID NO: 3696221 - DNA, 14 bp, Homo sapiens
cccaccctgggccc

SEQ ID NO: 3696222 - DNA, 18 bp, Homo sapiens
cccaccctggtgggccaa

SEQ ID NO: 3696223 - DNA, 13 bp, Homo sapiens
cccacctgcccat

SEQ ID NO: 3696224 - DNA, 13 bp, Homo sapiens
cccacctgccggc

SEQ ID NO: 3696225 - DNA, 14 bp, Homo sapiens
cccacctgccggcc

SEQ ID NO: 3696226 - DNA, 21 bp, Homo sapiens
cccacgactgcccggcagggt

SEQ ID NO: 3696227 - DNA, 17 bp, Homo sapiens
cccactcaagccaagca

SEQ ID NO: 3696228 - DNA, 19 bp, Homo sapiens
cccactcaagccaagcagc

SEQ ID NO: 3696229 - DNA, 14 bp, Homo sapiens
cccactctccccac

SEQ ID NO: 3696230 - DNA, 15 bp, Homo sapiens
cccactctccccaca

SEQ ID NO: 3696231 - DNA, 17 bp, Homo sapiens
cccacttcccaccctgc

SEQ ID NO: 3696232 - DNA, 22 bp, Homo sapiens
cccagaacacactccatcagct

SEQ ID NO: 3696233 - DNA, 16 bp, Homo sapiens
cccagactcagacatt

SEQ ID NO: 3696234 - DNA, 23 bp, Homo sapiens
cccagagacatacttgaagggcc

SEQ ID NO: 3696235 - DNA, 20 bp, Homo sapiens
cccagagaccaggctgtgtc

SEQ ID NO: 3696236 - DNA, 15 bp, Homo sapiens
cccagagcccagctc

SEQ ID NO: 3696237 - DNA, 17 bp, Homo sapiens
cccagagcccagctcca

SEQ ID NO: 3696238 - DNA, 13 bp, Homo sapiens
cccagagctgctg

SEQ ID NO: 3696239 - DNA, 21 bp, Homo sapiens
cccagagctgtttatggcctc

SEQ ID NO: 3696240 - DNA, 23 bp, Homo sapiens
cccagagctgtttatggcctcag

SEQ ID NO: 3696241 - DNA, 19 bp, Homo sapiens
cccagatctggtcccttgc

SEQ ID NO: 3696242 - DNA, 20 bp, Homo sapiens
cccagatctggtcccttgca

SEQ ID NO: 3696243 - DNA, 19 bp, Homo sapiens
cccagcacagcttgacctg

SEQ ID NO: 3696244 - DNA, 19 bp, Homo sapiens
cccagcattccagcccctc

SEQ ID NO: 3696245 - DNA, 20 bp, Homo sapiens
cccagcattccagcccctct

SEQ ID NO: 3696246 - DNA, 14 bp, Homo sapiens
cccagccaccccgg

SEQ ID NO: 3696247 - DNA, 19 bp, Homo sapiens
cccagccaccccgggctct

SEQ ID NO: 3696248 - DNA, 22 bp, Homo sapiens
cccagccaccccgggctctctg

SEQ ID NO: 3696249 - DNA, 13 bp, Homo sapiens
cccagcccagaga

SEQ ID NO: 3696250 - DNA, 20 bp, Homo sapiens
cccagcccccaaccccaaga

SEQ ID NO: 3696251 - DNA, 22 bp, Homo sapiens
cccagctgtgcttatggtacca

SEQ ID NO: 3696252 - DNA, 12 bp, Homo sapiens
cccaggaccagc

SEQ ID NO: 3696253 - DNA, 16 bp, Homo sapiens
cccaggaccagctcag

SEQ ID NO: 3696254 - DNA, 21 bp, Homo sapiens
cccaggaccagctcaggacag

SEQ ID NO: 3696255 - DNA, 13 bp, Homo sapiens
cccaggaccctga

SEQ ID NO: 3696256 - DNA, 23 bp, Homo sapiens
cccaggaccctgaaggggccatg

SEQ ID NO: 3696257 - DNA, 22 bp, Homo sapiens
cccaggagcaagtgaggccgga

SEQ ID NO: 3696258 - DNA, 18 bp, Homo sapiens
cccaggagggagggggct

SEQ ID NO: 3696259 - DNA, 12 bp, Homo sapiens
cccaggcaggga

SEQ ID NO: 3696260 - DNA, 17 bp, Homo sapiens
cccaggcagggagacgg

SEQ ID NO: 3696261 - DNA, 17 bp, Homo sapiens
cccaggccccaggaagc

SEQ ID NO: 3696262 - DNA, 11 bp, Homo sapiens
cccaggctgcc

SEQ ID NO: 3696263 - DNA, 19 bp, Homo sapiens
cccaggctggagtgcagtg

SEQ ID NO: 3696264 - DNA, 19 bp, Homo sapiens
cccagggacacctgggaga

SEQ ID NO: 3696265 - DNA, 14 bp, Homo sapiens
cccagggcccagag

SEQ ID NO: 3696266 - DNA, 14 bp, Homo sapiens
cccagggctcctgc

SEQ ID NO: 3696267 - DNA, 18 bp, Homo sapiens
cccaggggacaagggatt

SEQ ID NO: 3696268 - DNA, 15 bp, Homo sapiens
cccaggggtcccagc

SEQ ID NO: 3696269 - DNA, 16 bp, Homo sapiens
cccaggggtcccagcc

SEQ ID NO: 3696270 - DNA, 18 bp, Homo sapiens
cccaggggtcccagccac

SEQ ID NO: 3696271 - DNA, 19 bp, Homo sapiens
cccaggggtcccagccacc

SEQ ID NO: 3696272 - DNA, 16 bp, Homo sapiens
cccagggtcttcccta

SEQ ID NO: 3696273 - DNA, 18 bp, Homo sapiens
cccagggtcttccctacc

SEQ ID NO: 3696274 - DNA, 18 bp, Homo sapiens
cccaggtccagctctgga

SEQ ID NO: 3696275 - DNA, 12 bp, Homo sapiens
cccagtgcatgg

SEQ ID NO: 3696276 - DNA, 20 bp, Homo sapiens
cccagtgcatggtggccaga

SEQ ID NO: 3696277 - DNA, 22 bp, Homo sapiens
cccagtgcatggtggccagagg

SEQ ID NO: 3696278 - DNA, 14 bp, Homo sapiens
cccagttcaccctg

SEQ ID NO: 3696279 - DNA, 16 bp, Homo sapiens
cccagttcttcctgca

SEQ ID NO: 3696280 - DNA, 19 bp, Homo sapiens
cccagttcttcctgcaacc

SEQ ID NO: 3696281 - DNA, 22 bp, Homo sapiens
cccatcacagggttgggcccag

SEQ ID NO: 3696282 - DNA, 15 bp, Homo sapiens
cccatcccccacctg

SEQ ID NO: 3696283 - DNA, 15 bp, Homo sapiens
cccatcctccagcag

SEQ ID NO: 3696284 - DNA, 21 bp, Homo sapiens
cccatctgcacccccctgggc

SEQ ID NO: 3696285 - DNA, 22 bp, Homo sapiens
cccatctgcacccccctgggct

SEQ ID NO: 3696286 - DNA, 12 bp, Homo sapiens
cccatcttgctt

SEQ ID NO: 3696287 - DNA, 19 bp, Homo sapiens
cccatgaccatactgaggg

SEQ ID NO: 3696288 - DNA, 16 bp, Homo sapiens
cccatgcaagcagagg

SEQ ID NO: 3696289 - DNA, 20 bp, Homo sapiens
cccatgcactgtgaaggacc

SEQ ID NO: 3696290 - DNA, 22 bp, Homo sapiens
cccatgcactgtgaaggaccct

SEQ ID NO: 3696291 - DNA, 21 bp, Homo sapiens
cccatgccaaagctagggtgg

SEQ ID NO: 3696292 - DNA, 20 bp, Homo sapiens
cccattgtccctctgcccca

SEQ ID NO: 3696293 - DNA, 20 bp, Homo sapiens
cccatttctagaacatccct

SEQ ID NO: 3696294 - DNA, 15 bp, Homo sapiens
cctcttaaattatat

SEQ ID NO: 3696295 - DNA, 17 bp, Homo sapiens
cctcttccaaaggcagc

SEQ ID NO: 3696296 - DNA, 14 bp, Homo sapiens
cctcttccccagaa

SEQ ID NO: 3696297 - DNA, 19 bp, Homo sapiens
cctcttctcgtgcctcccc

SEQ ID NO: 3696298 - DNA, 14 bp, Homo sapiens
cctcttctgtccca

SEQ ID NO: 3696299 - DNA, 15 bp, Homo sapiens
cctcttctgtcccaa

SEQ ID NO: 3696300 - DNA, 14 bp, Homo sapiens
cctcttgagcagtg

SEQ ID NO: 3696301 - DNA, 17 bp, Homo sapiens
cctcttggctttgttga

SEQ ID NO: 3696302 - DNA, 15 bp, Homo sapiens
cctctttccctagga

SEQ ID NO: 3696303 - DNA, 15 bp, Homo sapiens
cctctttgctttgct

SEQ ID NO: 3696304 - DNA, 23 bp, Homo sapiens
cctgaaaatgtttttctgccagg

SEQ ID NO: 3696305 - DNA, 18 bp, Homo sapiens
cctgaaagccctgagctt

SEQ ID NO: 3696306 - DNA, 17 bp, Homo sapiens
cctgaagaaccagtccc

SEQ ID NO: 3696307 - DNA, 12 bp, Homo sapiens
cctgaaggcagg

SEQ ID NO: 3696308 - DNA, 15 bp, Homo sapiens
cctgaaggcagggct

SEQ ID NO: 3696309 - DNA, 16 bp, Homo sapiens
cctgaaggggcgtctg

SEQ ID NO: 3696310 - DNA, 17 bp, Homo sapiens
cctgaagtgagaaccca

SEQ ID NO: 3696311 - DNA, 19 bp, Homo sapiens
cctgaatgaggcggagctc

SEQ ID NO: 3696312 - DNA, 13 bp, Homo sapiens
cctgacattgtct

SEQ ID NO: 3696313 - DNA, 22 bp, Homo sapiens
cctgaccaggggccctacctgg

SEQ ID NO: 3696314 - DNA, 23 bp, Homo sapiens
cctgaccaggggccctacctggg

SEQ ID NO: 3696315 - DNA, 14 bp, Homo sapiens
cctgacctgtctca

SEQ ID NO: 3696316 - DNA, 16 bp, Homo sapiens
cctgacctgtctcacc

SEQ ID NO: 3696317 - DNA, 13 bp, Homo sapiens
cctgactcatccg

SEQ ID NO: 3696318 - DNA, 15 bp, Homo sapiens
cctgacttctgttta

SEQ ID NO: 3696319 - DNA, 23 bp, Homo sapiens
cctgagaactgaattttgggact

SEQ ID NO: 3696320 - DNA, 15 bp, Homo sapiens
cctgagacaaatgga

SEQ ID NO: 3696321 - DNA, 19 bp, Homo sapiens
cctgagacaaatggaggcc

SEQ ID NO: 3696322 - DNA, 20 bp, Homo sapiens
cctgagacaaatggaggcct

SEQ ID NO: 3696323 - DNA, 16 bp, Homo sapiens
cctgagatgggccggc

SEQ ID NO: 3696324 - DNA, 16 bp, Homo sapiens
cctgagctttctgcta

SEQ ID NO: 3696325 - DNA, 17 bp, Homo sapiens
cctgaggctgtggtcac

SEQ ID NO: 3696326 - DNA, 22 bp, Homo sapiens
cctgagggcggagcgcctcctt

SEQ ID NO: 3696327 - DNA, 23 bp, Homo sapiens
cctgagggtgggcttttccctgg

SEQ ID NO: 3696328 - DNA, 16 bp, Homo sapiens
cctgagtctgggcagc

SEQ ID NO: 3696329 - DNA, 17 bp, Homo sapiens
cctgataaagcacagct

SEQ ID NO: 3696330 - DNA, 15 bp, Homo sapiens
cctgatcctggaggc

SEQ ID NO: 3696331 - DNA, 18 bp, Homo sapiens
cctgatcctggaggccca

SEQ ID NO: 3696332 - DNA, 13 bp, Homo sapiens
cctgatgctccct

SEQ ID NO: 3696333 - DNA, 14 bp, Homo sapiens
cctgatgctccctc

SEQ ID NO: 3696334 - DNA, 22 bp, Homo sapiens
cctgattaaggcgtggcttctg

SEQ ID NO: 3696335 - DNA, 20 bp, Homo sapiens
cctgatttaggagaagccag

SEQ ID NO: 3696336 - DNA, 21 bp, Homo sapiens
cctgatttaggagaagccagg

SEQ ID NO: 3696337 - DNA, 15 bp, Homo sapiens
cctgcaaaaaatact

SEQ ID NO: 3696338 - DNA, 18 bp, Homo sapiens
cctgcaaccactctgtgg

SEQ ID NO: 3696339 - DNA, 17 bp, Homo sapiens
cctgcaactcaaggact

SEQ ID NO: 3696340 - DNA, 14 bp, Homo sapiens
cctgcacttacttg

SEQ ID NO: 3696341 - DNA, 13 bp, Homo sapiens
cctgcagccagct

SEQ ID NO: 3696342 - DNA, 15 bp, Homo sapiens
cctgcaggcggggct

SEQ ID NO: 3696343 - DNA, 23 bp, Homo sapiens
cctgcaggcggggctcctcctga

SEQ ID NO: 3696344 - DNA, 16 bp, Homo sapiens
cctgcataggctcctt

SEQ ID NO: 3696345 - DNA, 22 bp, Homo sapiens
cctgcataggctccttcctgtg

SEQ ID NO: 3696346 - DNA, 18 bp, Homo sapiens
cctgcatctgaccagcag

SEQ ID NO: 3696347 - DNA, 21 bp, Homo sapiens
cctgccactcactaggccccc

SEQ ID NO: 3696348 - DNA, 21 bp, Homo sapiens
cctgccagcggtttcctggtg

SEQ ID NO: 3696349 - DNA, 13 bp, Homo sapiens
cctgccagctgca

SEQ ID NO: 3696350 - DNA, 16 bp, Homo sapiens
cctgccagctgcactg

SEQ ID NO: 3696351 - DNA, 23 bp, Homo sapiens
cctgccagctgcactgatgctgc

SEQ ID NO: 3696352 - DNA, 12 bp, Homo sapiens
cctgccaggcat

SEQ ID NO: 3696353 - DNA, 23 bp, Homo sapiens
cctgccagggaactggcctgctg

SEQ ID NO: 3696354 - DNA, 16 bp, Homo sapiens
cctgccattcttctgg

SEQ ID NO: 3696355 - DNA, 14 bp, Homo sapiens
cctgccccaggcct

SEQ ID NO: 3696356 - DNA, 13 bp, Homo sapiens
cctgcccgggctc

SEQ ID NO: 3696357 - DNA, 15 bp, Homo sapiens
cctgccctggtccag

SEQ ID NO: 3696358 - DNA, 16 bp, Homo sapiens
cctgcccttgtcccac

SEQ ID NO: 3696359 - DNA, 12 bp, Homo sapiens
cctgcctacgcc

SEQ ID NO: 3696360 - DNA, 16 bp, Homo sapiens
cctgcctacgccagga

SEQ ID NO: 3696361 - DNA, 17 bp, Homo sapiens
cctgcctacgccaggag

SEQ ID NO: 3696362 - DNA, 12 bp, Homo sapiens
cctgcctgaggg

SEQ ID NO: 3696363 - DNA, 13 bp, Homo sapiens
cctgcctggccag

SEQ ID NO: 3696364 - DNA, 16 bp, Homo sapiens
cctgcgaccctggggg

SEQ ID NO: 3696365 - DNA, 15 bp, Homo sapiens
cctgcgcctgtgatg

SEQ ID NO: 3696366 - DNA, 17 bp, Homo sapiens
cctgcgggggcgaggcc

SEQ ID NO: 3696367 - DNA, 21 bp, Homo sapiens
cctgcgggtggggcttggggc

SEQ ID NO: 3696368 - DNA, 24 bp, Homo sapiens
cctgcgggtggggcttggggctca

SEQ ID NO: 3696369 - DNA, 13 bp, Homo sapiens
cctgctccagacc

SEQ ID NO: 3696370 - DNA, 14 bp, Homo sapiens
cctgctccagacct

SEQ ID NO: 3696371 - DNA, 15 bp, Homo sapiens
cctgctccagacctg

SEQ ID NO: 3696372 - DNA, 13 bp, Homo sapiens
cctgctccagctg

SEQ ID NO: 3696373 - DNA, 13 bp, Homo sapiens
cctgctgagctgc

SEQ ID NO: 3696374 - DNA, 22 bp, Homo sapiens
cctgctgagctgcccctgctgc

SEQ ID NO: 3696375 - DNA, 23 bp, Homo sapiens
cctgctgagctgcccctgctgct

SEQ ID NO: 3696376 - DNA, 19 bp, Homo sapiens
cctgctgcgccccaggccc

SEQ ID NO: 3696377 - DNA, 18 bp, Homo sapiens
cctgctgctggtgcacag

SEQ ID NO: 3696378 - DNA, 20 bp, Homo sapiens
cctgctgcttaagtgcatgc

SEQ ID NO: 3696379 - DNA, 18 bp, Homo sapiens
cctgctgtatccctacat

SEQ ID NO: 3696380 - DNA, 12 bp, Homo sapiens
cctgctttctcc

SEQ ID NO: 3696381 - DNA, 15 bp, Homo sapiens
cctggaacctggacc

SEQ ID NO: 3696382 - DNA, 19 bp, Homo sapiens
cctggaacctggaccccag

SEQ ID NO: 3696383 - DNA, 16 bp, Homo sapiens
cctggaacttggggag

SEQ ID NO: 3696384 - DNA, 15 bp, Homo sapiens
cctggacagaggcgg

SEQ ID NO: 3696385 - DNA, 18 bp, Homo sapiens
cctggaccccagccttgg

SEQ ID NO: 3696386 - DNA, 14 bp, Homo sapiens
cctggactttcctg

SEQ ID NO: 3696387 - DNA, 19 bp, Homo sapiens
cctggactttcctgcaact

SEQ ID NO: 3696388 - DNA, 19 bp, Homo sapiens
cctggagatcctcctgcag

SEQ ID NO: 3696389 - DNA, 20 bp, Homo sapiens
cctggagctagtgtctcctc

SEQ ID NO: 3696390 - DNA, 12 bp, Homo sapiens
cctggaggccca

SEQ ID NO: 3696391 - DNA, 13 bp, Homo sapiens
cctggaggcccag

SEQ ID NO: 3696392 - DNA, 21 bp, Homo sapiens
cctggaggtggctgagcccct

SEQ ID NO: 3696393 - DNA, 13 bp, Homo sapiens
cctggatggggca

SEQ ID NO: 3696394 - DNA, 18 bp, Homo sapiens
cctggatggggcagagct

SEQ ID NO: 3696395 - DNA, 21 bp, Homo sapiens
cctggatggggcagagcttct

SEQ ID NO: 3696396 - DNA, 12 bp, Homo sapiens
cctggcagctct

SEQ ID NO: 3696397 - DNA, 14 bp, Homo sapiens
cctggcagctctgg

SEQ ID NO: 3696398 - DNA, 23 bp, Homo sapiens
cctggcagggtcatcctgtgctc

SEQ ID NO: 3696399 - DNA, 21 bp, Homo sapiens
cctggcatcgcaccattctga

SEQ ID NO: 3696400 - DNA, 14 bp, Homo sapiens
cctggccaacatgg

SEQ ID NO: 3696401 - DNA, 13 bp, Homo sapiens
cctggccaggagc

SEQ ID NO: 3696402 - DNA, 15 bp, Homo sapiens
cctggccaggagctc

SEQ ID NO: 3696403 - DNA, 21 bp, Homo sapiens
cctggccaggagctcttcagg

SEQ ID NO: 3696404 - DNA, 14 bp, Homo sapiens
cctggccaggcaga

SEQ ID NO: 3696405 - DNA, 13 bp, Homo sapiens
cctggcccactgc

SEQ ID NO: 3696406 - DNA, 16 bp, Homo sapiens
cctggcccactgcatc

SEQ ID NO: 3696407 - DNA, 15 bp, Homo sapiens
cctggcctcccctgc

SEQ ID NO: 3696408 - DNA, 18 bp, Homo sapiens
cctggcctcccctgccac

SEQ ID NO: 3696409 - DNA, 20 bp, Homo sapiens
cctggcctcccctgccacca

SEQ ID NO: 3696410 - DNA, 22 bp, Homo sapiens
cctggctcccatgaccatactg

SEQ ID NO: 3696411 - DNA, 20 bp, Homo sapiens
ctagactttaaatttaaagt

SEQ ID NO: 3696412 - DNA, 16 bp, Homo sapiens
ctagagaacaggtggt

SEQ ID NO: 3696413 - DNA, 13 bp, Homo sapiens
ctagagagggagg

SEQ ID NO: 3696414 - DNA, 15 bp, Homo sapiens
ctagagcactgccac

SEQ ID NO: 3696415 - DNA, 22 bp, Homo sapiens
ctagaggccagccccacccagg

SEQ ID NO: 3696416 - DNA, 19 bp, Homo sapiens
ctagagggaggggcctagg

SEQ ID NO: 3696417 - DNA, 21 bp, Homo sapiens
ctagagggaggggcctaggcc

SEQ ID NO: 3696418 - DNA, 22 bp, Homo sapiens
ctagagggaggggcctaggcct

SEQ ID NO: 3696419 - DNA, 19 bp, Homo sapiens
ctagagtcctcactcccag

SEQ ID NO: 3696420 - DNA, 17 bp, Homo sapiens
ctagagtgaacttgggc

SEQ ID NO: 3696421 - DNA, 21 bp, Homo sapiens
ctagagtgaacttgggccact

SEQ ID NO: 3696422 - DNA, 17 bp, Homo sapiens
ctagagtgatgactgct

SEQ ID NO: 3696423 - DNA, 15 bp, Homo sapiens
ctagatggctcctct

SEQ ID NO: 3696424 - DNA, 21 bp, Homo sapiens
ctagcaagctgccgaaccaaa

SEQ ID NO: 3696425 - DNA, 17 bp, Homo sapiens
ctagcagaaatctagaa

SEQ ID NO: 3696426 - DNA, 12 bp, Homo sapiens
ctagcagcaggg

SEQ ID NO: 3696427 - DNA, 22 bp, Homo sapiens
ctagcagcagggagggcttctg

SEQ ID NO: 3696428 - DNA, 19 bp, Homo sapiens
ctagcagcccaccctgctg

SEQ ID NO: 3696429 - DNA, 14 bp, Homo sapiens
ctaggaaactcaca

SEQ ID NO: 3696430 - DNA, 11 bp, Homo sapiens
ctaggatgggg

SEQ ID NO: 3696431 - DNA, 14 bp, Homo sapiens
ctaggatggggcac

SEQ ID NO: 3696432 - DNA, 16 bp, Homo sapiens
ctaggatggggcacgg

SEQ ID NO: 3696433 - DNA, 23 bp, Homo sapiens
ctaggatggggcacggctctggg

SEQ ID NO: 3696434 - DNA, 21 bp, Homo sapiens
ctaggcatttgctgaatacag

SEQ ID NO: 3696435 - DNA, 16 bp, Homo sapiens
ctaggcccccacttgc

SEQ ID NO: 3696436 - DNA, 17 bp, Homo sapiens
ctaggcccccacttgcc

SEQ ID NO: 3696437 - DNA, 15 bp, Homo sapiens
ctaggcctcagccag

SEQ ID NO: 3696438 - DNA, 18 bp, Homo sapiens
ctaggcctcagccagaga

SEQ ID NO: 3696439 - DNA, 19 bp, Homo sapiens
ctaggcctcagccagagaa

SEQ ID NO: 3696440 - DNA, 19 bp, Homo sapiens
ctaggcgattttgtctacc

SEQ ID NO: 3696441 - DNA, 17 bp, Homo sapiens
ctaggctggagcccagg

SEQ ID NO: 3696442 - DNA, 21 bp, Homo sapiens
ctagggaaaaaccagcgtgtg

SEQ ID NO: 3696443 - DNA, 14 bp, Homo sapiens
ctagggaagataat

SEQ ID NO: 3696444 - DNA, 17 bp, Homo sapiens
ctagggattcaggctgc

SEQ ID NO: 3696445 - DNA, 16 bp, Homo sapiens
ctaggtaggcttctac

SEQ ID NO: 3696446 - DNA, 16 bp, Homo sapiens
ctagtaaaaatacaaa

SEQ ID NO: 3696447 - DNA, 19 bp, Homo sapiens
ctagtcaagctcctcctcc

SEQ ID NO: 3696448 - DNA, 21 bp, Homo sapiens
ctagtcaatcaagtctgttta

SEQ ID NO: 3696449 - DNA, 14 bp, Homo sapiens
ctagtcccttcccc

SEQ ID NO: 3696450 - DNA, 19 bp, Homo sapiens
ctagtcttgaatttctgac

SEQ ID NO: 3696451 - DNA, 18 bp, Homo sapiens
ctagtgacttgtgtccca

SEQ ID NO: 3696452 - DNA, 20 bp, Homo sapiens
ctagtgacttgtgtcccatg

SEQ ID NO: 3696453 - DNA, 18 bp, Homo sapiens
ctagtgttctgtttgtta

SEQ ID NO: 3696454 - DNA, 23 bp, Homo sapiens
ctagttaccacattactctgcct

SEQ ID NO: 3696455 - DNA, 19 bp, Homo sapiens
ctataaagagaagacgaaa

SEQ ID NO: 3696456 - DNA, 12 bp, Homo sapiens
ctatagaataaa

SEQ ID NO: 3696457 - DNA, 12 bp, Homo sapiens
ctatagcctggg

SEQ ID NO: 3696458 - DNA, 18 bp, Homo sapiens
ctatagcctggggtgggg

SEQ ID NO: 3696459 - DNA, 15 bp, Homo sapiens
ctatagtatttgatt

SEQ ID NO: 3696460 - DNA, 22 bp, Homo sapiens
ctatagtatttgattcaaaata

SEQ ID NO: 3696461 - DNA, 12 bp, Homo sapiens
ctatatatttct

SEQ ID NO: 3696462 - DNA, 16 bp, Homo sapiens
ctatatatttctatta

SEQ ID NO: 3696463 - DNA, 15 bp, Homo sapiens
ctatattgtacacac

SEQ ID NO: 3696464 - DNA, 15 bp, Homo sapiens
ctatcaacaataaaa

SEQ ID NO: 3696465 - DNA, 16 bp, Homo sapiens
ctatctgtctggtggc

SEQ ID NO: 3696466 - DNA, 17 bp, Homo sapiens
ctatgaattctaagtga

SEQ ID NO: 3696467 - DNA, 15 bp, Homo sapiens
ctatgatttggaaaa

SEQ ID NO: 3696468 - DNA, 18 bp, Homo sapiens
ctatgcttaataaaagaa

SEQ ID NO: 3696469 - DNA, 12 bp, Homo sapiens
ctatgcttcctc

SEQ ID NO: 3696470 - DNA, 11 bp, Homo sapiens
ctatgctttga

SEQ ID NO: 3696471 - DNA, 13 bp, Homo sapiens
ctatgggagcccc

SEQ ID NO: 3696472 - DNA, 14 bp, Homo sapiens
ctatggtgctctgt

SEQ ID NO: 3696473 - DNA, 17 bp, Homo sapiens
ctatggtgctctgtcta

SEQ ID NO: 3696474 - DNA, 11 bp, Homo sapiens
ctatgtatgtt

SEQ ID NO: 3696475 - DNA, 18 bp, Homo sapiens
ctatgtgtatgttgactt

SEQ ID NO: 3696476 - DNA, 16 bp, Homo sapiens
ctattcccatcgctgg

SEQ ID NO: 3696477 - DNA, 16 bp, Homo sapiens
ctatttcttaaacact

SEQ ID NO: 3696478 - DNA, 12 bp, Homo sapiens
ctattttcagat

SEQ ID NO: 3696479 - DNA, 18 bp, Homo sapiens
ctattttcagatgtgaac

SEQ ID NO: 3696480 - DNA, 14 bp, Homo sapiens
ctatttttgtaaag

SEQ ID NO: 3696481 - DNA, 19 bp, Homo sapiens
ctatttttgtaaagtttcc

SEQ ID NO: 3696482 - DNA, 17 bp, Homo sapiens
ctcaaaaaaagaaaaag

SEQ ID NO: 3696483 - DNA, 11 bp, Homo sapiens
ctcaaaggcac

SEQ ID NO: 3696484 - DNA, 23 bp, Homo sapiens
ctcaaagtgactattcagttttc

SEQ ID NO: 3696485 - DNA, 21 bp, Homo sapiens
ctcaaatggggccagatccag

SEQ ID NO: 3696486 - DNA, 12 bp, Homo sapiens
ctcaaatgtgtg

SEQ ID NO: 3696487 - DNA, 20 bp, Homo sapiens
ctcaaatgtgtgttcctgct

SEQ ID NO: 3696488 - DNA, 21 bp, Homo sapiens
ctcaacacctctgcacaagct

SEQ ID NO: 3696489 - DNA, 15 bp, Homo sapiens
ctcaaccatcccctc

SEQ ID NO: 3696490 - DNA, 20 bp, Homo sapiens
ctcaaccatcccctccgtgg

SEQ ID NO: 3696491 - DNA, 15 bp, Homo sapiens
ctcaagagatcccaa

SEQ ID NO: 3696492 - DNA, 22 bp, Homo sapiens
ctcaagccaagcagccaagctc

SEQ ID NO: 3696493 - DNA, 12 bp, Homo sapiens
ctcaagccctgc

SEQ ID NO: 3696494 - DNA, 13 bp, Homo sapiens
ctcaagccctgca

SEQ ID NO: 3696495 - DNA, 22 bp, Homo sapiens
ctcaaggactttgcagccggca

SEQ ID NO: 3696496 - DNA, 20 bp, Homo sapiens
ctcaaggtgcggggagaaga

SEQ ID NO: 3696497 - DNA, 19 bp, Homo sapiens
ctcaatattttccatgaaa

SEQ ID NO: 3696498 - DNA, 16 bp, Homo sapiens
ctcacaaagtgctggg

SEQ ID NO: 3696499 - DNA, 18 bp, Homo sapiens
ctcacactcccctagggg

SEQ ID NO: 3696500 - DNA, 22 bp, Homo sapiens
ctcacagtgggagccagggctg

SEQ ID NO: 3696501 - DNA, 21 bp, Homo sapiens
ctcacccatgcaagcagagga

SEQ ID NO: 3696502 - DNA, 13 bp, Homo sapiens
ctcaccctgcctt

SEQ ID NO: 3696503 - DNA, 15 bp, Homo sapiens
ctcacctagcctgat

SEQ ID NO: 3696504 - DNA, 14 bp, Homo sapiens
ctcacctcctgctg

SEQ ID NO: 3696505 - DNA, 15 bp, Homo sapiens
ctcacctctggactg

SEQ ID NO: 3696506 - DNA, 11 bp, Homo sapiens
ctcacctgggg

SEQ ID NO: 3696507 - DNA, 23 bp, Homo sapiens
ctcacgcttacctcaaccatcct

SEQ ID NO: 3696508 - DNA, 16 bp, Homo sapiens
ctcacgtgagagtgtc

SEQ ID NO: 3696509 - DNA, 13 bp, Homo sapiens
ctcactaattttt

SEQ ID NO: 3696510 - DNA, 19 bp, Homo sapiens
ctcactgtttgtttttatt

SEQ ID NO: 3696511 - DNA, 23 bp, Homo sapiens
ctcagaaccttgtcccagccagt

SEQ ID NO: 3696512 - DNA, 22 bp, Homo sapiens
ctcagaagaggttgggcttcca

SEQ ID NO: 3696513 - DNA, 23 bp, Homo sapiens
ctcagaggccttgctgtggagct

SEQ ID NO: 3696514 - DNA, 17 bp, Homo sapiens
ctcagagtcggaacgga

SEQ ID NO: 3696515 - DNA, 10 bp, Homo sapiens
ctcagatcca

SEQ ID NO: 3696516 - DNA, 13 bp, Homo sapiens
ctcagatccaggg

SEQ ID NO: 3696517 - DNA, 15 bp, Homo sapiens
ctcagatccagggac

SEQ ID NO: 3696518 - DNA, 16 bp, Homo sapiens
ctcagatccagggaca

SEQ ID NO: 3696519 - DNA, 17 bp, Homo sapiens
ctcagatccagggacag

SEQ ID NO: 3696520 - DNA, 18 bp, Homo sapiens
ctcagatccagggacaga

SEQ ID NO: 3696521 - DNA, 22 bp, Homo sapiens
ctcagatccagggacagaggcc

SEQ ID NO: 3696522 - DNA, 20 bp, Homo sapiens
ctcagatggaaccgcaggaa

SEQ ID NO: 3696523 - DNA, 23 bp, Homo sapiens
ctcagatggaaccgcaggaagct

SEQ ID NO: 3696524 - DNA, 19 bp, Homo sapiens
ctcagcaaaagatgcttct

SEQ ID NO: 3696525 - DNA, 20 bp, Homo sapiens
ctcagcatttgattaacatt

SEQ ID NO: 3696526 - DNA, 14 bp, Homo sapiens
ctcagccagagaag

SEQ ID NO: 3696527 - DNA, 14 bp, Homo sapiens
ctcagcctctgcca

SEQ ID NO: 3696528 - DNA, 24 bp, Homo sapiens
ctggctctgagcgcctccatccaa

SEQ ID NO: 3696529 - DNA, 21 bp, Homo sapiens
ctggctgggtggcaccagcag

SEQ ID NO: 3696530 - DNA, 21 bp, Homo sapiens
ctggcttagtgccacccacct

SEQ ID NO: 3696531 - DNA, 22 bp, Homo sapiens
ctggcttagtgccacccacctt

SEQ ID NO: 3696532 - DNA, 17 bp, Homo sapiens
ctggcttctggccagga

SEQ ID NO: 3696533 - DNA, 19 bp, Homo sapiens
ctggcttctggccaggaag

SEQ ID NO: 3696534 - DNA, 16 bp, Homo sapiens
ctggctttggaatgct

SEQ ID NO: 3696535 - DNA, 13 bp, Homo sapiens
ctgggaaggttcc

SEQ ID NO: 3696536 - DNA, 16 bp, Homo sapiens
ctgggaccaggctcca

SEQ ID NO: 3696537 - DNA, 16 bp, Homo sapiens
ctgggactcagccttc

SEQ ID NO: 3696538 - DNA, 18 bp, Homo sapiens
ctgggagaaatctggctt

SEQ ID NO: 3696539 - DNA, 21 bp, Homo sapiens
ctgggagaggacagggacttc

SEQ ID NO: 3696540 - DNA, 21 bp, Homo sapiens
ctgggagctccactctgcttc

SEQ ID NO: 3696541 - DNA, 18 bp, Homo sapiens
ctgggaggtcaaggctgc

SEQ ID NO: 3696542 - DNA, 13 bp, Homo sapiens
ctgggatcctaag

SEQ ID NO: 3696543 - DNA, 14 bp, Homo sapiens
ctgggatgtttctg

SEQ ID NO: 3696544 - DNA, 23 bp, Homo sapiens
ctgggattacaggtgtgagccac

SEQ ID NO: 3696545 - DNA, 20 bp, Homo sapiens
ctgggcaatgtgataaaacc

SEQ ID NO: 3696546 - DNA, 14 bp, Homo sapiens
ctgggcagaaggcc

SEQ ID NO: 3696547 - DNA, 17 bp, Homo sapiens
ctgggcagccaggctgc

SEQ ID NO: 3696548 - DNA, 20 bp, Homo sapiens
ctgggcaggttggtgggggc

SEQ ID NO: 3696549 - DNA, 17 bp, Homo sapiens
ctgggccccgagccacg

SEQ ID NO: 3696550 - DNA, 21 bp, Homo sapiens
ctgggcccgacatggctccgg

SEQ ID NO: 3696551 - DNA, 11 bp, Homo sapiens
ctgggccctga

SEQ ID NO: 3696552 - DNA, 13 bp, Homo sapiens
ctgggccctgagt

SEQ ID NO: 3696553 - DNA, 22 bp, Homo sapiens
ctgggccctgagtctgggcagc

SEQ ID NO: 3696554 - DNA, 14 bp, Homo sapiens
ctgggccctgggct

SEQ ID NO: 3696555 - DNA, 18 bp, Homo sapiens
ctgggccctgggctggaa

SEQ ID NO: 3696556 - DNA, 18 bp, Homo sapiens
ctgggcctcagtttccct

SEQ ID NO: 3696557 - DNA, 13 bp, Homo sapiens
ctgggcctgcaga

SEQ ID NO: 3696558 - DNA, 14 bp, Homo sapiens
ctgggctaccccac

SEQ ID NO: 3696559 - DNA, 15 bp, Homo sapiens
ctgggctaccccacc

SEQ ID NO: 3696560 - DNA, 13 bp, Homo sapiens
ctgggctgagaga

SEQ ID NO: 3696561 - DNA, 19 bp, Homo sapiens
ctggggaaagcctgaaggg

SEQ ID NO: 3696562 - DNA, 13 bp, Homo sapiens
ctgggggaagaag

SEQ ID NO: 3696563 - DNA, 19 bp, Homo sapiens
ctgggggcacaggaggcag

SEQ ID NO: 3696564 - DNA, 18 bp, Homo sapiens
ctgggggcgggactcctc

SEQ ID NO: 3696565 - DNA, 22 bp, Homo sapiens
ctgggggcgggactcctccctg

SEQ ID NO: 3696566 - DNA, 20 bp, Homo sapiens
ctggggggacccagtgcaga

SEQ ID NO: 3696567 - DNA, 15 bp, Homo sapiens
ctgggggtgggccag

SEQ ID NO: 3696568 - DNA, 22 bp, Homo sapiens
ctgggggtggggctcctacctg

SEQ ID NO: 3696569 - DNA, 23 bp, Homo sapiens
ctgggggtggggctcctacctgg

SEQ ID NO: 3696570 - DNA, 19 bp, Homo sapiens
ctggggtttgaccacccac

SEQ ID NO: 3696571 - DNA, 22 bp, Homo sapiens
ctgggtccaggggatgggaggt

SEQ ID NO: 3696572 - DNA, 14 bp, Homo sapiens
ctgggtgctcccta

SEQ ID NO: 3696573 - DNA, 16 bp, Homo sapiens
ctgggtggagcaggac

SEQ ID NO: 3696574 - DNA, 20 bp, Homo sapiens
ctgggtggagcaggactccc

SEQ ID NO: 3696575 - DNA, 23 bp, Homo sapiens
ctgggtggcaccagcagcctgga

SEQ ID NO: 3696576 - DNA, 18 bp, Homo sapiens
ctgggtgggcggggcact

SEQ ID NO: 3696577 - DNA, 19 bp, Homo sapiens
ctgggtggtctgcaggcag

SEQ ID NO: 3696578 - DNA, 20 bp, Homo sapiens
ctgggtgtccccgctgctgt

SEQ ID NO: 3696579 - DNA, 21 bp, Homo sapiens
ctgggttccctttccttccat

SEQ ID NO: 3696580 - DNA, 18 bp, Homo sapiens
ctgggttgcagacaggaa

SEQ ID NO: 3696581 - DNA, 17 bp, Homo sapiens
ctggtccagggaagctg

SEQ ID NO: 3696582 - DNA, 22 bp, Homo sapiens
ctggtccagggaagctggccga

SEQ ID NO: 3696583 - DNA, 13 bp, Homo sapiens
ctggtcctaccca

SEQ ID NO: 3696584 - DNA, 15 bp, Homo sapiens
ctggtcgctcctgcc

SEQ ID NO: 3696585 - DNA, 18 bp, Homo sapiens
ctggtcgctcctgcccac

SEQ ID NO: 3696586 - DNA, 14 bp, Homo sapiens
ctggtctgtaggga

SEQ ID NO: 3696587 - DNA, 16 bp, Homo sapiens
ctggtgcactttgtaa

SEQ ID NO: 3696588 - DNA, 17 bp, Homo sapiens
ctggtgcactttgtaaa

SEQ ID NO: 3696589 - DNA, 12 bp, Homo sapiens
ctggtgcagtgg

SEQ ID NO: 3696590 - DNA, 15 bp, Homo sapiens
ctggtgctactccat

SEQ ID NO: 3696591 - DNA, 17 bp, Homo sapiens
ctggtgctgcagcaccg

SEQ ID NO: 3696592 - DNA, 22 bp, Homo sapiens
ctggtggccactgagctggctg

SEQ ID NO: 3696593 - DNA, 16 bp, Homo sapiens
ctggtggcccagctat

SEQ ID NO: 3696594 - DNA, 13 bp, Homo sapiens
ctggtggcccagg

SEQ ID NO: 3696595 - DNA, 15 bp, Homo sapiens
ctggtggctgggctg

SEQ ID NO: 3696596 - DNA, 13 bp, Homo sapiens
ctggtgggccaac

SEQ ID NO: 3696597 - DNA, 20 bp, Homo sapiens
ctggtggtctgttggcaggc

SEQ ID NO: 3696598 - DNA, 15 bp, Homo sapiens
ctggtggtggcctgt

SEQ ID NO: 3696599 - DNA, 15 bp, Homo sapiens
ctggtggttgctgtt

SEQ ID NO: 3696600 - DNA, 16 bp, Homo sapiens
ctggttccagggtccc

SEQ ID NO: 3696601 - DNA, 18 bp, Homo sapiens
ctggttccagggtccctc

SEQ ID NO: 3696602 - DNA, 23 bp, Homo sapiens
ctggttccagggtccctctgtgt

SEQ ID NO: 3696603 - DNA, 22 bp, Homo sapiens
ctggttgcctcatggccagcgc

SEQ ID NO: 3696604 - DNA, 18 bp, Homo sapiens
ctggttgtctgaacccag

SEQ ID NO: 3696605 - DNA, 20 bp, Homo sapiens
ctggttgtctgaacccaggc

SEQ ID NO: 3696606 - DNA, 20 bp, Homo sapiens
ctgtaatcctagcactttgg

SEQ ID NO: 3696607 - DNA, 18 bp, Homo sapiens
ctgtactgttactgggcc

SEQ ID NO: 3696608 - DNA, 22 bp, Homo sapiens
ctgtactgttactgggccctga

SEQ ID NO: 3696609 - DNA, 13 bp, Homo sapiens
ctgtagagtggga

SEQ ID NO: 3696610 - DNA, 16 bp, Homo sapiens
ctgtagcacttactgg

SEQ ID NO: 3696611 - DNA, 14 bp, Homo sapiens
ctgtagctttcctg

SEQ ID NO: 3696612 - DNA, 16 bp, Homo sapiens
ctgtagctttcctggt

SEQ ID NO: 3696613 - DNA, 20 bp, Homo sapiens
ctgtagggagggcggcaggg

SEQ ID NO: 3696614 - DNA, 18 bp, Homo sapiens
ctgtagtaggcattttta

SEQ ID NO: 3696615 - DNA, 15 bp, Homo sapiens
ctgtatataaatgtg

SEQ ID NO: 3696616 - DNA, 16 bp, Homo sapiens
ctgtatatttgtaaag

SEQ ID NO: 3696617 - DNA, 20 bp, Homo sapiens
ctgtatatttgtaaagctat

SEQ ID NO: 3696618 - DNA, 23 bp, Homo sapiens
ctgtatttatgtgtgaggagctg

SEQ ID NO: 3696619 - DNA, 13 bp, Homo sapiens
ctgtcaatcacag

SEQ ID NO: 3696620 - DNA, 19 bp, Homo sapiens
ctgtcatggtcctttctgg

SEQ ID NO: 3696621 - DNA, 20 bp, Homo sapiens
ctgtcatggtcctttctgga

SEQ ID NO: 3696622 - DNA, 23 bp, Homo sapiens
ctgtcatggtcctttctggaagt

SEQ ID NO: 3696623 - DNA, 15 bp, Homo sapiens
ctgtccaaactgcct

SEQ ID NO: 3696624 - DNA, 20 bp, Homo sapiens
ctgtccaaactgcctaagcc

SEQ ID NO: 3696625 - DNA, 19 bp, Homo sapiens
ctgtccaaaggaggctggc

SEQ ID NO: 3696626 - DNA, 22 bp, Homo sapiens
ctgtccaaaggaggctggcagg

SEQ ID NO: 3696627 - DNA, 14 bp, Homo sapiens
ctgtccacgcgtgc

SEQ ID NO: 3696628 - DNA, 18 bp, Homo sapiens
ctgtccagcctgggcagc

SEQ ID NO: 3696629 - DNA, 14 bp, Homo sapiens
ctgtccagctccaa

SEQ ID NO: 3696630 - DNA, 17 bp, Homo sapiens
ctgtccagctccaacct

SEQ ID NO: 3696631 - DNA, 18 bp, Homo sapiens
ctgtccagctccaacctg

SEQ ID NO: 3696632 - DNA, 21 bp, Homo sapiens
ctgtccagctccaacctgcaa

SEQ ID NO: 3696633 - DNA, 14 bp, Homo sapiens
ctgtcccaagtctc

SEQ ID NO: 3696634 - DNA, 17 bp, Homo sapiens
ctgtcccaagtctccag

SEQ ID NO: 3696635 - DNA, 16 bp, Homo sapiens
ctgtcccttgcctcaa

SEQ ID NO: 3696636 - DNA, 13 bp, Homo sapiens
ctgtcctcagcct

SEQ ID NO: 3696637 - DNA, 14 bp, Homo sapiens
ctgtcctcagcctt

SEQ ID NO: 3696638 - DNA, 20 bp, Homo sapiens
ctgtcctcagccttgccaga

SEQ ID NO: 3696639 - DNA, 18 bp, Homo sapiens
ctgtcctgacctgtctca

SEQ ID NO: 3696640 - DNA, 14 bp, Homo sapiens
ctgtcctgggcctg

SEQ ID NO: 3696641 - DNA, 18 bp, Homo sapiens
ctgtcctgggcctgcaga

SEQ ID NO: 3696642 - DNA, 17 bp, Homo sapiens
ctgtccttacccatctg

SEQ ID NO: 3696643 - DNA, 22 bp, Homo sapiens
ctgtcctttctagagcactgcc

SEQ ID NO: 3696644 - DNA, 22 bp, Homo sapiens
cttttcctgataaagcacagct

SEQ ID NO: 3696645 - DNA, 13 bp, Homo sapiens
cttttccttgggg

SEQ ID NO: 3696646 - DNA, 17 bp, Homo sapiens
cttttccttggggcagg

SEQ ID NO: 3696647 - DNA, 21 bp, Homo sapiens
cttttccttggggcaggcagt

SEQ ID NO: 3696648 - DNA, 14 bp, Homo sapiens
cttttctttaaaga

SEQ ID NO: 3696649 - DNA, 17 bp, Homo sapiens
cttttgcttttggcaaa

SEQ ID NO: 3696650 - DNA, 16 bp, Homo sapiens
cttttgtctaattaaa

SEQ ID NO: 3696651 - DNA, 20 bp, Homo sapiens
ctttttaaggtctttcagta

SEQ ID NO: 3696652 - DNA, 14 bp, Homo sapiens
ctttttaataaaaa

SEQ ID NO: 3696653 - DNA, 16 bp, Homo sapiens
ctttttagtaatttct

SEQ ID NO: 3696654 - DNA, 17 bp, Homo sapiens
ctttttcaggagaatta

SEQ ID NO: 3696655 - DNA, 12 bp, Homo sapiens
ctttttctaatg

SEQ ID NO: 3696656 - DNA, 20 bp, Homo sapiens
ctttttctaatgaggagaga

SEQ ID NO: 3696657 - DNA, 18 bp, Homo sapiens
cttttttaaatattttct

SEQ ID NO: 3696658 - DNA, 21 bp, Homo sapiens
cttttttgttttttcaaaata

SEQ ID NO: 3696659 - DNA, 20 bp, Homo sapiens
gaaaaaaaaaaagaagaaga

SEQ ID NO: 3696660 - DNA, 16 bp, Homo sapiens
gaaaaaaaccacacaa

SEQ ID NO: 3696661 - DNA, 21 bp, Homo sapiens
gaaaaaaatgttgtttcctaa

SEQ ID NO: 3696662 - DNA, 12 bp, Homo sapiens
gaaaaaggagga

SEQ ID NO: 3696663 - DNA, 15 bp, Homo sapiens
gaaaaatatttctga

SEQ ID NO: 3696664 - DNA, 13 bp, Homo sapiens
gaaaacaaaactg

SEQ ID NO: 3696665 - DNA, 20 bp, Homo sapiens
gaaaacaatggagtattctc

SEQ ID NO: 3696666 - DNA, 13 bp, Homo sapiens
gaaaacaggagag

SEQ ID NO: 3696667 - DNA, 13 bp, Homo sapiens
gaaaacctcatgg

SEQ ID NO: 3696668 - DNA, 23 bp, Homo sapiens
gaaaagaaaaatgagcctggcaa

SEQ ID NO: 3696669 - DNA, 10 bp, Homo sapiens
gaaaagttat

SEQ ID NO: 3696670 - DNA, 23 bp, Homo sapiens
gaaaataaatcaatgctataact

SEQ ID NO: 3696671 - DNA, 16 bp, Homo sapiens
gaaaatatatgtattt

SEQ ID NO: 3696672 - DNA, 14 bp, Homo sapiens
gaaaatcagcctgc

SEQ ID NO: 3696673 - DNA, 15 bp, Homo sapiens
gaaaatcagtgacat

SEQ ID NO: 3696674 - DNA, 20 bp, Homo sapiens
gaaaatgcaacaacatgtat

SEQ ID NO: 3696675 - DNA, 23 bp, Homo sapiens
gaaaatgcagcagggatgccctg

SEQ ID NO: 3696676 - DNA, 23 bp, Homo sapiens
gaaaatgctgtattagtcacaga

SEQ ID NO: 3696677 - DNA, 14 bp, Homo sapiens
gaaacaacttggaa

SEQ ID NO: 3696678 - DNA, 16 bp, Homo sapiens
gaaacacactgaggca

SEQ ID NO: 3696679 - DNA, 20 bp, Homo sapiens
gaaacagcctgtgtctttaa

SEQ ID NO: 3696680 - DNA, 16 bp, Homo sapiens
gaaacattttttaaaa

SEQ ID NO: 3696681 - DNA, 21 bp, Homo sapiens
gaaactcacactcccctaggg

SEQ ID NO: 3696682 - DNA, 22 bp, Homo sapiens
gaaactcagagtcggaacggag

SEQ ID NO: 3696683 - DNA, 21 bp, Homo sapiens
gaaactgtcggtttgctttga

SEQ ID NO: 3696684 - DNA, 22 bp, Homo sapiens
gaaagaactgtcatgtaaacat

SEQ ID NO: 3696685 - DNA, 21 bp, Homo sapiens
gaaagaggctgaggcctggac

SEQ ID NO: 3696686 - DNA, 22 bp, Homo sapiens
gaaagccctgagctttctgcta

SEQ ID NO: 3696687 - DNA, 14 bp, Homo sapiens
gaaagccttctttt

SEQ ID NO: 3696688 - DNA, 14 bp, Homo sapiens
gaaaggaacatttt

SEQ ID NO: 3696689 - DNA, 20 bp, Homo sapiens
gaaaggcaggaagggaagcg

SEQ ID NO: 3696690 - DNA, 14 bp, Homo sapiens
gaaaggccagctgg

SEQ ID NO: 3696691 - DNA, 21 bp, Homo sapiens
gaaaggccagctggcagcaga

SEQ ID NO: 3696692 - DNA, 22 bp, Homo sapiens
gaaagggagctatcaggaacag

SEQ ID NO: 3696693 - DNA, 17 bp, Homo sapiens
gaaaggggtcggctgac

SEQ ID NO: 3696694 - DNA, 17 bp, Homo sapiens
gaaagggtcctgctttc

SEQ ID NO: 3696695 - DNA, 16 bp, Homo sapiens
gaaaggtggtgtttct

SEQ ID NO: 3696696 - DNA, 22 bp, Homo sapiens
gaaaggtggtgtttctgtaaga

SEQ ID NO: 3696697 - DNA, 16 bp, Homo sapiens
gaaagtacagcagtag

SEQ ID NO: 3696698 - DNA, 13 bp, Homo sapiens
gaaagtgcatttt

SEQ ID NO: 3696699 - DNA, 20 bp, Homo sapiens
gaaagtgcatttttgtaaat

SEQ ID NO: 3696700 - DNA, 13 bp, Homo sapiens
gaaagttcatgct

SEQ ID NO: 3696701 - DNA, 20 bp, Homo sapiens
gaaagtttcgttatattaaa

SEQ ID NO: 3696702 - DNA, 13 bp, Homo sapiens
gaaataagagcag

SEQ ID NO: 3696703 - DNA, 16 bp, Homo sapiens
gaaataagagcagtca

SEQ ID NO: 3696704 - DNA, 22 bp, Homo sapiens
gaaataccacaagcctgagaac

SEQ ID NO: 3696705 - DNA, 15 bp, Homo sapiens
gaaatagtctgtgtg

SEQ ID NO: 3696706 - DNA, 22 bp, Homo sapiens
gaaatctggcttctggccagga

SEQ ID NO: 3696707 - DNA, 21 bp, Homo sapiens
gaaatggtccgctttcctgga

SEQ ID NO: 3696708 - DNA, 20 bp, Homo sapiens
gaaatgtattaatgtatgta

SEQ ID NO: 3696709 - DNA, 14 bp, Homo sapiens
gaaattaaggaaca

SEQ ID NO: 3696710 - DNA, 15 bp, Homo sapiens
gaaattaaggaacat

SEQ ID NO: 3696711 - DNA, 21 bp, Homo sapiens
gaaattcagcccaccagccac

SEQ ID NO: 3696712 - DNA, 23 bp, Homo sapiens
gaaattcagcccaccagccacct

SEQ ID NO: 3696713 - DNA, 17 bp, Homo sapiens
gaacacgcgtatttaca

SEQ ID NO: 3696714 - DNA, 21 bp, Homo sapiens
gaacagctatgggagccccag

SEQ ID NO: 3696715 - DNA, 13 bp, Homo sapiens
gaacatgaagcca

SEQ ID NO: 3696716 - DNA, 16 bp, Homo sapiens
gaacattggagctgac

SEQ ID NO: 3696717 - DNA, 16 bp, Homo sapiens
gaaccaaatctggaag

SEQ ID NO: 3696718 - DNA, 13 bp, Homo sapiens
gaaccacctaccc

SEQ ID NO: 3696719 - DNA, 14 bp, Homo sapiens
gaaccacctacccc

SEQ ID NO: 3696720 - DNA, 21 bp, Homo sapiens
gaaccacgcgggggccttgag

SEQ ID NO: 3696721 - DNA, 19 bp, Homo sapiens
gaaccactacatgcagccc

SEQ ID NO: 3696722 - DNA, 16 bp, Homo sapiens
gaacccagactcagac

SEQ ID NO: 3696723 - DNA, 19 bp, Homo sapiens
gaacccagactcagacatt

SEQ ID NO: 3696724 - DNA, 12 bp, Homo sapiens
gaacccaggcag

SEQ ID NO: 3696725 - DNA, 15 bp, Homo sapiens
gaacccaggcagctg

SEQ ID NO: 3696726 - DNA, 17 bp, Homo sapiens
gaacccaggcagctggc

SEQ ID NO: 3696727 - DNA, 21 bp, Homo sapiens
gaacccaggcagctggcagga

SEQ ID NO: 3696728 - DNA, 13 bp, Homo sapiens
gaaccgcaggaag

SEQ ID NO: 3696729 - DNA, 15 bp, Homo sapiens
gaaccgcaggaagct

SEQ ID NO: 3696730 - DNA, 16 bp, Homo sapiens
gaaccgcaggaagctg

SEQ ID NO: 3696731 - DNA, 20 bp, Homo sapiens
gaaccgcaggaagctgctcc

SEQ ID NO: 3696732 - DNA, 16 bp, Homo sapiens
gaaccgccctcctgat

SEQ ID NO: 3696733 - DNA, 21 bp, Homo sapiens
gaacctcacgcacctcccatc

SEQ ID NO: 3696734 - DNA, 15 bp, Homo sapiens
gaacctcagcctggc

SEQ ID NO: 3696735 - DNA, 17 bp, Homo sapiens
gaacctcttccccagaa

SEQ ID NO: 3696736 - DNA, 16 bp, Homo sapiens
gaacctggaacttggg

SEQ ID NO: 3696737 - DNA, 21 bp, Homo sapiens
gaacctgggttgcagacagga

SEQ ID NO: 3696738 - DNA, 12 bp, Homo sapiens
gaacctgtgtcc

SEQ ID NO: 3696739 - DNA, 14 bp, Homo sapiens
gaacctttctgtgt

SEQ ID NO: 3696740 - DNA, 19 bp, Homo sapiens
gaacgttttttcctcagtg

SEQ ID NO: 3696741 - DNA, 20 bp, Homo sapiens
gaactcaaatggggccagat

SEQ ID NO: 3696742 - DNA, 14 bp, Homo sapiens
gaactcagatccag

SEQ ID NO: 3696743 - DNA, 17 bp, Homo sapiens
gaactccaggccctcct

SEQ ID NO: 3696744 - DNA, 17 bp, Homo sapiens
gaactgcacactcagtg

SEQ ID NO: 3696745 - DNA, 18 bp, Homo sapiens
gaactgcacactcagtgg

SEQ ID NO: 3696746 - DNA, 19 bp, Homo sapiens
gaactgcaggccctggcct

SEQ ID NO: 3696747 - DNA, 17 bp, Homo sapiens
gaactggaagaaagcaa

SEQ ID NO: 3696748 - DNA, 16 bp, Homo sapiens
gaactggcctgctgcg

SEQ ID NO: 3696749 - DNA, 21 bp, Homo sapiens
gaactgttacaacttgtattt

SEQ ID NO: 3696750 - DNA, 22 bp, Homo sapiens
gaactgttgcccttctgtccaa

SEQ ID NO: 3696751 - DNA, 21 bp, Homo sapiens
gaacttgctgggtggttctct

SEQ ID NO: 3696752 - DNA, 18 bp, Homo sapiens
gaagacaattgacaacag

SEQ ID NO: 3696753 - DNA, 13 bp, Homo sapiens
gaagacagagaaa

SEQ ID NO: 3696754 - DNA, 22 bp, Homo sapiens
gaagatcctgcgggtggggctt

SEQ ID NO: 3696755 - DNA, 20 bp, Homo sapiens
gaagcactacaccttgcctt

SEQ ID NO: 3696756 - DNA, 20 bp, Homo sapiens
gaagcagatgcaaagaggca

SEQ ID NO: 3696757 - DNA, 22 bp, Homo sapiens
gaagcagcctctccccaggtcc

SEQ ID NO: 3696758 - DNA, 17 bp, Homo sapiens
gaagcccggactgacca

SEQ ID NO: 3696759 - DNA, 19 bp, Homo sapiens
gaagctataaattcctctt

SEQ ID NO: 3696760 - DNA, 21 bp, Homo sapiens
gagtgacacccaagagggctg

SEQ ID NO: 3696761 - DNA, 19 bp, Homo sapiens
gagtgatagtcttttgctt

SEQ ID NO: 3696762 - DNA, 19 bp, Homo sapiens
gagtggaggttaaggctga

SEQ ID NO: 3696763 - DNA, 14 bp, Homo sapiens
gagtggcaggggac

SEQ ID NO: 3696764 - DNA, 12 bp, Homo sapiens
gagtggcctggc

SEQ ID NO: 3696765 - DNA, 13 bp, Homo sapiens
gagtgggtgaata

SEQ ID NO: 3696766 - DNA, 15 bp, Homo sapiens
gagtgtagactgtgg

SEQ ID NO: 3696767 - DNA, 17 bp, Homo sapiens
gagtgtagactgtggct

SEQ ID NO: 3696768 - DNA, 17 bp, Homo sapiens
gagtgtgcctgaagtcc

SEQ ID NO: 3696769 - DNA, 14 bp, Homo sapiens
gagtgttatgtatt

SEQ ID NO: 3696770 - DNA, 19 bp, Homo sapiens
gagttcaggaacccttctc

SEQ ID NO: 3696771 - DNA, 22 bp, Homo sapiens
gagttcaggtagctgcccctgg

SEQ ID NO: 3696772 - DNA, 19 bp, Homo sapiens
gagttccagttcctctttg

SEQ ID NO: 3696773 - DNA, 14 bp, Homo sapiens
gagttgatctggaa

SEQ ID NO: 3696774 - DNA, 15 bp, Homo sapiens
gagttgattcagctc

SEQ ID NO: 3696775 - DNA, 16 bp, Homo sapiens
gagttgattcagctct

SEQ ID NO: 3696776 - DNA, 17 bp, Homo sapiens
gagttgattcagctctg

SEQ ID NO: 3696777 - DNA, 17 bp, Homo sapiens
gagtttgtcgctcatgt

SEQ ID NO: 3696778 - DNA, 16 bp, Homo sapiens
gagttttttgtaccaa

SEQ ID NO: 3696779 - DNA, 20 bp, Homo sapiens
gataaggtaaaatgccatga

SEQ ID NO: 3696780 - DNA, 17 bp, Homo sapiens
gatacggggtcttgctc

SEQ ID NO: 3696781 - DNA, 17 bp, Homo sapiens
gatactgcgactttctg

SEQ ID NO: 3696782 - DNA, 19 bp, Homo sapiens
gatactgcgactttctgcc

SEQ ID NO: 3696783 - DNA, 21 bp, Homo sapiens
gatactgcgactttctgcctg

SEQ ID NO: 3696784 - DNA, 23 bp, Homo sapiens
gatactgcgactttctgcctgga

SEQ ID NO: 3696785 - DNA, 14 bp, Homo sapiens
gatagaaatgccaa

SEQ ID NO: 3696786 - DNA, 21 bp, Homo sapiens
gatagacacatatgaggggga

SEQ ID NO: 3696787 - DNA, 12 bp, Homo sapiens
gatagatgctgg

SEQ ID NO: 3696788 - DNA, 16 bp, Homo sapiens
gatagatgctggccca

SEQ ID NO: 3696789 - DNA, 21 bp, Homo sapiens
gatagatgctggcccagggcc

SEQ ID NO: 3696790 - DNA, 16 bp, Homo sapiens
gatagctaactgtaaa

SEQ ID NO: 3696791 - DNA, 23 bp, Homo sapiens
gatatcgacttgtttttgcacat

SEQ ID NO: 3696792 - DNA, 21 bp, Homo sapiens
gatatgtattgggcagcagac

SEQ ID NO: 3696793 - DNA, 23 bp, Homo sapiens
gatattaagaactgctgtttcac

SEQ ID NO: 3696794 - DNA, 19 bp, Homo sapiens
gatcacagcttcagccagg

SEQ ID NO: 3696795 - DNA, 21 bp, Homo sapiens
gatcacagcttcagccaggag

SEQ ID NO: 3696796 - DNA, 13 bp, Homo sapiens
gatcaggtgggga

SEQ ID NO: 3696797 - DNA, 18 bp, Homo sapiens
gatccagggacagaggcc

SEQ ID NO: 3696798 - DNA, 14 bp, Homo sapiens
gatccctgtgttgt

SEQ ID NO: 3696799 - DNA, 18 bp, Homo sapiens
gatccctgtgttgtctct

SEQ ID NO: 3696800 - DNA, 19 bp, Homo sapiens
gatccctgtgttgtctcta

SEQ ID NO: 3696801 - DNA, 21 bp, Homo sapiens
gatccctgtgttgtctctaga

SEQ ID NO: 3696802 - DNA, 16 bp, Homo sapiens
gatccgagggcccctc

SEQ ID NO: 3696803 - DNA, 17 bp, Homo sapiens
gatccgagggcccctct

SEQ ID NO: 3696804 - DNA, 23 bp, Homo sapiens
gatcctaatgaatgcataaaatg

SEQ ID NO: 3696805 - DNA, 21 bp, Homo sapiens
gatcctcctgcagaccacgcc

SEQ ID NO: 3696806 - DNA, 16 bp, Homo sapiens
gatcctctcacctcag

SEQ ID NO: 3696807 - DNA, 15 bp, Homo sapiens
gatcctggaggccca

SEQ ID NO: 3696808 - DNA, 17 bp, Homo sapiens
gatcctggaggcccagt

SEQ ID NO: 3696809 - DNA, 23 bp, Homo sapiens
gatcctgggtggtctgcaggcag

SEQ ID NO: 3696810 - DNA, 20 bp, Homo sapiens
gatctcggtttgccaaaatt

SEQ ID NO: 3696811 - DNA, 22 bp, Homo sapiens
gatctctgggatttatgctcat

SEQ ID NO: 3696812 - DNA, 12 bp, Homo sapiens
gatctggaaccc

SEQ ID NO: 3696813 - DNA, 16 bp, Homo sapiens
gatctggaacccagac

SEQ ID NO: 3696814 - DNA, 19 bp, Homo sapiens
gatctggaacctcagcctg

SEQ ID NO: 3696815 - DNA, 20 bp, Homo sapiens
gatctggaacctcagcctgg

SEQ ID NO: 3696816 - DNA, 15 bp, Homo sapiens
gatctggtcctaccc

SEQ ID NO: 3696817 - DNA, 13 bp, Homo sapiens
gatctgtgcccca

SEQ ID NO: 3696818 - DNA, 18 bp, Homo sapiens
gatcttccgtggtcagag

SEQ ID NO: 3696819 - DNA, 15 bp, Homo sapiens
gatctttgactgaaa

SEQ ID NO: 3696820 - DNA, 11 bp, Homo sapiens
gatctttgtgg

SEQ ID NO: 3696821 - DNA, 16 bp, Homo sapiens
gatgagatttttaaaa

SEQ ID NO: 3696822 - DNA, 17 bp, Homo sapiens
gatgaggcttcttcctg

SEQ ID NO: 3696823 - DNA, 20 bp, Homo sapiens
gatgagggggaattcctgga

SEQ ID NO: 3696824 - DNA, 22 bp, Homo sapiens
gatgagggggaattcctggaac

SEQ ID NO: 3696825 - DNA, 13 bp, Homo sapiens
gatgatcctaggc

SEQ ID NO: 3696826 - DNA, 14 bp, Homo sapiens
gatgatcctaggca

SEQ ID NO: 3696827 - DNA, 14 bp, Homo sapiens
gatgcaaagaggca

SEQ ID NO: 3696828 - DNA, 18 bp, Homo sapiens
gatgcaaggaccaggact

SEQ ID NO: 3696829 - DNA, 16 bp, Homo sapiens
gatgcagcattatgat

SEQ ID NO: 3696830 - DNA, 14 bp, Homo sapiens
gatgcagctcaaga

SEQ ID NO: 3696831 - DNA, 17 bp, Homo sapiens
gatgcatgtcttttaaa

SEQ ID NO: 3696832 - DNA, 12 bp, Homo sapiens
gatgccccagag

SEQ ID NO: 3696833 - DNA, 12 bp, Homo sapiens
gatgccctggag

SEQ ID NO: 3696834 - DNA, 15 bp, Homo sapiens
gatgccctggaggtg

SEQ ID NO: 3696835 - DNA, 18 bp, Homo sapiens
gatgccctggaggtggct

SEQ ID NO: 3696836 - DNA, 18 bp, Homo sapiens
gatgccttttttgtagtt

SEQ ID NO: 3696837 - DNA, 13 bp, Homo sapiens
gatgctgcccctc

SEQ ID NO: 3696838 - DNA, 15 bp, Homo sapiens
gatgctggcccaggg

SEQ ID NO: 3696839 - DNA, 17 bp, Homo sapiens
gatgctggcccagggcc

SEQ ID NO: 3696840 - DNA, 23 bp, Homo sapiens
gatgctggcccagggcccagagc

SEQ ID NO: 3696841 - DNA, 21 bp, Homo sapiens
gatgctgggcacttcatctga

SEQ ID NO: 3696842 - DNA, 17 bp, Homo sapiens
gatggaaccgcaggaag

SEQ ID NO: 3696843 - DNA, 22 bp, Homo sapiens
gatggaagtgggccagtcctgg

SEQ ID NO: 3696844 - DNA, 12 bp, Homo sapiens
gatggagctgac

SEQ ID NO: 3696845 - DNA, 22 bp, Homo sapiens
gatggatttccagccaaagcct

SEQ ID NO: 3696846 - DNA, 15 bp, Homo sapiens
gatggcaacagatct

SEQ ID NO: 3696847 - DNA, 18 bp, Homo sapiens
gatggcagtgtggggagg

SEQ ID NO: 3696848 - DNA, 12 bp, Homo sapiens
gatggccccagc

SEQ ID NO: 3696849 - DNA, 15 bp, Homo sapiens
gatgggacatttttg

SEQ ID NO: 3696850 - DNA, 19 bp, Homo sapiens
gatggggcacggctctggg

SEQ ID NO: 3696851 - DNA, 20 bp, Homo sapiens
gatggggcagagcttctcct

SEQ ID NO: 3696852 - DNA, 21 bp, Homo sapiens
gatgggggagtctgaagcaga

SEQ ID NO: 3696853 - DNA, 19 bp, Homo sapiens
gatggtgtggcctgtggct

SEQ ID NO: 3696854 - DNA, 17 bp, Homo sapiens
gatgtaaattgaagaag

SEQ ID NO: 3696855 - DNA, 16 bp, Homo sapiens
gatgtgtttgctttct

SEQ ID NO: 3696856 - DNA, 17 bp, Homo sapiens
gatgttcagcactgtcc

SEQ ID NO: 3696857 - DNA, 15 bp, Homo sapiens
gatgtttgtggcctc

SEQ ID NO: 3696858 - DNA, 17 bp, Homo sapiens
gatgtttgtggcctcag

SEQ ID NO: 3696859 - DNA, 14 bp, Homo sapiens
gattaaggcgtggc

SEQ ID NO: 3696860 - DNA, 14 bp, Homo sapiens
gattcaaaatattt

SEQ ID NO: 3696861 - DNA, 18 bp, Homo sapiens
gattcaaaatatttaaaa

SEQ ID NO: 3696862 - DNA, 13 bp, Homo sapiens
gattcagctctgc

SEQ ID NO: 3696863 - DNA, 16 bp, Homo sapiens
gattccattttggaaa

SEQ ID NO: 3696864 - DNA, 13 bp, Homo sapiens
gattcccctccac

SEQ ID NO: 3696865 - DNA, 17 bp, Homo sapiens
gattcggtatcccccca

SEQ ID NO: 3696866 - DNA, 16 bp, Homo sapiens
gattgacagctttgct

SEQ ID NO: 3696867 - DNA, 19 bp, Homo sapiens
gattgacagctttgctgct

SEQ ID NO: 3696868 - DNA, 14 bp, Homo sapiens
gattgagaagccat

SEQ ID NO: 3696869 - DNA, 18 bp, Homo sapiens
gattgcttgagctcagga

SEQ ID NO: 3696870 - DNA, 22 bp, Homo sapiens
gattggatacgcatcagacaga

SEQ ID NO: 3696871 - DNA, 22 bp, Homo sapiens
gattgttttttaaaaatggata

SEQ ID NO: 3696872 - DNA, 17 bp, Homo sapiens
gatttaaacacacagat

SEQ ID NO: 3696873 - DNA, 12 bp, Homo sapiens
gatttaaatcag

SEQ ID NO: 3696874 - DNA, 14 bp, Homo sapiens
gatttgtgaactgg

SEQ ID NO: 3696875 - DNA, 16 bp, Homo sapiens
gatttgtgaactggaa

SEQ ID NO: 3696876 - DNA, 22 bp, Homo sapiens
gatttgtgaactggaagaaagc

SEQ ID NO: 3696877 - DNA, 12 bp, Homo sapiens
gctcctacctgg

SEQ ID NO: 3696878 - DNA, 19 bp, Homo sapiens
gctcctacctgggggcaga

SEQ ID NO: 3696879 - DNA, 13 bp, Homo sapiens
gctcctagaggga

SEQ ID NO: 3696880 - DNA, 18 bp, Homo sapiens
gctcctagagggaggggc

SEQ ID NO: 3696881 - DNA, 19 bp, Homo sapiens
gctcctcatggtgggttca

SEQ ID NO: 3696882 - DNA, 17 bp, Homo sapiens
gctcctccctggagcta

SEQ ID NO: 3696883 - DNA, 14 bp, Homo sapiens
gctcctcctccctg

SEQ ID NO: 3696884 - DNA, 15 bp, Homo sapiens
gctcctcctccctgc

SEQ ID NO: 3696885 - DNA, 16 bp, Homo sapiens
gctcctcctccctgca

SEQ ID NO: 3696886 - DNA, 20 bp, Homo sapiens
gctcctcctccctgcatctg

SEQ ID NO: 3696887 - DNA, 12 bp, Homo sapiens
gctcctcctgaa

SEQ ID NO: 3696888 - DNA, 16 bp, Homo sapiens
gctcctcctgaaggag

SEQ ID NO: 3696889 - DNA, 18 bp, Homo sapiens
gctcctctccccagccca

SEQ ID NO: 3696890 - DNA, 21 bp, Homo sapiens
gctcctctccccagcccagag

SEQ ID NO: 3696891 - DNA, 22 bp, Homo sapiens
gctcctctccccagcccagaga

SEQ ID NO: 3696892 - DNA, 20 bp, Homo sapiens
gctcctgaatgaggcggagc

SEQ ID NO: 3696893 - DNA, 22 bp, Homo sapiens
gctcctgaatgaggcggagctc

SEQ ID NO: 3696894 - DNA, 21 bp, Homo sapiens
gctcctgaggggcatctgccc

SEQ ID NO: 3696895 - DNA, 22 bp, Homo sapiens
gctcctgaggggcatctgcccc

SEQ ID NO: 3696896 - DNA, 14 bp, Homo sapiens
gctcctggcccact

SEQ ID NO: 3696897 - DNA, 18 bp, Homo sapiens
gctcctggcccactgcat

SEQ ID NO: 3696898 - DNA, 23 bp, Homo sapiens
gctcctgtggtagtcctcccaag

SEQ ID NO: 3696899 - DNA, 11 bp, Homo sapiens
gctccttgctg

SEQ ID NO: 3696900 - DNA, 22 bp, Homo sapiens
gctccttgctgcattgatccag

SEQ ID NO: 3696901 - DNA, 22 bp, Homo sapiens
gctccttgggaggccccactgg

SEQ ID NO: 3696902 - DNA, 12 bp, Homo sapiens
gctctaatacat

SEQ ID NO: 3696903 - DNA, 23 bp, Homo sapiens
gctctaggatggggcacggctct

SEQ ID NO: 3696904 - DNA, 21 bp, Homo sapiens
gctctgaccgaaacagcgctg

SEQ ID NO: 3696905 - DNA, 19 bp, Homo sapiens
gctctgcgttggcttctcc

SEQ ID NO: 3696906 - DNA, 11 bp, Homo sapiens
gctctgggtgg

SEQ ID NO: 3696907 - DNA, 18 bp, Homo sapiens
gctctgggtgggcggggc

SEQ ID NO: 3696908 - DNA, 22 bp, Homo sapiens
gctctgggtgggcgtggcctgc

SEQ ID NO: 3696909 - DNA, 23 bp, Homo sapiens
gctctgggtgggcgtggcctgca

SEQ ID NO: 3696910 - DNA, 18 bp, Homo sapiens
gctctggtggccactgag

SEQ ID NO: 3696911 - DNA, 21 bp, Homo sapiens
gctctggtggccactgagctg

SEQ ID NO: 3696912 - DNA, 18 bp, Homo sapiens
gctctgtgggccctaccc

SEQ ID NO: 3696913 - DNA, 17 bp, Homo sapiens
gctcttctccttggagg

SEQ ID NO: 3696914 - DNA, 22 bp, Homo sapiens
gctcttctccttggaggacagt

SEQ ID NO: 3696915 - DNA, 21 bp, Homo sapiens
gctcttctgccggccctgggg

SEQ ID NO: 3696916 - DNA, 18 bp, Homo sapiens
gctcttgaccttgtagag

SEQ ID NO: 3696917 - DNA, 14 bp, Homo sapiens
gctctttctctgcc

SEQ ID NO: 3696918 - DNA, 18 bp, Homo sapiens
gctctttctctgccagtg

SEQ ID NO: 3696919 - DNA, 17 bp, Homo sapiens
gctgaatacagaggcaa

SEQ ID NO: 3696920 - DNA, 14 bp, Homo sapiens
gctgacagctgctc

SEQ ID NO: 3696921 - DNA, 15 bp, Homo sapiens
gctgactagaagggc

SEQ ID NO: 3696922 - DNA, 22 bp, Homo sapiens
gctgactgttttctcttgagag

SEQ ID NO: 3696923 - DNA, 16 bp, Homo sapiens
gctgagaaggaacagg

SEQ ID NO: 3696924 - DNA, 22 bp, Homo sapiens
gctgagcccctgtctagagagg

SEQ ID NO: 3696925 - DNA, 23 bp, Homo sapiens
gctgagcccctgtctagagaggg

SEQ ID NO: 3696926 - DNA, 12 bp, Homo sapiens
gctgagctgccc

SEQ ID NO: 3696927 - DNA, 15 bp, Homo sapiens
gctgaggaaaggcca

SEQ ID NO: 3696928 - DNA, 21 bp, Homo sapiens
gctgaggaaaggccagctggc

SEQ ID NO: 3696929 - DNA, 21 bp, Homo sapiens
gctgaggcctggactttcctg

SEQ ID NO: 3696930 - DNA, 14 bp, Homo sapiens
gctgaggcctgggc

SEQ ID NO: 3696931 - DNA, 15 bp, Homo sapiens
gctgaggtgggagga

SEQ ID NO: 3696932 - DNA, 21 bp, Homo sapiens
gctgagtggcaggggacagga

SEQ ID NO: 3696933 - DNA, 20 bp, Homo sapiens
gctgatgtcaatttctgtgt

SEQ ID NO: 3696934 - DNA, 23 bp, Homo sapiens
gctgatgtcaatttctgtgttgc

SEQ ID NO: 3696935 - DNA, 19 bp, Homo sapiens
gctgcaaggtttaggctgg

SEQ ID NO: 3696936 - DNA, 18 bp, Homo sapiens
gctgcaccctcaggcagg

SEQ ID NO: 3696937 - DNA, 13 bp, Homo sapiens
gctgcatctgtct

SEQ ID NO: 3696938 - DNA, 17 bp, Homo sapiens
gctgccaaggccagagt

SEQ ID NO: 3696939 - DNA, 20 bp, Homo sapiens
gctgccacccacctccctgc

SEQ ID NO: 3696940 - DNA, 13 bp, Homo sapiens
gctgcccagagct

SEQ ID NO: 3696941 - DNA, 15 bp, Homo sapiens
gctgcccagcccctc

SEQ ID NO: 3696942 - DNA, 12 bp, Homo sapiens
gctgcctcactt

SEQ ID NO: 3696943 - DNA, 15 bp, Homo sapiens
gctgcctccagcctg

SEQ ID NO: 3696944 - DNA, 16 bp, Homo sapiens
gctgcctccagcctgg

SEQ ID NO: 3696945 - DNA, 18 bp, Homo sapiens
gctgcgccccaggccccg

SEQ ID NO: 3696946 - DNA, 14 bp, Homo sapiens
gctgctccctgagg

SEQ ID NO: 3696947 - DNA, 23 bp, Homo sapiens
gctgctcgcgaaggtcccacagc

SEQ ID NO: 3696948 - DNA, 15 bp, Homo sapiens
gctgctggcttgcag

SEQ ID NO: 3696949 - DNA, 17 bp, Homo sapiens
gctgctggtgcacagcc

SEQ ID NO: 3696950 - DNA, 22 bp, Homo sapiens
gctgcttcccatgcctgcaacc

SEQ ID NO: 3696951 - DNA, 14 bp, Homo sapiens
gctgcttcctcctg

SEQ ID NO: 3696952 - DNA, 23 bp, Homo sapiens
gctgcttttccttggggcaggca

SEQ ID NO: 3696953 - DNA, 22 bp, Homo sapiens
gctggaaaataatactgctgag

SEQ ID NO: 3696954 - DNA, 21 bp, Homo sapiens
gctggaacctgcaaaaaatac

SEQ ID NO: 3696955 - DNA, 16 bp, Homo sapiens
gctggagtacccagcc

SEQ ID NO: 3696956 - DNA, 19 bp, Homo sapiens
gctggagtacccagcctat

SEQ ID NO: 3696957 - DNA, 22 bp, Homo sapiens
gctggatgctccttccaacagg

SEQ ID NO: 3696958 - DNA, 15 bp, Homo sapiens
gctggcagcagagtg

SEQ ID NO: 3696959 - DNA, 14 bp, Homo sapiens
gctggccagtccag

SEQ ID NO: 3696960 - DNA, 16 bp, Homo sapiens
gctggccagtccaggc

SEQ ID NO: 3696961 - DNA, 19 bp, Homo sapiens
gctggccgagggtcctggc

SEQ ID NO: 3696962 - DNA, 22 bp, Homo sapiens
gctggctgactaagccccgtct

SEQ ID NO: 3696963 - DNA, 15 bp, Homo sapiens
gctgggaaggttcca

SEQ ID NO: 3696964 - DNA, 13 bp, Homo sapiens
gctgggcagaagg

SEQ ID NO: 3696965 - DNA, 20 bp, Homo sapiens
gctgggcccgacatggctcc

SEQ ID NO: 3696966 - DNA, 21 bp, Homo sapiens
gctgggcccgacatggctccg

SEQ ID NO: 3696967 - DNA, 17 bp, Homo sapiens
gctgggccgggacccag

SEQ ID NO: 3696968 - DNA, 17 bp, Homo sapiens
gctgggctaggcatagg

SEQ ID NO: 3696969 - DNA, 23 bp, Homo sapiens
gctgggggcaggagggccctacc

SEQ ID NO: 3696970 - DNA, 13 bp, Homo sapiens
gctggtggcccag

SEQ ID NO: 3696971 - DNA, 14 bp, Homo sapiens
gctggtggcccagg

SEQ ID NO: 3696972 - DNA, 22 bp, Homo sapiens
gctgtaatctatgaattctaag

SEQ ID NO: 3696973 - DNA, 16 bp, Homo sapiens
gctgtagtaggcattt

SEQ ID NO: 3696974 - DNA, 22 bp, Homo sapiens
gctgtcatggtcctttctggaa

SEQ ID NO: 3696975 - DNA, 22 bp, Homo sapiens
gctgtcccttgcttgcctgcag

SEQ ID NO: 3696976 - DNA, 17 bp, Homo sapiens
gctgtccttacccatct

SEQ ID NO: 3696977 - DNA, 18 bp, Homo sapiens
gctgtgaggctgtcctgt

SEQ ID NO: 3696978 - DNA, 23 bp, Homo sapiens
gctgtgaggcttgcccaggagca

SEQ ID NO: 3696979 - DNA, 19 bp, Homo sapiens
gctgtgcctcgcatcctat

SEQ ID NO: 3696980 - DNA, 14 bp, Homo sapiens
gctgtggctctggg

SEQ ID NO: 3696981 - DNA, 21 bp, Homo sapiens
gctgtgtatatggtatatata

SEQ ID NO: 3696982 - DNA, 12 bp, Homo sapiens
gctgtgtctgag

SEQ ID NO: 3696983 - DNA, 17 bp, Homo sapiens
gctgtgtctgagcccaa

SEQ ID NO: 3696984 - DNA, 15 bp, Homo sapiens
gctgtgtgtcccagg

SEQ ID NO: 3696985 - DNA, 14 bp, Homo sapiens
gctgttagttgctg

SEQ ID NO: 3696986 - DNA, 14 bp, Homo sapiens
gctgttcagctggt

SEQ ID NO: 3696987 - DNA, 21 bp, Homo sapiens
gctgttcctgttcagtaataa

SEQ ID NO: 3696988 - DNA, 12 bp, Homo sapiens
gctgttgaagat

SEQ ID NO: 3696989 - DNA, 19 bp, Homo sapiens
gctgttgacatatttaatg

SEQ ID NO: 3696990 - DNA, 14 bp, Homo sapiens
gctgtttatggcct

SEQ ID NO: 3696991 - DNA, 23 bp, Homo sapiens
gctgtttatggcctcagctgcct

SEQ ID NO: 3696992 - DNA, 15 bp, Homo sapiens
gctgttttcctccct

SEQ ID NO: 3696993 - DNA, 14 bp, Homo sapiens
ggcgggccctgcct

SEQ ID NO: 3696994 - DNA, 20 bp, Homo sapiens
ggcggggcgccccaagagcc

SEQ ID NO: 3696995 - DNA, 12 bp, Homo sapiens
ggcggggctcct

SEQ ID NO: 3696996 - DNA, 15 bp, Homo sapiens
ggcggggctcctcct

SEQ ID NO: 3696997 - DNA, 23 bp, Homo sapiens
ggcggtgcccacaccggggacag

SEQ ID NO: 3696998 - DNA, 21 bp, Homo sapiens
ggcgtctgttcccccttcaca

SEQ ID NO: 3696999 - DNA, 17 bp, Homo sapiens
ggcgtggagggaggccc

SEQ ID NO: 3697000 - DNA, 18 bp, Homo sapiens
ggcgtggctctgggtggg

SEQ ID NO: 3697001 - DNA, 14 bp, Homo sapiens
ggcgtgtgcagtgc

SEQ ID NO: 3697002 - DNA, 16 bp, Homo sapiens
ggctagaggccagccc

SEQ ID NO: 3697003 - DNA, 13 bp, Homo sapiens
ggctagagtcctc

SEQ ID NO: 3697004 - DNA, 20 bp, Homo sapiens
ggctagagtcctcactccca

SEQ ID NO: 3697005 - DNA, 17 bp, Homo sapiens
ggctagtcaagctcctc

SEQ ID NO: 3697006 - DNA, 20 bp, Homo sapiens
ggctagtgacttgtgtccca

SEQ ID NO: 3697007 - DNA, 23 bp, Homo sapiens
ggctagtgacttgtgtcccatga

SEQ ID NO: 3697008 - DNA, 19 bp, Homo sapiens
ggctatagctacaggaagc

SEQ ID NO: 3697009 - DNA, 19 bp, Homo sapiens
ggctcagcaaaagatgctt

SEQ ID NO: 3697010 - DNA, 23 bp, Homo sapiens
ggctcagcaaaagatgcttctca

SEQ ID NO: 3697011 - DNA, 17 bp, Homo sapiens
ggctccagagcaggaaa

SEQ ID NO: 3697012 - DNA, 19 bp, Homo sapiens
ggctcccatgaccatactg

SEQ ID NO: 3697013 - DNA, 19 bp, Homo sapiens
ggctccccctggacggggc

SEQ ID NO: 3697014 - DNA, 22 bp, Homo sapiens
ggctccccctggacggggcggg

SEQ ID NO: 3697015 - DNA, 14 bp, Homo sapiens
ggctcctccctgga

SEQ ID NO: 3697016 - DNA, 16 bp, Homo sapiens
ggctcctccctggagc

SEQ ID NO: 3697017 - DNA, 17 bp, Homo sapiens
ggctcctccctggagct

SEQ ID NO: 3697018 - DNA, 16 bp, Homo sapiens
ggctcctcctgaagga

SEQ ID NO: 3697019 - DNA, 12 bp, Homo sapiens
ggctcctctcag

SEQ ID NO: 3697020 - DNA, 9 bp, Homo sapiens
ggctcctgc

SEQ ID NO: 3697021 - DNA, 21 bp, Homo sapiens
ggctcctgtggtagtcctccc

SEQ ID NO: 3697022 - DNA, 17 bp, Homo sapiens
ggctcgaatctctgtgc

SEQ ID NO: 3697023 - DNA, 18 bp, Homo sapiens
ggctcgaatctctgtgcc

SEQ ID NO: 3697024 - DNA, 20 bp, Homo sapiens
ggctctgcgttggcttctcc

SEQ ID NO: 3697025 - DNA, 17 bp, Homo sapiens
ggctctggtggccactg

SEQ ID NO: 3697026 - DNA, 21 bp, Homo sapiens
ggctctggtggccactgagct

SEQ ID NO: 3697027 - DNA, 22 bp, Homo sapiens
ggctctggtggccactgagctg

SEQ ID NO: 3697028 - DNA, 18 bp, Homo sapiens
ggctcttagcagcttcca

SEQ ID NO: 3697029 - DNA, 19 bp, Homo sapiens
ggctcttagcagcttccag

SEQ ID NO: 3697030 - DNA, 23 bp, Homo sapiens
ggctcttctccttggaggacagt

SEQ ID NO: 3697031 - DNA, 13 bp, Homo sapiens
ggctgaaaacaat

SEQ ID NO: 3697032 - DNA, 17 bp, Homo sapiens
ggctgaaattctcctgg

SEQ ID NO: 3697033 - DNA, 22 bp, Homo sapiens
ggctgaaattctcctggaggtc

SEQ ID NO: 3697034 - DNA, 23 bp, Homo sapiens
ggctgacgtgtgagggaggacag

SEQ ID NO: 3697035 - DNA, 14 bp, Homo sapiens
ggctgactaagccc

SEQ ID NO: 3697036 - DNA, 22 bp, Homo sapiens
ggctgactagaagggccagtcc

SEQ ID NO: 3697037 - DNA, 22 bp, Homo sapiens
ggctgaggaaaggccagctggc

SEQ ID NO: 3697038 - DNA, 14 bp, Homo sapiens
ggctgaggcctgga

SEQ ID NO: 3697039 - DNA, 13 bp, Homo sapiens
ggctgaggtggga

SEQ ID NO: 3697040 - DNA, 23 bp, Homo sapiens
ggctgatggtgtggcctgtggct

SEQ ID NO: 3697041 - DNA, 22 bp, Homo sapiens
ggctgatgtcaatttctgtgtt

SEQ ID NO: 3697042 - DNA, 16 bp, Homo sapiens
ggctgcagaggccaga

SEQ ID NO: 3697043 - DNA, 16 bp, Homo sapiens
ggctgccgtggggccg

SEQ ID NO: 3697044 - DNA, 17 bp, Homo sapiens
ggctgcggcgtctgtct

SEQ ID NO: 3697045 - DNA, 14 bp, Homo sapiens
ggctggcaggtatg

SEQ ID NO: 3697046 - DNA, 21 bp, Homo sapiens
ggctggccagtccaggctgcc

SEQ ID NO: 3697047 - DNA, 22 bp, Homo sapiens
ggctggccagtccaggctgccg

SEQ ID NO: 3697048 - DNA, 19 bp, Homo sapiens
ggctggggactgctacctc

SEQ ID NO: 3697049 - DNA, 16 bp, Homo sapiens
ggctgggggaagaagc

SEQ ID NO: 3697050 - DNA, 13 bp, Homo sapiens
ggctggtggccca

SEQ ID NO: 3697051 - DNA, 16 bp, Homo sapiens
ggctgtggctctgggt

SEQ ID NO: 3697052 - DNA, 14 bp, Homo sapiens
ggctgtgttggtgt

SEQ ID NO: 3697053 - DNA, 12 bp, Homo sapiens
ggctgtttctgc

SEQ ID NO: 3697054 - DNA, 19 bp, Homo sapiens
ggcttagtgccacccacct

SEQ ID NO: 3697055 - DNA, 13 bp, Homo sapiens
ggcttcaggtcca

SEQ ID NO: 3697056 - DNA, 21 bp, Homo sapiens
ggcttcctcattccttgtctt

SEQ ID NO: 3697057 - DNA, 23 bp, Homo sapiens
ggcttctctgggaccaggctcca

SEQ ID NO: 3697058 - DNA, 13 bp, Homo sapiens
ggcttgcccagga

SEQ ID NO: 3697059 - DNA, 15 bp, Homo sapiens
ggcttgcccaggagc

SEQ ID NO: 3697060 - DNA, 11 bp, Homo sapiens
ggcttgctgcc

SEQ ID NO: 3697061 - DNA, 17 bp, Homo sapiens
ggcttttccctgggtgg

SEQ ID NO: 3697062 - DNA, 20 bp, Homo sapiens
gggaaagggtcctgctttct

SEQ ID NO: 3697063 - DNA, 16 bp, Homo sapiens
gggaactcagatccag

SEQ ID NO: 3697064 - DNA, 16 bp, Homo sapiens
gggaactggcctgctg

SEQ ID NO: 3697065 - DNA, 15 bp, Homo sapiens
gggaagaaaaagcaa

SEQ ID NO: 3697066 - DNA, 17 bp, Homo sapiens
gggaaggttccatgaag

SEQ ID NO: 3697067 - DNA, 23 bp, Homo sapiens
gggaatagtctagatggctcctc

SEQ ID NO: 3697068 - DNA, 14 bp, Homo sapiens
gggaatcagaactc

SEQ ID NO: 3697069 - DNA, 22 bp, Homo sapiens
gggaatctaagagagctgccat

SEQ ID NO: 3697070 - DNA, 16 bp, Homo sapiens
gggaatggcacagccc

SEQ ID NO: 3697071 - DNA, 13 bp, Homo sapiens
gggacagggcttc

SEQ ID NO: 3697072 - DNA, 14 bp, Homo sapiens
gggacatttccaag

SEQ ID NO: 3697073 - DNA, 16 bp, Homo sapiens
gggacatttccaagct

SEQ ID NO: 3697074 - DNA, 22 bp, Homo sapiens
gggactcagccttcagacagag

SEQ ID NO: 3697075 - DNA, 19 bp, Homo sapiens
gggactcttccctgggaac

SEQ ID NO: 3697076 - DNA, 12 bp, Homo sapiens
gggactggagaa

SEQ ID NO: 3697077 - DNA, 15 bp, Homo sapiens
gggagaggacaggga

SEQ ID NO: 3697078 - DNA, 22 bp, Homo sapiens
gggagcatgcttccctgcagct

SEQ ID NO: 3697079 - DNA, 13 bp, Homo sapiens
gggagccccaggg

SEQ ID NO: 3697080 - DNA, 16 bp, Homo sapiens
gggagccccagggtct

SEQ ID NO: 3697081 - DNA, 15 bp, Homo sapiens
gggagcctctggaat

SEQ ID NO: 3697082 - DNA, 16 bp, Homo sapiens
gggagcctctggaatg

SEQ ID NO: 3697083 - DNA, 22 bp, Homo sapiens
gggagctcagtctccctggcct

SEQ ID NO: 3697084 - DNA, 16 bp, Homo sapiens
gggaggccagaggaga

SEQ ID NO: 3697085 - DNA, 16 bp, Homo sapiens
gggaggccccactggg

SEQ ID NO: 3697086 - DNA, 22 bp, Homo sapiens
gggagggattctggttccaggg

SEQ ID NO: 3697087 - DNA, 22 bp, Homo sapiens
gggagggcggcaggggcctgga

SEQ ID NO: 3697088 - DNA, 15 bp, Homo sapiens
gggagggggatccga

SEQ ID NO: 3697089 - DNA, 18 bp, Homo sapiens
gggaggtcgaggcaggag

SEQ ID NO: 3697090 - DNA, 23 bp, Homo sapiens
gggagtctgaagcagatgcaaag

SEQ ID NO: 3697091 - DNA, 20 bp, Homo sapiens
gggagttaagacctggcagc

SEQ ID NO: 3697092 - DNA, 23 bp, Homo sapiens
gggagttaagacctggcagctct

SEQ ID NO: 3697093 - DNA, 21 bp, Homo sapiens
gggatatgatttaaatcagcc

SEQ ID NO: 3697094 - DNA, 18 bp, Homo sapiens
gggatccgagggcccctc

SEQ ID NO: 3697095 - DNA, 21 bp, Homo sapiens
gggatccgagggcccctctcc

SEQ ID NO: 3697096 - DNA, 17 bp, Homo sapiens
gggcaaggccccttcca

SEQ ID NO: 3697097 - DNA, 18 bp, Homo sapiens
gggcaaggccccttccac

SEQ ID NO: 3697098 - DNA, 18 bp, Homo sapiens
gggcacaggaggcaggca

SEQ ID NO: 3697099 - DNA, 13 bp, Homo sapiens
gggcacagggtct

SEQ ID NO: 3697100 - DNA, 16 bp, Homo sapiens
gggcagagctggctct

SEQ ID NO: 3697101 - DNA, 14 bp, Homo sapiens
gggcagccaggctg

SEQ ID NO: 3697102 - DNA, 18 bp, Homo sapiens
gggcaggaaggagagcct

SEQ ID NO: 3697103 - DNA, 21 bp, Homo sapiens
gggcaggaaggagagcctgct

SEQ ID NO: 3697104 - DNA, 11 bp, Homo sapiens
gggcaggcagt

SEQ ID NO: 3697105 - DNA, 15 bp, Homo sapiens
gggcagggagctggg

SEQ ID NO: 3697106 - DNA, 16 bp, Homo sapiens
gggcagtactcctccc

SEQ ID NO: 3697107 - DNA, 18 bp, Homo sapiens
gggcagtactcctccctg

SEQ ID NO: 3697108 - DNA, 19 bp, Homo sapiens
gggcagtactcctccctgg

SEQ ID NO: 3697109 - DNA, 14 bp, Homo sapiens
gtgatggggcaagg

SEQ ID NO: 3697110 - DNA, 21 bp, Homo sapiens
gtgatgtgaactgactttaag

SEQ ID NO: 3697111 - DNA, 15 bp, Homo sapiens
gtgatgtgtttacat

SEQ ID NO: 3697112 - DNA, 22 bp, Homo sapiens
gtgattgacagctttgctgctg

SEQ ID NO: 3697113 - DNA, 23 bp, Homo sapiens
gtgatttcagactgcagagggga

SEQ ID NO: 3697114 - DNA, 23 bp, Homo sapiens
gtgcaataaatctgacccagtgc

SEQ ID NO: 3697115 - DNA, 16 bp, Homo sapiens
gtgcacgtggagagct

SEQ ID NO: 3697116 - DNA, 15 bp, Homo sapiens
gtgcactttgtaaat

SEQ ID NO: 3697117 - DNA, 13 bp, Homo sapiens
gtgcagaatgtaa

SEQ ID NO: 3697118 - DNA, 14 bp, Homo sapiens
gtgcatagtttctt

SEQ ID NO: 3697119 - DNA, 17 bp, Homo sapiens
gtgcatgcattgagctg

SEQ ID NO: 3697120 - DNA, 14 bp, Homo sapiens
gtgcatgtcctttg

SEQ ID NO: 3697121 - DNA, 23 bp, Homo sapiens
gtgcatttcttggtttatgtctt

SEQ ID NO: 3697122 - DNA, 15 bp, Homo sapiens
gtgccaccccttcct

SEQ ID NO: 3697123 - DNA, 16 bp, Homo sapiens
gtgccacgctcctctg

SEQ ID NO: 3697124 - DNA, 19 bp, Homo sapiens
gtgccactgcgggagctct

SEQ ID NO: 3697125 - DNA, 23 bp, Homo sapiens
gtgccagggctgggccccttcca

SEQ ID NO: 3697126 - DNA, 17 bp, Homo sapiens
gtgccagtcaagaagaa

SEQ ID NO: 3697127 - DNA, 19 bp, Homo sapiens
gtgccatttctcagggaag

SEQ ID NO: 3697128 - DNA, 21 bp, Homo sapiens
gtgccatttctgaactgttac

SEQ ID NO: 3697129 - DNA, 19 bp, Homo sapiens
gtgcccaagccagaggctg

SEQ ID NO: 3697130 - DNA, 20 bp, Homo sapiens
gtgcccaagccagaggctgg

SEQ ID NO: 3697131 - DNA, 15 bp, Homo sapiens
gtgccccaggaccag

SEQ ID NO: 3697132 - DNA, 21 bp, Homo sapiens
gtgccccaggaccagctcagg

SEQ ID NO: 3697133 - DNA, 15 bp, Homo sapiens
gtgcccccactgacc

SEQ ID NO: 3697134 - DNA, 22 bp, Homo sapiens
gtgcccctcttccaaaggcagc

SEQ ID NO: 3697135 - DNA, 22 bp, Homo sapiens
gtgccgagaaggaagcctccca

SEQ ID NO: 3697136 - DNA, 12 bp, Homo sapiens
gtgccgagccag

SEQ ID NO: 3697137 - DNA, 13 bp, Homo sapiens
gtgccgagccagc

SEQ ID NO: 3697138 - DNA, 19 bp, Homo sapiens
gtgccgagccagcaagagg

SEQ ID NO: 3697139 - DNA, 12 bp, Homo sapiens
gtgccgtggcac

SEQ ID NO: 3697140 - DNA, 14 bp, Homo sapiens
gtgcctgtgtgcgt

SEQ ID NO: 3697141 - DNA, 13 bp, Homo sapiens
gtgcctttcaaat

SEQ ID NO: 3697142 - DNA, 18 bp, Homo sapiens
gtgcgcatcttgcctcca

SEQ ID NO: 3697143 - DNA, 20 bp, Homo sapiens
gtgcgcatcttgcctccagg

SEQ ID NO: 3697144 - DNA, 24 bp, Homo sapiens
gtgcgcatcttgcctccaggtgca

SEQ ID NO: 3697145 - DNA, 20 bp, Homo sapiens
gtgctactccatgcaggggt

SEQ ID NO: 3697146 - DNA, 14 bp, Homo sapiens
gtgctatagtattt

SEQ ID NO: 3697147 - DNA, 16 bp, Homo sapiens
gtgctctttgtagcta

SEQ ID NO: 3697148 - DNA, 15 bp, Homo sapiens
gtgctgacagctgct

SEQ ID NO: 3697149 - DNA, 23 bp, Homo sapiens
gtgctgacggccagggagaagct

SEQ ID NO: 3697150 - DNA, 22 bp, Homo sapiens
gtgctgcagcaccgaggggcct

SEQ ID NO: 3697151 - DNA, 15 bp, Homo sapiens
gtgctgggaagcccg

SEQ ID NO: 3697152 - DNA, 21 bp, Homo sapiens
gtgctgtgaggcttgcccagg

SEQ ID NO: 3697153 - DNA, 11 bp, Homo sapiens
gtgctgtgtgt

SEQ ID NO: 3697154 - DNA, 16 bp, Homo sapiens
gtgcttatggtaccag

SEQ ID NO: 3697155 - DNA, 18 bp, Homo sapiens
gtgcttgatagaaatgcc

SEQ ID NO: 3697156 - DNA, 23 bp, Homo sapiens
gtgcttgtttgctcacctggggt

SEQ ID NO: 3697157 - DNA, 19 bp, Homo sapiens
gtggacccagcgggcaggt

SEQ ID NO: 3697158 - DNA, 13 bp, Homo sapiens
gtggactggaagg

SEQ ID NO: 3697159 - DNA, 11 bp, Homo sapiens
gtggagcagga

SEQ ID NO: 3697160 - DNA, 16 bp, Homo sapiens
gtggagcaggactccc

SEQ ID NO: 3697161 - DNA, 22 bp, Homo sapiens
gtggagcctccaattgcagtgg

SEQ ID NO: 3697162 - DNA, 15 bp, Homo sapiens
gtggagggaggcccc

SEQ ID NO: 3697163 - DNA, 21 bp, Homo sapiens
gtggatcagagatgcaccacc

SEQ ID NO: 3697164 - DNA, 19 bp, Homo sapiens
gtggatggccccagcacag

SEQ ID NO: 3697165 - DNA, 17 bp, Homo sapiens
gtggcaagagtgtggag

SEQ ID NO: 3697166 - DNA, 20 bp, Homo sapiens
gtggcatcaccttaggcagg

SEQ ID NO: 3697167 - DNA, 18 bp, Homo sapiens
gtggcatctttgccttgg

SEQ ID NO: 3697168 - DNA, 21 bp, Homo sapiens
gtggcatctttgccttgggct

SEQ ID NO: 3697169 - DNA, 15 bp, Homo sapiens
gtggccactgagctg

SEQ ID NO: 3697170 - DNA, 18 bp, Homo sapiens
gtggccactgagctggct

SEQ ID NO: 3697171 - DNA, 19 bp, Homo sapiens
gtggccagaggtgtcaccc

SEQ ID NO: 3697172 - DNA, 16 bp, Homo sapiens
gtggccagcctggcat

SEQ ID NO: 3697173 - DNA, 17 bp, Homo sapiens
gtggccagcctggcatc

SEQ ID NO: 3697174 - DNA, 13 bp, Homo sapiens
gtggccagctgca

SEQ ID NO: 3697175 - DNA, 11 bp, Homo sapiens
gtggcccagct

SEQ ID NO: 3697176 - DNA, 15 bp, Homo sapiens
gtggccccaccctgg

SEQ ID NO: 3697177 - DNA, 11 bp, Homo sapiens
gtggcccttgc

SEQ ID NO: 3697178 - DNA, 9 bp, Homo sapiens
gtggcctca

SEQ ID NO: 3697179 - DNA, 11 bp, Homo sapiens
gtggcctcaga

SEQ ID NO: 3697180 - DNA, 12 bp, Homo sapiens
gtggcctcagaa

SEQ ID NO: 3697181 - DNA, 20 bp, Homo sapiens
gtggcctcttgagcagtggc

SEQ ID NO: 3697182 - DNA, 19 bp, Homo sapiens
gtggcctgcataggctcct

SEQ ID NO: 3697183 - DNA, 22 bp, Homo sapiens
gtggcctgcataggctccttcc

SEQ ID NO: 3697184 - DNA, 12 bp, Homo sapiens
gtggcctggcca

SEQ ID NO: 3697185 - DNA, 21 bp, Homo sapiens
gtggcctggccaggagctctt

SEQ ID NO: 3697186 - DNA, 23 bp, Homo sapiens
gtggcctgtttgaaagtaaaaac

SEQ ID NO: 3697187 - DNA, 22 bp, Homo sapiens
gtggcgccgtctccaggggctg

SEQ ID NO: 3697188 - DNA, 22 bp, Homo sapiens
gtggctagtcaagctcctcctc

SEQ ID NO: 3697189 - DNA, 23 bp, Homo sapiens
gtggctagtcaagctcctcctcc

SEQ ID NO: 3697190 - DNA, 15 bp, Homo sapiens
gtggctctgggtggg

SEQ ID NO: 3697191 - DNA, 16 bp, Homo sapiens
gtggctctgggtgggc

SEQ ID NO: 3697192 - DNA, 21 bp, Homo sapiens
gtggctctgggtgggcggggc

SEQ ID NO: 3697193 - DNA, 17 bp, Homo sapiens
gtggctggaagatcctg

SEQ ID NO: 3697194 - DNA, 12 bp, Homo sapiens
gtggctgggctg

SEQ ID NO: 3697195 - DNA, 18 bp, Homo sapiens
gtggctgggctgctcctg

SEQ ID NO: 3697196 - DNA, 20 bp, Homo sapiens
gtggctgggctgctcctgaa

SEQ ID NO: 3697197 - DNA, 11 bp, Homo sapiens
gtggctggggg

SEQ ID NO: 3697198 - DNA, 18 bp, Homo sapiens
gtggctgggtttacacgc

SEQ ID NO: 3697199 - DNA, 17 bp, Homo sapiens
gtggctggtccagggct

SEQ ID NO: 3697200 - DNA, 14 bp, Homo sapiens
gtgggaactggagg

SEQ ID NO: 3697201 - DNA, 16 bp, Homo sapiens
gtgggactcttccctg

SEQ ID NO: 3697202 - DNA, 18 bp, Homo sapiens
gtgggactcttccctggg

SEQ ID NO: 3697203 - DNA, 12 bp, Homo sapiens
gtgggagctgag

SEQ ID NO: 3697204 - DNA, 24 bp, Homo sapiens
gtgggatgttcagcactgtccctt

SEQ ID NO: 3697205 - DNA, 17 bp, Homo sapiens
gtgggccaacaaagaac

SEQ ID NO: 3697206 - DNA, 15 bp, Homo sapiens
gtgggccagtctgtg

SEQ ID NO: 3697207 - DNA, 17 bp, Homo sapiens
gtgggccagtctgtgga

SEQ ID NO: 3697208 - DNA, 19 bp, Homo sapiens
gtgggccctaccctcctgc

SEQ ID NO: 3697209 - DNA, 21 bp, Homo sapiens
gtgggccctaccctcctgctg

SEQ ID NO: 3697210 - DNA, 14 bp, Homo sapiens
gtgggcctcggccc

SEQ ID NO: 3697211 - DNA, 17 bp, Homo sapiens
gtgggcttttccctggg

SEQ ID NO: 3697212 - DNA, 19 bp, Homo sapiens
gtgggcttttccctgggtg

SEQ ID NO: 3697213 - DNA, 20 bp, Homo sapiens
gtgggcttttccctgggtgg

SEQ ID NO: 3697214 - DNA, 21 bp, Homo sapiens
gtgggcttttccctgggtgga

SEQ ID NO: 3697215 - DNA, 13 bp, Homo sapiens
gtggggcagggag

SEQ ID NO: 3697216 - DNA, 15 bp, Homo sapiens
gtggggtcatgccct

SEQ ID NO: 3697217 - DNA, 19 bp, Homo sapiens
gtggggtcatgccctcctc

SEQ ID NO: 3697218 - DNA, 21 bp, Homo sapiens
gtggggtcatgccctcctctc

SEQ ID NO: 3697219 - DNA, 16 bp, Homo sapiens
gtggggtgtgctggga

SEQ ID NO: 3697220 - DNA, 12 bp, Homo sapiens
gtgggtggggct

SEQ ID NO: 3697221 - DNA, 17 bp, Homo sapiens
gtggtagagtgtgcctg

SEQ ID NO: 3697222 - DNA, 19 bp, Homo sapiens
gtggtagtcctcccaagct

SEQ ID NO: 3697223 - DNA, 16 bp, Homo sapiens
gtggtcacagcggagg

SEQ ID NO: 3697224 - DNA, 18 bp, Homo sapiens
gtggtcacagcggaggtg

SEQ ID NO: 3697225 - DNA, 17 bp, Homo sapiens
tacctgggggcagaact

SEQ ID NO: 3697226 - DNA, 21 bp, Homo sapiens
tacctgtgaccctctttgctg

SEQ ID NO: 3697227 - DNA, 14 bp, Homo sapiens
tacctgttgagcat

SEQ ID NO: 3697228 - DNA, 16 bp, Homo sapiens
tacggaactgcacact

SEQ ID NO: 3697229 - DNA, 18 bp, Homo sapiens
tactaaagccaaacatat

SEQ ID NO: 3697230 - DNA, 14 bp, Homo sapiens
tactactttaagtg

SEQ ID NO: 3697231 - DNA, 23 bp, Homo sapiens
tactactttgttaggattttcac

SEQ ID NO: 3697232 - DNA, 19 bp, Homo sapiens
tactagttttagttttctc

SEQ ID NO: 3697233 - DNA, 14 bp, Homo sapiens
tactatatttgtga

SEQ ID NO: 3697234 - DNA, 16 bp, Homo sapiens
tactcagataaggtaa

SEQ ID NO: 3697235 - DNA, 16 bp, Homo sapiens
tactcagggttaggaa

SEQ ID NO: 3697236 - DNA, 22 bp, Homo sapiens
tactcgcacctcttggctttgt

SEQ ID NO: 3697237 - DNA, 23 bp, Homo sapiens
tactgaaatgcgctctttaattt

SEQ ID NO: 3697238 - DNA, 13 bp, Homo sapiens
tactgacatgtgg

SEQ ID NO: 3697239 - DNA, 20 bp, Homo sapiens
tactgacatgtggggccagg

SEQ ID NO: 3697240 - DNA, 21 bp, Homo sapiens
tactgcaaggttcaacttatt

SEQ ID NO: 3697241 - DNA, 22 bp, Homo sapiens
tactgccgtcagtgctgtgctg

SEQ ID NO: 3697242 - DNA, 21 bp, Homo sapiens
tactgcgactttctgcctgga

SEQ ID NO: 3697243 - DNA, 22 bp, Homo sapiens
tactgcgactttctgcctggag

SEQ ID NO: 3697244 - DNA, 20 bp, Homo sapiens
tactgctgagatacatacag

SEQ ID NO: 3697245 - DNA, 14 bp, Homo sapiens
tactgtacaataaa

SEQ ID NO: 3697246 - DNA, 18 bp, Homo sapiens
tactgtacaataaaaaca

SEQ ID NO: 3697247 - DNA, 21 bp, Homo sapiens
tactgtcttcagtaagccgtg

SEQ ID NO: 3697248 - DNA, 10 bp, Homo sapiens
tactgtgtta

SEQ ID NO: 3697249 - DNA, 17 bp, Homo sapiens
tactgttactgggccct

SEQ ID NO: 3697250 - DNA, 13 bp, Homo sapiens
tactgttatagaa

SEQ ID NO: 3697251 - DNA, 16 bp, Homo sapiens
tacttagggaagaaaa

SEQ ID NO: 3697252 - DNA, 16 bp, Homo sapiens
tacttcattttcagag

SEQ ID NO: 3697253 - DNA, 23 bp, Homo sapiens
tacttctgaaataaatgttctct

SEQ ID NO: 3697254 - DNA, 12 bp, Homo sapiens
tacttgaagggc

SEQ ID NO: 3697255 - DNA, 14 bp, Homo sapiens
tacttgaagggcca

SEQ ID NO: 3697256 - DNA, 17 bp, Homo sapiens
tacttgaagggccagag

SEQ ID NO: 3697257 - DNA, 22 bp, Homo sapiens
tacttgaagggccagagccagg

SEQ ID NO: 3697258 - DNA, 16 bp, Homo sapiens
tacttggctttttcca

SEQ ID NO: 3697259 - DNA, 13 bp, Homo sapiens
tacttggtttgtg

SEQ ID NO: 3697260 - DNA, 18 bp, Homo sapiens
tactttgcaatccaaata

SEQ ID NO: 3697261 - DNA, 23 bp, Homo sapiens
tactttggcaatttcctggccct

SEQ ID NO: 3697262 - DNA, 19 bp, Homo sapiens
tactttgttaggattttca

SEQ ID NO: 3697263 - DNA, 13 bp, Homo sapiens
tactttttctaat

SEQ ID NO: 3697264 - DNA, 14 bp, Homo sapiens
tactttttctaatg

SEQ ID NO: 3697265 - DNA, 13 bp, Homo sapiens
tacttttttaaat

SEQ ID NO: 3697266 - DNA, 21 bp, Homo sapiens
tacttttttaaatattttcta

SEQ ID NO: 3697267 - DNA, 12 bp, Homo sapiens
tagaaaagttat

SEQ ID NO: 3697268 - DNA, 17 bp, Homo sapiens
tagaaatggaaattttg

SEQ ID NO: 3697269 - DNA, 13 bp, Homo sapiens
tagaaattttcaa

SEQ ID NO: 3697270 - DNA, 16 bp, Homo sapiens
tagaacctttctgtgt

SEQ ID NO: 3697271 - DNA, 20 bp, Homo sapiens
tagaagacaattgacaacag

SEQ ID NO: 3697272 - DNA, 21 bp, Homo sapiens
tagaagcactacaccttgcct

SEQ ID NO: 3697273 - DNA, 13 bp, Homo sapiens
tagaagcctctcg

SEQ ID NO: 3697274 - DNA, 15 bp, Homo sapiens
tagaatgcatctcat

SEQ ID NO: 3697275 - DNA, 19 bp, Homo sapiens
tagaatgcatctcatcaac

SEQ ID NO: 3697276 - DNA, 23 bp, Homo sapiens
tagacaaatgctacattaatgtt

SEQ ID NO: 3697277 - DNA, 13 bp, Homo sapiens
tagacaagccaga

SEQ ID NO: 3697278 - DNA, 19 bp, Homo sapiens
tagacaagccagaacttga

SEQ ID NO: 3697279 - DNA, 19 bp, Homo sapiens
tagacacatatgaggggga

SEQ ID NO: 3697280 - DNA, 18 bp, Homo sapiens
tagaccaagcttgtccaa

SEQ ID NO: 3697281 - DNA, 21 bp, Homo sapiens
tagactcatggtgtgttacac

SEQ ID NO: 3697282 - DNA, 20 bp, Homo sapiens
tagagaacacgcgtatttac

SEQ ID NO: 3697283 - DNA, 14 bp, Homo sapiens
tagagactggaaca

SEQ ID NO: 3697284 - DNA, 22 bp, Homo sapiens
tagagaggacaatactggggtt

SEQ ID NO: 3697285 - DNA, 21 bp, Homo sapiens
tagagggacggccaagaatgt

SEQ ID NO: 3697286 - DNA, 23 bp, Homo sapiens
tagatatcgacttgtttttgcac

SEQ ID NO: 3697287 - DNA, 17 bp, Homo sapiens
tagatcacgagatcaag

SEQ ID NO: 3697288 - DNA, 15 bp, Homo sapiens
tagatctggcatgtt

SEQ ID NO: 3697289 - DNA, 13 bp, Homo sapiens
tagatgctggccc

SEQ ID NO: 3697290 - DNA, 14 bp, Homo sapiens
tagatgctggccca

SEQ ID NO: 3697291 - DNA, 15 bp, Homo sapiens
tagatgctggcccag

SEQ ID NO: 3697292 - DNA, 17 bp, Homo sapiens
tagattaggtcttgctg

SEQ ID NO: 3697293 - DNA, 19 bp, Homo sapiens
tagattaggtcttgctgga

SEQ ID NO: 3697294 - DNA, 12 bp, Homo sapiens
tagattttccaa

SEQ ID NO: 3697295 - DNA, 17 bp, Homo sapiens
tagcaaagcaaaaggct

SEQ ID NO: 3697296 - DNA, 20 bp, Homo sapiens
tagcaaagcaaaaggctgag

SEQ ID NO: 3697297 - DNA, 15 bp, Homo sapiens
tagcagcccaccctg

SEQ ID NO: 3697298 - DNA, 14 bp, Homo sapiens
tagccacaccagga

SEQ ID NO: 3697299 - DNA, 15 bp, Homo sapiens
tagccacaccaggat

SEQ ID NO: 3697300 - DNA, 15 bp, Homo sapiens
tagccagatttgtct

SEQ ID NO: 3697301 - DNA, 13 bp, Homo sapiens
tagccatgcaaca

SEQ ID NO: 3697302 - DNA, 14 bp, Homo sapiens
tagcccaaaaccaa

SEQ ID NO: 3697303 - DNA, 13 bp, Homo sapiens
tagcctccctgaa

SEQ ID NO: 3697304 - DNA, 17 bp, Homo sapiens
tagcctgcctcttctct

SEQ ID NO: 3697305 - DNA, 15 bp, Homo sapiens
tagctaacagtgaag

SEQ ID NO: 3697306 - DNA, 17 bp, Homo sapiens
tagctaactgtaaatca

SEQ ID NO: 3697307 - DNA, 15 bp, Homo sapiens
tagctacaggaagca

SEQ ID NO: 3697308 - DNA, 12 bp, Homo sapiens
tagctcctgtgg

SEQ ID NO: 3697309 - DNA, 18 bp, Homo sapiens
tagctgggggtgggccag

SEQ ID NO: 3697310 - DNA, 19 bp, Homo sapiens
tagcttgataaagggccaa

SEQ ID NO: 3697311 - DNA, 14 bp, Homo sapiens
tagctttcctggtc

SEQ ID NO: 3697312 - DNA, 23 bp, Homo sapiens
taggaagaacgttttttcctcag

SEQ ID NO: 3697313 - DNA, 14 bp, Homo sapiens
taggaccaagaaag

SEQ ID NO: 3697314 - DNA, 18 bp, Homo sapiens
taggaccaagcatcttgg

SEQ ID NO: 3697315 - DNA, 19 bp, Homo sapiens
taggacctttccaccacag

SEQ ID NO: 3697316 - DNA, 22 bp, Homo sapiens
taggacctttccaccacagcca

SEQ ID NO: 3697317 - DNA, 20 bp, Homo sapiens
taggagaaccaaatctggaa

SEQ ID NO: 3697318 - DNA, 17 bp, Homo sapiens
taggagctgcagttctt

SEQ ID NO: 3697319 - DNA, 18 bp, Homo sapiens
taggatagctaactgtaa

SEQ ID NO: 3697320 - DNA, 21 bp, Homo sapiens
taggatagctaactgtaaatc

SEQ ID NO: 3697321 - DNA, 21 bp, Homo sapiens
taggatggggcacggctctgg

SEQ ID NO: 3697322 - DNA, 13 bp, Homo sapiens
taggattttcaca

SEQ ID NO: 3697323 - DNA, 22 bp, Homo sapiens
taggattttcacattcttggct

SEQ ID NO: 3697324 - DNA, 13 bp, Homo sapiens
taggatttttaga

SEQ ID NO: 3697325 - DNA, 22 bp, Homo sapiens
taggattttttttaatgtttaa

SEQ ID NO: 3697326 - DNA, 15 bp, Homo sapiens
taggcatgttatgtt

SEQ ID NO: 3697327 - DNA, 20 bp, Homo sapiens
taggcatttgctgaatacag

SEQ ID NO: 3697328 - DNA, 21 bp, Homo sapiens
taggcatttttaccatcactg

SEQ ID NO: 3697329 - DNA, 19 bp, Homo sapiens
taggcccccacttgcctct

SEQ ID NO: 3697330 - DNA, 21 bp, Homo sapiens
taggcccccacttgcctcttc

SEQ ID NO: 3697331 - DNA, 16 bp, Homo sapiens
taggcctcagccagag

SEQ ID NO: 3697332 - DNA, 16 bp, Homo sapiens
taggctccttcctgtg

SEQ ID NO: 3697333 - DNA, 23 bp, Homo sapiens
taggctccttcctgtgggtgggg

SEQ ID NO: 3697334 - DNA, 16 bp, Homo sapiens
taggctgctccctgag

SEQ ID NO: 3697335 - DNA, 18 bp, Homo sapiens
taggctgctccctgaggg

SEQ ID NO: 3697336 - DNA, 22 bp, Homo sapiens
taggctgctccctgagggcgga

SEQ ID NO: 3697337 - DNA, 19 bp, Homo sapiens
taggctggtggcccaggac

SEQ ID NO: 3697338 - DNA, 20 bp, Homo sapiens
tagggaaaaaccagcgtgtg

SEQ ID NO: 3697339 - DNA, 15 bp, Homo sapiens
tagggaactggggaa

SEQ ID NO: 3697340 - DNA, 17 bp, Homo sapiens
tagggaagaaaaagcaa

SEQ ID NO: 3697341 - DNA, 18 bp, Homo sapiens
tctcttgagcctgggagg

SEQ ID NO: 3697342 - DNA, 14 bp, Homo sapiens
tctcttgagtttgt

SEQ ID NO: 3697343 - DNA, 20 bp, Homo sapiens
tctcttgctttcacattgta

SEQ ID NO: 3697344 - DNA, 21 bp, Homo sapiens
tctcttgggtgggacagggct

SEQ ID NO: 3697345 - DNA, 22 bp, Homo sapiens
tctctttcacattgtttgctgc

SEQ ID NO: 3697346 - DNA, 17 bp, Homo sapiens
tctgaaaattaacactg

SEQ ID NO: 3697347 - DNA, 18 bp, Homo sapiens
tctgaaactatagaataa

SEQ ID NO: 3697348 - DNA, 14 bp, Homo sapiens
tctgaacccaggca

SEQ ID NO: 3697349 - DNA, 20 bp, Homo sapiens
tctgaacccaggcagctggc

SEQ ID NO: 3697350 - DNA, 18 bp, Homo sapiens
tctgaactgttacaactt

SEQ ID NO: 3697351 - DNA, 15 bp, Homo sapiens
tctgaactttggaag

SEQ ID NO: 3697352 - DNA, 16 bp, Homo sapiens
tctgaccagcagcgcc

SEQ ID NO: 3697353 - DNA, 18 bp, Homo sapiens
tctgaccagcagcgcctt

SEQ ID NO: 3697354 - DNA, 18 bp, Homo sapiens
tctgaccccagcccagac

SEQ ID NO: 3697355 - DNA, 18 bp, Homo sapiens
tctgactcggtttctcca

SEQ ID NO: 3697356 - DNA, 23 bp, Homo sapiens
tctgacttaagcaaaagaaaaag

SEQ ID NO: 3697357 - DNA, 16 bp, Homo sapiens
tctgacttctgcctgg

SEQ ID NO: 3697358 - DNA, 17 bp, Homo sapiens
tctgacttctgcctgga

SEQ ID NO: 3697359 - DNA, 13 bp, Homo sapiens
tctgagcccaacc

SEQ ID NO: 3697360 - DNA, 15 bp, Homo sapiens
tctgagcccaaccct

SEQ ID NO: 3697361 - DNA, 23 bp, Homo sapiens
tctgagtatctcctcgcaagctg

SEQ ID NO: 3697362 - DNA, 17 bp, Homo sapiens
tctgattccgcaccctg

SEQ ID NO: 3697363 - DNA, 24 bp, Homo sapiens
tctgcaaacaccaacatgttggga

SEQ ID NO: 3697364 - DNA, 20 bp, Homo sapiens
tctgcaagaattgaagcagg

SEQ ID NO: 3697365 - DNA, 16 bp, Homo sapiens
tctgcacccccctggg

SEQ ID NO: 3697366 - DNA, 17 bp, Homo sapiens
tctgcacccccctgggc

SEQ ID NO: 3697367 - DNA, 18 bp, Homo sapiens
tctgcactactgacatgt

SEQ ID NO: 3697368 - DNA, 21 bp, Homo sapiens
tctgcactactgacatgtggg

SEQ ID NO: 3697369 - DNA, 18 bp, Homo sapiens
tctgcatttcggtggcta

SEQ ID NO: 3697370 - DNA, 23 bp, Homo sapiens
tctgccactgtgaaccggctccc

SEQ ID NO: 3697371 - DNA, 19 bp, Homo sapiens
tctgccagggagcttgaaa

SEQ ID NO: 3697372 - DNA, 13 bp, Homo sapiens
tctgccagtgaca

SEQ ID NO: 3697373 - DNA, 23 bp, Homo sapiens
tctgccattgggaccctccagtg

SEQ ID NO: 3697374 - DNA, 19 bp, Homo sapiens
tctgccccatcctccagca

SEQ ID NO: 3697375 - DNA, 21 bp, Homo sapiens
tctgccccatcctccagcagg

SEQ ID NO: 3697376 - DNA, 16 bp, Homo sapiens
tctgccccgccctcct

SEQ ID NO: 3697377 - DNA, 14 bp, Homo sapiens
tctgcccctccccc

SEQ ID NO: 3697378 - DNA, 15 bp, Homo sapiens
tctgcccctccccca

SEQ ID NO: 3697379 - DNA, 22 bp, Homo sapiens
tctgccggacccggaggccgag

SEQ ID NO: 3697380 - DNA, 15 bp, Homo sapiens
tctgccggccctggg

SEQ ID NO: 3697381 - DNA, 18 bp, Homo sapiens
tctgcctgccagctgcac

SEQ ID NO: 3697382 - DNA, 15 bp, Homo sapiens
tctgcgttggcttct

SEQ ID NO: 3697383 - DNA, 20 bp, Homo sapiens
tctgctcagaggccttgctg

SEQ ID NO: 3697384 - DNA, 23 bp, Homo sapiens
tctgctcagctgcgcccccttct

SEQ ID NO: 3697385 - DNA, 15 bp, Homo sapiens
tctgctcagcttctc

SEQ ID NO: 3697386 - DNA, 20 bp, Homo sapiens
tctgctccaccacatcctcc

SEQ ID NO: 3697387 - DNA, 20 bp, Homo sapiens
tctgctccacccttggcctg

SEQ ID NO: 3697388 - DNA, 21 bp, Homo sapiens
tctgctccacccttggcctgt

SEQ ID NO: 3697389 - DNA, 16 bp, Homo sapiens
tctgctctttctctgc

SEQ ID NO: 3697390 - DNA, 22 bp, Homo sapiens
tctgcttctctgacttctgcct

SEQ ID NO: 3697391 - DNA, 17 bp, Homo sapiens
tctggaaaatgcttctt

SEQ ID NO: 3697392 - DNA, 13 bp, Homo sapiens
tctggaacccaga

SEQ ID NO: 3697393 - DNA, 17 bp, Homo sapiens
tctggaacccagactca

SEQ ID NO: 3697394 - DNA, 15 bp, Homo sapiens
tctggaacctcagcc

SEQ ID NO: 3697395 - DNA, 17 bp, Homo sapiens
tctggaacctcagcctg

SEQ ID NO: 3697396 - DNA, 23 bp, Homo sapiens
tctggaacctcagcctggccaga

SEQ ID NO: 3697397 - DNA, 20 bp, Homo sapiens
tctggacagccccaccctgg

SEQ ID NO: 3697398 - DNA, 20 bp, Homo sapiens
tctggacatgaattaaagta

SEQ ID NO: 3697399 - DNA, 16 bp, Homo sapiens
tctggagttgatctgg

SEQ ID NO: 3697400 - DNA, 21 bp, Homo sapiens
tctggagttgatctggaaccc

SEQ ID NO: 3697401 - DNA, 17 bp, Homo sapiens
tctggccaggaagcttt

SEQ ID NO: 3697402 - DNA, 22 bp, Homo sapiens
tctggctagaggccagccccac

SEQ ID NO: 3697403 - DNA, 16 bp, Homo sapiens
tctggcttagtgccac

SEQ ID NO: 3697404 - DNA, 19 bp, Homo sapiens
tctggcttctggccaggaa

SEQ ID NO: 3697405 - DNA, 19 bp, Homo sapiens
tctgggaccaggctccaat

SEQ ID NO: 3697406 - DNA, 15 bp, Homo sapiens
tctgggcctcagttt

SEQ ID NO: 3697407 - DNA, 20 bp, Homo sapiens
tctgggcggcgggcggctgg

SEQ ID NO: 3697408 - DNA, 18 bp, Homo sapiens
tctgggctaccccaccca

SEQ ID NO: 3697409 - DNA, 20 bp, Homo sapiens
tctggggtaggctgctccct

SEQ ID NO: 3697410 - DNA, 16 bp, Homo sapiens
tctgggtaagaagaaa

SEQ ID NO: 3697411 - DNA, 18 bp, Homo sapiens
tctgggtaagaagaaagc

SEQ ID NO: 3697412 - DNA, 18 bp, Homo sapiens
tctgggtgctccctacca

SEQ ID NO: 3697413 - DNA, 17 bp, Homo sapiens
tctgggtgggcggggca

SEQ ID NO: 3697414 - DNA, 14 bp, Homo sapiens
tctggtcctaccca

SEQ ID NO: 3697415 - DNA, 17 bp, Homo sapiens
tctggtcgctcctgccc

SEQ ID NO: 3697416 - DNA, 19 bp, Homo sapiens
tctggtggccactgagctg

SEQ ID NO: 3697417 - DNA, 23 bp, Homo sapiens
tctggtggccactgagctggctg

SEQ ID NO: 3697418 - DNA, 17 bp, Homo sapiens
tctggtggctgggctgc

SEQ ID NO: 3697419 - DNA, 18 bp, Homo sapiens
tctggtggctgggctgct

SEQ ID NO: 3697420 - DNA, 23 bp, Homo sapiens
tctggtggctgggctgctcctga

SEQ ID NO: 3697421 - DNA, 14 bp, Homo sapiens
tctggttccagggt

SEQ ID NO: 3697422 - DNA, 23 bp, Homo sapiens
tctggttccagggtccctctgtg

SEQ ID NO: 3697423 - DNA, 23 bp, Homo sapiens
tctgtactgttactgggccctga

SEQ ID NO: 3697424 - DNA, 20 bp, Homo sapiens
tctgtacttttcattctctt

SEQ ID NO: 3697425 - DNA, 23 bp, Homo sapiens
tctgtatttatgtgtgaggagct

SEQ ID NO: 3697426 - DNA, 16 bp, Homo sapiens
tctgtccaaaggaggc

SEQ ID NO: 3697427 - DNA, 17 bp, Homo sapiens
tctgtccaaaggaggct

SEQ ID NO: 3697428 - DNA, 19 bp, Homo sapiens
tctgtccaaaggaggctgg

SEQ ID NO: 3697429 - DNA, 22 bp, Homo sapiens
tctgtccaaaggaggctggcag

SEQ ID NO: 3697430 - DNA, 12 bp, Homo sapiens
tctgtcccaagt

SEQ ID NO: 3697431 - DNA, 15 bp, Homo sapiens
tctgtcctacaatct

SEQ ID NO: 3697432 - DNA, 15 bp, Homo sapiens
tctgtctacttgctc

SEQ ID NO: 3697433 - DNA, 17 bp, Homo sapiens
tctgtctcccaggctgg

SEQ ID NO: 3697434 - DNA, 12 bp, Homo sapiens
tctgtctggcac

SEQ ID NO: 3697435 - DNA, 13 bp, Homo sapiens
tctgtctggtggc

SEQ ID NO: 3697436 - DNA, 16 bp, Homo sapiens
tctgtctggtggcccc

SEQ ID NO: 3697437 - DNA, 12 bp, Homo sapiens
tctgtggccagc

SEQ ID NO: 3697438 - DNA, 14 bp, Homo sapiens
tctgtggccagcct

SEQ ID NO: 3697439 - DNA, 16 bp, Homo sapiens
tctgtgggccctaccc

SEQ ID NO: 3697440 - DNA, 23 bp, Homo sapiens
tctgtgggctacatgctggggtc

SEQ ID NO: 3697441 - DNA, 16 bp, Homo sapiens
tctgtgttgccaagct

SEQ ID NO: 3697442 - DNA, 20 bp, Homo sapiens
tctgttcccccttcacaaag

SEQ ID NO: 3697443 - DNA, 21 bp, Homo sapiens
tctgttgattactactttaag

SEQ ID NO: 3697444 - DNA, 16 bp, Homo sapiens
tctgttgcaagtgcaa

SEQ ID NO: 3697445 - DNA, 15 bp, Homo sapiens
tctgttggcaggctg

SEQ ID NO: 3697446 - DNA, 20 bp, Homo sapiens
tctgttggcaggctggccag

SEQ ID NO: 3697447 - DNA, 16 bp, Homo sapiens
tctgtttcctgacatt

SEQ ID NO: 3697448 - DNA, 21 bp, Homo sapiens
tctgtttgtttggctgtccag

SEQ ID NO: 3697449 - DNA, 13 bp, Homo sapiens
tcttaaaaagtgg

SEQ ID NO: 3697450 - DNA, 16 bp, Homo sapiens
tcttaaacacttgcaa

SEQ ID NO: 3697451 - DNA, 22 bp, Homo sapiens
tcttaagattccattttggaaa

SEQ ID NO: 3697452 - DNA, 21 bp, Homo sapiens
tcttaagtaccaatgggaagc

SEQ ID NO: 3697453 - DNA, 23 bp, Homo sapiens
tcttaatacttgaactgttgccc

SEQ ID NO: 3697454 - DNA, 15 bp, Homo sapiens
tcttactgttttgag

SEQ ID NO: 3697455 - DNA, 20 bp, Homo sapiens
tcttaggttggcaaaaaggc

SEQ ID NO: 3697456 - DNA, 12 bp, Homo sapiens
tgcagctgaccg

SEQ ID NO: 3697457 - DNA, 16 bp, Homo sapiens
tgcaggaatcccggct

SEQ ID NO: 3697458 - DNA, 19 bp, Homo sapiens
tgcaggaatcccggctcca

SEQ ID NO: 3697459 - DNA, 16 bp, Homo sapiens
tgcaggacctcaggtg

SEQ ID NO: 3697460 - DNA, 16 bp, Homo sapiens
tgcaggccctggcctc

SEQ ID NO: 3697461 - DNA, 16 bp, Homo sapiens
tgcaggcggggctcct

SEQ ID NO: 3697462 - DNA, 20 bp, Homo sapiens
tgcagggagggcagttttct

SEQ ID NO: 3697463 - DNA, 23 bp, Homo sapiens
tgcaggggtcagtgcagcagagg

SEQ ID NO: 3697464 - DNA, 22 bp, Homo sapiens
tgcagtcatggagaaccaccta

SEQ ID NO: 3697465 - DNA, 15 bp, Homo sapiens
tgcagttcagcacca

SEQ ID NO: 3697466 - DNA, 21 bp, Homo sapiens
tgcagttcttgtggaagacac

SEQ ID NO: 3697467 - DNA, 11 bp, Homo sapiens
tgcataaaatg

SEQ ID NO: 3697468 - DNA, 15 bp, Homo sapiens
tgcataagaaatgta

SEQ ID NO: 3697469 - DNA, 21 bp, Homo sapiens
tgcataagaaatgtagctgaa

SEQ ID NO: 3697470 - DNA, 22 bp, Homo sapiens
tgcataagaaatgtagctgaag

SEQ ID NO: 3697471 - DNA, 14 bp, Homo sapiens
tgcataccaacctg

SEQ ID NO: 3697472 - DNA, 19 bp, Homo sapiens
tgcatagagccacgtatgt

SEQ ID NO: 3697473 - DNA, 13 bp, Homo sapiens
tgcataggctcct

SEQ ID NO: 3697474 - DNA, 14 bp, Homo sapiens
tgcataggctcctt

SEQ ID NO: 3697475 - DNA, 19 bp, Homo sapiens
tgcataggctccttcctgt

SEQ ID NO: 3697476 - DNA, 19 bp, Homo sapiens
tgcatgaaggtttctgaaa

SEQ ID NO: 3697477 - DNA, 17 bp, Homo sapiens
tgcatgcattgagctgc

SEQ ID NO: 3697478 - DNA, 17 bp, Homo sapiens
tgcatggggcgggtcct

SEQ ID NO: 3697479 - DNA, 23 bp, Homo sapiens
tgcatggggtggggtagggctga

SEQ ID NO: 3697480 - DNA, 21 bp, Homo sapiens
tgcatggtgccccaggaccag

SEQ ID NO: 3697481 - DNA, 22 bp, Homo sapiens
tgcatggtgccccaggaccagc

SEQ ID NO: 3697482 - DNA, 13 bp, Homo sapiens
tgcattgagctgc

SEQ ID NO: 3697483 - DNA, 21 bp, Homo sapiens
tgccaaaaaggatacataatg

SEQ ID NO: 3697484 - DNA, 18 bp, Homo sapiens
tgccaaaatgctctagtg

SEQ ID NO: 3697485 - DNA, 17 bp, Homo sapiens
tgccaaacaaaaaggtt

SEQ ID NO: 3697486 - DNA, 23 bp, Homo sapiens
tgccaaacaaaaaggttctcagg

SEQ ID NO: 3697487 - DNA, 13 bp, Homo sapiens
tgccaagctccaa

SEQ ID NO: 3697488 - DNA, 15 bp, Homo sapiens
tgccaagctccaagc

SEQ ID NO: 3697489 - DNA, 22 bp, Homo sapiens
tgccaaggccagagtggcctgg

SEQ ID NO: 3697490 - DNA, 18 bp, Homo sapiens
tgccaagtctcagaagag

SEQ ID NO: 3697491 - DNA, 18 bp, Homo sapiens
tgccaattgctaccgaga

SEQ ID NO: 3697492 - DNA, 19 bp, Homo sapiens
tgccacaaggacttcctgt

SEQ ID NO: 3697493 - DNA, 13 bp, Homo sapiens
tgccaccaggcca

SEQ ID NO: 3697494 - DNA, 13 bp, Homo sapiens
tgccacccacctc

SEQ ID NO: 3697495 - DNA, 22 bp, Homo sapiens
tgccacccacctccctgcctcc

SEQ ID NO: 3697496 - DNA, 15 bp, Homo sapiens
tgccaccccttcctc

SEQ ID NO: 3697497 - DNA, 21 bp, Homo sapiens
tgccaccccttcctcagcctg

SEQ ID NO: 3697498 - DNA, 22 bp, Homo sapiens
tgccacgttggagaagcccgtg

SEQ ID NO: 3697499 - DNA, 19 bp, Homo sapiens
tgccactaaactacattgt

SEQ ID NO: 3697500 - DNA, 13 bp, Homo sapiens
tgccactcactag

SEQ ID NO: 3697501 - DNA, 22 bp, Homo sapiens
tgccactcactaggcccccact

SEQ ID NO: 3697502 - DNA, 23 bp, Homo sapiens
tgccactgcgggagctctgtatg

SEQ ID NO: 3697503 - DNA, 14 bp, Homo sapiens
tgccagagatccaa

SEQ ID NO: 3697504 - DNA, 17 bp, Homo sapiens
tgccagcggtttcctgg

SEQ ID NO: 3697505 - DNA, 10 bp, Homo sapiens
tgccaggcat

SEQ ID NO: 3697506 - DNA, 14 bp, Homo sapiens
tgccaggcatggtg

SEQ ID NO: 3697507 - DNA, 21 bp, Homo sapiens
tgccagtaacgcgtcttcctg

SEQ ID NO: 3697508 - DNA, 23 bp, Homo sapiens
tgccagtaacgcgtcttcctgag

SEQ ID NO: 3697509 - DNA, 17 bp, Homo sapiens
tgccagtcaagaagaaa

SEQ ID NO: 3697510 - DNA, 16 bp, Homo sapiens
tgccagtgacagacag

SEQ ID NO: 3697511 - DNA, 20 bp, Homo sapiens
tgccagtgacagacaggctc

SEQ ID NO: 3697512 - DNA, 22 bp, Homo sapiens
tgccagtgacagacaggctctt

SEQ ID NO: 3697513 - DNA, 19 bp, Homo sapiens
tgccatgatgcctctgtct

SEQ ID NO: 3697514 - DNA, 21 bp, Homo sapiens
tgccatgatgcctctgtcttc

SEQ ID NO: 3697515 - DNA, 23 bp, Homo sapiens
tgccatggacagaagaaggcagc

SEQ ID NO: 3697516 - DNA, 13 bp, Homo sapiens
tgccattcttctg

SEQ ID NO: 3697517 - DNA, 18 bp, Homo sapiens
tgccattcttctggtgct

SEQ ID NO: 3697518 - DNA, 21 bp, Homo sapiens
tgccattcttctggtgctact

SEQ ID NO: 3697519 - DNA, 17 bp, Homo sapiens
tgccatttctgaactgt

SEQ ID NO: 3697520 - DNA, 20 bp, Homo sapiens
tgcccaacccttccctcacc

SEQ ID NO: 3697521 - DNA, 14 bp, Homo sapiens
tgcccaagccagag

SEQ ID NO: 3697522 - DNA, 15 bp, Homo sapiens
tgcccaagccagagg

SEQ ID NO: 3697523 - DNA, 20 bp, Homo sapiens
tgcccaagccagaggctggg

SEQ ID NO: 3697524 - DNA, 23 bp, Homo sapiens
tgcccaagccagaggctgggttc

SEQ ID NO: 3697525 - DNA, 14 bp, Homo sapiens
tgcccacctgccca

SEQ ID NO: 3697526 - DNA, 19 bp, Homo sapiens
tgcccacctgcccatcaca

SEQ ID NO: 3697527 - DNA, 16 bp, Homo sapiens
tgcccacctgccggcc

SEQ ID NO: 3697528 - DNA, 12 bp, Homo sapiens
tgcccaggagca

SEQ ID NO: 3697529 - DNA, 23 bp, Homo sapiens
tgcccatcacagggttgggccca

SEQ ID NO: 3697530 - DNA, 15 bp, Homo sapiens
tgccccagagctgtt

SEQ ID NO: 3697531 - DNA, 23 bp, Homo sapiens
tgccccagagctgtttatggcct

SEQ ID NO: 3697532 - DNA, 19 bp, Homo sapiens
tgccccaggaccagctcag

SEQ ID NO: 3697533 - DNA, 21 bp, Homo sapiens
tgccccatcctccagcaggga

SEQ ID NO: 3697534 - DNA, 15 bp, Homo sapiens
tgcccctccaagtca

SEQ ID NO: 3697535 - DNA, 22 bp, Homo sapiens
tgcccctccaagtcacaaagag

SEQ ID NO: 3697536 - DNA, 21 bp, Homo sapiens
tgcccctcccccaacccccac

SEQ ID NO: 3697537 - DNA, 20 bp, Homo sapiens
tgccccttgacaactggcag

SEQ ID NO: 3697538 - DNA, 19 bp, Homo sapiens
tgcccgtgtagtccccaac

SEQ ID NO: 3697539 - DNA, 15 bp, Homo sapiens
tgccctcctctccca

SEQ ID NO: 3697540 - DNA, 23 bp, Homo sapiens
tgccctggcagggtcatcctgtg

SEQ ID NO: 3697541 - DNA, 18 bp, Homo sapiens
tgccctggtccagggaag

SEQ ID NO: 3697542 - DNA, 22 bp, Homo sapiens
tgcccttctgattcccctccac

SEQ ID NO: 3697543 - DNA, 16 bp, Homo sapiens
tgccgagccagcaaga

SEQ ID NO: 3697544 - DNA, 15 bp, Homo sapiens
tgccgcaaattgtac

SEQ ID NO: 3697545 - DNA, 15 bp, Homo sapiens
tgccggccctggggc

SEQ ID NO: 3697546 - DNA, 20 bp, Homo sapiens
tgccgtctaggattgggcct

SEQ ID NO: 3697547 - DNA, 20 bp, Homo sapiens
tgccgtggattgcacgtggc

SEQ ID NO: 3697548 - DNA, 22 bp, Homo sapiens
tgccgtggcaccaggcgctgcc

SEQ ID NO: 3697549 - DNA, 23 bp, Homo sapiens
tgccgtggggccgccgcctcttt

SEQ ID NO: 3697550 - DNA, 18 bp, Homo sapiens
tgcctcagcctccctggt

SEQ ID NO: 3697551 - DNA, 18 bp, Homo sapiens
tgcctcatggccagcgcc

SEQ ID NO: 3697552 - DNA, 15 bp, Homo sapiens
tgcctccagcctggt

SEQ ID NO: 3697553 - DNA, 22 bp, Homo sapiens
tgcctccagcctggtggcccag

SEQ ID NO: 3697554 - DNA, 23 bp, Homo sapiens
tgcctccagcctggtggcccagc

SEQ ID NO: 3697555 - DNA, 17 bp, Homo sapiens
tgcctccaggaaccaca

SEQ ID NO: 3697556 - DNA, 19 bp, Homo sapiens
tgcctccaggaaccacacc

SEQ ID NO: 3697557 - DNA, 14 bp, Homo sapiens
tgcctcgcatccta

SEQ ID NO: 3697558 - DNA, 19 bp, Homo sapiens
tgcctcgcatcctatgctt

SEQ ID NO: 3697559 - DNA, 12 bp, Homo sapiens
tgcctctgtgct

SEQ ID NO: 3697560 - DNA, 13 bp, Homo sapiens
tgcctctgtgctg

SEQ ID NO: 3697561 - DNA, 14 bp, Homo sapiens
tgcctctgtgctgt

SEQ ID NO: 3697562 - DNA, 16 bp, Homo sapiens
tgcctctgtgctgtgt

SEQ ID NO: 3697563 - DNA, 18 bp, Homo sapiens
tgcctgatcctccaacag

SEQ ID NO: 3697564 - DNA, 16 bp, Homo sapiens
tgcctgcagggccatg

SEQ ID NO: 3697565 - DNA, 23 bp, Homo sapiens
tgcctggggtgttagtggcaccg

SEQ ID NO: 3697566 - DNA, 12 bp, Homo sapiens
tgcctgtagcct

SEQ ID NO: 3697567 - DNA, 16 bp, Homo sapiens
tgcctgtccagcctgg

SEQ ID NO: 3697568 - DNA, 19 bp, Homo sapiens
tgcctgtccagcctgggca

SEQ ID NO: 3697569 - DNA, 19 bp, Homo sapiens
tgcctgtgtccatgcgctc

SEQ ID NO: 3697570 - DNA, 21 bp, Homo sapiens
tgccttcgcttcttgcctctg

SEQ ID NO: 3697571 - DNA, 20 bp, Homo sapiens
tggggtaggctgctccctga

SEQ ID NO: 3697572 - DNA, 13 bp, Homo sapiens
tggggtagggctg

SEQ ID NO: 3697573 - DNA, 16 bp, Homo sapiens
tggggtagggctgact

SEQ ID NO: 3697574 - DNA, 16 bp, Homo sapiens
tggggtcctggccatc

SEQ ID NO: 3697575 - DNA, 19 bp, Homo sapiens
tggggtcctggccatccca

SEQ ID NO: 3697576 - DNA, 16 bp, Homo sapiens
tggggtgtttgggagg

SEQ ID NO: 3697577 - DNA, 19 bp, Homo sapiens
tggggtttaaatatccagg

SEQ ID NO: 3697578 - DNA, 21 bp, Homo sapiens
tggggtttaaatatccaggtg

SEQ ID NO: 3697579 - DNA, 18 bp, Homo sapiens
tggggtttgaccacccac

SEQ ID NO: 3697580 - DNA, 22 bp, Homo sapiens
tggggttttatggtggatgagg

SEQ ID NO: 3697581 - DNA, 14 bp, Homo sapiens
tgggtaagaagaaa

SEQ ID NO: 3697582 - DNA, 19 bp, Homo sapiens
tgggtacttcttgaaggtg

SEQ ID NO: 3697583 - DNA, 15 bp, Homo sapiens
tgggtccaggggatg

SEQ ID NO: 3697584 - DNA, 21 bp, Homo sapiens
tgggtccaggggatgggaggt

SEQ ID NO: 3697585 - DNA, 20 bp, Homo sapiens
tgggtggcaccagcagcctg

SEQ ID NO: 3697586 - DNA, 18 bp, Homo sapiens
tgggtgggacagggcttc

SEQ ID NO: 3697587 - DNA, 14 bp, Homo sapiens
tgggtgtggatggc

SEQ ID NO: 3697588 - DNA, 17 bp, Homo sapiens
tgggtgtggatggcagt

SEQ ID NO: 3697589 - DNA, 20 bp, Homo sapiens
tgggttccctttccttccat

SEQ ID NO: 3697590 - DNA, 22 bp, Homo sapiens
tgggttctgcctgccagctgca

SEQ ID NO: 3697591 - DNA, 21 bp, Homo sapiens
tgggttgcagacaggaatctt

SEQ ID NO: 3697592 - DNA, 14 bp, Homo sapiens
tggtacaaaaataa

SEQ ID NO: 3697593 - DNA, 18 bp, Homo sapiens
tggtacaaaaataaattt

SEQ ID NO: 3697594 - DNA, 16 bp, Homo sapiens
tggtaggaccaagcat

SEQ ID NO: 3697595 - DNA, 21 bp, Homo sapiens
tggtagtcctcccaagctgtg

SEQ ID NO: 3697596 - DNA, 24 bp, Homo sapiens
tggtagtcctcccaagctgtgctg

SEQ ID NO: 3697597 - DNA, 19 bp, Homo sapiens
tggtatctgggtaagaaga

SEQ ID NO: 3697598 - DNA, 21 bp, Homo sapiens
tggtcacagcggaggtgtgga

SEQ ID NO: 3697599 - DNA, 19 bp, Homo sapiens
tggtcagggtgtgggatct

SEQ ID NO: 3697600 - DNA, 20 bp, Homo sapiens
tggtcagggtgtgggatctg

SEQ ID NO: 3697601 - DNA, 13 bp, Homo sapiens
tggtccctcaccc

SEQ ID NO: 3697602 - DNA, 16 bp, Homo sapiens
tggtccgctttcctgg

SEQ ID NO: 3697603 - DNA, 12 bp, Homo sapiens
tggtcctaccca

SEQ ID NO: 3697604 - DNA, 13 bp, Homo sapiens
tggtcgctcctgc

SEQ ID NO: 3697605 - DNA, 16 bp, Homo sapiens
tggtctcatttggggg

SEQ ID NO: 3697606 - DNA, 15 bp, Homo sapiens
tggtgcactttgtaa

SEQ ID NO: 3697607 - DNA, 17 bp, Homo sapiens
tggtgcactttgtaaat

SEQ ID NO: 3697608 - DNA, 14 bp, Homo sapiens
tggtgccccaggac

SEQ ID NO: 3697609 - DNA, 16 bp, Homo sapiens
tggtgccccaggacca

SEQ ID NO: 3697610 - DNA, 19 bp, Homo sapiens
tggtgccccaggaccagct

SEQ ID NO: 3697611 - DNA, 23 bp, Homo sapiens
tggtgccccaggaccagctcagg

SEQ ID NO: 3697612 - DNA, 17 bp, Homo sapiens
tggtggcagtggaggtg

SEQ ID NO: 3697613 - DNA, 16 bp, Homo sapiens
tggtggctgggctgct

SEQ ID NO: 3697614 - DNA, 21 bp, Homo sapiens
tggtgggttcaggggactcag

SEQ ID NO: 3697615 - DNA, 17 bp, Homo sapiens
tggtggtaaccctggtg

SEQ ID NO: 3697616 - DNA, 16 bp, Homo sapiens
tggtgtggcaaagcct

SEQ ID NO: 3697617 - DNA, 19 bp, Homo sapiens
tggtgttatttgaaacttt

SEQ ID NO: 3697618 - DNA, 12 bp, Homo sapiens
tggttccagggt

SEQ ID NO: 3697619 - DNA, 22 bp, Homo sapiens
tggttccagggtccctctgtgt

SEQ ID NO: 3697620 - DNA, 13 bp, Homo sapiens
tggttctgtgacc

SEQ ID NO: 3697621 - DNA, 22 bp, Homo sapiens
tggttgtctgaacccaggcagc

SEQ ID NO: 3697622 - DNA, 17 bp, Homo sapiens
tggtttgcaaggaagcc

SEQ ID NO: 3697623 - DNA, 17 bp, Homo sapiens
tggtttgccttccagaa

SEQ ID NO: 3697624 - DNA, 16 bp, Homo sapiens
tggttttgagaaagta

SEQ ID NO: 3697625 - DNA, 21 bp, Homo sapiens
tggtttttaaaaaactgctga

SEQ ID NO: 3697626 - DNA, 15 bp, Homo sapiens
tggtttttaaatttt

SEQ ID NO: 3697627 - DNA, 14 bp, Homo sapiens
tgtaaaaaaaccac

SEQ ID NO: 3697628 - DNA, 14 bp, Homo sapiens
tgtaaaacaaaatt

SEQ ID NO: 3697629 - DNA, 18 bp, Homo sapiens
tgtaaacagcctcttttt

SEQ ID NO: 3697630 - DNA, 16 bp, Homo sapiens
tgtaaattgaagaagc

SEQ ID NO: 3697631 - DNA, 17 bp, Homo sapiens
tgtaagaaacacactga

SEQ ID NO: 3697632 - DNA, 19 bp, Homo sapiens
tgtaagtgaagtaaaactt

SEQ ID NO: 3697633 - DNA, 15 bp, Homo sapiens
tgtaataaactttaa

SEQ ID NO: 3697634 - DNA, 17 bp, Homo sapiens
tgtaataaactttaata

SEQ ID NO: 3697635 - DNA, 11 bp, Homo sapiens
tgtaatacaat

SEQ ID NO: 3697636 - DNA, 13 bp, Homo sapiens
tgtaatgttttct

SEQ ID NO: 3697637 - DNA, 22 bp, Homo sapiens
tgtacagacatatttaactggt

SEQ ID NO: 3697638 - DNA, 14 bp, Homo sapiens
tgtacagtagattt

SEQ ID NO: 3697639 - DNA, 20 bp, Homo sapiens
tgtacagtagattttccaaa

SEQ ID NO: 3697640 - DNA, 17 bp, Homo sapiens
tgtacatttctataaat

SEQ ID NO: 3697641 - DNA, 21 bp, Homo sapiens
tgtacatttctataaatagat

SEQ ID NO: 3697642 - DNA, 13 bp, Homo sapiens
tgtactagtttta

SEQ ID NO: 3697643 - DNA, 18 bp, Homo sapiens
tgtactcagtggacagtg

SEQ ID NO: 3697644 - DNA, 14 bp, Homo sapiens
tgtacttgtttgca

SEQ ID NO: 3697645 - DNA, 15 bp, Homo sapiens
tgtactttgcttgct

SEQ ID NO: 3697646 - DNA, 12 bp, Homo sapiens
tgtacttttcat

SEQ ID NO: 3697647 - DNA, 22 bp, Homo sapiens
tgtacttttcattctcttttaa

SEQ ID NO: 3697648 - DNA, 13 bp, Homo sapiens
tgtagagtgggag

SEQ ID NO: 3697649 - DNA, 14 bp, Homo sapiens
tgtagagtgggagc

SEQ ID NO: 3697650 - DNA, 17 bp, Homo sapiens
tgtagagtgtagactgt

SEQ ID NO: 3697651 - DNA, 15 bp, Homo sapiens
tgtagcacttactgg

SEQ ID NO: 3697652 - DNA, 19 bp, Homo sapiens
tgtagcacttactggtagg

SEQ ID NO: 3697653 - DNA, 13 bp, Homo sapiens
tgtagccacacca

SEQ ID NO: 3697654 - DNA, 17 bp, Homo sapiens
tgtagccacaccaggat

SEQ ID NO: 3697655 - DNA, 19 bp, Homo sapiens
tgtagctaacagtgaagat

SEQ ID NO: 3697656 - DNA, 15 bp, Homo sapiens
tgtagctgaagtaga

SEQ ID NO: 3697657 - DNA, 15 bp, Homo sapiens
tgtagctttcctggt

SEQ ID NO: 3697658 - DNA, 13 bp, Homo sapiens
tgtaggagctgca

SEQ ID NO: 3697659 - DNA, 17 bp, Homo sapiens
tgtaggcttagtttgtg

SEQ ID NO: 3697660 - DNA, 13 bp, Homo sapiens
tgtagggagggcg

SEQ ID NO: 3697661 - DNA, 22 bp, Homo sapiens
tgtaggggttaacttggtcaga

SEQ ID NO: 3697662 - DNA, 19 bp, Homo sapiens
tgtaggtatgtctgtgcca

SEQ ID NO: 3697663 - DNA, 13 bp, Homo sapiens
tgtataatcccac

SEQ ID NO: 3697664 - DNA, 21 bp, Homo sapiens
tgtatataggacaaaatgtta

SEQ ID NO: 3697665 - DNA, 19 bp, Homo sapiens
tgtatatggtatatataca

SEQ ID NO: 3697666 - DNA, 22 bp, Homo sapiens
tgtatatttgtaaagctattta

SEQ ID NO: 3697667 - DNA, 16 bp, Homo sapiens
tgtatctctttcacat

SEQ ID NO: 3697668 - DNA, 16 bp, Homo sapiens
tgtatgactgcacatg

SEQ ID NO: 3697669 - DNA, 23 bp, Homo sapiens
tgtatgtaaagttcctgctgtaa

SEQ ID NO: 3697670 - DNA, 17 bp, Homo sapiens
tgtatgtgtctcccagg

SEQ ID NO: 3697671 - DNA, 14 bp, Homo sapiens
tgtattacagatgc

SEQ ID NO: 3697672 - DNA, 19 bp, Homo sapiens
tgtattgcatatatacata

SEQ ID NO: 3697673 - DNA, 11 bp, Homo sapiens
tgtatttaatt

SEQ ID NO: 3697674 - DNA, 16 bp, Homo sapiens
tgtatttatgtgtgag

SEQ ID NO: 3697675 - DNA, 22 bp, Homo sapiens
tgtatttccaaacctggttcat

SEQ ID NO: 3697676 - DNA, 18 bp, Homo sapiens
tgtatttgttaatggttt

SEQ ID NO: 3697677 - DNA, 23 bp, Homo sapiens
tgtatttttatataatatctaaa

SEQ ID NO: 3697678 - DNA, 17 bp, Homo sapiens
tgtcaaacaaagccaga

SEQ ID NO: 3697679 - DNA, 17 bp, Homo sapiens
tgtcaagcctgtgcaaa

SEQ ID NO: 3697680 - DNA, 18 bp, Homo sapiens
tgtcaagcctgtgcaaaa

SEQ ID NO: 3697681 - DNA, 16 bp, Homo sapiens
tgtcaatttctgtgtt

SEQ ID NO: 3697682 - DNA, 19 bp, Homo sapiens
tgtcagctgaacctgggta

SEQ ID NO: 3697683 - DNA, 19 bp, Homo sapiens
tgtcatagactcctttgct

SEQ ID NO: 3697684 - DNA, 21 bp, Homo sapiens
tgtcatggtcctttctggaag

SEQ ID NO: 3697685 - DNA, 16 bp, Homo sapiens
tgtcatttgttaaaat

SEQ ID NO: 3697686 - DNA, 15 bp, Homo sapiens
tgtccaaactgccta

SEQ ID NO: 3697687 - DNA, 19 bp, Homo sapiens
tgtccaaaggaggctggca

SEQ ID NO: 3697688 - DNA, 21 bp, Homo sapiens
tgtgtgattgacagctttgct

SEQ ID NO: 3697689 - DNA, 15 bp, Homo sapiens
tgtgtgtcccaggca

SEQ ID NO: 3697690 - DNA, 16 bp, Homo sapiens
tgtgtgtgacaattct

SEQ ID NO: 3697691 - DNA, 13 bp, Homo sapiens
tgtgttgccaagc

SEQ ID NO: 3697692 - DNA, 15 bp, Homo sapiens
tgtgtttggctttca

SEQ ID NO: 3697693 - DNA, 17 bp, Homo sapiens
tgtgtttggctttcagg

SEQ ID NO: 3697694 - DNA, 14 bp, Homo sapiens
tgttaaagagcact

SEQ ID NO: 3697695 - DNA, 23 bp, Homo sapiens
tgttaagcagctaaattttctga

SEQ ID NO: 3697696 - DNA, 22 bp, Homo sapiens
tgttaagttgatggtgatgaaa

SEQ ID NO: 3697697 - DNA, 15 bp, Homo sapiens
tgttaattacaccat

SEQ ID NO: 3697698 - DNA, 19 bp, Homo sapiens
tgttaattttttggtacaa

SEQ ID NO: 3697699 - DNA, 16 bp, Homo sapiens
tgttacacaatggttt

SEQ ID NO: 3697700 - DNA, 21 bp, Homo sapiens
tgttagggacatttccaagct

SEQ ID NO: 3697701 - DNA, 15 bp, Homo sapiens
tgttattatatttga

SEQ ID NO: 3697702 - DNA, 16 bp, Homo sapiens
tgttattgttttgtta

SEQ ID NO: 3697703 - DNA, 17 bp, Homo sapiens
tgttcagcactgtccct

SEQ ID NO: 3697704 - DNA, 11 bp, Homo sapiens
tgttcagctgg

SEQ ID NO: 3697705 - DNA, 20 bp, Homo sapiens
tgttcatagcccagtagacc

SEQ ID NO: 3697706 - DNA, 16 bp, Homo sapiens
tgttcccacaccccaa

SEQ ID NO: 3697707 - DNA, 21 bp, Homo sapiens
tgttcccaccaggctgctcag

SEQ ID NO: 3697708 - DNA, 14 bp, Homo sapiens
tgttcccttcctct

SEQ ID NO: 3697709 - DNA, 21 bp, Homo sapiens
tgttcccttcctctgtgccac

SEQ ID NO: 3697710 - DNA, 14 bp, Homo sapiens
tgttctgtttgtta

SEQ ID NO: 3697711 - DNA, 23 bp, Homo sapiens
tgttgagcaagcagtagcatttg

SEQ ID NO: 3697712 - DNA, 22 bp, Homo sapiens
tgttgccaaatatgtcctgggg

SEQ ID NO: 3697713 - DNA, 23 bp, Homo sapiens
tgttgccaaatatgtcctggggt

SEQ ID NO: 3697714 - DNA, 12 bp, Homo sapiens
tgttgcccttct

SEQ ID NO: 3697715 - DNA, 20 bp, Homo sapiens
tgttgcttcaaactgagaca

SEQ ID NO: 3697716 - DNA, 19 bp, Homo sapiens
tgttgggaaacttggctcg

SEQ ID NO: 3697717 - DNA, 16 bp, Homo sapiens
tgttggttgttttttc

SEQ ID NO: 3697718 - DNA, 12 bp, Homo sapiens
tgttgtttgtaa

SEQ ID NO: 3697719 - DNA, 17 bp, Homo sapiens
tgtttacatttgatgca

SEQ ID NO: 3697720 - DNA, 14 bp, Homo sapiens
tgtttagtaataca

SEQ ID NO: 3697721 - DNA, 13 bp, Homo sapiens
tgtttatggcctc

SEQ ID NO: 3697722 - DNA, 12 bp, Homo sapiens
tgtttattttct

SEQ ID NO: 3697723 - DNA, 13 bp, Homo sapiens
tgtttcacaaggt

SEQ ID NO: 3697724 - DNA, 17 bp, Homo sapiens
tgtttcattcatcctga

SEQ ID NO: 3697725 - DNA, 20 bp, Homo sapiens
tgtttccagcagaagacaaa

SEQ ID NO: 3697726 - DNA, 17 bp, Homo sapiens
tgtttcctaatatcaaa

SEQ ID NO: 3697727 - DNA, 21 bp, Homo sapiens
tgtttcctaatatcaaatgca

SEQ ID NO: 3697728 - DNA, 14 bp, Homo sapiens
tgtttcctctagtt

SEQ ID NO: 3697729 - DNA, 12 bp, Homo sapiens
tgtttgctttct

SEQ ID NO: 3697730 - DNA, 22 bp, Homo sapiens
tgtttgctttctgatcaaggcc

SEQ ID NO: 3697731 - DNA, 13 bp, Homo sapiens
tgtttggctttca

SEQ ID NO: 3697732 - DNA, 22 bp, Homo sapiens
tgtttgtaaatgcctcttaaat

SEQ ID NO: 3697733 - DNA, 15 bp, Homo sapiens
tgtttgtatgaaatt

SEQ ID NO: 3697734 - DNA, 15 bp, Homo sapiens
tgtttgtggcctcag

SEQ ID NO: 3697735 - DNA, 16 bp, Homo sapiens
tgtttgttgtcagctg

SEQ ID NO: 3697736 - DNA, 19 bp, Homo sapiens
tgttttaaagaatatgact

SEQ ID NO: 3697737 - DNA, 22 bp, Homo sapiens
tgttttaaagaatatgactttt

SEQ ID NO: 3697738 - DNA, 13 bp, Homo sapiens
tgttttacaatgt

SEQ ID NO: 3697739 - DNA, 21 bp, Homo sapiens
tgttttcctcccttctgctac

SEQ ID NO: 3697740 - DNA, 23 bp, Homo sapiens
tgttttcctcccttctgctactg

SEQ ID NO: 3697741 - DNA, 18 bp, Homo sapiens
tgttttggctgaaattct

SEQ ID NO: 3697742 - DNA, 23 bp, Homo sapiens
tgttttggctgaaattctcctgg

SEQ ID NO: 3697743 - DNA, 13 bp, Homo sapiens
tgttttttcaaaa

SEQ ID NO: 3697744 - DNA, 16 bp, Homo sapiens
tgttttttcaaaatag

SEQ ID NO: 3697745 - DNA, 21 bp, Homo sapiens
tgtttttttaaatattatgct

SEQ ID NO: 3697746 - DNA, 20 bp, Homo sapiens
ttaaaaaatattttctctgt

SEQ ID NO: 3697747 - DNA, 20 bp, Homo sapiens
ttaaaaagtttctaatatta

SEQ ID NO: 3697748 - DNA, 18 bp, Homo sapiens
ttaaaacactttcaaaac

SEQ ID NO: 3697749 - DNA, 11 bp, Homo sapiens
ttaaaagagag

SEQ ID NO: 3697750 - DNA, 21 bp, Homo sapiens
ttaaaatggatgccttgaata

SEQ ID NO: 3697751 - DNA, 17 bp, Homo sapiens
ttaaaatgtaaagccat

SEQ ID NO: 3697752 - DNA, 16 bp, Homo sapiens
ttaaaattctgagtga

SEQ ID NO: 3697753 - DNA, 22 bp, Homo sapiens
ttaaacaaatgtatgattacat

SEQ ID NO: 3697754 - DNA, 17 bp, Homo sapiens
ttaaaccgccaaggctg

SEQ ID NO: 3697755 - DNA, 22 bp, Homo sapiens
ttaaactaggagaaccaaatct

SEQ ID NO: 3697756 - DNA, 20 bp, Homo sapiens
ttaaagaatatgacttttta

SEQ ID NO: 3697757 - DNA, 14 bp, Homo sapiens
ttaaagcaaaggag

SEQ ID NO: 3697758 - DNA, 20 bp, Homo sapiens
ttaaagcttatttttctgtg

SEQ ID NO: 3697759 - DNA, 20 bp, Homo sapiens
ttaaagtgactaatggcatg

SEQ ID NO: 3697760 - DNA, 18 bp, Homo sapiens
ttaaatattttctatttt

SEQ ID NO: 3697761 - DNA, 12 bp, Homo sapiens
ttaaatgctgct

SEQ ID NO: 3697762 - DNA, 18 bp, Homo sapiens
ttaaattatatatttatt

SEQ ID NO: 3697763 - DNA, 17 bp, Homo sapiens
ttaacacaatgtgaatt

SEQ ID NO: 3697764 - DNA, 13 bp, Homo sapiens
ttaacagagtctg

SEQ ID NO: 3697765 - DNA, 18 bp, Homo sapiens
ttaacagtggagctgaat

SEQ ID NO: 3697766 - DNA, 12 bp, Homo sapiens
ttaactcaatat

SEQ ID NO: 3697767 - DNA, 17 bp, Homo sapiens
ttaactgccaatcctta

SEQ ID NO: 3697768 - DNA, 16 bp, Homo sapiens
ttaacttggtcagagc

SEQ ID NO: 3697769 - DNA, 17 bp, Homo sapiens
ttaacttggtcagagcc

SEQ ID NO: 3697770 - DNA, 18 bp, Homo sapiens
ttaacttggtcagagcca

SEQ ID NO: 3697771 - DNA, 18 bp, Homo sapiens
ttaagaactgctgtttca

SEQ ID NO: 3697772 - DNA, 14 bp, Homo sapiens
ttaagactgatttt

SEQ ID NO: 3697773 - DNA, 15 bp, Homo sapiens
ttaagattccatttt

SEQ ID NO: 3697774 - DNA, 19 bp, Homo sapiens
ttaagcaaaagaaaaagat

SEQ ID NO: 3697775 - DNA, 22 bp, Homo sapiens
ttaagcagctaaattttctgaa

SEQ ID NO: 3697776 - DNA, 17 bp, Homo sapiens
ttaagctgttactgtct

SEQ ID NO: 3697777 - DNA, 16 bp, Homo sapiens
ttaaggctaaaaagta

SEQ ID NO: 3697778 - DNA, 20 bp, Homo sapiens
ttaagtaccaatgggaagca

SEQ ID NO: 3697779 - DNA, 21 bp, Homo sapiens
ttaagtaccaatgggaagcag

SEQ ID NO: 3697780 - DNA, 22 bp, Homo sapiens
ttaagtgcatgcattgagctgc

SEQ ID NO: 3697781 - DNA, 23 bp, Homo sapiens
ttaagtgcatgcattgagctgcc

SEQ ID NO: 3697782 - DNA, 14 bp, Homo sapiens
ttaagttttcttgt

SEQ ID NO: 3697783 - DNA, 21 bp, Homo sapiens
ttaagttttcttgtttctgca

SEQ ID NO: 3697784 - DNA, 11 bp, Homo sapiens
ttaataaaaag

SEQ ID NO: 3697785 - DNA, 14 bp, Homo sapiens
ttaataaaagaaca

SEQ ID NO: 3697786 - DNA, 15 bp, Homo sapiens
ttaataaaagaacat

SEQ ID NO: 3697787 - DNA, 12 bp, Homo sapiens
ttaatacttgaa

SEQ ID NO: 3697788 - DNA, 19 bp, Homo sapiens
ttaatcattttcattccta

SEQ ID NO: 3697789 - DNA, 10 bp, Homo sapiens
ttaatgtttt

SEQ ID NO: 3697790 - DNA, 16 bp, Homo sapiens
ttaatgttttaaatgt

SEQ ID NO: 3697791 - DNA, 13 bp, Homo sapiens
ttaattacaccat

SEQ ID NO: 3697792 - DNA, 17 bp, Homo sapiens
ttaatttagtaaatgtt

SEQ ID NO: 3697793 - DNA, 18 bp, Homo sapiens
ttaatttagtaaatgtta

SEQ ID NO: 3697794 - DNA, 19 bp, Homo sapiens
ttaatttagtaaatgttat

SEQ ID NO: 3697795 - DNA, 24 bp, Homo sapiens
ttacatctatgtgtatgttgactt

SEQ ID NO: 3697796 - DNA, 15 bp, Homo sapiens
ttacatgtaatttga

SEQ ID NO: 3697797 - DNA, 16 bp, Homo sapiens
ttaccaaagtgtcttt

SEQ ID NO: 3697798 - DNA, 23 bp, Homo sapiens
ttaccaaagtgtcttttgacatt

SEQ ID NO: 3697799 - DNA, 22 bp, Homo sapiens
ttaccagaggttgtgcactgtt

SEQ ID NO: 3697800 - DNA, 23 bp, Homo sapiens
ttaccatgggtgtggatggcagt

SEQ ID NO: 3697801 - DNA, 16 bp, Homo sapiens
ttaccccttagcctcc

SEQ ID NO: 3697802 - DNA, 21 bp, Homo sapiens
ttacctgtgaccctctttgct

SEQ ID NO: 3697803 - DNA, 17 bp, Homo sapiens
ttacgtgtttaaaaaaa

SEQ ID NO: 3697804 - DNA, 14 bp, Homo sapiens
ttggtttgccttcc

SEQ ID NO: 3697805 - DNA, 12 bp, Homo sapiens
ttgtaaagtttc

SEQ ID NO: 3697806 - DNA, 13 bp, Homo sapiens
ttgtaaatgcctc

SEQ ID NO: 3697807 - DNA, 20 bp, Homo sapiens
ttgtaaattatatttgtgct

SEQ ID NO: 3697808 - DNA, 19 bp, Homo sapiens
ttgtacacaccttatattt

SEQ ID NO: 3697809 - DNA, 23 bp, Homo sapiens
ttgtaccttttttgttttttcaa

SEQ ID NO: 3697810 - DNA, 23 bp, Homo sapiens
ttgtactcagtggacagtgctgt

SEQ ID NO: 3697811 - DNA, 20 bp, Homo sapiens
ttgtatgatcctaatgaatg

SEQ ID NO: 3697812 - DNA, 20 bp, Homo sapiens
ttgtcccactcaagccaagc

SEQ ID NO: 3697813 - DNA, 17 bp, Homo sapiens
ttgtccctctgccccat

SEQ ID NO: 3697814 - DNA, 14 bp, Homo sapiens
ttgtcgctcatgtg

SEQ ID NO: 3697815 - DNA, 20 bp, Homo sapiens
ttgtcgggcaccagccagcg

SEQ ID NO: 3697816 - DNA, 15 bp, Homo sapiens
ttgtctgaacccagg

SEQ ID NO: 3697817 - DNA, 19 bp, Homo sapiens
ttgtctgaacccaggcagc

SEQ ID NO: 3697818 - DNA, 23 bp, Homo sapiens
ttgtctgaacccaggcagctggc

SEQ ID NO: 3697819 - DNA, 19 bp, Homo sapiens
ttgtctttttagatgccca

SEQ ID NO: 3697820 - DNA, 23 bp, Homo sapiens
ttgtgacttcttcttctttgttt

SEQ ID NO: 3697821 - DNA, 12 bp, Homo sapiens
ttgtgcactgtt

SEQ ID NO: 3697822 - DNA, 13 bp, Homo sapiens
ttgtgcctggggt

SEQ ID NO: 3697823 - DNA, 14 bp, Homo sapiens
ttgtgctacagatg

SEQ ID NO: 3697824 - DNA, 14 bp, Homo sapiens
ttgtgctatagtat

SEQ ID NO: 3697825 - DNA, 19 bp, Homo sapiens
ttgtgctatagtatttgat

SEQ ID NO: 3697826 - DNA, 19 bp, Homo sapiens
ttgtggccaaggagctgct

SEQ ID NO: 3697827 - DNA, 14 bp, Homo sapiens
ttgtggctgggggc

SEQ ID NO: 3697828 - DNA, 15 bp, Homo sapiens
ttgtgtcaagacatt

SEQ ID NO: 3697829 - DNA, 18 bp, Homo sapiens
ttgtgtcaagacatttct

SEQ ID NO: 3697830 - DNA, 13 bp, Homo sapiens
ttgtgtgttgtct

SEQ ID NO: 3697831 - DNA, 17 bp, Homo sapiens
ttgtgtgttgtctcttg

SEQ ID NO: 3697832 - DNA, 13 bp, Homo sapiens
ttgtgttctgtag

SEQ ID NO: 3697833 - DNA, 19 bp, Homo sapiens
ttgtgttcttcttcatatt

SEQ ID NO: 3697834 - DNA, 23 bp, Homo sapiens
ttgttattgatgttgctgttatt

SEQ ID NO: 3697835 - DNA, 15 bp, Homo sapiens
ttgttcatagcccag

SEQ ID NO: 3697836 - DNA, 12 bp, Homo sapiens
ttgttccagctc

SEQ ID NO: 3697837 - DNA, 18 bp, Homo sapiens
ttgttcttattctggcat

SEQ ID NO: 3697838 - DNA, 21 bp, Homo sapiens
ttgttgtaaaacaaaatttga

SEQ ID NO: 3697839 - DNA, 16 bp, Homo sapiens
ttgtttggctgtccag

SEQ ID NO: 3697840 - DNA, 23 bp, Homo sapiens
ttgttttgatgtttgtggcctca

SEQ ID NO: 3697841 - DNA, 16 bp, Homo sapiens
tttaaaaaatattttc

SEQ ID NO: 3697842 - DNA, 18 bp, Homo sapiens
tttaaaaacatagaaaaa

SEQ ID NO: 3697843 - DNA, 14 bp, Homo sapiens
tttaaaaatgtctt

SEQ ID NO: 3697844 - DNA, 17 bp, Homo sapiens
tttaaaaatgtcttgct

SEQ ID NO: 3697845 - DNA, 21 bp, Homo sapiens
tttaaaagagagagagagaaa

SEQ ID NO: 3697846 - DNA, 13 bp, Homo sapiens
tttaaaagatgct

SEQ ID NO: 3697847 - DNA, 20 bp, Homo sapiens
tttaaaatgtaaagccatgc

SEQ ID NO: 3697848 - DNA, 13 bp, Homo sapiens
tttaaatattttc

SEQ ID NO: 3697849 - DNA, 15 bp, Homo sapiens
tttaaatattttcta

SEQ ID NO: 3697850 - DNA, 16 bp, Homo sapiens
tttaaccttgtataaa

SEQ ID NO: 3697851 - DNA, 23 bp, Homo sapiens
tttaactggtgcactttgtaaat

SEQ ID NO: 3697852 - DNA, 17 bp, Homo sapiens
tttaagcctgcattctt

SEQ ID NO: 3697853 - DNA, 18 bp, Homo sapiens
tttaagcctgcattctta

SEQ ID NO: 3697854 - DNA, 21 bp, Homo sapiens
tttaagctgttactgtcttca

SEQ ID NO: 3697855 - DNA, 17 bp, Homo sapiens
tttaagttaatagattt

SEQ ID NO: 3697856 - DNA, 21 bp, Homo sapiens
tttaatgtttaaaacatcatt

SEQ ID NO: 3697857 - DNA, 15 bp, Homo sapiens
tttaatgttttaaat

SEQ ID NO: 3697858 - DNA, 16 bp, Homo sapiens
tttaatttagtaaatg

SEQ ID NO: 3697859 - DNA, 21 bp, Homo sapiens
tttacaccagttcctttcaat

SEQ ID NO: 3697860 - DNA, 22 bp, Homo sapiens
tttacagccagtgggagatgtt

SEQ ID NO: 3697861 - DNA, 15 bp, Homo sapiens
tttacagctgtgtta

SEQ ID NO: 3697862 - DNA, 14 bp, Homo sapiens
tttactgaaatgcg

SEQ ID NO: 3697863 - DNA, 16 bp, Homo sapiens
tttactgcagctttgt

SEQ ID NO: 3697864 - DNA, 11 bp, Homo sapiens
tttacttaaac

SEQ ID NO: 3697865 - DNA, 19 bp, Homo sapiens
tttagaccctattgctgct

SEQ ID NO: 3697866 - DNA, 16 bp, Homo sapiens
tttagtaaatgttatc

SEQ ID NO: 3697867 - DNA, 14 bp, Homo sapiens
tttagtgccaactt

SEQ ID NO: 3697868 - DNA, 17 bp, Homo sapiens
tttagtttgtactcagt

SEQ ID NO: 3697869 - DNA, 13 bp, Homo sapiens
tttagttttctct

SEQ ID NO: 3697870 - DNA, 18 bp, Homo sapiens
tttataggtgagaaaaaa

SEQ ID NO: 3697871 - DNA, 14 bp, Homo sapiens
tttatattaatgta

SEQ ID NO: 3697872 - DNA, 17 bp, Homo sapiens
tttatcacctcattctg

SEQ ID NO: 3697873 - DNA, 15 bp, Homo sapiens
tttatcagcaaaaaa

SEQ ID NO: 3697874 - DNA, 20 bp, Homo sapiens
tttatgagatgctggttttc

SEQ ID NO: 3697875 - DNA, 16 bp, Homo sapiens
tttatgcaaaaggttt

SEQ ID NO: 3697876 - DNA, 18 bp, Homo sapiens
tttatgcaaaaggtttat

SEQ ID NO: 3697877 - DNA, 20 bp, Homo sapiens
tttatgccttttatttctta

SEQ ID NO: 3697878 - DNA, 13 bp, Homo sapiens
tttatgcttgcaa

SEQ ID NO: 3697879 - DNA, 12 bp, Homo sapiens
tttatggcctca

SEQ ID NO: 3697880 - DNA, 18 bp, Homo sapiens
tttatgtgtgaggagctg

SEQ ID NO: 3697881 - DNA, 22 bp, Homo sapiens
tttatgtgtgaggagctgctgg

SEQ ID NO: 3697882 - DNA, 17 bp, Homo sapiens
tttatgttagattttgc

SEQ ID NO: 3697883 - DNA, 19 bp, Homo sapiens
tttattgtctgtctacatt

SEQ ID NO: 3697884 - DNA, 14 bp, Homo sapiens
tttcaaaaggaagg

SEQ ID NO: 3697885 - DNA, 11 bp, Homo sapiens
tttcaaaatag

SEQ ID NO: 3697886 - DNA, 20 bp, Homo sapiens
tttcaaaatagaaaagttat

SEQ ID NO: 3697887 - DNA, 21 bp, Homo sapiens
tttcaaatcattccttagata

SEQ ID NO: 3697888 - DNA, 20 bp, Homo sapiens
tttcaaatttagaaactaat

SEQ ID NO: 3697889 - DNA, 17 bp, Homo sapiens
tttcaacagtgaagaca

SEQ ID NO: 3697890 - DNA, 19 bp, Homo sapiens
tttcaacagtgaagacaga

SEQ ID NO: 3697891 - DNA, 20 bp, Homo sapiens
tttcaacagtgaagacagaa

SEQ ID NO: 3697892 - DNA, 21 bp, Homo sapiens
tttcaagtgcctagactgtta

SEQ ID NO: 3697893 - DNA, 14 bp, Homo sapiens
tttcaattgctttg

SEQ ID NO: 3697894 - DNA, 22 bp, Homo sapiens
tttcaattgctttgtgacttct

SEQ ID NO: 3697895 - DNA, 20 bp, Homo sapiens
tttcacaccggaaggttttt

SEQ ID NO: 3697896 - DNA, 23 bp, Homo sapiens
tttcacttagaacctttctgtgt

SEQ ID NO: 3697897 - DNA, 21 bp, Homo sapiens
tttcagaaagaagtggggaca

SEQ ID NO: 3697898 - DNA, 23 bp, Homo sapiens
tttcagaacctcttccccagaaa

SEQ ID NO: 3697899 - DNA, 21 bp, Homo sapiens
tttcagactcccattcctgaa

SEQ ID NO: 3697900 - DNA, 17 bp, Homo sapiens
tttcagatgtaatgttt

SEQ ID NO: 3697901 - DNA, 11 bp, Homo sapiens
tttcagatgtg

SEQ ID NO: 3697902 - DNA, 18 bp, Homo sapiens
tttcagatgtgaaccatt

SEQ ID NO: 3697903 - DNA, 18 bp, Homo sapiens
tttcagcattaagctgtt

SEQ ID NO: 3697904 - DNA, 22 bp, Homo sapiens
tttcagggaggtggctgggttt

SEQ ID NO: 3697905 - DNA, 16 bp, Homo sapiens
tttcagtactttttta

SEQ ID NO: 3697906 - DNA, 13 bp, Homo sapiens
tttcatcaagtag

SEQ ID NO: 3697907 - DNA, 13 bp, Homo sapiens
tttccaagagctg

SEQ ID NO: 3697908 - DNA, 19 bp, Homo sapiens
tttccaccacagccagcac

SEQ ID NO: 3697909 - DNA, 13 bp, Homo sapiens
tttccagggaggg

SEQ ID NO: 3697910 - DNA, 20 bp, Homo sapiens
tttccatggcaggaaggctt

SEQ ID NO: 3697911 - DNA, 18 bp, Homo sapiens
tttcccaggaccctgaag

SEQ ID NO: 3697912 - DNA, 13 bp, Homo sapiens
tttccccccactc

SEQ ID NO: 3697913 - DNA, 19 bp, Homo sapiens
tttccccccactctcccca

SEQ ID NO: 3697914 - DNA, 20 bp, Homo sapiens
tttcccttgtgtcaagacat

SEQ ID NO: 3697915 - DNA, 20 bp, Homo sapiens
tttcctagtgaggaaagcct

SEQ ID NO: 3697916 - DNA, 15 bp, Homo sapiens
tttcctatgctttga

SEQ ID NO: 3697917 - DNA, 11 bp, Homo sapiens
tttcctcagtg

SEQ ID NO: 3697918 - DNA, 11 bp, Homo sapiens
tttcctccctt

SEQ ID NO: 3697919 - DNA, 13 bp, Homo sapiens
tttcctcccttct

SEQ ID NO: 3697920 - DNA, 14 bp, Homo sapiens
tttcctcccttctg

SEQ ID NO: 3697921 - DNA, 15 bp, Homo sapiens
acatccctgccagct

SEQ ID NO: 3697922 - DNA, 22 bp, Homo sapiens
acatccgcgtgtgcctgtgtgc

SEQ ID NO: 3697923 - DNA, 14 bp, Homo sapiens
acatcctccgtcca

SEQ ID NO: 3697924 - DNA, 13 bp, Homo sapiens
acatcctcctccc

SEQ ID NO: 3697925 - DNA, 19 bp, Homo sapiens
acatcttatagatgcaaag

SEQ ID NO: 3697926 - DNA, 17 bp, Homo sapiens
acatgcagcccatgccc

SEQ ID NO: 3697927 - DNA, 16 bp, Homo sapiens
acatgcccccacttcc

SEQ ID NO: 3697928 - DNA, 16 bp, Homo sapiens
acatggcagtgtttta

SEQ ID NO: 3697929 - DNA, 20 bp, Homo sapiens
acatgtaactatttcttcag

SEQ ID NO: 3697930 - DNA, 20 bp, Homo sapiens
acatgtataatatttttaat

SEQ ID NO: 3697931 - DNA, 17 bp, Homo sapiens
acatgtccagcaccttg

SEQ ID NO: 3697932 - DNA, 20 bp, Homo sapiens
acatgtccagcaccttgtgc

SEQ ID NO: 3697933 - DNA, 16 bp, Homo sapiens
acattctgccaggccc

SEQ ID NO: 3697934 - DNA, 20 bp, Homo sapiens
acattcttggcttaatcatt

SEQ ID NO: 3697935 - DNA, 14 bp, Homo sapiens
acattgccaaaaag

SEQ ID NO: 3697936 - DNA, 12 bp, Homo sapiens
acattgcctttg

SEQ ID NO: 3697937 - DNA, 16 bp, Homo sapiens
acattgcctttgaatg

SEQ ID NO: 3697938 - DNA, 17 bp, Homo sapiens
acattgttcttattctg

SEQ ID NO: 3697939 - DNA, 12 bp, Homo sapiens
acatttaaattc

SEQ ID NO: 3697940 - DNA, 17 bp, Homo sapiens
acatttaaattccacag

SEQ ID NO: 3697941 - DNA, 14 bp, Homo sapiens
acatttactgaaat

SEQ ID NO: 3697942 - DNA, 12 bp, Homo sapiens
acatttctataa

SEQ ID NO: 3697943 - DNA, 21 bp, Homo sapiens
acatttctctaactcctgcca

SEQ ID NO: 3697944 - DNA, 22 bp, Homo sapiens
acatttctctaactcctgccat

SEQ ID NO: 3697945 - DNA, 20 bp, Homo sapiens
acatttgtgtaatatgaaat

SEQ ID NO: 3697946 - DNA, 18 bp, Homo sapiens
acatttttgtctgtccta

SEQ ID NO: 3697947 - DNA, 23 bp, Homo sapiens
accaaatctcaaaatatcctaag

SEQ ID NO: 3697948 - DNA, 16 bp, Homo sapiens
accaagaagatgtctt

SEQ ID NO: 3697949 - DNA, 16 bp, Homo sapiens
accaagcaggaagctc

SEQ ID NO: 3697950 - DNA, 17 bp, Homo sapiens
accaagcaggaagctca

SEQ ID NO: 3697951 - DNA, 23 bp, Homo sapiens
accaagccaagggaacctgtgtc

SEQ ID NO: 3697952 - DNA, 15 bp, Homo sapiens
accaatgggaagcag

SEQ ID NO: 3697953 - DNA, 15 bp, Homo sapiens
accaatgttctctct

SEQ ID NO: 3697954 - DNA, 20 bp, Homo sapiens
accacaactattttcagatg

SEQ ID NO: 3697955 - DNA, 19 bp, Homo sapiens
accacagccagcacctggc

SEQ ID NO: 3697956 - DNA, 20 bp, Homo sapiens
accacatcctccgtccagcc

SEQ ID NO: 3697957 - DNA, 21 bp, Homo sapiens
accacatcctccgtccagccg

SEQ ID NO: 3697958 - DNA, 22 bp, Homo sapiens
accacatcctccgtccagccgc

SEQ ID NO: 3697959 - DNA, 15 bp, Homo sapiens
accaccaaaaacaaa

SEQ ID NO: 3697960 - DNA, 11 bp, Homo sapiens
accacccacct

SEQ ID NO: 3697961 - DNA, 13 bp, Homo sapiens
accacccacctga

SEQ ID NO: 3697962 - DNA, 16 bp, Homo sapiens
accacccacctgacca

SEQ ID NO: 3697963 - DNA, 21 bp, Homo sapiens
accaccctagtcccttcccct

SEQ ID NO: 3697964 - DNA, 23 bp, Homo sapiens
accactaaaagatcgcagtttgc

SEQ ID NO: 3697965 - DNA, 18 bp, Homo sapiens
accactctgtggccagcc

SEQ ID NO: 3697966 - DNA, 20 bp, Homo sapiens
accactgcactccagcctgg

SEQ ID NO: 3697967 - DNA, 21 bp, Homo sapiens
accactgcactccagcctggg

SEQ ID NO: 3697968 - DNA, 13 bp, Homo sapiens
accactggaagca

SEQ ID NO: 3697969 - DNA, 16 bp, Homo sapiens
accactggtctgtagg

SEQ ID NO: 3697970 - DNA, 13 bp, Homo sapiens
accacttcagctg

SEQ ID NO: 3697971 - DNA, 13 bp, Homo sapiens
accagagccttca

SEQ ID NO: 3697972 - DNA, 16 bp, Homo sapiens
accagagccttcaagt

SEQ ID NO: 3697973 - DNA, 17 bp, Homo sapiens
accagagccttcaagtg

SEQ ID NO: 3697974 - DNA, 21 bp, Homo sapiens
accagagccttcaagtgccaa

SEQ ID NO: 3697975 - DNA, 17 bp, Homo sapiens
accagcaattctctttc

SEQ ID NO: 3697976 - DNA, 14 bp, Homo sapiens
accagcagcctgga

SEQ ID NO: 3697977 - DNA, 17 bp, Homo sapiens
accagcctggccaacat

SEQ ID NO: 3697978 - DNA, 20 bp, Homo sapiens
accagcctggccaacatggt

SEQ ID NO: 3697979 - DNA, 23 bp, Homo sapiens
accagctcaggacagatgccaca

SEQ ID NO: 3697980 - DNA, 17 bp, Homo sapiens
accaggactccctcctc

SEQ ID NO: 3697981 - DNA, 21 bp, Homo sapiens
accaggactccctcctcacct

SEQ ID NO: 3697982 - DNA, 14 bp, Homo sapiens
accaggagaaccac

SEQ ID NO: 3697983 - DNA, 16 bp, Homo sapiens
accaggcacctcttcc

SEQ ID NO: 3697984 - DNA, 17 bp, Homo sapiens
accaggcacctcttcct

SEQ ID NO: 3697985 - DNA, 17 bp, Homo sapiens
accaggccacctcccca

SEQ ID NO: 3697986 - DNA, 16 bp, Homo sapiens
accagggcaaggcccc

SEQ ID NO: 3697987 - DNA, 20 bp, Homo sapiens
accagggcaaggccccttcc

SEQ ID NO: 3697988 - DNA, 16 bp, Homo sapiens
accagggccttttctg

SEQ ID NO: 3697989 - DNA, 21 bp, Homo sapiens
accagggccttttctggcacc

SEQ ID NO: 3697990 - DNA, 13 bp, Homo sapiens
accaggggcccta

SEQ ID NO: 3697991 - DNA, 18 bp, Homo sapiens
accaggggccctacctgg

SEQ ID NO: 3697992 - DNA, 13 bp, Homo sapiens
accaggtgccttt

SEQ ID NO: 3697993 - DNA, 12 bp, Homo sapiens
accatcatccta

SEQ ID NO: 3697994 - DNA, 13 bp, Homo sapiens
accatcctggctg

SEQ ID NO: 3697995 - DNA, 19 bp, Homo sapiens
accatgcctcactaatttt

SEQ ID NO: 3697996 - DNA, 20 bp, Homo sapiens
accatgctcatctgctggtc

SEQ ID NO: 3697997 - DNA, 21 bp, Homo sapiens
accatgggtgtggatggcagt

SEQ ID NO: 3697998 - DNA, 18 bp, Homo sapiens
accattatgaagaagaga

SEQ ID NO: 3697999 - DNA, 22 bp, Homo sapiens
accatttttaaagtagaagagg

SEQ ID NO: 3698000 - DNA, 16 bp, Homo sapiens
acccaaagctgagcct

SEQ ID NO: 3698001 - DNA, 21 bp, Homo sapiens
acccagatggaaaaataacaa

SEQ ID NO: 3698002 - DNA, 19 bp, Homo sapiens
acccaggagggagggggct

SEQ ID NO: 3698003 - DNA, 17 bp, Homo sapiens
acccaggcagctggcag

SEQ ID NO: 3698004 - DNA, 9 bp, Homo sapiens
acccagtgc

SEQ ID NO: 3698005 - DNA, 22 bp, Homo sapiens
acccagtgcccccactgaccag

SEQ ID NO: 3698006 - DNA, 13 bp, Homo sapiens
acccatctgcacc

SEQ ID NO: 3698007 - DNA, 10 bp, Homo sapiens
acccatctgt

SEQ ID NO: 3698008 - DNA, 20 bp, Homo sapiens
acccatctgtagtaatttat

SEQ ID NO: 3698009 - DNA, 22 bp, Homo sapiens
acccatgcaagcagaggaccag

SEQ ID NO: 3698010 - DNA, 17 bp, Homo sapiens
accccaaagctttcctg

SEQ ID NO: 3698011 - DNA, 15 bp, Homo sapiens
accccaacaaaccat

SEQ ID NO: 3698012 - DNA, 11 bp, Homo sapiens
accccacactt

SEQ ID NO: 3698013 - DNA, 24 bp, Homo sapiens
accccagattcttcagcttgatcc

SEQ ID NO: 3698014 - DNA, 16 bp, Homo sapiens
accccagcccagacag

SEQ ID NO: 3698015 - DNA, 16 bp, Homo sapiens
accccatgccaaagct

SEQ ID NO: 3698016 - DNA, 20 bp, Homo sapiens
acccccatggccccaggccc

SEQ ID NO: 3698017 - DNA, 17 bp, Homo sapiens
accccctgtaaggttcc

SEQ ID NO: 3698018 - DNA, 14 bp, Homo sapiens
acccccttctctgc

SEQ ID NO: 3698019 - DNA, 17 bp, Homo sapiens
acccccttctctgctcc

SEQ ID NO: 3698020 - DNA, 19 bp, Homo sapiens
acccccttctctgctccac

SEQ ID NO: 3698021 - DNA, 23 bp, Homo sapiens
acccccttctctgctccaccaca

SEQ ID NO: 3698022 - DNA, 16 bp, Homo sapiens
accccgggctctctgc

SEQ ID NO: 3698023 - DNA, 15 bp, Homo sapiens
acccctgggggctct

SEQ ID NO: 3698024 - DNA, 17 bp, Homo sapiens
acccctgggggctctca

SEQ ID NO: 3698025 - DNA, 15 bp, Homo sapiens
accccttagcctccc

SEQ ID NO: 3698026 - DNA, 20 bp, Homo sapiens
accccttcctcagcctgggg

SEQ ID NO: 3698027 - DNA, 16 bp, Homo sapiens
acccgacagagggaag

SEQ ID NO: 3698028 - DNA, 14 bp, Homo sapiens
acccgaggcccgca

SEQ ID NO: 3698029 - DNA, 14 bp, Homo sapiens
acccggaggccgag

SEQ ID NO: 3698030 - DNA, 21 bp, Homo sapiens
acccggcggtcccctccgcca

SEQ ID NO: 3698031 - DNA, 16 bp, Homo sapiens
acccgtgcccctggga

SEQ ID NO: 3698032 - DNA, 21 bp, Homo sapiens
accctacttcattttcagagt

SEQ ID NO: 3698033 - DNA, 16 bp, Homo sapiens
accctcaggcaggtgg

SEQ ID NO: 3698034 - DNA, 16 bp, Homo sapiens
accctccagtgctgga

SEQ ID NO: 3698035 - DNA, 19 bp, Homo sapiens
accctccagtgctggattt

SEQ ID NO: 3698036 - DNA, 20 bp, Homo sapiens
accctcccacccccttctct

SEQ ID NO: 3698037 - DNA, 23 bp, Homo sapiens
accctcccacccccttctctgct

SEQ ID NO: 3698038 - DNA, 19 bp, Homo sapiens
actaagccccgtctgaccc

SEQ ID NO: 3698039 - DNA, 23 bp, Homo sapiens
actaagccccgtctgaccccagc

SEQ ID NO: 3698040 - DNA, 12 bp, Homo sapiens
actaaggggccc

SEQ ID NO: 3698041 - DNA, 17 bp, Homo sapiens
actaattatactacttt

SEQ ID NO: 3698042 - DNA, 21 bp, Homo sapiens
actaattttacatgtttataa

SEQ ID NO: 3698043 - DNA, 18 bp, Homo sapiens
actaatttttgtattatt

SEQ ID NO: 3698044 - DNA, 19 bp, Homo sapiens
actaatttttgtattattt

SEQ ID NO: 3698045 - DNA, 16 bp, Homo sapiens
actacaaccaatggaa

SEQ ID NO: 3698046 - DNA, 20 bp, Homo sapiens
actacatgcagcccatgccc

SEQ ID NO: 3698047 - DNA, 23 bp, Homo sapiens
actactgacatgtggggccaggt

SEQ ID NO: 3698048 - DNA, 19 bp, Homo sapiens
actactttgttaggatttt

SEQ ID NO: 3698049 - DNA, 14 bp, Homo sapiens
actagaagggccag

SEQ ID NO: 3698050 - DNA, 12 bp, Homo sapiens
actagacaagcc

SEQ ID NO: 3698051 - DNA, 15 bp, Homo sapiens
actagacaagccaga

SEQ ID NO: 3698052 - DNA, 21 bp, Homo sapiens
actagacaagccagaacttga

SEQ ID NO: 3698053 - DNA, 21 bp, Homo sapiens
actagagtctgaacagctgta

SEQ ID NO: 3698054 - DNA, 18 bp, Homo sapiens
actaggagaaccaaatct

SEQ ID NO: 3698055 - DNA, 22 bp, Homo sapiens
actaggcccccacttgcctctt

SEQ ID NO: 3698056 - DNA, 14 bp, Homo sapiens
actagggagccatg

SEQ ID NO: 3698057 - DNA, 22 bp, Homo sapiens
actagggagccatgtttcacaa

SEQ ID NO: 3698058 - DNA, 19 bp, Homo sapiens
actaggtaggcttctacct

SEQ ID NO: 3698059 - DNA, 20 bp, Homo sapiens
actaggtaggcttctacctg

SEQ ID NO: 3698060 - DNA, 13 bp, Homo sapiens
actagtgttctgt

SEQ ID NO: 3698061 - DNA, 14 bp, Homo sapiens
actataagaacttt

SEQ ID NO: 3698062 - DNA, 15 bp, Homo sapiens
actatattgtacaca

SEQ ID NO: 3698063 - DNA, 23 bp, Homo sapiens
actatatttgggcctgctccaga

SEQ ID NO: 3698064 - DNA, 17 bp, Homo sapiens
actatctgtctggtggc

SEQ ID NO: 3698065 - DNA, 23 bp, Homo sapiens
actatgcatggtgccccaggacc

SEQ ID NO: 3698066 - DNA, 22 bp, Homo sapiens
actattaaaaaggtttacagaa

SEQ ID NO: 3698067 - DNA, 12 bp, Homo sapiens
actatttcttca

SEQ ID NO: 3698068 - DNA, 16 bp, Homo sapiens
actatttcttcagagt

SEQ ID NO: 3698069 - DNA, 22 bp, Homo sapiens
actattttcagatgtgaaccat

SEQ ID NO: 3698070 - DNA, 13 bp, Homo sapiens
actcaaaagctgg

SEQ ID NO: 3698071 - DNA, 18 bp, Homo sapiens
actcaaaagctgggcagg

SEQ ID NO: 3698072 - DNA, 20 bp, Homo sapiens
actcaaatggggccagatcc

SEQ ID NO: 3698073 - DNA, 22 bp, Homo sapiens
actcaaatggggccagatccag

SEQ ID NO: 3698074 - DNA, 16 bp, Homo sapiens
actcaagccaagcagc

SEQ ID NO: 3698075 - DNA, 19 bp, Homo sapiens
actcaagccaagcagccaa

SEQ ID NO: 3698076 - DNA, 22 bp, Homo sapiens
actcaatattttccatgaaaat

SEQ ID NO: 3698077 - DNA, 17 bp, Homo sapiens
actcactaggcccccac

SEQ ID NO: 3698078 - DNA, 21 bp, Homo sapiens
actcactaggcccccacttgc

SEQ ID NO: 3698079 - DNA, 22 bp, Homo sapiens
actcactaggcccccacttgcc

SEQ ID NO: 3698080 - DNA, 21 bp, Homo sapiens
actcagatggaaccgcaggaa

SEQ ID NO: 3698081 - DNA, 23 bp, Homo sapiens
actcagatggaaccgcaggaagc

SEQ ID NO: 3698082 - DNA, 22 bp, Homo sapiens
actcagcatttgattaacattt

SEQ ID NO: 3698083 - DNA, 23 bp, Homo sapiens
actcagcatttgattaacatttg

SEQ ID NO: 3698084 - DNA, 14 bp, Homo sapiens
actcagccctgagg

SEQ ID NO: 3698085 - DNA, 17 bp, Homo sapiens
actcagctttagttttt

SEQ ID NO: 3698086 - DNA, 21 bp, Homo sapiens
actcatccgcctggcccggga

SEQ ID NO: 3698087 - DNA, 12 bp, Homo sapiens
actcatcttagg

SEQ ID NO: 3698088 - DNA, 18 bp, Homo sapiens
actccaggccctcctctc

SEQ ID NO: 3698089 - DNA, 12 bp, Homo sapiens
actccattgtcg

SEQ ID NO: 3698090 - DNA, 13 bp, Homo sapiens
actccctcctcac

SEQ ID NO: 3698091 - DNA, 15 bp, Homo sapiens
actccctcctcacct

SEQ ID NO: 3698092 - DNA, 16 bp, Homo sapiens
actccctcctcacctc

SEQ ID NO: 3698093 - DNA, 20 bp, Homo sapiens
actccctcctcacctctgga

SEQ ID NO: 3698094 - DNA, 23 bp, Homo sapiens
actccgagaggtgggccagtctg

SEQ ID NO: 3698095 - DNA, 15 bp, Homo sapiens
actccgttggccact

SEQ ID NO: 3698096 - DNA, 13 bp, Homo sapiens
actcctccctggg

SEQ ID NO: 3698097 - DNA, 14 bp, Homo sapiens
actcctccctgggg

SEQ ID NO: 3698098 - DNA, 14 bp, Homo sapiens
actcctgccaggga

SEQ ID NO: 3698099 - DNA, 19 bp, Homo sapiens
actcctgccattcttctgg

SEQ ID NO: 3698100 - DNA, 21 bp, Homo sapiens
actcctgccattcttctggtg

SEQ ID NO: 3698101 - DNA, 15 bp, Homo sapiens
actcgctgtatgaaa

SEQ ID NO: 3698102 - DNA, 14 bp, Homo sapiens
actcggtttctcca

SEQ ID NO: 3698103 - DNA, 19 bp, Homo sapiens
actcgtatagcatgcatct

SEQ ID NO: 3698104 - DNA, 15 bp, Homo sapiens
actcgtggctgtcaa

SEQ ID NO: 3698105 - DNA, 21 bp, Homo sapiens
actctacatgtaactatttct

SEQ ID NO: 3698106 - DNA, 21 bp, Homo sapiens
actctacttaatccaatgggt

SEQ ID NO: 3698107 - DNA, 17 bp, Homo sapiens
actctagggaaaaacca

SEQ ID NO: 3698108 - DNA, 20 bp, Homo sapiens
actctatagtaggcatgtta

SEQ ID NO: 3698109 - DNA, 12 bp, Homo sapiens
actctgcttctc

SEQ ID NO: 3698110 - DNA, 17 bp, Homo sapiens
actctgcttctctgact

SEQ ID NO: 3698111 - DNA, 21 bp, Homo sapiens
actctgcttctctgacttctg

SEQ ID NO: 3698112 - DNA, 12 bp, Homo sapiens
actctgtggcca

SEQ ID NO: 3698113 - DNA, 15 bp, Homo sapiens
actctgtggccagcc

SEQ ID NO: 3698114 - DNA, 17 bp, Homo sapiens
actctgtggccagcctg

SEQ ID NO: 3698115 - DNA, 19 bp, Homo sapiens
actctgtggccagcctggc

SEQ ID NO: 3698116 - DNA, 11 bp, Homo sapiens
actcttaaaac

SEQ ID NO: 3698117 - DNA, 18 bp, Homo sapiens
actcttaaaacccaagtg

SEQ ID NO: 3698118 - DNA, 15 bp, Homo sapiens
actcttcaaatgcct

SEQ ID NO: 3698119 - DNA, 13 bp, Homo sapiens
actcttccctggg

SEQ ID NO: 3698120 - DNA, 20 bp, Homo sapiens
actcttggatgggacatttt

SEQ ID NO: 3698121 - DNA, 17 bp, Homo sapiens
actgaaatctgtcaaga

SEQ ID NO: 3698122 - DNA, 13 bp, Homo sapiens
actgaagcagcct

SEQ ID NO: 3698123 - DNA, 12 bp, Homo sapiens
actgacatgtgg

SEQ ID NO: 3698124 - DNA, 18 bp, Homo sapiens
actgacatgtggggccag

SEQ ID NO: 3698125 - DNA, 14 bp, Homo sapiens
actgaccagaacta

SEQ ID NO: 3698126 - DNA, 19 bp, Homo sapiens
actgactagagtgatgact

SEQ ID NO: 3698127 - DNA, 13 bp, Homo sapiens
actgagacagatg

SEQ ID NO: 3698128 - DNA, 13 bp, Homo sapiens
actgagctggctg

SEQ ID NO: 3698129 - DNA, 21 bp, Homo sapiens
actgagggaccaactgggccc

SEQ ID NO: 3698130 - DNA, 20 bp, Homo sapiens
actgagtagctctcctgact

SEQ ID NO: 3698131 - DNA, 17 bp, Homo sapiens
actgattacctgccaat

SEQ ID NO: 3698132 - DNA, 20 bp, Homo sapiens
actgcacccacccaagacaa

SEQ ID NO: 3698133 - DNA, 18 bp, Homo sapiens
actgcactccagcctggg

SEQ ID NO: 3698134 - DNA, 19 bp, Homo sapiens
actgcactccagcctgggt

SEQ ID NO: 3698135 - DNA, 19 bp, Homo sapiens
actgcaggccctggcctcc

SEQ ID NO: 3698136 - DNA, 23 bp, Homo sapiens
actgccaatatagaaaaataaaa

SEQ ID NO: 3698137 - DNA, 20 bp, Homo sapiens
actgccaggacccaccactg

SEQ ID NO: 3698138 - DNA, 21 bp, Homo sapiens
actgccatgtactagttttag

SEQ ID NO: 3698139 - DNA, 17 bp, Homo sapiens
actgccctgtttctgtt

SEQ ID NO: 3698140 - DNA, 18 bp, Homo sapiens
actgccgtcagtgctgtg

SEQ ID NO: 3698141 - DNA, 15 bp, Homo sapiens
actgcgactttctgc

SEQ ID NO: 3698142 - DNA, 15 bp, Homo sapiens
actgctacctctgag

SEQ ID NO: 3698143 - DNA, 19 bp, Homo sapiens
actgctacctttcaaagct

SEQ ID NO: 3698144 - DNA, 19 bp, Homo sapiens
actgctgagatacatacag

SEQ ID NO: 3698145 - DNA, 13 bp, Homo sapiens
actggacagcctc

SEQ ID NO: 3698146 - DNA, 22 bp, Homo sapiens
actggacagcctcttctgtccc

SEQ ID NO: 3698147 - DNA, 24 bp, Homo sapiens
actggacagcctcttctgtcccaa

SEQ ID NO: 3698148 - DNA, 18 bp, Homo sapiens
actggcctgctgcgcccc

SEQ ID NO: 3698149 - DNA, 15 bp, Homo sapiens
actggtctgtaggga

SEQ ID NO: 3698150 - DNA, 22 bp, Homo sapiens
actggtgcactttgtaaattcc

SEQ ID NO: 3698151 - DNA, 11 bp, Homo sapiens
actgtaaatca

SEQ ID NO: 3698152 - DNA, 16 bp, Homo sapiens
actgtaactgattaca

SEQ ID NO: 3698153 - DNA, 16 bp, Homo sapiens
actgtaataaagatga

SEQ ID NO: 3698154 - DNA, 15 bp, Homo sapiens
agaatggggtgcatg

SEQ ID NO: 3698155 - DNA, 21 bp, Homo sapiens
agaattgatcattttcccccc

SEQ ID NO: 3698156 - DNA, 14 bp, Homo sapiens
agaattttatttat

SEQ ID NO: 3698157 - DNA, 18 bp, Homo sapiens
agacaaatctcagaacct

SEQ ID NO: 3698158 - DNA, 17 bp, Homo sapiens
agacaagccagaacttg

SEQ ID NO: 3698159 - DNA, 14 bp, Homo sapiens
agacaagtgatttt

SEQ ID NO: 3698160 - DNA, 13 bp, Homo sapiens
agacaatttgcac

SEQ ID NO: 3698161 - DNA, 14 bp, Homo sapiens
agacacatatgagg

SEQ ID NO: 3698162 - DNA, 16 bp, Homo sapiens
agacacatatgagggg

SEQ ID NO: 3698163 - DNA, 13 bp, Homo sapiens
agacacccaggac

SEQ ID NO: 3698164 - DNA, 16 bp, Homo sapiens
agacacccaggactta

SEQ ID NO: 3698165 - DNA, 13 bp, Homo sapiens
agacacttgctga

SEQ ID NO: 3698166 - DNA, 19 bp, Homo sapiens
agacagagaaaacttgcct

SEQ ID NO: 3698167 - DNA, 15 bp, Homo sapiens
agacagagaggactg

SEQ ID NO: 3698168 - DNA, 15 bp, Homo sapiens
agacagatgccccag

SEQ ID NO: 3698169 - DNA, 19 bp, Homo sapiens
agacagatgccccagagct

SEQ ID NO: 3698170 - DNA, 11 bp, Homo sapiens
agacagcaagg

SEQ ID NO: 3698171 - DNA, 19 bp, Homo sapiens
agacagcaaggtgtggagg

SEQ ID NO: 3698172 - DNA, 19 bp, Homo sapiens
agacatacttgaagggcca

SEQ ID NO: 3698173 - DNA, 21 bp, Homo sapiens
agacatacttgaagggccaga

SEQ ID NO: 3698174 - DNA, 16 bp, Homo sapiens
agacatatttaactgg

SEQ ID NO: 3698175 - DNA, 19 bp, Homo sapiens
agaccaagcttagtcctgg

SEQ ID NO: 3698176 - DNA, 20 bp, Homo sapiens
agaccaagcttagtcctggg

SEQ ID NO: 3698177 - DNA, 23 bp, Homo sapiens
agaccaagcttagtcctgggaga

SEQ ID NO: 3698178 - DNA, 19 bp, Homo sapiens
agaccacgcccgtcctgcc

SEQ ID NO: 3698179 - DNA, 24 bp, Homo sapiens
agaccacgcccgtcctgcctgtgg

SEQ ID NO: 3698180 - DNA, 13 bp, Homo sapiens
agaccagcctggc

SEQ ID NO: 3698181 - DNA, 15 bp, Homo sapiens
agaccagcctggcca

SEQ ID NO: 3698182 - DNA, 22 bp, Homo sapiens
agaccagcctggccaacatggc

SEQ ID NO: 3698183 - DNA, 16 bp, Homo sapiens
agaccaggctgtgtcc

SEQ ID NO: 3698184 - DNA, 13 bp, Homo sapiens
agacccccacacc

SEQ ID NO: 3698185 - DNA, 15 bp, Homo sapiens
agacccccacacctc

SEQ ID NO: 3698186 - DNA, 14 bp, Homo sapiens
agacctgatcctgg

SEQ ID NO: 3698187 - DNA, 19 bp, Homo sapiens
agacctgatcctggaggcc

SEQ ID NO: 3698188 - DNA, 11 bp, Homo sapiens
agacctggcag

SEQ ID NO: 3698189 - DNA, 16 bp, Homo sapiens
agacggtgttttgcca

SEQ ID NO: 3698190 - DNA, 21 bp, Homo sapiens
agacggtgttttgccatgttg

SEQ ID NO: 3698191 - DNA, 18 bp, Homo sapiens
agactaacaaaggcagct

SEQ ID NO: 3698192 - DNA, 14 bp, Homo sapiens
agactactaagagg

SEQ ID NO: 3698193 - DNA, 16 bp, Homo sapiens
agactcagtgcagatg

SEQ ID NO: 3698194 - DNA, 16 bp, Homo sapiens
agactctttggacact

SEQ ID NO: 3698195 - DNA, 20 bp, Homo sapiens
agactgatctcgatgcaggt

SEQ ID NO: 3698196 - DNA, 21 bp, Homo sapiens
agactgcagaggggaaagact

SEQ ID NO: 3698197 - DNA, 14 bp, Homo sapiens
agactgtgccatgg

SEQ ID NO: 3698198 - DNA, 15 bp, Homo sapiens
agactgtgccatggt

SEQ ID NO: 3698199 - DNA, 21 bp, Homo sapiens
agactgtgccatggtgagaaa

SEQ ID NO: 3698200 - DNA, 23 bp, Homo sapiens
agactgtttttcagggaggtggc

SEQ ID NO: 3698201 - DNA, 18 bp, Homo sapiens
agactttgtttttaaaat

SEQ ID NO: 3698202 - DNA, 19 bp, Homo sapiens
agactttttttaaatagta

SEQ ID NO: 3698203 - DNA, 18 bp, Homo sapiens
agagaaaaaaaaaatagt

SEQ ID NO: 3698204 - DNA, 22 bp, Homo sapiens
agagaaaaaatattttcctgcc

SEQ ID NO: 3698205 - DNA, 14 bp, Homo sapiens
agagaaaatatatg

SEQ ID NO: 3698206 - DNA, 23 bp, Homo sapiens
agagaaaatatatgtatttttat

SEQ ID NO: 3698207 - DNA, 19 bp, Homo sapiens
agagaaaggggagcccact

SEQ ID NO: 3698208 - DNA, 21 bp, Homo sapiens
agagaaaggggagcccactgt

SEQ ID NO: 3698209 - DNA, 19 bp, Homo sapiens
agagaaatcaggcctgatg

SEQ ID NO: 3698210 - DNA, 22 bp, Homo sapiens
agagacatacttgaagggccag

SEQ ID NO: 3698211 - DNA, 21 bp, Homo sapiens
agagacccccggaacaagcct

SEQ ID NO: 3698212 - DNA, 15 bp, Homo sapiens
agagacggtgttttg

SEQ ID NO: 3698213 - DNA, 16 bp, Homo sapiens
agagactccagctggg

SEQ ID NO: 3698214 - DNA, 12 bp, Homo sapiens
agagagagaaaa

SEQ ID NO: 3698215 - DNA, 14 bp, Homo sapiens
agagagagagaaaa

SEQ ID NO: 3698216 - DNA, 15 bp, Homo sapiens
agagagagagagaaa

SEQ ID NO: 3698217 - DNA, 18 bp, Homo sapiens
agagagctgccatcgctg

SEQ ID NO: 3698218 - DNA, 17 bp, Homo sapiens
agagaggtccagccccc

SEQ ID NO: 3698219 - DNA, 16 bp, Homo sapiens
agagattgtggtttca

SEQ ID NO: 3698220 - DNA, 15 bp, Homo sapiens
agagcactgccacca

SEQ ID NO: 3698221 - DNA, 12 bp, Homo sapiens
agagcagcctgt

SEQ ID NO: 3698222 - DNA, 19 bp, Homo sapiens
agagcagcctgtggcatct

SEQ ID NO: 3698223 - DNA, 11 bp, Homo sapiens
agagcaggaaa

SEQ ID NO: 3698224 - DNA, 24 bp, Homo sapiens
agagcagggattaacctctgcact

SEQ ID NO: 3698225 - DNA, 12 bp, Homo sapiens
agagcccagctc

SEQ ID NO: 3698226 - DNA, 15 bp, Homo sapiens
agagcctgctgcatg

SEQ ID NO: 3698227 - DNA, 11 bp, Homo sapiens
agagccttgcg

SEQ ID NO: 3698228 - DNA, 21 bp, Homo sapiens
agagcgcctgcccctcccaga

SEQ ID NO: 3698229 - DNA, 20 bp, Homo sapiens
agagctagcagcagggaggg

SEQ ID NO: 3698230 - DNA, 16 bp, Homo sapiens
agagctgccatcgctg

SEQ ID NO: 3698231 - DNA, 13 bp, Homo sapiens
agagctggctctg

SEQ ID NO: 3698232 - DNA, 15 bp, Homo sapiens
agagctggctctgag

SEQ ID NO: 3698233 - DNA, 16 bp, Homo sapiens
agagctggctctgagc

SEQ ID NO: 3698234 - DNA, 13 bp, Homo sapiens
agagctgtacatt

SEQ ID NO: 3698235 - DNA, 16 bp, Homo sapiens
agaggacagtctggag

SEQ ID NO: 3698236 - DNA, 19 bp, Homo sapiens
agaggacagtctggagaag

SEQ ID NO: 3698237 - DNA, 13 bp, Homo sapiens
agaggagaggggc

SEQ ID NO: 3698238 - DNA, 18 bp, Homo sapiens
agaggaggggccgctgcc

SEQ ID NO: 3698239 - DNA, 18 bp, Homo sapiens
agaggcaactgcattggc

SEQ ID NO: 3698240 - DNA, 21 bp, Homo sapiens
agaggccagccccacccagga

SEQ ID NO: 3698241 - DNA, 23 bp, Homo sapiens
agaggccagccccacccaggagg

SEQ ID NO: 3698242 - DNA, 13 bp, Homo sapiens
agaggccccagcc

SEQ ID NO: 3698243 - DNA, 16 bp, Homo sapiens
agaggccccagcctcc

SEQ ID NO: 3698244 - DNA, 23 bp, Homo sapiens
agaggccccagcctccctgaagc

SEQ ID NO: 3698245 - DNA, 18 bp, Homo sapiens
agaggccctctggagtgg

SEQ ID NO: 3698246 - DNA, 24 bp, Homo sapiens
agaggccctctggagtggccacta

SEQ ID NO: 3698247 - DNA, 14 bp, Homo sapiens
agaggccttgctgt

SEQ ID NO: 3698248 - DNA, 14 bp, Homo sapiens
agaggctgaggcct

SEQ ID NO: 3698249 - DNA, 13 bp, Homo sapiens
agaggctgcattg

SEQ ID NO: 3698250 - DNA, 23 bp, Homo sapiens
agagggaagaaaagagctttctt

SEQ ID NO: 3698251 - DNA, 12 bp, Homo sapiens
agagggacagat

SEQ ID NO: 3698252 - DNA, 16 bp, Homo sapiens
agagggaggcaagccc

SEQ ID NO: 3698253 - DNA, 13 bp, Homo sapiens
agagggaggggcc

SEQ ID NO: 3698254 - DNA, 14 bp, Homo sapiens
agagggaggggcct

SEQ ID NO: 3698255 - DNA, 23 bp, Homo sapiens
agagggttttaggtagaaaaaca

SEQ ID NO: 3698256 - DNA, 14 bp, Homo sapiens
agagtcctcactcc

SEQ ID NO: 3698257 - DNA, 22 bp, Homo sapiens
agagtcggaacggagaaaggtg

SEQ ID NO: 3698258 - DNA, 21 bp, Homo sapiens
agagtctaatagtctttgcca

SEQ ID NO: 3698259 - DNA, 16 bp, Homo sapiens
agagtctgaacctatt

SEQ ID NO: 3698260 - DNA, 14 bp, Homo sapiens
agagtgatgactgc

SEQ ID NO: 3698261 - DNA, 14 bp, Homo sapiens
agagtgccactgcg

SEQ ID NO: 3698262 - DNA, 18 bp, Homo sapiens
agagtgccactgcgggag

SEQ ID NO: 3698263 - DNA, 19 bp, Homo sapiens
agagtggcctggccaggag

SEQ ID NO: 3698264 - DNA, 20 bp, Homo sapiens
agagtgtcttcacggcagga

SEQ ID NO: 3698265 - DNA, 17 bp, Homo sapiens
agagtgtggcaaaataa

SEQ ID NO: 3698266 - DNA, 17 bp, Homo sapiens
agagtgtggccttcgga

SEQ ID NO: 3698267 - DNA, 23 bp, Homo sapiens
agagttttatagcctggactgct

SEQ ID NO: 3698268 - DNA, 19 bp, Homo sapiens
agataactttgactttctt

SEQ ID NO: 3698269 - DNA, 18 bp, Homo sapiens
agataaggtaaaatgcca

SEQ ID NO: 3698270 - DNA, 18 bp, Homo sapiens
agataatattaaggaaga

SEQ ID NO: 3698271 - DNA, 16 bp, Homo sapiens
agccaagggaacctgt

SEQ ID NO: 3698272 - DNA, 20 bp, Homo sapiens
agccaagggaacctgtgtcc

SEQ ID NO: 3698273 - DNA, 16 bp, Homo sapiens
agccaaggggcttcag

SEQ ID NO: 3698274 - DNA, 23 bp, Homo sapiens
agccaatggcccggcccctcctg

SEQ ID NO: 3698275 - DNA, 13 bp, Homo sapiens
agccacaccagga

SEQ ID NO: 3698276 - DNA, 14 bp, Homo sapiens
agccacaccaggat

SEQ ID NO: 3698277 - DNA, 17 bp, Homo sapiens
agccacaccaggataga

SEQ ID NO: 3698278 - DNA, 13 bp, Homo sapiens
agccacagctggt

SEQ ID NO: 3698279 - DNA, 19 bp, Homo sapiens
agccaccccgggctctctg

SEQ ID NO: 3698280 - DNA, 21 bp, Homo sapiens
agccaccccgggctctctgct

SEQ ID NO: 3698281 - DNA, 14 bp, Homo sapiens
agccacctcatccc

SEQ ID NO: 3698282 - DNA, 20 bp, Homo sapiens
agccagaagctgagcaccag

SEQ ID NO: 3698283 - DNA, 13 bp, Homo sapiens
agccagcttagca

SEQ ID NO: 3698284 - DNA, 17 bp, Homo sapiens
agccaggaatttcccag

SEQ ID NO: 3698285 - DNA, 21 bp, Homo sapiens
agccaggaatttcccaggacc

SEQ ID NO: 3698286 - DNA, 21 bp, Homo sapiens
agccaggctgccaaggccaga

SEQ ID NO: 3698287 - DNA, 17 bp, Homo sapiens
agccagtgacctgagga

SEQ ID NO: 3698288 - DNA, 18 bp, Homo sapiens
agccagtgacctgaggaa

SEQ ID NO: 3698289 - DNA, 23 bp, Homo sapiens
agccatgcgccccctccgccctg

SEQ ID NO: 3698290 - DNA, 20 bp, Homo sapiens
agccatgtactcaagtacca

SEQ ID NO: 3698291 - DNA, 14 bp, Homo sapiens
agccatgtctgcat

SEQ ID NO: 3698292 - DNA, 22 bp, Homo sapiens
agcccaagggatctggtcctac

SEQ ID NO: 3698293 - DNA, 15 bp, Homo sapiens
agcccaccagccacc

SEQ ID NO: 3698294 - DNA, 19 bp, Homo sapiens
agcccaccagccacctcat

SEQ ID NO: 3698295 - DNA, 18 bp, Homo sapiens
agcccactgtcctgggcc

SEQ ID NO: 3698296 - DNA, 22 bp, Homo sapiens
agcccactgtcctgggcctgca

SEQ ID NO: 3698297 - DNA, 10 bp, Homo sapiens
agcccagaga

SEQ ID NO: 3698298 - DNA, 22 bp, Homo sapiens
agcccagagacatacttgaagg

SEQ ID NO: 3698299 - DNA, 12 bp, Homo sapiens
agcccagctcca

SEQ ID NO: 3698300 - DNA, 21 bp, Homo sapiens
agcccagggagcggaaagcag

SEQ ID NO: 3698301 - DNA, 14 bp, Homo sapiens
agcccagggctcct

SEQ ID NO: 3698302 - DNA, 23 bp, Homo sapiens
agcccagggctcctgcacttact

SEQ ID NO: 3698303 - DNA, 11 bp, Homo sapiens
agcccatgccc

SEQ ID NO: 3698304 - DNA, 20 bp, Homo sapiens
agcccatgcccacctgccca

SEQ ID NO: 3698305 - DNA, 17 bp, Homo sapiens
agccccacatgtccagc

SEQ ID NO: 3698306 - DNA, 18 bp, Homo sapiens
agccccagggtcttccct

SEQ ID NO: 3698307 - DNA, 23 bp, Homo sapiens
agccccagggtcttccctacctc

SEQ ID NO: 3698308 - DNA, 20 bp, Homo sapiens
agcccccagctaagaacctg

SEQ ID NO: 3698309 - DNA, 22 bp, Homo sapiens
agcccccagctaagaacctgga

SEQ ID NO: 3698310 - DNA, 18 bp, Homo sapiens
agccccccaggctgccca

SEQ ID NO: 3698311 - DNA, 15 bp, Homo sapiens
agccccgtctgaccc

SEQ ID NO: 3698312 - DNA, 16 bp, Homo sapiens
agccccgtctgacccc

SEQ ID NO: 3698313 - DNA, 22 bp, Homo sapiens
agccccgtctgaccccagccca

SEQ ID NO: 3698314 - DNA, 12 bp, Homo sapiens
agcccctctggt

SEQ ID NO: 3698315 - DNA, 21 bp, Homo sapiens
agcccctctggtcgctcctgc

SEQ ID NO: 3698316 - DNA, 18 bp, Homo sapiens
agcccctgagtcctgagc

SEQ ID NO: 3698317 - DNA, 21 bp, Homo sapiens
agcccctgtctagagagggag

SEQ ID NO: 3698318 - DNA, 16 bp, Homo sapiens
agcccggactgaccaa

SEQ ID NO: 3698319 - DNA, 17 bp, Homo sapiens
agcccggactgaccaaa

SEQ ID NO: 3698320 - DNA, 14 bp, Homo sapiens
agccctgagatggg

SEQ ID NO: 3698321 - DNA, 22 bp, Homo sapiens
agccctgaggtgaaagggagct

SEQ ID NO: 3698322 - DNA, 18 bp, Homo sapiens
agccctgttgacacaggt

SEQ ID NO: 3698323 - DNA, 21 bp, Homo sapiens
agccctgttgacacaggtctt

SEQ ID NO: 3698324 - DNA, 21 bp, Homo sapiens
agccgccattgccaccaggag

SEQ ID NO: 3698325 - DNA, 21 bp, Homo sapiens
agccggggactcccaggctgg

SEQ ID NO: 3698326 - DNA, 17 bp, Homo sapiens
agccgtgcctgtagcct

SEQ ID NO: 3698327 - DNA, 16 bp, Homo sapiens
agcctatcaggtgccc

SEQ ID NO: 3698328 - DNA, 21 bp, Homo sapiens
agcctatcaggtgcccctctt

SEQ ID NO: 3698329 - DNA, 11 bp, Homo sapiens
agcctccctga

SEQ ID NO: 3698330 - DNA, 14 bp, Homo sapiens
agcctccctgaagc

SEQ ID NO: 3698331 - DNA, 22 bp, Homo sapiens
agcctctcgtcccgtccctccc

SEQ ID NO: 3698332 - DNA, 16 bp, Homo sapiens
agcctctgccactgtg

SEQ ID NO: 3698333 - DNA, 13 bp, Homo sapiens
agcctctggaatg

SEQ ID NO: 3698334 - DNA, 12 bp, Homo sapiens
agcctctggcta

SEQ ID NO: 3698335 - DNA, 14 bp, Homo sapiens
agcctctggctaga

SEQ ID NO: 3698336 - DNA, 15 bp, Homo sapiens
agcctctggctagag

SEQ ID NO: 3698337 - DNA, 14 bp, Homo sapiens
agcctgaagggcct

SEQ ID NO: 3698338 - DNA, 15 bp, Homo sapiens
agcctgaagggcctc

SEQ ID NO: 3698339 - DNA, 19 bp, Homo sapiens
agcctgaagggcctcccag

SEQ ID NO: 3698340 - DNA, 20 bp, Homo sapiens
agcctgaagggcctcccagc

SEQ ID NO: 3698341 - DNA, 19 bp, Homo sapiens
agcctgcagggaagcccca

SEQ ID NO: 3698342 - DNA, 14 bp, Homo sapiens
agcctgcattctta

SEQ ID NO: 3698343 - DNA, 15 bp, Homo sapiens
agcctgcattcttaa

SEQ ID NO: 3698344 - DNA, 16 bp, Homo sapiens
agcctgcctcttctct

SEQ ID NO: 3698345 - DNA, 11 bp, Homo sapiens
agcctgctgca

SEQ ID NO: 3698346 - DNA, 12 bp, Homo sapiens
agcctgctgcat

SEQ ID NO: 3698347 - DNA, 23 bp, Homo sapiens
agcctggcatcagtttaggcctt

SEQ ID NO: 3698348 - DNA, 13 bp, Homo sapiens
agcctggccagac

SEQ ID NO: 3698349 - DNA, 15 bp, Homo sapiens
agcctggccagacac

SEQ ID NO: 3698350 - DNA, 21 bp, Homo sapiens
agcctggccagacacaggccc

SEQ ID NO: 3698351 - DNA, 21 bp, Homo sapiens
agcctgggcagccaggctgcc

SEQ ID NO: 3698352 - DNA, 23 bp, Homo sapiens
agcctggggtttgaccacccacc

SEQ ID NO: 3698353 - DNA, 13 bp, Homo sapiens
agcctggtggccc

SEQ ID NO: 3698354 - DNA, 20 bp, Homo sapiens
agcctgtgcaaaaaaattaa

SEQ ID NO: 3698355 - DNA, 22 bp, Homo sapiens
agcctgtggcatctttgccttg

SEQ ID NO: 3698356 - DNA, 23 bp, Homo sapiens
agcctgttacaggaatgaagtaa

SEQ ID NO: 3698357 - DNA, 12 bp, Homo sapiens
agccttcaagtg

SEQ ID NO: 3698358 - DNA, 15 bp, Homo sapiens
agccttcaagtgcca

SEQ ID NO: 3698359 - DNA, 16 bp, Homo sapiens
agccttcaagtgccaa

SEQ ID NO: 3698360 - DNA, 22 bp, Homo sapiens
agccttggtgggggagcctctg

SEQ ID NO: 3698361 - DNA, 19 bp, Homo sapiens
agcctttaccttttatgca

SEQ ID NO: 3698362 - DNA, 12 bp, Homo sapiens
agcgcccctcag

SEQ ID NO: 3698363 - DNA, 20 bp, Homo sapiens
agcgcccctcagcctctgcc

SEQ ID NO: 3698364 - DNA, 18 bp, Homo sapiens
agcgcctccatccaaggc

SEQ ID NO: 3698365 - DNA, 20 bp, Homo sapiens
agcgcctccatccaaggcca

SEQ ID NO: 3698366 - DNA, 22 bp, Homo sapiens
agcgcctccatccaaggccagg

SEQ ID NO: 3698367 - DNA, 12 bp, Homo sapiens
agcgcctgcccc

SEQ ID NO: 3698368 - DNA, 20 bp, Homo sapiens
agcgcctttcccaactctag

SEQ ID NO: 3698369 - DNA, 17 bp, Homo sapiens
agcggaaagcagctcaa

SEQ ID NO: 3698370 - DNA, 17 bp, Homo sapiens
agcggagtctgtcctgt

SEQ ID NO: 3698371 - DNA, 23 bp, Homo sapiens
agcggctggcagcccacccctca

SEQ ID NO: 3698372 - DNA, 15 bp, Homo sapiens
agcgtcagctgctcc

SEQ ID NO: 3698373 - DNA, 14 bp, Homo sapiens
agcgtgccgagcca

SEQ ID NO: 3698374 - DNA, 16 bp, Homo sapiens
agcgtgccgagccagc

SEQ ID NO: 3698375 - DNA, 17 bp, Homo sapiens
agcgtgccgagccagca

SEQ ID NO: 3698376 - DNA, 12 bp, Homo sapiens
agctaacagtga

SEQ ID NO: 3698377 - DNA, 14 bp, Homo sapiens
agctaacagtgaag

SEQ ID NO: 3698378 - DNA, 23 bp, Homo sapiens
agctaacagtgaagatttacctc

SEQ ID NO: 3698379 - DNA, 17 bp, Homo sapiens
agctaagaacctggaac

SEQ ID NO: 3698380 - DNA, 23 bp, Homo sapiens
agctaaggaggggaaaaaaatgt

SEQ ID NO: 3698381 - DNA, 22 bp, Homo sapiens
agctaccaccacggccaccact

SEQ ID NO: 3698382 - DNA, 17 bp, Homo sapiens
agctacttggtttgtgt

SEQ ID NO: 3698383 - DNA, 21 bp, Homo sapiens
agctacttggtttgtgttctt

SEQ ID NO: 3698384 - DNA, 19 bp, Homo sapiens
agctaggatggttctgtga

SEQ ID NO: 3698385 - DNA, 23 bp, Homo sapiens
agctataaattcctctttgcttt

SEQ ID NO: 3698386 - DNA, 17 bp, Homo sapiens
agctatagacccgagga

SEQ ID NO: 3698387 - DNA, 18 bp, Homo sapiens
aggactccctcctcacct

SEQ ID NO: 3698388 - DNA, 23 bp, Homo sapiens
aggactccctcctcacctctgga

SEQ ID NO: 3698389 - DNA, 19 bp, Homo sapiens
aggacttatttaaactctg

SEQ ID NO: 3698390 - DNA, 21 bp, Homo sapiens
aggacttcctgtccagctcca

SEQ ID NO: 3698391 - DNA, 22 bp, Homo sapiens
aggacttcctgtccagctccaa

SEQ ID NO: 3698392 - DNA, 11 bp, Homo sapiens
aggactttgca

SEQ ID NO: 3698393 - DNA, 22 bp, Homo sapiens
aggagaaccaaatctggaagcc

SEQ ID NO: 3698394 - DNA, 14 bp, Homo sapiens
aggagaaccactac

SEQ ID NO: 3698395 - DNA, 13 bp, Homo sapiens
aggagaagccagg

SEQ ID NO: 3698396 - DNA, 14 bp, Homo sapiens
aggagacccacagg

SEQ ID NO: 3698397 - DNA, 14 bp, Homo sapiens
aggagagaaaatat

SEQ ID NO: 3698398 - DNA, 16 bp, Homo sapiens
aggagagaaaatatat

SEQ ID NO: 3698399 - DNA, 22 bp, Homo sapiens
aggagagaaaatatatgtattt

SEQ ID NO: 3698400 - DNA, 15 bp, Homo sapiens
aggagagcctgctgc

SEQ ID NO: 3698401 - DNA, 16 bp, Homo sapiens
aggagagcctgctgca

SEQ ID NO: 3698402 - DNA, 15 bp, Homo sapiens
aggagagctagcagc

SEQ ID NO: 3698403 - DNA, 14 bp, Homo sapiens
aggagaggggcaca

SEQ ID NO: 3698404 - DNA, 13 bp, Homo sapiens
aggagctgctata

SEQ ID NO: 3698405 - DNA, 20 bp, Homo sapiens
aggagctgctatagcctggg

SEQ ID NO: 3698406 - DNA, 21 bp, Homo sapiens
aggagctgctggcttgcagtg

SEQ ID NO: 3698407 - DNA, 20 bp, Homo sapiens
aggagctgggcagaaggcca

SEQ ID NO: 3698408 - DNA, 14 bp, Homo sapiens
aggaggaggagccg

SEQ ID NO: 3698409 - DNA, 15 bp, Homo sapiens
aggaggcggggctct

SEQ ID NO: 3698410 - DNA, 16 bp, Homo sapiens
aggaggcggggctcta

SEQ ID NO: 3698411 - DNA, 13 bp, Homo sapiens
aggaggctggcag

SEQ ID NO: 3698412 - DNA, 16 bp, Homo sapiens
aggaggctggcaggta

SEQ ID NO: 3698413 - DNA, 13 bp, Homo sapiens
aggaggctggctt

SEQ ID NO: 3698414 - DNA, 13 bp, Homo sapiens
aggaggtgtgagg

SEQ ID NO: 3698415 - DNA, 20 bp, Homo sapiens
aggagtccactttgtttcgt

SEQ ID NO: 3698416 - DNA, 17 bp, Homo sapiens
aggagtgactttgcagg

SEQ ID NO: 3698417 - DNA, 19 bp, Homo sapiens
aggagttcaggaacccttc

SEQ ID NO: 3698418 - DNA, 15 bp, Homo sapiens
aggagtttgaatcca

SEQ ID NO: 3698419 - DNA, 21 bp, Homo sapiens
aggagtttgagaccaacctgg

SEQ ID NO: 3698420 - DNA, 20 bp, Homo sapiens
aggatagatgctggcccagg

SEQ ID NO: 3698421 - DNA, 20 bp, Homo sapiens
aggatagctaactgtaaatc

SEQ ID NO: 3698422 - DNA, 16 bp, Homo sapiens
aggatcccctccaagc

SEQ ID NO: 3698423 - DNA, 12 bp, Homo sapiens
aggatctcttga

SEQ ID NO: 3698424 - DNA, 15 bp, Homo sapiens
aggatctttgactga

SEQ ID NO: 3698425 - DNA, 15 bp, Homo sapiens
aggatctttgtggcc

SEQ ID NO: 3698426 - DNA, 20 bp, Homo sapiens
aggatctttgtggccaagga

SEQ ID NO: 3698427 - DNA, 15 bp, Homo sapiens
aggatggggaggggc

SEQ ID NO: 3698428 - DNA, 23 bp, Homo sapiens
aggatgtaggggttaacttggtc

SEQ ID NO: 3698429 - DNA, 13 bp, Homo sapiens
aggatgtgtttgc

SEQ ID NO: 3698430 - DNA, 22 bp, Homo sapiens
aggattctcatgggaaggggag

SEQ ID NO: 3698431 - DNA, 16 bp, Homo sapiens
aggcaacttgggaact

SEQ ID NO: 3698432 - DNA, 13 bp, Homo sapiens
aggcacctcttcc

SEQ ID NO: 3698433 - DNA, 15 bp, Homo sapiens
aggcagatccaggac

SEQ ID NO: 3698434 - DNA, 16 bp, Homo sapiens
aggcagatccaggact

SEQ ID NO: 3698435 - DNA, 17 bp, Homo sapiens
aggcagatccaggacta

SEQ ID NO: 3698436 - DNA, 22 bp, Homo sapiens
aggcagcgtgccgagccagcaa

SEQ ID NO: 3698437 - DNA, 11 bp, Homo sapiens
aggcagctggc

SEQ ID NO: 3698438 - DNA, 12 bp, Homo sapiens
aggcagctggca

SEQ ID NO: 3698439 - DNA, 13 bp, Homo sapiens
aggcagctgtgtc

SEQ ID NO: 3698440 - DNA, 15 bp, Homo sapiens
aggcagctgtgtctg

SEQ ID NO: 3698441 - DNA, 16 bp, Homo sapiens
aggcagctgtgtctga

SEQ ID NO: 3698442 - DNA, 18 bp, Homo sapiens
aggcagctgtgtctgagc

SEQ ID NO: 3698443 - DNA, 21 bp, Homo sapiens
aggcagctgtgtctgagccca

SEQ ID NO: 3698444 - DNA, 14 bp, Homo sapiens
aggcaggaagggaa

SEQ ID NO: 3698445 - DNA, 17 bp, Homo sapiens
aggcaggaagggcagga

SEQ ID NO: 3698446 - DNA, 20 bp, Homo sapiens
aggcaggcatggccctgggc

SEQ ID NO: 3698447 - DNA, 12 bp, Homo sapiens
aggcagggaagt

SEQ ID NO: 3698448 - DNA, 23 bp, Homo sapiens
aggcagggaagtccccaggcccc

SEQ ID NO: 3698449 - DNA, 12 bp, Homo sapiens
aggcagggctcc

SEQ ID NO: 3698450 - DNA, 16 bp, Homo sapiens
aggcagggctcctccc

SEQ ID NO: 3698451 - DNA, 17 bp, Homo sapiens
aggcaggtgggatggat

SEQ ID NO: 3698452 - DNA, 19 bp, Homo sapiens
aggcagtgatgctggatgc

SEQ ID NO: 3698453 - DNA, 12 bp, Homo sapiens
aggcatggtggc

SEQ ID NO: 3698454 - DNA, 18 bp, Homo sapiens
aggcatgtgtgaaacata

SEQ ID NO: 3698455 - DNA, 20 bp, Homo sapiens
aggcatttgctgaatacaga

SEQ ID NO: 3698456 - DNA, 15 bp, Homo sapiens
aggccaaccctcctc

SEQ ID NO: 3698457 - DNA, 22 bp, Homo sapiens
aggccagaggcccccagcccag

SEQ ID NO: 3698458 - DNA, 22 bp, Homo sapiens
aggccagagtggcctggccagg

SEQ ID NO: 3698459 - DNA, 13 bp, Homo sapiens
aggccagccccac

SEQ ID NO: 3698460 - DNA, 18 bp, Homo sapiens
aggccagccccacccagg

SEQ ID NO: 3698461 - DNA, 14 bp, Homo sapiens
aggccagctggcag

SEQ ID NO: 3698462 - DNA, 16 bp, Homo sapiens
aggccagctggcagca

SEQ ID NO: 3698463 - DNA, 15 bp, Homo sapiens
aggccccactgggga

SEQ ID NO: 3698464 - DNA, 12 bp, Homo sapiens
aggccccagcct

SEQ ID NO: 3698465 - DNA, 13 bp, Homo sapiens
aggccccagcctc

SEQ ID NO: 3698466 - DNA, 13 bp, Homo sapiens
aggccccaggaag

SEQ ID NO: 3698467 - DNA, 14 bp, Homo sapiens
aggccccaggaagc

SEQ ID NO: 3698468 - DNA, 20 bp, Homo sapiens
aggcccccacttgcctcttc

SEQ ID NO: 3698469 - DNA, 14 bp, Homo sapiens
aggcccccagccca

SEQ ID NO: 3698470 - DNA, 17 bp, Homo sapiens
aggcccccagcccaggg

SEQ ID NO: 3698471 - DNA, 23 bp, Homo sapiens
aggccccgcccgtctctgctctg

SEQ ID NO: 3698472 - DNA, 21 bp, Homo sapiens
aggcccctatgtagtccgtgc

SEQ ID NO: 3698473 - DNA, 13 bp, Homo sapiens
aggcccctcccag

SEQ ID NO: 3698474 - DNA, 19 bp, Homo sapiens
aggcccgcatgcggcccag

SEQ ID NO: 3698475 - DNA, 20 bp, Homo sapiens
aggcccgccctgcccgggct

SEQ ID NO: 3698476 - DNA, 21 bp, Homo sapiens
aggcccgccctgcccgggctc

SEQ ID NO: 3698477 - DNA, 23 bp, Homo sapiens
aggcccgccctgcccgggctccc

SEQ ID NO: 3698478 - DNA, 23 bp, Homo sapiens
aggccctcctctcccatccttga

SEQ ID NO: 3698479 - DNA, 13 bp, Homo sapiens
aggccctctggag

SEQ ID NO: 3698480 - DNA, 19 bp, Homo sapiens
aggccgaggccatgtgcat

SEQ ID NO: 3698481 - DNA, 20 bp, Homo sapiens
aggccgcagctccattttct

SEQ ID NO: 3698482 - DNA, 15 bp, Homo sapiens
aggcctccctctctc

SEQ ID NO: 3698483 - DNA, 22 bp, Homo sapiens
aggcctccctctctcttctgct

SEQ ID NO: 3698484 - DNA, 17 bp, Homo sapiens
aggcctgaaagaggctg

SEQ ID NO: 3698485 - DNA, 17 bp, Homo sapiens
aggcctgcgaccctggg

SEQ ID NO: 3698486 - DNA, 18 bp, Homo sapiens
aggcctgcgaccctgggg

SEQ ID NO: 3698487 - DNA, 19 bp, Homo sapiens
aggcctggactttcctgca

SEQ ID NO: 3698488 - DNA, 20 bp, Homo sapiens
aggcctgggccgctgccacg

SEQ ID NO: 3698489 - DNA, 17 bp, Homo sapiens
aggcgattttgtctacc

SEQ ID NO: 3698490 - DNA, 14 bp, Homo sapiens
aggcgggaggaggt

SEQ ID NO: 3698491 - DNA, 15 bp, Homo sapiens
aggcggggcgcccca

SEQ ID NO: 3698492 - DNA, 21 bp, Homo sapiens
aggcggggctcctcctgaagg

SEQ ID NO: 3698493 - DNA, 12 bp, Homo sapiens
aggctcatttta

SEQ ID NO: 3698494 - DNA, 21 bp, Homo sapiens
aggctccaatggggcggggct

SEQ ID NO: 3698495 - DNA, 15 bp, Homo sapiens
aggctcccagggaca

SEQ ID NO: 3698496 - DNA, 20 bp, Homo sapiens
aggctcccgaggggaagggg

SEQ ID NO: 3698497 - DNA, 14 bp, Homo sapiens
aggctcctgtggta

SEQ ID NO: 3698498 - DNA, 23 bp, Homo sapiens
aggctcctgtggtagtcctccca

SEQ ID NO: 3698499 - DNA, 14 bp, Homo sapiens
aggctccttcctgt

SEQ ID NO: 3698500 - DNA, 20 bp, Homo sapiens
aggctcttctccttggagga

SEQ ID NO: 3698501 - DNA, 20 bp, Homo sapiens
aggctgacgtgtgagggagg

SEQ ID NO: 3698502 - DNA, 20 bp, Homo sapiens
aggctgagaaggaacaggga

SEQ ID NO: 3698503 - DNA, 22 bp, Homo sapiens
aggctgaggaaaggccagctgg

SEQ ID NO: 3698504 - DNA, 15 bp, Homo sapiens
aggctgcccagagct

SEQ ID NO: 3698505 - DNA, 16 bp, Homo sapiens
aggctgctcagggctg

SEQ ID NO: 3698506 - DNA, 17 bp, Homo sapiens
aggctgctcagggctgg

SEQ ID NO: 3698507 - DNA, 14 bp, Homo sapiens
aggctgctccctga

SEQ ID NO: 3698508 - DNA, 15 bp, Homo sapiens
aggctgctccctgag

SEQ ID NO: 3698509 - DNA, 16 bp, Homo sapiens
aggctggagagcactg

SEQ ID NO: 3698510 - DNA, 15 bp, Homo sapiens
aggctggagcccagg

SEQ ID NO: 3698511 - DNA, 18 bp, Homo sapiens
aggctggagcccagggag

SEQ ID NO: 3698512 - DNA, 22 bp, Homo sapiens
aggctggcttgtcccctcctca

SEQ ID NO: 3698513 - DNA, 17 bp, Homo sapiens
aggctgggggaagaagc

SEQ ID NO: 3698514 - DNA, 21 bp, Homo sapiens
aggctggtacaacggaggcct

SEQ ID NO: 3698515 - DNA, 13 bp, Homo sapiens
aggcttctacctg

SEQ ID NO: 3698516 - DNA, 18 bp, Homo sapiens
aggcttctacctgcaggc

SEQ ID NO: 3698517 - DNA, 16 bp, Homo sapiens
aggcttcttcctggat

SEQ ID NO: 3698518 - DNA, 19 bp, Homo sapiens
aggcttgcccaggagcaag

SEQ ID NO: 3698519 - DNA, 23 bp, Homo sapiens
aggctttcccacttcccaccctg

SEQ ID NO: 3698520 - DNA, 22 bp, Homo sapiens
agggaaaatgcagcagggatgc

SEQ ID NO: 3698521 - DNA, 14 bp, Homo sapiens
agggaacctgtgtc

SEQ ID NO: 3698522 - DNA, 16 bp, Homo sapiens
agggaagaaaagagct

SEQ ID NO: 3698523 - DNA, 16 bp, Homo sapiens
agggaagataaagatg

SEQ ID NO: 3698524 - DNA, 16 bp, Homo sapiens
agggaagcgtatatac

SEQ ID NO: 3698525 - DNA, 16 bp, Homo sapiens
agggacatttccaagc

SEQ ID NO: 3698526 - DNA, 18 bp, Homo sapiens
agggacatttccaagctg

SEQ ID NO: 3698527 - DNA, 19 bp, Homo sapiens
agggacatttccaagctgt

SEQ ID NO: 3698528 - DNA, 16 bp, Homo sapiens
agggaccaactgggcc

SEQ ID NO: 3698529 - DNA, 16 bp, Homo sapiens
agggaccttcatgccc

SEQ ID NO: 3698530 - DNA, 20 bp, Homo sapiens
agggacggccaagaatgtac

SEQ ID NO: 3698531 - DNA, 21 bp, Homo sapiens
agggacttcgcagaggcaagc

SEQ ID NO: 3698532 - DNA, 21 bp, Homo sapiens
agggagaagactatattgtac

SEQ ID NO: 3698533 - DNA, 13 bp, Homo sapiens
agggagaagctcc

SEQ ID NO: 3698534 - DNA, 20 bp, Homo sapiens
agggagacggtttccaggga

SEQ ID NO: 3698535 - DNA, 18 bp, Homo sapiens
agggagcggaaagcagct

SEQ ID NO: 3698536 - DNA, 14 bp, Homo sapiens
agggagctgggccc

SEQ ID NO: 3698537 - DNA, 15 bp, Homo sapiens
agggagctgggcccg

SEQ ID NO: 3698538 - DNA, 14 bp, Homo sapiens
agggaggcaagccc

SEQ ID NO: 3698539 - DNA, 15 bp, Homo sapiens
agggaggcaagccct

SEQ ID NO: 3698540 - DNA, 11 bp, Homo sapiens
agggaggcccc

SEQ ID NO: 3698541 - DNA, 15 bp, Homo sapiens
agggaggggcctagg

SEQ ID NO: 3698542 - DNA, 14 bp, Homo sapiens
agggattcaggctg

SEQ ID NO: 3698543 - DNA, 21 bp, Homo sapiens
agggcaccaggggtttctcgc

SEQ ID NO: 3698544 - DNA, 16 bp, Homo sapiens
agggcaggaaggagag

SEQ ID NO: 3698545 - DNA, 14 bp, Homo sapiens
agggcaggtccagc

SEQ ID NO: 3698546 - DNA, 15 bp, Homo sapiens
agggcaggtccagct

SEQ ID NO: 3698547 - DNA, 23 bp, Homo sapiens
agggcaggtccagctctgtgggc

SEQ ID NO: 3698548 - DNA, 14 bp, Homo sapiens
agggcatcggggcc

SEQ ID NO: 3698549 - DNA, 13 bp, Homo sapiens
agggccagagcca

SEQ ID NO: 3698550 - DNA, 16 bp, Homo sapiens
agggccagagccaggg

SEQ ID NO: 3698551 - DNA, 16 bp, Homo sapiens
agggccagtcctgcct

SEQ ID NO: 3698552 - DNA, 21 bp, Homo sapiens
agggccagtcctgcctggcca

SEQ ID NO: 3698553 - DNA, 21 bp, Homo sapiens
agggccatggctcagggtggt

SEQ ID NO: 3698554 - DNA, 17 bp, Homo sapiens
agggcccagagcccagc

SEQ ID NO: 3698555 - DNA, 13 bp, Homo sapiens
agggccctacctg

SEQ ID NO: 3698556 - DNA, 12 bp, Homo sapiens
agggcctcccag

SEQ ID NO: 3698557 - DNA, 13 bp, Homo sapiens
agggcctcccagc

SEQ ID NO: 3698558 - DNA, 15 bp, Homo sapiens
agggcggagcgcctc

SEQ ID NO: 3698559 - DNA, 18 bp, Homo sapiens
agggcggagcgcctcctt

SEQ ID NO: 3698560 - DNA, 18 bp, Homo sapiens
agggcggcaggggcctgg

SEQ ID NO: 3698561 - DNA, 17 bp, Homo sapiens
agggcgtggctctgggt

SEQ ID NO: 3698562 - DNA, 18 bp, Homo sapiens
agggcgtggctctgggtg

SEQ ID NO: 3698563 - DNA, 12 bp, Homo sapiens
agggctcctccc

SEQ ID NO: 3698564 - DNA, 14 bp, Homo sapiens
agggctcctccctg

SEQ ID NO: 3698565 - DNA, 17 bp, Homo sapiens
agggctcctccctggag

SEQ ID NO: 3698566 - DNA, 22 bp, Homo sapiens
agggcttctcctgcgggggcga

SEQ ID NO: 3698567 - DNA, 15 bp, Homo sapiens
aggggaaaaaaatgt

SEQ ID NO: 3698568 - DNA, 17 bp, Homo sapiens
aggggaaaaaaatgttg

SEQ ID NO: 3698569 - DNA, 18 bp, Homo sapiens
aggggaaaatcagcctgc

SEQ ID NO: 3698570 - DNA, 22 bp, Homo sapiens
aggggaaaatcagcctgctcca

SEQ ID NO: 3698571 - DNA, 17 bp, Homo sapiens
aggggaaagacttccat

SEQ ID NO: 3698572 - DNA, 16 bp, Homo sapiens
aggggaatcagaactc

SEQ ID NO: 3698573 - DNA, 24 bp, Homo sapiens
aggggagcccactgtcctgggcct

SEQ ID NO: 3698574 - DNA, 18 bp, Homo sapiens
aggggagggggatccgac

SEQ ID NO: 3698575 - DNA, 14 bp, Homo sapiens
aggggatgggaggt

SEQ ID NO: 3698576 - DNA, 17 bp, Homo sapiens
aggggcaaattcttttg

SEQ ID NO: 3698577 - DNA, 21 bp, Homo sapiens
aggggcatctgcccctccccc

SEQ ID NO: 3698578 - DNA, 17 bp, Homo sapiens
aggggcccggccagcca

SEQ ID NO: 3698579 - DNA, 19 bp, Homo sapiens
aggggcccggccagccatg

SEQ ID NO: 3698580 - DNA, 15 bp, Homo sapiens
aggggccgctgccac

SEQ ID NO: 3698581 - DNA, 16 bp, Homo sapiens
aggggccgctgccacc

SEQ ID NO: 3698582 - DNA, 13 bp, Homo sapiens
aggggccggccct

SEQ ID NO: 3698583 - DNA, 15 bp, Homo sapiens
aggggccggccctgt

SEQ ID NO: 3698584 - DNA, 21 bp, Homo sapiens
aggggccggccctgtgtgcag

SEQ ID NO: 3698585 - DNA, 13 bp, Homo sapiens
aggggcctggaga

SEQ ID NO: 3698586 - DNA, 22 bp, Homo sapiens
aggggcctggagatcctcctgc

SEQ ID NO: 3698587 - DNA, 18 bp, Homo sapiens
aggggcggtgcccacacc

SEQ ID NO: 3698588 - DNA, 19 bp, Homo sapiens
aggggcgtctgttccccct

SEQ ID NO: 3698589 - DNA, 15 bp, Homo sapiens
aggggcttcaggtcc

SEQ ID NO: 3698590 - DNA, 18 bp, Homo sapiens
aggggtcccagccacccc

SEQ ID NO: 3698591 - DNA, 14 bp, Homo sapiens
aggggtccctagca

SEQ ID NO: 3698592 - DNA, 23 bp, Homo sapiens
aggggtccctagcagcccaccct

SEQ ID NO: 3698593 - DNA, 22 bp, Homo sapiens
aggggtgtcttgggcagagctg

SEQ ID NO: 3698594 - DNA, 23 bp, Homo sapiens
aggggttaacttggtcagagcca

SEQ ID NO: 3698595 - DNA, 20 bp, Homo sapiens
aggggttggtatctcaggtc

SEQ ID NO: 3698596 - DNA, 23 bp, Homo sapiens
aggggtttcagaattttgcattg

SEQ ID NO: 3698597 - DNA, 21 bp, Homo sapiens
agggtatggactatctgtctg

SEQ ID NO: 3698598 - DNA, 13 bp, Homo sapiens
agggtattccaga

SEQ ID NO: 3698599 - DNA, 12 bp, Homo sapiens
agggtatttatt

SEQ ID NO: 3698600 - DNA, 14 bp, Homo sapiens
agggtatttattgg

SEQ ID NO: 3698601 - DNA, 14 bp, Homo sapiens
agggtccctctgtg

SEQ ID NO: 3698602 - DNA, 18 bp, Homo sapiens
agggtccctctgtgtatt

SEQ ID NO: 3698603 - DNA, 14 bp, Homo sapiens
agggtcctggctcc

SEQ ID NO: 3698604 - DNA, 20 bp, Homo sapiens
agggtcctggctcctgaggg

SEQ ID NO: 3698605 - DNA, 21 bp, Homo sapiens
agggtcctggctcctgagggg

SEQ ID NO: 3698606 - DNA, 13 bp, Homo sapiens
agggtctgctctt

SEQ ID NO: 3698607 - DNA, 17 bp, Homo sapiens
agggtctgctctttctc

SEQ ID NO: 3698608 - DNA, 20 bp, Homo sapiens
agggtctgctctttctctgc

SEQ ID NO: 3698609 - DNA, 21 bp, Homo sapiens
agggtctgctctttctctgcc

SEQ ID NO: 3698610 - DNA, 22 bp, Homo sapiens
agggtctgctctttctctgcca

SEQ ID NO: 3698611 - DNA, 17 bp, Homo sapiens
agggtcttccctacctc

SEQ ID NO: 3698612 - DNA, 11 bp, Homo sapiens
agggtggccct

SEQ ID NO: 3698613 - DNA, 14 bp, Homo sapiens
agggtggcccttgc

SEQ ID NO: 3698614 - DNA, 20 bp, Homo sapiens
agggtgggcttttccctggg

SEQ ID NO: 3698615 - DNA, 19 bp, Homo sapiens
agggtgtctgcgtcgtcac

SEQ ID NO: 3698616 - DNA, 18 bp, Homo sapiens
agggttattgcatttgga

SEQ ID NO: 3698617 - DNA, 12 bp, Homo sapiens
agggtttgacat

SEQ ID NO: 3698618 - DNA, 13 bp, Homo sapiens
aggtaaaatgcca

SEQ ID NO: 3698619 - DNA, 14 bp, Homo sapiens
aggtaaaatgccat

SEQ ID NO: 3698620 - DNA, 15 bp, Homo sapiens
aggtaaaatgccatg

SEQ ID NO: 3698621 - DNA, 21 bp, Homo sapiens
agttttcagaacctcttcccc

SEQ ID NO: 3698622 - DNA, 22 bp, Homo sapiens
agttttcagaacctcttcccca

SEQ ID NO: 3698623 - DNA, 18 bp, Homo sapiens
agtttttacagctgtgtt

SEQ ID NO: 3698624 - DNA, 15 bp, Homo sapiens
agttttttgtaccaa

SEQ ID NO: 3698625 - DNA, 17 bp, Homo sapiens
ataaaaaccaagaagat

SEQ ID NO: 3698626 - DNA, 13 bp, Homo sapiens
ataaaagaacatg

SEQ ID NO: 3698627 - DNA, 16 bp, Homo sapiens
ataaaagaacatgctt

SEQ ID NO: 3698628 - DNA, 17 bp, Homo sapiens
ataaaagaacatgcttg

SEQ ID NO: 3698629 - DNA, 16 bp, Homo sapiens
ataaaatggctgtaat

SEQ ID NO: 3698630 - DNA, 22 bp, Homo sapiens
ataaaattctattacagtatgt

SEQ ID NO: 3698631 - DNA, 22 bp, Homo sapiens
ataaagataacccttattccat

SEQ ID NO: 3698632 - DNA, 16 bp, Homo sapiens
ataaagtagtcctgtg

SEQ ID NO: 3698633 - DNA, 14 bp, Homo sapiens
ataaattaggacca

SEQ ID NO: 3698634 - DNA, 20 bp, Homo sapiens
ataaattcctctttgctttg

SEQ ID NO: 3698635 - DNA, 11 bp, Homo sapiens
ataacatatat

SEQ ID NO: 3698636 - DNA, 20 bp, Homo sapiens
ataacatatatggaagagga

SEQ ID NO: 3698637 - DNA, 17 bp, Homo sapiens
ataacatttaaattcca

SEQ ID NO: 3698638 - DNA, 15 bp, Homo sapiens
ataactatgttgata

SEQ ID NO: 3698639 - DNA, 18 bp, Homo sapiens
ataacttttacacgacca

SEQ ID NO: 3698640 - DNA, 18 bp, Homo sapiens
ataaggtaaaatgccatg

SEQ ID NO: 3698641 - DNA, 14 bp, Homo sapiens
ataagtgaaaatct

SEQ ID NO: 3698642 - DNA, 16 bp, Homo sapiens
ataagtgaaaatctta

SEQ ID NO: 3698643 - DNA, 17 bp, Homo sapiens
ataatatctaaagttat

SEQ ID NO: 3698644 - DNA, 18 bp, Homo sapiens
ataatatctaaagttata

SEQ ID NO: 3698645 - DNA, 18 bp, Homo sapiens
ataatatttcaagtgcct

SEQ ID NO: 3698646 - DNA, 19 bp, Homo sapiens
ataatatttcaagtgccta

SEQ ID NO: 3698647 - DNA, 19 bp, Homo sapiens
ataatcatgtgaaatgttt

SEQ ID NO: 3698648 - DNA, 21 bp, Homo sapiens
ataatgctaatttaaagagac

SEQ ID NO: 3698649 - DNA, 17 bp, Homo sapiens
ataatgctcacttggtc

SEQ ID NO: 3698650 - DNA, 17 bp, Homo sapiens
ataatgggccactgaaa

SEQ ID NO: 3698651 - DNA, 17 bp, Homo sapiens
ataatgttgtatttaat

SEQ ID NO: 3698652 - DNA, 18 bp, Homo sapiens
ataattgctttgccaaaa

SEQ ID NO: 3698653 - DNA, 18 bp, Homo sapiens
ataatttacaggttctta

SEQ ID NO: 3698654 - DNA, 18 bp, Homo sapiens
atacaaaaatactcagat

SEQ ID NO: 3698655 - DNA, 17 bp, Homo sapiens
atacaccagcattcctt

SEQ ID NO: 3698656 - DNA, 16 bp, Homo sapiens
atacagtacaggcagc

SEQ ID NO: 3698657 - DNA, 22 bp, Homo sapiens
atacagttaacacaatgtgaat

SEQ ID NO: 3698658 - DNA, 12 bp, Homo sapiens
atacataatggg

SEQ ID NO: 3698659 - DNA, 22 bp, Homo sapiens
atacataatgggccactgaaat

SEQ ID NO: 3698660 - DNA, 23 bp, Homo sapiens
atacatacaccagcattcctttt

SEQ ID NO: 3698661 - DNA, 14 bp, Homo sapiens
atacatcttataga

SEQ ID NO: 3698662 - DNA, 19 bp, Homo sapiens
atacctatcacttacattt

SEQ ID NO: 3698663 - DNA, 20 bp, Homo sapiens
atactgcgactttctgcctg

SEQ ID NO: 3698664 - DNA, 18 bp, Homo sapiens
atactgctgagatacata

SEQ ID NO: 3698665 - DNA, 10 bp, Homo sapiens
atactgcttg

SEQ ID NO: 3698666 - DNA, 23 bp, Homo sapiens
atactgcttgtcatctgcatgtc

SEQ ID NO: 3698667 - DNA, 15 bp, Homo sapiens
atactggaggaacac

SEQ ID NO: 3698668 - DNA, 20 bp, Homo sapiens
atagaaatggaaattttgct

SEQ ID NO: 3698669 - DNA, 15 bp, Homo sapiens
atagatgctggccca

SEQ ID NO: 3698670 - DNA, 17 bp, Homo sapiens
atagatgctggcccagg

SEQ ID NO: 3698671 - DNA, 23 bp, Homo sapiens
atagatgctggcccagggcccag

SEQ ID NO: 3698672 - DNA, 18 bp, Homo sapiens
atagcctggactgctacc

SEQ ID NO: 3698673 - DNA, 17 bp, Homo sapiens
atagcctgttacaggaa

SEQ ID NO: 3698674 - DNA, 15 bp, Homo sapiens
atagctaactgtaaa

SEQ ID NO: 3698675 - DNA, 16 bp, Homo sapiens
atagctacaggaagca

SEQ ID NO: 3698676 - DNA, 16 bp, Homo sapiens
ataggctccttcctgt

SEQ ID NO: 3698677 - DNA, 22 bp, Homo sapiens
ataggtctctttgctttctggt

SEQ ID NO: 3698678 - DNA, 15 bp, Homo sapiens
atagtaggcatgtta

SEQ ID NO: 3698679 - DNA, 17 bp, Homo sapiens
atagtaggcatgttatg

SEQ ID NO: 3698680 - DNA, 12 bp, Homo sapiens
atagtatttgat

SEQ ID NO: 3698681 - DNA, 13 bp, Homo sapiens
atagtttctttat

SEQ ID NO: 3698682 - DNA, 18 bp, Homo sapiens
atagtttctttattttgt

SEQ ID NO: 3698683 - DNA, 19 bp, Homo sapiens
atagtttctttattttgtg

SEQ ID NO: 3698684 - DNA, 13 bp, Homo sapiens
atataaacactat

SEQ ID NO: 3698685 - DNA, 15 bp, Homo sapiens
atatacttaagaata

SEQ ID NO: 3698686 - DNA, 17 bp, Homo sapiens
atatacttaagaataca

SEQ ID NO: 3698687 - DNA, 16 bp, Homo sapiens
atatatataacatata

SEQ ID NO: 3698688 - DNA, 15 bp, Homo sapiens
atatatatatataac

SEQ ID NO: 3698689 - DNA, 21 bp, Homo sapiens
atatatatctatatatataat

SEQ ID NO: 3698690 - DNA, 13 bp, Homo sapiens
atatatattttaa

SEQ ID NO: 3698691 - DNA, 15 bp, Homo sapiens
atatatttattttat

SEQ ID NO: 3698692 - DNA, 19 bp, Homo sapiens
atatccaggtgtgcccctc

SEQ ID NO: 3698693 - DNA, 17 bp, Homo sapiens
atatcgacttgtttttg

SEQ ID NO: 3698694 - DNA, 22 bp, Homo sapiens
atatgctccaggatctttgact

SEQ ID NO: 3698695 - DNA, 16 bp, Homo sapiens
atatggaaaaaatgta

SEQ ID NO: 3698696 - DNA, 17 bp, Homo sapiens
atatggaaaaaatgtat

SEQ ID NO: 3698697 - DNA, 16 bp, Homo sapiens
atatggggatgcagca

SEQ ID NO: 3698698 - DNA, 18 bp, Homo sapiens
atatggtatatatacata

SEQ ID NO: 3698699 - DNA, 19 bp, Homo sapiens
atatggtatatatacatat

SEQ ID NO: 3698700 - DNA, 11 bp, Homo sapiens
atatgtatttt

SEQ ID NO: 3698701 - DNA, 17 bp, Homo sapiens
atattaactacagaaaa

SEQ ID NO: 3698702 - DNA, 18 bp, Homo sapiens
atattaagaactgctgtt

SEQ ID NO: 3698703 - DNA, 22 bp, Homo sapiens
atattaaggaagacaatgtgaa

SEQ ID NO: 3698704 - DNA, 18 bp, Homo sapiens
atattatcctaagggaag

SEQ ID NO: 3698705 - DNA, 21 bp, Homo sapiens
atattcatttaaaacattgca

SEQ ID NO: 3698706 - DNA, 15 bp, Homo sapiens
atattctatttttat

SEQ ID NO: 3698707 - DNA, 16 bp, Homo sapiens
atatttaaaaatgtct

SEQ ID NO: 3698708 - DNA, 13 bp, Homo sapiens
atatttaatgttt

SEQ ID NO: 3698709 - DNA, 15 bp, Homo sapiens
atatttatactttgc

SEQ ID NO: 3698710 - DNA, 16 bp, Homo sapiens
atatttgtaaagctat

SEQ ID NO: 3698711 - DNA, 17 bp, Homo sapiens
atatttgtgctatagta

SEQ ID NO: 3698712 - DNA, 16 bp, Homo sapiens
atattttccatgaaaa

SEQ ID NO: 3698713 - DNA, 21 bp, Homo sapiens
atcaaccccccgactgtgctg

SEQ ID NO: 3698714 - DNA, 23 bp, Homo sapiens
atcaagttggcttctaatcaaag

SEQ ID NO: 3698715 - DNA, 22 bp, Homo sapiens
atcaattttgacttaatgtgat

SEQ ID NO: 3698716 - DNA, 21 bp, Homo sapiens
atcacagggtgggcctcggcc

SEQ ID NO: 3698717 - DNA, 19 bp, Homo sapiens
atcacagggttgggcccag

SEQ ID NO: 3698718 - DNA, 15 bp, Homo sapiens
atcaccttaggcagg

SEQ ID NO: 3698719 - DNA, 22 bp, Homo sapiens
atcagaactcaaatggggccag

SEQ ID NO: 3698720 - DNA, 22 bp, Homo sapiens
atcagagatgcaccaccaagcc

SEQ ID NO: 3698721 - DNA, 11 bp, Homo sapiens
atcagcctggg

SEQ ID NO: 3698722 - DNA, 21 bp, Homo sapiens
atcagcctgggcaatgtgata

SEQ ID NO: 3698723 - DNA, 22 bp, Homo sapiens
atcaggaatattttccaaagag

SEQ ID NO: 3698724 - DNA, 13 bp, Homo sapiens
atcaggtgcccct

SEQ ID NO: 3698725 - DNA, 15 bp, Homo sapiens
atcagtgacatctga

SEQ ID NO: 3698726 - DNA, 19 bp, Homo sapiens
atcagtttaggccttggct

SEQ ID NO: 3698727 - DNA, 12 bp, Homo sapiens
atcatcctactg

SEQ ID NO: 3698728 - DNA, 22 bp, Homo sapiens
atcatgctggaacctgcaaaaa

SEQ ID NO: 3698729 - DNA, 17 bp, Homo sapiens
atcatggcactgcattc

SEQ ID NO: 3698730 - DNA, 18 bp, Homo sapiens
atcatgtactttttagta

SEQ ID NO: 3698731 - DNA, 14 bp, Homo sapiens
atcattaatgtaat

SEQ ID NO: 3698732 - DNA, 13 bp, Homo sapiens
atcattactataa

SEQ ID NO: 3698733 - DNA, 17 bp, Homo sapiens
atcattttccccccact

SEQ ID NO: 3698734 - DNA, 18 bp, Homo sapiens
atccaaaagaagccccca

SEQ ID NO: 3698735 - DNA, 20 bp, Homo sapiens
atccactctaccctcccacc

SEQ ID NO: 3698736 - DNA, 21 bp, Homo sapiens
atccactctaccctcccaccc

SEQ ID NO: 3698737 - DNA, 19 bp, Homo sapiens
atgaggagagaaaatatat

SEQ ID NO: 3698738 - DNA, 16 bp, Homo sapiens
atgaggcggagctcca

SEQ ID NO: 3698739 - DNA, 22 bp, Homo sapiens
atgaggcggagctccaggatgg

SEQ ID NO: 3698740 - DNA, 11 bp, Homo sapiens
atgaggcttct

SEQ ID NO: 3698741 - DNA, 23 bp, Homo sapiens
atgaggcttcttcctggatgggg

SEQ ID NO: 3698742 - DNA, 19 bp, Homo sapiens
atgagggggaattcctgga

SEQ ID NO: 3698743 - DNA, 20 bp, Homo sapiens
atgagttgtgaaatttaatg

SEQ ID NO: 3698744 - DNA, 15 bp, Homo sapiens
atgataaaacacaaa

SEQ ID NO: 3698745 - DNA, 12 bp, Homo sapiens
atgatcactgtg

SEQ ID NO: 3698746 - DNA, 16 bp, Homo sapiens
atgatcctaggcattt

SEQ ID NO: 3698747 - DNA, 22 bp, Homo sapiens
atgatgcctctgtcttctggac

SEQ ID NO: 3698748 - DNA, 23 bp, Homo sapiens
atgcaaaaaaaaaaaaagcaatt

SEQ ID NO: 3698749 - DNA, 16 bp, Homo sapiens
atgcaacaacatgtat

SEQ ID NO: 3698750 - DNA, 21 bp, Homo sapiens
atgcaacaacatgtataatat

SEQ ID NO: 3698751 - DNA, 16 bp, Homo sapiens
atgcaacatggatatg

SEQ ID NO: 3698752 - DNA, 17 bp, Homo sapiens
atgcaagcagaggacca

SEQ ID NO: 3698753 - DNA, 22 bp, Homo sapiens
atgcaaggaccaggactccctc

SEQ ID NO: 3698754 - DNA, 18 bp, Homo sapiens
atgcaccaccaagccaag

SEQ ID NO: 3698755 - DNA, 13 bp, Homo sapiens
atgcactgtgaag

SEQ ID NO: 3698756 - DNA, 20 bp, Homo sapiens
atgcactgtgaaggaccctt

SEQ ID NO: 3698757 - DNA, 21 bp, Homo sapiens
atgcagaatgttgattacagt

SEQ ID NO: 3698758 - DNA, 22 bp, Homo sapiens
atgcagcccatgcccacctgcc

SEQ ID NO: 3698759 - DNA, 16 bp, Homo sapiens
atgcaggggtcagtgc

SEQ ID NO: 3698760 - DNA, 18 bp, Homo sapiens
atgcaggggtcagtgcag

SEQ ID NO: 3698761 - DNA, 18 bp, Homo sapiens
atgcatggggcgggtcct

SEQ ID NO: 3698762 - DNA, 21 bp, Homo sapiens
atgcatggggcgggtcctagc

SEQ ID NO: 3698763 - DNA, 22 bp, Homo sapiens
atgcatggggcgggtcctagct

SEQ ID NO: 3698764 - DNA, 20 bp, Homo sapiens
atgcatggtgccccaggacc

SEQ ID NO: 3698765 - DNA, 21 bp, Homo sapiens
atgcatggtgccccaggacca

SEQ ID NO: 3698766 - DNA, 18 bp, Homo sapiens
atgcatgtcttttaaaat

SEQ ID NO: 3698767 - DNA, 15 bp, Homo sapiens
atgcattgagctgcc

SEQ ID NO: 3698768 - DNA, 16 bp, Homo sapiens
atgcattgagctgcct

SEQ ID NO: 3698769 - DNA, 22 bp, Homo sapiens
atgccaaagctagggtggccct

SEQ ID NO: 3698770 - DNA, 22 bp, Homo sapiens
atgccagtaacgcgtcttcctg

SEQ ID NO: 3698771 - DNA, 23 bp, Homo sapiens
atgccagtaacgcgtcttcctga

SEQ ID NO: 3698772 - DNA, 20 bp, Homo sapiens
atgcccacctgcccatcaca

SEQ ID NO: 3698773 - DNA, 23 bp, Homo sapiens
atgccctcctctcccattgtccc

SEQ ID NO: 3698774 - DNA, 16 bp, Homo sapiens
atgcctcactaatttt

SEQ ID NO: 3698775 - DNA, 21 bp, Homo sapiens
atgcctcactaatttttgtat

SEQ ID NO: 3698776 - DNA, 23 bp, Homo sapiens
atgcctcactaatttttgtatta

SEQ ID NO: 3698777 - DNA, 20 bp, Homo sapiens
atgcctgtagctttcctggt

SEQ ID NO: 3698778 - DNA, 22 bp, Homo sapiens
atgcctgtagctttcctggtcc

SEQ ID NO: 3698779 - DNA, 14 bp, Homo sapiens
atgccttttatttc

SEQ ID NO: 3698780 - DNA, 22 bp, Homo sapiens
atgcgccccctccgccctgcca

SEQ ID NO: 3698781 - DNA, 20 bp, Homo sapiens
atgcggcccaggatggcttt

SEQ ID NO: 3698782 - DNA, 16 bp, Homo sapiens
atgcgggccagtgctc

SEQ ID NO: 3698783 - DNA, 14 bp, Homo sapiens
atgctaaaattctt

SEQ ID NO: 3698784 - DNA, 13 bp, Homo sapiens
atgctcatctgct

SEQ ID NO: 3698785 - DNA, 14 bp, Homo sapiens
atgctcatctgctg

SEQ ID NO: 3698786 - DNA, 16 bp, Homo sapiens
atgctcatctgctggt

SEQ ID NO: 3698787 - DNA, 14 bp, Homo sapiens
atgctccaggcgcg

SEQ ID NO: 3698788 - DNA, 16 bp, Homo sapiens
atgctccctcccctgc

SEQ ID NO: 3698789 - DNA, 20 bp, Homo sapiens
atgctccctcccctgccctg

SEQ ID NO: 3698790 - DNA, 12 bp, Homo sapiens
atgctgctttaa

SEQ ID NO: 3698791 - DNA, 23 bp, Homo sapiens
atgctgctttaacagtggagctg

SEQ ID NO: 3698792 - DNA, 13 bp, Homo sapiens
atgctgctttttc

SEQ ID NO: 3698793 - DNA, 17 bp, Homo sapiens
atgctggagtacccagc

SEQ ID NO: 3698794 - DNA, 19 bp, Homo sapiens
atgctggagtacccagcct

SEQ ID NO: 3698795 - DNA, 19 bp, Homo sapiens
atgctggatgctccttcca

SEQ ID NO: 3698796 - DNA, 13 bp, Homo sapiens
atgctggcccagg

SEQ ID NO: 3698797 - DNA, 18 bp, Homo sapiens
atgctggcccagggccca

SEQ ID NO: 3698798 - DNA, 23 bp, Homo sapiens
atgctggcccagggcccagagcc

SEQ ID NO: 3698799 - DNA, 18 bp, Homo sapiens
atgcttccctgcagctga

SEQ ID NO: 3698800 - DNA, 10 bp, Homo sapiens
atgcttcctc

SEQ ID NO: 3698801 - DNA, 16 bp, Homo sapiens
atgcttctcactgcca

SEQ ID NO: 3698802 - DNA, 20 bp, Homo sapiens
atgcttctcactgccatgcc

SEQ ID NO: 3698803 - DNA, 20 bp, Homo sapiens
atggaaccgcaggaagctgc

SEQ ID NO: 3698804 - DNA, 20 bp, Homo sapiens
atggaagaggaaaaggctgg

SEQ ID NO: 3698805 - DNA, 19 bp, Homo sapiens
atggacagaagaaggcagc

SEQ ID NO: 3698806 - DNA, 21 bp, Homo sapiens
atggacccaatatttaccaga

SEQ ID NO: 3698807 - DNA, 13 bp, Homo sapiens
atggagtcatctt

SEQ ID NO: 3698808 - DNA, 15 bp, Homo sapiens
atggatttccagcca

SEQ ID NO: 3698809 - DNA, 20 bp, Homo sapiens
atggcagtgtggggagggca

SEQ ID NO: 3698810 - DNA, 22 bp, Homo sapiens
atggccagcgcccctcagcctc

SEQ ID NO: 3698811 - DNA, 20 bp, Homo sapiens
atggcccggcccctcctgac

SEQ ID NO: 3698812 - DNA, 22 bp, Homo sapiens
atggcccggcccctcctgactc

SEQ ID NO: 3698813 - DNA, 13 bp, Homo sapiens
atggccctgggcg

SEQ ID NO: 3698814 - DNA, 19 bp, Homo sapiens
atggcctcagctgcctcac

SEQ ID NO: 3698815 - DNA, 13 bp, Homo sapiens
atggcctcatgtg

SEQ ID NO: 3698816 - DNA, 18 bp, Homo sapiens
atggcctcatgtggctgg

SEQ ID NO: 3698817 - DNA, 19 bp, Homo sapiens
atggcctcatgtggctgga

SEQ ID NO: 3698818 - DNA, 13 bp, Homo sapiens
atggctcctctca

SEQ ID NO: 3698819 - DNA, 22 bp, Homo sapiens
atggctgtgttggtgtggccca

SEQ ID NO: 3698820 - DNA, 18 bp, Homo sapiens
atgggaaaactgccaata

SEQ ID NO: 3698821 - DNA, 13 bp, Homo sapiens
atgggaagcaata

SEQ ID NO: 3698822 - DNA, 18 bp, Homo sapiens
atgggaaggggaggaccc

SEQ ID NO: 3698823 - DNA, 14 bp, Homo sapiens
atgggattctggac

SEQ ID NO: 3698824 - DNA, 16 bp, Homo sapiens
atgggccactgaaatc

SEQ ID NO: 3698825 - DNA, 23 bp, Homo sapiens
atgggccactgaaatctgtcaag

SEQ ID NO: 3698826 - DNA, 12 bp, Homo sapiens
atgggcccctgg

SEQ ID NO: 3698827 - DNA, 20 bp, Homo sapiens
atgggccggcccccttcctg

SEQ ID NO: 3698828 - DNA, 21 bp, Homo sapiens
atgggccggcccccttcctgg

SEQ ID NO: 3698829 - DNA, 14 bp, Homo sapiens
atggggaggccgct

SEQ ID NO: 3698830 - DNA, 12 bp, Homo sapiens
atggggaggggc

SEQ ID NO: 3698831 - DNA, 15 bp, Homo sapiens
atggggaggggctct

SEQ ID NO: 3698832 - DNA, 16 bp, Homo sapiens
atggggaggggctctg

SEQ ID NO: 3698833 - DNA, 13 bp, Homo sapiens
atggggccagatc

SEQ ID NO: 3698834 - DNA, 14 bp, Homo sapiens
atggggccagatcc

SEQ ID NO: 3698835 - DNA, 19 bp, Homo sapiens
atggggccagatccagcct

SEQ ID NO: 3698836 - DNA, 12 bp, Homo sapiens
atggggcggggc

SEQ ID NO: 3698837 - DNA, 12 bp, Homo sapiens
atggtatatata

SEQ ID NO: 3698838 - DNA, 21 bp, Homo sapiens
atggtatctgggtaagaagaa

SEQ ID NO: 3698839 - DNA, 16 bp, Homo sapiens
atggtccgctttcctg

SEQ ID NO: 3698840 - DNA, 18 bp, Homo sapiens
atggtccgctttcctgga

SEQ ID NO: 3698841 - DNA, 19 bp, Homo sapiens
atggtccgctttcctggag

SEQ ID NO: 3698842 - DNA, 20 bp, Homo sapiens
atggtccgctttcctggagc

SEQ ID NO: 3698843 - DNA, 17 bp, Homo sapiens
atggtgagaaaaatgta

SEQ ID NO: 3698844 - DNA, 17 bp, Homo sapiens
atggtgatgaaatgtaa

SEQ ID NO: 3698845 - DNA, 14 bp, Homo sapiens
atggtgccccagga

SEQ ID NO: 3698846 - DNA, 15 bp, Homo sapiens
atggtgccccaggac

SEQ ID NO: 3698847 - DNA, 16 bp, Homo sapiens
atggtggacccagcgg

SEQ ID NO: 3698848 - DNA, 17 bp, Homo sapiens
atggtttgcaaggaagc

SEQ ID NO: 3698849 - DNA, 15 bp, Homo sapiens
atggtttgtcctgat

SEQ ID NO: 3698850 - DNA, 20 bp, Homo sapiens
atgtaaaatcctacagtgaa

SEQ ID NO: 3698851 - DNA, 20 bp, Homo sapiens
atgtaaacataccaacatgt

SEQ ID NO: 3698852 - DNA, 14 bp, Homo sapiens
atgtaaattgaaga

SEQ ID NO: 3698853 - DNA, 16 bp, Homo sapiens
attcttacaaacatgt

SEQ ID NO: 3698854 - DNA, 17 bp, Homo sapiens
attcttacaaacatgtg

SEQ ID NO: 3698855 - DNA, 13 bp, Homo sapiens
attcttcagcttg

SEQ ID NO: 3698856 - DNA, 17 bp, Homo sapiens
attcttccaacacattt

SEQ ID NO: 3698857 - DNA, 15 bp, Homo sapiens
attcttttgaattgt

SEQ ID NO: 3698858 - DNA, 15 bp, Homo sapiens
attgaagaagcctca

SEQ ID NO: 3698859 - DNA, 20 bp, Homo sapiens
attgaatgtgtgatgtgaac

SEQ ID NO: 3698860 - DNA, 17 bp, Homo sapiens
attgacaacagttacat

SEQ ID NO: 3698861 - DNA, 15 bp, Homo sapiens
attgacagctttgct

SEQ ID NO: 3698862 - DNA, 22 bp, Homo sapiens
attgacgacaagtgctgaacag

SEQ ID NO: 3698863 - DNA, 16 bp, Homo sapiens
attgcacgtggcctct

SEQ ID NO: 3698864 - DNA, 17 bp, Homo sapiens
attgcacgtggcctctt

SEQ ID NO: 3698865 - DNA, 19 bp, Homo sapiens
attgcagtcatagaagaga

SEQ ID NO: 3698866 - DNA, 15 bp, Homo sapiens
attgccaccaggaga

SEQ ID NO: 3698867 - DNA, 17 bp, Homo sapiens
attgcctttgaatgtta

SEQ ID NO: 3698868 - DNA, 22 bp, Homo sapiens
attgcgtagctctcaaatgtgt

SEQ ID NO: 3698869 - DNA, 12 bp, Homo sapiens
attgctgcttga

SEQ ID NO: 3698870 - DNA, 22 bp, Homo sapiens
attgctttgtgacttcttcttc

SEQ ID NO: 3698871 - DNA, 12 bp, Homo sapiens
attggagctgac

SEQ ID NO: 3698872 - DNA, 10 bp, Homo sapiens
attggctttc

SEQ ID NO: 3698873 - DNA, 23 bp, Homo sapiens
attggctttgggttgcaggacct

SEQ ID NO: 3698874 - DNA, 15 bp, Homo sapiens
attgggaccctccag

SEQ ID NO: 3698875 - DNA, 18 bp, Homo sapiens
attgggcagcagactgtg

SEQ ID NO: 3698876 - DNA, 15 bp, Homo sapiens
attgggcggggcttc

SEQ ID NO: 3698877 - DNA, 15 bp, Homo sapiens
attggggtccctcta

SEQ ID NO: 3698878 - DNA, 21 bp, Homo sapiens
attgtaaatatttgactttag

SEQ ID NO: 3698879 - DNA, 21 bp, Homo sapiens
attgtaaattatatttgtgct

SEQ ID NO: 3698880 - DNA, 22 bp, Homo sapiens
attgtactaaagccaaacatat

SEQ ID NO: 3698881 - DNA, 21 bp, Homo sapiens
attgtattagtattgtgaata

SEQ ID NO: 3698882 - DNA, 12 bp, Homo sapiens
attgtccctctg

SEQ ID NO: 3698883 - DNA, 22 bp, Homo sapiens
attgtcgtataggcatgtaaac

SEQ ID NO: 3698884 - DNA, 18 bp, Homo sapiens
attgtctcctatatattt

SEQ ID NO: 3698885 - DNA, 22 bp, Homo sapiens
attgtctcctatatatttctat

SEQ ID NO: 3698886 - DNA, 23 bp, Homo sapiens
attgtctcctatatatttctatt

SEQ ID NO: 3698887 - DNA, 14 bp, Homo sapiens
attgtctgtctaca

SEQ ID NO: 3698888 - DNA, 19 bp, Homo sapiens
attgtctgtctacatttct

SEQ ID NO: 3698889 - DNA, 17 bp, Homo sapiens
attgttaatttttccta

SEQ ID NO: 3698890 - DNA, 18 bp, Homo sapiens
attgttcttattctggca

SEQ ID NO: 3698891 - DNA, 12 bp, Homo sapiens
attgtttgctgc

SEQ ID NO: 3698892 - DNA, 14 bp, Homo sapiens
atttaaaaaaaatc

SEQ ID NO: 3698893 - DNA, 14 bp, Homo sapiens
atttaaaaatgtct

SEQ ID NO: 3698894 - DNA, 21 bp, Homo sapiens
atttaaattacaattttatct

SEQ ID NO: 3698895 - DNA, 14 bp, Homo sapiens
atttaaattccaca

SEQ ID NO: 3698896 - DNA, 22 bp, Homo sapiens
atttaaattccacagattatca

SEQ ID NO: 3698897 - DNA, 16 bp, Homo sapiens
atttaagcaacatctt

SEQ ID NO: 3698898 - DNA, 19 bp, Homo sapiens
atttaatgttttaaatgta

SEQ ID NO: 3698899 - DNA, 21 bp, Homo sapiens
atttaatgttttaaatgtaca

SEQ ID NO: 3698900 - DNA, 15 bp, Homo sapiens
atttacaactgaaac

SEQ ID NO: 3698901 - DNA, 22 bp, Homo sapiens
atttacaactgaaacctaggaa

SEQ ID NO: 3698902 - DNA, 15 bp, Homo sapiens
atttactacagtagt

SEQ ID NO: 3698903 - DNA, 15 bp, Homo sapiens
atttagtaaatgtta

SEQ ID NO: 3698904 - DNA, 17 bp, Homo sapiens
atttagtttttaacaat

SEQ ID NO: 3698905 - DNA, 14 bp, Homo sapiens
atttatactttgca

SEQ ID NO: 3698906 - DNA, 15 bp, Homo sapiens
atttatgggcccctg

SEQ ID NO: 3698907 - DNA, 13 bp, Homo sapiens
atttatgtgtgag

SEQ ID NO: 3698908 - DNA, 22 bp, Homo sapiens
atttattggtcagggtgtggga

SEQ ID NO: 3698909 - DNA, 13 bp, Homo sapiens
atttattgtctgt

SEQ ID NO: 3698910 - DNA, 23 bp, Homo sapiens
atttattgtctgtctacatttct

SEQ ID NO: 3698911 - DNA, 13 bp, Homo sapiens
atttatttaattt

SEQ ID NO: 3698912 - DNA, 15 bp, Homo sapiens
atttattttattcta

SEQ ID NO: 3698913 - DNA, 13 bp, Homo sapiens
atttcaagtgcct

SEQ ID NO: 3698914 - DNA, 23 bp, Homo sapiens
atttcagactcccattcctgaag

SEQ ID NO: 3698915 - DNA, 13 bp, Homo sapiens
atttcagatgtaa

SEQ ID NO: 3698916 - DNA, 15 bp, Homo sapiens
atttcagatgtaatg

SEQ ID NO: 3698917 - DNA, 16 bp, Homo sapiens
atttcagatgtaatgt

SEQ ID NO: 3698918 - DNA, 20 bp, Homo sapiens
atttcagatgtaatgttttc

SEQ ID NO: 3698919 - DNA, 15 bp, Homo sapiens
atttccaagagctga

SEQ ID NO: 3698920 - DNA, 14 bp, Homo sapiens
atttcccaggaccc

SEQ ID NO: 3698921 - DNA, 19 bp, Homo sapiens
atttcccaggaccctgaag

SEQ ID NO: 3698922 - DNA, 15 bp, Homo sapiens
atttcctggatgttt

SEQ ID NO: 3698923 - DNA, 13 bp, Homo sapiens
atttcctggccct

SEQ ID NO: 3698924 - DNA, 15 bp, Homo sapiens
atttctactgtgtga

SEQ ID NO: 3698925 - DNA, 23 bp, Homo sapiens
atttctagaacatccctgccagc

SEQ ID NO: 3698926 - DNA, 20 bp, Homo sapiens
atttctctaactcctgccat

SEQ ID NO: 3698927 - DNA, 16 bp, Homo sapiens
atttctgaactgttac

SEQ ID NO: 3698928 - DNA, 21 bp, Homo sapiens
atttctgcagatcttccgtgg

SEQ ID NO: 3698929 - DNA, 13 bp, Homo sapiens
atttcttaaacaa

SEQ ID NO: 3698930 - DNA, 14 bp, Homo sapiens
atttcttaaacact

SEQ ID NO: 3698931 - DNA, 15 bp, Homo sapiens
atttcttcagagttt

SEQ ID NO: 3698932 - DNA, 15 bp, Homo sapiens
atttgactaatttta

SEQ ID NO: 3698933 - DNA, 23 bp, Homo sapiens
atttgagaatagacccttactag

SEQ ID NO: 3698934 - DNA, 21 bp, Homo sapiens
atttgatgagttaactgtgaa

SEQ ID NO: 3698935 - DNA, 14 bp, Homo sapiens
atttgattaacatt

SEQ ID NO: 3698936 - DNA, 20 bp, Homo sapiens
atttgattcaaaatatttaa

SEQ ID NO: 3698937 - DNA, 12 bp, Homo sapiens
atttggaaaata

SEQ ID NO: 3698938 - DNA, 22 bp, Homo sapiens
atttggccggctctggtggcca

SEQ ID NO: 3698939 - DNA, 19 bp, Homo sapiens
atttgtaaagctatttatg

SEQ ID NO: 3698940 - DNA, 23 bp, Homo sapiens
atttgtctttttgttgtaaaaca

SEQ ID NO: 3698941 - DNA, 15 bp, Homo sapiens
atttgtgaactggaa

SEQ ID NO: 3698942 - DNA, 17 bp, Homo sapiens
atttgtgaactggaaga

SEQ ID NO: 3698943 - DNA, 20 bp, Homo sapiens
atttgtgctagaaattttca

SEQ ID NO: 3698944 - DNA, 22 bp, Homo sapiens
atttgttaaaatacagttctgt

SEQ ID NO: 3698945 - DNA, 21 bp, Homo sapiens
attttatgccttttatttctt

SEQ ID NO: 3698946 - DNA, 16 bp, Homo sapiens
attttatggtgcatta

SEQ ID NO: 3698947 - DNA, 18 bp, Homo sapiens
attttattcaagaatgcc

SEQ ID NO: 3698948 - DNA, 19 bp, Homo sapiens
attttattctatgtatgtt

SEQ ID NO: 3698949 - DNA, 20 bp, Homo sapiens
attttcacattcttggctta

SEQ ID NO: 3698950 - DNA, 14 bp, Homo sapiens
attttcatcaagta

SEQ ID NO: 3698951 - DNA, 21 bp, Homo sapiens
attttccccccactctcccca

SEQ ID NO: 3698952 - DNA, 19 bp, Homo sapiens
attttccctattagagaag

SEQ ID NO: 3698953 - DNA, 16 bp, Homo sapiens
attttctacgtttctt

SEQ ID NO: 3698954 - DNA, 17 bp, Homo sapiens
attttctacgtttcttt

SEQ ID NO: 3698955 - DNA, 16 bp, Homo sapiens
attttctctgtacttt

SEQ ID NO: 3698956 - DNA, 20 bp, Homo sapiens
attttctggaaaatgcttct

SEQ ID NO: 3698957 - DNA, 22 bp, Homo sapiens
attttctggattccccatctca

SEQ ID NO: 3698958 - DNA, 21 bp, Homo sapiens
attttcttattgcgctgctac

SEQ ID NO: 3698959 - DNA, 17 bp, Homo sapiens
attttgataccagaagg

SEQ ID NO: 3698960 - DNA, 19 bp, Homo sapiens
attttgataccagaaggga

SEQ ID NO: 3698961 - DNA, 19 bp, Homo sapiens
attttggaaaatgattagg

SEQ ID NO: 3698962 - DNA, 16 bp, Homo sapiens
attttgtaatgaattc

SEQ ID NO: 3698963 - DNA, 12 bp, Homo sapiens
attttgtctacc

SEQ ID NO: 3698964 - DNA, 12 bp, Homo sapiens
attttgtgtaaa

SEQ ID NO: 3698965 - DNA, 14 bp, Homo sapiens
atttttaaaaaata

SEQ ID NO: 3698966 - DNA, 18 bp, Homo sapiens
atttttaaaaaatatttt

SEQ ID NO: 3698967 - DNA, 13 bp, Homo sapiens
atttttgtaaagt

SEQ ID NO: 3698968 - DNA, 20 bp, Homo sapiens
attttttcagacttgtcaag

SEQ ID NO: 3698969 - DNA, 11 bp, Homo sapiens
attttttcctt

SEQ ID NO: 3698970 - DNA, 23 bp, Homo sapiens
cacacccgccctgtgtgtgtccc

SEQ ID NO: 3698971 - DNA, 20 bp, Homo sapiens
cacacctcagttcccttggc

SEQ ID NO: 3698972 - DNA, 17 bp, Homo sapiens
cacactccatcagctta

SEQ ID NO: 3698973 - DNA, 14 bp, Homo sapiens
cacactgaggcagg

SEQ ID NO: 3698974 - DNA, 17 bp, Homo sapiens
cacactgaggcagggaa

SEQ ID NO: 3698975 - DNA, 15 bp, Homo sapiens
cacacttgttccagc

SEQ ID NO: 3698976 - DNA, 18 bp, Homo sapiens
cacacttgttccagctct

SEQ ID NO: 3698977 - DNA, 18 bp, Homo sapiens
cacactttcatgcagtgc

SEQ ID NO: 3698978 - DNA, 14 bp, Homo sapiens
cacagagacccccg

SEQ ID NO: 3698979 - DNA, 23 bp, Homo sapiens
cacagagacccccggaacaagcc

SEQ ID NO: 3698980 - DNA, 14 bp, Homo sapiens
cacagatcacagct

SEQ ID NO: 3698981 - DNA, 15 bp, Homo sapiens
cacagccagcacctg

SEQ ID NO: 3698982 - DNA, 16 bp, Homo sapiens
cacagccagcacctgg

SEQ ID NO: 3698983 - DNA, 17 bp, Homo sapiens
cacagccagcacctggc

SEQ ID NO: 3698984 - DNA, 11 bp, Homo sapiens
cacagcctctg

SEQ ID NO: 3698985 - DNA, 23 bp, Homo sapiens
cacagcggagtctgtcctgtgac

SEQ ID NO: 3698986 - DNA, 17 bp, Homo sapiens
cacagcttcagccagga

SEQ ID NO: 3698987 - DNA, 18 bp, Homo sapiens
cacagcttcagccaggag

SEQ ID NO: 3698988 - DNA, 19 bp, Homo sapiens
cacagcttcagccaggagc

SEQ ID NO: 3698989 - DNA, 22 bp, Homo sapiens
cacagcttcagccaggagctgg

SEQ ID NO: 3698990 - DNA, 19 bp, Homo sapiens
cacagcttgacctgaggct

SEQ ID NO: 3698991 - DNA, 19 bp, Homo sapiens
cacaggaggcaggcatggc

SEQ ID NO: 3698992 - DNA, 17 bp, Homo sapiens
cacagggtctgctcttt

SEQ ID NO: 3698993 - DNA, 14 bp, Homo sapiens
cacagggtgggcct

SEQ ID NO: 3698994 - DNA, 18 bp, Homo sapiens
cacagggttgggcccaga

SEQ ID NO: 3698995 - DNA, 22 bp, Homo sapiens
cacagggttgggcccagatctg

SEQ ID NO: 3698996 - DNA, 23 bp, Homo sapiens
cacaggtatgaccttctaggaag

SEQ ID NO: 3698997 - DNA, 14 bp, Homo sapiens
cacaggtctttcct

SEQ ID NO: 3698998 - DNA, 15 bp, Homo sapiens
cacaggtctttccta

SEQ ID NO: 3698999 - DNA, 17 bp, Homo sapiens
cacagtgaaggctgtcc

SEQ ID NO: 3699000 - DNA, 19 bp, Homo sapiens
cacagttctttgggccaga

SEQ ID NO: 3699001 - DNA, 21 bp, Homo sapiens
cacagttctttgggccagaca

SEQ ID NO: 3699002 - DNA, 19 bp, Homo sapiens
cacataccctcttcatgga

SEQ ID NO: 3699003 - DNA, 22 bp, Homo sapiens
cacataccctcttcatggatgg

SEQ ID NO: 3699004 - DNA, 24 bp, Homo sapiens
cacatcagctccactttcagtgaa

SEQ ID NO: 3699005 - DNA, 17 bp, Homo sapiens
cacatctaagcctgaag

SEQ ID NO: 3699006 - DNA, 20 bp, Homo sapiens
cacatgactcgggggtgggg

SEQ ID NO: 3699007 - DNA, 21 bp, Homo sapiens
cacattagaagacaattgaca

SEQ ID NO: 3699008 - DNA, 22 bp, Homo sapiens
cacattcttggcttaatcattt

SEQ ID NO: 3699009 - DNA, 22 bp, Homo sapiens
caccaaatcgtagcgtttgtta

SEQ ID NO: 3699010 - DNA, 18 bp, Homo sapiens
caccacatcctccgtcca

SEQ ID NO: 3699011 - DNA, 14 bp, Homo sapiens
caccacatctaagc

SEQ ID NO: 3699012 - DNA, 13 bp, Homo sapiens
caccaccaagcca

SEQ ID NO: 3699013 - DNA, 17 bp, Homo sapiens
caccacggccaccactg

SEQ ID NO: 3699014 - DNA, 22 bp, Homo sapiens
caccacggcgttgtacctgtag

SEQ ID NO: 3699015 - DNA, 13 bp, Homo sapiens
caccactgcagcc

SEQ ID NO: 3699016 - DNA, 17 bp, Homo sapiens
caccagacacccaggac

SEQ ID NO: 3699017 - DNA, 20 bp, Homo sapiens
caccagacacccaggactta

SEQ ID NO: 3699018 - DNA, 14 bp, Homo sapiens
caccagcagcctgg

SEQ ID NO: 3699019 - DNA, 15 bp, Homo sapiens
caccaggccacctcc

SEQ ID NO: 3699020 - DNA, 22 bp, Homo sapiens
caccaggccacctccccagcat

SEQ ID NO: 3699021 - DNA, 15 bp, Homo sapiens
caccaggcgctgccc

SEQ ID NO: 3699022 - DNA, 18 bp, Homo sapiens
caccagttcctttcaatg

SEQ ID NO: 3699023 - DNA, 18 bp, Homo sapiens
caccatgtacatagcttg

SEQ ID NO: 3699024 - DNA, 20 bp, Homo sapiens
cacccaaaccggcaggtgcg

SEQ ID NO: 3699025 - DNA, 12 bp, Homo sapiens
cacccaaagctg

SEQ ID NO: 3699026 - DNA, 19 bp, Homo sapiens
cacccaaagctgagcctgc

SEQ ID NO: 3699027 - DNA, 21 bp, Homo sapiens
cacccaagtatacaataaagt

SEQ ID NO: 3699028 - DNA, 13 bp, Homo sapiens
cacccacctccct

SEQ ID NO: 3699029 - DNA, 16 bp, Homo sapiens
cacccacctccctgcc

SEQ ID NO: 3699030 - DNA, 14 bp, Homo sapiens
cacccacctgacca

SEQ ID NO: 3699031 - DNA, 11 bp, Homo sapiens
cacccaggagg

SEQ ID NO: 3699032 - DNA, 18 bp, Homo sapiens
caccccaaagctttcctg

SEQ ID NO: 3699033 - DNA, 12 bp, Homo sapiens
caccccatgcca

SEQ ID NO: 3699034 - DNA, 13 bp, Homo sapiens
cacccccttctct

SEQ ID NO: 3699035 - DNA, 17 bp, Homo sapiens
cacccccttctctgctc

SEQ ID NO: 3699036 - DNA, 18 bp, Homo sapiens
cacccccttctctgctcc

SEQ ID NO: 3699037 - DNA, 22 bp, Homo sapiens
cacccctccagaacacggctca

SEQ ID NO: 3699038 - DNA, 12 bp, Homo sapiens
cacccctggggg

SEQ ID NO: 3699039 - DNA, 14 bp, Homo sapiens
cacccctgggggct

SEQ ID NO: 3699040 - DNA, 13 bp, Homo sapiens
cacccgccctgtg

SEQ ID NO: 3699041 - DNA, 14 bp, Homo sapiens
caccctcaggcagg

SEQ ID NO: 3699042 - DNA, 17 bp, Homo sapiens
caccctgaaagccctga

SEQ ID NO: 3699043 - DNA, 22 bp, Homo sapiens
caccctgatttaggagaagcca

SEQ ID NO: 3699044 - DNA, 13 bp, Homo sapiens
caccctgccttat

SEQ ID NO: 3699045 - DNA, 12 bp, Homo sapiens
caccctgtcttc

SEQ ID NO: 3699046 - DNA, 15 bp, Homo sapiens
cacccttggcctgtc

SEQ ID NO: 3699047 - DNA, 21 bp, Homo sapiens
cacccttggcctgtctcatcc

SEQ ID NO: 3699048 - DNA, 20 bp, Homo sapiens
caccctttgctgtgaggctg

SEQ ID NO: 3699049 - DNA, 19 bp, Homo sapiens
caccgcctccccacctcca

SEQ ID NO: 3699050 - DNA, 22 bp, Homo sapiens
caccgcctccccacctccaggc

SEQ ID NO: 3699051 - DNA, 21 bp, Homo sapiens
caccgcggcgcttcccagcac

SEQ ID NO: 3699052 - DNA, 19 bp, Homo sapiens
caccgtcaggtactcctgc

SEQ ID NO: 3699053 - DNA, 15 bp, Homo sapiens
caccgtggctaagag

SEQ ID NO: 3699054 - DNA, 22 bp, Homo sapiens
cacctaatccaggcagatccag

SEQ ID NO: 3699055 - DNA, 20 bp, Homo sapiens
cacctcagttcccttggcct

SEQ ID NO: 3699056 - DNA, 15 bp, Homo sapiens
cacctcatccccaac

SEQ ID NO: 3699057 - DNA, 19 bp, Homo sapiens
cacctcattctgaaccctt

SEQ ID NO: 3699058 - DNA, 13 bp, Homo sapiens
cacctcccatcct

SEQ ID NO: 3699059 - DNA, 14 bp, Homo sapiens
cacctccccagcat

SEQ ID NO: 3699060 - DNA, 13 bp, Homo sapiens
cacctccctgcct

SEQ ID NO: 3699061 - DNA, 14 bp, Homo sapiens
cacctcctgctggg

SEQ ID NO: 3699062 - DNA, 18 bp, Homo sapiens
cacctctgcacaagctgc

SEQ ID NO: 3699063 - DNA, 19 bp, Homo sapiens
cacctctgcacaagctgca

SEQ ID NO: 3699064 - DNA, 13 bp, Homo sapiens
cacctcttggctt

SEQ ID NO: 3699065 - DNA, 21 bp, Homo sapiens
cacctgccagcggtttcctgg

SEQ ID NO: 3699066 - DNA, 16 bp, Homo sapiens
cacctgggagaaatct

SEQ ID NO: 3699067 - DNA, 17 bp, Homo sapiens
cacctgggagaaatctg

SEQ ID NO: 3699068 - DNA, 18 bp, Homo sapiens
cacctggggtgtgggagg

SEQ ID NO: 3699069 - DNA, 11 bp, Homo sapiens
cacctggttgc

SEQ ID NO: 3699070 - DNA, 18 bp, Homo sapiens
cacctgtagcacttactg

SEQ ID NO: 3699071 - DNA, 22 bp, Homo sapiens
cacctgtagcacttactggtag

SEQ ID NO: 3699072 - DNA, 13 bp, Homo sapiens
cacctgtcaaaca

SEQ ID NO: 3699073 - DNA, 20 bp, Homo sapiens
cacctgtcaaacaaagccag

SEQ ID NO: 3699074 - DNA, 23 bp, Homo sapiens
cacctgtcaaacaaagccagaag

SEQ ID NO: 3699075 - DNA, 13 bp, Homo sapiens
caccttgccttgc

SEQ ID NO: 3699076 - DNA, 16 bp, Homo sapiens
caccttggacatcctc

SEQ ID NO: 3699077 - DNA, 17 bp, Homo sapiens
caccttggacatcctcc

SEQ ID NO: 3699078 - DNA, 21 bp, Homo sapiens
caccttggacatcctcctccc

SEQ ID NO: 3699079 - DNA, 16 bp, Homo sapiens
caccttggcttgttat

SEQ ID NO: 3699080 - DNA, 14 bp, Homo sapiens
cacctttgccacaa

SEQ ID NO: 3699081 - DNA, 17 bp, Homo sapiens
caccttttttcaacagt

SEQ ID NO: 3699082 - DNA, 17 bp, Homo sapiens
cacgactgcccggcagg

SEQ ID NO: 3699083 - DNA, 19 bp, Homo sapiens
cacgcacctcccatcctaa

SEQ ID NO: 3699084 - DNA, 17 bp, Homo sapiens
cacgcacttcgggaggt

SEQ ID NO: 3699085 - DNA, 16 bp, Homo sapiens
cacgcccgtcctgcct

SEQ ID NO: 3699086 - DNA, 21 bp, Homo sapiens
cagctaaggaggggaaaaaaa

SEQ ID NO: 3699087 - DNA, 22 bp, Homo sapiens
cagctaaggaggggaaaaaaat

SEQ ID NO: 3699088 - DNA, 15 bp, Homo sapiens
cagctacaggagaga

SEQ ID NO: 3699089 - DNA, 17 bp, Homo sapiens
cagctacttggtttgtg

SEQ ID NO: 3699090 - DNA, 15 bp, Homo sapiens
cagctatgggagccc

SEQ ID NO: 3699091 - DNA, 15 bp, Homo sapiens
cagctcaaaggcaca

SEQ ID NO: 3699092 - DNA, 13 bp, Homo sapiens
cagctcacagtgc

SEQ ID NO: 3699093 - DNA, 20 bp, Homo sapiens
cagctcacagtgctgtgtgc

SEQ ID NO: 3699094 - DNA, 13 bp, Homo sapiens
cagctcactgtga

SEQ ID NO: 3699095 - DNA, 15 bp, Homo sapiens
cagctcactgtgacc

SEQ ID NO: 3699096 - DNA, 16 bp, Homo sapiens
cagctcaggacagatg

SEQ ID NO: 3699097 - DNA, 17 bp, Homo sapiens
cagctccaacctgcaaa

SEQ ID NO: 3699098 - DNA, 20 bp, Homo sapiens
cagctccaacctgcaaagat

SEQ ID NO: 3699099 - DNA, 21 bp, Homo sapiens
cagctctgcaagaattgaagc

SEQ ID NO: 3699100 - DNA, 17 bp, Homo sapiens
cagctctggacagcccc

SEQ ID NO: 3699101 - DNA, 13 bp, Homo sapiens
cagctctgtgggc

SEQ ID NO: 3699102 - DNA, 14 bp, Homo sapiens
cagctctgtgggcc

SEQ ID NO: 3699103 - DNA, 23 bp, Homo sapiens
cagctcttctgccggccctgggg

SEQ ID NO: 3699104 - DNA, 17 bp, Homo sapiens
cagctgcgcccccttct

SEQ ID NO: 3699105 - DNA, 19 bp, Homo sapiens
cagctggtggtatctgagt

SEQ ID NO: 3699106 - DNA, 18 bp, Homo sapiens
cagctggttgaggtttca

SEQ ID NO: 3699107 - DNA, 16 bp, Homo sapiens
cagctgtaatctatga

SEQ ID NO: 3699108 - DNA, 17 bp, Homo sapiens
cagctgtgtctgagccc

SEQ ID NO: 3699109 - DNA, 19 bp, Homo sapiens
cagctgtgtctgagcccaa

SEQ ID NO: 3699110 - DNA, 16 bp, Homo sapiens
cagctgttcagctggt

SEQ ID NO: 3699111 - DNA, 17 bp, Homo sapiens
cagcttcagccaggagc

SEQ ID NO: 3699112 - DNA, 18 bp, Homo sapiens
cagcttcccctctctcct

SEQ ID NO: 3699113 - DNA, 23 bp, Homo sapiens
cagcttcccctctctcctcctgc

SEQ ID NO: 3699114 - DNA, 16 bp, Homo sapiens
cagcttgacctgaggc

SEQ ID NO: 3699115 - DNA, 13 bp, Homo sapiens
cagctttgaggaa

SEQ ID NO: 3699116 - DNA, 21 bp, Homo sapiens
cagctttgtttgttgtcagct

SEQ ID NO: 3699117 - DNA, 23 bp, Homo sapiens
cagctttgtttgttgtcagctga

SEQ ID NO: 3699118 - DNA, 21 bp, Homo sapiens
caggaaattcagcccaccagc

SEQ ID NO: 3699119 - DNA, 20 bp, Homo sapiens
caggaacagctatgggagcc

SEQ ID NO: 3699120 - DNA, 23 bp, Homo sapiens
caggaacagctatgggagcccca

SEQ ID NO: 3699121 - DNA, 16 bp, Homo sapiens
caggaagcaccccatg

SEQ ID NO: 3699122 - DNA, 15 bp, Homo sapiens
caggaagctgctccg

SEQ ID NO: 3699123 - DNA, 17 bp, Homo sapiens
caggaagctgctccgtg

SEQ ID NO: 3699124 - DNA, 18 bp, Homo sapiens
caggaagctgctccgtgc

SEQ ID NO: 3699125 - DNA, 21 bp, Homo sapiens
caggaagctttggtgagaacc

SEQ ID NO: 3699126 - DNA, 22 bp, Homo sapiens
caggaagctttggtgagaacct

SEQ ID NO: 3699127 - DNA, 23 bp, Homo sapiens
caggaagctttggtgagaacctg

SEQ ID NO: 3699128 - DNA, 16 bp, Homo sapiens
caggaaggagagcctg

SEQ ID NO: 3699129 - DNA, 18 bp, Homo sapiens
caggaaggagagcctgct

SEQ ID NO: 3699130 - DNA, 22 bp, Homo sapiens
caggaaggcttgttgtgctttt

SEQ ID NO: 3699131 - DNA, 13 bp, Homo sapiens
caggaagggaagc

SEQ ID NO: 3699132 - DNA, 21 bp, Homo sapiens
caggaagggcaggaaggagag

SEQ ID NO: 3699133 - DNA, 13 bp, Homo sapiens
caggacagatgcc

SEQ ID NO: 3699134 - DNA, 12 bp, Homo sapiens
caggaccagctc

SEQ ID NO: 3699135 - DNA, 16 bp, Homo sapiens
caggaccagctcagga

SEQ ID NO: 3699136 - DNA, 13 bp, Homo sapiens
caggaccctgaag

SEQ ID NO: 3699137 - DNA, 16 bp, Homo sapiens
caggacctcaggtgag

SEQ ID NO: 3699138 - DNA, 14 bp, Homo sapiens
caggactcccacct

SEQ ID NO: 3699139 - DNA, 16 bp, Homo sapiens
caggactccctcctca

SEQ ID NO: 3699140 - DNA, 21 bp, Homo sapiens
caggactccctcctcacctct

SEQ ID NO: 3699141 - DNA, 22 bp, Homo sapiens
caggactccctcctcacctctg

SEQ ID NO: 3699142 - DNA, 18 bp, Homo sapiens
caggactctgaaaaggaa

SEQ ID NO: 3699143 - DNA, 11 bp, Homo sapiens
caggagaacca

SEQ ID NO: 3699144 - DNA, 23 bp, Homo sapiens
caggagataattgtttcattcat

SEQ ID NO: 3699145 - DNA, 16 bp, Homo sapiens
caggagcaccctgtct

SEQ ID NO: 3699146 - DNA, 22 bp, Homo sapiens
caggagctcttcaggcctccct

SEQ ID NO: 3699147 - DNA, 14 bp, Homo sapiens
caggagctgggatc

SEQ ID NO: 3699148 - DNA, 22 bp, Homo sapiens
caggagctgggatcctaagggc

SEQ ID NO: 3699149 - DNA, 23 bp, Homo sapiens
caggagctgggcagaaggccaag

SEQ ID NO: 3699150 - DNA, 19 bp, Homo sapiens
caggaggatcacttgagtc

SEQ ID NO: 3699151 - DNA, 23 bp, Homo sapiens
caggaggcaggcatggccctggg

SEQ ID NO: 3699152 - DNA, 14 bp, Homo sapiens
caggagtccacttt

SEQ ID NO: 3699153 - DNA, 21 bp, Homo sapiens
caggagtttgagaccaacctg

SEQ ID NO: 3699154 - DNA, 21 bp, Homo sapiens
caggagtttgagaccagcctg

SEQ ID NO: 3699155 - DNA, 19 bp, Homo sapiens
caggatagagactggaaca

SEQ ID NO: 3699156 - DNA, 18 bp, Homo sapiens
caggatatttactattac

SEQ ID NO: 3699157 - DNA, 18 bp, Homo sapiens
caggatgtaggggttaac

SEQ ID NO: 3699158 - DNA, 14 bp, Homo sapiens
caggcacctcttcc

SEQ ID NO: 3699159 - DNA, 15 bp, Homo sapiens
caggcacctcttcct

SEQ ID NO: 3699160 - DNA, 14 bp, Homo sapiens
caggcactgcaaac

SEQ ID NO: 3699161 - DNA, 18 bp, Homo sapiens
caggcagatccaggacta

SEQ ID NO: 3699162 - DNA, 16 bp, Homo sapiens
caggcagatctgtgcc

SEQ ID NO: 3699163 - DNA, 19 bp, Homo sapiens
caggcagatctgtgcccca

SEQ ID NO: 3699164 - DNA, 16 bp, Homo sapiens
caggcagctggcagga

SEQ ID NO: 3699165 - DNA, 18 bp, Homo sapiens
caggcagctggcaggagt

SEQ ID NO: 3699166 - DNA, 18 bp, Homo sapiens
caggcaggctcccaggga

SEQ ID NO: 3699167 - DNA, 23 bp, Homo sapiens
caggcatgggtgcaaggaaaatt

SEQ ID NO: 3699168 - DNA, 14 bp, Homo sapiens
caggccccaggaag

SEQ ID NO: 3699169 - DNA, 15 bp, Homo sapiens
caggcccccaagcct

SEQ ID NO: 3699170 - DNA, 17 bp, Homo sapiens
caggcccccaagcctgc

SEQ ID NO: 3699171 - DNA, 18 bp, Homo sapiens
caggcccccaagcctgca

SEQ ID NO: 3699172 - DNA, 12 bp, Homo sapiens
caggcctccctc

SEQ ID NO: 3699173 - DNA, 17 bp, Homo sapiens
caggcctccctctctct

SEQ ID NO: 3699174 - DNA, 18 bp, Homo sapiens
caggcctccctctctctt

SEQ ID NO: 3699175 - DNA, 13 bp, Homo sapiens
caggcggggctcc

SEQ ID NO: 3699176 - DNA, 14 bp, Homo sapiens
caggcggggctcct

SEQ ID NO: 3699177 - DNA, 23 bp, Homo sapiens
caggcggggctcctcctgaagga

SEQ ID NO: 3699178 - DNA, 23 bp, Homo sapiens
caggctccaatggggcggggctt

SEQ ID NO: 3699179 - DNA, 22 bp, Homo sapiens
caggctcttagcagcttccaga

SEQ ID NO: 3699180 - DNA, 14 bp, Homo sapiens
caggctgaaaacaa

SEQ ID NO: 3699181 - DNA, 14 bp, Homo sapiens
caggctgcccagag

SEQ ID NO: 3699182 - DNA, 15 bp, Homo sapiens
caggctgcccagagc

SEQ ID NO: 3699183 - DNA, 18 bp, Homo sapiens
caggctggagtgcagtga

SEQ ID NO: 3699184 - DNA, 12 bp, Homo sapiens
caggctggccag

SEQ ID NO: 3699185 - DNA, 20 bp, Homo sapiens
cagggaaaatgcagcaggga

SEQ ID NO: 3699186 - DNA, 19 bp, Homo sapiens
cagggaacattggagctga

SEQ ID NO: 3699187 - DNA, 23 bp, Homo sapiens
cagggaagccccacatgtccagc

SEQ ID NO: 3699188 - DNA, 17 bp, Homo sapiens
cagggaagctggccgag

SEQ ID NO: 3699189 - DNA, 16 bp, Homo sapiens
cagggaagtccccagg

SEQ ID NO: 3699190 - DNA, 18 bp, Homo sapiens
cagggacagaggccccag

SEQ ID NO: 3699191 - DNA, 14 bp, Homo sapiens
cagggacccctgcc

SEQ ID NO: 3699192 - DNA, 21 bp, Homo sapiens
cagggagacggtttccaggga

SEQ ID NO: 3699193 - DNA, 13 bp, Homo sapiens
cagggagcggaaa

SEQ ID NO: 3699194 - DNA, 16 bp, Homo sapiens
cagggagggcttctgc

SEQ ID NO: 3699195 - DNA, 16 bp, Homo sapiens
cagggaggggccggcc

SEQ ID NO: 3699196 - DNA, 14 bp, Homo sapiens
cagggatgccctgg

SEQ ID NO: 3699197 - DNA, 22 bp, Homo sapiens
cagggatgccctggaggtggct

SEQ ID NO: 3699198 - DNA, 18 bp, Homo sapiens
cagggattaacctctgca

SEQ ID NO: 3699199 - DNA, 19 bp, Homo sapiens
cagggattaacctctgcac

SEQ ID NO: 3699200 - DNA, 14 bp, Homo sapiens
cagggcaaggcccc

SEQ ID NO: 3699201 - DNA, 17 bp, Homo sapiens
cagggccatggctcagg

SEQ ID NO: 3699202 - DNA, 14 bp, Homo sapiens
ccaagctccttggg

SEQ ID NO: 3699203 - DNA, 15 bp, Homo sapiens
ccaagctccttggga

SEQ ID NO: 3699204 - DNA, 11 bp, Homo sapiens
ccaagctgtgc

SEQ ID NO: 3699205 - DNA, 18 bp, Homo sapiens
ccaagctgttagttgctg

SEQ ID NO: 3699206 - DNA, 16 bp, Homo sapiens
ccaagcttagtcctgg

SEQ ID NO: 3699207 - DNA, 19 bp, Homo sapiens
ccaaggccagagtggcctg

SEQ ID NO: 3699208 - DNA, 13 bp, Homo sapiens
ccaaggccaggtt

SEQ ID NO: 3699209 - DNA, 20 bp, Homo sapiens
ccaaggttttataaggctga

SEQ ID NO: 3699210 - DNA, 21 bp, Homo sapiens
ccaaggttttataaggctgat

SEQ ID NO: 3699211 - DNA, 19 bp, Homo sapiens
ccaagtacttaactatctg

SEQ ID NO: 3699212 - DNA, 22 bp, Homo sapiens
ccaagtagaatctcagttgatt

SEQ ID NO: 3699213 - DNA, 14 bp, Homo sapiens
ccaatcccagttct

SEQ ID NO: 3699214 - DNA, 18 bp, Homo sapiens
ccaatcccagttcttcct

SEQ ID NO: 3699215 - DNA, 19 bp, Homo sapiens
ccaatggcccggcccctcc

SEQ ID NO: 3699216 - DNA, 12 bp, Homo sapiens
ccaatggggcgg

SEQ ID NO: 3699217 - DNA, 16 bp, Homo sapiens
ccaatggggcggggct

SEQ ID NO: 3699218 - DNA, 11 bp, Homo sapiens
ccaattcttac

SEQ ID NO: 3699219 - DNA, 19 bp, Homo sapiens
ccaattcttacaaacatgt

SEQ ID NO: 3699220 - DNA, 18 bp, Homo sapiens
ccacaaaggagagctagc

SEQ ID NO: 3699221 - DNA, 15 bp, Homo sapiens
ccacaactattttca

SEQ ID NO: 3699222 - DNA, 16 bp, Homo sapiens
ccacaagcctgagaac

SEQ ID NO: 3699223 - DNA, 23 bp, Homo sapiens
ccacaagcctgagaactgaattt

SEQ ID NO: 3699224 - DNA, 20 bp, Homo sapiens
ccacaatctggcttagtgcc

SEQ ID NO: 3699225 - DNA, 22 bp, Homo sapiens
ccacacaaggatagatgctggc

SEQ ID NO: 3699226 - DNA, 18 bp, Homo sapiens
ccacacctcagttccctt

SEQ ID NO: 3699227 - DNA, 22 bp, Homo sapiens
ccacacctcagttcccttggcc

SEQ ID NO: 3699228 - DNA, 23 bp, Homo sapiens
ccacactaacctgggttcccttt

SEQ ID NO: 3699229 - DNA, 22 bp, Homo sapiens
ccacagccagcacctggcatcg

SEQ ID NO: 3699230 - DNA, 22 bp, Homo sapiens
ccacagccccttaagggaaagg

SEQ ID NO: 3699231 - DNA, 14 bp, Homo sapiens
ccacagccctgaga

SEQ ID NO: 3699232 - DNA, 17 bp, Homo sapiens
ccacagcttcccctctc

SEQ ID NO: 3699233 - DNA, 18 bp, Homo sapiens
ccacatggcggagagttt

SEQ ID NO: 3699234 - DNA, 15 bp, Homo sapiens
ccaccacagccagca

SEQ ID NO: 3699235 - DNA, 21 bp, Homo sapiens
ccaccaggccacctccccagc

SEQ ID NO: 3699236 - DNA, 20 bp, Homo sapiens
ccaccaggtgcctttcaaat

SEQ ID NO: 3699237 - DNA, 16 bp, Homo sapiens
ccaccatgcctcacta

SEQ ID NO: 3699238 - DNA, 14 bp, Homo sapiens
ccacccaggaggga

SEQ ID NO: 3699239 - DNA, 23 bp, Homo sapiens
ccaccccatgtcaccggatcctg

SEQ ID NO: 3699240 - DNA, 19 bp, Homo sapiens
ccacccccttctctgctcc

SEQ ID NO: 3699241 - DNA, 19 bp, Homo sapiens
ccacccctcaacacctctg

SEQ ID NO: 3699242 - DNA, 17 bp, Homo sapiens
ccacccctgggggctct

SEQ ID NO: 3699243 - DNA, 16 bp, Homo sapiens
ccaccccttcctcagc

SEQ ID NO: 3699244 - DNA, 20 bp, Homo sapiens
ccaccccttcctcagcctgg

SEQ ID NO: 3699245 - DNA, 13 bp, Homo sapiens
ccaccctgcccct

SEQ ID NO: 3699246 - DNA, 15 bp, Homo sapiens
ccaccctgctgctgg

SEQ ID NO: 3699247 - DNA, 13 bp, Homo sapiens
ccacccttggcct

SEQ ID NO: 3699248 - DNA, 17 bp, Homo sapiens
ccacccttggcctgtct

SEQ ID NO: 3699249 - DNA, 19 bp, Homo sapiens
ccacccttggcctgtctca

SEQ ID NO: 3699250 - DNA, 23 bp, Homo sapiens
ccacctgccagcggtttcctggt

SEQ ID NO: 3699251 - DNA, 14 bp, Homo sapiens
ccacctgcccatca

SEQ ID NO: 3699252 - DNA, 15 bp, Homo sapiens
ccacctgcccatcac

SEQ ID NO: 3699253 - DNA, 15 bp, Homo sapiens
ccacgcccgtcctgc

SEQ ID NO: 3699254 - DNA, 18 bp, Homo sapiens
ccacgcccgtcctgcctg

SEQ ID NO: 3699255 - DNA, 19 bp, Homo sapiens
ccacgcccgtcctgcctgt

SEQ ID NO: 3699256 - DNA, 21 bp, Homo sapiens
ccacgcccgtcctgcctgtgg

SEQ ID NO: 3699257 - DNA, 23 bp, Homo sapiens
ccacgcccgtcctgcctgtggcg

SEQ ID NO: 3699258 - DNA, 14 bp, Homo sapiens
ccacggccaccact

SEQ ID NO: 3699259 - DNA, 22 bp, Homo sapiens
ccacgggacatcacagggtggg

SEQ ID NO: 3699260 - DNA, 21 bp, Homo sapiens
ccacgttggagaagcccgtgt

SEQ ID NO: 3699261 - DNA, 14 bp, Homo sapiens
ccactaagcagagg

SEQ ID NO: 3699262 - DNA, 21 bp, Homo sapiens
ccactaagcagaggaggggcc

SEQ ID NO: 3699263 - DNA, 22 bp, Homo sapiens
ccactaagcagaggaggggccg

SEQ ID NO: 3699264 - DNA, 19 bp, Homo sapiens
ccactacctcctttcctat

SEQ ID NO: 3699265 - DNA, 17 bp, Homo sapiens
ccactccgagaggtggg

SEQ ID NO: 3699266 - DNA, 23 bp, Homo sapiens
ccactccgagaggtgggccagtc

SEQ ID NO: 3699267 - DNA, 18 bp, Homo sapiens
ccactcgtgcatccctga

SEQ ID NO: 3699268 - DNA, 18 bp, Homo sapiens
ccactctaccctcccacc

SEQ ID NO: 3699269 - DNA, 14 bp, Homo sapiens
ccactctccccaca

SEQ ID NO: 3699270 - DNA, 16 bp, Homo sapiens
ccactctccccacact

SEQ ID NO: 3699271 - DNA, 14 bp, Homo sapiens
ccactctgcttctc

SEQ ID NO: 3699272 - DNA, 15 bp, Homo sapiens
ccactctgtggccag

SEQ ID NO: 3699273 - DNA, 17 bp, Homo sapiens
ccactctgtggccagcc

SEQ ID NO: 3699274 - DNA, 18 bp, Homo sapiens
ccactctgtggccagcct

SEQ ID NO: 3699275 - DNA, 18 bp, Homo sapiens
ccactgcactccagcctg

SEQ ID NO: 3699276 - DNA, 18 bp, Homo sapiens
ccactgcataccaacctg

SEQ ID NO: 3699277 - DNA, 21 bp, Homo sapiens
ccactgcatcgtttcatcttc

SEQ ID NO: 3699278 - DNA, 16 bp, Homo sapiens
ccactgccttcgcttc

SEQ ID NO: 3699279 - DNA, 22 bp, Homo sapiens
ccactgccttcgcttcttgcct

SEQ ID NO: 3699280 - DNA, 23 bp, Homo sapiens
ccactgcgggagctctgtatggt

SEQ ID NO: 3699281 - DNA, 11 bp, Homo sapiens
ccactggggaa

SEQ ID NO: 3699282 - DNA, 22 bp, Homo sapiens
ccactggggaaataacagctgt

SEQ ID NO: 3699283 - DNA, 15 bp, Homo sapiens
ccactgtcctgggcc

SEQ ID NO: 3699284 - DNA, 19 bp, Homo sapiens
ccactgtcctgggcctgca

SEQ ID NO: 3699285 - DNA, 14 bp, Homo sapiens
ccactgtgaagaga

SEQ ID NO: 3699286 - DNA, 15 bp, Homo sapiens
ccactgtgctttcag

SEQ ID NO: 3699287 - DNA, 16 bp, Homo sapiens
ccacttattttacatt

SEQ ID NO: 3699288 - DNA, 14 bp, Homo sapiens
ccacttcagctgac

SEQ ID NO: 3699289 - DNA, 16 bp, Homo sapiens
ccacttgcctcttcct

SEQ ID NO: 3699290 - DNA, 19 bp, Homo sapiens
ccacttgcctcttccttga

SEQ ID NO: 3699291 - DNA, 22 bp, Homo sapiens
ccacttgcctcttccttgaaga

SEQ ID NO: 3699292 - DNA, 14 bp, Homo sapiens
ccagaaaggagact

SEQ ID NO: 3699293 - DNA, 19 bp, Homo sapiens
ccagaacacactccatcag

SEQ ID NO: 3699294 - DNA, 20 bp, Homo sapiens
ccagaagcctctggctagag

SEQ ID NO: 3699295 - DNA, 15 bp, Homo sapiens
ccagacacaggccct

SEQ ID NO: 3699296 - DNA, 19 bp, Homo sapiens
ccagacacaggccctccct

SEQ ID NO: 3699297 - DNA, 14 bp, Homo sapiens
ccagacacccagga

SEQ ID NO: 3699298 - DNA, 16 bp, Homo sapiens
ccagacacccaggact

SEQ ID NO: 3699299 - DNA, 22 bp, Homo sapiens
ccagacagcaaggtgtggaggc

SEQ ID NO: 3699300 - DNA, 15 bp, Homo sapiens
ccagacctgatcctg

SEQ ID NO: 3699301 - DNA, 16 bp, Homo sapiens
ccagacctgatcctgg

SEQ ID NO: 3699302 - DNA, 18 bp, Homo sapiens
ccagacctgatcctggag

SEQ ID NO: 3699303 - DNA, 19 bp, Homo sapiens
ccagacctgatcctggagg

SEQ ID NO: 3699304 - DNA, 20 bp, Homo sapiens
ccagacctgatcctggaggc

SEQ ID NO: 3699305 - DNA, 23 bp, Homo sapiens
ccagacctgatcctggaggccca

SEQ ID NO: 3699306 - DNA, 12 bp, Homo sapiens
ccagagaagcta

SEQ ID NO: 3699307 - DNA, 20 bp, Homo sapiens
ccagagagaaatcaggcctg

SEQ ID NO: 3699308 - DNA, 21 bp, Homo sapiens
ccagagagaaatcaggcctga

SEQ ID NO: 3699309 - DNA, 13 bp, Homo sapiens
ccagagatccaaa

SEQ ID NO: 3699310 - DNA, 20 bp, Homo sapiens
ccagagatccaaaagaagcc

SEQ ID NO: 3699311 - DNA, 11 bp, Homo sapiens
ccagagccagg

SEQ ID NO: 3699312 - DNA, 12 bp, Homo sapiens
ccagagccaggg

SEQ ID NO: 3699313 - DNA, 14 bp, Homo sapiens
ccagagcccagctc

SEQ ID NO: 3699314 - DNA, 16 bp, Homo sapiens
ccagagcccagctcca

SEQ ID NO: 3699315 - DNA, 17 bp, Homo sapiens
ccagagcccagctccaa

SEQ ID NO: 3699316 - DNA, 18 bp, Homo sapiens
ccagagcccagctccaag

SEQ ID NO: 3699317 - DNA, 22 bp, Homo sapiens
ccagagctgtttatggcctcag

SEQ ID NO: 3699318 - DNA, 15 bp, Homo sapiens
cccacctgccagcgg

SEQ ID NO: 3699319 - DNA, 16 bp, Homo sapiens
cccactcaagccaagc

SEQ ID NO: 3699320 - DNA, 22 bp, Homo sapiens
cccactgtcctgggcctgcaga

SEQ ID NO: 3699321 - DNA, 17 bp, Homo sapiens
cccagaaaggagactag

SEQ ID NO: 3699322 - DNA, 13 bp, Homo sapiens
cccagactcagac

SEQ ID NO: 3699323 - DNA, 20 bp, Homo sapiens
cccagactcagacattggca

SEQ ID NO: 3699324 - DNA, 13 bp, Homo sapiens
cccagagaagcca

SEQ ID NO: 3699325 - DNA, 21 bp, Homo sapiens
cccagagacatacttgaaggg

SEQ ID NO: 3699326 - DNA, 22 bp, Homo sapiens
cccagagacatacttgaagggc

SEQ ID NO: 3699327 - DNA, 16 bp, Homo sapiens
cccagagcccagctcc

SEQ ID NO: 3699328 - DNA, 20 bp, Homo sapiens
cccagagctgtttatggcct

SEQ ID NO: 3699329 - DNA, 15 bp, Homo sapiens
cccagagtcatctga

SEQ ID NO: 3699330 - DNA, 18 bp, Homo sapiens
cccagcattccagcccct

SEQ ID NO: 3699331 - DNA, 11 bp, Homo sapiens
cccagcccaga

SEQ ID NO: 3699332 - DNA, 13 bp, Homo sapiens
cccagcccagaca

SEQ ID NO: 3699333 - DNA, 12 bp, Homo sapiens
cccagcccagag

SEQ ID NO: 3699334 - DNA, 14 bp, Homo sapiens
cccagcccagagac

SEQ ID NO: 3699335 - DNA, 15 bp, Homo sapiens
cccagcccagagaca

SEQ ID NO: 3699336 - DNA, 16 bp, Homo sapiens
cccagcccagagacat

SEQ ID NO: 3699337 - DNA, 22 bp, Homo sapiens
cccagcttaaaggggctagagt

SEQ ID NO: 3699338 - DNA, 14 bp, Homo sapiens
cccaggaccagctc

SEQ ID NO: 3699339 - DNA, 20 bp, Homo sapiens
cccaggaccagctcaggaca

SEQ ID NO: 3699340 - DNA, 14 bp, Homo sapiens
cccaggagggaggg

SEQ ID NO: 3699341 - DNA, 12 bp, Homo sapiens
cccaggcagctg

SEQ ID NO: 3699342 - DNA, 18 bp, Homo sapiens
cccaggcagctggcagga

SEQ ID NO: 3699343 - DNA, 11 bp, Homo sapiens
cccaggcaggg

SEQ ID NO: 3699344 - DNA, 18 bp, Homo sapiens
cccaggctgcccagagct

SEQ ID NO: 3699345 - DNA, 21 bp, Homo sapiens
cccaggctgcccagagctgct

SEQ ID NO: 3699346 - DNA, 18 bp, Homo sapiens
cccagggacacctgggag

SEQ ID NO: 3699347 - DNA, 13 bp, Homo sapiens
cccagggcccaga

SEQ ID NO: 3699348 - DNA, 15 bp, Homo sapiens
cccagggcccagagc

SEQ ID NO: 3699349 - DNA, 15 bp, Homo sapiens
cccagggctcctgca

SEQ ID NO: 3699350 - DNA, 23 bp, Homo sapiens
cccagggtcttccctacctcagg

SEQ ID NO: 3699351 - DNA, 23 bp, Homo sapiens
cccagtagggtttgacatttcat

SEQ ID NO: 3699352 - DNA, 23 bp, Homo sapiens
cccagtccaaatgtcctccagaa

SEQ ID NO: 3699353 - DNA, 11 bp, Homo sapiens
cccagtgcaga

SEQ ID NO: 3699354 - DNA, 19 bp, Homo sapiens
cccagtgcatggtggccag

SEQ ID NO: 3699355 - DNA, 14 bp, Homo sapiens
cccagtgcccccac

SEQ ID NO: 3699356 - DNA, 17 bp, Homo sapiens
cccagtgccgagaagga

SEQ ID NO: 3699357 - DNA, 14 bp, Homo sapiens
cccagttagctctc

SEQ ID NO: 3699358 - DNA, 15 bp, Homo sapiens
cccagttcttcctgc

SEQ ID NO: 3699359 - DNA, 21 bp, Homo sapiens
cccatcacagggttgggccca

SEQ ID NO: 3699360 - DNA, 18 bp, Homo sapiens
cccatcagctccagctgc

SEQ ID NO: 3699361 - DNA, 16 bp, Homo sapiens
cccatccccgcagtgt

SEQ ID NO: 3699362 - DNA, 14 bp, Homo sapiens
cccatcctccagca

SEQ ID NO: 3699363 - DNA, 16 bp, Homo sapiens
cccatcctccagcagg

SEQ ID NO: 3699364 - DNA, 19 bp, Homo sapiens
cccatcgctggaaaacagc

SEQ ID NO: 3699365 - DNA, 23 bp, Homo sapiens
cccatctcaggccagagccaagg

SEQ ID NO: 3699366 - DNA, 19 bp, Homo sapiens
cccatctctacaaaaagca

SEQ ID NO: 3699367 - DNA, 19 bp, Homo sapiens
cccatctgtagtaatttat

SEQ ID NO: 3699368 - DNA, 15 bp, Homo sapiens
cccatgatccctgtg

SEQ ID NO: 3699369 - DNA, 18 bp, Homo sapiens
cccatgcaagcagaggac

SEQ ID NO: 3699370 - DNA, 19 bp, Homo sapiens
cccatgcactgtgaaggac

SEQ ID NO: 3699371 - DNA, 15 bp, Homo sapiens
cccatgcccacctgc

SEQ ID NO: 3699372 - DNA, 19 bp, Homo sapiens
cccatgcctgtccagcctg

SEQ ID NO: 3699373 - DNA, 20 bp, Homo sapiens
cccatgcttacgtgatcctc

SEQ ID NO: 3699374 - DNA, 13 bp, Homo sapiens
cccattcctgaag

SEQ ID NO: 3699375 - DNA, 18 bp, Homo sapiens
cccattcctgaagaacca

SEQ ID NO: 3699376 - DNA, 12 bp, Homo sapiens
cccattggcttt

SEQ ID NO: 3699377 - DNA, 14 bp, Homo sapiens
cccattgtccctct

SEQ ID NO: 3699378 - DNA, 13 bp, Homo sapiens
ccccaacccccac

SEQ ID NO: 3699379 - DNA, 22 bp, Homo sapiens
ccccaacccgtgcccctgggat

SEQ ID NO: 3699380 - DNA, 14 bp, Homo sapiens
ccccacacctcagt

SEQ ID NO: 3699381 - DNA, 16 bp, Homo sapiens
ccccacacctcagttc

SEQ ID NO: 3699382 - DNA, 22 bp, Homo sapiens
ccccacacttgttccagctctt

SEQ ID NO: 3699383 - DNA, 23 bp, Homo sapiens
ccccacacttgttccagctcttt

SEQ ID NO: 3699384 - DNA, 13 bp, Homo sapiens
ccccacccaggag

SEQ ID NO: 3699385 - DNA, 14 bp, Homo sapiens
ccccacccctccag

SEQ ID NO: 3699386 - DNA, 20 bp, Homo sapiens
ccccaccctggtgggccaac

SEQ ID NO: 3699387 - DNA, 12 bp, Homo sapiens
ccccactctccc

SEQ ID NO: 3699388 - DNA, 14 bp, Homo sapiens
ccccactgtatcta

SEQ ID NO: 3699389 - DNA, 14 bp, Homo sapiens
ccccacttgcctct

SEQ ID NO: 3699390 - DNA, 15 bp, Homo sapiens
ccccacttgcctctt

SEQ ID NO: 3699391 - DNA, 16 bp, Homo sapiens
ccccacttgcctcttc

SEQ ID NO: 3699392 - DNA, 15 bp, Homo sapiens
ccccagcccagacag

SEQ ID NO: 3699393 - DNA, 16 bp, Homo sapiens
ccccagcccagacagc

SEQ ID NO: 3699394 - DNA, 13 bp, Homo sapiens
ccccagcccagag

SEQ ID NO: 3699395 - DNA, 15 bp, Homo sapiens
ccccagcccagagac

SEQ ID NO: 3699396 - DNA, 13 bp, Homo sapiens
ccccagcctccct

SEQ ID NO: 3699397 - DNA, 15 bp, Homo sapiens
ccccagcctccctga

SEQ ID NO: 3699398 - DNA, 23 bp, Homo sapiens
ccccagccttggtgggggagcct

SEQ ID NO: 3699399 - DNA, 19 bp, Homo sapiens
ccccagctaagaacctgga

SEQ ID NO: 3699400 - DNA, 21 bp, Homo sapiens
ccccagctaagaacctggaac

SEQ ID NO: 3699401 - DNA, 13 bp, Homo sapiens
ccccaggaccagc

SEQ ID NO: 3699402 - DNA, 16 bp, Homo sapiens
ccccaggaccagctca

SEQ ID NO: 3699403 - DNA, 19 bp, Homo sapiens
ccccaggaccagctcagga

SEQ ID NO: 3699404 - DNA, 21 bp, Homo sapiens
ccccaggaccagctcaggaca

SEQ ID NO: 3699405 - DNA, 19 bp, Homo sapiens
ccccaggccccaggaagcc

SEQ ID NO: 3699406 - DNA, 23 bp, Homo sapiens
ccccaggcctgaaagaggctgag

SEQ ID NO: 3699407 - DNA, 16 bp, Homo sapiens
ccccaggctgcccaga

SEQ ID NO: 3699408 - DNA, 18 bp, Homo sapiens
ccccaggctgcccagagc

SEQ ID NO: 3699409 - DNA, 20 bp, Homo sapiens
ccccaggctgcccagagctg

SEQ ID NO: 3699410 - DNA, 22 bp, Homo sapiens
ccccagggggtctcacccatgc

SEQ ID NO: 3699411 - DNA, 17 bp, Homo sapiens
ccccaggggtcccagcc

SEQ ID NO: 3699412 - DNA, 19 bp, Homo sapiens
ccccaggggtcccagccac

SEQ ID NO: 3699413 - DNA, 22 bp, Homo sapiens
ccccaggggtcccagccacccc

SEQ ID NO: 3699414 - DNA, 16 bp, Homo sapiens
ccccagggtcttccct

SEQ ID NO: 3699415 - DNA, 21 bp, Homo sapiens
ccccaggtccagctctggagg

SEQ ID NO: 3699416 - DNA, 12 bp, Homo sapiens
ccccatcctcca

SEQ ID NO: 3699417 - DNA, 13 bp, Homo sapiens
ccccatctcaggc

SEQ ID NO: 3699418 - DNA, 13 bp, Homo sapiens
ccccatgcactgt

SEQ ID NO: 3699419 - DNA, 13 bp, Homo sapiens
ccccatgccaaag

SEQ ID NO: 3699420 - DNA, 22 bp, Homo sapiens
ccccatgccaaagctagggtgg

SEQ ID NO: 3699421 - DNA, 17 bp, Homo sapiens
ccccatgcctgtccagc

SEQ ID NO: 3699422 - DNA, 19 bp, Homo sapiens
ccccatgcctgtccagcct

SEQ ID NO: 3699423 - DNA, 22 bp, Homo sapiens
cccccacttgcctcttccttga

SEQ ID NO: 3699424 - DNA, 17 bp, Homo sapiens
cccccgtggggcaggga

SEQ ID NO: 3699425 - DNA, 19 bp, Homo sapiens
ccccctccgccctgccact

SEQ ID NO: 3699426 - DNA, 16 bp, Homo sapiens
cccccttctctgctcc

SEQ ID NO: 3699427 - DNA, 17 bp, Homo sapiens
cccccttctctgctcca

SEQ ID NO: 3699428 - DNA, 14 bp, Homo sapiens
ccccgcagacacct

SEQ ID NO: 3699429 - DNA, 13 bp, Homo sapiens
ccccgctgctgtg

SEQ ID NO: 3699430 - DNA, 17 bp, Homo sapiens
ccccgggctctctgctg

SEQ ID NO: 3699431 - DNA, 20 bp, Homo sapiens
ccccggtcacctagcaagct

SEQ ID NO: 3699432 - DNA, 22 bp, Homo sapiens
ccccgtctgaccccagcccaga

SEQ ID NO: 3699433 - DNA, 16 bp, Homo sapiens
cccctcaacacctctg

SEQ ID NO: 3699434 - DNA, 20 bp, Homo sapiens
cccctcatctctctgcccaa

SEQ ID NO: 3699435 - DNA, 18 bp, Homo sapiens
cctcagctgcctcacttc

SEQ ID NO: 3699436 - DNA, 11 bp, Homo sapiens
cctcaggcagg

SEQ ID NO: 3699437 - DNA, 13 bp, Homo sapiens
cctcaggcaggaa

SEQ ID NO: 3699438 - DNA, 15 bp, Homo sapiens
cctcaggcaggaagg

SEQ ID NO: 3699439 - DNA, 16 bp, Homo sapiens
cctcaggtgagaagca

SEQ ID NO: 3699440 - DNA, 16 bp, Homo sapiens
cctcagttcccttggc

SEQ ID NO: 3699441 - DNA, 19 bp, Homo sapiens
cctcagttcccttggcctc

SEQ ID NO: 3699442 - DNA, 22 bp, Homo sapiens
cctcagttcccttggcctcaga

SEQ ID NO: 3699443 - DNA, 19 bp, Homo sapiens
cctcatctctctgcccaac

SEQ ID NO: 3699444 - DNA, 13 bp, Homo sapiens
cctcatggcggga

SEQ ID NO: 3699445 - DNA, 16 bp, Homo sapiens
cctcatgtggctggaa

SEQ ID NO: 3699446 - DNA, 17 bp, Homo sapiens
cctcatgtggctggaag

SEQ ID NO: 3699447 - DNA, 17 bp, Homo sapiens
cctcatttggggtagct

SEQ ID NO: 3699448 - DNA, 22 bp, Homo sapiens
cctccagaagcctctggctaga

SEQ ID NO: 3699449 - DNA, 21 bp, Homo sapiens
cctccagcctggtggcccagc

SEQ ID NO: 3699450 - DNA, 15 bp, Homo sapiens
cctccaggtgcagag

SEQ ID NO: 3699451 - DNA, 18 bp, Homo sapiens
cctcccaaagaggcccgc

SEQ ID NO: 3699452 - DNA, 14 bp, Homo sapiens
cctcccaagctgtg

SEQ ID NO: 3699453 - DNA, 15 bp, Homo sapiens
cctcccaagctgtgc

SEQ ID NO: 3699454 - DNA, 16 bp, Homo sapiens
cctcccaagctgtgct

SEQ ID NO: 3699455 - DNA, 18 bp, Homo sapiens
cctcccacacccaaagct

SEQ ID NO: 3699456 - DNA, 22 bp, Homo sapiens
cctcccacacccaaagctgagc

SEQ ID NO: 3699457 - DNA, 12 bp, Homo sapiens
cctcccaccccc

SEQ ID NO: 3699458 - DNA, 21 bp, Homo sapiens
cctcccacccccttctctgct

SEQ ID NO: 3699459 - DNA, 18 bp, Homo sapiens
cctcccccaacccccacc

SEQ ID NO: 3699460 - DNA, 16 bp, Homo sapiens
cctcccccccatgcac

SEQ ID NO: 3699461 - DNA, 17 bp, Homo sapiens
cctcccccccatgcact

SEQ ID NO: 3699462 - DNA, 14 bp, Homo sapiens
cctcccctgccacc

SEQ ID NO: 3699463 - DNA, 20 bp, Homo sapiens
cctccctgaaaatgtttttc

SEQ ID NO: 3699464 - DNA, 14 bp, Homo sapiens
cctccctgcatctg

SEQ ID NO: 3699465 - DNA, 13 bp, Homo sapiens
cctccctggctcc

SEQ ID NO: 3699466 - DNA, 15 bp, Homo sapiens
cctccctggctccca

SEQ ID NO: 3699467 - DNA, 16 bp, Homo sapiens
cctccctggctcccat

SEQ ID NO: 3699468 - DNA, 19 bp, Homo sapiens
cctccctgggggcgggact

SEQ ID NO: 3699469 - DNA, 20 bp, Homo sapiens
cctccctgttccccagagaa

SEQ ID NO: 3699470 - DNA, 16 bp, Homo sapiens
cctcccttctgctact

SEQ ID NO: 3699471 - DNA, 18 bp, Homo sapiens
cctccctttcctccgcct

SEQ ID NO: 3699472 - DNA, 18 bp, Homo sapiens
cctccgccctgccactca

SEQ ID NO: 3699473 - DNA, 13 bp, Homo sapiens
cctcctcacctct

SEQ ID NO: 3699474 - DNA, 21 bp, Homo sapiens
cctcctcacctctggactggc

SEQ ID NO: 3699475 - DNA, 12 bp, Homo sapiens
cctcctccagcc

SEQ ID NO: 3699476 - DNA, 16 bp, Homo sapiens
cctcctccctgcatct

SEQ ID NO: 3699477 - DNA, 17 bp, Homo sapiens
cctcctccctgcatctg

SEQ ID NO: 3699478 - DNA, 16 bp, Homo sapiens
cctcctgactcatccg

SEQ ID NO: 3699479 - DNA, 13 bp, Homo sapiens
cctcctgctgagc

SEQ ID NO: 3699480 - DNA, 17 bp, Homo sapiens
cctcctgggttcaagag

SEQ ID NO: 3699481 - DNA, 14 bp, Homo sapiens
cctcctgttctgaa

SEQ ID NO: 3699482 - DNA, 19 bp, Homo sapiens
cctccttaggagtggggtt

SEQ ID NO: 3699483 - DNA, 17 bp, Homo sapiens
cctcgggtctccccacc

SEQ ID NO: 3699484 - DNA, 21 bp, Homo sapiens
cctcgggtctccccacctgca

SEQ ID NO: 3699485 - DNA, 18 bp, Homo sapiens
cctcggtgtggagaagcg

SEQ ID NO: 3699486 - DNA, 23 bp, Homo sapiens
cctcgtcccatccagctaccacc

SEQ ID NO: 3699487 - DNA, 14 bp, Homo sapiens
cctctaactggaca

SEQ ID NO: 3699488 - DNA, 17 bp, Homo sapiens
cctctaactggacagcc

SEQ ID NO: 3699489 - DNA, 18 bp, Homo sapiens
cctctaactggacagcct

SEQ ID NO: 3699490 - DNA, 18 bp, Homo sapiens
cctctactttgattctga

SEQ ID NO: 3699491 - DNA, 16 bp, Homo sapiens
cctctccccagcccag

SEQ ID NO: 3699492 - DNA, 18 bp, Homo sapiens
cctctccccagcccagag

SEQ ID NO: 3699493 - DNA, 20 bp, Homo sapiens
cctctccccagcccagagac

SEQ ID NO: 3699494 - DNA, 13 bp, Homo sapiens
cctctccctgcca

SEQ ID NO: 3699495 - DNA, 14 bp, Homo sapiens
cctctccctgccaa

SEQ ID NO: 3699496 - DNA, 20 bp, Homo sapiens
cctctctggtggctgggctg

SEQ ID NO: 3699497 - DNA, 23 bp, Homo sapiens
cctctctggtggctgggctgctc

SEQ ID NO: 3699498 - DNA, 23 bp, Homo sapiens
cctctgccccgccctccttccca

SEQ ID NO: 3699499 - DNA, 14 bp, Homo sapiens
cctctggactggct

SEQ ID NO: 3699500 - DNA, 16 bp, Homo sapiens
cctctggagtggccac

SEQ ID NO: 3699501 - DNA, 17 bp, Homo sapiens
cctctggtcgctcctgc

SEQ ID NO: 3699502 - DNA, 16 bp, Homo sapiens
cctctgtcttctggac

SEQ ID NO: 3699503 - DNA, 14 bp, Homo sapiens
cctctgtgccacgc

SEQ ID NO: 3699504 - DNA, 16 bp, Homo sapiens
cctctgtgctgtgtgt

SEQ ID NO: 3699505 - DNA, 11 bp, Homo sapiens
cctcttcccca

SEQ ID NO: 3699506 - DNA, 17 bp, Homo sapiens
cctcttctgtcccaagt

SEQ ID NO: 3699507 - DNA, 24 bp, Homo sapiens
cctcttgagcagtggctggtccag

SEQ ID NO: 3699508 - DNA, 23 bp, Homo sapiens
cctctttcaagcagtcgtgcctg

SEQ ID NO: 3699509 - DNA, 17 bp, Homo sapiens
cctctttgctttgcttt

SEQ ID NO: 3699510 - DNA, 21 bp, Homo sapiens
cctctttgctttgctttctgc

SEQ ID NO: 3699511 - DNA, 23 bp, Homo sapiens
cctctttttccaacttggctgca

SEQ ID NO: 3699512 - DNA, 15 bp, Homo sapiens
cctgaaacaacttgg

SEQ ID NO: 3699513 - DNA, 19 bp, Homo sapiens
cctgaaagaggctgaggcc

SEQ ID NO: 3699514 - DNA, 22 bp, Homo sapiens
cctgaaagaggctgaggcctgg

SEQ ID NO: 3699515 - DNA, 24 bp, Homo sapiens
cctgaaggaggcggggctctagga

SEQ ID NO: 3699516 - DNA, 16 bp, Homo sapiens
cctgaaggcagggctc

SEQ ID NO: 3699517 - DNA, 17 bp, Homo sapiens
cctgaaggcagggctcc

SEQ ID NO: 3699518 - DNA, 20 bp, Homo sapiens
cctgaagggcctcccagccc

SEQ ID NO: 3699519 - DNA, 20 bp, Homo sapiens
cctgaaggggccatgatggc

SEQ ID NO: 3699520 - DNA, 19 bp, Homo sapiens
cctgaagtaagcaaagact

SEQ ID NO: 3699521 - DNA, 19 bp, Homo sapiens
cctgacaaccactggtctg

SEQ ID NO: 3699522 - DNA, 21 bp, Homo sapiens
cctgaccaagactgagccagc

SEQ ID NO: 3699523 - DNA, 13 bp, Homo sapiens
cctgaccagggca

SEQ ID NO: 3699524 - DNA, 21 bp, Homo sapiens
cctgaccaggggccctacctg

SEQ ID NO: 3699525 - DNA, 13 bp, Homo sapiens
cctgactggtgct

SEQ ID NO: 3699526 - DNA, 13 bp, Homo sapiens
cctgagaactgaa

SEQ ID NO: 3699527 - DNA, 17 bp, Homo sapiens
cctgagctgaccagccg

SEQ ID NO: 3699528 - DNA, 14 bp, Homo sapiens
cctgagctttctgc

SEQ ID NO: 3699529 - DNA, 12 bp, Homo sapiens
cctgaggaagcg

SEQ ID NO: 3699530 - DNA, 15 bp, Homo sapiens
cctgaggctgtggtc

SEQ ID NO: 3699531 - DNA, 16 bp, Homo sapiens
cctgaggctgtggtca

SEQ ID NO: 3699532 - DNA, 17 bp, Homo sapiens
cctgagggtgggctttt

SEQ ID NO: 3699533 - DNA, 15 bp, Homo sapiens
cctgaggtcccctcg

SEQ ID NO: 3699534 - DNA, 20 bp, Homo sapiens
cctgaggtgaaagggagcta

SEQ ID NO: 3699535 - DNA, 18 bp, Homo sapiens
cctgagtcctgagcgaaa

SEQ ID NO: 3699536 - DNA, 14 bp, Homo sapiens
cctgagtggtgcca

SEQ ID NO: 3699537 - DNA, 23 bp, Homo sapiens
cctgatgagggggaattcctgga

SEQ ID NO: 3699538 - DNA, 21 bp, Homo sapiens
cctgattaaggcgtggcttct

SEQ ID NO: 3699539 - DNA, 18 bp, Homo sapiens
cctgcaactcaaggactt

SEQ ID NO: 3699540 - DNA, 16 bp, Homo sapiens
cctgcactccatccag

SEQ ID NO: 3699541 - DNA, 21 bp, Homo sapiens
cctgcactccatccagctaca

SEQ ID NO: 3699542 - DNA, 17 bp, Homo sapiens
cctgcagggccatggct

SEQ ID NO: 3699543 - DNA, 15 bp, Homo sapiens
cctgcagtcatcttg

SEQ ID NO: 3699544 - DNA, 15 bp, Homo sapiens
cctgcataggctcct

SEQ ID NO: 3699545 - DNA, 19 bp, Homo sapiens
cctgcataggctccttcct

SEQ ID NO: 3699546 - DNA, 13 bp, Homo sapiens
cctgccaattgct

SEQ ID NO: 3699547 - DNA, 15 bp, Homo sapiens
cctgccactcactag

SEQ ID NO: 3699548 - DNA, 16 bp, Homo sapiens
cctgccactcactagg

SEQ ID NO: 3699549 - DNA, 12 bp, Homo sapiens
cctgccagctgc

SEQ ID NO: 3699550 - DNA, 18 bp, Homo sapiens
cctgccagctgcactgat

SEQ ID NO: 3699551 - DNA, 16 bp, Homo sapiens
cctgccaggcatggtg

SEQ ID NO: 3699552 - DNA, 14 bp, Homo sapiens
cggacttttctgca

SEQ ID NO: 3699553 - DNA, 23 bp, Homo sapiens
cggagagcgcctgcccctcccag

SEQ ID NO: 3699554 - DNA, 14 bp, Homo sapiens
cggagaggagttca

SEQ ID NO: 3699555 - DNA, 23 bp, Homo sapiens
cggagtcgtggggtgtgctggga

SEQ ID NO: 3699556 - DNA, 15 bp, Homo sapiens
cggatagttgctatt

SEQ ID NO: 3699557 - DNA, 18 bp, Homo sapiens
cggatgctccatttcaat

SEQ ID NO: 3699558 - DNA, 19 bp, Homo sapiens
cggcacagggtctgctctt

SEQ ID NO: 3699559 - DNA, 21 bp, Homo sapiens
cggcaggacaacgaggaagcc

SEQ ID NO: 3699560 - DNA, 15 bp, Homo sapiens
cggcaggggcctgga

SEQ ID NO: 3699561 - DNA, 18 bp, Homo sapiens
cggcaggggcctggagat

SEQ ID NO: 3699562 - DNA, 21 bp, Homo sapiens
cggcatgagactcagtgcaga

SEQ ID NO: 3699563 - DNA, 18 bp, Homo sapiens
cggcatgtttccagcaga

SEQ ID NO: 3699564 - DNA, 12 bp, Homo sapiens
cggccaagaatg

SEQ ID NO: 3699565 - DNA, 12 bp, Homo sapiens
cggccaggcggg

SEQ ID NO: 3699566 - DNA, 17 bp, Homo sapiens
cggccagggagaagctc

SEQ ID NO: 3699567 - DNA, 18 bp, Homo sapiens
cggcccatatccctggtt

SEQ ID NO: 3699568 - DNA, 17 bp, Homo sapiens
cggcccccttcctggcc

SEQ ID NO: 3699569 - DNA, 23 bp, Homo sapiens
cggcccccttcctggcccctcat

SEQ ID NO: 3699570 - DNA, 14 bp, Homo sapiens
cggccgcttggccg

SEQ ID NO: 3699571 - DNA, 17 bp, Homo sapiens
cggcctctgcctttgca

SEQ ID NO: 3699572 - DNA, 15 bp, Homo sapiens
cggcctttggcttca

SEQ ID NO: 3699573 - DNA, 16 bp, Homo sapiens
cggcgtggcccaaggc

SEQ ID NO: 3699574 - DNA, 22 bp, Homo sapiens
cggcgtggcccaaggctggcag

SEQ ID NO: 3699575 - DNA, 13 bp, Homo sapiens
cggctccagagca

SEQ ID NO: 3699576 - DNA, 14 bp, Homo sapiens
cggctccagagcag

SEQ ID NO: 3699577 - DNA, 16 bp, Homo sapiens
cggctccccctggacg

SEQ ID NO: 3699578 - DNA, 16 bp, Homo sapiens
cggctctggtggccac

SEQ ID NO: 3699579 - DNA, 21 bp, Homo sapiens
cggctctggtggccactgagc

SEQ ID NO: 3699580 - DNA, 11 bp, Homo sapiens
cggctgaccat

SEQ ID NO: 3699581 - DNA, 22 bp, Homo sapiens
cggctgaccatgctcatctgct

SEQ ID NO: 3699582 - DNA, 14 bp, Homo sapiens
cggctggcagccca

SEQ ID NO: 3699583 - DNA, 18 bp, Homo sapiens
cggctggggactgctacc

SEQ ID NO: 3699584 - DNA, 19 bp, Homo sapiens
cggctggggactgctacct

SEQ ID NO: 3699585 - DNA, 14 bp, Homo sapiens
cggctgggtctgtg

SEQ ID NO: 3699586 - DNA, 19 bp, Homo sapiens
cgggacatcacagggtggg

SEQ ID NO: 3699587 - DNA, 23 bp, Homo sapiens
cgggacatcacagggtgggcctc

SEQ ID NO: 3699588 - DNA, 22 bp, Homo sapiens
cgggacccagggccctcggtgg

SEQ ID NO: 3699589 - DNA, 17 bp, Homo sapiens
cgggactcctccctggg

SEQ ID NO: 3699590 - DNA, 20 bp, Homo sapiens
cgggactcctccctgggggt

SEQ ID NO: 3699591 - DNA, 13 bp, Homo sapiens
cgggagctctgta

SEQ ID NO: 3699592 - DNA, 22 bp, Homo sapiens
cgggaggcagaggttgcagtgt

SEQ ID NO: 3699593 - DNA, 20 bp, Homo sapiens
cgggaggtcgaggcaggagg

SEQ ID NO: 3699594 - DNA, 14 bp, Homo sapiens
cgggcaccagccag

SEQ ID NO: 3699595 - DNA, 16 bp, Homo sapiens
cgggccctgcctgagg

SEQ ID NO: 3699596 - DNA, 17 bp, Homo sapiens
cgggccctgcctgaggg

SEQ ID NO: 3699597 - DNA, 21 bp, Homo sapiens
cgggcggtcctactgctgtga

SEQ ID NO: 3699598 - DNA, 15 bp, Homo sapiens
cgggctctctgctgt

SEQ ID NO: 3699599 - DNA, 20 bp, Homo sapiens
cggggccatttggccggctc

SEQ ID NO: 3699600 - DNA, 22 bp, Homo sapiens
cggggccatttggccggctctg

SEQ ID NO: 3699601 - DNA, 18 bp, Homo sapiens
cggggcgggccctgcctg

SEQ ID NO: 3699602 - DNA, 17 bp, Homo sapiens
cggggctcctcctgaag

SEQ ID NO: 3699603 - DNA, 16 bp, Homo sapiens
cggggcttctcttggg

SEQ ID NO: 3699604 - DNA, 16 bp, Homo sapiens
cgggtctccccacctg

SEQ ID NO: 3699605 - DNA, 17 bp, Homo sapiens
cgggtctccccacctgc

SEQ ID NO: 3699606 - DNA, 20 bp, Homo sapiens
cgggtggggcttggggctca

SEQ ID NO: 3699607 - DNA, 15 bp, Homo sapiens
cgggtttctctgtgg

SEQ ID NO: 3699608 - DNA, 18 bp, Homo sapiens
cggtcccctccgccaggc

SEQ ID NO: 3699609 - DNA, 20 bp, Homo sapiens
cggtgcccaagccagaggct

SEQ ID NO: 3699610 - DNA, 13 bp, Homo sapiens
cggtgcccacacc

SEQ ID NO: 3699611 - DNA, 20 bp, Homo sapiens
cggtggctcacgcctgtaat

SEQ ID NO: 3699612 - DNA, 16 bp, Homo sapiens
cggtgggactcgtggc

SEQ ID NO: 3699613 - DNA, 12 bp, Homo sapiens
cggtttcctggt

SEQ ID NO: 3699614 - DNA, 11 bp, Homo sapiens
cggtttctcca

SEQ ID NO: 3699615 - DNA, 22 bp, Homo sapiens
cgtagatattggacaaagaacc

SEQ ID NO: 3699616 - DNA, 16 bp, Homo sapiens
cgtatctccctggaga

SEQ ID NO: 3699617 - DNA, 21 bp, Homo sapiens
cgtatctccctggagaagcac

SEQ ID NO: 3699618 - DNA, 19 bp, Homo sapiens
cgtccaattgactgccctc

SEQ ID NO: 3699619 - DNA, 17 bp, Homo sapiens
cgtccagggtttacatt

SEQ ID NO: 3699620 - DNA, 21 bp, Homo sapiens
cgtccaggttcaacccacagc

SEQ ID NO: 3699621 - DNA, 15 bp, Homo sapiens
cgtcctgcctgtggc

SEQ ID NO: 3699622 - DNA, 20 bp, Homo sapiens
cgtctccaggggctgcttcc

SEQ ID NO: 3699623 - DNA, 21 bp, Homo sapiens
cgtctccaggggctgcttcct

SEQ ID NO: 3699624 - DNA, 19 bp, Homo sapiens
cgtctgaccccagcccaga

SEQ ID NO: 3699625 - DNA, 22 bp, Homo sapiens
cgtctgaccccagcccagacag

SEQ ID NO: 3699626 - DNA, 17 bp, Homo sapiens
cgtgaaagtgcattttt

SEQ ID NO: 3699627 - DNA, 22 bp, Homo sapiens
cgtgaaagtgcatttttgtaaa

SEQ ID NO: 3699628 - DNA, 19 bp, Homo sapiens
cgtgagtgtctcttgtcta

SEQ ID NO: 3699629 - DNA, 17 bp, Homo sapiens
cgtgcatccctgagaca

SEQ ID NO: 3699630 - DNA, 22 bp, Homo sapiens
cgtgccaattatagtttgacag

SEQ ID NO: 3699631 - DNA, 14 bp, Homo sapiens
cgtgcccctgggat

SEQ ID NO: 3699632 - DNA, 13 bp, Homo sapiens
cgtgccgagccag

SEQ ID NO: 3699633 - DNA, 12 bp, Homo sapiens
cgtgcctgtgtc

SEQ ID NO: 3699634 - DNA, 14 bp, Homo sapiens
cgtgcctgtgtcca

SEQ ID NO: 3699635 - DNA, 15 bp, Homo sapiens
cgtgcctgtgtccat

SEQ ID NO: 3699636 - DNA, 17 bp, Homo sapiens
cgtgctgacagctgctc

SEQ ID NO: 3699637 - DNA, 20 bp, Homo sapiens
cgtggagggaggccccaggg

SEQ ID NO: 3699638 - DNA, 13 bp, Homo sapiens
cgtggcccaaggc

SEQ ID NO: 3699639 - DNA, 19 bp, Homo sapiens
cgtggcccaaggctggcag

SEQ ID NO: 3699640 - DNA, 15 bp, Homo sapiens
cgtggcctcttgagc

SEQ ID NO: 3699641 - DNA, 23 bp, Homo sapiens
cgtggcctcttgagcagtggctg

SEQ ID NO: 3699642 - DNA, 11 bp, Homo sapiens
cgtggggaggt

SEQ ID NO: 3699643 - DNA, 16 bp, Homo sapiens
cgtgggggggcgtgga

SEQ ID NO: 3699644 - DNA, 15 bp, Homo sapiens
cgtggggtgtgctgg

SEQ ID NO: 3699645 - DNA, 14 bp, Homo sapiens
cgtggtcagagtgc

SEQ ID NO: 3699646 - DNA, 17 bp, Homo sapiens
cgtggtcagagtgccac

SEQ ID NO: 3699647 - DNA, 20 bp, Homo sapiens
cgtgtaaccatggacccaat

SEQ ID NO: 3699648 - DNA, 20 bp, Homo sapiens
cgtgtcctctccctgccaag

SEQ ID NO: 3699649 - DNA, 23 bp, Homo sapiens
cgtgtgagaagtgaatgctggga

SEQ ID NO: 3699650 - DNA, 15 bp, Homo sapiens
cgttagctcctgtgg

SEQ ID NO: 3699651 - DNA, 13 bp, Homo sapiens
cgttcattgctct

SEQ ID NO: 3699652 - DNA, 21 bp, Homo sapiens
cgttcttatttaatctccatt

SEQ ID NO: 3699653 - DNA, 20 bp, Homo sapiens
cgttggcttctccctgggga

SEQ ID NO: 3699654 - DNA, 16 bp, Homo sapiens
cgttttttcctcagtg

SEQ ID NO: 3699655 - DNA, 23 bp, Homo sapiens
ctaaaaatacaaaattagctggg

SEQ ID NO: 3699656 - DNA, 21 bp, Homo sapiens
ctaaaaatctgagaaactcta

SEQ ID NO: 3699657 - DNA, 11 bp, Homo sapiens
ctaaaaccatt

SEQ ID NO: 3699658 - DNA, 23 bp, Homo sapiens
ctaaagaaaaatatcttggccta

SEQ ID NO: 3699659 - DNA, 10 bp, Homo sapiens
ctaaagttat

SEQ ID NO: 3699660 - DNA, 12 bp, Homo sapiens
ctaaatggcctc

SEQ ID NO: 3699661 - DNA, 16 bp, Homo sapiens
ctaaatggcctcatgt

SEQ ID NO: 3699662 - DNA, 15 bp, Homo sapiens
ctaaattttctgaaa

SEQ ID NO: 3699663 - DNA, 15 bp, Homo sapiens
ctaacaaaggcagct

SEQ ID NO: 3699664 - DNA, 16 bp, Homo sapiens
ctaacaaaggcagctg

SEQ ID NO: 3699665 - DNA, 21 bp, Homo sapiens
ctaacaataatatttcaagtg

SEQ ID NO: 3699666 - DNA, 14 bp, Homo sapiens
ctaacagtgaagat

SEQ ID NO: 3699667 - DNA, 13 bp, Homo sapiens
ctaacttcataga

SEQ ID NO: 3699668 - DNA, 16 bp, Homo sapiens
ctaagaacctggaact

SEQ ID NO: 3699669 - DNA, 13 bp, Homo sapiens
ctcgtatagcatg

SEQ ID NO: 3699670 - DNA, 16 bp, Homo sapiens
ctcgtcccgtccctcc

SEQ ID NO: 3699671 - DNA, 18 bp, Homo sapiens
ctctaactggacagcctc

SEQ ID NO: 3699672 - DNA, 16 bp, Homo sapiens
ctctaccctcccaccc

SEQ ID NO: 3699673 - DNA, 17 bp, Homo sapiens
ctctaccctcccacccc

SEQ ID NO: 3699674 - DNA, 20 bp, Homo sapiens
ctctacctcatatcagtttg

SEQ ID NO: 3699675 - DNA, 20 bp, Homo sapiens
ctctagctgggggtgggcca

SEQ ID NO: 3699676 - DNA, 22 bp, Homo sapiens
ctctaggtgcccttggaggcca

SEQ ID NO: 3699677 - DNA, 19 bp, Homo sapiens
ctctatggggcatcctctt

SEQ ID NO: 3699678 - DNA, 22 bp, Homo sapiens
ctctcaaatgtgtgttcctgct

SEQ ID NO: 3699679 - DNA, 14 bp, Homo sapiens
ctctcaagtaatat

SEQ ID NO: 3699680 - DNA, 19 bp, Homo sapiens
ctctcagtactttggaggc

SEQ ID NO: 3699681 - DNA, 16 bp, Homo sapiens
ctctccaagcgcctgg

SEQ ID NO: 3699682 - DNA, 17 bp, Homo sapiens
ctctccaagcgcctggc

SEQ ID NO: 3699683 - DNA, 21 bp, Homo sapiens
ctctcccattgtccctctgcc

SEQ ID NO: 3699684 - DNA, 14 bp, Homo sapiens
ctctccccacacta

SEQ ID NO: 3699685 - DNA, 11 bp, Homo sapiens
ctctccccagc

SEQ ID NO: 3699686 - DNA, 16 bp, Homo sapiens
ctctccccagcccaga

SEQ ID NO: 3699687 - DNA, 20 bp, Homo sapiens
ctctccccagcccagagaca

SEQ ID NO: 3699688 - DNA, 18 bp, Homo sapiens
ctctccccaggtccagct

SEQ ID NO: 3699689 - DNA, 13 bp, Homo sapiens
ctctccctgccaa

SEQ ID NO: 3699690 - DNA, 15 bp, Homo sapiens
ctctcctcctgccca

SEQ ID NO: 3699691 - DNA, 20 bp, Homo sapiens
ctctcctcctgcccacctgt

SEQ ID NO: 3699692 - DNA, 14 bp, Homo sapiens
ctctctcctcctgc

SEQ ID NO: 3699693 - DNA, 12 bp, Homo sapiens
ctctctcttctg

SEQ ID NO: 3699694 - DNA, 18 bp, Homo sapiens
ctctctcttctgctccac

SEQ ID NO: 3699695 - DNA, 15 bp, Homo sapiens
ctctctggtggctgg

SEQ ID NO: 3699696 - DNA, 16 bp, Homo sapiens
ctctctggtggctggg

SEQ ID NO: 3699697 - DNA, 21 bp, Homo sapiens
ctctctggtggctgggctgct

SEQ ID NO: 3699698 - DNA, 22 bp, Homo sapiens
ctctgaccgaaacagcgctggg

SEQ ID NO: 3699699 - DNA, 19 bp, Homo sapiens
ctctgacttaagcaaaaga

SEQ ID NO: 3699700 - DNA, 20 bp, Homo sapiens
ctctgacttaagcaaaagaa

SEQ ID NO: 3699701 - DNA, 22 bp, Homo sapiens
ctctgacttaagcaaaagaaaa

SEQ ID NO: 3699702 - DNA, 13 bp, Homo sapiens
ctctgacttctgc

SEQ ID NO: 3699703 - DNA, 18 bp, Homo sapiens
ctctgacttctgcctgga

SEQ ID NO: 3699704 - DNA, 13 bp, Homo sapiens
ctctgagcgcctc

SEQ ID NO: 3699705 - DNA, 22 bp, Homo sapiens
ctctgagtgttttatgagaaag

SEQ ID NO: 3699706 - DNA, 22 bp, Homo sapiens
ctctgcaagaattgaagcagga

SEQ ID NO: 3699707 - DNA, 17 bp, Homo sapiens
ctctgcacaagctgcac

SEQ ID NO: 3699708 - DNA, 13 bp, Homo sapiens
ctctgccagtgac

SEQ ID NO: 3699709 - DNA, 14 bp, Homo sapiens
ctctgcccaaccct

SEQ ID NO: 3699710 - DNA, 21 bp, Homo sapiens
ctctgccccatcctccagcag

SEQ ID NO: 3699711 - DNA, 24 bp, Homo sapiens
ctctgccccatcctccagcaggga

SEQ ID NO: 3699712 - DNA, 21 bp, Homo sapiens
ctctgcctcaaattctgcgtt

SEQ ID NO: 3699713 - DNA, 22 bp, Homo sapiens
ctctgcctttgcaccacgggac

SEQ ID NO: 3699714 - DNA, 23 bp, Homo sapiens
ctctgcctttgcaccacgggaca

SEQ ID NO: 3699715 - DNA, 16 bp, Homo sapiens
ctctgctccaccacat

SEQ ID NO: 3699716 - DNA, 23 bp, Homo sapiens
ctctgctgtacatatttgagact

SEQ ID NO: 3699717 - DNA, 21 bp, Homo sapiens
ctctgcttctctgacttctgc

SEQ ID NO: 3699718 - DNA, 13 bp, Homo sapiens
ctctggaatgcat

SEQ ID NO: 3699719 - DNA, 15 bp, Homo sapiens
ctctggaatgcatgg

SEQ ID NO: 3699720 - DNA, 16 bp, Homo sapiens
ctctggactggctaga

SEQ ID NO: 3699721 - DNA, 12 bp, Homo sapiens
ctctggagtggc

SEQ ID NO: 3699722 - DNA, 14 bp, Homo sapiens
ctctggctagaggc

SEQ ID NO: 3699723 - DNA, 19 bp, Homo sapiens
ctctggctagaggccagcc

SEQ ID NO: 3699724 - DNA, 21 bp, Homo sapiens
ctctggctagaggccagcccc

SEQ ID NO: 3699725 - DNA, 19 bp, Homo sapiens
ctctgggatttatgctcat

SEQ ID NO: 3699726 - DNA, 17 bp, Homo sapiens
ctctgggcctcagtttc

SEQ ID NO: 3699727 - DNA, 22 bp, Homo sapiens
ctctgggtgggcgtggcctgca

SEQ ID NO: 3699728 - DNA, 18 bp, Homo sapiens
ctctggtcgctcctgccc

SEQ ID NO: 3699729 - DNA, 13 bp, Homo sapiens
ctctggtggccac

SEQ ID NO: 3699730 - DNA, 20 bp, Homo sapiens
ctctggtggctgggctgctc

SEQ ID NO: 3699731 - DNA, 22 bp, Homo sapiens
ctctggtggctgggctgctcct

SEQ ID NO: 3699732 - DNA, 11 bp, Homo sapiens
ctctgtacttt

SEQ ID NO: 3699733 - DNA, 12 bp, Homo sapiens
ctctgtactttt

SEQ ID NO: 3699734 - DNA, 20 bp, Homo sapiens
ctctgtacttttcattctct

SEQ ID NO: 3699735 - DNA, 15 bp, Homo sapiens
ctctgtggccagcct

SEQ ID NO: 3699736 - DNA, 16 bp, Homo sapiens
ctctgtggccagcctg

SEQ ID NO: 3699737 - DNA, 21 bp, Homo sapiens
ctctgtggccagctgcatctg

SEQ ID NO: 3699738 - DNA, 20 bp, Homo sapiens
ctctgtggctccaggccaaa

SEQ ID NO: 3699739 - DNA, 17 bp, Homo sapiens
ctctgtgggccctaccc

SEQ ID NO: 3699740 - DNA, 18 bp, Homo sapiens
ctctgtgggccctaccct

SEQ ID NO: 3699741 - DNA, 18 bp, Homo sapiens
ctctgtgtatttgctttt

SEQ ID NO: 3699742 - DNA, 19 bp, Homo sapiens
ctctgtgtatttgcttttt

SEQ ID NO: 3699743 - DNA, 18 bp, Homo sapiens
ctctgtttgtttggctgt

SEQ ID NO: 3699744 - DNA, 22 bp, Homo sapiens
ctctgtttgtttggctgtccag

SEQ ID NO: 3699745 - DNA, 13 bp, Homo sapiens
ctcttaaaaccca

SEQ ID NO: 3699746 - DNA, 18 bp, Homo sapiens
ctcttaaattatatattt

SEQ ID NO: 3699747 - DNA, 17 bp, Homo sapiens
ctcttagcagcttccag

SEQ ID NO: 3699748 - DNA, 18 bp, Homo sapiens
ctcttcactcttcaaatg

SEQ ID NO: 3699749 - DNA, 13 bp, Homo sapiens
ctcttcaggcctc

SEQ ID NO: 3699750 - DNA, 18 bp, Homo sapiens
ctcttcaggcctccctct

SEQ ID NO: 3699751 - DNA, 15 bp, Homo sapiens
ctcttccctgggaac

SEQ ID NO: 3699752 - DNA, 21 bp, Homo sapiens
ctcttctgccggccctggggc

SEQ ID NO: 3699753 - DNA, 16 bp, Homo sapiens
ctcttctgctccaccc

SEQ ID NO: 3699754 - DNA, 21 bp, Homo sapiens
ctcttcttggggcccagtgca

SEQ ID NO: 3699755 - DNA, 16 bp, Homo sapiens
ctcttgaccttgtaga

SEQ ID NO: 3699756 - DNA, 15 bp, Homo sapiens
ctcttgagcagtggc

SEQ ID NO: 3699757 - DNA, 18 bp, Homo sapiens
ctcttgagcagtggctgg

SEQ ID NO: 3699758 - DNA, 13 bp, Homo sapiens
ctcttgagcctgg

SEQ ID NO: 3699759 - DNA, 14 bp, Homo sapiens
ctcttggctttgtt

SEQ ID NO: 3699760 - DNA, 17 bp, Homo sapiens
ctcttgggtgggacagg

SEQ ID NO: 3699761 - DNA, 22 bp, Homo sapiens
ctcttgtctggcaaaagaaaaa

SEQ ID NO: 3699762 - DNA, 21 bp, Homo sapiens
ctctttaatttgttgtagatt

SEQ ID NO: 3699763 - DNA, 14 bp, Homo sapiens
ctctttcacattgt

SEQ ID NO: 3699764 - DNA, 18 bp, Homo sapiens
ctctttgctttgctttct

SEQ ID NO: 3699765 - DNA, 20 bp, Homo sapiens
ctctttgctttgctttctgc

SEQ ID NO: 3699766 - DNA, 15 bp, Homo sapiens
ctctttggacactca

SEQ ID NO: 3699767 - DNA, 22 bp, Homo sapiens
ctctttgtagctaacagtgaag

SEQ ID NO: 3699768 - DNA, 22 bp, Homo sapiens
ctgaaaaggaacggcttcctca

SEQ ID NO: 3699769 - DNA, 16 bp, Homo sapiens
ctgaaaattaacactg

SEQ ID NO: 3699770 - DNA, 20 bp, Homo sapiens
ctgaaacaacttggaaagat

SEQ ID NO: 3699771 - DNA, 17 bp, Homo sapiens
ctgaaactatagaataa

SEQ ID NO: 3699772 - DNA, 14 bp, Homo sapiens
ctgaaagaggctga

SEQ ID NO: 3699773 - DNA, 14 bp, Homo sapiens
ctgaaataaatgtt

SEQ ID NO: 3699774 - DNA, 19 bp, Homo sapiens
ctgaaatgcgctctttaat

SEQ ID NO: 3699775 - DNA, 14 bp, Homo sapiens
ctgaaattctcctg

SEQ ID NO: 3699776 - DNA, 16 bp, Homo sapiens
ctgaaattctcctgga

SEQ ID NO: 3699777 - DNA, 12 bp, Homo sapiens
ctgaacagtgga

SEQ ID NO: 3699778 - DNA, 21 bp, Homo sapiens
ctgaacccaggcagctggcag

SEQ ID NO: 3699779 - DNA, 22 bp, Homo sapiens
ctgaacccaggcagctggcagg

SEQ ID NO: 3699780 - DNA, 13 bp, Homo sapiens
ctgaactgttaca

SEQ ID NO: 3699781 - DNA, 14 bp, Homo sapiens
ctgaagcagatgca

SEQ ID NO: 3699782 - DNA, 15 bp, Homo sapiens
ctgaagcagcctctc

SEQ ID NO: 3699783 - DNA, 16 bp, Homo sapiens
ctgaagcagcctctcc

SEQ ID NO: 3699784 - DNA, 14 bp, Homo sapiens
ctgaagccgtgcct

SEQ ID NO: 3699785 - DNA, 13 bp, Homo sapiens
ctgtaaggttcca

SEQ ID NO: 3699786 - DNA, 18 bp, Homo sapiens
ctgtaaggttccatccac

SEQ ID NO: 3699787 - DNA, 18 bp, Homo sapiens
ctgtaatcatttgtttac

SEQ ID NO: 3699788 - DNA, 20 bp, Homo sapiens
ctgtaatcatttgtttacat

SEQ ID NO: 3699789 - DNA, 20 bp, Homo sapiens
ctgtacatatttgagactag

SEQ ID NO: 3699790 - DNA, 17 bp, Homo sapiens
ctgtatttatgtgtgag

SEQ ID NO: 3699791 - DNA, 20 bp, Homo sapiens
ctgtattttgtttttgtctt

SEQ ID NO: 3699792 - DNA, 14 bp, Homo sapiens
ctgtcaaacaaagc

SEQ ID NO: 3699793 - DNA, 18 bp, Homo sapiens
ctgtcaaacaaagccaga

SEQ ID NO: 3699794 - DNA, 19 bp, Homo sapiens
ctgtcaaacaaagccagaa

SEQ ID NO: 3699795 - DNA, 22 bp, Homo sapiens
ctgtcaagagtagttatataat

SEQ ID NO: 3699796 - DNA, 15 bp, Homo sapiens
ctgtcaatcacagtc

SEQ ID NO: 3699797 - DNA, 16 bp, Homo sapiens
ctgtcaggctgaaaac

SEQ ID NO: 3699798 - DNA, 18 bp, Homo sapiens
ctgtcaggctgaaaacaa

SEQ ID NO: 3699799 - DNA, 14 bp, Homo sapiens
ctgtcatggtcctt

SEQ ID NO: 3699800 - DNA, 18 bp, Homo sapiens
ctgtcatggtcctttctg

SEQ ID NO: 3699801 - DNA, 20 bp, Homo sapiens
ctgtccaaaggaggctggca

SEQ ID NO: 3699802 - DNA, 21 bp, Homo sapiens
ctgtccaaaggaggctggcag

SEQ ID NO: 3699803 - DNA, 12 bp, Homo sapiens
ctgtccagctcc

SEQ ID NO: 3699804 - DNA, 11 bp, Homo sapiens
ctgtcccaagt

SEQ ID NO: 3699805 - DNA, 22 bp, Homo sapiens
ctgtcccagtgccgagaaggaa

SEQ ID NO: 3699806 - DNA, 19 bp, Homo sapiens
ctgtccctagtaaaaatac

SEQ ID NO: 3699807 - DNA, 21 bp, Homo sapiens
ctgtccctagtaaaaatacaa

SEQ ID NO: 3699808 - DNA, 13 bp, Homo sapiens
ctgtcccttgcct

SEQ ID NO: 3699809 - DNA, 15 bp, Homo sapiens
ctgtcccttgcctca

SEQ ID NO: 3699810 - DNA, 20 bp, Homo sapiens
ctgtcccttgcctcaatgcc

SEQ ID NO: 3699811 - DNA, 17 bp, Homo sapiens
ctgtcccttgcttgcct

SEQ ID NO: 3699812 - DNA, 14 bp, Homo sapiens
ctgtccgagctttg

SEQ ID NO: 3699813 - DNA, 18 bp, Homo sapiens
ctgtcctcagccttgcca

SEQ ID NO: 3699814 - DNA, 12 bp, Homo sapiens
ctgtccttaccc

SEQ ID NO: 3699815 - DNA, 21 bp, Homo sapiens
ctgtcctttctagagcactgc

SEQ ID NO: 3699816 - DNA, 13 bp, Homo sapiens
ctgtctacatttc

SEQ ID NO: 3699817 - DNA, 14 bp, Homo sapiens
ctgtctacatttct

SEQ ID NO: 3699818 - DNA, 18 bp, Homo sapiens
ctgtctacttgctcaggt

SEQ ID NO: 3699819 - DNA, 14 bp, Homo sapiens
ctgtctagagaggg

SEQ ID NO: 3699820 - DNA, 17 bp, Homo sapiens
ctgtctagagagggagg

SEQ ID NO: 3699821 - DNA, 18 bp, Homo sapiens
ctgtctagagagggaggc

SEQ ID NO: 3699822 - DNA, 18 bp, Homo sapiens
ctgtctcaaaaaaagaaa

SEQ ID NO: 3699823 - DNA, 17 bp, Homo sapiens
ctgtctcatccccaggg

SEQ ID NO: 3699824 - DNA, 15 bp, Homo sapiens
ctgtctggtggcccc

SEQ ID NO: 3699825 - DNA, 23 bp, Homo sapiens
ctgtctggtggccccgtttctgg

SEQ ID NO: 3699826 - DNA, 15 bp, Homo sapiens
ctgtcttctggactg

SEQ ID NO: 3699827 - DNA, 23 bp, Homo sapiens
ctgtgaaaattgaccaagtgatg

SEQ ID NO: 3699828 - DNA, 20 bp, Homo sapiens
ctgtgaaataccacaagcct

SEQ ID NO: 3699829 - DNA, 15 bp, Homo sapiens
ctgtgaagagaacca

SEQ ID NO: 3699830 - DNA, 21 bp, Homo sapiens
ctgtgaatgccactgccttcg

SEQ ID NO: 3699831 - DNA, 16 bp, Homo sapiens
ctgtgaggcttgccca

SEQ ID NO: 3699832 - DNA, 18 bp, Homo sapiens
ctgtgaggcttgcccagg

SEQ ID NO: 3699833 - DNA, 19 bp, Homo sapiens
ctgtgcaacggtctcctga

SEQ ID NO: 3699834 - DNA, 20 bp, Homo sapiens
ctgtgccaccccttcctcag

SEQ ID NO: 3699835 - DNA, 18 bp, Homo sapiens
ctgtgccatttctcaggg

SEQ ID NO: 3699836 - DNA, 21 bp, Homo sapiens
ctgtgccatttctcagggaag

SEQ ID NO: 3699837 - DNA, 21 bp, Homo sapiens
ctgtgctatggtgctctgtct

SEQ ID NO: 3699838 - DNA, 19 bp, Homo sapiens
ctgtgctgggaagcccgga

SEQ ID NO: 3699839 - DNA, 17 bp, Homo sapiens
ctgtggatgataaaaca

SEQ ID NO: 3699840 - DNA, 13 bp, Homo sapiens
ctgtggccagcct

SEQ ID NO: 3699841 - DNA, 22 bp, Homo sapiens
ctgtggccagcctggcatcagt

SEQ ID NO: 3699842 - DNA, 15 bp, Homo sapiens
ctgtggccagctgca

SEQ ID NO: 3699843 - DNA, 23 bp, Homo sapiens
ctgtggccagctgcatctgtctg

SEQ ID NO: 3699844 - DNA, 17 bp, Homo sapiens
ctgtggccccaccctgg

SEQ ID NO: 3699845 - DNA, 18 bp, Homo sapiens
ctgtggccccaccctggg

SEQ ID NO: 3699846 - DNA, 20 bp, Homo sapiens
ctgtggccccaccctgggcc

SEQ ID NO: 3699847 - DNA, 20 bp, Homo sapiens
ctgtggcgccgtctccaggg

SEQ ID NO: 3699848 - DNA, 24 bp, Homo sapiens
ctgtggcgccgtctccaggggctg

SEQ ID NO: 3699849 - DNA, 11 bp, Homo sapiens
ctgtgggtggg

SEQ ID NO: 3699850 - DNA, 15 bp, Homo sapiens
ctgtgggtggggctt

SEQ ID NO: 3699851 - DNA, 17 bp, Homo sapiens
ctgtgggtggggcttct

SEQ ID NO: 3699852 - DNA, 19 bp, Homo sapiens
ctgtggtagtcctcccaag

SEQ ID NO: 3699853 - DNA, 16 bp, Homo sapiens
ctgtggtcacagcgga

SEQ ID NO: 3699854 - DNA, 9 bp, Homo sapiens
ctgtgtgca

SEQ ID NO: 3699855 - DNA, 13 bp, Homo sapiens
ctgtgtgcaggtt

SEQ ID NO: 3699856 - DNA, 22 bp, Homo sapiens
ctgtgtgtcccaggcagggaga

SEQ ID NO: 3699857 - DNA, 23 bp, Homo sapiens
ctgtgtgtgtgtgtgtgcgtgtg

SEQ ID NO: 3699858 - DNA, 14 bp, Homo sapiens
ctgtgttgccaagc

SEQ ID NO: 3699859 - DNA, 19 bp, Homo sapiens
ctgtgttgccaagctccaa

SEQ ID NO: 3699860 - DNA, 21 bp, Homo sapiens
ctgtgttgccaagctccaagc

SEQ ID NO: 3699861 - DNA, 14 bp, Homo sapiens
ctgtgttgtctcta

SEQ ID NO: 3699862 - DNA, 19 bp, Homo sapiens
ctgtgttgtctctagagca

SEQ ID NO: 3699863 - DNA, 16 bp, Homo sapiens
ctgtgtttggctttca

SEQ ID NO: 3699864 - DNA, 17 bp, Homo sapiens
ctgtgtttggctttcag

SEQ ID NO: 3699865 - DNA, 18 bp, Homo sapiens
ctgtgtttggctttcagg

SEQ ID NO: 3699866 - DNA, 15 bp, Homo sapiens
ctgttactttggcaa

SEQ ID NO: 3699867 - DNA, 23 bp, Homo sapiens
ctgttactttggcaatttcctgg

SEQ ID NO: 3699868 - DNA, 23 bp, Homo sapiens
ctgttagggacatttccaagctg

SEQ ID NO: 3699869 - DNA, 19 bp, Homo sapiens
ctgttcagctggttgaggt

SEQ ID NO: 3699870 - DNA, 21 bp, Homo sapiens
ctgttcagctggttgaggttt

SEQ ID NO: 3699871 - DNA, 16 bp, Homo sapiens
ctgttcagtaataaaa

SEQ ID NO: 3699872 - DNA, 16 bp, Homo sapiens
ctgttcccccttcaca

SEQ ID NO: 3699873 - DNA, 21 bp, Homo sapiens
ctgttgacacaggtctttcct

SEQ ID NO: 3699874 - DNA, 16 bp, Homo sapiens
ctgttgacatatttaa

SEQ ID NO: 3699875 - DNA, 17 bp, Homo sapiens
ctgttgacatatttaat

SEQ ID NO: 3699876 - DNA, 18 bp, Homo sapiens
ctgttggcaggctggcca

SEQ ID NO: 3699877 - DNA, 19 bp, Homo sapiens
ctgttggcaggctggccag

SEQ ID NO: 3699878 - DNA, 13 bp, Homo sapiens
ctgtttatggcct

SEQ ID NO: 3699879 - DNA, 15 bp, Homo sapiens
ctgtttatggcctca

SEQ ID NO: 3699880 - DNA, 17 bp, Homo sapiens
ctgtttatggcctcagc

SEQ ID NO: 3699881 - DNA, 19 bp, Homo sapiens
ctgtttatggcctcagctg

SEQ ID NO: 3699882 - DNA, 11 bp, Homo sapiens
ctgtttcacaa

SEQ ID NO: 3699883 - DNA, 16 bp, Homo sapiens
ctgtttctgcttattt

SEQ ID NO: 3699884 - DNA, 14 bp, Homo sapiens
ctgtttgaaagtaa

SEQ ID NO: 3699885 - DNA, 22 bp, Homo sapiens
ctgtttgaaagtaaaaacctgc

SEQ ID NO: 3699886 - DNA, 13 bp, Homo sapiens
ctgtttgttattg

SEQ ID NO: 3699887 - DNA, 19 bp, Homo sapiens
ctgtttgtttggctgtcca

SEQ ID NO: 3699888 - DNA, 20 bp, Homo sapiens
ctgtttgtttggctgtccag

SEQ ID NO: 3699889 - DNA, 12 bp, Homo sapiens
ctgttttcctcc

SEQ ID NO: 3699890 - DNA, 14 bp, Homo sapiens
ctgttttcctccct

SEQ ID NO: 3699891 - DNA, 16 bp, Homo sapiens
ctgttttcctcccttc

SEQ ID NO: 3699892 - DNA, 19 bp, Homo sapiens
ctgttttcctcccttctgc

SEQ ID NO: 3699893 - DNA, 23 bp, Homo sapiens
ctgttttcctcccttctgctact

SEQ ID NO: 3699894 - DNA, 17 bp, Homo sapiens
ctgttttctcttgagag

SEQ ID NO: 3699895 - DNA, 17 bp, Homo sapiens
ctgtttttcagggaggt

SEQ ID NO: 3699896 - DNA, 15 bp, Homo sapiens
cttaaaaaattgaaa

SEQ ID NO: 3699897 - DNA, 16 bp, Homo sapiens
cttaaaaagtggaaaa

SEQ ID NO: 3699898 - DNA, 17 bp, Homo sapiens
cttaaaaagtggaaaaa

SEQ ID NO: 3699899 - DNA, 22 bp, Homo sapiens
cttaaaatcactcagcactcca

SEQ ID NO: 3699900 - DNA, 20 bp, Homo sapiens
cttaaaattacttggctttt

SEQ ID NO: 3699901 - DNA, 16 bp, Homo sapiens
ctttctgctcagcttc

SEQ ID NO: 3699902 - DNA, 13 bp, Homo sapiens
ctttgaaacagaa

SEQ ID NO: 3699903 - DNA, 19 bp, Homo sapiens
ctttgaaatagtctgtgtg

SEQ ID NO: 3699904 - DNA, 21 bp, Homo sapiens
ctttgaaatagtctgtgtgaa

SEQ ID NO: 3699905 - DNA, 15 bp, Homo sapiens
ctttgatcaggtggg

SEQ ID NO: 3699906 - DNA, 13 bp, Homo sapiens
ctttgattctgat

SEQ ID NO: 3699907 - DNA, 19 bp, Homo sapiens
ctttgcaaagtattgtaaa

SEQ ID NO: 3699908 - DNA, 22 bp, Homo sapiens
ctttgcaaagtattgtaaatta

SEQ ID NO: 3699909 - DNA, 22 bp, Homo sapiens
ctttgcagccggcacagggtct

SEQ ID NO: 3699910 - DNA, 16 bp, Homo sapiens
ctttgcagctgcccag

SEQ ID NO: 3699911 - DNA, 18 bp, Homo sapiens
ctttgcatttcttgtgtt

SEQ ID NO: 3699912 - DNA, 14 bp, Homo sapiens
ctttgcattttgga

SEQ ID NO: 3699913 - DNA, 15 bp, Homo sapiens
ctttgcgcctgtgac

SEQ ID NO: 3699914 - DNA, 11 bp, Homo sapiens
ctttgctgctg

SEQ ID NO: 3699915 - DNA, 21 bp, Homo sapiens
ctttgctgtgaggctgtcctg

SEQ ID NO: 3699916 - DNA, 16 bp, Homo sapiens
ctttgctttctgctca

SEQ ID NO: 3699917 - DNA, 19 bp, Homo sapiens
ctttgctttctgctcagct

SEQ ID NO: 3699918 - DNA, 20 bp, Homo sapiens
ctttggacctaaatggcctc

SEQ ID NO: 3699919 - DNA, 21 bp, Homo sapiens
ctttggacctaaatggcctca

SEQ ID NO: 3699920 - DNA, 22 bp, Homo sapiens
ctttggcaatttcctggccctc

SEQ ID NO: 3699921 - DNA, 23 bp, Homo sapiens
ctttgggaggccaaggtgggagg

SEQ ID NO: 3699922 - DNA, 13 bp, Homo sapiens
ctttgggccagac

SEQ ID NO: 3699923 - DNA, 12 bp, Homo sapiens
ctttgtaaatag

SEQ ID NO: 3699924 - DNA, 15 bp, Homo sapiens
ctttgtataatccca

SEQ ID NO: 3699925 - DNA, 13 bp, Homo sapiens
ctttgtatattac

SEQ ID NO: 3699926 - DNA, 23 bp, Homo sapiens
ctttgtcacagggtgttggaaga

SEQ ID NO: 3699927 - DNA, 12 bp, Homo sapiens
ctttgtggccaa

SEQ ID NO: 3699928 - DNA, 20 bp, Homo sapiens
ctttgtggccaaggagctgc

SEQ ID NO: 3699929 - DNA, 20 bp, Homo sapiens
ctttgtttgttgtcagctga

SEQ ID NO: 3699930 - DNA, 13 bp, Homo sapiens
cttttaaaatgca

SEQ ID NO: 3699931 - DNA, 17 bp, Homo sapiens
cttttaggacccttccc

SEQ ID NO: 3699932 - DNA, 23 bp, Homo sapiens
cttttcactttctacttttttca

SEQ ID NO: 3699933 - DNA, 17 bp, Homo sapiens
cttttcattctctttta

SEQ ID NO: 3699934 - DNA, 19 bp, Homo sapiens
cttttcctgataaagcaca

SEQ ID NO: 3699935 - DNA, 20 bp, Homo sapiens
cttttccttggggcaggcag

SEQ ID NO: 3699936 - DNA, 18 bp, Homo sapiens
cttttctaatggatattt

SEQ ID NO: 3699937 - DNA, 14 bp, Homo sapiens
cttttctggcaccg

SEQ ID NO: 3699938 - DNA, 18 bp, Homo sapiens
cttttctgtccgagcttt

SEQ ID NO: 3699939 - DNA, 21 bp, Homo sapiens
cttttgaacgcccccccccac

SEQ ID NO: 3699940 - DNA, 16 bp, Homo sapiens
cttttgaattgttaca

SEQ ID NO: 3699941 - DNA, 15 bp, Homo sapiens
cttttgcttttggca

SEQ ID NO: 3699942 - DNA, 18 bp, Homo sapiens
cttttgggggtcaacagt

SEQ ID NO: 3699943 - DNA, 14 bp, Homo sapiens
ctttttaaaattct

SEQ ID NO: 3699944 - DNA, 15 bp, Homo sapiens
ctttttccaaatgct

SEQ ID NO: 3699945 - DNA, 22 bp, Homo sapiens
ctttttccaaatgcttctattt

SEQ ID NO: 3699946 - DNA, 18 bp, Homo sapiens
ctttttgaccctcattct

SEQ ID NO: 3699947 - DNA, 19 bp, Homo sapiens
gaaaaaaaaaaagaagaag

SEQ ID NO: 3699948 - DNA, 21 bp, Homo sapiens
gaaaaaaaccacacaaagaca

SEQ ID NO: 3699949 - DNA, 19 bp, Homo sapiens
gaaaaaatattttcctgcc

SEQ ID NO: 3699950 - DNA, 22 bp, Homo sapiens
gaaaaataaagacacctggttg

SEQ ID NO: 3699951 - DNA, 16 bp, Homo sapiens
gaaaaatatgtaccaa

SEQ ID NO: 3699952 - DNA, 16 bp, Homo sapiens
gaaaaatatttctgag

SEQ ID NO: 3699953 - DNA, 13 bp, Homo sapiens
gaaaaatcttaag

SEQ ID NO: 3699954 - DNA, 18 bp, Homo sapiens
gaaaaatcttaagtacca

SEQ ID NO: 3699955 - DNA, 22 bp, Homo sapiens
gaaaaatcttaagtaccaatgg

SEQ ID NO: 3699956 - DNA, 14 bp, Homo sapiens
gaaaacaataattt

SEQ ID NO: 3699957 - DNA, 15 bp, Homo sapiens
gaaaacctcatggag

SEQ ID NO: 3699958 - DNA, 19 bp, Homo sapiens
gaaaactgcaacttgtaaa

SEQ ID NO: 3699959 - DNA, 11 bp, Homo sapiens
gaaaaggcagg

SEQ ID NO: 3699960 - DNA, 20 bp, Homo sapiens
gaaaatatatgtatttttat

SEQ ID NO: 3699961 - DNA, 22 bp, Homo sapiens
gaaaatatctgctcaaaacttt

SEQ ID NO: 3699962 - DNA, 16 bp, Homo sapiens
gaaaatcagcctgctc

SEQ ID NO: 3699963 - DNA, 22 bp, Homo sapiens
gaaaatcagcctgctccagctg

SEQ ID NO: 3699964 - DNA, 18 bp, Homo sapiens
gaaaatgcaacaacatgt

SEQ ID NO: 3699965 - DNA, 22 bp, Homo sapiens
gaaaatgcagcagggatgccct

SEQ ID NO: 3699966 - DNA, 14 bp, Homo sapiens
gaaaatgcttcttg

SEQ ID NO: 3699967 - DNA, 20 bp, Homo sapiens
gaaaatgtttttctgccagg

SEQ ID NO: 3699968 - DNA, 13 bp, Homo sapiens
gaaaattaacact

SEQ ID NO: 3699969 - DNA, 21 bp, Homo sapiens
gaaacacactgaggcagggaa

SEQ ID NO: 3699970 - DNA, 17 bp, Homo sapiens
gaaacagcctgtgtctt

SEQ ID NO: 3699971 - DNA, 19 bp, Homo sapiens
gaaaccttagtttcaagag

SEQ ID NO: 3699972 - DNA, 21 bp, Homo sapiens
gaaactaattgactttagaaa

SEQ ID NO: 3699973 - DNA, 12 bp, Homo sapiens
gaaacttggctc

SEQ ID NO: 3699974 - DNA, 22 bp, Homo sapiens
gaaagaaacccgacagagggaa

SEQ ID NO: 3699975 - DNA, 18 bp, Homo sapiens
gaaagaagtggggacaga

SEQ ID NO: 3699976 - DNA, 16 bp, Homo sapiens
gaaagacagagctggg

SEQ ID NO: 3699977 - DNA, 22 bp, Homo sapiens
gaaagcaacaaagattgagaag

SEQ ID NO: 3699978 - DNA, 20 bp, Homo sapiens
gaaagcagctcaaaggcaca

SEQ ID NO: 3699979 - DNA, 14 bp, Homo sapiens
gaaagcctgaaggg

SEQ ID NO: 3699980 - DNA, 13 bp, Homo sapiens
gaaaggagactag

SEQ ID NO: 3699981 - DNA, 12 bp, Homo sapiens
gaaaggccagct

SEQ ID NO: 3699982 - DNA, 16 bp, Homo sapiens
gaaaggggagcccact

SEQ ID NO: 3699983 - DNA, 14 bp, Homo sapiens
gaaaggtggtgttt

SEQ ID NO: 3699984 - DNA, 13 bp, Homo sapiens
gaaatacaaaaat

SEQ ID NO: 3699985 - DNA, 14 bp, Homo sapiens
gaaatacaaaaata

SEQ ID NO: 3699986 - DNA, 14 bp, Homo sapiens
gaaatcaggcctga

SEQ ID NO: 3699987 - DNA, 20 bp, Homo sapiens
gaaatctggcttctggccag

SEQ ID NO: 3699988 - DNA, 20 bp, Homo sapiens
gaaatgagcagcccttacag

SEQ ID NO: 3699989 - DNA, 18 bp, Homo sapiens
gaaatgtattaatgtatg

SEQ ID NO: 3699990 - DNA, 20 bp, Homo sapiens
gaaattcccgtgttgcttca

SEQ ID NO: 3699991 - DNA, 17 bp, Homo sapiens
gaaattctcctggaggt

SEQ ID NO: 3699992 - DNA, 15 bp, Homo sapiens
gaacactagacaagc

SEQ ID NO: 3699993 - DNA, 17 bp, Homo sapiens
gaacactagacaagcca

SEQ ID NO: 3699994 - DNA, 23 bp, Homo sapiens
gaacagctatgggagccccaggg

SEQ ID NO: 3699995 - DNA, 15 bp, Homo sapiens
gaacagctgtaatct

SEQ ID NO: 3699996 - DNA, 15 bp, Homo sapiens
gaacaggtgtttttc

SEQ ID NO: 3699997 - DNA, 10 bp, Homo sapiens
gaacattgta

SEQ ID NO: 3699998 - DNA, 17 bp, Homo sapiens
gaaccaaatctggaagc

SEQ ID NO: 3699999 - DNA, 19 bp, Homo sapiens
gaaccagtccccccaccct

SEQ ID NO: 3700000 - DNA, 13 bp, Homo sapiens
gaacccagactca

SEQ ID NO: 3700001 - DNA, 13 bp, Homo sapiens
gaacccaggcagc

SEQ ID NO: 3700002 - DNA, 15 bp, Homo sapiens
gaaccgccctcctga

SEQ ID NO: 3700003 - DNA, 16 bp, Homo sapiens
gaaccggctcccaccc

SEQ ID NO: 3700004 - DNA, 20 bp, Homo sapiens
gaaccggctcccaccctcaa

SEQ ID NO: 3700005 - DNA, 16 bp, Homo sapiens
gaacctcacgcacctc

SEQ ID NO: 3700006 - DNA, 17 bp, Homo sapiens
gaacctcacgcacctcc

SEQ ID NO: 3700007 - DNA, 19 bp, Homo sapiens
gaacctcacgcacctccca

SEQ ID NO: 3700008 - DNA, 14 bp, Homo sapiens
gaacctcagcctgg

SEQ ID NO: 3700009 - DNA, 13 bp, Homo sapiens
gaacctcttcccc

SEQ ID NO: 3700010 - DNA, 14 bp, Homo sapiens
gaacctcttcccca

SEQ ID NO: 3700011 - DNA, 18 bp, Homo sapiens
gaacctggaccccagcct

SEQ ID NO: 3700012 - DNA, 22 bp, Homo sapiens
gaacctggaccccagccttggt

SEQ ID NO: 3700013 - DNA, 21 bp, Homo sapiens
gaaccttgtcccagccagtga

SEQ ID NO: 3700014 - DNA, 18 bp, Homo sapiens
gaacgcccccccccaccc

SEQ ID NO: 3700015 - DNA, 13 bp, Homo sapiens
gaacggcttcctc

SEQ ID NO: 3700016 - DNA, 23 bp, Homo sapiens
gaactaaaaagagactgtgccat

SEQ ID NO: 3700017 - DNA, 16 bp, Homo sapiens
gaactagctatgaaat

SEQ ID NO: 3700018 - DNA, 20 bp, Homo sapiens
gagaagggccaggccggcag

SEQ ID NO: 3700019 - DNA, 19 bp, Homo sapiens
gagaaggtattagcaaagc

SEQ ID NO: 3700020 - DNA, 18 bp, Homo sapiens
gagaataagaataataat

SEQ ID NO: 3700021 - DNA, 15 bp, Homo sapiens
gagacaagcatggaa

SEQ ID NO: 3700022 - DNA, 20 bp, Homo sapiens
gagacatacttgaagggcca

SEQ ID NO: 3700023 - DNA, 14 bp, Homo sapiens
gagaccagcctggc

SEQ ID NO: 3700024 - DNA, 12 bp, Homo sapiens
gagacccccaca

SEQ ID NO: 3700025 - DNA, 23 bp, Homo sapiens
gagacccccacacctcagttccc

SEQ ID NO: 3700026 - DNA, 15 bp, Homo sapiens
gagactactaagagg

SEQ ID NO: 3700027 - DNA, 16 bp, Homo sapiens
gagactctcctgcctc

SEQ ID NO: 3700028 - DNA, 13 bp, Homo sapiens
gagactgtgccat

SEQ ID NO: 3700029 - DNA, 11 bp, Homo sapiens
gagagaaaaaa

SEQ ID NO: 3700030 - DNA, 11 bp, Homo sapiens
gagagagaaaa

SEQ ID NO: 3700031 - DNA, 16 bp, Homo sapiens
gagagcgcctgcccct

SEQ ID NO: 3700032 - DNA, 14 bp, Homo sapiens
gagagctggtgccc

SEQ ID NO: 3700033 - DNA, 17 bp, Homo sapiens
gagagctggtgcccgga

SEQ ID NO: 3700034 - DNA, 12 bp, Homo sapiens
gagaggaagggt

SEQ ID NO: 3700035 - DNA, 18 bp, Homo sapiens
gagagggaggcaagccct

SEQ ID NO: 3700036 - DNA, 13 bp, Homo sapiens
gagaggggcacag

SEQ ID NO: 3700037 - DNA, 14 bp, Homo sapiens
gagaggtgggccag

SEQ ID NO: 3700038 - DNA, 14 bp, Homo sapiens
gagatcctcctgca

SEQ ID NO: 3700039 - DNA, 23 bp, Homo sapiens
gagatcctcctgcagaccacgcc

SEQ ID NO: 3700040 - DNA, 21 bp, Homo sapiens
gagatcgtgccattgcactcc

SEQ ID NO: 3700041 - DNA, 21 bp, Homo sapiens
gagatgggccggcccccttcc

SEQ ID NO: 3700042 - DNA, 14 bp, Homo sapiens
gagcaagaaggaaa

SEQ ID NO: 3700043 - DNA, 16 bp, Homo sapiens
gagcaagtgaggccgg

SEQ ID NO: 3700044 - DNA, 13 bp, Homo sapiens
gagcaccagggga

SEQ ID NO: 3700045 - DNA, 13 bp, Homo sapiens
gagcagcctgtgg

SEQ ID NO: 3700046 - DNA, 20 bp, Homo sapiens
gagcagggattaacctctgc

SEQ ID NO: 3700047 - DNA, 21 bp, Homo sapiens
gagcagggattaacctctgca

SEQ ID NO: 3700048 - DNA, 22 bp, Homo sapiens
gagcagggattaacctctgcac

SEQ ID NO: 3700049 - DNA, 12 bp, Homo sapiens
gagcagtcacaa

SEQ ID NO: 3700050 - DNA, 21 bp, Homo sapiens
gagcatacatcttaaatcttt

SEQ ID NO: 3700051 - DNA, 14 bp, Homo sapiens
gagcatcacagaat

SEQ ID NO: 3700052 - DNA, 22 bp, Homo sapiens
gagcatgcttccctgcagctga

SEQ ID NO: 3700053 - DNA, 18 bp, Homo sapiens
gagccaaggggcttcagg

SEQ ID NO: 3700054 - DNA, 19 bp, Homo sapiens
gagcccactgtcctgggcc

SEQ ID NO: 3700055 - DNA, 21 bp, Homo sapiens
gagcccaggagtttgaatcca

SEQ ID NO: 3700056 - DNA, 21 bp, Homo sapiens
gagcccctgtctagagaggga

SEQ ID NO: 3700057 - DNA, 14 bp, Homo sapiens
gagccttcaagtgc

SEQ ID NO: 3700058 - DNA, 17 bp, Homo sapiens
gagccttcaagtgccaa

SEQ ID NO: 3700059 - DNA, 23 bp, Homo sapiens
gagcgcctccatccaaggccagg

SEQ ID NO: 3700060 - DNA, 17 bp, Homo sapiens
gagcgctactcttggat

SEQ ID NO: 3700061 - DNA, 13 bp, Homo sapiens
gagcggaaagcag

SEQ ID NO: 3700062 - DNA, 17 bp, Homo sapiens
gagcggaaagcagctca

SEQ ID NO: 3700063 - DNA, 11 bp, Homo sapiens
gagctactgcc

SEQ ID NO: 3700064 - DNA, 17 bp, Homo sapiens
gagctcaggacactaat

SEQ ID NO: 3700065 - DNA, 18 bp, Homo sapiens
gagctccactctgcttct

SEQ ID NO: 3700066 - DNA, 13 bp, Homo sapiens
gagctccactgcc

SEQ ID NO: 3700067 - DNA, 23 bp, Homo sapiens
gagctccaggatggggaggggct

SEQ ID NO: 3700068 - DNA, 17 bp, Homo sapiens
gagctctgtatggtcag

SEQ ID NO: 3700069 - DNA, 19 bp, Homo sapiens
gagctcttcaggcctccct

SEQ ID NO: 3700070 - DNA, 19 bp, Homo sapiens
gagctgaattttctggaaa

SEQ ID NO: 3700071 - DNA, 14 bp, Homo sapiens
gagctgaccagccg

SEQ ID NO: 3700072 - DNA, 15 bp, Homo sapiens
gagctgagtggggga

SEQ ID NO: 3700073 - DNA, 20 bp, Homo sapiens
gagctgcctccagcctggtg

SEQ ID NO: 3700074 - DNA, 21 bp, Homo sapiens
gagctgctatagcctggggtg

SEQ ID NO: 3700075 - DNA, 12 bp, Homo sapiens
gagctgctggct

SEQ ID NO: 3700076 - DNA, 21 bp, Homo sapiens
gagctgctggcttgcagtgcg

SEQ ID NO: 3700077 - DNA, 23 bp, Homo sapiens
gagctgctgggccccgagccacg

SEQ ID NO: 3700078 - DNA, 22 bp, Homo sapiens
gagctggctctgagcgcctcca

SEQ ID NO: 3700079 - DNA, 12 bp, Homo sapiens
gagctggctgac

SEQ ID NO: 3700080 - DNA, 13 bp, Homo sapiens
gagctggctgact

SEQ ID NO: 3700081 - DNA, 16 bp, Homo sapiens
gagctgggaaggttcc

SEQ ID NO: 3700082 - DNA, 23 bp, Homo sapiens
gagctgggcccgacatggctccg

SEQ ID NO: 3700083 - DNA, 21 bp, Homo sapiens
gagctggtgcccggagattgg

SEQ ID NO: 3700084 - DNA, 19 bp, Homo sapiens
gaggaaaggccagctggca

SEQ ID NO: 3700085 - DNA, 19 bp, Homo sapiens
gaggaagccctaagacgtc

SEQ ID NO: 3700086 - DNA, 14 bp, Homo sapiens
gaggacaggcggga

SEQ ID NO: 3700087 - DNA, 21 bp, Homo sapiens
gaggacagggacttcgcagag

SEQ ID NO: 3700088 - DNA, 22 bp, Homo sapiens
gaggacagggacttcgcagagg

SEQ ID NO: 3700089 - DNA, 16 bp, Homo sapiens
gaggacagtctggaga

SEQ ID NO: 3700090 - DNA, 12 bp, Homo sapiens
gaggacagtggg

SEQ ID NO: 3700091 - DNA, 13 bp, Homo sapiens
gaggaccagggcc

SEQ ID NO: 3700092 - DNA, 14 bp, Homo sapiens
gaggaccagggcct

SEQ ID NO: 3700093 - DNA, 11 bp, Homo sapiens
gaggagctgct

SEQ ID NO: 3700094 - DNA, 16 bp, Homo sapiens
gaggaggggccgctgc

SEQ ID NO: 3700095 - DNA, 15 bp, Homo sapiens
gaggaggtgtgagga

SEQ ID NO: 3700096 - DNA, 21 bp, Homo sapiens
gaggaggtgtgaggaggaggc

SEQ ID NO: 3700097 - DNA, 16 bp, Homo sapiens
gaggagtggagggaaa

SEQ ID NO: 3700098 - DNA, 13 bp, Homo sapiens
gaggcaagccctg

SEQ ID NO: 3700099 - DNA, 18 bp, Homo sapiens
gaggcaggcatggccctg

SEQ ID NO: 3700100 - DNA, 19 bp, Homo sapiens
gaggcaggcatggccctgg

SEQ ID NO: 3700101 - DNA, 16 bp, Homo sapiens
gaggccagccccaccc

SEQ ID NO: 3700102 - DNA, 22 bp, Homo sapiens
gaggccagccccacccaggagg

SEQ ID NO: 3700103 - DNA, 12 bp, Homo sapiens
gaggccccagcc

SEQ ID NO: 3700104 - DNA, 14 bp, Homo sapiens
gaggccccaggggg

SEQ ID NO: 3700105 - DNA, 21 bp, Homo sapiens
gaggcccccagcccagggctc

SEQ ID NO: 3700106 - DNA, 19 bp, Homo sapiens
gaggcccccatctccttaa

SEQ ID NO: 3700107 - DNA, 22 bp, Homo sapiens
gaggcccgccctgcccgggctc

SEQ ID NO: 3700108 - DNA, 13 bp, Homo sapiens
gaggccctcccaa

SEQ ID NO: 3700109 - DNA, 18 bp, Homo sapiens
gaggccctcccaaagagg

SEQ ID NO: 3700110 - DNA, 17 bp, Homo sapiens
gaggccctctggagtgg

SEQ ID NO: 3700111 - DNA, 14 bp, Homo sapiens
gaggccgaggccat

SEQ ID NO: 3700112 - DNA, 19 bp, Homo sapiens
gaggcctgcgaccctgggg

SEQ ID NO: 3700113 - DNA, 14 bp, Homo sapiens
gaggcggagctcca

SEQ ID NO: 3700114 - DNA, 13 bp, Homo sapiens
gaggctcctgtgg

SEQ ID NO: 3700115 - DNA, 14 bp, Homo sapiens
gaggctgaggcctg

SEQ ID NO: 3700116 - DNA, 18 bp, Homo sapiens
gaggctgaggcctggact

SEQ ID NO: 3700117 - DNA, 17 bp, Homo sapiens
gaggctgttcccaccag

SEQ ID NO: 3700118 - DNA, 17 bp, Homo sapiens
gaggcttcttcctggat

SEQ ID NO: 3700119 - DNA, 23 bp, Homo sapiens
gaggcttcttcctggatggggca

SEQ ID NO: 3700120 - DNA, 15 bp, Homo sapiens
gaggcttgcccagga

SEQ ID NO: 3700121 - DNA, 16 bp, Homo sapiens
gaggcttgcccaggag

SEQ ID NO: 3700122 - DNA, 12 bp, Homo sapiens
gagggaggcccc

SEQ ID NO: 3700123 - DNA, 12 bp, Homo sapiens
gagggaggggcc

SEQ ID NO: 3700124 - DNA, 15 bp, Homo sapiens
gagggagtagaatac

SEQ ID NO: 3700125 - DNA, 17 bp, Homo sapiens
gagggcaggtccagctc

SEQ ID NO: 3700126 - DNA, 16 bp, Homo sapiens
gagggcggagccggcc

SEQ ID NO: 3700127 - DNA, 23 bp, Homo sapiens
gagggcggcaggggcctggagat

SEQ ID NO: 3700128 - DNA, 17 bp, Homo sapiens
gaggggaaaaaaatgtt

SEQ ID NO: 3700129 - DNA, 21 bp, Homo sapiens
gaggggccggccctgtgtgca

SEQ ID NO: 3700130 - DNA, 22 bp, Homo sapiens
gaggggcctaggcctcagccag

SEQ ID NO: 3700131 - DNA, 20 bp, Homo sapiens
gaggggtccctagcagccca

SEQ ID NO: 3700132 - DNA, 20 bp, Homo sapiens
gagggtgagaggaagggtgg

SEQ ID NO: 3700133 - DNA, 13 bp, Homo sapiens
gagggttgtgcta

SEQ ID NO: 3700134 - DNA, 21 bp, Homo sapiens
gagggttttaggtagaaaaac

SEQ ID NO: 3700135 - DNA, 22 bp, Homo sapiens
ggatgggggaactcagatccag

SEQ ID NO: 3700136 - DNA, 18 bp, Homo sapiens
ggatgtcactcagatgga

SEQ ID NO: 3700137 - DNA, 20 bp, Homo sapiens
ggatgttcagcactgtccct

SEQ ID NO: 3700138 - DNA, 23 bp, Homo sapiens
ggatgtttctgtcacatcagctc

SEQ ID NO: 3700139 - DNA, 13 bp, Homo sapiens
ggattcaggctgc

SEQ ID NO: 3700140 - DNA, 14 bp, Homo sapiens
ggattctggttcca

SEQ ID NO: 3700141 - DNA, 16 bp, Homo sapiens
ggattggggtccctct

SEQ ID NO: 3700142 - DNA, 17 bp, Homo sapiens
ggattggggtccctcta

SEQ ID NO: 3700143 - DNA, 16 bp, Homo sapiens
ggatttttagaattaa

SEQ ID NO: 3700144 - DNA, 19 bp, Homo sapiens
ggcaactgcattggctttg

SEQ ID NO: 3700145 - DNA, 15 bp, Homo sapiens
ggcacaccgccatcc

SEQ ID NO: 3700146 - DNA, 23 bp, Homo sapiens
ggcacaccgccatcctctgcctc

SEQ ID NO: 3700147 - DNA, 20 bp, Homo sapiens
ggcacagcggagtctgtcct

SEQ ID NO: 3700148 - DNA, 12 bp, Homo sapiens
ggcacaggaggc

SEQ ID NO: 3700149 - DNA, 20 bp, Homo sapiens
ggcacaggaggcaggcatgg

SEQ ID NO: 3700150 - DNA, 20 bp, Homo sapiens
ggcaccagacacccaggact

SEQ ID NO: 3700151 - DNA, 17 bp, Homo sapiens
ggcaccaggggtttctc

SEQ ID NO: 3700152 - DNA, 23 bp, Homo sapiens
ggcactaggtaggcttctacctg

SEQ ID NO: 3700153 - DNA, 15 bp, Homo sapiens
ggcagaactcctacc

SEQ ID NO: 3700154 - DNA, 21 bp, Homo sapiens
ggcagaactcctacctgaagg

SEQ ID NO: 3700155 - DNA, 16 bp, Homo sapiens
ggcagaaggccaagag

SEQ ID NO: 3700156 - DNA, 19 bp, Homo sapiens
ggcagactctttatgcttg

SEQ ID NO: 3700157 - DNA, 22 bp, Homo sapiens
ggcagactctttatgcttgcaa

SEQ ID NO: 3700158 - DNA, 13 bp, Homo sapiens
ggcagagaataaa

SEQ ID NO: 3700159 - DNA, 21 bp, Homo sapiens
ggcagagcttctcctgaccag

SEQ ID NO: 3700160 - DNA, 21 bp, Homo sapiens
ggcagagcttgcagtgagccg

SEQ ID NO: 3700161 - DNA, 19 bp, Homo sapiens
ggcagagggcatcggggcc

SEQ ID NO: 3700162 - DNA, 15 bp, Homo sapiens
ggcagatctgtgccc

SEQ ID NO: 3700163 - DNA, 18 bp, Homo sapiens
ggcagcgtgccgagccag

SEQ ID NO: 3700164 - DNA, 13 bp, Homo sapiens
ggcagctggcagg

SEQ ID NO: 3700165 - DNA, 18 bp, Homo sapiens
ggcagctgtgtctgagcc

SEQ ID NO: 3700166 - DNA, 21 bp, Homo sapiens
ggcagctgtgtctgagcccaa

SEQ ID NO: 3700167 - DNA, 22 bp, Homo sapiens
ggcagctgtgtctgagcccaac

SEQ ID NO: 3700168 - DNA, 23 bp, Homo sapiens
ggcaggaaggagagcctgctgca

SEQ ID NO: 3700169 - DNA, 20 bp, Homo sapiens
ggcaggacaacgaggaagcc

SEQ ID NO: 3700170 - DNA, 20 bp, Homo sapiens
ggcaggcatggccctgggcg

SEQ ID NO: 3700171 - DNA, 13 bp, Homo sapiens
ggcaggctggcca

SEQ ID NO: 3700172 - DNA, 14 bp, Homo sapiens
ggcagggctcctcc

SEQ ID NO: 3700173 - DNA, 19 bp, Homo sapiens
ggcagggctcctccctgga

SEQ ID NO: 3700174 - DNA, 20 bp, Homo sapiens
ggcagggctcctccctggag

SEQ ID NO: 3700175 - DNA, 22 bp, Homo sapiens
ggcagggctcctccctggagct

SEQ ID NO: 3700176 - DNA, 14 bp, Homo sapiens
ggcaggggcctgga

SEQ ID NO: 3700177 - DNA, 16 bp, Homo sapiens
ggcaggggcctggaga

SEQ ID NO: 3700178 - DNA, 20 bp, Homo sapiens
ggcaggtaggtattagtgtt

SEQ ID NO: 3700179 - DNA, 18 bp, Homo sapiens
ggcaggtccagctctgtg

SEQ ID NO: 3700180 - DNA, 23 bp, Homo sapiens
ggcaggtccagctctgtgggccc

SEQ ID NO: 3700181 - DNA, 17 bp, Homo sapiens
ggcaggttggtgggggc

SEQ ID NO: 3700182 - DNA, 16 bp, Homo sapiens
ggcagtactcctccct

SEQ ID NO: 3700183 - DNA, 19 bp, Homo sapiens
ggcagtactcctccctggg

SEQ ID NO: 3700184 - DNA, 21 bp, Homo sapiens
ggcagtactcctccctggggg

SEQ ID NO: 3700185 - DNA, 21 bp, Homo sapiens
ggcagtgtggggagggcaggt

SEQ ID NO: 3700186 - DNA, 20 bp, Homo sapiens
ggcatcaccttaggcaggga

SEQ ID NO: 3700187 - DNA, 21 bp, Homo sapiens
ggcatctttgccttgggctgc

SEQ ID NO: 3700188 - DNA, 21 bp, Homo sapiens
ggcatgagactcagtgcagat

SEQ ID NO: 3700189 - DNA, 22 bp, Homo sapiens
ggcatgctggagtacccagcct

SEQ ID NO: 3700190 - DNA, 16 bp, Homo sapiens
ggcatgtttccagcag

SEQ ID NO: 3700191 - DNA, 16 bp, Homo sapiens
ggcattaacacaaagg

SEQ ID NO: 3700192 - DNA, 14 bp, Homo sapiens
ggcatttgctgaat

SEQ ID NO: 3700193 - DNA, 16 bp, Homo sapiens
ggccaaaggctggtgg

SEQ ID NO: 3700194 - DNA, 13 bp, Homo sapiens
ggccaacatggta

SEQ ID NO: 3700195 - DNA, 21 bp, Homo sapiens
ggccaagaatgtacgtccagc

SEQ ID NO: 3700196 - DNA, 14 bp, Homo sapiens
ggccaaggagctgc

SEQ ID NO: 3700197 - DNA, 13 bp, Homo sapiens
ggccaaggtggga

SEQ ID NO: 3700198 - DNA, 16 bp, Homo sapiens
ggccacatggcggaga

SEQ ID NO: 3700199 - DNA, 17 bp, Homo sapiens
ggccacctccccagcat

SEQ ID NO: 3700200 - DNA, 11 bp, Homo sapiens
ggccactaagc

SEQ ID NO: 3700201 - DNA, 13 bp, Homo sapiens
ggccactccgaga

SEQ ID NO: 3700202 - DNA, 17 bp, Homo sapiens
ggccactgagctggctg

SEQ ID NO: 3700203 - DNA, 11 bp, Homo sapiens
ggccactgtga

SEQ ID NO: 3700204 - DNA, 16 bp, Homo sapiens
ggccactgtgaagaga

SEQ ID NO: 3700205 - DNA, 20 bp, Homo sapiens
ggccactgtgaagagaacca

SEQ ID NO: 3700206 - DNA, 18 bp, Homo sapiens
ggccagacacaggccctc

SEQ ID NO: 3700207 - DNA, 16 bp, Homo sapiens
ggccagagtggcctgg

SEQ ID NO: 3700208 - DNA, 13 bp, Homo sapiens
ggccagatccagc

SEQ ID NO: 3700209 - DNA, 18 bp, Homo sapiens
ggccagatccagcctggg

SEQ ID NO: 3700210 - DNA, 21 bp, Homo sapiens
ggccagccccacccaggaggg

SEQ ID NO: 3700211 - DNA, 12 bp, Homo sapiens
ggccagcctggc

SEQ ID NO: 3700212 - DNA, 17 bp, Homo sapiens
ggccagcctggcatcag

SEQ ID NO: 3700213 - DNA, 19 bp, Homo sapiens
ggccagcgcccctcagcct

SEQ ID NO: 3700214 - DNA, 18 bp, Homo sapiens
ggccagctgcatctgtct

SEQ ID NO: 3700215 - DNA, 13 bp, Homo sapiens
ggccaggagctct

SEQ ID NO: 3700216 - DNA, 22 bp, Homo sapiens
ggccaggcagatctgtgcccca

SEQ ID NO: 3700217 - DNA, 21 bp, Homo sapiens
ggccaggctgatgggacagaa

SEQ ID NO: 3700218 - DNA, 15 bp, Homo sapiens
ggccagggagaagct

SEQ ID NO: 3700219 - DNA, 21 bp, Homo sapiens
ggccagtcctgcctggccagg

SEQ ID NO: 3700220 - DNA, 14 bp, Homo sapiens
ggccatgctgaggc

SEQ ID NO: 3700221 - DNA, 14 bp, Homo sapiens
ggccatggctcagg

SEQ ID NO: 3700222 - DNA, 14 bp, Homo sapiens
ggccattaggaaac

SEQ ID NO: 3700223 - DNA, 17 bp, Homo sapiens
ggccattaggaaactgt

SEQ ID NO: 3700224 - DNA, 20 bp, Homo sapiens
ggccatttggccggctctgg

SEQ ID NO: 3700225 - DNA, 18 bp, Homo sapiens
ggcccacccggtgggacc

SEQ ID NO: 3700226 - DNA, 20 bp, Homo sapiens
ggcccacccggtgggacccc

SEQ ID NO: 3700227 - DNA, 15 bp, Homo sapiens
ggcccagagaagcca

SEQ ID NO: 3700228 - DNA, 15 bp, Homo sapiens
ggcccagggcccaga

SEQ ID NO: 3700229 - DNA, 16 bp, Homo sapiens
ggcccagggcccagag

SEQ ID NO: 3700230 - DNA, 18 bp, Homo sapiens
ggcccagggcccagagcc

SEQ ID NO: 3700231 - DNA, 15 bp, Homo sapiens
ggccccaccctgggc

SEQ ID NO: 3700232 - DNA, 17 bp, Homo sapiens
ggccccaccctgggccc

SEQ ID NO: 3700233 - DNA, 15 bp, Homo sapiens
ggcccccacttgcct

SEQ ID NO: 3700234 - DNA, 18 bp, Homo sapiens
ggcccccagcccagggct

SEQ ID NO: 3700235 - DNA, 23 bp, Homo sapiens
ggcccccagcccagggctcctgc

SEQ ID NO: 3700236 - DNA, 15 bp, Homo sapiens
ggcccccttcctggc

SEQ ID NO: 3700237 - DNA, 19 bp, Homo sapiens
ggcccccttcctggcccct

SEQ ID NO: 3700238 - DNA, 22 bp, Homo sapiens
ggcccctcaccctgccttatct

SEQ ID NO: 3700239 - DNA, 22 bp, Homo sapiens
ggcccctctccaagcgcctggc

SEQ ID NO: 3700240 - DNA, 13 bp, Homo sapiens
ggcccgacatggc

SEQ ID NO: 3700241 - DNA, 20 bp, Homo sapiens
ggcccggccagccatgtctg

SEQ ID NO: 3700242 - DNA, 18 bp, Homo sapiens
ggcccggcccctcctgac

SEQ ID NO: 3700243 - DNA, 13 bp, Homo sapiens
ggccctaccctcc

SEQ ID NO: 3700244 - DNA, 19 bp, Homo sapiens
ggccctaccctcctgctga

SEQ ID NO: 3700245 - DNA, 22 bp, Homo sapiens
ggccctaccctcctgctgagct

SEQ ID NO: 3700246 - DNA, 24 bp, Homo sapiens
ggccctaccctcctgctgagctgc

SEQ ID NO: 3700247 - DNA, 14 bp, Homo sapiens
ggccctcccaaaga

SEQ ID NO: 3700248 - DNA, 18 bp, Homo sapiens
ggccctgagtctgggcag

SEQ ID NO: 3700249 - DNA, 17 bp, Homo sapiens
ggccctgccctggcagg

SEQ ID NO: 3700250 - DNA, 13 bp, Homo sapiens
ggccctggctgcc

SEQ ID NO: 3700251 - DNA, 22 bp, Homo sapiens
ggggccgctgccacccacctcc

SEQ ID NO: 3700252 - DNA, 17 bp, Homo sapiens
ggggcgccccaagagcc

SEQ ID NO: 3700253 - DNA, 18 bp, Homo sapiens
ggggcgggccctgcctga

SEQ ID NO: 3700254 - DNA, 21 bp, Homo sapiens
ggggctgctgacctccacagc

SEQ ID NO: 3700255 - DNA, 19 bp, Homo sapiens
ggggctgtggctctgggtg

SEQ ID NO: 3700256 - DNA, 20 bp, Homo sapiens
ggggctgtggctctgggtgg

SEQ ID NO: 3700257 - DNA, 21 bp, Homo sapiens
ggggctgtggctctgggtggg

SEQ ID NO: 3700258 - DNA, 13 bp, Homo sapiens
ggggcttctctgg

SEQ ID NO: 3700259 - DNA, 14 bp, Homo sapiens
ggggcttctctggg

SEQ ID NO: 3700260 - DNA, 14 bp, Homo sapiens
gggggagcctctgg

SEQ ID NO: 3700261 - DNA, 17 bp, Homo sapiens
gggggagtctgaagcag

SEQ ID NO: 3700262 - DNA, 15 bp, Homo sapiens
gggggcgaggcccct

SEQ ID NO: 3700263 - DNA, 17 bp, Homo sapiens
gggggcgaggcccctcc

SEQ ID NO: 3700264 - DNA, 22 bp, Homo sapiens
ggggtaaagtatcacttttctg

SEQ ID NO: 3700265 - DNA, 18 bp, Homo sapiens
ggggtagctagaggaacc

SEQ ID NO: 3700266 - DNA, 12 bp, Homo sapiens
ggggtctttgtg

SEQ ID NO: 3700267 - DNA, 16 bp, Homo sapiens
ggggtggggtcatgcc

SEQ ID NO: 3700268 - DNA, 20 bp, Homo sapiens
ggggtgtttgggaggctgcg

SEQ ID NO: 3700269 - DNA, 20 bp, Homo sapiens
ggggtttgaccacccacctg

SEQ ID NO: 3700270 - DNA, 22 bp, Homo sapiens
ggggttttatggtggatgaggc

SEQ ID NO: 3700271 - DNA, 17 bp, Homo sapiens
gggtaggctgctccctg

SEQ ID NO: 3700272 - DNA, 22 bp, Homo sapiens
gggtatgtttaatctgttatgt

SEQ ID NO: 3700273 - DNA, 14 bp, Homo sapiens
gggtcatgccctcc

SEQ ID NO: 3700274 - DNA, 21 bp, Homo sapiens
gggtccccaacccgtgcccct

SEQ ID NO: 3700275 - DNA, 14 bp, Homo sapiens
gggtcggctgacca

SEQ ID NO: 3700276 - DNA, 15 bp, Homo sapiens
gggtcggctgaccat

SEQ ID NO: 3700277 - DNA, 17 bp, Homo sapiens
gggtctccccacctgca

SEQ ID NO: 3700278 - DNA, 23 bp, Homo sapiens
gggtcttccctacctcaggcagg

SEQ ID NO: 3700279 - DNA, 16 bp, Homo sapiens
gggtcttgctctgtct

SEQ ID NO: 3700280 - DNA, 14 bp, Homo sapiens
gggtggagcaggac

SEQ ID NO: 3700281 - DNA, 19 bp, Homo sapiens
gggtggcaccagcagcctg

SEQ ID NO: 3700282 - DNA, 13 bp, Homo sapiens
gggtgggccaggc

SEQ ID NO: 3700283 - DNA, 16 bp, Homo sapiens
gggtgggcggggcact

SEQ ID NO: 3700284 - DNA, 22 bp, Homo sapiens
gggtgggcttttccctgggtgg

SEQ ID NO: 3700285 - DNA, 12 bp, Homo sapiens
gggtggggctcc

SEQ ID NO: 3700286 - DNA, 12 bp, Homo sapiens
gggtggggcttc

SEQ ID NO: 3700287 - DNA, 16 bp, Homo sapiens
gggtggggtagggctg

SEQ ID NO: 3700288 - DNA, 22 bp, Homo sapiens
gggtggtctcttcttggggccc

SEQ ID NO: 3700289 - DNA, 16 bp, Homo sapiens
gggtggtctgcaggca

SEQ ID NO: 3700290 - DNA, 19 bp, Homo sapiens
gggtgtccccgctgctgtg

SEQ ID NO: 3700291 - DNA, 14 bp, Homo sapiens
gggttcatttgtgt

SEQ ID NO: 3700292 - DNA, 21 bp, Homo sapiens
gggttccctttccttccatcc

SEQ ID NO: 3700293 - DNA, 22 bp, Homo sapiens
gggttctaggcatctctgtact

SEQ ID NO: 3700294 - DNA, 15 bp, Homo sapiens
gggttctcacagtgg

SEQ ID NO: 3700295 - DNA, 14 bp, Homo sapiens
gggttgggcccaga

SEQ ID NO: 3700296 - DNA, 22 bp, Homo sapiens
gggttgggcccagatctggtcc

SEQ ID NO: 3700297 - DNA, 12 bp, Homo sapiens
gggttggtaagg

SEQ ID NO: 3700298 - DNA, 16 bp, Homo sapiens
gggttggtatctcagg

SEQ ID NO: 3700299 - DNA, 16 bp, Homo sapiens
gggtttctctgtggct

SEQ ID NO: 3700300 - DNA, 14 bp, Homo sapiens
ggtacaaaaataaa

SEQ ID NO: 3700301 - DNA, 13 bp, Homo sapiens
ggtaccctgggtg

SEQ ID NO: 3700302 - DNA, 12 bp, Homo sapiens
ggtactcctgcc

SEQ ID NO: 3700303 - DNA, 16 bp, Homo sapiens
ggtacttcttgaaggt

SEQ ID NO: 3700304 - DNA, 16 bp, Homo sapiens
ggtacttgtcatttcg

SEQ ID NO: 3700305 - DNA, 13 bp, Homo sapiens
ggtagaaaaacat

SEQ ID NO: 3700306 - DNA, 17 bp, Homo sapiens
ggtagctagaggaacca

SEQ ID NO: 3700307 - DNA, 15 bp, Homo sapiens
ggtagctgcccctgg

SEQ ID NO: 3700308 - DNA, 18 bp, Homo sapiens
ggtaggttcagccaaggt

SEQ ID NO: 3700309 - DNA, 17 bp, Homo sapiens
ggtagtcctcccaagct

SEQ ID NO: 3700310 - DNA, 21 bp, Homo sapiens
ggtataaaactttcctcgcct

SEQ ID NO: 3700311 - DNA, 22 bp, Homo sapiens
ggtataaaactttcctcgcctg

SEQ ID NO: 3700312 - DNA, 16 bp, Homo sapiens
ggtattttttcctttt

SEQ ID NO: 3700313 - DNA, 20 bp, Homo sapiens
ggtcaatacagtacaggcag

SEQ ID NO: 3700314 - DNA, 15 bp, Homo sapiens
ggtcagagccactct

SEQ ID NO: 3700315 - DNA, 18 bp, Homo sapiens
ggtcagcccaagattctt

SEQ ID NO: 3700316 - DNA, 16 bp, Homo sapiens
ggtcatagcagtgctt

SEQ ID NO: 3700317 - DNA, 15 bp, Homo sapiens
ggtcatgccctcctc

SEQ ID NO: 3700318 - DNA, 17 bp, Homo sapiens
ggtcatgccctcctctc

SEQ ID NO: 3700319 - DNA, 12 bp, Homo sapiens
ggtccagccccc

SEQ ID NO: 3700320 - DNA, 22 bp, Homo sapiens
ggtccagctctggaggggaggg

SEQ ID NO: 3700321 - DNA, 13 bp, Homo sapiens
ggtccagctctgt

SEQ ID NO: 3700322 - DNA, 19 bp, Homo sapiens
ggtccagctctgtgggccc

SEQ ID NO: 3700323 - DNA, 21 bp, Homo sapiens
ggtccagctctgtgggcccta

SEQ ID NO: 3700324 - DNA, 11 bp, Homo sapiens
ggtccagggaa

SEQ ID NO: 3700325 - DNA, 15 bp, Homo sapiens
ggtcccagccacccc

SEQ ID NO: 3700326 - DNA, 23 bp, Homo sapiens
ggtcccttgcagctagttttcta

SEQ ID NO: 3700327 - DNA, 17 bp, Homo sapiens
ggtccgctttcctggag

SEQ ID NO: 3700328 - DNA, 19 bp, Homo sapiens
ggtccgctttcctggagcc

SEQ ID NO: 3700329 - DNA, 20 bp, Homo sapiens
ggtcctacccatccccgcag

SEQ ID NO: 3700330 - DNA, 14 bp, Homo sapiens
ggtcgctcctgccc

SEQ ID NO: 3700331 - DNA, 13 bp, Homo sapiens
ggtctcacccatg

SEQ ID NO: 3700332 - DNA, 16 bp, Homo sapiens
ggtctccccacctgca

SEQ ID NO: 3700333 - DNA, 21 bp, Homo sapiens
ggtctcttcttggggcccagt

SEQ ID NO: 3700334 - DNA, 13 bp, Homo sapiens
ggtctctttgctt

SEQ ID NO: 3700335 - DNA, 21 bp, Homo sapiens
ggtctgagaagattcaattta

SEQ ID NO: 3700336 - DNA, 20 bp, Homo sapiens
ggtctgctctttctctgcca

SEQ ID NO: 3700337 - DNA, 14 bp, Homo sapiens
ggtctgtagggatt

SEQ ID NO: 3700338 - DNA, 16 bp, Homo sapiens
ggtctgttggcaggct

SEQ ID NO: 3700339 - DNA, 18 bp, Homo sapiens
ggtctgttggcaggctgg

SEQ ID NO: 3700340 - DNA, 20 bp, Homo sapiens
ggtcttccctacctcaggca

SEQ ID NO: 3700341 - DNA, 15 bp, Homo sapiens
ggtcttgctggaaga

SEQ ID NO: 3700342 - DNA, 20 bp, Homo sapiens
ggtctttcagtactttttta

SEQ ID NO: 3700343 - DNA, 18 bp, Homo sapiens
ggtctttcctaaggctgc

SEQ ID NO: 3700344 - DNA, 13 bp, Homo sapiens
ggtgaaagggagc

SEQ ID NO: 3700345 - DNA, 12 bp, Homo sapiens
ggtgagaaaaaa

SEQ ID NO: 3700346 - DNA, 16 bp, Homo sapiens
ggtgagtaaggcatgt

SEQ ID NO: 3700347 - DNA, 14 bp, Homo sapiens
ggtgcccaagccag

SEQ ID NO: 3700348 - DNA, 23 bp, Homo sapiens
ggtgcccaagccagaggctgggt

SEQ ID NO: 3700349 - DNA, 21 bp, Homo sapiens
ggtgcccacaccggggacagg

SEQ ID NO: 3700350 - DNA, 16 bp, Homo sapiens
ggtgccccaggaccag

SEQ ID NO: 3700351 - DNA, 20 bp, Homo sapiens
ggtgccccaggaccagctca

SEQ ID NO: 3700352 - DNA, 12 bp, Homo sapiens
ggtgcccctctt

SEQ ID NO: 3700353 - DNA, 17 bp, Homo sapiens
ggtgcccctcttccaaa

SEQ ID NO: 3700354 - DNA, 18 bp, Homo sapiens
ggtgcctttcaaatttag

SEQ ID NO: 3700355 - DNA, 20 bp, Homo sapiens
ggtgctgacggccagggaga

SEQ ID NO: 3700356 - DNA, 21 bp, Homo sapiens
ggtgctgcagcaccgaggggc

SEQ ID NO: 3700357 - DNA, 13 bp, Homo sapiens
ggtgctgtgaggc

SEQ ID NO: 3700358 - DNA, 20 bp, Homo sapiens
ggtggagcaggactcccacc

SEQ ID NO: 3700359 - DNA, 20 bp, Homo sapiens
ggtggcaccagcagcctgga

SEQ ID NO: 3700360 - DNA, 18 bp, Homo sapiens
ggtggcagtggaggtggg

SEQ ID NO: 3700361 - DNA, 16 bp, Homo sapiens
ggtggccactgagctg

SEQ ID NO: 3700362 - DNA, 19 bp, Homo sapiens
ggtggcgggtgcctgtaat

SEQ ID NO: 3700363 - DNA, 21 bp, Homo sapiens
ggtggctagtcaagctcctcc

SEQ ID NO: 3700364 - DNA, 12 bp, Homo sapiens
ggtggctgggct

SEQ ID NO: 3700365 - DNA, 23 bp, Homo sapiens
ggtgggaaggggagcacaatttc

SEQ ID NO: 3700366 - DNA, 18 bp, Homo sapiens
ggtgggacagggcttctc

SEQ ID NO: 3700367 - DNA, 21 bp, Homo sapiens
ggtgggactcttccctgggaa

SEQ ID NO: 3700368 - DNA, 14 bp, Homo sapiens
gtcttcaggggagg

SEQ ID NO: 3700369 - DNA, 15 bp, Homo sapiens
gtcttccctacctca

SEQ ID NO: 3700370 - DNA, 18 bp, Homo sapiens
gtcttccctacctcaggc

SEQ ID NO: 3700371 - DNA, 21 bp, Homo sapiens
gtcttccctacctcaggcagg

SEQ ID NO: 3700372 - DNA, 20 bp, Homo sapiens
gtcttgctggaagacagaga

SEQ ID NO: 3700373 - DNA, 19 bp, Homo sapiens
gtcttgggcagagctggct

SEQ ID NO: 3700374 - DNA, 22 bp, Homo sapiens
gtcttgggcagagctggctctg

SEQ ID NO: 3700375 - DNA, 20 bp, Homo sapiens
gtcttgttgttattgatgtt

SEQ ID NO: 3700376 - DNA, 15 bp, Homo sapiens
gtctttcagtacttt

SEQ ID NO: 3700377 - DNA, 16 bp, Homo sapiens
gtctttcagtactttt

SEQ ID NO: 3700378 - DNA, 19 bp, Homo sapiens
gtctttcccatggggaggg

SEQ ID NO: 3700379 - DNA, 13 bp, Homo sapiens
gtcttttgacatt

SEQ ID NO: 3700380 - DNA, 14 bp, Homo sapiens
gtcttttgcttttg

SEQ ID NO: 3700381 - DNA, 14 bp, Homo sapiens
gtcttttttttcct

SEQ ID NO: 3700382 - DNA, 23 bp, Homo sapiens
gtgaaaagaaaaatgagcctggc

SEQ ID NO: 3700383 - DNA, 20 bp, Homo sapiens
gtgaaagcatcacttgggat

SEQ ID NO: 3700384 - DNA, 21 bp, Homo sapiens
gtgaaagggagctatcaggaa

SEQ ID NO: 3700385 - DNA, 14 bp, Homo sapiens
gtgaaagtttttct

SEQ ID NO: 3700386 - DNA, 18 bp, Homo sapiens
gtgaaataccacaagcct

SEQ ID NO: 3700387 - DNA, 15 bp, Homo sapiens
gtgaactggaagaaa

SEQ ID NO: 3700388 - DNA, 17 bp, Homo sapiens
gtgaacttgggccactg

SEQ ID NO: 3700389 - DNA, 12 bp, Homo sapiens
gtgaaggaccct

SEQ ID NO: 3700390 - DNA, 20 bp, Homo sapiens
gtgaaggccgagaagcaaga

SEQ ID NO: 3700391 - DNA, 20 bp, Homo sapiens
gtgaatgctgggactcagcc

SEQ ID NO: 3700392 - DNA, 21 bp, Homo sapiens
gtgaatgctgggactcagcct

SEQ ID NO: 3700393 - DNA, 16 bp, Homo sapiens
gtgacaaaccatccag

SEQ ID NO: 3700394 - DNA, 23 bp, Homo sapiens
gtgacaaaccatccagtggaggt

SEQ ID NO: 3700395 - DNA, 16 bp, Homo sapiens
gtgacagacaggctct

SEQ ID NO: 3700396 - DNA, 15 bp, Homo sapiens
gtgaccggacttttc

SEQ ID NO: 3700397 - DNA, 19 bp, Homo sapiens
gtgaccggacttttctgca

SEQ ID NO: 3700398 - DNA, 14 bp, Homo sapiens
gtgacctgaggaag

SEQ ID NO: 3700399 - DNA, 13 bp, Homo sapiens
gtgacctgtttat

SEQ ID NO: 3700400 - DNA, 20 bp, Homo sapiens
gtgagaagtgaatgctggga

SEQ ID NO: 3700401 - DNA, 14 bp, Homo sapiens
gtgagacccccaca

SEQ ID NO: 3700402 - DNA, 15 bp, Homo sapiens
gtgagaggaagggtg

SEQ ID NO: 3700403 - DNA, 18 bp, Homo sapiens
gtgaggatgtcactcaga

SEQ ID NO: 3700404 - DNA, 14 bp, Homo sapiens
gtgaggctgtcctg

SEQ ID NO: 3700405 - DNA, 22 bp, Homo sapiens
gtgatagtcttttgcttttggc

SEQ ID NO: 3700406 - DNA, 21 bp, Homo sapiens
gtgatcctctcacctcagcct

SEQ ID NO: 3700407 - DNA, 15 bp, Homo sapiens
gtgatgttcatgggt

SEQ ID NO: 3700408 - DNA, 20 bp, Homo sapiens
gtgattcacagtgtgaatct

SEQ ID NO: 3700409 - DNA, 21 bp, Homo sapiens
gtgattgacagctttgctgct

SEQ ID NO: 3700410 - DNA, 23 bp, Homo sapiens
gtgattgacagctttgctgctga

SEQ ID NO: 3700411 - DNA, 14 bp, Homo sapiens
gtgcaacccttacc

SEQ ID NO: 3700412 - DNA, 19 bp, Homo sapiens
gtgcaacctcgctgagggc

SEQ ID NO: 3700413 - DNA, 21 bp, Homo sapiens
gtgcaataaatctgacccagt

SEQ ID NO: 3700414 - DNA, 14 bp, Homo sapiens
gtgcactttgtaaa

SEQ ID NO: 3700415 - DNA, 22 bp, Homo sapiens
gtgcagaatgtaagtgggccca

SEQ ID NO: 3700416 - DNA, 19 bp, Homo sapiens
gtgcagaggtaccctgggt

SEQ ID NO: 3700417 - DNA, 15 bp, Homo sapiens
gtgcagatggagaga

SEQ ID NO: 3700418 - DNA, 15 bp, Homo sapiens
gtgcatagtttcttt

SEQ ID NO: 3700419 - DNA, 20 bp, Homo sapiens
gtgcatgcattgagctgcct

SEQ ID NO: 3700420 - DNA, 13 bp, Homo sapiens
gtgcatttttgta

SEQ ID NO: 3700421 - DNA, 15 bp, Homo sapiens
gtgcatttttgtaaa

SEQ ID NO: 3700422 - DNA, 22 bp, Homo sapiens
gtgccaaacaaaaaggttctca

SEQ ID NO: 3700423 - DNA, 16 bp, Homo sapiens
gtgccaccatgcctca

SEQ ID NO: 3700424 - DNA, 19 bp, Homo sapiens
gtgccacccacctttgcca

SEQ ID NO: 3700425 - DNA, 22 bp, Homo sapiens
gtgccacccacctttgccacaa

SEQ ID NO: 3700426 - DNA, 21 bp, Homo sapiens
gtgccaccccttcctcagcct

SEQ ID NO: 3700427 - DNA, 13 bp, Homo sapiens
gtgccactgcggg

SEQ ID NO: 3700428 - DNA, 12 bp, Homo sapiens
gtgccccaggac

SEQ ID NO: 3700429 - DNA, 19 bp, Homo sapiens
gtgccccaggaccagctca

SEQ ID NO: 3700430 - DNA, 18 bp, Homo sapiens
gtgccccatgcctgtcca

SEQ ID NO: 3700431 - DNA, 21 bp, Homo sapiens
gtgccccatgcctgtccagcc

SEQ ID NO: 3700432 - DNA, 13 bp, Homo sapiens
gtgcccccactga

SEQ ID NO: 3700433 - DNA, 15 bp, Homo sapiens
gtgcccctccaagtc

SEQ ID NO: 3700434 - DNA, 12 bp, Homo sapiens
gtgcccctggga

SEQ ID NO: 3700435 - DNA, 13 bp, Homo sapiens
gtgcccctgggat

SEQ ID NO: 3700436 - DNA, 19 bp, Homo sapiens
gtgcccctgggatccgagg

SEQ ID NO: 3700437 - DNA, 17 bp, Homo sapiens
gtgcctagactgttact

SEQ ID NO: 3700438 - DNA, 11 bp, Homo sapiens
gtgcctggggt

SEQ ID NO: 3700439 - DNA, 13 bp, Homo sapiens
gtgcctgtgtcca

SEQ ID NO: 3700440 - DNA, 12 bp, Homo sapiens
gtgcctttcaaa

SEQ ID NO: 3700441 - DNA, 14 bp, Homo sapiens
gtgcggccaccacc

SEQ ID NO: 3700442 - DNA, 21 bp, Homo sapiens
gtgctgacggccagggagaag

SEQ ID NO: 3700443 - DNA, 23 bp, Homo sapiens
gtgctgagttggtgttgacatgt

SEQ ID NO: 3700444 - DNA, 14 bp, Homo sapiens
gtgctgcagcaccg

SEQ ID NO: 3700445 - DNA, 19 bp, Homo sapiens
gtgctgggaagcccggact

SEQ ID NO: 3700446 - DNA, 16 bp, Homo sapiens
gtgctgggagctccac

SEQ ID NO: 3700447 - DNA, 22 bp, Homo sapiens
gtgctgggagctccactctgct

SEQ ID NO: 3700448 - DNA, 22 bp, Homo sapiens
gtgcttgtttgctcacctgggg

SEQ ID NO: 3700449 - DNA, 21 bp, Homo sapiens
gtggacagtgctgttgaagat

SEQ ID NO: 3700450 - DNA, 16 bp, Homo sapiens
gtggagaactcctagg

SEQ ID NO: 3700451 - DNA, 16 bp, Homo sapiens
gtggagagctggtgcc

SEQ ID NO: 3700452 - DNA, 23 bp, Homo sapiens
gtggaggagctcaggacactaat

SEQ ID NO: 3700453 - DNA, 14 bp, Homo sapiens
gtggaggctcctgt

SEQ ID NO: 3700454 - DNA, 15 bp, Homo sapiens
gtggaggctcctgtg

SEQ ID NO: 3700455 - DNA, 21 bp, Homo sapiens
gtggatgaggcttcttcctgg

SEQ ID NO: 3700456 - DNA, 13 bp, Homo sapiens
gtggatggcagtg

SEQ ID NO: 3700457 - DNA, 15 bp, Homo sapiens
gtggatggccccagc

SEQ ID NO: 3700458 - DNA, 22 bp, Homo sapiens
gtggatggccccagcacagctt

SEQ ID NO: 3700459 - DNA, 20 bp, Homo sapiens
gtggcaggggacaggagtcc

SEQ ID NO: 3700460 - DNA, 20 bp, Homo sapiens
gtggcatctttgccttgggc

SEQ ID NO: 3700461 - DNA, 18 bp, Homo sapiens
gtggccaaggagctgcta

SEQ ID NO: 3700462 - DNA, 19 bp, Homo sapiens
gtggccaaggagctgctat

SEQ ID NO: 3700463 - DNA, 16 bp, Homo sapiens
gtggccactgagctgg

SEQ ID NO: 3700464 - DNA, 13 bp, Homo sapiens
gtggccagaggtg

SEQ ID NO: 3700465 - DNA, 14 bp, Homo sapiens
gtggccagcctggc

SEQ ID NO: 3700466 - DNA, 18 bp, Homo sapiens
gtggccagcctggcatca

SEQ ID NO: 3700467 - DNA, 19 bp, Homo sapiens
gtggccccaccctgggccc

SEQ ID NO: 3700468 - DNA, 20 bp, Homo sapiens
gtggccccaccctgggccct

SEQ ID NO: 3700469 - DNA, 16 bp, Homo sapiens
gtggccccgtttctgg

SEQ ID NO: 3700470 - DNA, 18 bp, Homo sapiens
gtggcctggccaggagct

SEQ ID NO: 3700471 - DNA, 17 bp, Homo sapiens
gtggcctgtggctgtcg

SEQ ID NO: 3700472 - DNA, 18 bp, Homo sapiens
gtggcctgtggctgtcgg

SEQ ID NO: 3700473 - DNA, 17 bp, Homo sapiens
gtggcgccgtctccagg

SEQ ID NO: 3700474 - DNA, 19 bp, Homo sapiens
gtggctagtcaagctcctc

SEQ ID NO: 3700475 - DNA, 17 bp, Homo sapiens
gtggctgagcccctgtc

SEQ ID NO: 3700476 - DNA, 16 bp, Homo sapiens
gtggctgggggcagga

SEQ ID NO: 3700477 - DNA, 17 bp, Homo sapiens
gtggctgggggcaggag

SEQ ID NO: 3700478 - DNA, 22 bp, Homo sapiens
gtggctgggggcaggagggccc

SEQ ID NO: 3700479 - DNA, 15 bp, Homo sapiens
gtgggacagggcttc

SEQ ID NO: 3700480 - DNA, 19 bp, Homo sapiens
gtgggacggtgcccaagcc

SEQ ID NO: 3700481 - DNA, 20 bp, Homo sapiens
gtgggacggtgcccaagcca

SEQ ID NO: 3700482 - DNA, 22 bp, Homo sapiens
gtgggcccacccggtgggaccc

SEQ ID NO: 3700483 - DNA, 20 bp, Homo sapiens
gtgggccctaccctcctgct

SEQ ID NO: 3700484 - DNA, 21 bp, Homo sapiens
tacttagggaagaaaaagcaa

SEQ ID NO: 3700485 - DNA, 18 bp, Homo sapiens
tacttcattttcagagtg

SEQ ID NO: 3700486 - DNA, 19 bp, Homo sapiens
tacttcattttcagagtga

SEQ ID NO: 3700487 - DNA, 14 bp, Homo sapiens
tacttcttgaaggt

SEQ ID NO: 3700488 - DNA, 13 bp, Homo sapiens
tacttgaactgtt

SEQ ID NO: 3700489 - DNA, 19 bp, Homo sapiens
tacttgaactgttgccctt

SEQ ID NO: 3700490 - DNA, 11 bp, Homo sapiens
tacttgaaggg

SEQ ID NO: 3700491 - DNA, 15 bp, Homo sapiens
tacttgaagggccag

SEQ ID NO: 3700492 - DNA, 19 bp, Homo sapiens
tacttgaagggccagagcc

SEQ ID NO: 3700493 - DNA, 16 bp, Homo sapiens
tacttgctcaggtact

SEQ ID NO: 3700494 - DNA, 14 bp, Homo sapiens
tacttggtttgtgt

SEQ ID NO: 3700495 - DNA, 22 bp, Homo sapiens
tactttgcaatccaaataaaga

SEQ ID NO: 3700496 - DNA, 17 bp, Homo sapiens
tactttggcaatttcct

SEQ ID NO: 3700497 - DNA, 16 bp, Homo sapiens
tacttttcattctctt

SEQ ID NO: 3700498 - DNA, 19 bp, Homo sapiens
tactttttagtaatttctt

SEQ ID NO: 3700499 - DNA, 12 bp, Homo sapiens
tactttttctaa

SEQ ID NO: 3700500 - DNA, 16 bp, Homo sapiens
tactttttctaatgag

SEQ ID NO: 3700501 - DNA, 20 bp, Homo sapiens
tacttttttaaatattttct

SEQ ID NO: 3700502 - DNA, 14 bp, Homo sapiens
tagaaaagttatta

SEQ ID NO: 3700503 - DNA, 15 bp, Homo sapiens
tagaaaattcataac

SEQ ID NO: 3700504 - DNA, 19 bp, Homo sapiens
tagaaactaattgacttta

SEQ ID NO: 3700505 - DNA, 16 bp, Homo sapiens
tagaaatggaaatttt

SEQ ID NO: 3700506 - DNA, 21 bp, Homo sapiens
tagaaatggaaattttgctat

SEQ ID NO: 3700507 - DNA, 23 bp, Homo sapiens
tagaaccaggcaacttgggaact

SEQ ID NO: 3700508 - DNA, 19 bp, Homo sapiens
tagaagagggttttaggta

SEQ ID NO: 3700509 - DNA, 22 bp, Homo sapiens
tagaagggccagtcctgcctgg

SEQ ID NO: 3700510 - DNA, 15 bp, Homo sapiens
tagaatagcctgagg

SEQ ID NO: 3700511 - DNA, 14 bp, Homo sapiens
tagaattaaaaaag

SEQ ID NO: 3700512 - DNA, 21 bp, Homo sapiens
tagaattaaaaaagcatactt

SEQ ID NO: 3700513 - DNA, 17 bp, Homo sapiens
tagaccttgttacttct

SEQ ID NO: 3700514 - DNA, 21 bp, Homo sapiens
tagactattccttttctgtat

SEQ ID NO: 3700515 - DNA, 23 bp, Homo sapiens
tagagcagggattaacctctgca

SEQ ID NO: 3700516 - DNA, 18 bp, Homo sapiens
tagaggccagccccaccc

SEQ ID NO: 3700517 - DNA, 20 bp, Homo sapiens
tagaggccagccccacccag

SEQ ID NO: 3700518 - DNA, 22 bp, Homo sapiens
tagagggacggccaagaatgta

SEQ ID NO: 3700519 - DNA, 14 bp, Homo sapiens
tagagggaggggcc

SEQ ID NO: 3700520 - DNA, 21 bp, Homo sapiens
tagagtgatgactgcttgtag

SEQ ID NO: 3700521 - DNA, 19 bp, Homo sapiens
tagatacactaaaaatctg

SEQ ID NO: 3700522 - DNA, 12 bp, Homo sapiens
tagatctccagc

SEQ ID NO: 3700523 - DNA, 16 bp, Homo sapiens
tagatctggcatgtta

SEQ ID NO: 3700524 - DNA, 13 bp, Homo sapiens
tagattttccaaa

SEQ ID NO: 3700525 - DNA, 12 bp, Homo sapiens
tagattttttca

SEQ ID NO: 3700526 - DNA, 16 bp, Homo sapiens
tagcactttgggaggc

SEQ ID NO: 3700527 - DNA, 14 bp, Homo sapiens
tagcagcccaccct

SEQ ID NO: 3700528 - DNA, 17 bp, Homo sapiens
tagcagcccaccctgct

SEQ ID NO: 3700529 - DNA, 14 bp, Homo sapiens
tagcagcttccaga

SEQ ID NO: 3700530 - DNA, 15 bp, Homo sapiens
tagcagcttccagat

SEQ ID NO: 3700531 - DNA, 18 bp, Homo sapiens
tagccagcccctcttccc

SEQ ID NO: 3700532 - DNA, 18 bp, Homo sapiens
tagccatgcaacatggat

SEQ ID NO: 3700533 - DNA, 12 bp, Homo sapiens
tagcctccctga

SEQ ID NO: 3700534 - DNA, 19 bp, Homo sapiens
tagcgtgcccgtgtgcatg

SEQ ID NO: 3700535 - DNA, 14 bp, Homo sapiens
tagctaacagtgaa

SEQ ID NO: 3700536 - DNA, 15 bp, Homo sapiens
tagctaactgtaaat

SEQ ID NO: 3700537 - DNA, 23 bp, Homo sapiens
tagctacaggaagcaccccatgc

SEQ ID NO: 3700538 - DNA, 16 bp, Homo sapiens
tagctcctgtggcccc

SEQ ID NO: 3700539 - DNA, 20 bp, Homo sapiens
tagctcctgtggccccaccc

SEQ ID NO: 3700540 - DNA, 20 bp, Homo sapiens
tagcttggaaactggatgag

SEQ ID NO: 3700541 - DNA, 13 bp, Homo sapiens
tagctttcctggt

SEQ ID NO: 3700542 - DNA, 13 bp, Homo sapiens
taggaagagaggt

SEQ ID NO: 3700543 - DNA, 21 bp, Homo sapiens
taggaagagaggtccagcccc

SEQ ID NO: 3700544 - DNA, 14 bp, Homo sapiens
taggatttttagaa

SEQ ID NO: 3700545 - DNA, 17 bp, Homo sapiens
taggcatctctgtactt

SEQ ID NO: 3700546 - DNA, 14 bp, Homo sapiens
taggcatgtaaaca

SEQ ID NO: 3700547 - DNA, 20 bp, Homo sapiens
taggcattaacacaaaggag

SEQ ID NO: 3700548 - DNA, 16 bp, Homo sapiens
taggcatttgctgaat

SEQ ID NO: 3700549 - DNA, 14 bp, Homo sapiens
taggcctcagccag

SEQ ID NO: 3700550 - DNA, 18 bp, Homo sapiens
taggcctcagccagagaa

SEQ ID NO: 3700551 - DNA, 14 bp, Homo sapiens
taggctccttcctg

SEQ ID NO: 3700552 - DNA, 15 bp, Homo sapiens
taggctccttcctgt

SEQ ID NO: 3700553 - DNA, 17 bp, Homo sapiens
taggctccttcctgtgg

SEQ ID NO: 3700554 - DNA, 18 bp, Homo sapiens
taggctggtggcccagga

SEQ ID NO: 3700555 - DNA, 18 bp, Homo sapiens
taggcttagtttgtgtgt

SEQ ID NO: 3700556 - DNA, 15 bp, Homo sapiens
taggcttctacctgc

SEQ ID NO: 3700557 - DNA, 12 bp, Homo sapiens
taggcttttgtt

SEQ ID NO: 3700558 - DNA, 21 bp, Homo sapiens
tagggaatggcacagcccaaa

SEQ ID NO: 3700559 - DNA, 19 bp, Homo sapiens
tagggacatttccaagctg

SEQ ID NO: 3700560 - DNA, 15 bp, Homo sapiens
tagggcaccaggggt

SEQ ID NO: 3700561 - DNA, 20 bp, Homo sapiens
tagggcaccaggggtttctc

SEQ ID NO: 3700562 - DNA, 17 bp, Homo sapiens
taggtatgtctgtgcca

SEQ ID NO: 3700563 - DNA, 18 bp, Homo sapiens
taggtatgtctgtgccat

SEQ ID NO: 3700564 - DNA, 15 bp, Homo sapiens
taggttcagccaagg

SEQ ID NO: 3700565 - DNA, 15 bp, Homo sapiens
tagtaaaaatacaaa

SEQ ID NO: 3700566 - DNA, 23 bp, Homo sapiens
tagtaatttattgtctgtctaca

SEQ ID NO: 3700567 - DNA, 24 bp, Homo sapiens
tagtaatttattgtctgtctacat

SEQ ID NO: 3700568 - DNA, 20 bp, Homo sapiens
tagtaatttctttttttcct

SEQ ID NO: 3700569 - DNA, 21 bp, Homo sapiens
tagtaatttctttttttcctt

SEQ ID NO: 3700570 - DNA, 23 bp, Homo sapiens
tagtatttgattcaaaatattta

SEQ ID NO: 3700571 - DNA, 15 bp, Homo sapiens
tagtcaagctcctcc

SEQ ID NO: 3700572 - DNA, 19 bp, Homo sapiens
tagtcaatcaagtctgttt

SEQ ID NO: 3700573 - DNA, 22 bp, Homo sapiens
tagtcccttcccctccctggct

SEQ ID NO: 3700574 - DNA, 23 bp, Homo sapiens
tagtcccttcccctccctggctc

SEQ ID NO: 3700575 - DNA, 21 bp, Homo sapiens
tagtccgtgctgacagctgct

SEQ ID NO: 3700576 - DNA, 23 bp, Homo sapiens
tagtccgtgctgacagctgctcc

SEQ ID NO: 3700577 - DNA, 15 bp, Homo sapiens
tagtcctcccaagct

SEQ ID NO: 3700578 - DNA, 23 bp, Homo sapiens
tagtcctcccaagctgtgctggg

SEQ ID NO: 3700579 - DNA, 21 bp, Homo sapiens
tagtcctgggagaggacaggg

SEQ ID NO: 3700580 - DNA, 11 bp, Homo sapiens
tagtcctgtga

SEQ ID NO: 3700581 - DNA, 19 bp, Homo sapiens
tagtctagatggctcctct

SEQ ID NO: 3700582 - DNA, 18 bp, Homo sapiens
tagtctgtgtgaaggtga

SEQ ID NO: 3700583 - DNA, 15 bp, Homo sapiens
tagtcttgaatttct

SEQ ID NO: 3700584 - DNA, 18 bp, Homo sapiens
tagtctttgccagtcatt

SEQ ID NO: 3700585 - DNA, 16 bp, Homo sapiens
tagtcttttgcttttg

SEQ ID NO: 3700586 - DNA, 16 bp, Homo sapiens
tagtgacttgtgtccc

SEQ ID NO: 3700587 - DNA, 18 bp, Homo sapiens
tagtgtacatttctataa

SEQ ID NO: 3700588 - DNA, 21 bp, Homo sapiens
tagtgtacatttctataaata

SEQ ID NO: 3700589 - DNA, 23 bp, Homo sapiens
tagtgtacatttctataaataga

SEQ ID NO: 3700590 - DNA, 13 bp, Homo sapiens
tagttgctatttt

SEQ ID NO: 3700591 - DNA, 12 bp, Homo sapiens
tagtttctttat

SEQ ID NO: 3700592 - DNA, 17 bp, Homo sapiens
tagtttctttattttgt

SEQ ID NO: 3700593 - DNA, 16 bp, Homo sapiens
tataaagtagtcctgt

SEQ ID NO: 3700594 - DNA, 14 bp, Homo sapiens
tataatatctaaag

SEQ ID NO: 3700595 - DNA, 20 bp, Homo sapiens
tataatatctaaagttatat

SEQ ID NO: 3700596 - DNA, 15 bp, Homo sapiens
tatactgatttaatt

SEQ ID NO: 3700597 - DNA, 17 bp, Homo sapiens
tatactgtacaataaaa

SEQ ID NO: 3700598 - DNA, 21 bp, Homo sapiens
tatactgtacaataaaaacat

SEQ ID NO: 3700599 - DNA, 22 bp, Homo sapiens
tatactgtacaataaaaacatt

SEQ ID NO: 3700600 - DNA, 15 bp, Homo sapiens
tcaaaatatttaaaa

SEQ ID NO: 3700601 - DNA, 21 bp, Homo sapiens
tcaaacaaagccagaagctga

SEQ ID NO: 3700602 - DNA, 15 bp, Homo sapiens
tcaaacgtgaaaatg

SEQ ID NO: 3700603 - DNA, 14 bp, Homo sapiens
tcaaagaagctgtc

SEQ ID NO: 3700604 - DNA, 19 bp, Homo sapiens
tcaaaggcacagtgaaggc

SEQ ID NO: 3700605 - DNA, 15 bp, Homo sapiens
tcaaagtatgtatgt

SEQ ID NO: 3700606 - DNA, 12 bp, Homo sapiens
tcaaataagaaa

SEQ ID NO: 3700607 - DNA, 20 bp, Homo sapiens
tcaaatgcagtatatttctt

SEQ ID NO: 3700608 - DNA, 22 bp, Homo sapiens
tcaaatttagaaactaattgac

SEQ ID NO: 3700609 - DNA, 13 bp, Homo sapiens
tcaacaagcctga

SEQ ID NO: 3700610 - DNA, 17 bp, Homo sapiens
tcaacagttttcctatg

SEQ ID NO: 3700611 - DNA, 17 bp, Homo sapiens
tcaagcagtcgtgcctg

SEQ ID NO: 3700612 - DNA, 15 bp, Homo sapiens
tcaagcctgtgcaaa

SEQ ID NO: 3700613 - DNA, 15 bp, Homo sapiens
tcaagctcctcctcc

SEQ ID NO: 3700614 - DNA, 16 bp, Homo sapiens
tcaagctcctcctccc

SEQ ID NO: 3700615 - DNA, 18 bp, Homo sapiens
tcaagctcctcctccctg

SEQ ID NO: 3700616 - DNA, 18 bp, Homo sapiens
tcaagcttagtgagcagt

SEQ ID NO: 3700617 - DNA, 21 bp, Homo sapiens
tcaagcttagtgagcagtgag

SEQ ID NO: 3700618 - DNA, 18 bp, Homo sapiens
tcaagggtcttcagggga

SEQ ID NO: 3700619 - DNA, 19 bp, Homo sapiens
tcaagtctgtttactgcaa

SEQ ID NO: 3700620 - DNA, 18 bp, Homo sapiens
tcaagtgccaaacagagt

SEQ ID NO: 3700621 - DNA, 11 bp, Homo sapiens
tcaagtgccta

SEQ ID NO: 3700622 - DNA, 19 bp, Homo sapiens
tcaagttttgggtatgttt

SEQ ID NO: 3700623 - DNA, 15 bp, Homo sapiens
tcaatacaaatgtta

SEQ ID NO: 3700624 - DNA, 18 bp, Homo sapiens
tcaatacagtacaggcag

SEQ ID NO: 3700625 - DNA, 19 bp, Homo sapiens
tcaatacagtacaggcagc

SEQ ID NO: 3700626 - DNA, 16 bp, Homo sapiens
tcaatagatctccagc

SEQ ID NO: 3700627 - DNA, 17 bp, Homo sapiens
tcaatattttccatgaa

SEQ ID NO: 3700628 - DNA, 15 bp, Homo sapiens
tcaatgaagccagct

SEQ ID NO: 3700629 - DNA, 17 bp, Homo sapiens
tcaatgctataactatg

SEQ ID NO: 3700630 - DNA, 18 bp, Homo sapiens
tcaatttccaagagctga

SEQ ID NO: 3700631 - DNA, 15 bp, Homo sapiens
tcaatttctgtgttg

SEQ ID NO: 3700632 - DNA, 23 bp, Homo sapiens
tcaatttctgtgttgccaagctc

SEQ ID NO: 3700633 - DNA, 18 bp, Homo sapiens
tcaattttgacttaatgt

SEQ ID NO: 3700634 - DNA, 22 bp, Homo sapiens
tcacaaaacagcctttgggaaa

SEQ ID NO: 3700635 - DNA, 13 bp, Homo sapiens
tcacacaaaggca

SEQ ID NO: 3700636 - DNA, 17 bp, Homo sapiens
tcacacaaaggcatgct

SEQ ID NO: 3700637 - DNA, 12 bp, Homo sapiens
tcacacacctgt

SEQ ID NO: 3700638 - DNA, 20 bp, Homo sapiens
tcacacagctaacaagtagc

SEQ ID NO: 3700639 - DNA, 22 bp, Homo sapiens
tcacacgtctggcttcacagat

SEQ ID NO: 3700640 - DNA, 13 bp, Homo sapiens
tcacagcggaggt

SEQ ID NO: 3700641 - DNA, 16 bp, Homo sapiens
tcacagcttcagccag

SEQ ID NO: 3700642 - DNA, 15 bp, Homo sapiens
tcacagggtgggcct

SEQ ID NO: 3700643 - DNA, 16 bp, Homo sapiens
tcacagggtgggcctc

SEQ ID NO: 3700644 - DNA, 19 bp, Homo sapiens
tcacagggtgggcctcggc

SEQ ID NO: 3700645 - DNA, 16 bp, Homo sapiens
tcacagggttgggccc

SEQ ID NO: 3700646 - DNA, 14 bp, Homo sapiens
tcacagtgctgtgt

SEQ ID NO: 3700647 - DNA, 22 bp, Homo sapiens
tcacagttctttgggccagaca

SEQ ID NO: 3700648 - DNA, 14 bp, Homo sapiens
tcacattcttggct

SEQ ID NO: 3700649 - DNA, 19 bp, Homo sapiens
tcacattgtttgctgctat

SEQ ID NO: 3700650 - DNA, 15 bp, Homo sapiens
tcaccatctttctga

SEQ ID NO: 3700651 - DNA, 16 bp, Homo sapiens
tcacccaatcccagtt

SEQ ID NO: 3700652 - DNA, 18 bp, Homo sapiens
tcacccaatcccagttct

SEQ ID NO: 3700653 - DNA, 19 bp, Homo sapiens
tcacccatgcaagcagagg

SEQ ID NO: 3700654 - DNA, 22 bp, Homo sapiens
tcacccccatggccccaggccc

SEQ ID NO: 3700655 - DNA, 23 bp, Homo sapiens
tcaccctgatttaggagaagcca

SEQ ID NO: 3700656 - DNA, 21 bp, Homo sapiens
tcaccctgtccaaactgccta

SEQ ID NO: 3700657 - DNA, 22 bp, Homo sapiens
tcaccctttgctgtgaggctgt

SEQ ID NO: 3700658 - DNA, 13 bp, Homo sapiens
tcacctcctgctg

SEQ ID NO: 3700659 - DNA, 17 bp, Homo sapiens
tcacctcctgctgggca

SEQ ID NO: 3700660 - DNA, 19 bp, Homo sapiens
tcacctctggactggctag

SEQ ID NO: 3700661 - DNA, 20 bp, Homo sapiens
tcaccttaggcagggaagtg

SEQ ID NO: 3700662 - DNA, 18 bp, Homo sapiens
tcaccttggcaccagaca

SEQ ID NO: 3700663 - DNA, 23 bp, Homo sapiens
tcaccttggcaccagacacccag

SEQ ID NO: 3700664 - DNA, 15 bp, Homo sapiens
tcacgcacctcccat

SEQ ID NO: 3700665 - DNA, 17 bp, Homo sapiens
tcacgcacctcccatcc

SEQ ID NO: 3700666 - DNA, 19 bp, Homo sapiens
tcacgcctgtaatcctagc

SEQ ID NO: 3700667 - DNA, 16 bp, Homo sapiens
tcacggaagagccttg

SEQ ID NO: 3700668 - DNA, 22 bp, Homo sapiens
tcacggcaggacaacgaggaag

SEQ ID NO: 3700669 - DNA, 14 bp, Homo sapiens
tcactcagatggaa

SEQ ID NO: 3700670 - DNA, 15 bp, Homo sapiens
tcactctgagtgttt

SEQ ID NO: 3700671 - DNA, 16 bp, Homo sapiens
tcactgatgggaaaac

SEQ ID NO: 3700672 - DNA, 18 bp, Homo sapiens
tcactgcaagctccgcct

SEQ ID NO: 3700673 - DNA, 15 bp, Homo sapiens
tcactgctccttgct

SEQ ID NO: 3700674 - DNA, 16 bp, Homo sapiens
tcactgctccttgctg

SEQ ID NO: 3700675 - DNA, 17 bp, Homo sapiens
tcacttacatttttgtg

SEQ ID NO: 3700676 - DNA, 13 bp, Homo sapiens
tcacttagccatg

SEQ ID NO: 3700677 - DNA, 10 bp, Homo sapiens
tcacttgagt

SEQ ID NO: 3700678 - DNA, 19 bp, Homo sapiens
tcagaaccttgtcccagcc

SEQ ID NO: 3700679 - DNA, 21 bp, Homo sapiens
tcagaactcaaatggggccag

SEQ ID NO: 3700680 - DNA, 21 bp, Homo sapiens
tcagaattgatcattttcccc

SEQ ID NO: 3700681 - DNA, 22 bp, Homo sapiens
tcagacagagaggactgtaggg

SEQ ID NO: 3700682 - DNA, 19 bp, Homo sapiens
tcagactcccattcctgaa

SEQ ID NO: 3700683 - DNA, 21 bp, Homo sapiens
tcagactcccattcctgaaga

SEQ ID NO: 3700684 - DNA, 15 bp, Homo sapiens
tcagacttgtcaagc

SEQ ID NO: 3700685 - DNA, 22 bp, Homo sapiens
tcagagatgcaccaccaagcca

SEQ ID NO: 3700686 - DNA, 18 bp, Homo sapiens
tcagagccactctatgag

SEQ ID NO: 3700687 - DNA, 13 bp, Homo sapiens
tcagagtgccact

SEQ ID NO: 3700688 - DNA, 20 bp, Homo sapiens
tcagataaggtaaaatgcca

SEQ ID NO: 3700689 - DNA, 15 bp, Homo sapiens
tcagatccagtgtaa

SEQ ID NO: 3700690 - DNA, 21 bp, Homo sapiens
tcagatggaaccgcaggaagc

SEQ ID NO: 3700691 - DNA, 13 bp, Homo sapiens
tcagatgtaatgt

SEQ ID NO: 3700692 - DNA, 14 bp, Homo sapiens
tcagatgtaatgtt

SEQ ID NO: 3700693 - DNA, 17 bp, Homo sapiens
tcagatgtaatgttttc

SEQ ID NO: 3700694 - DNA, 13 bp, Homo sapiens
tcagcaaaccatt

SEQ ID NO: 3700695 - DNA, 14 bp, Homo sapiens
tcagcactgtccct

SEQ ID NO: 3700696 - DNA, 21 bp, Homo sapiens
tcagcactgtcccttgcctca

SEQ ID NO: 3700697 - DNA, 18 bp, Homo sapiens
tcagcagcaaattttcag

SEQ ID NO: 3700698 - DNA, 21 bp, Homo sapiens
tcagcccaccagccacctcat

SEQ ID NO: 3700699 - DNA, 13 bp, Homo sapiens
tcagccctgaggt

SEQ ID NO: 3700700 - DNA, 19 bp, Homo sapiens
tcagcctgctccagctgtt

SEQ ID NO: 3700701 - DNA, 17 bp, Homo sapiens
tcagcctggccagacac

SEQ ID NO: 3700702 - DNA, 13 bp, Homo sapiens
tcagcctttatca

SEQ ID NO: 3700703 - DNA, 21 bp, Homo sapiens
tcagcctttatcaagcttagt

SEQ ID NO: 3700704 - DNA, 20 bp, Homo sapiens
tcagcgactccgttggccac

SEQ ID NO: 3700705 - DNA, 23 bp, Homo sapiens
tcagcgactccgttggccactcc

SEQ ID NO: 3700706 - DNA, 16 bp, Homo sapiens
tcagcggttgaggaga

SEQ ID NO: 3700707 - DNA, 13 bp, Homo sapiens
tcagctcactgtg

SEQ ID NO: 3700708 - DNA, 14 bp, Homo sapiens
tcagctcactgtga

SEQ ID NO: 3700709 - DNA, 15 bp, Homo sapiens
tcagctgcctcactt

SEQ ID NO: 3700710 - DNA, 24 bp, Homo sapiens
tcagctgcctcacttcctacaaga

SEQ ID NO: 3700711 - DNA, 18 bp, Homo sapiens
tcagctgcgcccccttct

SEQ ID NO: 3700712 - DNA, 17 bp, Homo sapiens
tcaggaatattttccaa

SEQ ID NO: 3700713 - DNA, 18 bp, Homo sapiens
tcaggaatattttccaaa

SEQ ID NO: 3700714 - DNA, 15 bp, Homo sapiens
tcaggacagatgcca

SEQ ID NO: 3700715 - DNA, 14 bp, Homo sapiens
tcaggactctgaaa

SEQ ID NO: 3700716 - DNA, 21 bp, Homo sapiens
tcaggatgtaggggttaactt

SEQ ID NO: 3700717 - DNA, 19 bp, Homo sapiens
tcctaggcatttgctgaat

SEQ ID NO: 3700718 - DNA, 21 bp, Homo sapiens
tcctaggtcatgcctcctccc

SEQ ID NO: 3700719 - DNA, 17 bp, Homo sapiens
tcctatatatttctatt

SEQ ID NO: 3700720 - DNA, 18 bp, Homo sapiens
tcctatctttacatctat

SEQ ID NO: 3700721 - DNA, 14 bp, Homo sapiens
tcctatgcttaata

SEQ ID NO: 3700722 - DNA, 17 bp, Homo sapiens
tcctatgcttaataaaa

SEQ ID NO: 3700723 - DNA, 22 bp, Homo sapiens
tcctatgcttaataaaagaaca

SEQ ID NO: 3700724 - DNA, 14 bp, Homo sapiens
tcctatgctttgaa

SEQ ID NO: 3700725 - DNA, 16 bp, Homo sapiens
tcctcacctctggact

SEQ ID NO: 3700726 - DNA, 19 bp, Homo sapiens
tcctcactcccttcccata

SEQ ID NO: 3700727 - DNA, 14 bp, Homo sapiens
tcctcagcctgggg

SEQ ID NO: 3700728 - DNA, 15 bp, Homo sapiens
tcctcagcctggggt

SEQ ID NO: 3700729 - DNA, 11 bp, Homo sapiens
tcctcagcctt

SEQ ID NO: 3700730 - DNA, 19 bp, Homo sapiens
tcctcagtgcatttgtgct

SEQ ID NO: 3700731 - DNA, 18 bp, Homo sapiens
tcctcattagcattttgc

SEQ ID NO: 3700732 - DNA, 19 bp, Homo sapiens
tcctcatttggggtagcta

SEQ ID NO: 3700733 - DNA, 21 bp, Homo sapiens
tcctccagaagcctctggcta

SEQ ID NO: 3700734 - DNA, 12 bp, Homo sapiens
tcctcccaagct

SEQ ID NO: 3700735 - DNA, 13 bp, Homo sapiens
tcctcccaagctg

SEQ ID NO: 3700736 - DNA, 19 bp, Homo sapiens
tcctcccaagctgtgctgg

SEQ ID NO: 3700737 - DNA, 20 bp, Homo sapiens
tcctcccaatttcagactcc

SEQ ID NO: 3700738 - DNA, 21 bp, Homo sapiens
tcctcccacccggctgcagag

SEQ ID NO: 3700739 - DNA, 14 bp, Homo sapiens
tcctccctgcatct

SEQ ID NO: 3700740 - DNA, 22 bp, Homo sapiens
tcctccctgcatctgaccagca

SEQ ID NO: 3700741 - DNA, 14 bp, Homo sapiens
tcctcccttctgct

SEQ ID NO: 3700742 - DNA, 18 bp, Homo sapiens
tcctccgtccagccgcca

SEQ ID NO: 3700743 - DNA, 12 bp, Homo sapiens
tcctcctgcaga

SEQ ID NO: 3700744 - DNA, 20 bp, Homo sapiens
tcctcctgcagaccacgccc

SEQ ID NO: 3700745 - DNA, 11 bp, Homo sapiens
tcctcctggaa

SEQ ID NO: 3700746 - DNA, 13 bp, Homo sapiens
tcctcgcaagctg

SEQ ID NO: 3700747 - DNA, 13 bp, Homo sapiens
tcctcgcctgaca

SEQ ID NO: 3700748 - DNA, 15 bp, Homo sapiens
tcctcgcctgacaac

SEQ ID NO: 3700749 - DNA, 14 bp, Homo sapiens
tcctctccccagcc

SEQ ID NO: 3700750 - DNA, 15 bp, Homo sapiens
tcctctccccagccc

SEQ ID NO: 3700751 - DNA, 16 bp, Homo sapiens
tcctctccccagccca

SEQ ID NO: 3700752 - DNA, 16 bp, Homo sapiens
tcctctccctgccaag

SEQ ID NO: 3700753 - DNA, 13 bp, Homo sapiens
tcctctctggtgg

SEQ ID NO: 3700754 - DNA, 20 bp, Homo sapiens
tcctctctggtggctgggct

SEQ ID NO: 3700755 - DNA, 22 bp, Homo sapiens
tcctctctggtggctgggctgc

SEQ ID NO: 3700756 - DNA, 24 bp, Homo sapiens
tcctctctggtggctgggctgctc

SEQ ID NO: 3700757 - DNA, 15 bp, Homo sapiens
tcctctgtggccagc

SEQ ID NO: 3700758 - DNA, 15 bp, Homo sapiens
tcctctttgctttgc

SEQ ID NO: 3700759 - DNA, 16 bp, Homo sapiens
tcctctttgctttgct

SEQ ID NO: 3700760 - DNA, 18 bp, Homo sapiens
tcctgaagaaccagtccc

SEQ ID NO: 3700761 - DNA, 23 bp, Homo sapiens
tcctgaagaaccagtccccccac

SEQ ID NO: 3700762 - DNA, 14 bp, Homo sapiens
tcctgacattgtct

SEQ ID NO: 3700763 - DNA, 15 bp, Homo sapiens
tcctgacattgtctc

SEQ ID NO: 3700764 - DNA, 14 bp, Homo sapiens
tcctgaccagggca

SEQ ID NO: 3700765 - DNA, 22 bp, Homo sapiens
tcctgaccagggcaaggcccct

SEQ ID NO: 3700766 - DNA, 13 bp, Homo sapiens
tcctgactcatcc

SEQ ID NO: 3700767 - DNA, 20 bp, Homo sapiens
tcctgagcgaaaacaggaga

SEQ ID NO: 3700768 - DNA, 20 bp, Homo sapiens
tcctgaggggcatctgcccc

SEQ ID NO: 3700769 - DNA, 21 bp, Homo sapiens
tcctgaggggcatctgcccct

SEQ ID NO: 3700770 - DNA, 20 bp, Homo sapiens
tcctgcaaccactctgtggc

SEQ ID NO: 3700771 - DNA, 23 bp, Homo sapiens
tcctgcaaccactctgtggccag

SEQ ID NO: 3700772 - DNA, 18 bp, Homo sapiens
tcctgcaactcaaggact

SEQ ID NO: 3700773 - DNA, 13 bp, Homo sapiens
tcctgccaggcat

SEQ ID NO: 3700774 - DNA, 17 bp, Homo sapiens
tcctgccattcttctgg

SEQ ID NO: 3700775 - DNA, 15 bp, Homo sapiens
tcctgccccaggcct

SEQ ID NO: 3700776 - DNA, 12 bp, Homo sapiens
tcctgcctggcc

SEQ ID NO: 3700777 - DNA, 13 bp, Homo sapiens
tcctgcctggcca

SEQ ID NO: 3700778 - DNA, 16 bp, Homo sapiens
tcctgcctggccaggc

SEQ ID NO: 3700779 - DNA, 12 bp, Homo sapiens
tcctgcctgtgg

SEQ ID NO: 3700780 - DNA, 14 bp, Homo sapiens
tcctgcgggtgggg

SEQ ID NO: 3700781 - DNA, 12 bp, Homo sapiens
tcctgctgagct

SEQ ID NO: 3700782 - DNA, 13 bp, Homo sapiens
tcctgctgagctg

SEQ ID NO: 3700783 - DNA, 17 bp, Homo sapiens
tcctgctgagctgcccc

SEQ ID NO: 3700784 - DNA, 23 bp, Homo sapiens
tcctgctgagctgcccctgctgc

SEQ ID NO: 3700785 - DNA, 13 bp, Homo sapiens
tcctgctgggcag

SEQ ID NO: 3700786 - DNA, 22 bp, Homo sapiens
tcctggaacactatagagaacc

SEQ ID NO: 3700787 - DNA, 10 bp, Homo sapiens
tcctggaacc

SEQ ID NO: 3700788 - DNA, 13 bp, Homo sapiens
tcctggaacctgg

SEQ ID NO: 3700789 - DNA, 15 bp, Homo sapiens
tcctggaacctggac

SEQ ID NO: 3700790 - DNA, 23 bp, Homo sapiens
tcctggaacctggaccccagcct

SEQ ID NO: 3700791 - DNA, 19 bp, Homo sapiens
tcctggatggggcagagct

SEQ ID NO: 3700792 - DNA, 20 bp, Homo sapiens
tcctggatggggcagagctt

SEQ ID NO: 3700793 - DNA, 11 bp, Homo sapiens
tcctggccatc

SEQ ID NO: 3700794 - DNA, 14 bp, Homo sapiens
tcctggccatccca

SEQ ID NO: 3700795 - DNA, 17 bp, Homo sapiens
tcctggcccactgcatc

SEQ ID NO: 3700796 - DNA, 19 bp, Homo sapiens
tcctgggtggtctgcaggc

SEQ ID NO: 3700797 - DNA, 21 bp, Homo sapiens
tcctggttgtctgaacccagg

SEQ ID NO: 3700798 - DNA, 15 bp, Homo sapiens
tcctgtccagctcca

SEQ ID NO: 3700799 - DNA, 16 bp, Homo sapiens
tcctgtccagctccaa

SEQ ID NO: 3700800 - DNA, 22 bp, Homo sapiens
tcctgtggccccaccctgggcc

SEQ ID NO: 3700801 - DNA, 15 bp, Homo sapiens
tcctgtgggtggggc

SEQ ID NO: 3700802 - DNA, 18 bp, Homo sapiens
tcctgtgggtggggcttc

SEQ ID NO: 3700803 - DNA, 17 bp, Homo sapiens
tccttccatccctaccc

SEQ ID NO: 3700804 - DNA, 20 bp, Homo sapiens
tccttgaagaactgcaggcc

SEQ ID NO: 3700805 - DNA, 21 bp, Homo sapiens
tccttgaagaactgcaggccc

SEQ ID NO: 3700806 - DNA, 13 bp, Homo sapiens
tccttggaggaca

SEQ ID NO: 3700807 - DNA, 22 bp, Homo sapiens
tccttgggaggccccactgggg

SEQ ID NO: 3700808 - DNA, 16 bp, Homo sapiens
tcctttacgtgtttaa

SEQ ID NO: 3700809 - DNA, 18 bp, Homo sapiens
tcctttcctatctttaca

SEQ ID NO: 3700810 - DNA, 13 bp, Homo sapiens
tccttttctttaa

SEQ ID NO: 3700811 - DNA, 16 bp, Homo sapiens
tcgaatctctgtgcct

SEQ ID NO: 3700812 - DNA, 17 bp, Homo sapiens
tcgaatctctgtgcctt

SEQ ID NO: 3700813 - DNA, 14 bp, Homo sapiens
tcgagaccagcctg

SEQ ID NO: 3700814 - DNA, 14 bp, Homo sapiens
tcgatactgcgact

SEQ ID NO: 3700815 - DNA, 23 bp, Homo sapiens
tcgatactgcgactttctgcctg

SEQ ID NO: 3700816 - DNA, 23 bp, Homo sapiens
tcgatgggggagtctgaagcaga

SEQ ID NO: 3700817 - DNA, 16 bp, Homo sapiens
tcgcaccattctgact

SEQ ID NO: 3700818 - DNA, 20 bp, Homo sapiens
tcgcctgacaaccactggtc

SEQ ID NO: 3700819 - DNA, 21 bp, Homo sapiens
tcgcctgacaaccactggtct

SEQ ID NO: 3700820 - DNA, 12 bp, Homo sapiens
tcgctggaaaac

SEQ ID NO: 3700821 - DNA, 11 bp, Homo sapiens
tcgctgtcctt

SEQ ID NO: 3700822 - DNA, 17 bp, Homo sapiens
tcgctgtcctttctaga

SEQ ID NO: 3700823 - DNA, 17 bp, Homo sapiens
tcgcttcttgcctctgt

SEQ ID NO: 3700824 - DNA, 18 bp, Homo sapiens
tcggatagttgctatttt

SEQ ID NO: 3700825 - DNA, 15 bp, Homo sapiens
tcggctgaccatgct

SEQ ID NO: 3700826 - DNA, 16 bp, Homo sapiens
tcggctgaccatgctc

SEQ ID NO: 3700827 - DNA, 19 bp, Homo sapiens
tcgggaggtcgaggcagga

SEQ ID NO: 3700828 - DNA, 16 bp, Homo sapiens
tcgggcaccagccagc

SEQ ID NO: 3700829 - DNA, 18 bp, Homo sapiens
tcggggccatttggccgg

SEQ ID NO: 3700830 - DNA, 18 bp, Homo sapiens
tcgggtttctctgtggct

SEQ ID NO: 3700831 - DNA, 16 bp, Homo sapiens
tcggtaggttcagcca

SEQ ID NO: 3700832 - DNA, 22 bp, Homo sapiens
tcggtttgccaaaattcatttc

SEQ ID NO: 3700833 - DNA, 20 bp, Homo sapiens
tcgtctttcccatggggagg

SEQ ID NO: 3700834 - DNA, 16 bp, Homo sapiens
tgatgggattctggac

SEQ ID NO: 3700835 - DNA, 17 bp, Homo sapiens
tgatggggaaggaggct

SEQ ID NO: 3700836 - DNA, 19 bp, Homo sapiens
tgatgtggccctggctgcc

SEQ ID NO: 3700837 - DNA, 15 bp, Homo sapiens
tgatgtgtttacatt

SEQ ID NO: 3700838 - DNA, 16 bp, Homo sapiens
tgatgtttgtggcctc

SEQ ID NO: 3700839 - DNA, 18 bp, Homo sapiens
tgatgtttgtggcctcag

SEQ ID NO: 3700840 - DNA, 13 bp, Homo sapiens
tgattcaaaatat

SEQ ID NO: 3700841 - DNA, 12 bp, Homo sapiens
tgattcacagtg

SEQ ID NO: 3700842 - DNA, 15 bp, Homo sapiens
tgattccgcaccctg

SEQ ID NO: 3700843 - DNA, 19 bp, Homo sapiens
tgattgaataatgccacca

SEQ ID NO: 3700844 - DNA, 15 bp, Homo sapiens
tgatttaaacacaca

SEQ ID NO: 3700845 - DNA, 16 bp, Homo sapiens
tgatttaaacacacag

SEQ ID NO: 3700846 - DNA, 21 bp, Homo sapiens
tgatttcagactgcagagggg

SEQ ID NO: 3700847 - DNA, 12 bp, Homo sapiens
tgatttggaaaa

SEQ ID NO: 3700848 - DNA, 23 bp, Homo sapiens
tgattttcacagctttgaggaac

SEQ ID NO: 3700849 - DNA, 17 bp, Homo sapiens
tgattttcattgtaaat

SEQ ID NO: 3700850 - DNA, 22 bp, Homo sapiens
tgcaaaaaatactttttctaat

SEQ ID NO: 3700851 - DNA, 19 bp, Homo sapiens
tgcaaaaactacaaccaat

SEQ ID NO: 3700852 - DNA, 15 bp, Homo sapiens
tgcaaagaggcaaga

SEQ ID NO: 3700853 - DNA, 19 bp, Homo sapiens
tgcaaagaggcaagaggct

SEQ ID NO: 3700854 - DNA, 23 bp, Homo sapiens
tgcaaagatctgtcctcagcctt

SEQ ID NO: 3700855 - DNA, 13 bp, Homo sapiens
tgcaaagtatttt

SEQ ID NO: 3700856 - DNA, 13 bp, Homo sapiens
tgcaacaacatgt

SEQ ID NO: 3700857 - DNA, 21 bp, Homo sapiens
tgcaacggtctcctgactggt

SEQ ID NO: 3700858 - DNA, 16 bp, Homo sapiens
tgcaactcaaggactt

SEQ ID NO: 3700859 - DNA, 16 bp, Homo sapiens
tgcaagcagaggacca

SEQ ID NO: 3700860 - DNA, 21 bp, Homo sapiens
tgcaagcagaggaccagggcc

SEQ ID NO: 3700861 - DNA, 19 bp, Homo sapiens
tgcaaggaagccacagctg

SEQ ID NO: 3700862 - DNA, 13 bp, Homo sapiens
tgcaaggaccagg

SEQ ID NO: 3700863 - DNA, 17 bp, Homo sapiens
tgcaatccaaataaaga

SEQ ID NO: 3700864 - DNA, 15 bp, Homo sapiens
tgcacaagctgcacc

SEQ ID NO: 3700865 - DNA, 18 bp, Homo sapiens
tgcacaagctgcaccctc

SEQ ID NO: 3700866 - DNA, 13 bp, Homo sapiens
tgcacactcagtg

SEQ ID NO: 3700867 - DNA, 14 bp, Homo sapiens
tgcacactcagtgg

SEQ ID NO: 3700868 - DNA, 15 bp, Homo sapiens
tgcacactcagtggg

SEQ ID NO: 3700869 - DNA, 20 bp, Homo sapiens
tgcacatccgcgtgtgcctg

SEQ ID NO: 3700870 - DNA, 21 bp, Homo sapiens
tgcacatccgcgtgtgcctgt

SEQ ID NO: 3700871 - DNA, 18 bp, Homo sapiens
tgcacatgtttcctctag

SEQ ID NO: 3700872 - DNA, 15 bp, Homo sapiens
tgcaccaccaagcca

SEQ ID NO: 3700873 - DNA, 19 bp, Homo sapiens
tgcaccaccaagccaaggg

SEQ ID NO: 3700874 - DNA, 21 bp, Homo sapiens
tgcaccactgcactccagcct

SEQ ID NO: 3700875 - DNA, 23 bp, Homo sapiens
tgcaccccaaagctttcctgccc

SEQ ID NO: 3700876 - DNA, 15 bp, Homo sapiens
tgcacccccctgggc

SEQ ID NO: 3700877 - DNA, 20 bp, Homo sapiens
tgcacgtggagagctggtgc

SEQ ID NO: 3700878 - DNA, 21 bp, Homo sapiens
tgcacgtggagagctggtgcc

SEQ ID NO: 3700879 - DNA, 14 bp, Homo sapiens
tgcacgtggcctct

SEQ ID NO: 3700880 - DNA, 15 bp, Homo sapiens
tgcactaaggggccc

SEQ ID NO: 3700881 - DNA, 17 bp, Homo sapiens
tgcactaaggggcccgg

SEQ ID NO: 3700882 - DNA, 22 bp, Homo sapiens
tgcactaaggggcccggccagc

SEQ ID NO: 3700883 - DNA, 16 bp, Homo sapiens
tgcactccatccagct

SEQ ID NO: 3700884 - DNA, 21 bp, Homo sapiens
tgcactgatgctgcccctcat

SEQ ID NO: 3700885 - DNA, 18 bp, Homo sapiens
tgcactgtgaaggaccct

SEQ ID NO: 3700886 - DNA, 12 bp, Homo sapiens
tgcactttgtaa

SEQ ID NO: 3700887 - DNA, 13 bp, Homo sapiens
tgcactttgtaaa

SEQ ID NO: 3700888 - DNA, 15 bp, Homo sapiens
tgcactttgtaaatt

SEQ ID NO: 3700889 - DNA, 17 bp, Homo sapiens
tgcactttgtaaattcc

SEQ ID NO: 3700890 - DNA, 17 bp, Homo sapiens
tgcagaggccagaggcc

SEQ ID NO: 3700891 - DNA, 15 bp, Homo sapiens
tgcagaggggaaaga

SEQ ID NO: 3700892 - DNA, 22 bp, Homo sapiens
tgcagcagaggacagtctggag

SEQ ID NO: 3700893 - DNA, 23 bp, Homo sapiens
tgcagcagaggacagtctggaga

SEQ ID NO: 3700894 - DNA, 14 bp, Homo sapiens
tgcagcagggatgc

SEQ ID NO: 3700895 - DNA, 18 bp, Homo sapiens
tgcagcccatgcccacct

SEQ ID NO: 3700896 - DNA, 23 bp, Homo sapiens
tgcagcccatgcccacctgccca

SEQ ID NO: 3700897 - DNA, 19 bp, Homo sapiens
tgcagctgcccagcccctc

SEQ ID NO: 3700898 - DNA, 20 bp, Homo sapiens
tgcaggaatcccggctccag

SEQ ID NO: 3700899 - DNA, 14 bp, Homo sapiens
tgcaggacctcagg

SEQ ID NO: 3700900 - DNA, 19 bp, Homo sapiens
tgcaggccctggcctcccc

SEQ ID NO: 3700901 - DNA, 15 bp, Homo sapiens
tgcaggcggggctcc

SEQ ID NO: 3700902 - DNA, 15 bp, Homo sapiens
tgcagggccatggct

SEQ ID NO: 3700903 - DNA, 14 bp, Homo sapiens
tgcagtgagccgag

SEQ ID NO: 3700904 - DNA, 20 bp, Homo sapiens
tgcagtgctctttgtagcta

SEQ ID NO: 3700905 - DNA, 18 bp, Homo sapiens
tgcagtggcgcattctag

SEQ ID NO: 3700906 - DNA, 18 bp, Homo sapiens
tgcagttcagcaccaccc

SEQ ID NO: 3700907 - DNA, 23 bp, Homo sapiens
tgcataagaaatgtagctgaagt

SEQ ID NO: 3700908 - DNA, 12 bp, Homo sapiens
tgcataccaacc

SEQ ID NO: 3700909 - DNA, 17 bp, Homo sapiens
tgcatagagccacgtat

SEQ ID NO: 3700910 - DNA, 18 bp, Homo sapiens
tgcataggctccttcctg

SEQ ID NO: 3700911 - DNA, 22 bp, Homo sapiens
tgcataggctccttcctgtggg

SEQ ID NO: 3700912 - DNA, 15 bp, Homo sapiens
tgcatagtttcttta

SEQ ID NO: 3700913 - DNA, 23 bp, Homo sapiens
tgcatagtttctttattttgtgt

SEQ ID NO: 3700914 - DNA, 17 bp, Homo sapiens
tgcatatatacatatat

SEQ ID NO: 3700915 - DNA, 15 bp, Homo sapiens
tgcatcgtttcatct

SEQ ID NO: 3700916 - DNA, 23 bp, Homo sapiens
tgcatctttttgaccctcattct

SEQ ID NO: 3700917 - DNA, 13 bp, Homo sapiens
tgcatgaaggttt

SEQ ID NO: 3700918 - DNA, 18 bp, Homo sapiens
tgcatgaaggtttctgaa

SEQ ID NO: 3700919 - DNA, 21 bp, Homo sapiens
tgcatgaaggtttctgaaaat

SEQ ID NO: 3700920 - DNA, 18 bp, Homo sapiens
tgcatgcattgagctgcc

SEQ ID NO: 3700921 - DNA, 20 bp, Homo sapiens
tgcatgcattgagctgcctc

SEQ ID NO: 3700922 - DNA, 18 bp, Homo sapiens
tgcatggtgccccaggac

SEQ ID NO: 3700923 - DNA, 20 bp, Homo sapiens
tgcatggtgccccaggacca

SEQ ID NO: 3700924 - DNA, 14 bp, Homo sapiens
tgcatggtggccag

SEQ ID NO: 3700925 - DNA, 15 bp, Homo sapiens
tgcatggtggccaga

SEQ ID NO: 3700926 - DNA, 23 bp, Homo sapiens
tgcatgtcctttgcgcctgtgac

SEQ ID NO: 3700927 - DNA, 23 bp, Homo sapiens
tgcatgtctactcagcatttgat

SEQ ID NO: 3700928 - DNA, 22 bp, Homo sapiens
tgcattcttaacaaactcttca

SEQ ID NO: 3700929 - DNA, 14 bp, Homo sapiens
tgcattgagctgcc

SEQ ID NO: 3700930 - DNA, 19 bp, Homo sapiens
tgcattgagctgcctccag

SEQ ID NO: 3700931 - DNA, 22 bp, Homo sapiens
tgcattgagctgcctccagcct

SEQ ID NO: 3700932 - DNA, 23 bp, Homo sapiens
tgcattgagctgcctccagcctg

SEQ ID NO: 3700933 - DNA, 21 bp, Homo sapiens
tgcatttttttcattactgtt

SEQ ID NO: 3700934 - DNA, 19 bp, Homo sapiens
tgccaaaaaggatacataa

SEQ ID NO: 3700935 - DNA, 17 bp, Homo sapiens
tgccaaaatgctctagt

SEQ ID NO: 3700936 - DNA, 16 bp, Homo sapiens
tgccaaatatgtcctg

SEQ ID NO: 3700937 - DNA, 17 bp, Homo sapiens
tgccaaatatgtcctgg

SEQ ID NO: 3700938 - DNA, 16 bp, Homo sapiens
tgccaagctccaagcc

SEQ ID NO: 3700939 - DNA, 15 bp, Homo sapiens
tgccaagtctcagaa

SEQ ID NO: 3700940 - DNA, 17 bp, Homo sapiens
tgccaagtctcagaaga

SEQ ID NO: 3700941 - DNA, 16 bp, Homo sapiens
tgccaatctcaacacc

SEQ ID NO: 3700942 - DNA, 20 bp, Homo sapiens
tgccaatgtgaaatgtaaat

SEQ ID NO: 3700943 - DNA, 15 bp, Homo sapiens
tgccacaaggacttc

SEQ ID NO: 3700944 - DNA, 17 bp, Homo sapiens
tgccaccaggagaacca

SEQ ID NO: 3700945 - DNA, 14 bp, Homo sapiens
tgccaccaggccac

SEQ ID NO: 3700946 - DNA, 17 bp, Homo sapiens
tgccaccaggccacctc

SEQ ID NO: 3700947 - DNA, 18 bp, Homo sapiens
tgccacccacctccctgc

SEQ ID NO: 3700948 - DNA, 19 bp, Homo sapiens
tgccacccacctccctgcc

SEQ ID NO: 3700949 - DNA, 20 bp, Homo sapiens
tgccacccacctccctgcct

SEQ ID NO: 3700950 - DNA, 21 bp, Homo sapiens
tggttctctgggcctcagttt

SEQ ID NO: 3700951 - DNA, 18 bp, Homo sapiens
tggttctgtgacccatct

SEQ ID NO: 3700952 - DNA, 19 bp, Homo sapiens
tggttctgtgacccatctg

SEQ ID NO: 3700953 - DNA, 19 bp, Homo sapiens
tggttggggccctgccctg

SEQ ID NO: 3700954 - DNA, 23 bp, Homo sapiens
tggttgtctgaacccaggcagct

SEQ ID NO: 3700955 - DNA, 16 bp, Homo sapiens
tggtttgccttccaga

SEQ ID NO: 3700956 - DNA, 20 bp, Homo sapiens
tggtttttaaattttgtaat

SEQ ID NO: 3700957 - DNA, 20 bp, Homo sapiens
tgtaaaatcctacagtgaaa

SEQ ID NO: 3700958 - DNA, 21 bp, Homo sapiens
tgtaaaatcctacagtgaaat

SEQ ID NO: 3700959 - DNA, 13 bp, Homo sapiens
tgtaaagccatgc

SEQ ID NO: 3700960 - DNA, 17 bp, Homo sapiens
tgtaaataggattttta

SEQ ID NO: 3700961 - DNA, 21 bp, Homo sapiens
tgtaaatcatgttgatcatgt

SEQ ID NO: 3700962 - DNA, 15 bp, Homo sapiens
tgtaaatgtgtacat

SEQ ID NO: 3700963 - DNA, 22 bp, Homo sapiens
tgtaaattatatttgtgctata

SEQ ID NO: 3700964 - DNA, 15 bp, Homo sapiens
tgtaactatttcttc

SEQ ID NO: 3700965 - DNA, 12 bp, Homo sapiens
tgtaagaaacct

SEQ ID NO: 3700966 - DNA, 14 bp, Homo sapiens
tgtaagtgggccca

SEQ ID NO: 3700967 - DNA, 13 bp, Homo sapiens
tgtaatatgaaat

SEQ ID NO: 3700968 - DNA, 15 bp, Homo sapiens
tgtaatcccagcact

SEQ ID NO: 3700969 - DNA, 19 bp, Homo sapiens
tgtaatgaattcctagaat

SEQ ID NO: 3700970 - DNA, 19 bp, Homo sapiens
tgtaatttgatgaggtatt

SEQ ID NO: 3700971 - DNA, 20 bp, Homo sapiens
tgtacaataaaaacattgcc

SEQ ID NO: 3700972 - DNA, 20 bp, Homo sapiens
tgtacatatttgagactagt

SEQ ID NO: 3700973 - DNA, 16 bp, Homo sapiens
tgtacatttctataaa

SEQ ID NO: 3700974 - DNA, 19 bp, Homo sapiens
tgtactcagtggacagtgc

SEQ ID NO: 3700975 - DNA, 21 bp, Homo sapiens
tgtactcagtggacagtgctg

SEQ ID NO: 3700976 - DNA, 23 bp, Homo sapiens
tgtactcagtggacagtgctgtt

SEQ ID NO: 3700977 - DNA, 15 bp, Homo sapiens
tgtactgttactggg

SEQ ID NO: 3700978 - DNA, 18 bp, Homo sapiens
tgtactgttactgggccc

SEQ ID NO: 3700979 - DNA, 13 bp, Homo sapiens
tgtacttttcatt

SEQ ID NO: 3700980 - DNA, 20 bp, Homo sapiens
tgtactttttagtaatttct

SEQ ID NO: 3700981 - DNA, 21 bp, Homo sapiens
tgtactttttagtaatttctt

SEQ ID NO: 3700982 - DNA, 23 bp, Homo sapiens
tgtagagaacacgcgtatttaca

SEQ ID NO: 3700983 - DNA, 20 bp, Homo sapiens
tgtagctttcctggtccctc

SEQ ID NO: 3700984 - DNA, 16 bp, Homo sapiens
tgtaggagctgcagtt

SEQ ID NO: 3700985 - DNA, 22 bp, Homo sapiens
tgtagggagggcggcaggggcc

SEQ ID NO: 3700986 - DNA, 18 bp, Homo sapiens
tgtaggtatgtctgtgcc

SEQ ID NO: 3700987 - DNA, 20 bp, Homo sapiens
tgtaggtatgtctgtgccat

SEQ ID NO: 3700988 - DNA, 14 bp, Homo sapiens
tgtagtaatttatt

SEQ ID NO: 3700989 - DNA, 20 bp, Homo sapiens
tgtagtccgtgctgacagct

SEQ ID NO: 3700990 - DNA, 16 bp, Homo sapiens
tgtatatttgtaaagc

SEQ ID NO: 3700991 - DNA, 18 bp, Homo sapiens
tgtatatttgtaaagcta

SEQ ID NO: 3700992 - DNA, 15 bp, Homo sapiens
tgtatcattaatgta

SEQ ID NO: 3700993 - DNA, 17 bp, Homo sapiens
tgtatgactgcacatga

SEQ ID NO: 3700994 - DNA, 17 bp, Homo sapiens
tgtatggggaatctaag

SEQ ID NO: 3700995 - DNA, 18 bp, Homo sapiens
tgtatgtaggagctgcag

SEQ ID NO: 3700996 - DNA, 15 bp, Homo sapiens
tgtattaatgtatgt

SEQ ID NO: 3700997 - DNA, 14 bp, Homo sapiens
tgtattcagacaga

SEQ ID NO: 3700998 - DNA, 21 bp, Homo sapiens
tgtattgggcagcagactgtg

SEQ ID NO: 3700999 - DNA, 20 bp, Homo sapiens
tgtatttgttaatggtttga

SEQ ID NO: 3701000 - DNA, 16 bp, Homo sapiens
tgtatttttatataat

SEQ ID NO: 3701001 - DNA, 21 bp, Homo sapiens
tgtcaaacaaagccagaagct

SEQ ID NO: 3701002 - DNA, 20 bp, Homo sapiens
tgtcaagagtagttatataa

SEQ ID NO: 3701003 - DNA, 16 bp, Homo sapiens
tgtcaagcctgtgcaa

SEQ ID NO: 3701004 - DNA, 20 bp, Homo sapiens
tgtcacagggtgttggaaga

SEQ ID NO: 3701005 - DNA, 20 bp, Homo sapiens
tgtcactcaaggcggtgctt

SEQ ID NO: 3701006 - DNA, 17 bp, Homo sapiens
tgtcaggctgaaaacaa

SEQ ID NO: 3701007 - DNA, 18 bp, Homo sapiens
tgtcaggctgaaaacaat

SEQ ID NO: 3701008 - DNA, 17 bp, Homo sapiens
tgtccaaactgcctaag

SEQ ID NO: 3701009 - DNA, 22 bp, Homo sapiens
tgtccaaactgcctaagccctc

SEQ ID NO: 3701010 - DNA, 22 bp, Homo sapiens
tgtccagcaccttgtgcctggg

SEQ ID NO: 3701011 - DNA, 18 bp, Homo sapiens
tgtccatgcgctcagggc

SEQ ID NO: 3701012 - DNA, 17 bp, Homo sapiens
tgtcccactcaagccaa

SEQ ID NO: 3701013 - DNA, 16 bp, Homo sapiens
tgtcccatgatccctg

SEQ ID NO: 3701014 - DNA, 17 bp, Homo sapiens
tgtcccatgatccctgt

SEQ ID NO: 3701015 - DNA, 21 bp, Homo sapiens
tgtccctagtaaaaatacaaa

SEQ ID NO: 3701016 - DNA, 22 bp, Homo sapiens
tgtcccttgcctcaatgccagt

SEQ ID NO: 3701017 - DNA, 16 bp, Homo sapiens
tgtcctcagccttgcc

SEQ ID NO: 3701018 - DNA, 22 bp, Homo sapiens
tgtcctcagccttgccagagat

SEQ ID NO: 3701019 - DNA, 22 bp, Homo sapiens
tgtcctccagaagcctctggct

SEQ ID NO: 3701020 - DNA, 23 bp, Homo sapiens
tgtcctccagaagcctctggcta

SEQ ID NO: 3701021 - DNA, 14 bp, Homo sapiens
tgtcctctccctgc

SEQ ID NO: 3701022 - DNA, 18 bp, Homo sapiens
tgtcctgatgcttttgtc

SEQ ID NO: 3701023 - DNA, 14 bp, Homo sapiens
tgtcctgggcctgc

SEQ ID NO: 3701024 - DNA, 17 bp, Homo sapiens
tgtcctgggcctgcaga

SEQ ID NO: 3701025 - DNA, 22 bp, Homo sapiens
tgtcgctcatgtgtgcaacagg

SEQ ID NO: 3701026 - DNA, 15 bp, Homo sapiens
tgtcgggcaccagcc

SEQ ID NO: 3701027 - DNA, 13 bp, Homo sapiens
tgtctacatttct

SEQ ID NO: 3701028 - DNA, 18 bp, Homo sapiens
tgtctactcagcatttga

SEQ ID NO: 3701029 - DNA, 19 bp, Homo sapiens
tgtctactcagcatttgat

SEQ ID NO: 3701030 - DNA, 21 bp, Homo sapiens
tgtctcaggagcaccctgtct

SEQ ID NO: 3701031 - DNA, 23 bp, Homo sapiens
tgtctcatccccaggggtcccag

SEQ ID NO: 3701032 - DNA, 15 bp, Homo sapiens
tgtctgaacccaggc

SEQ ID NO: 3701033 - DNA, 13 bp, Homo sapiens
tgtctgagcccaa

SEQ ID NO: 3701034 - DNA, 15 bp, Homo sapiens
tgtctgagcccaacc

SEQ ID NO: 3701035 - DNA, 17 bp, Homo sapiens
tgtctgagcccaaccct

SEQ ID NO: 3701036 - DNA, 17 bp, Homo sapiens
tgtctgtcaatcacagt

SEQ ID NO: 3701037 - DNA, 14 bp, Homo sapiens
tgtctgtctacatt

SEQ ID NO: 3701038 - DNA, 16 bp, Homo sapiens
tgtctgtgccatttct

SEQ ID NO: 3701039 - DNA, 20 bp, Homo sapiens
tgtcttgataaagtggaatt

SEQ ID NO: 3701040 - DNA, 20 bp, Homo sapiens
tgtcttgctgttgacatatt

SEQ ID NO: 3701041 - DNA, 17 bp, Homo sapiens
tgtcttgttcttgagat

SEQ ID NO: 3701042 - DNA, 15 bp, Homo sapiens
tgtctttaaaagaga

SEQ ID NO: 3701043 - DNA, 16 bp, Homo sapiens
tgtctttaaaagagag

SEQ ID NO: 3701044 - DNA, 15 bp, Homo sapiens
tgtcttttaaaatgc

SEQ ID NO: 3701045 - DNA, 20 bp, Homo sapiens
tgtcttttaaaatgcaatgt

SEQ ID NO: 3701046 - DNA, 20 bp, Homo sapiens
tgtgaaaattgaccaagtga

SEQ ID NO: 3701047 - DNA, 17 bp, Homo sapiens
tgtgaaaggaacatttt

SEQ ID NO: 3701048 - DNA, 20 bp, Homo sapiens
tgtgaaataaaactggcttt

SEQ ID NO: 3701049 - DNA, 21 bp, Homo sapiens
tgtgaaataaaactggctttg

SEQ ID NO: 3701050 - DNA, 15 bp, Homo sapiens
tgtgaaccggctccc

SEQ ID NO: 3701051 - DNA, 19 bp, Homo sapiens
tgtgaactggaagaaagca

SEQ ID NO: 3701052 - DNA, 20 bp, Homo sapiens
tgtgaactggaagaaagcaa

SEQ ID NO: 3701053 - DNA, 15 bp, Homo sapiens
tgtgacaattctgtt

SEQ ID NO: 3701054 - DNA, 19 bp, Homo sapiens
tgtgacaattctgttttta

SEQ ID NO: 3701055 - DNA, 16 bp, Homo sapiens
tgtgacgcgcaagtct

SEQ ID NO: 3701056 - DNA, 14 bp, Homo sapiens
tgtgacttcttctt

SEQ ID NO: 3701057 - DNA, 19 bp, Homo sapiens
tgtgacttcttcttctttg

SEQ ID NO: 3701058 - DNA, 14 bp, Homo sapiens
tgtgagacccccac

SEQ ID NO: 3701059 - DNA, 19 bp, Homo sapiens
tgtgagacccccacacctc

SEQ ID NO: 3701060 - DNA, 13 bp, Homo sapiens
tgtgaggcttgcc

SEQ ID NO: 3701061 - DNA, 17 bp, Homo sapiens
tgtgcaaaaaaattaaa

SEQ ID NO: 3701062 - DNA, 20 bp, Homo sapiens
tgtgcaacagggtatggact

SEQ ID NO: 3701063 - DNA, 23 bp, Homo sapiens
tgtgcacatccgcgtgtgcctgt

SEQ ID NO: 3701064 - DNA, 12 bp, Homo sapiens
tgtgcactaagg

SEQ ID NO: 3701065 - DNA, 16 bp, Homo sapiens
ttggcctgtctcatcc

SEQ ID NO: 3701066 - DNA, 22 bp, Homo sapiens
ttggcctgtctcatccccaggg

SEQ ID NO: 3701067 - DNA, 22 bp, Homo sapiens
ttggctgaaattctcctggagg

SEQ ID NO: 3701068 - DNA, 16 bp, Homo sapiens
ttggcttaatcatttt

SEQ ID NO: 3701069 - DNA, 17 bp, Homo sapiens
ttggcttgttattgcct

SEQ ID NO: 3701070 - DNA, 20 bp, Homo sapiens
ttggctttttccaaatgctt

SEQ ID NO: 3701071 - DNA, 22 bp, Homo sapiens
ttggctttttccaaatgcttct

SEQ ID NO: 3701072 - DNA, 19 bp, Homo sapiens
ttgggaatatccatgtact

SEQ ID NO: 3701073 - DNA, 17 bp, Homo sapiens
ttgggaccctccagtgc

SEQ ID NO: 3701074 - DNA, 17 bp, Homo sapiens
ttgggaggccccactgg

SEQ ID NO: 3701075 - DNA, 17 bp, Homo sapiens
ttgggcagagctggctc

SEQ ID NO: 3701076 - DNA, 22 bp, Homo sapiens
ttgggcagagctggctctgagc

SEQ ID NO: 3701077 - DNA, 14 bp, Homo sapiens
ttgggccagacatg

SEQ ID NO: 3701078 - DNA, 17 bp, Homo sapiens
ttgggccagacatgcca

SEQ ID NO: 3701079 - DNA, 21 bp, Homo sapiens
ttgggcctcccataattgctt

SEQ ID NO: 3701080 - DNA, 17 bp, Homo sapiens
ttgggcctgctccagac

SEQ ID NO: 3701081 - DNA, 20 bp, Homo sapiens
ttgggcctgctccagacctg

SEQ ID NO: 3701082 - DNA, 22 bp, Homo sapiens
ttggggggctgaggtgggagga

SEQ ID NO: 3701083 - DNA, 19 bp, Homo sapiens
ttgggtactcgcacctctt

SEQ ID NO: 3701084 - DNA, 13 bp, Homo sapiens
ttggtacaaaaat

SEQ ID NO: 3701085 - DNA, 13 bp, Homo sapiens
ttggtatctcagg

SEQ ID NO: 3701086 - DNA, 16 bp, Homo sapiens
ttggtatctcaggtct

SEQ ID NO: 3701087 - DNA, 21 bp, Homo sapiens
ttggtgcaacccttacccctt

SEQ ID NO: 3701088 - DNA, 21 bp, Homo sapiens
ttggtgggggagcctctggaa

SEQ ID NO: 3701089 - DNA, 22 bp, Homo sapiens
ttggtgggggagcctctggaat

SEQ ID NO: 3701090 - DNA, 18 bp, Homo sapiens
ttggttgttttttccttt

SEQ ID NO: 3701091 - DNA, 18 bp, Homo sapiens
ttgtaaataggattttta

SEQ ID NO: 3701092 - DNA, 21 bp, Homo sapiens
ttgtaaatgtggtaaagagtt

SEQ ID NO: 3701093 - DNA, 16 bp, Homo sapiens
ttgtaaattatatttg

SEQ ID NO: 3701094 - DNA, 16 bp, Homo sapiens
ttgtaaattattaatt

SEQ ID NO: 3701095 - DNA, 18 bp, Homo sapiens
ttgtaatgaattcctaga

SEQ ID NO: 3701096 - DNA, 18 bp, Homo sapiens
ttgtagagtgtagactgt

SEQ ID NO: 3701097 - DNA, 14 bp, Homo sapiens
ttgtattacagatg

SEQ ID NO: 3701098 - DNA, 18 bp, Homo sapiens
ttgtctgaacccaggcag

SEQ ID NO: 3701099 - DNA, 15 bp, Homo sapiens
ttgtcttaaaaagtg

SEQ ID NO: 3701100 - DNA, 13 bp, Homo sapiens
ttgtctttttaga

SEQ ID NO: 3701101 - DNA, 21 bp, Homo sapiens
ttgtgaaataaaactggcttt

SEQ ID NO: 3701102 - DNA, 18 bp, Homo sapiens
ttgtgaactggaagaaag

SEQ ID NO: 3701103 - DNA, 19 bp, Homo sapiens
ttgtgaactggaagaaagc

SEQ ID NO: 3701104 - DNA, 21 bp, Homo sapiens
ttgtgaactggaagaaagcaa

SEQ ID NO: 3701105 - DNA, 19 bp, Homo sapiens
ttgtgacttcttcttcttt

SEQ ID NO: 3701106 - DNA, 16 bp, Homo sapiens
ttgtgctagaaatttt

SEQ ID NO: 3701107 - DNA, 18 bp, Homo sapiens
ttgtgctagaaattttca

SEQ ID NO: 3701108 - DNA, 14 bp, Homo sapiens
ttgtgcttttcctg

SEQ ID NO: 3701109 - DNA, 15 bp, Homo sapiens
ttgtgcttttcctga

SEQ ID NO: 3701110 - DNA, 18 bp, Homo sapiens
ttgtggccaaggagctgc

SEQ ID NO: 3701111 - DNA, 20 bp, Homo sapiens
ttgtggccaaggagctgcta

SEQ ID NO: 3701112 - DNA, 12 bp, Homo sapiens
ttgtggcctcag

SEQ ID NO: 3701113 - DNA, 13 bp, Homo sapiens
ttgtggcctcaga

SEQ ID NO: 3701114 - DNA, 15 bp, Homo sapiens
ttgtgtaatatgaaa

SEQ ID NO: 3701115 - DNA, 18 bp, Homo sapiens
ttgtgtcccatgatccct

SEQ ID NO: 3701116 - DNA, 14 bp, Homo sapiens
ttgtgttctgtaga

SEQ ID NO: 3701117 - DNA, 14 bp, Homo sapiens
ttgttacttctgag

SEQ ID NO: 3701118 - DNA, 15 bp, Homo sapiens
ttgttgtgtgtgcag

SEQ ID NO: 3701119 - DNA, 16 bp, Homo sapiens
ttgtttgtaaatgcct

SEQ ID NO: 3701120 - DNA, 17 bp, Homo sapiens
ttgttttttcaaaatag

SEQ ID NO: 3701121 - DNA, 17 bp, Homo sapiens
tttaaaaaatattttct

SEQ ID NO: 3701122 - DNA, 13 bp, Homo sapiens
tttaaaaatgtct

SEQ ID NO: 3701123 - DNA, 22 bp, Homo sapiens
tttaaaagagagagagagaaaa

SEQ ID NO: 3701124 - DNA, 20 bp, Homo sapiens
tttaaaatggtttgtcctga

SEQ ID NO: 3701125 - DNA, 21 bp, Homo sapiens
tttaaacacttatcttctgga

SEQ ID NO: 3701126 - DNA, 18 bp, Homo sapiens
tttaaagaatatgacttt

SEQ ID NO: 3701127 - DNA, 22 bp, Homo sapiens
tttaaagtgactaatggcatga

SEQ ID NO: 3701128 - DNA, 23 bp, Homo sapiens
tttaaataaaaattactgtgtta

SEQ ID NO: 3701129 - DNA, 19 bp, Homo sapiens
tttaaatattatgctgctt

SEQ ID NO: 3701130 - DNA, 11 bp, Homo sapiens
tttaaatgtac

SEQ ID NO: 3701131 - DNA, 15 bp, Homo sapiens
tttaaattttgtaat

SEQ ID NO: 3701132 - DNA, 16 bp, Homo sapiens
tttaaggttgaaaaga

SEQ ID NO: 3701133 - DNA, 19 bp, Homo sapiens
tttaatcagttgtttaata

SEQ ID NO: 3701134 - DNA, 16 bp, Homo sapiens
tttaatgtttaaaaca

SEQ ID NO: 3701135 - DNA, 17 bp, Homo sapiens
tttaatgtttaaaacat

SEQ ID NO: 3701136 - DNA, 19 bp, Homo sapiens
tttaatttagtaaatgtta

SEQ ID NO: 3701137 - DNA, 21 bp, Homo sapiens
tttaatttattaattgctttg

SEQ ID NO: 3701138 - DNA, 13 bp, Homo sapiens
tttacaactgaaa

SEQ ID NO: 3701139 - DNA, 13 bp, Homo sapiens
tttacagaatttt

SEQ ID NO: 3701140 - DNA, 21 bp, Homo sapiens
tttacatgccccgtttttgag

SEQ ID NO: 3701141 - DNA, 16 bp, Homo sapiens
tttacatttactgaaa

SEQ ID NO: 3701142 - DNA, 14 bp, Homo sapiens
tttacctagagaac

SEQ ID NO: 3701143 - DNA, 18 bp, Homo sapiens
tttaccttttatgcaaaa

SEQ ID NO: 3701144 - DNA, 13 bp, Homo sapiens
tttagaattaaaa

SEQ ID NO: 3701145 - DNA, 22 bp, Homo sapiens
tttagaccctattgctgcttga

SEQ ID NO: 3701146 - DNA, 13 bp, Homo sapiens
tttagctggccac

SEQ ID NO: 3701147 - DNA, 13 bp, Homo sapiens
tttaggaagtgtt

SEQ ID NO: 3701148 - DNA, 17 bp, Homo sapiens
tttagtaaatgttatct

SEQ ID NO: 3701149 - DNA, 13 bp, Homo sapiens
tttagtaatttct

SEQ ID NO: 3701150 - DNA, 14 bp, Homo sapiens
tttagtatgtaaat

SEQ ID NO: 3701151 - DNA, 16 bp, Homo sapiens
tttagtgaacttgaaa

SEQ ID NO: 3701152 - DNA, 15 bp, Homo sapiens
tttataatgttgtat

SEQ ID NO: 3701153 - DNA, 21 bp, Homo sapiens
tttatactttgcaatccaaat

SEQ ID NO: 3701154 - DNA, 16 bp, Homo sapiens
tttataggtgagaaaa

SEQ ID NO: 3701155 - DNA, 14 bp, Homo sapiens
tttatataatatct

SEQ ID NO: 3701156 - DNA, 15 bp, Homo sapiens
tttatcacacttctg

SEQ ID NO: 3701157 - DNA, 18 bp, Homo sapiens
tttatcacacttctgtga

SEQ ID NO: 3701158 - DNA, 18 bp, Homo sapiens
tttatgggcccctggcac

SEQ ID NO: 3701159 - DNA, 21 bp, Homo sapiens
tttatggtggatgaggcttct

SEQ ID NO: 3701160 - DNA, 17 bp, Homo sapiens
tttattaattgctttga

SEQ ID NO: 3701161 - DNA, 19 bp, Homo sapiens
tttatttagtttttaacaa

SEQ ID NO: 3701162 - DNA, 20 bp, Homo sapiens
tttatttgtttgtgcatttg

SEQ ID NO: 3701163 - DNA, 13 bp, Homo sapiens
tttattttgtgta

SEQ ID NO: 3701164 - DNA, 17 bp, Homo sapiens
tttattttttggacttc

SEQ ID NO: 3701165 - DNA, 21 bp, Homo sapiens
tttcaaaaggaagggtggctt

SEQ ID NO: 3701166 - DNA, 20 bp, Homo sapiens
tttcaaaataaaaaccaaga

SEQ ID NO: 3701167 - DNA, 16 bp, Homo sapiens
tttcaaatcattcctt

SEQ ID NO: 3701168 - DNA, 21 bp, Homo sapiens
tttcaaatttagaaactaatt

SEQ ID NO: 3701169 - DNA, 23 bp, Homo sapiens
tttcaaatttagaaactaattga

SEQ ID NO: 3701170 - DNA, 16 bp, Homo sapiens
tttcaactgccaaaat

SEQ ID NO: 3701171 - DNA, 21 bp, Homo sapiens
tttcaagagtctaatagtctt

SEQ ID NO: 3701172 - DNA, 13 bp, Homo sapiens
tttcaagtgccta

SEQ ID NO: 3701173 - DNA, 15 bp, Homo sapiens
tttcaagtgcctaga

SEQ ID NO: 3701174 - DNA, 12 bp, Homo sapiens
tttcaattgctt

SEQ ID NO: 3701175 - DNA, 20 bp, Homo sapiens
tttcaattgctttgtgactt

SEQ ID NO: 3701176 - DNA, 14 bp, Homo sapiens
tttcaatttccaag

SEQ ID NO: 3701177 - DNA, 20 bp, Homo sapiens
tttcacagctttgaggaaca

SEQ ID NO: 3701178 - DNA, 15 bp, Homo sapiens
tttcacattgtttgc

SEQ ID NO: 3701179 - DNA, 19 bp, Homo sapiens
tttcacattgtttgctgct

SEQ ID NO: 3701180 - DNA, 17 bp, Homo sapiens
tttcacttttctgtaaa

SEQ ID NO: 3701181 - DNA, 13 bp, Homo sapiens
tcgatatttccat

SEQ ID NO: 3701182 - DNA, 23 bp, Homo sapiens
tcgatgggggagtctgaagcaga

SEQ ID NO: 3701183 - DNA, 20 bp, Homo sapiens
tcgattattccctgtacaat

SEQ ID NO: 3701184 - DNA, 15 bp, Homo sapiens
tcgcatttgtcaatg

SEQ ID NO: 3701185 - DNA, 11 bp, Homo sapiens
tcgcccaggag

SEQ ID NO: 3701186 - DNA, 14 bp, Homo sapiens
tcgcccagtctgga

SEQ ID NO: 3701187 - DNA, 22 bp, Homo sapiens
tcgctgatatatgtgtttttca

SEQ ID NO: 3701188 - DNA, 15 bp, Homo sapiens
tcgctggcccccact

SEQ ID NO: 3701189 - DNA, 17 bp, Homo sapiens
tcgctggcccccactgg

SEQ ID NO: 3701190 - DNA, 23 bp, Homo sapiens
tcgctgtgtcagcatagaagtaa

SEQ ID NO: 3701191 - DNA, 16 bp, Homo sapiens
tcgcttcccccatagc

SEQ ID NO: 3701192 - DNA, 17 bp, Homo sapiens
tcgcttcccccatagcc

SEQ ID NO: 3701193 - DNA, 22 bp, Homo sapiens
tcggaagcagtgccttccataa

SEQ ID NO: 3701194 - DNA, 15 bp, Homo sapiens
tcggagccctgtctc

SEQ ID NO: 3701195 - DNA, 22 bp, Homo sapiens
tcggagcctcatccgaggcagg

SEQ ID NO: 3701196 - DNA, 23 bp, Homo sapiens
tcggagcctcatccgaggcaggg

SEQ ID NO: 3701197 - DNA, 22 bp, Homo sapiens
tcggaggcttgtcagagctggg

SEQ ID NO: 3701198 - DNA, 13 bp, Homo sapiens
tcgggagcagtgt

SEQ ID NO: 3701199 - DNA, 15 bp, Homo sapiens
tcgggagcagtgtct

SEQ ID NO: 3701200 - DNA, 22 bp, Homo sapiens
tcgggagcagtgtcttccataa

SEQ ID NO: 3701201 - DNA, 17 bp, Homo sapiens
tcgggaggtcgaggcag

SEQ ID NO: 3701202 - DNA, 12 bp, Homo sapiens
tcgggctcagct

SEQ ID NO: 3701203 - DNA, 15 bp, Homo sapiens
tcgggctcagctctg

SEQ ID NO: 3701204 - DNA, 16 bp, Homo sapiens
tcgggctcagctctgg

SEQ ID NO: 3701205 - DNA, 17 bp, Homo sapiens
tcgggctcagctctggc

SEQ ID NO: 3701206 - DNA, 16 bp, Homo sapiens
tcggggaactcctgga

SEQ ID NO: 3701207 - DNA, 19 bp, Homo sapiens
tcggggagaggctgaggac

SEQ ID NO: 3701208 - DNA, 16 bp, Homo sapiens
tcggggcatgctgggg

SEQ ID NO: 3701209 - DNA, 17 bp, Homo sapiens
tcggggcatgctggggc

SEQ ID NO: 3701210 - DNA, 18 bp, Homo sapiens
tcggggcatgctggggca

SEQ ID NO: 3701211 - DNA, 14 bp, Homo sapiens
tcgggggctggggc

SEQ ID NO: 3701212 - DNA, 15 bp, Homo sapiens
tcggtgtccatttat

SEQ ID NO: 3701213 - DNA, 14 bp, Homo sapiens
tcgtcctccccctg

SEQ ID NO: 3701214 - DNA, 16 bp, Homo sapiens
tcgtcctccccctgcc

SEQ ID NO: 3701215 - DNA, 17 bp, Homo sapiens
tcgtcctccccctgcca

SEQ ID NO: 3701216 - DNA, 17 bp, Homo sapiens
tcgtgaagtatactgta

SEQ ID NO: 3701217 - DNA, 19 bp, Homo sapiens
tcgtgaagtatactgtatt

SEQ ID NO: 3701218 - DNA, 23 bp, Homo sapiens
tcgtgccgttactctccaacctg

SEQ ID NO: 3701219 - DNA, 22 bp, Homo sapiens
tcgtggcagataatcagcctct

SEQ ID NO: 3701220 - DNA, 15 bp, Homo sapiens
tcgtgggtgtgtgta

SEQ ID NO: 3701221 - DNA, 14 bp, Homo sapiens
tcgttaacattgac

SEQ ID NO: 3701222 - DNA, 15 bp, Homo sapiens
tcgttaactgtgtat

SEQ ID NO: 3701223 - DNA, 22 bp, Homo sapiens
tcgttaactgtgtatgtacata

SEQ ID NO: 3701224 - DNA, 15 bp, Homo sapiens
tcgttatgtgtgtat

SEQ ID NO: 3701225 - DNA, 14 bp, Homo sapiens
tcgttctttctagc

SEQ ID NO: 3701226 - DNA, 14 bp, Homo sapiens
tctaaaaacaccaa

SEQ ID NO: 3701227 - DNA, 21 bp, Homo sapiens
tctaaaccatatgaacatata

SEQ ID NO: 3701228 - DNA, 18 bp, Homo sapiens
tctaaagccaaaggtcta

SEQ ID NO: 3701229 - DNA, 21 bp, Homo sapiens
tctaaatttcttcctatttct

SEQ ID NO: 3701230 - DNA, 18 bp, Homo sapiens
tctaacaggggctggtgg

SEQ ID NO: 3701231 - DNA, 16 bp, Homo sapiens
tctaaccaaatgcatc

SEQ ID NO: 3701232 - DNA, 16 bp, Homo sapiens
tctaactctgatgtaa

SEQ ID NO: 3701233 - DNA, 17 bp, Homo sapiens
tctaagcctttccataa

SEQ ID NO: 3701234 - DNA, 19 bp, Homo sapiens
tctaatagaactcagtttt

SEQ ID NO: 3701235 - DNA, 20 bp, Homo sapiens
tctaatagcgaggctctaac

SEQ ID NO: 3701236 - DNA, 18 bp, Homo sapiens
tctaatcatgaaactccc

SEQ ID NO: 3701237 - DNA, 14 bp, Homo sapiens
tctaatgtgtgaat

SEQ ID NO: 3701238 - DNA, 18 bp, Homo sapiens
tctaattcccattttgca

SEQ ID NO: 3701239 - DNA, 22 bp, Homo sapiens
tctaattcccattttgcaaaat

SEQ ID NO: 3701240 - DNA, 20 bp, Homo sapiens
tctaattctaaggaatatga

SEQ ID NO: 3701241 - DNA, 13 bp, Homo sapiens
tctaattgccatg

SEQ ID NO: 3701242 - DNA, 15 bp, Homo sapiens
tctaattgccatgta

SEQ ID NO: 3701243 - DNA, 12 bp, Homo sapiens
tctacactctcc

SEQ ID NO: 3701244 - DNA, 16 bp, Homo sapiens
tctacactctcctggg

SEQ ID NO: 3701245 - DNA, 17 bp, Homo sapiens
tctacactctcctgggc

SEQ ID NO: 3701246 - DNA, 18 bp, Homo sapiens
tctacagacttctccaga

SEQ ID NO: 3701247 - DNA, 16 bp, Homo sapiens
tctacagaggccatgg

SEQ ID NO: 3701248 - DNA, 18 bp, Homo sapiens
tctacagcaaatttataa

SEQ ID NO: 3701249 - DNA, 19 bp, Homo sapiens
tctacagcaaatttataat

SEQ ID NO: 3701250 - DNA, 23 bp, Homo sapiens
tctacagctaatcagcattctca

SEQ ID NO: 3701251 - DNA, 23 bp, Homo sapiens
tctacatttcacctactttgtaa

SEQ ID NO: 3701252 - DNA, 14 bp, Homo sapiens
tctaccatttcaga

SEQ ID NO: 3701253 - DNA, 20 bp, Homo sapiens
tctaccattttctggttctt

SEQ ID NO: 3701254 - DNA, 17 bp, Homo sapiens
tctacccagcccatctt

SEQ ID NO: 3701255 - DNA, 20 bp, Homo sapiens
tctacccagcgagccctggt

SEQ ID NO: 3701256 - DNA, 14 bp, Homo sapiens
tctaccttttctct

SEQ ID NO: 3701257 - DNA, 15 bp, Homo sapiens
tctacgctctccttt

SEQ ID NO: 3701258 - DNA, 17 bp, Homo sapiens
tctacgctctcctttct

SEQ ID NO: 3701259 - DNA, 15 bp, Homo sapiens
tctactaaaaataca

SEQ ID NO: 3701260 - DNA, 15 bp, Homo sapiens
tctactctttttgtt

SEQ ID NO: 3701261 - DNA, 22 bp, Homo sapiens
tctactgaggtgctatgttctt

SEQ ID NO: 3701262 - DNA, 22 bp, Homo sapiens
tctactttagaatgagagtgtg

SEQ ID NO: 3701263 - DNA, 19 bp, Homo sapiens
tctagaacatccctgccag

SEQ ID NO: 3701264 - DNA, 17 bp, Homo sapiens
tctagaagaaatgaaat

SEQ ID NO: 3701265 - DNA, 18 bp, Homo sapiens
tctagaagaaatgaaatt

SEQ ID NO: 3701266 - DNA, 23 bp, Homo sapiens
tctagaagaaatgaaattttacc

SEQ ID NO: 3701267 - DNA, 21 bp, Homo sapiens
tctagaagactgtcagcttcc

SEQ ID NO: 3701268 - DNA, 19 bp, Homo sapiens
tctagaattttaagtgctt

SEQ ID NO: 3701269 - DNA, 14 bp, Homo sapiens
tctagacactgcca

SEQ ID NO: 3701270 - DNA, 14 bp, Homo sapiens
tctagagagggaat

SEQ ID NO: 3701271 - DNA, 22 bp, Homo sapiens
tctagagagggaattctcttgg

SEQ ID NO: 3701272 - DNA, 23 bp, Homo sapiens
tctagagagggaattctcttggc

SEQ ID NO: 3701273 - DNA, 20 bp, Homo sapiens
tctagagccgtgatgcctcc

SEQ ID NO: 3701274 - DNA, 16 bp, Homo sapiens
tctaggagctgggagg

SEQ ID NO: 3701275 - DNA, 17 bp, Homo sapiens
tctaggagctgggagga

SEQ ID NO: 3701276 - DNA, 19 bp, Homo sapiens
tctagggaaaaaccagcgt

SEQ ID NO: 3701277 - DNA, 22 bp, Homo sapiens
tctagggaaaaaccagcgtgtg

SEQ ID NO: 3701278 - DNA, 13 bp, Homo sapiens
tctagggaaatga

SEQ ID NO: 3701279 - DNA, 22 bp, Homo sapiens
tctagggaaggccacctgcagg

SEQ ID NO: 3701280 - DNA, 23 bp, Homo sapiens
tctagggaaggccacctgcaggt

SEQ ID NO: 3701281 - DNA, 21 bp, Homo sapiens
tctaggtcagtacccacctga

SEQ ID NO: 3701282 - DNA, 23 bp, Homo sapiens
tctaggtgcccttggaggccagc

SEQ ID NO: 3701283 - DNA, 19 bp, Homo sapiens
tctaggtggagttgaaaga

SEQ ID NO: 3701284 - DNA, 14 bp, Homo sapiens
tctaggttctaaaa

SEQ ID NO: 3701285 - DNA, 23 bp, Homo sapiens
tctagtgcagctgattttaacaa

SEQ ID NO: 3701286 - DNA, 14 bp, Homo sapiens
tctagtgccctcca

SEQ ID NO: 3701287 - DNA, 20 bp, Homo sapiens
tctagtgccctccacagccg

SEQ ID NO: 3701288 - DNA, 21 bp, Homo sapiens
tctagttgaggagtttcctaa

SEQ ID NO: 3701289 - DNA, 15 bp, Homo sapiens
tctataacatgcatt

SEQ ID NO: 3701290 - DNA, 18 bp, Homo sapiens
tctataggaacatatgaa

SEQ ID NO: 3701291 - DNA, 21 bp, Homo sapiens
tctatatagtacctttgctct

SEQ ID NO: 3701292 - DNA, 20 bp, Homo sapiens
tctatcgagtttgcaatgtc

SEQ ID NO: 3701293 - DNA, 13 bp, Homo sapiens
tctctctcctgtc

SEQ ID NO: 3701294 - DNA, 13 bp, Homo sapiens
tctctcttaccct

SEQ ID NO: 3701295 - DNA, 12 bp, Homo sapiens
tctctctttgga

SEQ ID NO: 3701296 - DNA, 23 bp, Homo sapiens
tctctgatcttgtgctcagcatg

SEQ ID NO: 3701297 - DNA, 20 bp, Homo sapiens
tctctgattttcaaagcttt

SEQ ID NO: 3701298 - DNA, 18 bp, Homo sapiens
tctctgcagccagcccag

SEQ ID NO: 3701299 - DNA, 20 bp, Homo sapiens
tctctgcagccagcccagcc

SEQ ID NO: 3701300 - DNA, 19 bp, Homo sapiens
tctctgcccattccccagc

SEQ ID NO: 3701301 - DNA, 22 bp, Homo sapiens
tctctgccccttaaatcacaca

SEQ ID NO: 3701302 - DNA, 18 bp, Homo sapiens
tctctgcctgtgagccag

SEQ ID NO: 3701303 - DNA, 19 bp, Homo sapiens
tctctgcctgtgagccagt

SEQ ID NO: 3701304 - DNA, 13 bp, Homo sapiens
tctctgctccacc

SEQ ID NO: 3701305 - DNA, 19 bp, Homo sapiens
tctctgctggcccagccaa

SEQ ID NO: 3701306 - DNA, 11 bp, Homo sapiens
tctctgctgta

SEQ ID NO: 3701307 - DNA, 18 bp, Homo sapiens
tctctgtaataaactcat

SEQ ID NO: 3701308 - DNA, 22 bp, Homo sapiens
tctctgtgaacgatttagaaag

SEQ ID NO: 3701309 - DNA, 23 bp, Homo sapiens
tctctgtgaacgatttagaaaga

SEQ ID NO: 3701310 - DNA, 18 bp, Homo sapiens
tctctgtgacctgccccg

SEQ ID NO: 3701311 - DNA, 18 bp, Homo sapiens
tctcttaatttaatcttt

SEQ ID NO: 3701312 - DNA, 18 bp, Homo sapiens
tctcttacccttctgtgc

SEQ ID NO: 3701313 - DNA, 23 bp, Homo sapiens
tctcttacccttctgtgcccagc

SEQ ID NO: 3701314 - DNA, 17 bp, Homo sapiens
tctcttatagaatattt

SEQ ID NO: 3701315 - DNA, 18 bp, Homo sapiens
tctcttatagaatattta

SEQ ID NO: 3701316 - DNA, 21 bp, Homo sapiens
tctcttatagaatatttatta

SEQ ID NO: 3701317 - DNA, 13 bp, Homo sapiens
tctcttcaggttc

SEQ ID NO: 3701318 - DNA, 13 bp, Homo sapiens
tctcttctccact

SEQ ID NO: 3701319 - DNA, 14 bp, Homo sapiens
tctcttgagagggt

SEQ ID NO: 3701320 - DNA, 14 bp, Homo sapiens
tctcttgagcctgg

SEQ ID NO: 3701321 - DNA, 16 bp, Homo sapiens
tctcttggtttccttc

SEQ ID NO: 3701322 - DNA, 19 bp, Homo sapiens
tctcttggtttccttcctt

SEQ ID NO: 3701323 - DNA, 20 bp, Homo sapiens
tctctttaactcaggactcc

SEQ ID NO: 3701324 - DNA, 23 bp, Homo sapiens
tctctttaactcaggactccagc

SEQ ID NO: 3701325 - DNA, 17 bp, Homo sapiens
tctctttaatcttcagt

SEQ ID NO: 3701326 - DNA, 21 bp, Homo sapiens
tctctttaatgtcacaggcag

SEQ ID NO: 3701327 - DNA, 15 bp, Homo sapiens
tctctttacattttg

SEQ ID NO: 3701328 - DNA, 12 bp, Homo sapiens
tctcttttctct

SEQ ID NO: 3701329 - DNA, 22 bp, Homo sapiens
tctcttttgaatccatgcttgg

SEQ ID NO: 3701330 - DNA, 13 bp, Homo sapiens
tctctttttcagt

SEQ ID NO: 3701331 - DNA, 13 bp, Homo sapiens
tctgaaaatgtat

SEQ ID NO: 3701332 - DNA, 23 bp, Homo sapiens
tctgaaaatgtatgtgtaagtat

SEQ ID NO: 3701333 - DNA, 18 bp, Homo sapiens
tctgaaaattaacactgc

SEQ ID NO: 3701334 - DNA, 22 bp, Homo sapiens
tctgaaaattccagaaaggata

SEQ ID NO: 3701335 - DNA, 17 bp, Homo sapiens
tctgaactcgcttctct

SEQ ID NO: 3701336 - DNA, 21 bp, Homo sapiens
tctgaactcgcttctctgtga

SEQ ID NO: 3701337 - DNA, 22 bp, Homo sapiens
tctgaagtcacatcacaggaca

SEQ ID NO: 3701338 - DNA, 23 bp, Homo sapiens
tctgaagtcacatcacaggacac

SEQ ID NO: 3701339 - DNA, 18 bp, Homo sapiens
tctgaagtcactgcacag

SEQ ID NO: 3701340 - DNA, 15 bp, Homo sapiens
tctgaagttggacag

SEQ ID NO: 3701341 - DNA, 16 bp, Homo sapiens
tctgaagtttcattta

SEQ ID NO: 3701342 - DNA, 12 bp, Homo sapiens
tctgaatgtaat

SEQ ID NO: 3701343 - DNA, 16 bp, Homo sapiens
tctgaatgtaatttgt

SEQ ID NO: 3701344 - DNA, 16 bp, Homo sapiens
tctgaatgttctgaca

SEQ ID NO: 3701345 - DNA, 17 bp, Homo sapiens
tctgaatgttctgacat

SEQ ID NO: 3701346 - DNA, 13 bp, Homo sapiens
tctgacacaaaaa

SEQ ID NO: 3701347 - DNA, 13 bp, Homo sapiens
tctgacacacagc

SEQ ID NO: 3701348 - DNA, 14 bp, Homo sapiens
tctgacacacagct

SEQ ID NO: 3701349 - DNA, 15 bp, Homo sapiens
tctgacacacagctc

SEQ ID NO: 3701350 - DNA, 19 bp, Homo sapiens
tctgacacacagctctgtc

SEQ ID NO: 3701351 - DNA, 13 bp, Homo sapiens
tctgacacctatt

SEQ ID NO: 3701352 - DNA, 21 bp, Homo sapiens
tctgacacctattttagacaa

SEQ ID NO: 3701353 - DNA, 21 bp, Homo sapiens
tctgacaggcaatgctggctg

SEQ ID NO: 3701354 - DNA, 22 bp, Homo sapiens
tctgacaggcaatgctggctgt

SEQ ID NO: 3701355 - DNA, 15 bp, Homo sapiens
tctgacattaacagt

SEQ ID NO: 3701356 - DNA, 18 bp, Homo sapiens
tctgacattaacagtttt

SEQ ID NO: 3701357 - DNA, 18 bp, Homo sapiens
tctgaccacacttcctgt

SEQ ID NO: 3701358 - DNA, 17 bp, Homo sapiens
tctgacccactgatctc

SEQ ID NO: 3701359 - DNA, 13 bp, Homo sapiens
tctgacccactgc

SEQ ID NO: 3701360 - DNA, 14 bp, Homo sapiens
tctgacccactgct

SEQ ID NO: 3701361 - DNA, 21 bp, Homo sapiens
tctgaccctagctctttcctt

SEQ ID NO: 3701362 - DNA, 14 bp, Homo sapiens
tctgaccctctcca

SEQ ID NO: 3701363 - DNA, 21 bp, Homo sapiens
tctgaccgaaacagcgctggg

SEQ ID NO: 3701364 - DNA, 17 bp, Homo sapiens
tctgaggaatccagacc

SEQ ID NO: 3701365 - DNA, 18 bp, Homo sapiens
tctgaggaatccagaccc

SEQ ID NO: 3701366 - DNA, 22 bp, Homo sapiens
tctgaggaatccagacccggct

SEQ ID NO: 3701367 - DNA, 23 bp, Homo sapiens
tctgaggacactaaccacgctgg

SEQ ID NO: 3701368 - DNA, 22 bp, Homo sapiens
tctgaggagaaacaaataagac

SEQ ID NO: 3701369 - DNA, 21 bp, Homo sapiens
tctgaggctctttctgggcca

SEQ ID NO: 3701370 - DNA, 24 bp, Homo sapiens
tctgagtgtttttactacagttgt

SEQ ID NO: 3701371 - DNA, 22 bp, Homo sapiens
tctgatattccatgaatgtatc

SEQ ID NO: 3701372 - DNA, 21 bp, Homo sapiens
tctgatcatccactgtgccat

SEQ ID NO: 3701373 - DNA, 19 bp, Homo sapiens
tctgatcttgtgctcagca

SEQ ID NO: 3701374 - DNA, 16 bp, Homo sapiens
tctgatgtaaatgaag

SEQ ID NO: 3701375 - DNA, 17 bp, Homo sapiens
tctgattttatgtaaaa

SEQ ID NO: 3701376 - DNA, 21 bp, Homo sapiens
tctgcaagaattgaagcagga

SEQ ID NO: 3701377 - DNA, 19 bp, Homo sapiens
tctgcacaagctgcaccct

SEQ ID NO: 3701378 - DNA, 17 bp, Homo sapiens
tctgcacccccctgggc

SEQ ID NO: 3701379 - DNA, 22 bp, Homo sapiens
tctgcaccgccggccagctggg

SEQ ID NO: 3701380 - DNA, 14 bp, Homo sapiens
tctgcaccttatct

SEQ ID NO: 3701381 - DNA, 15 bp, Homo sapiens
tctgcaccttatctt

SEQ ID NO: 3701382 - DNA, 15 bp, Homo sapiens
tctgcacttaaatat

SEQ ID NO: 3701383 - DNA, 16 bp, Homo sapiens
tctgcacttaaatatc

SEQ ID NO: 3701384 - DNA, 12 bp, Homo sapiens
tctgcagagcag

SEQ ID NO: 3701385 - DNA, 16 bp, Homo sapiens
tctgcagcatgacctg

SEQ ID NO: 3701386 - DNA, 20 bp, Homo sapiens
tctgcagcatgacctgtgac

SEQ ID NO: 3701387 - DNA, 16 bp, Homo sapiens
tctgcagccagcccag

SEQ ID NO: 3701388 - DNA, 18 bp, Homo sapiens
tctgcagccagcccagcc

SEQ ID NO: 3701389 - DNA, 18 bp, Homo sapiens
tctgcatcatctgtagat

SEQ ID NO: 3701390 - DNA, 10 bp, Homo sapiens
tctgcattta

SEQ ID NO: 3701391 - DNA, 13 bp, Homo sapiens
tctgcatttagca

SEQ ID NO: 3701392 - DNA, 21 bp, Homo sapiens
tctgcattttcaccccaccct

SEQ ID NO: 3701393 - DNA, 20 bp, Homo sapiens
tctgcattttctgaaactaa

SEQ ID NO: 3701394 - DNA, 14 bp, Homo sapiens
tctgccacctcccc

SEQ ID NO: 3701395 - DNA, 20 bp, Homo sapiens
tctgccacctcccctatcca

SEQ ID NO: 3701396 - DNA, 13 bp, Homo sapiens
tctgccagccagc

SEQ ID NO: 3701397 - DNA, 14 bp, Homo sapiens
tctgccaggccccc

SEQ ID NO: 3701398 - DNA, 12 bp, Homo sapiens
tctgccagggag

SEQ ID NO: 3701399 - DNA, 18 bp, Homo sapiens
tctgccatattctgttgg

SEQ ID NO: 3701400 - DNA, 23 bp, Homo sapiens
tctgccatattctgttggccagt

SEQ ID NO: 3701401 - DNA, 16 bp, Homo sapiens
tctgcccagagctggg

SEQ ID NO: 3701402 - DNA, 19 bp, Homo sapiens
tctgcccagagctgggtga

SEQ ID NO: 3701403 - DNA, 17 bp, Homo sapiens
tctgccccagctctggc

SEQ ID NO: 3701404 - DNA, 14 bp, Homo sapiens
tctgcccctccccc

SEQ ID NO: 3701405 - DNA, 14 bp, Homo sapiens
tctgccctgcccac

SEQ ID NO: 3701406 - DNA, 17 bp, Homo sapiens
tcttagatatcttttta

SEQ ID NO: 3701407 - DNA, 12 bp, Homo sapiens
tcttagatgtat

SEQ ID NO: 3701408 - DNA, 17 bp, Homo sapiens
tcttagcctgtggcagt

SEQ ID NO: 3701409 - DNA, 14 bp, Homo sapiens
tcttagctgccaag

SEQ ID NO: 3701410 - DNA, 15 bp, Homo sapiens
tcttaggaagagaaa

SEQ ID NO: 3701411 - DNA, 19 bp, Homo sapiens
tcttaggggagagctttct

SEQ ID NO: 3701412 - DNA, 20 bp, Homo sapiens
tcttaggttggcaaaaaggc

SEQ ID NO: 3701413 - DNA, 14 bp, Homo sapiens
tcttagtagatttt

SEQ ID NO: 3701414 - DNA, 16 bp, Homo sapiens
tcttagtggatgttct

SEQ ID NO: 3701415 - DNA, 14 bp, Homo sapiens
tcttatacatttga

SEQ ID NO: 3701416 - DNA, 22 bp, Homo sapiens
tcttatagtcaatgtttctttt

SEQ ID NO: 3701417 - DNA, 14 bp, Homo sapiens
tcttatgccatttg

SEQ ID NO: 3701418 - DNA, 20 bp, Homo sapiens
tcttatgccatttgtttatt

SEQ ID NO: 3701419 - DNA, 17 bp, Homo sapiens
tcttattcagtaaaaaa

SEQ ID NO: 3701420 - DNA, 22 bp, Homo sapiens
tcttattgcccacgctggagtg

SEQ ID NO: 3701421 - DNA, 19 bp, Homo sapiens
tcttcaacatcaatgttca

SEQ ID NO: 3701422 - DNA, 24 bp, Homo sapiens
tcttcaacatcaatgttcattgta

SEQ ID NO: 3701423 - DNA, 17 bp, Homo sapiens
tcttcaagggctgcttc

SEQ ID NO: 3701424 - DNA, 19 bp, Homo sapiens
tcttcacctaagtctctgt

SEQ ID NO: 3701425 - DNA, 14 bp, Homo sapiens
tcttcacggcagga

SEQ ID NO: 3701426 - DNA, 18 bp, Homo sapiens
tcttcagaagacactgca

SEQ ID NO: 3701427 - DNA, 11 bp, Homo sapiens
tcttcagccta

SEQ ID NO: 3701428 - DNA, 21 bp, Homo sapiens
tcttcagcctagccgacctca

SEQ ID NO: 3701429 - DNA, 22 bp, Homo sapiens
tcttcagcctagccgacctcag

SEQ ID NO: 3701430 - DNA, 23 bp, Homo sapiens
tcttcagcctagccgacctcagc

SEQ ID NO: 3701431 - DNA, 15 bp, Homo sapiens
tcttcagggcactgc

SEQ ID NO: 3701432 - DNA, 15 bp, Homo sapiens
tcttcagggggccag

SEQ ID NO: 3701433 - DNA, 23 bp, Homo sapiens
tcttcaggtggaaaaacatctga

SEQ ID NO: 3701434 - DNA, 14 bp, Homo sapiens
tcttcaggttctta

SEQ ID NO: 3701435 - DNA, 19 bp, Homo sapiens
tcttcagtgggagaaaaca

SEQ ID NO: 3701436 - DNA, 20 bp, Homo sapiens
tcttcagttggtgtgttttt

SEQ ID NO: 3701437 - DNA, 20 bp, Homo sapiens
tcttcataacaattttagga

SEQ ID NO: 3701438 - DNA, 15 bp, Homo sapiens
tcttcatcccactcc

SEQ ID NO: 3701439 - DNA, 19 bp, Homo sapiens
tcttcatccggcagcctgg

SEQ ID NO: 3701440 - DNA, 17 bp, Homo sapiens
tcttcatgcaatgacat

SEQ ID NO: 3701441 - DNA, 18 bp, Homo sapiens
tcttccaagcaaaggtga

SEQ ID NO: 3701442 - DNA, 24 bp, Homo sapiens
tcttccaagcaaaggtgaagagac

SEQ ID NO: 3701443 - DNA, 14 bp, Homo sapiens
tcttccacctggaa

SEQ ID NO: 3701444 - DNA, 12 bp, Homo sapiens
tcttccataatg

SEQ ID NO: 3701445 - DNA, 20 bp, Homo sapiens
tcttccccaacgaaaagcac

SEQ ID NO: 3701446 - DNA, 19 bp, Homo sapiens
tcttccccactccccacct

SEQ ID NO: 3701447 - DNA, 20 bp, Homo sapiens
tcttccccagaaaggagact

SEQ ID NO: 3701448 - DNA, 18 bp, Homo sapiens
tcttccccctctcccagt

SEQ ID NO: 3701449 - DNA, 21 bp, Homo sapiens
tcttccccctctcccagttgt

SEQ ID NO: 3701450 - DNA, 24 bp, Homo sapiens
tcttcccctctaatgctcacgctc

SEQ ID NO: 3701451 - DNA, 17 bp, Homo sapiens
tcttcccgaaccccaag

SEQ ID NO: 3701452 - DNA, 13 bp, Homo sapiens
tcttccctacctc

SEQ ID NO: 3701453 - DNA, 18 bp, Homo sapiens
tcttccggagatgtagca

SEQ ID NO: 3701454 - DNA, 18 bp, Homo sapiens
tcttcctatcccatccca

SEQ ID NO: 3701455 - DNA, 16 bp, Homo sapiens
tcttcctatttctgga

SEQ ID NO: 3701456 - DNA, 18 bp, Homo sapiens
tcttcctatttctggaat

SEQ ID NO: 3701457 - DNA, 18 bp, Homo sapiens
tcttcgttcttgttagta

SEQ ID NO: 3701458 - DNA, 23 bp, Homo sapiens
tcttctagagccgtgatgcctcc

SEQ ID NO: 3701459 - DNA, 17 bp, Homo sapiens
tcttctaggttctaaaa

SEQ ID NO: 3701460 - DNA, 13 bp, Homo sapiens
tcttctattttgt

SEQ ID NO: 3701461 - DNA, 14 bp, Homo sapiens
tcttctcaggctct

SEQ ID NO: 3701462 - DNA, 20 bp, Homo sapiens
tcttctcaggctctgccctg

SEQ ID NO: 3701463 - DNA, 21 bp, Homo sapiens
tcttctcaggctctgccctgc

SEQ ID NO: 3701464 - DNA, 20 bp, Homo sapiens
tcttctcatagcattaacta

SEQ ID NO: 3701465 - DNA, 13 bp, Homo sapiens
tcttctccaggct

SEQ ID NO: 3701466 - DNA, 13 bp, Homo sapiens
tcttctcctttca

SEQ ID NO: 3701467 - DNA, 14 bp, Homo sapiens
tcttctcctttcac

SEQ ID NO: 3701468 - DNA, 19 bp, Homo sapiens
tcttctgccggccctgggg

SEQ ID NO: 3701469 - DNA, 12 bp, Homo sapiens
tcttctgctcca

SEQ ID NO: 3701470 - DNA, 14 bp, Homo sapiens
tcttctgctccacc

SEQ ID NO: 3701471 - DNA, 15 bp, Homo sapiens
tcttctgctccaccc

SEQ ID NO: 3701472 - DNA, 16 bp, Homo sapiens
tcttctgctccaccct

SEQ ID NO: 3701473 - DNA, 22 bp, Homo sapiens
tcttctgctccacccttggcct

SEQ ID NO: 3701474 - DNA, 23 bp, Homo sapiens
tcttctgctccacccttggcctg

SEQ ID NO: 3701475 - DNA, 19 bp, Homo sapiens
tcttctgcttcagcctccc

SEQ ID NO: 3701476 - DNA, 15 bp, Homo sapiens
tcttctgtacgtctg

SEQ ID NO: 3701477 - DNA, 20 bp, Homo sapiens
tcttctgtacgtctgacagg

SEQ ID NO: 3701478 - DNA, 16 bp, Homo sapiens
tcttctttttttgtga

SEQ ID NO: 3701479 - DNA, 17 bp, Homo sapiens
tcttctttttttgtgat

SEQ ID NO: 3701480 - DNA, 23 bp, Homo sapiens
tcttgaaatgaaagtataactga

SEQ ID NO: 3701481 - DNA, 12 bp, Homo sapiens
tcttgaactcct

SEQ ID NO: 3701482 - DNA, 15 bp, Homo sapiens
tcttgaactcctggc

SEQ ID NO: 3701483 - DNA, 16 bp, Homo sapiens
tcttgaactcctggcc

SEQ ID NO: 3701484 - DNA, 18 bp, Homo sapiens
tcttgaatttctaaaaaa

SEQ ID NO: 3701485 - DNA, 19 bp, Homo sapiens
tcttgaccaagcaggaagc

SEQ ID NO: 3701486 - DNA, 16 bp, Homo sapiens
tcttgagatgtcttct

SEQ ID NO: 3701487 - DNA, 13 bp, Homo sapiens
tcttgagcctggg

SEQ ID NO: 3701488 - DNA, 14 bp, Homo sapiens
tcttgagggagctt

SEQ ID NO: 3701489 - DNA, 16 bp, Homo sapiens
tcttgatgactggaat

SEQ ID NO: 3701490 - DNA, 19 bp, Homo sapiens
tcttgatttgttttagaat

SEQ ID NO: 3701491 - DNA, 23 bp, Homo sapiens
tcttgcatggcaaggactgcagg

SEQ ID NO: 3701492 - DNA, 16 bp, Homo sapiens
tcttgccatctatagg

SEQ ID NO: 3701493 - DNA, 12 bp, Homo sapiens
tcttgcccccca

SEQ ID NO: 3701494 - DNA, 21 bp, Homo sapiens
tcttgccccccaccccagcct

SEQ ID NO: 3701495 - DNA, 13 bp, Homo sapiens
tcttgctctgctg

SEQ ID NO: 3701496 - DNA, 13 bp, Homo sapiens
tcttgctgtggtc

SEQ ID NO: 3701497 - DNA, 16 bp, Homo sapiens
tcttgggtaggcggga

SEQ ID NO: 3701498 - DNA, 20 bp, Homo sapiens
tcttgtaagagctatacagt

SEQ ID NO: 3701499 - DNA, 16 bp, Homo sapiens
tcttgtaagattttga

SEQ ID NO: 3701500 - DNA, 19 bp, Homo sapiens
tcttgtaagattttgaaaa

SEQ ID NO: 3701501 - DNA, 22 bp, Homo sapiens
tcttgtccagagacaagacttc

SEQ ID NO: 3701502 - DNA, 13 bp, Homo sapiens
tcttgtcctagct

SEQ ID NO: 3701503 - DNA, 13 bp, Homo sapiens
tcttgtctctggg

SEQ ID NO: 3701504 - DNA, 22 bp, Homo sapiens
tcttgtgaatatgtacataggc

SEQ ID NO: 3701505 - DNA, 18 bp, Homo sapiens
tcttgtgactagtgctga

SEQ ID NO: 3701506 - DNA, 23 bp, Homo sapiens
tcttgtgactagtgctgaagctt

SEQ ID NO: 3701507 - DNA, 15 bp, Homo sapiens
tcttgtggcaagagc

SEQ ID NO: 3701508 - DNA, 21 bp, Homo sapiens
tcttgttgctcaaaaaatgag

SEQ ID NO: 3701509 - DNA, 14 bp, Homo sapiens
tcttgtttcaattc

SEQ ID NO: 3701510 - DNA, 14 bp, Homo sapiens
tcttgtttctgaaa

SEQ ID NO: 3701511 - DNA, 13 bp, Homo sapiens
tcttgtttttcca

SEQ ID NO: 3701512 - DNA, 20 bp, Homo sapiens
tcttgtttttccactactgc

SEQ ID NO: 3701513 - DNA, 18 bp, Homo sapiens
tctttaaagtcaggtcca

SEQ ID NO: 3701514 - DNA, 14 bp, Homo sapiens
tctttaactcagga

SEQ ID NO: 3701515 - DNA, 20 bp, Homo sapiens
tctttaactcaggactccag

SEQ ID NO: 3701516 - DNA, 15 bp, Homo sapiens
tctttaatcttcagt

SEQ ID NO: 3701517 - DNA, 15 bp, Homo sapiens
tctttacttcatgga

SEQ ID NO: 3701518 - DNA, 12 bp, Homo sapiens
tctttactttta

SEQ ID NO: 3701519 - DNA, 16 bp, Homo sapiens
tgaacggggagaaaag

SEQ ID NO: 3701520 - DNA, 17 bp, Homo sapiens
tgaactcaactttgaca

SEQ ID NO: 3701521 - DNA, 12 bp, Homo sapiens
tgaactcctggc

SEQ ID NO: 3701522 - DNA, 14 bp, Homo sapiens
tgaactcctgggct

SEQ ID NO: 3701523 - DNA, 14 bp, Homo sapiens
tgaactcttaatca

SEQ ID NO: 3701524 - DNA, 18 bp, Homo sapiens
tgaactgcatgtataaat

SEQ ID NO: 3701525 - DNA, 22 bp, Homo sapiens
tgaacttaaataaatgtcatta

SEQ ID NO: 3701526 - DNA, 18 bp, Homo sapiens
tgaagaaaagtgggccag

SEQ ID NO: 3701527 - DNA, 13 bp, Homo sapiens
tgaagaacagtaa

SEQ ID NO: 3701528 - DNA, 21 bp, Homo sapiens
tgaagaattattttttttctt

SEQ ID NO: 3701529 - DNA, 18 bp, Homo sapiens
tgaagacaaaaatactct

SEQ ID NO: 3701530 - DNA, 17 bp, Homo sapiens
tgaagagggagaaggga

SEQ ID NO: 3701531 - DNA, 22 bp, Homo sapiens
tgaagatatcttgaaatgaaag

SEQ ID NO: 3701532 - DNA, 16 bp, Homo sapiens
tgaagatgggaacgca

SEQ ID NO: 3701533 - DNA, 17 bp, Homo sapiens
tgaagatgtttgcaata

SEQ ID NO: 3701534 - DNA, 13 bp, Homo sapiens
tgaagcaaacaca

SEQ ID NO: 3701535 - DNA, 14 bp, Homo sapiens
tgaagcaaacacat

SEQ ID NO: 3701536 - DNA, 15 bp, Homo sapiens
tgaagcaaatcagaa

SEQ ID NO: 3701537 - DNA, 16 bp, Homo sapiens
tgaagcccaagtgaaa

SEQ ID NO: 3701538 - DNA, 19 bp, Homo sapiens
tgaagcccaataaacctct

SEQ ID NO: 3701539 - DNA, 20 bp, Homo sapiens
tgaagctaattattttaatt

SEQ ID NO: 3701540 - DNA, 22 bp, Homo sapiens
tgaagctaattattttaattag

SEQ ID NO: 3701541 - DNA, 16 bp, Homo sapiens
tgaagcttattaatgc

SEQ ID NO: 3701542 - DNA, 19 bp, Homo sapiens
tgaagcttattaatgctaa

SEQ ID NO: 3701543 - DNA, 13 bp, Homo sapiens
tgaaggaaagatt

SEQ ID NO: 3701544 - DNA, 16 bp, Homo sapiens
tgaaggaaagatttgt

SEQ ID NO: 3701545 - DNA, 19 bp, Homo sapiens
tgaaggacattgcggacag

SEQ ID NO: 3701546 - DNA, 22 bp, Homo sapiens
tgaaggacattgcggacagcca

SEQ ID NO: 3701547 - DNA, 20 bp, Homo sapiens
tgaaggagagcccttcattt

SEQ ID NO: 3701548 - DNA, 19 bp, Homo sapiens
tgaaggccgagaagcaaga

SEQ ID NO: 3701549 - DNA, 19 bp, Homo sapiens
tgaaggccttattctacat

SEQ ID NO: 3701550 - DNA, 18 bp, Homo sapiens
tgaagggaaaggatattt

SEQ ID NO: 3701551 - DNA, 22 bp, Homo sapiens
tgaagggaaaggatattttctt

SEQ ID NO: 3701552 - DNA, 14 bp, Homo sapiens
tgaagggagagcca

SEQ ID NO: 3701553 - DNA, 21 bp, Homo sapiens
tgaaggtaaaattgaaaggca

SEQ ID NO: 3701554 - DNA, 14 bp, Homo sapiens
tgaaggtgtcagaa

SEQ ID NO: 3701555 - DNA, 16 bp, Homo sapiens
tgaaggtttctgaaaa

SEQ ID NO: 3701556 - DNA, 19 bp, Homo sapiens
tgaagtaacttgtcttaaa

SEQ ID NO: 3701557 - DNA, 13 bp, Homo sapiens
tgaagtaagcaaa

SEQ ID NO: 3701558 - DNA, 14 bp, Homo sapiens
tgaagtaatgaatt

SEQ ID NO: 3701559 - DNA, 20 bp, Homo sapiens
tgaagtaatgaatttttatg

SEQ ID NO: 3701560 - DNA, 20 bp, Homo sapiens
tgaagtacatattaggaaaa

SEQ ID NO: 3701561 - DNA, 14 bp, Homo sapiens
tgaagtcacacagt

SEQ ID NO: 3701562 - DNA, 18 bp, Homo sapiens
tgaagtcacatcacagga

SEQ ID NO: 3701563 - DNA, 15 bp, Homo sapiens
tgaagtcactgcaca

SEQ ID NO: 3701564 - DNA, 14 bp, Homo sapiens
tgaagttctcctga

SEQ ID NO: 3701565 - DNA, 18 bp, Homo sapiens
tgaagttggacagcaaaa

SEQ ID NO: 3701566 - DNA, 16 bp, Homo sapiens
tgaagtttatacagta

SEQ ID NO: 3701567 - DNA, 19 bp, Homo sapiens
tgaagtttatacagtacag

SEQ ID NO: 3701568 - DNA, 20 bp, Homo sapiens
tgaagtttatacagtacagt

SEQ ID NO: 3701569 - DNA, 15 bp, Homo sapiens
tgaataaagacacct

SEQ ID NO: 3701570 - DNA, 17 bp, Homo sapiens
tgaataaagttgaagct

SEQ ID NO: 3701571 - DNA, 16 bp, Homo sapiens
tgaataaataaatgta

SEQ ID NO: 3701572 - DNA, 13 bp, Homo sapiens
tgaataatacagt

SEQ ID NO: 3701573 - DNA, 15 bp, Homo sapiens
tgaataatttcccaa

SEQ ID NO: 3701574 - DNA, 20 bp, Homo sapiens
tgaatagctcccagatttca

SEQ ID NO: 3701575 - DNA, 19 bp, Homo sapiens
tgaatatgattagtaaaga

SEQ ID NO: 3701576 - DNA, 19 bp, Homo sapiens
tgaatatttataacagcat

SEQ ID NO: 3701577 - DNA, 19 bp, Homo sapiens
tgaatatttatatttcact

SEQ ID NO: 3701578 - DNA, 17 bp, Homo sapiens
tgaatccatgcttgggt

SEQ ID NO: 3701579 - DNA, 22 bp, Homo sapiens
tgaatcctaagggctggtctct

SEQ ID NO: 3701580 - DNA, 15 bp, Homo sapiens
tgaatctcaatttga

SEQ ID NO: 3701581 - DNA, 22 bp, Homo sapiens
tgaatctgcattttctgggttc

SEQ ID NO: 3701582 - DNA, 16 bp, Homo sapiens
tgaatcttggtgtcta

SEQ ID NO: 3701583 - DNA, 14 bp, Homo sapiens
tgaatgaaatatca

SEQ ID NO: 3701584 - DNA, 14 bp, Homo sapiens
tgaatgaacaacct

SEQ ID NO: 3701585 - DNA, 19 bp, Homo sapiens
tgaatgaggtcccaggcag

SEQ ID NO: 3701586 - DNA, 22 bp, Homo sapiens
tgaatgaggtcccaggcagaga

SEQ ID NO: 3701587 - DNA, 18 bp, Homo sapiens
tgaatgatctctctgaat

SEQ ID NO: 3701588 - DNA, 14 bp, Homo sapiens
tgaatgcataaaat

SEQ ID NO: 3701589 - DNA, 15 bp, Homo sapiens
tgaatgcataaaatg

SEQ ID NO: 3701590 - DNA, 16 bp, Homo sapiens
tgaatgcataaaatgt

SEQ ID NO: 3701591 - DNA, 20 bp, Homo sapiens
tgaatgccacgcggtacaaa

SEQ ID NO: 3701592 - DNA, 21 bp, Homo sapiens
tgaatggcctgccttgaagcc

SEQ ID NO: 3701593 - DNA, 17 bp, Homo sapiens
tgaatgggtccattttg

SEQ ID NO: 3701594 - DNA, 14 bp, Homo sapiens
tgaatgtaatttgt

SEQ ID NO: 3701595 - DNA, 15 bp, Homo sapiens
tgaatgtatcaggaa

SEQ ID NO: 3701596 - DNA, 16 bp, Homo sapiens
tgaattaaattaggaa

SEQ ID NO: 3701597 - DNA, 15 bp, Homo sapiens
tgaattaaatttaat

SEQ ID NO: 3701598 - DNA, 20 bp, Homo sapiens
tgaattatcccttttcttga

SEQ ID NO: 3701599 - DNA, 13 bp, Homo sapiens
tgaattgataata

SEQ ID NO: 3701600 - DNA, 15 bp, Homo sapiens
tgaattgataataaa

SEQ ID NO: 3701601 - DNA, 16 bp, Homo sapiens
tgaattgataataaac

SEQ ID NO: 3701602 - DNA, 22 bp, Homo sapiens
tgaattgcattttttaaaacaa

SEQ ID NO: 3701603 - DNA, 13 bp, Homo sapiens
tgaatttaacaat

SEQ ID NO: 3701604 - DNA, 16 bp, Homo sapiens
tgaatttaacaatgcg

SEQ ID NO: 3701605 - DNA, 12 bp, Homo sapiens
tgaatttctcta

SEQ ID NO: 3701606 - DNA, 14 bp, Homo sapiens
tgaatttctctaca

SEQ ID NO: 3701607 - DNA, 13 bp, Homo sapiens
tgaatttgaatga

SEQ ID NO: 3701608 - DNA, 18 bp, Homo sapiens
tgaatttgaatgaaaaat

SEQ ID NO: 3701609 - DNA, 14 bp, Homo sapiens
tgaatttggagact

SEQ ID NO: 3701610 - DNA, 20 bp, Homo sapiens
tgaatttggagactctgtgg

SEQ ID NO: 3701611 - DNA, 21 bp, Homo sapiens
tgaatttggcctgcactaatt

SEQ ID NO: 3701612 - DNA, 14 bp, Homo sapiens
tgaattttgttgct

SEQ ID NO: 3701613 - DNA, 16 bp, Homo sapiens
tgaattttgttgctgt

SEQ ID NO: 3701614 - DNA, 23 bp, Homo sapiens
tgaatttttttcatcttctctgg

SEQ ID NO: 3701615 - DNA, 19 bp, Homo sapiens
tgaatttttttttcctagc

SEQ ID NO: 3701616 - DNA, 14 bp, Homo sapiens
tgacaaatcaagtt

SEQ ID NO: 3701617 - DNA, 19 bp, Homo sapiens
tgacaaatcaagtttccaa

SEQ ID NO: 3701618 - DNA, 20 bp, Homo sapiens
tgacaaatcaagtttccaag

SEQ ID NO: 3701619 - DNA, 19 bp, Homo sapiens
tgacaaccatgagaccact

SEQ ID NO: 3701620 - DNA, 13 bp, Homo sapiens
tgacaagccccag

SEQ ID NO: 3701621 - DNA, 17 bp, Homo sapiens
tgacaagccccaggcag

SEQ ID NO: 3701622 - DNA, 15 bp, Homo sapiens
tgacaaggccccaga

SEQ ID NO: 3701623 - DNA, 17 bp, Homo sapiens
tgacaaggccccagaga

SEQ ID NO: 3701624 - DNA, 20 bp, Homo sapiens
tgacaagtcattttaacttt

SEQ ID NO: 3701625 - DNA, 14 bp, Homo sapiens
tgacaataatttca

SEQ ID NO: 3701626 - DNA, 17 bp, Homo sapiens
tgacaataatttcaggt

SEQ ID NO: 3701627 - DNA, 23 bp, Homo sapiens
tgacaattcctagataaaaagat

SEQ ID NO: 3701628 - DNA, 22 bp, Homo sapiens
tgacaattttgtacaaatttgt

SEQ ID NO: 3701629 - DNA, 14 bp, Homo sapiens
tgacacacagctct

SEQ ID NO: 3701630 - DNA, 16 bp, Homo sapiens
tgacacacagctctgt

SEQ ID NO: 3701631 - DNA, 20 bp, Homo sapiens
tgacacacagctctgtcctg

SEQ ID NO: 3701632 - DNA, 13 bp, Homo sapiens
aatagaaggaaac

SEQ ID NO: 3701633 - DNA, 19 bp, Homo sapiens
aatagaaggaaactagctt

SEQ ID NO: 3701634 - DNA, 15 bp, Homo sapiens
aatagagactgtaga

SEQ ID NO: 3701635 - DNA, 18 bp, Homo sapiens
aatagagactgtagattg

SEQ ID NO: 3701636 - DNA, 17 bp, Homo sapiens
aatagagtatatgcact

SEQ ID NO: 3701637 - DNA, 20 bp, Homo sapiens
aatagctatatccatgtact

SEQ ID NO: 3701638 - DNA, 18 bp, Homo sapiens
aataggaaagactttctc

SEQ ID NO: 3701639 - DNA, 13 bp, Homo sapiens
aatagtatttatg

SEQ ID NO: 3701640 - DNA, 13 bp, Homo sapiens
aatagtctgtgtg

SEQ ID NO: 3701641 - DNA, 14 bp, Homo sapiens
aatagtgtgttctg

SEQ ID NO: 3701642 - DNA, 17 bp, Homo sapiens
aatagtgtgttctgatt

SEQ ID NO: 3701643 - DNA, 16 bp, Homo sapiens
aatagtttaggagaaa

SEQ ID NO: 3701644 - DNA, 14 bp, Homo sapiens
aatataaacactat

SEQ ID NO: 3701645 - DNA, 21 bp, Homo sapiens
aatataaagatggctgacttt

SEQ ID NO: 3701646 - DNA, 16 bp, Homo sapiens
aatataaagcatctaa

SEQ ID NO: 3701647 - DNA, 16 bp, Homo sapiens
aatataaccaatgttt

SEQ ID NO: 3701648 - DNA, 23 bp, Homo sapiens
aatataaggaaagcaataaatga

SEQ ID NO: 3701649 - DNA, 13 bp, Homo sapiens
aatatacacacag

SEQ ID NO: 3701650 - DNA, 21 bp, Homo sapiens
aatatagatcagttataagta

SEQ ID NO: 3701651 - DNA, 15 bp, Homo sapiens
aatatagctattttt

SEQ ID NO: 3701652 - DNA, 12 bp, Homo sapiens
aatatatgtatg

SEQ ID NO: 3701653 - DNA, 13 bp, Homo sapiens
aatatattataat

SEQ ID NO: 3701654 - DNA, 17 bp, Homo sapiens
aatatattctctttggt

SEQ ID NO: 3701655 - DNA, 13 bp, Homo sapiens
aatatcaatcatt

SEQ ID NO: 3701656 - DNA, 19 bp, Homo sapiens
aatatcagttactcagccc

SEQ ID NO: 3701657 - DNA, 14 bp, Homo sapiens
aatatcattcagca

SEQ ID NO: 3701658 - DNA, 11 bp, Homo sapiens
aattaaaacaa

SEQ ID NO: 3701659 - DNA, 14 bp, Homo sapiens
aattaaaacaatgt

SEQ ID NO: 3701660 - DNA, 20 bp, Homo sapiens
aattaaaacaatgtcaaggt

SEQ ID NO: 3701661 - DNA, 14 bp, Homo sapiens
aattaaagaaaata

SEQ ID NO: 3701662 - DNA, 20 bp, Homo sapiens
aattaaataaataaataaga

SEQ ID NO: 3701663 - DNA, 15 bp, Homo sapiens
aattaacatataata

SEQ ID NO: 3701664 - DNA, 20 bp, Homo sapiens
aattaacatataatatatgt

SEQ ID NO: 3701665 - DNA, 21 bp, Homo sapiens
aattaacatataatatatgtt

SEQ ID NO: 3701666 - DNA, 12 bp, Homo sapiens
aattaacctggt

SEQ ID NO: 3701667 - DNA, 15 bp, Homo sapiens
aattaacctggtgct

SEQ ID NO: 3701668 - DNA, 16 bp, Homo sapiens
aattaacctggtgctg

SEQ ID NO: 3701669 - DNA, 19 bp, Homo sapiens
aattaagaggatacacacg

SEQ ID NO: 3701670 - DNA, 22 bp, Homo sapiens
aattaaggcaactgaacaaaaa

SEQ ID NO: 3701671 - DNA, 16 bp, Homo sapiens
aattaagtttgtgaat

SEQ ID NO: 3701672 - DNA, 17 bp, Homo sapiens
aattacatgtaaaacat

SEQ ID NO: 3701673 - DNA, 16 bp, Homo sapiens
aattactacaaaattt

SEQ ID NO: 3701674 - DNA, 18 bp, Homo sapiens
aattagaaattggctgga

SEQ ID NO: 3701675 - DNA, 12 bp, Homo sapiens
aattagcaattg

SEQ ID NO: 3701676 - DNA, 22 bp, Homo sapiens
aattaggttaactatgtacaat

SEQ ID NO: 3701677 - DNA, 13 bp, Homo sapiens
aattagtaacatt

SEQ ID NO: 3701678 - DNA, 21 bp, Homo sapiens
aattagttgtgtactctggcc

SEQ ID NO: 3701679 - DNA, 17 bp, Homo sapiens
aattataacttaaaata

SEQ ID NO: 3701680 - DNA, 23 bp, Homo sapiens
aattataacttaaaatattttat

SEQ ID NO: 3701681 - DNA, 14 bp, Homo sapiens
aattataaggactg

SEQ ID NO: 3701682 - DNA, 20 bp, Homo sapiens
aattatactggagaagtctt

SEQ ID NO: 3701683 - DNA, 15 bp, Homo sapiens
aattatcccttttct

SEQ ID NO: 3701684 - DNA, 16 bp, Homo sapiens
aattatcccttttctt

SEQ ID NO: 3701685 - DNA, 21 bp, Homo sapiens
aattatcccttttcttgacta

SEQ ID NO: 3701686 - DNA, 23 bp, Homo sapiens
aattatcgggaacagtgtttccc

SEQ ID NO: 3701687 - DNA, 12 bp, Homo sapiens
aattatctattt

SEQ ID NO: 3701688 - DNA, 20 bp, Homo sapiens
aattatgagtttttcaatta

SEQ ID NO: 3701689 - DNA, 22 bp, Homo sapiens
aattatgtctgctgaataataa

SEQ ID NO: 3701690 - DNA, 18 bp, Homo sapiens
aattatgttattgaaaaa

SEQ ID NO: 3701691 - DNA, 19 bp, Homo sapiens
aattatgttattgaaaaaa

SEQ ID NO: 3701692 - DNA, 16 bp, Homo sapiens
aattattatttatata

SEQ ID NO: 3701693 - DNA, 22 bp, Homo sapiens
aattattatttatatatgtatt

SEQ ID NO: 3701694 - DNA, 13 bp, Homo sapiens
aattattcagtta

SEQ ID NO: 3701695 - DNA, 17 bp, Homo sapiens
aattattcagttaagaa

SEQ ID NO: 3701696 - DNA, 19 bp, Homo sapiens
aattattgtttatattttc

SEQ ID NO: 3701697 - DNA, 12 bp, Homo sapiens
aattatttcaga

SEQ ID NO: 3701698 - DNA, 15 bp, Homo sapiens
aattattttaaatta

SEQ ID NO: 3701699 - DNA, 17 bp, Homo sapiens
aattattttaaattata

SEQ ID NO: 3701700 - DNA, 18 bp, Homo sapiens
aattattttaaattataa

SEQ ID NO: 3701701 - DNA, 20 bp, Homo sapiens
aattattttaaattataagg

SEQ ID NO: 3701702 - DNA, 21 bp, Homo sapiens
aattattttaaattataagga

SEQ ID NO: 3701703 - DNA, 19 bp, Homo sapiens
aattattttttttctttta

SEQ ID NO: 3701704 - DNA, 17 bp, Homo sapiens
aattcaaaaatgtacaa

SEQ ID NO: 3701705 - DNA, 16 bp, Homo sapiens
aattcacaagctgcct

SEQ ID NO: 3701706 - DNA, 16 bp, Homo sapiens
aattcagtgctgtact

SEQ ID NO: 3701707 - DNA, 20 bp, Homo sapiens
aattccagaaaggatattta

SEQ ID NO: 3701708 - DNA, 17 bp, Homo sapiens
aattcccattttgcaaa

SEQ ID NO: 3701709 - DNA, 22 bp, Homo sapiens
aattcccattttgcaaaatttc

SEQ ID NO: 3701710 - DNA, 14 bp, Homo sapiens
aattccccaccctg

SEQ ID NO: 3701711 - DNA, 12 bp, Homo sapiens
aattccccagat

SEQ ID NO: 3701712 - DNA, 20 bp, Homo sapiens
aattcctagataaaaagatg

SEQ ID NO: 3701713 - DNA, 13 bp, Homo sapiens
aattcctctggga

SEQ ID NO: 3701714 - DNA, 13 bp, Homo sapiens
aattccttagctt

SEQ ID NO: 3701715 - DNA, 19 bp, Homo sapiens
aattccttttctaactctc

SEQ ID NO: 3701716 - DNA, 22 bp, Homo sapiens
aattctaatctaacaatggaag

SEQ ID NO: 3701717 - DNA, 15 bp, Homo sapiens
aattctacattgtca

SEQ ID NO: 3701718 - DNA, 14 bp, Homo sapiens
aattctactttgag

SEQ ID NO: 3701719 - DNA, 22 bp, Homo sapiens
aattctagctttgagcttaaga

SEQ ID NO: 3701720 - DNA, 16 bp, Homo sapiens
aattctgctacctcac

SEQ ID NO: 3701721 - DNA, 18 bp, Homo sapiens
aattctgttcatttgtta

SEQ ID NO: 3701722 - DNA, 12 bp, Homo sapiens
aattctgtttct

SEQ ID NO: 3701723 - DNA, 14 bp, Homo sapiens
aattcttaaaatat

SEQ ID NO: 3701724 - DNA, 23 bp, Homo sapiens
aattcttcacctaagtctctgtg

SEQ ID NO: 3701725 - DNA, 17 bp, Homo sapiens
aattgaaaggcattctc

SEQ ID NO: 3701726 - DNA, 13 bp, Homo sapiens
aattgaaggaaag

SEQ ID NO: 3701727 - DNA, 15 bp, Homo sapiens
aattgaatcactgct

SEQ ID NO: 3701728 - DNA, 15 bp, Homo sapiens
aattgaatttaacaa

SEQ ID NO: 3701729 - DNA, 14 bp, Homo sapiens
aattgactgtcact

SEQ ID NO: 3701730 - DNA, 22 bp, Homo sapiens
aattgataataaactgtcctct

SEQ ID NO: 3701731 - DNA, 15 bp, Homo sapiens
aattgatttcaagac

SEQ ID NO: 3701732 - DNA, 22 bp, Homo sapiens
aattgcatgggttttgtaggta

SEQ ID NO: 3701733 - DNA, 14 bp, Homo sapiens
aattgccaaagctg

SEQ ID NO: 3701734 - DNA, 17 bp, Homo sapiens
aattgcttgaaagaaaa

SEQ ID NO: 3701735 - DNA, 19 bp, Homo sapiens
aattgcttgtttgcttcaa

SEQ ID NO: 3701736 - DNA, 15 bp, Homo sapiens
aattgtaaactgtac

SEQ ID NO: 3701737 - DNA, 17 bp, Homo sapiens
aattgtaaactgtacta

SEQ ID NO: 3701738 - DNA, 18 bp, Homo sapiens
aattgtaggggtgtgtgt

SEQ ID NO: 3701739 - DNA, 20 bp, Homo sapiens
aattgtatctagtgcagctg

SEQ ID NO: 3701740 - DNA, 23 bp, Homo sapiens
aattgtatctagtgcagctgatt

SEQ ID NO: 3701741 - DNA, 16 bp, Homo sapiens
aattgtattttagtaa

SEQ ID NO: 3701742 - DNA, 12 bp, Homo sapiens
aattgtgaaaaa

SEQ ID NO: 3701743 - DNA, 18 bp, Homo sapiens
aattgtgaattgataata

SEQ ID NO: 3701744 - DNA, 21 bp, Homo sapiens
aattgtgaattgataataaac

SEQ ID NO: 3701745 - DNA, 20 bp, Homo sapiens
aattgtttaagtgttgtaaa

SEQ ID NO: 3701746 - DNA, 18 bp, Homo sapiens
aattgttttttatctttt

SEQ ID NO: 3701747 - DNA, 22 bp, Homo sapiens
aattgttttttatcttttctac

SEQ ID NO: 3701748 - DNA, 14 bp, Homo sapiens
aatttaaaaaaata

SEQ ID NO: 3701749 - DNA, 17 bp, Homo sapiens
aatttaaaaaaatacag

SEQ ID NO: 3701750 - DNA, 12 bp, Homo sapiens
aatttaaaacaa

SEQ ID NO: 3701751 - DNA, 12 bp, Homo sapiens
aatttaaagcaa

SEQ ID NO: 3701752 - DNA, 17 bp, Homo sapiens
aatttaacaatgcgaat

SEQ ID NO: 3701753 - DNA, 15 bp, Homo sapiens
aatttacatactctg

SEQ ID NO: 3701754 - DNA, 12 bp, Homo sapiens
aatttataattt

SEQ ID NO: 3701755 - DNA, 16 bp, Homo sapiens
aatttatagtttatac

SEQ ID NO: 3701756 - DNA, 23 bp, Homo sapiens
aatttatcctgaaatttcagatt

SEQ ID NO: 3701757 - DNA, 14 bp, Homo sapiens
aatttattcaagaa

SEQ ID NO: 3701758 - DNA, 21 bp, Homo sapiens
aatttattcaattcctctggg

SEQ ID NO: 3701759 - DNA, 15 bp, Homo sapiens
aatttattgcacaaa

SEQ ID NO: 3701760 - DNA, 22 bp, Homo sapiens
aatttattttattttagcagtt

SEQ ID NO: 3701761 - DNA, 24 bp, Homo sapiens
aatttccagtgagcttatcatgct

SEQ ID NO: 3701762 - DNA, 21 bp, Homo sapiens
aatttcgccgttgaagaggaa

SEQ ID NO: 3701763 - DNA, 17 bp, Homo sapiens
aatttgaaccaaaacat

SEQ ID NO: 3701764 - DNA, 13 bp, Homo sapiens
aatttgaatgaaa

SEQ ID NO: 3701765 - DNA, 14 bp, Homo sapiens
aatttgaatgaaaa

SEQ ID NO: 3701766 - DNA, 16 bp, Homo sapiens
aatttgaatgaaaaat

SEQ ID NO: 3701767 - DNA, 16 bp, Homo sapiens
aatttgatgaaagctg

SEQ ID NO: 3701768 - DNA, 20 bp, Homo sapiens
aatttgcactttcaggaaca

SEQ ID NO: 3701769 - DNA, 21 bp, Homo sapiens
aatttgccaaaataatgtctt

SEQ ID NO: 3701770 - DNA, 11 bp, Homo sapiens
aatttggaatt

SEQ ID NO: 3701771 - DNA, 15 bp, Homo sapiens
gtggagccagggagc

SEQ ID NO: 3701772 - DNA, 17 bp, Homo sapiens
gtggaggaatgctcccc

SEQ ID NO: 3701773 - DNA, 20 bp, Homo sapiens
gtggaggagctcaggacact

SEQ ID NO: 3701774 - DNA, 22 bp, Homo sapiens
gtggaggttaaggctgaggaaa

SEQ ID NO: 3701775 - DNA, 19 bp, Homo sapiens
gtggaggttgcagtgagct

SEQ ID NO: 3701776 - DNA, 20 bp, Homo sapiens
gtggatagatgccctgctag

SEQ ID NO: 3701777 - DNA, 14 bp, Homo sapiens
gtggatcacagagg

SEQ ID NO: 3701778 - DNA, 15 bp, Homo sapiens
gtggatgatgtttcg

SEQ ID NO: 3701779 - DNA, 22 bp, Homo sapiens
gtggcacacacctgtagtccca

SEQ ID NO: 3701780 - DNA, 23 bp, Homo sapiens
gtggcacatttttttttttaatt

SEQ ID NO: 3701781 - DNA, 13 bp, Homo sapiens
gtggcaccagcag

SEQ ID NO: 3701782 - DNA, 18 bp, Homo sapiens
gtggcagattttacaaaa

SEQ ID NO: 3701783 - DNA, 19 bp, Homo sapiens
gtggcagattttacaaaag

SEQ ID NO: 3701784 - DNA, 14 bp, Homo sapiens
gtggcagccctgta

SEQ ID NO: 3701785 - DNA, 17 bp, Homo sapiens
gtggcagctgcggtcca

SEQ ID NO: 3701786 - DNA, 21 bp, Homo sapiens
gtggcagctgcggtccaccca

SEQ ID NO: 3701787 - DNA, 22 bp, Homo sapiens
gtggcagctgcggtccacccag

SEQ ID NO: 3701788 - DNA, 23 bp, Homo sapiens
gtggcagctgcggtccacccagg

SEQ ID NO: 3701789 - DNA, 19 bp, Homo sapiens
gtggcagctgcttttgtct

SEQ ID NO: 3701790 - DNA, 11 bp, Homo sapiens
gtggcagctgt

SEQ ID NO: 3701791 - DNA, 14 bp, Homo sapiens
gtggcagtaaagag

SEQ ID NO: 3701792 - DNA, 17 bp, Homo sapiens
gtggcagtgcagcaacc

SEQ ID NO: 3701793 - DNA, 17 bp, Homo sapiens
gtggcagtgggagctgc

SEQ ID NO: 3701794 - DNA, 21 bp, Homo sapiens
gtggcagtgggagctgcctgt

SEQ ID NO: 3701795 - DNA, 16 bp, Homo sapiens
gtggcatgtgctgtga

SEQ ID NO: 3701796 - DNA, 15 bp, Homo sapiens
gtggccagaccagag

SEQ ID NO: 3701797 - DNA, 16 bp, Homo sapiens
gtggcccgacagcctg

SEQ ID NO: 3701798 - DNA, 17 bp, Homo sapiens
gtggcccgacagcctgg

SEQ ID NO: 3701799 - DNA, 19 bp, Homo sapiens
gtggcccgacagcctggca

SEQ ID NO: 3701800 - DNA, 17 bp, Homo sapiens
gtggccctggcctgctg

SEQ ID NO: 3701801 - DNA, 18 bp, Homo sapiens
gtggccctggcctgctgg

SEQ ID NO: 3701802 - DNA, 11 bp, Homo sapiens
gtggcccttgc

SEQ ID NO: 3701803 - DNA, 21 bp, Homo sapiens
gtggcctcaaccctccctcag

SEQ ID NO: 3701804 - DNA, 12 bp, Homo sapiens
gtggcctcagaa

SEQ ID NO: 3701805 - DNA, 13 bp, Homo sapiens
gtggcctggccag

SEQ ID NO: 3701806 - DNA, 16 bp, Homo sapiens
gtggcctggccaggag

SEQ ID NO: 3701807 - DNA, 21 bp, Homo sapiens
gtggcctggccaggagctctt

SEQ ID NO: 3701808 - DNA, 13 bp, Homo sapiens
gtggcctggctcc

SEQ ID NO: 3701809 - DNA, 12 bp, Homo sapiens
gtggcctgggca

SEQ ID NO: 3701810 - DNA, 19 bp, Homo sapiens
gtggccttccccagcctct

SEQ ID NO: 3701811 - DNA, 17 bp, Homo sapiens
gtggcggtgcctgggtg

SEQ ID NO: 3701812 - DNA, 19 bp, Homo sapiens
gtggctagtcagagagagt

SEQ ID NO: 3701813 - DNA, 15 bp, Homo sapiens
gtggctgacccagtc

SEQ ID NO: 3701814 - DNA, 16 bp, Homo sapiens
gtggctgcctggagcc

SEQ ID NO: 3701815 - DNA, 18 bp, Homo sapiens
gtggctgcggcacccttg

SEQ ID NO: 3701816 - DNA, 17 bp, Homo sapiens
gtggctgggggcaggag

SEQ ID NO: 3701817 - DNA, 19 bp, Homo sapiens
gtggctgggttggagggtg

SEQ ID NO: 3701818 - DNA, 18 bp, Homo sapiens
gtggctgggtttacacgc

SEQ ID NO: 3701819 - DNA, 19 bp, Homo sapiens
gtggctgtcagcaggaagc

SEQ ID NO: 3701820 - DNA, 20 bp, Homo sapiens
gtggcttcccgctcagccct

SEQ ID NO: 3701821 - DNA, 13 bp, Homo sapiens
gtggcttctgatg

SEQ ID NO: 3701822 - DNA, 17 bp, Homo sapiens
gtggctttcagagcctc

SEQ ID NO: 3701823 - DNA, 15 bp, Homo sapiens
gtgggacagagtctg

SEQ ID NO: 3701824 - DNA, 14 bp, Homo sapiens
gtgggactgtacac

SEQ ID NO: 3701825 - DNA, 22 bp, Homo sapiens
gtgggactgtacacactttatt

SEQ ID NO: 3701826 - DNA, 13 bp, Homo sapiens
gtgggagaggtct

SEQ ID NO: 3701827 - DNA, 23 bp, Homo sapiens
gtgggaggatctcttgagcctgg

SEQ ID NO: 3701828 - DNA, 15 bp, Homo sapiens
gtgggagtcatctca

SEQ ID NO: 3701829 - DNA, 21 bp, Homo sapiens
gtgggcacgctgtgggcaggt

SEQ ID NO: 3701830 - DNA, 20 bp, Homo sapiens
gtgggcattgatggggaagg

SEQ ID NO: 3701831 - DNA, 12 bp, Homo sapiens
gtgggccagccc

SEQ ID NO: 3701832 - DNA, 13 bp, Homo sapiens
gtgggccagcccc

SEQ ID NO: 3701833 - DNA, 15 bp, Homo sapiens
gtgggcctcctctgt

SEQ ID NO: 3701834 - DNA, 20 bp, Homo sapiens
gtgggcctcctctgtccagg

SEQ ID NO: 3701835 - DNA, 23 bp, Homo sapiens
gtgggcctcctctgtccagggcc

SEQ ID NO: 3701836 - DNA, 12 bp, Homo sapiens
gtgggctaagca

SEQ ID NO: 3701837 - DNA, 14 bp, Homo sapiens
gtgggctgagccct

SEQ ID NO: 3701838 - DNA, 15 bp, Homo sapiens
gtgggctgagccctg

SEQ ID NO: 3701839 - DNA, 13 bp, Homo sapiens
gtgggctgtgagt

SEQ ID NO: 3701840 - DNA, 14 bp, Homo sapiens
gtggggcagcacag

SEQ ID NO: 3701841 - DNA, 23 bp, Homo sapiens
gtggggcagcacagagagggggc

SEQ ID NO: 3701842 - DNA, 15 bp, Homo sapiens
gtggggcctagatcc

SEQ ID NO: 3701843 - DNA, 14 bp, Homo sapiens
gtgggggcagaggg

SEQ ID NO: 3701844 - DNA, 19 bp, Homo sapiens
gtgggggttggctgggtac

SEQ ID NO: 3701845 - DNA, 17 bp, Homo sapiens
gtggggtgaggaccact

SEQ ID NO: 3701846 - DNA, 17 bp, Homo sapiens
gtgggtcttcagggggc

SEQ ID NO: 3701847 - DNA, 13 bp, Homo sapiens
gtgggtgaaagaa

SEQ ID NO: 3701848 - DNA, 20 bp, Homo sapiens
gtgggtgaaagaaatcatgt

SEQ ID NO: 3701849 - DNA, 13 bp, Homo sapiens
gtgggtgagccag

SEQ ID NO: 3701850 - DNA, 16 bp, Homo sapiens
gtgggttttcttccca

SEQ ID NO: 3701851 - DNA, 17 bp, Homo sapiens
gtggtagagtgtgcctg

SEQ ID NO: 3701852 - DNA, 12 bp, Homo sapiens
gtggtatgtgtg

SEQ ID NO: 3701853 - DNA, 12 bp, Homo sapiens
gtggtcctgact

SEQ ID NO: 3701854 - DNA, 13 bp, Homo sapiens
gtggtctgaatgt

SEQ ID NO: 3701855 - DNA, 17 bp, Homo sapiens
gtggtctgaatgttctg

SEQ ID NO: 3701856 - DNA, 18 bp, Homo sapiens
gtggtctgaatgttctga

SEQ ID NO: 3701857 - DNA, 21 bp, Homo sapiens
gtggtctgagccaaagagaat

SEQ ID NO: 3701858 - DNA, 12 bp, Homo sapiens
gtggtggctctg

SEQ ID NO: 3701859 - DNA, 15 bp, Homo sapiens
gtggtggctctgaga

SEQ ID NO: 3701860 - DNA, 23 bp, Homo sapiens
gtggttaatgccatggacagaag

SEQ ID NO: 3701861 - DNA, 19 bp, Homo sapiens
gtggttatttttatacagt

SEQ ID NO: 3701862 - DNA, 15 bp, Homo sapiens
gtgtaacagctgagg

SEQ ID NO: 3701863 - DNA, 17 bp, Homo sapiens
gtgtaacaggtctcctc

SEQ ID NO: 3701864 - DNA, 21 bp, Homo sapiens
gtgtaagtattcttatttaat

SEQ ID NO: 3701865 - DNA, 14 bp, Homo sapiens
gtgtaataaagtgt

SEQ ID NO: 3701866 - DNA, 20 bp, Homo sapiens
gtgtaataaagtgttttcag

SEQ ID NO: 3701867 - DNA, 21 bp, Homo sapiens
gtgtaataaagtgttttcaga

SEQ ID NO: 3701868 - DNA, 22 bp, Homo sapiens
gtgtaataaagtgttttcagag

SEQ ID NO: 3701869 - DNA, 17 bp, Homo sapiens
gtgtacatggaataaca

SEQ ID NO: 3701870 - DNA, 13 bp, Homo sapiens
gtgtactctggcc

SEQ ID NO: 3701871 - DNA, 15 bp, Homo sapiens
gtgtactctggcctc

SEQ ID NO: 3701872 - DNA, 22 bp, Homo sapiens
gtgtagacgaagggggcatctg

SEQ ID NO: 3701873 - DNA, 14 bp, Homo sapiens
gtgtagccaaggtc

SEQ ID NO: 3701874 - DNA, 15 bp, Homo sapiens
gtgtagccccaagaa

SEQ ID NO: 3701875 - DNA, 14 bp, Homo sapiens
gtgtagctttgctc

SEQ ID NO: 3701876 - DNA, 16 bp, Homo sapiens
gtgtaggctttactta

SEQ ID NO: 3701877 - DNA, 15 bp, Homo sapiens
gtgtatgactaaaga

SEQ ID NO: 3701878 - DNA, 19 bp, Homo sapiens
gtgtatggaaataaatgta

SEQ ID NO: 3701879 - DNA, 22 bp, Homo sapiens
gtgtatgggtgtgtgtttgtgt

SEQ ID NO: 3701880 - DNA, 14 bp, Homo sapiens
gtgtcacctgaaga

SEQ ID NO: 3701881 - DNA, 19 bp, Homo sapiens
gttcatatgtaccatgtac

SEQ ID NO: 3701882 - DNA, 18 bp, Homo sapiens
gttcatccaatcctcact

SEQ ID NO: 3701883 - DNA, 16 bp, Homo sapiens
gttcatgccaccatgg

SEQ ID NO: 3701884 - DNA, 18 bp, Homo sapiens
gttcattgtaatgttact

SEQ ID NO: 3701885 - DNA, 20 bp, Homo sapiens
gttcattgtaatgttactga

SEQ ID NO: 3701886 - DNA, 22 bp, Homo sapiens
gttcattgtaatgttactgatc

SEQ ID NO: 3701887 - DNA, 16 bp, Homo sapiens
gttcatttgtgtgctc

SEQ ID NO: 3701888 - DNA, 17 bp, Homo sapiens
gttcatttgtgtgctca

SEQ ID NO: 3701889 - DNA, 18 bp, Homo sapiens
gttcatttgttattctta

SEQ ID NO: 3701890 - DNA, 14 bp, Homo sapiens
gttccaagacattg

SEQ ID NO: 3701891 - DNA, 16 bp, Homo sapiens
gttccaagacattgtc

SEQ ID NO: 3701892 - DNA, 17 bp, Homo sapiens
gttccaagacattgtca

SEQ ID NO: 3701893 - DNA, 16 bp, Homo sapiens
gttccaatcctggctc

SEQ ID NO: 3701894 - DNA, 16 bp, Homo sapiens
gttcccccagccctgt

SEQ ID NO: 3701895 - DNA, 19 bp, Homo sapiens
gttcccccagtacctccaa

SEQ ID NO: 3701896 - DNA, 15 bp, Homo sapiens
gttcccctgttcact

SEQ ID NO: 3701897 - DNA, 17 bp, Homo sapiens
gttccctctccctgttg

SEQ ID NO: 3701898 - DNA, 19 bp, Homo sapiens
gttccctgaaaacccagag

SEQ ID NO: 3701899 - DNA, 12 bp, Homo sapiens
gttcccttggcc

SEQ ID NO: 3701900 - DNA, 14 bp, Homo sapiens
gttcccttggcctc

SEQ ID NO: 3701901 - DNA, 17 bp, Homo sapiens
gttccctttgctccacc

SEQ ID NO: 3701902 - DNA, 18 bp, Homo sapiens
gttccctttgctccaccc

SEQ ID NO: 3701903 - DNA, 19 bp, Homo sapiens
gttccggaatcctgtcctc

SEQ ID NO: 3701904 - DNA, 16 bp, Homo sapiens
gttcctgatgacccag

SEQ ID NO: 3701905 - DNA, 22 bp, Homo sapiens
gttcctgatgacccaggctgcc

SEQ ID NO: 3701906 - DNA, 17 bp, Homo sapiens
gttcctgcagcagagcc

SEQ ID NO: 3701907 - DNA, 12 bp, Homo sapiens
gttcctggcaat

SEQ ID NO: 3701908 - DNA, 16 bp, Homo sapiens
gttctacactcatctt

SEQ ID NO: 3701909 - DNA, 14 bp, Homo sapiens
gttctatttaagtg

SEQ ID NO: 3701910 - DNA, 23 bp, Homo sapiens
gttctatttaagtgtactaatta

SEQ ID NO: 3701911 - DNA, 17 bp, Homo sapiens
gttctcctctcccctct

SEQ ID NO: 3701912 - DNA, 17 bp, Homo sapiens
gttctctctgcctgtga

SEQ ID NO: 3701913 - DNA, 15 bp, Homo sapiens
gttctctcttctcca

SEQ ID NO: 3701914 - DNA, 16 bp, Homo sapiens
gttctgattagaaatg

SEQ ID NO: 3701915 - DNA, 15 bp, Homo sapiens
gttctggccctcacc

SEQ ID NO: 3701916 - DNA, 15 bp, Homo sapiens
gttctgggacacagt

SEQ ID NO: 3701917 - DNA, 11 bp, Homo sapiens
gttctgggtgg

SEQ ID NO: 3701918 - DNA, 23 bp, Homo sapiens
gttctggttagctcagccccagc

SEQ ID NO: 3701919 - DNA, 19 bp, Homo sapiens
gttctgtgtatttaattgt

SEQ ID NO: 3701920 - DNA, 15 bp, Homo sapiens
gttctgtttgttaaa

SEQ ID NO: 3701921 - DNA, 22 bp, Homo sapiens
gttctgtttgttaaaactggca

SEQ ID NO: 3701922 - DNA, 16 bp, Homo sapiens
gttctgttttgcctga

SEQ ID NO: 3701923 - DNA, 14 bp, Homo sapiens
gttcttactgcttg

SEQ ID NO: 3701924 - DNA, 14 bp, Homo sapiens
gttcttgttctgtt

SEQ ID NO: 3701925 - DNA, 18 bp, Homo sapiens
gttctttcttcctctgct

SEQ ID NO: 3701926 - DNA, 22 bp, Homo sapiens
gttgaagctaagatttagagat

SEQ ID NO: 3701927 - DNA, 14 bp, Homo sapiens
gttgaagctctggt

SEQ ID NO: 3701928 - DNA, 16 bp, Homo sapiens
gttgaatggcctgcct

SEQ ID NO: 3701929 - DNA, 18 bp, Homo sapiens
gttgacagttcatatgta

SEQ ID NO: 3701930 - DNA, 19 bp, Homo sapiens
gttgagggaacagacagga

SEQ ID NO: 3701931 - DNA, 23 bp, Homo sapiens
gttgaggtggtctgaatgttctg

SEQ ID NO: 3701932 - DNA, 21 bp, Homo sapiens
gttgagttcaggtagctgccc

SEQ ID NO: 3701933 - DNA, 23 bp, Homo sapiens
gttgatgatctttgcagacaggc

SEQ ID NO: 3701934 - DNA, 17 bp, Homo sapiens
gttgcaaggccgctgtt

SEQ ID NO: 3701935 - DNA, 17 bp, Homo sapiens
gttgcaagtactgctgt

SEQ ID NO: 3701936 - DNA, 15 bp, Homo sapiens
gttgcaggacctcag

SEQ ID NO: 3701937 - DNA, 13 bp, Homo sapiens
gttgcagtgagct

SEQ ID NO: 3701938 - DNA, 15 bp, Homo sapiens
gttgcagtggagagg

SEQ ID NO: 3701939 - DNA, 21 bp, Homo sapiens
gttgccaagaactgaaaacat

SEQ ID NO: 3701940 - DNA, 22 bp, Homo sapiens
gttgccaagaactgaaaacata

SEQ ID NO: 3701941 - DNA, 11 bp, Homo sapiens
gttgccagaga

SEQ ID NO: 3701942 - DNA, 18 bp, Homo sapiens
gttgcccaggcaggtctt

SEQ ID NO: 3701943 - DNA, 15 bp, Homo sapiens
gttgcccaggctggc

SEQ ID NO: 3701944 - DNA, 20 bp, Homo sapiens
gttgcccagggatttgtcct

SEQ ID NO: 3701945 - DNA, 18 bp, Homo sapiens
gttgctcaaaaaatgagc

SEQ ID NO: 3701946 - DNA, 22 bp, Homo sapiens
gttgctccgcctctgctggcac

SEQ ID NO: 3701947 - DNA, 23 bp, Homo sapiens
gttgctgatgaactcttaatcaa

SEQ ID NO: 3701948 - DNA, 13 bp, Homo sapiens
gttgcttctggga

SEQ ID NO: 3701949 - DNA, 22 bp, Homo sapiens
gttggaatgaattaaataaacc

SEQ ID NO: 3701950 - DNA, 16 bp, Homo sapiens
gttggaattaaaacaa

SEQ ID NO: 3701951 - DNA, 23 bp, Homo sapiens
gttggacagcaaaaccattgctt

SEQ ID NO: 3701952 - DNA, 23 bp, Homo sapiens
gttggacttttcgttaacattga

SEQ ID NO: 3701953 - DNA, 18 bp, Homo sapiens
gttggagccactctgttc

SEQ ID NO: 3701954 - DNA, 18 bp, Homo sapiens
gttggcaaaaaggcagga

SEQ ID NO: 3701955 - DNA, 14 bp, Homo sapiens
gttggccagtgtga

SEQ ID NO: 3701956 - DNA, 14 bp, Homo sapiens
gttggctgggccca

SEQ ID NO: 3701957 - DNA, 17 bp, Homo sapiens
gttggctgggcccagaa

SEQ ID NO: 3701958 - DNA, 19 bp, Homo sapiens
gttggctgggggcctcagt

SEQ ID NO: 3701959 - DNA, 12 bp, Homo sapiens
gttggctgggta

SEQ ID NO: 3701960 - DNA, 17 bp, Homo sapiens
gttgggcccagatctgg

SEQ ID NO: 3701961 - DNA, 17 bp, Homo sapiens
gttgggctggtgtcacc

SEQ ID NO: 3701962 - DNA, 14 bp, Homo sapiens
gttggggaggggcg

SEQ ID NO: 3701963 - DNA, 23 bp, Homo sapiens
gttggggtggtttttgagccatg

SEQ ID NO: 3701964 - DNA, 15 bp, Homo sapiens
gttggtgtgtttttg

SEQ ID NO: 3701965 - DNA, 14 bp, Homo sapiens
gttgtaaatattta

SEQ ID NO: 3701966 - DNA, 20 bp, Homo sapiens
gttgtaaatatttatgtaaa

SEQ ID NO: 3701967 - DNA, 14 bp, Homo sapiens
gttgtagtaaagaa

SEQ ID NO: 3701968 - DNA, 22 bp, Homo sapiens
gttgtcaagtctctgctggccc

SEQ ID NO: 3701969 - DNA, 18 bp, Homo sapiens
gttgtcagcatcttctca

SEQ ID NO: 3701970 - DNA, 22 bp, Homo sapiens
gttgtctgaagtcactgcacag

SEQ ID NO: 3701971 - DNA, 14 bp, Homo sapiens
gttgtggttaatct

SEQ ID NO: 3701972 - DNA, 18 bp, Homo sapiens
gttgttaatgaaaatgtc

SEQ ID NO: 3701973 - DNA, 16 bp, Homo sapiens
gttgttatggaaactg

SEQ ID NO: 3701974 - DNA, 13 bp, Homo sapiens
gttgttcttttcc

SEQ ID NO: 3701975 - DNA, 23 bp, Homo sapiens
gttgttcttttcccccaaagtgg

SEQ ID NO: 3701976 - DNA, 20 bp, Homo sapiens
gttgtttgtaaataagagat

SEQ ID NO: 3701977 - DNA, 16 bp, Homo sapiens
gtttaaagtgtattat

SEQ ID NO: 3701978 - DNA, 23 bp, Homo sapiens
gtttaaagtgtattataacagtg

SEQ ID NO: 3701979 - DNA, 23 bp, Homo sapiens
gtttaacataaattgtactgttg

SEQ ID NO: 3701980 - DNA, 18 bp, Homo sapiens
gtttaacttttttcttta

SEQ ID NO: 3701981 - DNA, 21 bp, Homo sapiens
gtttaagatttaatttgccaa

SEQ ID NO: 3701982 - DNA, 12 bp, Homo sapiens
gtttaagtgttg

SEQ ID NO: 3701983 - DNA, 17 bp, Homo sapiens
gtttaatattgagaaag

SEQ ID NO: 3701984 - DNA, 21 bp, Homo sapiens
gtttaccatttgtaataaagt

SEQ ID NO: 3701985 - DNA, 16 bp, Homo sapiens
gtttacctgtgaaata

SEQ ID NO: 3701986 - DNA, 13 bp, Homo sapiens
gtttagtgtaaaa

SEQ ID NO: 3701987 - DNA, 17 bp, Homo sapiens
gtttagtgtaaaaatga

SEQ ID NO: 3701988 - DNA, 20 bp, Homo sapiens
gtttagtgtaaaaatgagaa

SEQ ID NO: 3701989 - DNA, 18 bp, Homo sapiens
gtttatacagttttaaag

SEQ ID NO: 3701990 - DNA, 14 bp, Homo sapiens
gctgaaagagaaaa

SEQ ID NO: 3701991 - DNA, 20 bp, Homo sapiens
gctgaaatactgaggggtct

SEQ ID NO: 3701992 - DNA, 22 bp, Homo sapiens
gcggctgagtcatgatctccct

SEQ ID NO: 3701993 - DNA, 15 bp, Homo sapiens
gcggctggtgcaggg

SEQ ID NO: 3701994 - DNA, 13 bp, Homo sapiens
gcgggaaggaggg

SEQ ID NO: 3701995 - DNA, 20 bp, Homo sapiens
gcgggaggatgttctgggac

SEQ ID NO: 3701996 - DNA, 15 bp, Homo sapiens
gcgggatggtcctgg

SEQ ID NO: 3701997 - DNA, 17 bp, Homo sapiens
gcgggatggtcctgggg

SEQ ID NO: 3701998 - DNA, 20 bp, Homo sapiens
gcgggcacctatagtcccag

SEQ ID NO: 3701999 - DNA, 20 bp, Homo sapiens
gcgggccaaggactgccgac

SEQ ID NO: 3702000 - DNA, 19 bp, Homo sapiens
gcgggcgaatcacgaggtc

SEQ ID NO: 3702001 - DNA, 22 bp, Homo sapiens
gttcatagggtctcttcaggtt

SEQ ID NO: 3702002 - DNA, 21 bp, Homo sapiens
aacatgtaattaagtactatg

SEQ ID NO: 3702003 - DNA, 18 bp, Homo sapiens
aacatgttggtatttatc

SEQ ID NO: 3702004 - DNA, 23 bp, Homo sapiens
aacattaaaacaatattgtttct

SEQ ID NO: 3702005 - DNA, 22 bp, Homo sapiens
aacattccgtttacattttaga

SEQ ID NO: 3702006 - DNA, 21 bp, Homo sapiens
aacattcgatctcattcagta

SEQ ID NO: 3702007 - DNA, 18 bp, Homo sapiens
aacattgattgctgtgtc

SEQ ID NO: 3702008 - DNA, 21 bp, Homo sapiens
aaccaaaagaacaagaatttc

SEQ ID NO: 3702009 - DNA, 18 bp, Homo sapiens
aaccaaatgcatcaatcc

SEQ ID NO: 3702010 - DNA, 23 bp, Homo sapiens
aaccaaatgcatcaatcctgtgt

SEQ ID NO: 3702011 - DNA, 20 bp, Homo sapiens
aaccaacccttccctgaaaa

SEQ ID NO: 3702012 - DNA, 16 bp, Homo sapiens
aaccaacttttctatt

SEQ ID NO: 3702013 - DNA, 20 bp, Homo sapiens
aaccaagtcatgtgcatttc

SEQ ID NO: 3702014 - DNA, 14 bp, Homo sapiens
aaccacagccctgt

SEQ ID NO: 3702015 - DNA, 21 bp, Homo sapiens
aaccaccacacccagcccact

SEQ ID NO: 3702016 - DNA, 19 bp, Homo sapiens
aaccaccgctccccagccc

SEQ ID NO: 3702017 - DNA, 13 bp, Homo sapiens
aaccacgctggac

SEQ ID NO: 3702018 - DNA, 18 bp, Homo sapiens
aaccacgtctgtcttcac

SEQ ID NO: 3702019 - DNA, 20 bp, Homo sapiens
aaccactgcttccatttaat

SEQ ID NO: 3702020 - DNA, 22 bp, Homo sapiens
aaccagaagcaacagaaaaaat

SEQ ID NO: 3702021 - DNA, 18 bp, Homo sapiens
aaccagaataaagttctg

SEQ ID NO: 3702022 - DNA, 19 bp, Homo sapiens
aaccagagcaagctttttt

SEQ ID NO: 3702023 - DNA, 18 bp, Homo sapiens
aaccagagcactgtatac

SEQ ID NO: 3702024 - DNA, 18 bp, Homo sapiens
aaccagagccatggactc

SEQ ID NO: 3702025 - DNA, 18 bp, Homo sapiens
aaccagggaagctgtccc

SEQ ID NO: 3702026 - DNA, 19 bp, Homo sapiens
aaccagggaagctgtccct

SEQ ID NO: 3702027 - DNA, 22 bp, Homo sapiens
aaccagggcaccaagcccacag

SEQ ID NO: 3702028 - DNA, 18 bp, Homo sapiens
aaccagtatacaagataa

SEQ ID NO: 3702029 - DNA, 22 bp, Homo sapiens
aaccagtctgaagtttcattta

SEQ ID NO: 3702030 - DNA, 23 bp, Homo sapiens
aaccagtctgaagtttcatttat

SEQ ID NO: 3702031 - DNA, 14 bp, Homo sapiens
aaccagtgtagcct

SEQ ID NO: 3702032 - DNA, 18 bp, Homo sapiens
aaccagtttcaggtgttt

SEQ ID NO: 3702033 - DNA, 18 bp, Homo sapiens
aaccataacaacttcata

SEQ ID NO: 3702034 - DNA, 22 bp, Homo sapiens
aaccataggctgctctgcctgt

SEQ ID NO: 3702035 - DNA, 14 bp, Homo sapiens
aaccatatggatat

SEQ ID NO: 3702036 - DNA, 19 bp, Homo sapiens
aaccatcccctccgtggca

SEQ ID NO: 3702037 - DNA, 22 bp, Homo sapiens
aaccatgagaccactgttatca

SEQ ID NO: 3702038 - DNA, 14 bp, Homo sapiens
aaccattgcttcac

SEQ ID NO: 3702039 - DNA, 22 bp, Homo sapiens
aacccaaattacgtgtactaca

SEQ ID NO: 3702040 - DNA, 11 bp, Homo sapiens
aacccacactg

SEQ ID NO: 3702041 - DNA, 13 bp, Homo sapiens
aacccagaaacac

SEQ ID NO: 3702042 - DNA, 14 bp, Homo sapiens
aacccagaaacacc

SEQ ID NO: 3702043 - DNA, 11 bp, Homo sapiens
aacccagagag

SEQ ID NO: 3702044 - DNA, 17 bp, Homo sapiens
aacccatctacccctgg

SEQ ID NO: 3702045 - DNA, 15 bp, Homo sapiens
aacccatgagattca

SEQ ID NO: 3702046 - DNA, 17 bp, Homo sapiens
aacccccaccccacact

SEQ ID NO: 3702047 - DNA, 14 bp, Homo sapiens
aacccccagcctgc

SEQ ID NO: 3702048 - DNA, 16 bp, Homo sapiens
aacccgacagagggaa

SEQ ID NO: 3702049 - DNA, 21 bp, Homo sapiens
aaccctaaaaagcagagcttt

SEQ ID NO: 3702050 - DNA, 14 bp, Homo sapiens
aaccctccctcagc

SEQ ID NO: 3702051 - DNA, 15 bp, Homo sapiens
aaccctccctcagcc

SEQ ID NO: 3702052 - DNA, 17 bp, Homo sapiens
aaccctccctcagcccc

SEQ ID NO: 3702053 - DNA, 18 bp, Homo sapiens
aaccctccctcagcccct

SEQ ID NO: 3702054 - DNA, 20 bp, Homo sapiens
aaccctccctcagcccctct

SEQ ID NO: 3702055 - DNA, 19 bp, Homo sapiens
aaccctcctatcacctccc

SEQ ID NO: 3702056 - DNA, 17 bp, Homo sapiens
aaccctgcaaaggactg

SEQ ID NO: 3702057 - DNA, 14 bp, Homo sapiens
aaccctgcccctgc

SEQ ID NO: 3702058 - DNA, 15 bp, Homo sapiens
aaccctgttttatac

SEQ ID NO: 3702059 - DNA, 21 bp, Homo sapiens
aacccttaccccttagcctcc

SEQ ID NO: 3702060 - DNA, 22 bp, Homo sapiens
aacccttttggcccccgagctg

SEQ ID NO: 3702061 - DNA, 15 bp, Homo sapiens
aaccgtcctcttttt

SEQ ID NO: 3702062 - DNA, 22 bp, Homo sapiens
aacctaaataaacacatagatt

SEQ ID NO: 3702063 - DNA, 15 bp, Homo sapiens
aacctaacccctttc

SEQ ID NO: 3702064 - DNA, 15 bp, Homo sapiens
aacctcaaagtgact

SEQ ID NO: 3702065 - DNA, 15 bp, Homo sapiens
aacctcagcaacctg

SEQ ID NO: 3702066 - DNA, 14 bp, Homo sapiens
aacctcattcccca

SEQ ID NO: 3702067 - DNA, 14 bp, Homo sapiens
aacctcctgggcta

SEQ ID NO: 3702068 - DNA, 21 bp, Homo sapiens
aacctcctgttagctgttatt

SEQ ID NO: 3702069 - DNA, 23 bp, Homo sapiens
aacctctctgatcttgtgctcag

SEQ ID NO: 3702070 - DNA, 14 bp, Homo sapiens
aacctcttccccag

SEQ ID NO: 3702071 - DNA, 21 bp, Homo sapiens
aacctgagatggccctctggt

SEQ ID NO: 3702072 - DNA, 11 bp, Homo sapiens
aacctgctctc

SEQ ID NO: 3702073 - DNA, 22 bp, Homo sapiens
aacctgctttcaagacccctgt

SEQ ID NO: 3702074 - DNA, 23 bp, Homo sapiens
aacctggtcacaggactctgcct

SEQ ID NO: 3702075 - DNA, 20 bp, Homo sapiens
aacctgtaaattattttaaa

SEQ ID NO: 3702076 - DNA, 11 bp, Homo sapiens
aacctgtcctt

SEQ ID NO: 3702077 - DNA, 16 bp, Homo sapiens
aaccttattgtacctc

SEQ ID NO: 3702078 - DNA, 23 bp, Homo sapiens
aaccttctgcccatcctgtctgt

SEQ ID NO: 3702079 - DNA, 15 bp, Homo sapiens
aacgaaactgctcta

SEQ ID NO: 3702080 - DNA, 12 bp, Homo sapiens
aacgaggaagcc

SEQ ID NO: 3702081 - DNA, 18 bp, Homo sapiens
aacgcagatgatccatga

SEQ ID NO: 3702082 - DNA, 12 bp, Homo sapiens
aacgcagccctg

SEQ ID NO: 3702083 - DNA, 13 bp, Homo sapiens
aacgcatggagtg

SEQ ID NO: 3702084 - DNA, 13 bp, Homo sapiens
aacgccagtctcc

SEQ ID NO: 3702085 - DNA, 20 bp, Homo sapiens
aacgccagtctcccaggccc

SEQ ID NO: 3702086 - DNA, 21 bp, Homo sapiens
aacggacgagataatgtgaac

SEQ ID NO: 3702087 - DNA, 15 bp, Homo sapiens
aacgggctgccctgc

SEQ ID NO: 3702088 - DNA, 17 bp, Homo sapiens
aacgggctgccctgcca

SEQ ID NO: 3702089 - DNA, 15 bp, Homo sapiens
aacggggtccttcaa

SEQ ID NO: 3702090 - DNA, 17 bp, Homo sapiens
aacgtaaccacggaaaa

SEQ ID NO: 3702091 - DNA, 17 bp, Homo sapiens
aacgtggggcagcacag

SEQ ID NO: 3702092 - DNA, 21 bp, Homo sapiens
aacgtttcagtaataaaacat

SEQ ID NO: 3702093 - DNA, 13 bp, Homo sapiens
aacgttttattgt

SEQ ID NO: 3702094 - DNA, 15 bp, Homo sapiens
aacgttttattgtgt

SEQ ID NO: 3702095 - DNA, 23 bp, Homo sapiens
aactaagaaatatgcacaatagc

SEQ ID NO: 3702096 - DNA, 12 bp, Homo sapiens
aactaatgagtt

SEQ ID NO: 3702097 - DNA, 11 bp, Homo sapiens
aactaatttct

SEQ ID NO: 3702098 - DNA, 17 bp, Homo sapiens
aactactcagggaatga

SEQ ID NO: 3702099 - DNA, 15 bp, Homo sapiens
aactactgtgttcct

SEQ ID NO: 3702100 - DNA, 16 bp, Homo sapiens
aactactgtgttcctg

SEQ ID NO: 3702101 - DNA, 17 bp, Homo sapiens
aactactgtgttcctgg

SEQ ID NO: 3702102 - DNA, 17 bp, Homo sapiens
aactagaatttattcaa

SEQ ID NO: 3702103 - DNA, 20 bp, Homo sapiens
aactagactcccaagctgga

SEQ ID NO: 3702104 - DNA, 22 bp, Homo sapiens
aactagaggttttatgatattt

SEQ ID NO: 3702105 - DNA, 23 bp, Homo sapiens
aactagctggaattttttattct

SEQ ID NO: 3702106 - DNA, 18 bp, Homo sapiens
aactagcttggaaactgg

SEQ ID NO: 3702107 - DNA, 11 bp, Homo sapiens
aactatcttgg

SEQ ID NO: 3702108 - DNA, 18 bp, Homo sapiens
aactatcttggtgaattt

SEQ ID NO: 3702109 - DNA, 12 bp, Homo sapiens
aactatgtacaa

SEQ ID NO: 3702110 - DNA, 13 bp, Homo sapiens
aactatgtacaat

SEQ ID NO: 3702111 - DNA, 15 bp, Homo sapiens
aactatgtacaatat

SEQ ID NO: 3702112 - DNA, 22 bp, Homo sapiens
aactatgtacaatattttaagc

SEQ ID NO: 3702113 - DNA, 20 bp, Homo sapiens
aactcaatattttccatgaa

SEQ ID NO: 3702114 - DNA, 15 bp, Homo sapiens
aactcaccatgtaaa

SEQ ID NO: 3702115 - DNA, 16 bp, Homo sapiens
aactcaccatgtaaaa

SEQ ID NO: 3702116 - DNA, 17 bp, Homo sapiens
aactcacctaatgttta

SEQ ID NO: 3702117 - DNA, 15 bp, Homo sapiens
aaattgggaaaggag

SEQ ID NO: 3702118 - DNA, 20 bp, Homo sapiens
aaattgggaaaggagtagaa

SEQ ID NO: 3702119 - DNA, 12 bp, Homo sapiens
aaatttaaaaaa

SEQ ID NO: 3702120 - DNA, 14 bp, Homo sapiens
aaatttaaaacaaa

SEQ ID NO: 3702121 - DNA, 16 bp, Homo sapiens
aaatttaaaacaaaca

SEQ ID NO: 3702122 - DNA, 15 bp, Homo sapiens
aaatttaagcattgt

SEQ ID NO: 3702123 - DNA, 16 bp, Homo sapiens
aaatttaagcattgtt

SEQ ID NO: 3702124 - DNA, 13 bp, Homo sapiens
aaatttatatgta

SEQ ID NO: 3702125 - DNA, 14 bp, Homo sapiens
aaatttcaaatgtt

SEQ ID NO: 3702126 - DNA, 18 bp, Homo sapiens
aaatttgaaccaaaacat

SEQ ID NO: 3702127 - DNA, 17 bp, Homo sapiens
aaatttggaattctgtt

SEQ ID NO: 3702128 - DNA, 20 bp, Homo sapiens
aaatttggaattctgttcat

SEQ ID NO: 3702129 - DNA, 15 bp, Homo sapiens
aaatttggttctaat

SEQ ID NO: 3702130 - DNA, 18 bp, Homo sapiens
aaatttgttataatgaat

SEQ ID NO: 3702131 - DNA, 21 bp, Homo sapiens
aaattttataaaattaagcaa

SEQ ID NO: 3702132 - DNA, 12 bp, Homo sapiens
aaattttggcca

SEQ ID NO: 3702133 - DNA, 14 bp, Homo sapiens
aaattttgtaattt

SEQ ID NO: 3702134 - DNA, 15 bp, Homo sapiens
aaattttgtaatttt

SEQ ID NO: 3702135 - DNA, 21 bp, Homo sapiens
aaattttgtaattttcttgat

SEQ ID NO: 3702136 - DNA, 23 bp, Homo sapiens
aaatttttcttccttaaactcct

SEQ ID NO: 3702137 - DNA, 13 bp, Homo sapiens
aaatttttggatt

SEQ ID NO: 3702138 - DNA, 16 bp, Homo sapiens
aacaaaaagcttcccc

SEQ ID NO: 3702139 - DNA, 11 bp, Homo sapiens
aacaaaaattt

SEQ ID NO: 3702140 - DNA, 17 bp, Homo sapiens
aacaaagtggaaggaaa

SEQ ID NO: 3702141 - DNA, 18 bp, Homo sapiens
aacaaagtggaaggaaag

SEQ ID NO: 3702142 - DNA, 20 bp, Homo sapiens
aacaaattatgttacatctg

SEQ ID NO: 3702143 - DNA, 22 bp, Homo sapiens
aacaaccccccatcacaaactt

SEQ ID NO: 3702144 - DNA, 14 bp, Homo sapiens
aacaactactactt

SEQ ID NO: 3702145 - DNA, 21 bp, Homo sapiens
aacaactttctcttgtaaacg

SEQ ID NO: 3702146 - DNA, 13 bp, Homo sapiens
aacaagaaaacat

SEQ ID NO: 3702147 - DNA, 12 bp, Homo sapiens
aacaagaaagga

SEQ ID NO: 3702148 - DNA, 15 bp, Homo sapiens
aacaagaaagtttcc

SEQ ID NO: 3702149 - DNA, 12 bp, Homo sapiens
aacaagaattgg

SEQ ID NO: 3702150 - DNA, 13 bp, Homo sapiens
aacaagagtgatt

SEQ ID NO: 3702151 - DNA, 12 bp, Homo sapiens
aacaaggaatgc

SEQ ID NO: 3702152 - DNA, 19 bp, Homo sapiens
aacaaggaatgcctgtgcc

SEQ ID NO: 3702153 - DNA, 20 bp, Homo sapiens
aacaagtgaacacattgtgt

SEQ ID NO: 3702154 - DNA, 17 bp, Homo sapiens
aacaataactactgtgt

SEQ ID NO: 3702155 - DNA, 18 bp, Homo sapiens
aacaataactactgtgtt

SEQ ID NO: 3702156 - DNA, 17 bp, Homo sapiens
aacaatggaagatttgc

SEQ ID NO: 3702157 - DNA, 18 bp, Homo sapiens
aacacacataaaggataa

SEQ ID NO: 3702158 - DNA, 18 bp, Homo sapiens
aacacactgaggcaggga

SEQ ID NO: 3702159 - DNA, 19 bp, Homo sapiens
aacacagacattctgccag

SEQ ID NO: 3702160 - DNA, 18 bp, Homo sapiens
aacacagcaattcctcag

SEQ ID NO: 3702161 - DNA, 12 bp, Homo sapiens
aacacagtattt

SEQ ID NO: 3702162 - DNA, 13 bp, Homo sapiens
aacacagtatttt

SEQ ID NO: 3702163 - DNA, 16 bp, Homo sapiens
aacaccctatattttg

SEQ ID NO: 3702164 - DNA, 22 bp, Homo sapiens
aacaccttcagaggctgaggtg

SEQ ID NO: 3702165 - DNA, 15 bp, Homo sapiens
aacactattttcaga

SEQ ID NO: 3702166 - DNA, 19 bp, Homo sapiens
aacactggcaacaacaaag

SEQ ID NO: 3702167 - DNA, 15 bp, Homo sapiens
aacactggcccctag

SEQ ID NO: 3702168 - DNA, 16 bp, Homo sapiens
aacactgggggagggg

SEQ ID NO: 3702169 - DNA, 19 bp, Homo sapiens
aacacttattgctttgaaa

SEQ ID NO: 3702170 - DNA, 16 bp, Homo sapiens
aacagaagcttccatt

SEQ ID NO: 3702171 - DNA, 21 bp, Homo sapiens
aacagacaaaaacagcctcac

SEQ ID NO: 3702172 - DNA, 11 bp, Homo sapiens
aacagacaagt

SEQ ID NO: 3702173 - DNA, 11 bp, Homo sapiens
aacagacagga

SEQ ID NO: 3702174 - DNA, 19 bp, Homo sapiens
aacagactggaagcacagc

SEQ ID NO: 3702175 - DNA, 20 bp, Homo sapiens
aacagactggaagcacagct

SEQ ID NO: 3702176 - DNA, 23 bp, Homo sapiens
aacagactggcctgaggagcagc

SEQ ID NO: 3702177 - DNA, 15 bp, Homo sapiens
aacagagaaggcagg

SEQ ID NO: 3702178 - DNA, 19 bp, Homo sapiens
aacagagacaggcccaaga

SEQ ID NO: 3702179 - DNA, 17 bp, Homo sapiens
aacagaggccatggcag

SEQ ID NO: 3702180 - DNA, 21 bp, Homo sapiens
aacagaggccatggcagaata

SEQ ID NO: 3702181 - DNA, 19 bp, Homo sapiens
aacagagtgagaccctgtc

SEQ ID NO: 3702182 - DNA, 19 bp, Homo sapiens
aacagataagcaagagaga

SEQ ID NO: 3702183 - DNA, 22 bp, Homo sapiens
aacagatgcaatgtgctactga

SEQ ID NO: 3702184 - DNA, 18 bp, Homo sapiens
aacagatttggtgaattt

SEQ ID NO: 3702185 - DNA, 16 bp, Homo sapiens
aacagcagaggttctt

SEQ ID NO: 3702186 - DNA, 17 bp, Homo sapiens
aacagcagaggttcttt

SEQ ID NO: 3702187 - DNA, 12 bp, Homo sapiens
aacagcattgct

SEQ ID NO: 3702188 - DNA, 14 bp, Homo sapiens
aacagcattgcttt

SEQ ID NO: 3702189 - DNA, 15 bp, Homo sapiens
aacagcattgctttc

SEQ ID NO: 3702190 - DNA, 20 bp, Homo sapiens
aacagcattgctttctgaaa

SEQ ID NO: 3702191 - DNA, 14 bp, Homo sapiens
aacagctcaggctg

SEQ ID NO: 3702192 - DNA, 13 bp, Homo sapiens
aacagctgtggct

SEQ ID NO: 3702193 - DNA, 21 bp, Homo sapiens
aacagcttcatgcctttgtaa

SEQ ID NO: 3702194 - DNA, 15 bp, Homo sapiens
aacaggaaaaaaact

SEQ ID NO: 3702195 - DNA, 11 bp, Homo sapiens
aacaggaaaag

SEQ ID NO: 3702196 - DNA, 12 bp, Homo sapiens
aacaggaaaaga

SEQ ID NO: 3702197 - DNA, 19 bp, Homo sapiens
aacaggattagacagtcaa

SEQ ID NO: 3702198 - DNA, 23 bp, Homo sapiens
aacaggctgggcttcagtggcag

SEQ ID NO: 3702199 - DNA, 18 bp, Homo sapiens
aacaggtctcctcttaaa

SEQ ID NO: 3702200 - DNA, 17 bp, Homo sapiens
aacagtcttcaggcaaa

SEQ ID NO: 3702201 - DNA, 20 bp, Homo sapiens
aacagtgatttttttttaga

SEQ ID NO: 3702202 - DNA, 18 bp, Homo sapiens
aacagtgccattgtcttt

SEQ ID NO: 3702203 - DNA, 19 bp, Homo sapiens
aacagtgccattgtcttta

SEQ ID NO: 3702204 - DNA, 20 bp, Homo sapiens
aacagtgccattgtctttat

SEQ ID NO: 3702205 - DNA, 13 bp, Homo sapiens
aacagtgcctgct

SEQ ID NO: 3702206 - DNA, 22 bp, Homo sapiens
aacagtgtggtagttaataaaa

SEQ ID NO: 3702207 - DNA, 18 bp, Homo sapiens
aacagtgtttcccataat

SEQ ID NO: 3702208 - DNA, 13 bp, Homo sapiens
aacagttaacttt

SEQ ID NO: 3702209 - DNA, 11 bp, Homo sapiens
aacagttttcc

SEQ ID NO: 3702210 - DNA, 15 bp, Homo sapiens
aacagttttccatga

SEQ ID NO: 3702211 - DNA, 19 bp, Homo sapiens
aacagttttccatgaaaac

SEQ ID NO: 3702212 - DNA, 21 bp, Homo sapiens
aacagttttttatgctaatca

SEQ ID NO: 3702213 - DNA, 18 bp, Homo sapiens
aacataattcttgtatat

SEQ ID NO: 3702214 - DNA, 13 bp, Homo sapiens
aacatataatgtt

SEQ ID NO: 3702215 - DNA, 17 bp, Homo sapiens
aacatatgaaaatacaa

SEQ ID NO: 3702216 - DNA, 13 bp, Homo sapiens
aacatatttgtta

SEQ ID NO: 3702217 - DNA, 14 bp, Homo sapiens
aacatcaacatctt

SEQ ID NO: 3702218 - DNA, 13 bp, Homo sapiens
aacatcaatgttc

SEQ ID NO: 3702219 - DNA, 18 bp, Homo sapiens
aacatcaatgttcattgt

SEQ ID NO: 3702220 - DNA, 19 bp, Homo sapiens
aacatcaatgttcattgta

SEQ ID NO: 3702221 - DNA, 18 bp, Homo sapiens
aacatcagttactctgaa

SEQ ID NO: 3702222 - DNA, 19 bp, Homo sapiens
aacatcagttactctgaag

SEQ ID NO: 3702223 - DNA, 19 bp, Homo sapiens
aacatccaaggagaaacag

SEQ ID NO: 3702224 - DNA, 16 bp, Homo sapiens
aacatcccattgccct

SEQ ID NO: 3702225 - DNA, 18 bp, Homo sapiens
aacatcccattgccctgg

SEQ ID NO: 3702226 - DNA, 22 bp, Homo sapiens
aacatcctatcaacaacaaggt

SEQ ID NO: 3702227 - DNA, 19 bp, Homo sapiens
aacatccttcaagaactct

SEQ ID NO: 3702228 - DNA, 17 bp, Homo sapiens
aacatctagcaaatgtt

SEQ ID NO: 3702229 - DNA, 14 bp, Homo sapiens
aacatgatgaaacc

SEQ ID NO: 3702230 - DNA, 16 bp, Homo sapiens
aacatgcttcatgaaa

SEQ ID NO: 3702231 - DNA, 19 bp, Homo sapiens
aacatggagaaaccctgtc

SEQ ID NO: 3702232 - DNA, 14 bp, Homo sapiens
aacatgtaattaag

SEQ ID NO: 3702233 - DNA, 22 bp, Homo sapiens
aaatagaagaatacaaacatat

SEQ ID NO: 3702234 - DNA, 16 bp, Homo sapiens
aaatagacagtatatt

SEQ ID NO: 3702235 - DNA, 19 bp, Homo sapiens
aaatagagtatatgcactt

SEQ ID NO: 3702236 - DNA, 21 bp, Homo sapiens
aaatagccacttaccttcaat

SEQ ID NO: 3702237 - DNA, 16 bp, Homo sapiens
aaatagtaaaaataaa

SEQ ID NO: 3702238 - DNA, 18 bp, Homo sapiens
aaatagtttaggagaaac

SEQ ID NO: 3702239 - DNA, 18 bp, Homo sapiens
aaatatagatcagttata

SEQ ID NO: 3702240 - DNA, 17 bp, Homo sapiens
aaatatatatgttgatt

SEQ ID NO: 3702241 - DNA, 13 bp, Homo sapiens
aaatatcattcag

SEQ ID NO: 3702242 - DNA, 14 bp, Homo sapiens
aaatatcattcagc

SEQ ID NO: 3702243 - DNA, 17 bp, Homo sapiens
aaatatctgaaaatgta

SEQ ID NO: 3702244 - DNA, 19 bp, Homo sapiens
aaatatgtccatatctaac

SEQ ID NO: 3702245 - DNA, 21 bp, Homo sapiens
aaatatgtccatatctaacca

SEQ ID NO: 3702246 - DNA, 20 bp, Homo sapiens
aaatatgttagcaaagagtt

SEQ ID NO: 3702247 - DNA, 19 bp, Homo sapiens
aaatattaagaaagactat

SEQ ID NO: 3702248 - DNA, 18 bp, Homo sapiens
aaatattatctttgtaat

SEQ ID NO: 3702249 - DNA, 22 bp, Homo sapiens
aaatattatgcaaattcccaga

SEQ ID NO: 3702250 - DNA, 20 bp, Homo sapiens
aaatattattttatgaaagg

SEQ ID NO: 3702251 - DNA, 12 bp, Homo sapiens
aaatatttaaga

SEQ ID NO: 3702252 - DNA, 15 bp, Homo sapiens
aaatatttacatatg

SEQ ID NO: 3702253 - DNA, 12 bp, Homo sapiens
aaatatttcctt

SEQ ID NO: 3702254 - DNA, 14 bp, Homo sapiens
aaatatttgtacat

SEQ ID NO: 3702255 - DNA, 15 bp, Homo sapiens
aaatatttgtacata

SEQ ID NO: 3702256 - DNA, 22 bp, Homo sapiens
aaatatttgtacatagttattt

SEQ ID NO: 3702257 - DNA, 18 bp, Homo sapiens
aaatcactaacattatat

SEQ ID NO: 3702258 - DNA, 19 bp, Homo sapiens
aaatcagccgtgtaaccat

SEQ ID NO: 3702259 - DNA, 12 bp, Homo sapiens
aaatcagcctgc

SEQ ID NO: 3702260 - DNA, 21 bp, Homo sapiens
aaatcagcctgctccagctgt

SEQ ID NO: 3702261 - DNA, 22 bp, Homo sapiens
aaatcataggaaagtatttttt

SEQ ID NO: 3702262 - DNA, 14 bp, Homo sapiens
aaatccagaaagaa

SEQ ID NO: 3702263 - DNA, 15 bp, Homo sapiens
aaatccagaaagaaa

SEQ ID NO: 3702264 - DNA, 17 bp, Homo sapiens
aaatcctaccaacctct

SEQ ID NO: 3702265 - DNA, 12 bp, Homo sapiens
aaatcctctggc

SEQ ID NO: 3702266 - DNA, 19 bp, Homo sapiens
aaatcctttttctttataa

SEQ ID NO: 3702267 - DNA, 23 bp, Homo sapiens
aaatcggatctggggctctggga

SEQ ID NO: 3702268 - DNA, 14 bp, Homo sapiens
aaatctaagggaaa

SEQ ID NO: 3702269 - DNA, 15 bp, Homo sapiens
aaatctcagcaatga

SEQ ID NO: 3702270 - DNA, 16 bp, Homo sapiens
aaatctctagctcaga

SEQ ID NO: 3702271 - DNA, 21 bp, Homo sapiens
aaatctctctctgttgtgttc

SEQ ID NO: 3702272 - DNA, 15 bp, Homo sapiens
aaatctgtgcaataa

SEQ ID NO: 3702273 - DNA, 16 bp, Homo sapiens
aaatctgtgcaataaa

SEQ ID NO: 3702274 - DNA, 11 bp, Homo sapiens
aaatgaaaatt

SEQ ID NO: 3702275 - DNA, 18 bp, Homo sapiens
aaatgaaagcatgtctca

SEQ ID NO: 3702276 - DNA, 15 bp, Homo sapiens
aaatgaaagcatgtg

SEQ ID NO: 3702277 - DNA, 22 bp, Homo sapiens
aaatgaaattactacaaaattt

SEQ ID NO: 3702278 - DNA, 18 bp, Homo sapiens
aaatgaaattttaccaag

SEQ ID NO: 3702279 - DNA, 17 bp, Homo sapiens
aaatgaataatttccca

SEQ ID NO: 3702280 - DNA, 18 bp, Homo sapiens
aaatgaataatttcccaa

SEQ ID NO: 3702281 - DNA, 22 bp, Homo sapiens
aaatgagaacatgttggtattt

SEQ ID NO: 3702282 - DNA, 13 bp, Homo sapiens
aaatgaggaaact

SEQ ID NO: 3702283 - DNA, 16 bp, Homo sapiens
aaatgaggtactctcc

SEQ ID NO: 3702284 - DNA, 19 bp, Homo sapiens
aaatgaggtcagagcctgc

SEQ ID NO: 3702285 - DNA, 21 bp, Homo sapiens
aaatgagttacctacatttta

SEQ ID NO: 3702286 - DNA, 15 bp, Homo sapiens
aaagcaataaatgaa

SEQ ID NO: 3702287 - DNA, 17 bp, Homo sapiens
aaagcaataaatgaatg

SEQ ID NO: 3702288 - DNA, 21 bp, Homo sapiens
aaagcactcctccctgatgta

SEQ ID NO: 3702289 - DNA, 12 bp, Homo sapiens
aaagcagaaaat

SEQ ID NO: 3702290 - DNA, 21 bp, Homo sapiens
aaagcagaggctggcctcaga

SEQ ID NO: 3702291 - DNA, 13 bp, Homo sapiens
aaagcagcatctg

SEQ ID NO: 3702292 - DNA, 17 bp, Homo sapiens
aaagcagtaactgacaa

SEQ ID NO: 3702293 - DNA, 14 bp, Homo sapiens
aaagcatgaatggt

SEQ ID NO: 3702294 - DNA, 13 bp, Homo sapiens
aaagcatgtctca

SEQ ID NO: 3702295 - DNA, 15 bp, Homo sapiens
aaagccaaaggtcta

SEQ ID NO: 3702296 - DNA, 23 bp, Homo sapiens
aaagccaacagtcaaaacagaga

SEQ ID NO: 3702297 - DNA, 13 bp, Homo sapiens
aaagccagtctta

SEQ ID NO: 3702298 - DNA, 22 bp, Homo sapiens
aaagcccttccatgtcgcctct

SEQ ID NO: 3702299 - DNA, 16 bp, Homo sapiens
aaagcctctgctgcca

SEQ ID NO: 3702300 - DNA, 14 bp, Homo sapiens
aaagcggggggagg

SEQ ID NO: 3702301 - DNA, 14 bp, Homo sapiens
aaagctaggcctgg

SEQ ID NO: 3702302 - DNA, 12 bp, Homo sapiens
aaagctgaaaac

SEQ ID NO: 3702303 - DNA, 17 bp, Homo sapiens
aaagctgacgaggctgg

SEQ ID NO: 3702304 - DNA, 15 bp, Homo sapiens
aaagctgcctgtagt

SEQ ID NO: 3702305 - DNA, 21 bp, Homo sapiens
aaagctgcctgtagttaggaa

SEQ ID NO: 3702306 - DNA, 15 bp, Homo sapiens
aaagctgctaaatct

SEQ ID NO: 3702307 - DNA, 13 bp, Homo sapiens
aaagctgctgaca

SEQ ID NO: 3702308 - DNA, 22 bp, Homo sapiens
aaagctggtgggtgaaagaaat

SEQ ID NO: 3702309 - DNA, 19 bp, Homo sapiens
aaagcttgcaacaaaattc

SEQ ID NO: 3702310 - DNA, 13 bp, Homo sapiens
aaagctttccccc

SEQ ID NO: 3702311 - DNA, 15 bp, Homo sapiens
aaagctttcctggag

SEQ ID NO: 3702312 - DNA, 14 bp, Homo sapiens
aaaggaaaccaagt

SEQ ID NO: 3702313 - DNA, 12 bp, Homo sapiens
aaaggaagacta

SEQ ID NO: 3702314 - DNA, 14 bp, Homo sapiens
aaaggaagtctagg

SEQ ID NO: 3702315 - DNA, 17 bp, Homo sapiens
aaaggacaggcagaaag

SEQ ID NO: 3702316 - DNA, 18 bp, Homo sapiens
aaaggacaggcagaaaga

SEQ ID NO: 3702317 - DNA, 20 bp, Homo sapiens
aaaggactgttttttcctga

SEQ ID NO: 3702318 - DNA, 13 bp, Homo sapiens
aaaggaggctggc

SEQ ID NO: 3702319 - DNA, 14 bp, Homo sapiens
aaaggaggctggca

SEQ ID NO: 3702320 - DNA, 21 bp, Homo sapiens
aaaggatatttaagaaaatac

SEQ ID NO: 3702321 - DNA, 17 bp, Homo sapiens
aaaggcagtggggctgg

SEQ ID NO: 3702322 - DNA, 12 bp, Homo sapiens
aaaggccagctg

SEQ ID NO: 3702323 - DNA, 14 bp, Homo sapiens
aaaggcctcttcct

SEQ ID NO: 3702324 - DNA, 20 bp, Homo sapiens
aaaggctatgattgtctttg

SEQ ID NO: 3702325 - DNA, 13 bp, Homo sapiens
aaaggctgtggta

SEQ ID NO: 3702326 - DNA, 14 bp, Homo sapiens
aaagggaaactatt

SEQ ID NO: 3702327 - DNA, 14 bp, Homo sapiens
aaagggaattatga

SEQ ID NO: 3702328 - DNA, 20 bp, Homo sapiens
aaagggcccagagagggtgg

SEQ ID NO: 3702329 - DNA, 21 bp, Homo sapiens
aaagggtgaagctatttatct

SEQ ID NO: 3702330 - DNA, 16 bp, Homo sapiens
aaaggtataattttat

SEQ ID NO: 3702331 - DNA, 18 bp, Homo sapiens
aaaggtcccaaggcaagg

SEQ ID NO: 3702332 - DNA, 19 bp, Homo sapiens
aaaggtggactggaagggg

SEQ ID NO: 3702333 - DNA, 20 bp, Homo sapiens
aaagtaaaaagggaattatg

SEQ ID NO: 3702334 - DNA, 19 bp, Homo sapiens
aaagtaagtaccactcagg

SEQ ID NO: 3702335 - DNA, 19 bp, Homo sapiens
aaagtacttctccaccctg

SEQ ID NO: 3702336 - DNA, 20 bp, Homo sapiens
aaagtacttctccaccctgc

SEQ ID NO: 3702337 - DNA, 23 bp, Homo sapiens
aaagtacttctccaccctgctct

SEQ ID NO: 3702338 - DNA, 17 bp, Homo sapiens
aaagtatatatagaatc

SEQ ID NO: 3702339 - DNA, 18 bp, Homo sapiens
aaagtatatatagaatct

SEQ ID NO: 3702340 - DNA, 14 bp, Homo sapiens
aaagtatatattta

SEQ ID NO: 3702341 - DNA, 23 bp, Homo sapiens
aaagtatatatttatttaagctt

SEQ ID NO: 3702342 - DNA, 15 bp, Homo sapiens
aaagtatcgggggct

SEQ ID NO: 3702343 - DNA, 20 bp, Homo sapiens
aaagtatcgggggctggggc

SEQ ID NO: 3702344 - DNA, 20 bp, Homo sapiens
aaagtattccaccttaaatt

SEQ ID NO: 3702345 - DNA, 18 bp, Homo sapiens
aaacacatagattcacct

SEQ ID NO: 3702346 - DNA, 14 bp, Homo sapiens
aaacacatcttccc

SEQ ID NO: 3702347 - DNA, 12 bp, Homo sapiens
aaacacctgctg

SEQ ID NO: 3702348 - DNA, 23 bp, Homo sapiens
aaacactagtaccttcagatcct

SEQ ID NO: 3702349 - DNA, 12 bp, Homo sapiens
aaacacttgtaa

SEQ ID NO: 3702350 - DNA, 12 bp, Homo sapiens
aaacagaaaaaa

SEQ ID NO: 3702351 - DNA, 13 bp, Homo sapiens
aaacagaaacaaa

SEQ ID NO: 3702352 - DNA, 19 bp, Homo sapiens
aaacagaaacaaaaacact

SEQ ID NO: 3702353 - DNA, 15 bp, Homo sapiens
aaacagaaattaatc

SEQ ID NO: 3702354 - DNA, 22 bp, Homo sapiens
aaacagacaaaaacagcctcac

SEQ ID NO: 3702355 - DNA, 14 bp, Homo sapiens
aaacagactcaggt

SEQ ID NO: 3702356 - DNA, 14 bp, Homo sapiens
aaacagcattgctt

SEQ ID NO: 3702357 - DNA, 17 bp, Homo sapiens
aaacagcattgctttct

SEQ ID NO: 3702358 - DNA, 15 bp, Homo sapiens
aaacagcctcacaga

SEQ ID NO: 3702359 - DNA, 14 bp, Homo sapiens
aaacagctcaggct

SEQ ID NO: 3702360 - DNA, 20 bp, Homo sapiens
aaacagcttcatgcctttgt

SEQ ID NO: 3702361 - DNA, 21 bp, Homo sapiens
aaacagcttcatgcctttgta

SEQ ID NO: 3702362 - DNA, 14 bp, Homo sapiens
aaacagtgagcctg

SEQ ID NO: 3702363 - DNA, 23 bp, Homo sapiens
aaacagttaactttcagaagaga

SEQ ID NO: 3702364 - DNA, 21 bp, Homo sapiens
aaacataattcttgtatatta

SEQ ID NO: 3702365 - DNA, 22 bp, Homo sapiens
aaacatatttgttaaatattta

SEQ ID NO: 3702366 - DNA, 22 bp, Homo sapiens
aaacatcacacacacagacaga

SEQ ID NO: 3702367 - DNA, 18 bp, Homo sapiens
aaacatcagacctgtctt

SEQ ID NO: 3702368 - DNA, 16 bp, Homo sapiens
aaacatcagttactct

SEQ ID NO: 3702369 - DNA, 20 bp, Homo sapiens
aaacatcagttactctgaag

SEQ ID NO: 3702370 - DNA, 21 bp, Homo sapiens
aaacatctggaaaataaaagg

SEQ ID NO: 3702371 - DNA, 14 bp, Homo sapiens
aaacattttcacac

SEQ ID NO: 3702372 - DNA, 22 bp, Homo sapiens
aaacattttcacacaatacaat

SEQ ID NO: 3702373 - DNA, 19 bp, Homo sapiens
aaacattttgtcatataag

SEQ ID NO: 3702374 - DNA, 16 bp, Homo sapiens
aaaccaagccgtggct

SEQ ID NO: 3702375 - DNA, 12 bp, Homo sapiens
aaaccagaagca

SEQ ID NO: 3702376 - DNA, 19 bp, Homo sapiens
aaaccagtatacaagataa

SEQ ID NO: 3702377 - DNA, 19 bp, Homo sapiens
aaaccagtgtagccttgcc

SEQ ID NO: 3702378 - DNA, 17 bp, Homo sapiens
aaaccattgcttcacta

SEQ ID NO: 3702379 - DNA, 11 bp, Homo sapiens
aaacccagaga

SEQ ID NO: 3702380 - DNA, 17 bp, Homo sapiens
aaaccccatctctacaa

SEQ ID NO: 3702381 - DNA, 21 bp, Homo sapiens
aaacccgttttatgatttact

SEQ ID NO: 3702382 - DNA, 19 bp, Homo sapiens
aaaccgtcctgtgtacaca

SEQ ID NO: 3702383 - DNA, 14 bp, Homo sapiens
aaacctgatgttaa

SEQ ID NO: 3702384 - DNA, 12 bp, Homo sapiens
aaacctggagat

SEQ ID NO: 3702385 - DNA, 17 bp, Homo sapiens
aaaccttattgtacctc

SEQ ID NO: 3702386 - DNA, 11 bp, Homo sapiens
aaacctttcaa

SEQ ID NO: 3702387 - DNA, 16 bp, Homo sapiens
aaacgaaactgctcta

SEQ ID NO: 3702388 - DNA, 13 bp, Homo sapiens
aaacgaaagctgg

SEQ ID NO: 3702389 - DNA, 14 bp, Homo sapiens
aaacgaaagctggg

SEQ ID NO: 3702390 - DNA, 14 bp, Homo sapiens
aaacgaaggcctct

SEQ ID NO: 3702391 - DNA, 12 bp, Homo sapiens
aaacgtgaaaat

SEQ ID NO: 3702392 - DNA, 14 bp, Homo sapiens
aaacgtgccctctg

SEQ ID NO: 3702393 - DNA, 14 bp, Homo sapiens
aaacgtttcagtaa

SEQ ID NO: 3702394 - DNA, 14 bp, Homo sapiens
aaactacattttaa

SEQ ID NO: 3702395 - DNA, 15 bp, Homo sapiens
aaactaggaaaattg

SEQ ID NO: 3702396 - DNA, 18 bp, Homo sapiens
aaactcacctgctggccc

SEQ ID NO: 3702397 - DNA, 19 bp, Homo sapiens
aaactcacctgctggcccc

SEQ ID NO: 3702398 - DNA, 16 bp, Homo sapiens
aaactcatttctagca

SEQ ID NO: 3702399 - DNA, 23 bp, Homo sapiens
aaactcccacttgtcatgtgaca

SEQ ID NO: 3702400 - DNA, 23 bp, Homo sapiens
aaactcttaaaacccaagtgcct

SEQ ID NO: 3702401 - DNA, 14 bp, Homo sapiens
aaactgaatggaag

SEQ ID NO: 3702402 - DNA, 18 bp, Homo sapiens
aaactgcaatagagactg

SEQ ID NO: 3702403 - DNA, 22 bp, Homo sapiens
aaactgcaatagagactgtaga

SEQ ID NO: 3702404 - DNA, 20 bp, Homo sapiens
aaactggcaaacttcagact

SEQ ID NO: 3702405 - DNA, 15 bp, Homo sapiens
aaactgtagtctcag

SEQ ID NO: 3702406 - DNA, 12 bp, Homo sapiens
aaactgtccctt

SEQ ID NO: 3702407 - DNA, 20 bp, Homo sapiens
aaactgtcctctttcagaaa

SEQ ID NO: 3702408 - DNA, 22 bp, Homo sapiens
aagccaagtcagctttgccttc

SEQ ID NO: 3702409 - DNA, 24 bp, Homo sapiens
aagccacagcccaggcctccagct

SEQ ID NO: 3702410 - DNA, 11 bp, Homo sapiens
aagccaccctc

SEQ ID NO: 3702411 - DNA, 19 bp, Homo sapiens
aagccaccctcccagctct

SEQ ID NO: 3702412 - DNA, 13 bp, Homo sapiens
aagccactgaagc

SEQ ID NO: 3702413 - DNA, 14 bp, Homo sapiens
aagccactgaagct

SEQ ID NO: 3702414 - DNA, 13 bp, Homo sapiens
aagccagaagctg

SEQ ID NO: 3702415 - DNA, 11 bp, Homo sapiens
aagccagacag

SEQ ID NO: 3702416 - DNA, 15 bp, Homo sapiens
aagccagctgccgac

SEQ ID NO: 3702417 - DNA, 23 bp, Homo sapiens
aagccagctgccgaccagagccc

SEQ ID NO: 3702418 - DNA, 14 bp, Homo sapiens
aagccagtcttaac

SEQ ID NO: 3702419 - DNA, 18 bp, Homo sapiens
aagccatcatgtaaatta

SEQ ID NO: 3702420 - DNA, 16 bp, Homo sapiens
aagccatgtttaagat

SEQ ID NO: 3702421 - DNA, 12 bp, Homo sapiens
aagccccaggca

SEQ ID NO: 3702422 - DNA, 21 bp, Homo sapiens
aagccccttgctctcccctgc

SEQ ID NO: 3702423 - DNA, 13 bp, Homo sapiens
aagccctccttcc

SEQ ID NO: 3702424 - DNA, 15 bp, Homo sapiens
aagccctccttccac

SEQ ID NO: 3702425 - DNA, 19 bp, Homo sapiens
aagccctgagctttctgct

SEQ ID NO: 3702426 - DNA, 15 bp, Homo sapiens
aagccgtggcttccc

SEQ ID NO: 3702427 - DNA, 19 bp, Homo sapiens
aagcctccatttagttctt

SEQ ID NO: 3702428 - DNA, 16 bp, Homo sapiens
aagcctcccacgactg

SEQ ID NO: 3702429 - DNA, 19 bp, Homo sapiens
aagcctgctttttaagtgt

SEQ ID NO: 3702430 - DNA, 14 bp, Homo sapiens
aagcgattcttctg

SEQ ID NO: 3702431 - DNA, 17 bp, Homo sapiens
aagcgattcttctgctt

SEQ ID NO: 3702432 - DNA, 14 bp, Homo sapiens
aagcggctggcagc

SEQ ID NO: 3702433 - DNA, 14 bp, Homo sapiens
aagcggggggaggg

SEQ ID NO: 3702434 - DNA, 16 bp, Homo sapiens
aagcgtgagccactgc

SEQ ID NO: 3702435 - DNA, 18 bp, Homo sapiens
aagctaataaaatatcat

SEQ ID NO: 3702436 - DNA, 17 bp, Homo sapiens
aagctaggcctggccag

SEQ ID NO: 3702437 - DNA, 18 bp, Homo sapiens
aagctaggcctggccaga

SEQ ID NO: 3702438 - DNA, 15 bp, Homo sapiens
aagctagggtggccc

SEQ ID NO: 3702439 - DNA, 19 bp, Homo sapiens
aagctagggtggcccttgc

SEQ ID NO: 3702440 - DNA, 17 bp, Homo sapiens
aagctatttatctgtag

SEQ ID NO: 3702441 - DNA, 15 bp, Homo sapiens
aagctcacagttcct

SEQ ID NO: 3702442 - DNA, 17 bp, Homo sapiens
aagctcagactggttga

SEQ ID NO: 3702443 - DNA, 21 bp, Homo sapiens
aagctctactgaggtgctatg

SEQ ID NO: 3702444 - DNA, 22 bp, Homo sapiens
aagctctgaagtcacatcacag

SEQ ID NO: 3702445 - DNA, 13 bp, Homo sapiens
aagctctgctcct

SEQ ID NO: 3702446 - DNA, 17 bp, Homo sapiens
aagctctgctcctctcc

SEQ ID NO: 3702447 - DNA, 17 bp, Homo sapiens
aagctcttgaagacact

SEQ ID NO: 3702448 - DNA, 20 bp, Homo sapiens
aagctcttgaagacactgaa

SEQ ID NO: 3702449 - DNA, 17 bp, Homo sapiens
aagctgattactgtcaa

SEQ ID NO: 3702450 - DNA, 22 bp, Homo sapiens
aagctgattactgtcaataaac

SEQ ID NO: 3702451 - DNA, 23 bp, Homo sapiens
aagctgattactgtcaataaaca

SEQ ID NO: 3702452 - DNA, 21 bp, Homo sapiens
aagctgcaccctcaggcaggt

SEQ ID NO: 3702453 - DNA, 15 bp, Homo sapiens
aagctgcctccctgt

SEQ ID NO: 3702454 - DNA, 20 bp, Homo sapiens
aagctgcctccctgtccacc

SEQ ID NO: 3702455 - DNA, 15 bp, Homo sapiens
aagctgcctgtagtt

SEQ ID NO: 3702456 - DNA, 16 bp, Homo sapiens
aagctgctgacagtgt

SEQ ID NO: 3702457 - DNA, 13 bp, Homo sapiens
aagctgggcaggt

SEQ ID NO: 3702458 - DNA, 15 bp, Homo sapiens
aagctgggcaggttg

SEQ ID NO: 3702459 - DNA, 17 bp, Homo sapiens
aagctggtgggtgaaag

SEQ ID NO: 3702460 - DNA, 16 bp, Homo sapiens
aagcttaaaaaaaact

SEQ ID NO: 3702461 - DNA, 14 bp, Homo sapiens
aagcttattaatgc

SEQ ID NO: 3702462 - DNA, 16 bp, Homo sapiens
aagcttattaatgcta

SEQ ID NO: 3702463 - DNA, 15 bp, Homo sapiens
aagcttccaggaaaa

SEQ ID NO: 3702464 - DNA, 21 bp, Homo sapiens
aagcttccaggaaaaaggaca

SEQ ID NO: 3702465 - DNA, 22 bp, Homo sapiens
aagctttgatttagattgagta

SEQ ID NO: 3702466 - DNA, 13 bp, Homo sapiens
aagcttttatgag

SEQ ID NO: 3702467 - DNA, 22 bp, Homo sapiens
aaggaaatctcaccccatccca

SEQ ID NO: 3702468 - DNA, 22 bp, Homo sapiens
aaggaagctttctctgcttcag

SEQ ID NO: 3702469 - DNA, 13 bp, Homo sapiens
aaggaaggaaaga

SEQ ID NO: 3702470 - DNA, 16 bp, Homo sapiens
aaggaaggaaagaaag

SEQ ID NO: 3702471 - DNA, 14 bp, Homo sapiens
aaggaagtctagga

SEQ ID NO: 3702472 - DNA, 21 bp, Homo sapiens
aaggaataaattgctccttga

SEQ ID NO: 3702473 - DNA, 17 bp, Homo sapiens
aaggaatctccagtttt

SEQ ID NO: 3702474 - DNA, 21 bp, Homo sapiens
aaggaatctccagttttcagt

SEQ ID NO: 3702475 - DNA, 16 bp, Homo sapiens
aaggaatggaggctct

SEQ ID NO: 3702476 - DNA, 15 bp, Homo sapiens
aaggaattctaggca

SEQ ID NO: 3702477 - DNA, 21 bp, Homo sapiens
aaggacaaagtctccagccca

SEQ ID NO: 3702478 - DNA, 13 bp, Homo sapiens
aaggacactagaa

SEQ ID NO: 3702479 - DNA, 17 bp, Homo sapiens
aaggacaggcagaaaga

SEQ ID NO: 3702480 - DNA, 13 bp, Homo sapiens
aaggaccaggact

SEQ ID NO: 3702481 - DNA, 13 bp, Homo sapiens
aaggacccctcac

SEQ ID NO: 3702482 - DNA, 18 bp, Homo sapiens
aaggacccggaggggcct

SEQ ID NO: 3702483 - DNA, 20 bp, Homo sapiens
aaggacccttcagaggtggc

SEQ ID NO: 3702484 - DNA, 15 bp, Homo sapiens
aaggactgcatggta

SEQ ID NO: 3702485 - DNA, 21 bp, Homo sapiens
aaggactgcatggtaatttat

SEQ ID NO: 3702486 - DNA, 22 bp, Homo sapiens
aaggactgcatggtaatttata

SEQ ID NO: 3702487 - DNA, 23 bp, Homo sapiens
aaggactgttttttcctgagctt

SEQ ID NO: 3702488 - DNA, 17 bp, Homo sapiens
aaggacttgaaagcatc

SEQ ID NO: 3702489 - DNA, 22 bp, Homo sapiens
aaggacttgaaagcatccatgt

SEQ ID NO: 3702490 - DNA, 16 bp, Homo sapiens
aaggagactcacctct

SEQ ID NO: 3702491 - DNA, 17 bp, Homo sapiens
aaggagactcacctctg

SEQ ID NO: 3702492 - DNA, 20 bp, Homo sapiens
aaggagactcacctctgcct

SEQ ID NO: 3702493 - DNA, 23 bp, Homo sapiens
aaggagactcacctctgcctcaa

SEQ ID NO: 3702494 - DNA, 13 bp, Homo sapiens
aaggagagcctgc

SEQ ID NO: 3702495 - DNA, 22 bp, Homo sapiens
aaggagagtcttgcagtgatta

SEQ ID NO: 3702496 - DNA, 16 bp, Homo sapiens
aaggagctgagaatag

SEQ ID NO: 3702497 - DNA, 22 bp, Homo sapiens
aaggagctgagaatagaaggaa

SEQ ID NO: 3702498 - DNA, 20 bp, Homo sapiens
aaggaggaagagaaaaaata

SEQ ID NO: 3702499 - DNA, 17 bp, Homo sapiens
aaggagggtcaggaagg

SEQ ID NO: 3702500 - DNA, 19 bp, Homo sapiens
aaggagggttagggagggg

SEQ ID NO: 3702501 - DNA, 19 bp, Homo sapiens
aaggatatttaagaaaata

SEQ ID NO: 3702502 - DNA, 22 bp, Homo sapiens
aaggatcagaacagcagaggtt

SEQ ID NO: 3702503 - DNA, 21 bp, Homo sapiens
aaggatctgtttttaaaaatc

SEQ ID NO: 3702504 - DNA, 19 bp, Homo sapiens
aaggatgtaaacagtgcct

SEQ ID NO: 3702505 - DNA, 20 bp, Homo sapiens
aaggatgtaaacagtgcctg

SEQ ID NO: 3702506 - DNA, 14 bp, Homo sapiens
aaggattgtgatat

SEQ ID NO: 3702507 - DNA, 17 bp, Homo sapiens
aaggattgtgatatttt

SEQ ID NO: 3702508 - DNA, 20 bp, Homo sapiens
aaggcacccacaaataaatg

SEQ ID NO: 3702509 - DNA, 22 bp, Homo sapiens
aaggcacctataaaacaggtca

SEQ ID NO: 3702510 - DNA, 19 bp, Homo sapiens
aaggccaagaggctgttcc

SEQ ID NO: 3702511 - DNA, 14 bp, Homo sapiens
aaggccacctgcag

SEQ ID NO: 3702512 - DNA, 17 bp, Homo sapiens
aaggccagagtggcctg

SEQ ID NO: 3702513 - DNA, 22 bp, Homo sapiens
aaggccagagtggcctggccag

SEQ ID NO: 3702514 - DNA, 23 bp, Homo sapiens
aaggccagagtggcctggccagg

SEQ ID NO: 3702515 - DNA, 14 bp, Homo sapiens
aaggccagctggca

SEQ ID NO: 3702516 - DNA, 16 bp, Homo sapiens
aaggcctgtccctggc

SEQ ID NO: 3702517 - DNA, 21 bp, Homo sapiens
aaggccttattctacatttca

SEQ ID NO: 3702518 - DNA, 16 bp, Homo sapiens
aaggctaaaacttaac

SEQ ID NO: 3702519 - DNA, 15 bp, Homo sapiens
aaggctatacttgtc

SEQ ID NO: 3702520 - DNA, 19 bp, Homo sapiens
aaggctgaggaaaggccag

SEQ ID NO: 3702521 - DNA, 16 bp, Homo sapiens
aaggctgggggaagaa

SEQ ID NO: 3702522 - DNA, 19 bp, Homo sapiens
aaggctgggggaagaagct

SEQ ID NO: 3702523 - DNA, 22 bp, Homo sapiens
aaggctgtccttacccatctgc

SEQ ID NO: 3702524 - DNA, 23 bp, Homo sapiens
aaggcttcaatttattgcacaaa

SEQ ID NO: 3702525 - DNA, 22 bp, Homo sapiens
aaggctttcagggcctccagcc

SEQ ID NO: 3702526 - DNA, 13 bp, Homo sapiens
aagggaaatatca

SEQ ID NO: 3702527 - DNA, 16 bp, Homo sapiens
aagggaaatatcattt

SEQ ID NO: 3702528 - DNA, 16 bp, Homo sapiens
aagggagagagagagg

SEQ ID NO: 3702529 - DNA, 17 bp, Homo sapiens
aagggagagcggggcag

SEQ ID NO: 3702530 - DNA, 16 bp, Homo sapiens
aagggagcagagaagg

SEQ ID NO: 3702531 - DNA, 15 bp, Homo sapiens
aagggcagtggaggt

SEQ ID NO: 3702532 - DNA, 22 bp, Homo sapiens
aagggccagtcctgcctggcca

SEQ ID NO: 3702533 - DNA, 22 bp, Homo sapiens
aaggggaatgtttgcctctgcc

SEQ ID NO: 3702534 - DNA, 19 bp, Homo sapiens
aaggggaggacctctgggc

SEQ ID NO: 3702535 - DNA, 22 bp, Homo sapiens
aaggggatgtatccatgggggc

SEQ ID NO: 3702536 - DNA, 18 bp, Homo sapiens
aaggggcagtctggaggg

SEQ ID NO: 3702537 - DNA, 19 bp, Homo sapiens
aaggggcagtctggagggg

SEQ ID NO: 3702538 - DNA, 22 bp, Homo sapiens
aaggggcccaaattctttcagt

SEQ ID NO: 3702539 - DNA, 15 bp, Homo sapiens
aaggggcccgtggga

SEQ ID NO: 3702540 - DNA, 21 bp, Homo sapiens
aaggggggttgcagtggagag

SEQ ID NO: 3702541 - DNA, 17 bp, Homo sapiens
aagggtctagggagaga

SEQ ID NO: 3702542 - DNA, 22 bp, Homo sapiens
aagggtctagggagagaccctt

SEQ ID NO: 3702543 - DNA, 16 bp, Homo sapiens
aagggtgctgcttccc

SEQ ID NO: 3702544 - DNA, 19 bp, Homo sapiens
aagggtgctgcttccctct

SEQ ID NO: 3702545 - DNA, 14 bp, Homo sapiens
aagggttatatttt

SEQ ID NO: 3702546 - DNA, 17 bp, Homo sapiens
aagggtttgtggctggg

SEQ ID NO: 3702547 - DNA, 19 bp, Homo sapiens
aagggttttccaccctgga

SEQ ID NO: 3702548 - DNA, 21 bp, Homo sapiens
aagggttttccaccctggaat

SEQ ID NO: 3702549 - DNA, 12 bp, Homo sapiens
aaggtaaaattg

SEQ ID NO: 3702550 - DNA, 20 bp, Homo sapiens
aaggtagccctggccagagg

SEQ ID NO: 3702551 - DNA, 14 bp, Homo sapiens
aaggtctctctttg

SEQ ID NO: 3702552 - DNA, 20 bp, Homo sapiens
aaggtctctctttggactct

SEQ ID NO: 3702553 - DNA, 18 bp, Homo sapiens
aaggtgcctgtgaggcag

SEQ ID NO: 3702554 - DNA, 20 bp, Homo sapiens
aatttgtcattttgaagcta

SEQ ID NO: 3702555 - DNA, 18 bp, Homo sapiens
aattttaaataaaagtga

SEQ ID NO: 3702556 - DNA, 22 bp, Homo sapiens
aattttaaataaaagtgatcaa

SEQ ID NO: 3702557 - DNA, 14 bp, Homo sapiens
aattttaacacaca

SEQ ID NO: 3702558 - DNA, 16 bp, Homo sapiens
aattttaagattcctt

SEQ ID NO: 3702559 - DNA, 19 bp, Homo sapiens
aattttaagattccttttc

SEQ ID NO: 3702560 - DNA, 15 bp, Homo sapiens
aattttaatttattt

SEQ ID NO: 3702561 - DNA, 20 bp, Homo sapiens
aattttatagctcagtttat

SEQ ID NO: 3702562 - DNA, 22 bp, Homo sapiens
aattttctggaatacatgaaat

SEQ ID NO: 3702563 - DNA, 14 bp, Homo sapiens
aattttcttcagtt

SEQ ID NO: 3702564 - DNA, 17 bp, Homo sapiens
aattttcttcagttggt

SEQ ID NO: 3702565 - DNA, 21 bp, Homo sapiens
aattttgaataaataaatgta

SEQ ID NO: 3702566 - DNA, 13 bp, Homo sapiens
aatttttaagcaa

SEQ ID NO: 3702567 - DNA, 21 bp, Homo sapiens
aatttttggattgacagtaac

SEQ ID NO: 3702568 - DNA, 22 bp, Homo sapiens
aatttttggattgacagtaact

SEQ ID NO: 3702569 - DNA, 23 bp, Homo sapiens
aatttttggattgacagtaactt

SEQ ID NO: 3702570 - DNA, 18 bp, Homo sapiens
aattttttattcttgtga

SEQ ID NO: 3702571 - DNA, 21 bp, Homo sapiens
aatttttttcatcttctctgg

SEQ ID NO: 3702572 - DNA, 13 bp, Homo sapiens
acaaaaaacaata

SEQ ID NO: 3702573 - DNA, 15 bp, Homo sapiens
acaaaaaacaatatt

SEQ ID NO: 3702574 - DNA, 12 bp, Homo sapiens
acaaaaagacac

SEQ ID NO: 3702575 - DNA, 16 bp, Homo sapiens
acaaaaagacacttga

SEQ ID NO: 3702576 - DNA, 12 bp, Homo sapiens
acaaaaatactc

SEQ ID NO: 3702577 - DNA, 18 bp, Homo sapiens
acaaaaatactctaattc

SEQ ID NO: 3702578 - DNA, 19 bp, Homo sapiens
acaaaaatactctaattct

SEQ ID NO: 3702579 - DNA, 20 bp, Homo sapiens
acaaaaattatctatttgta

SEQ ID NO: 3702580 - DNA, 21 bp, Homo sapiens
acaaaagatgtatccttccaa

SEQ ID NO: 3702581 - DNA, 21 bp, Homo sapiens
acaaaagggtttaaactgatt

SEQ ID NO: 3702582 - DNA, 14 bp, Homo sapiens
acaaaataaacaaa

SEQ ID NO: 3702583 - DNA, 14 bp, Homo sapiens
acaaaccatgcaaa

SEQ ID NO: 3702584 - DNA, 23 bp, Homo sapiens
acaaacctgaaaagatgttgtgt

SEQ ID NO: 3702585 - DNA, 10 bp, Homo sapiens
acaaactgca

SEQ ID NO: 3702586 - DNA, 16 bp, Homo sapiens
acaaactgcaatagag

SEQ ID NO: 3702587 - DNA, 15 bp, Homo sapiens
acaaactgtgtaact

SEQ ID NO: 3702588 - DNA, 16 bp, Homo sapiens
acaaactgtgtaactg

SEQ ID NO: 3702589 - DNA, 19 bp, Homo sapiens
acaaagacaaattctgttt

SEQ ID NO: 3702590 - DNA, 22 bp, Homo sapiens
acaaagacaaattctgtttctt

SEQ ID NO: 3702591 - DNA, 21 bp, Homo sapiens
acaaagatgtttgtcagatat

SEQ ID NO: 3702592 - DNA, 23 bp, Homo sapiens
acaaagatgtttgtcagatatga

SEQ ID NO: 3702593 - DNA, 16 bp, Homo sapiens
acaaagctgctaaatc

SEQ ID NO: 3702594 - DNA, 11 bp, Homo sapiens
acaaaggaaaa

SEQ ID NO: 3702595 - DNA, 13 bp, Homo sapiens
acaaaggaaaaag

SEQ ID NO: 3702596 - DNA, 14 bp, Homo sapiens
acaaagtggaagga

SEQ ID NO: 3702597 - DNA, 17 bp, Homo sapiens
acaaagtggaaggaaag

SEQ ID NO: 3702598 - DNA, 23 bp, Homo sapiens
acaaagtggaaggaaagatgctc

SEQ ID NO: 3702599 - DNA, 16 bp, Homo sapiens
acaaataacaatgtgc

SEQ ID NO: 3702600 - DNA, 15 bp, Homo sapiens
acaaatactcttagg

SEQ ID NO: 3702601 - DNA, 23 bp, Homo sapiens
acaaatactcttaggaagagaaa

SEQ ID NO: 3702602 - DNA, 18 bp, Homo sapiens
acaaatacttattcattg

SEQ ID NO: 3702603 - DNA, 23 bp, Homo sapiens
acaaatatttattttctttctgt

SEQ ID NO: 3702604 - DNA, 13 bp, Homo sapiens
acaaatcaagttt

SEQ ID NO: 3702605 - DNA, 22 bp, Homo sapiens
acaaatcaagtttccaagcaaa

SEQ ID NO: 3702606 - DNA, 22 bp, Homo sapiens
acaaatgctgcgcccttcccca

SEQ ID NO: 3702607 - DNA, 16 bp, Homo sapiens
acaaatggaggcctgt

SEQ ID NO: 3702608 - DNA, 18 bp, Homo sapiens
acaaatttaaaacaaaca

SEQ ID NO: 3702609 - DNA, 14 bp, Homo sapiens
acaacaaaaatttg

SEQ ID NO: 3702610 - DNA, 15 bp, Homo sapiens
acaacaacctggtca

SEQ ID NO: 3702611 - DNA, 16 bp, Homo sapiens
acaacattaaaacaat

SEQ ID NO: 3702612 - DNA, 15 bp, Homo sapiens
acaaccaccgctccc

SEQ ID NO: 3702613 - DNA, 20 bp, Homo sapiens
acaaccaccgctccccagcc

SEQ ID NO: 3702614 - DNA, 14 bp, Homo sapiens
acaaccattccaga

SEQ ID NO: 3702615 - DNA, 19 bp, Homo sapiens
acaaccctgcaaaggactg

SEQ ID NO: 3702616 - DNA, 20 bp, Homo sapiens
acaaccgatgctccagccaa

SEQ ID NO: 3702617 - DNA, 16 bp, Homo sapiens
acaactaggcttcagc

SEQ ID NO: 3702618 - DNA, 14 bp, Homo sapiens
acaacttctttgta

SEQ ID NO: 3702619 - DNA, 16 bp, Homo sapiens
acaactttctcttgta

SEQ ID NO: 3702620 - DNA, 18 bp, Homo sapiens
acaactttctcttgtaaa

SEQ ID NO: 3702621 - DNA, 20 bp, Homo sapiens
acaagaagccacagacctag

SEQ ID NO: 3702622 - DNA, 23 bp, Homo sapiens
acaagaagggttttccaccctgg

SEQ ID NO: 3702623 - DNA, 15 bp, Homo sapiens
acaagagcagcctgt

SEQ ID NO: 3702624 - DNA, 20 bp, Homo sapiens
acaagagcccagcagggcct

SEQ ID NO: 3702625 - DNA, 16 bp, Homo sapiens
acaagagcgaaactcc

SEQ ID NO: 3702626 - DNA, 17 bp, Homo sapiens
acaagagcgaaactccg

SEQ ID NO: 3702627 - DNA, 22 bp, Homo sapiens
acaagagtgattcttgctgcta

SEQ ID NO: 3702628 - DNA, 13 bp, Homo sapiens
acaagatctttca

SEQ ID NO: 3702629 - DNA, 21 bp, Homo sapiens
acaagattcccagagacagga

SEQ ID NO: 3702630 - DNA, 17 bp, Homo sapiens
acaagccccaggcaggc

SEQ ID NO: 3702631 - DNA, 19 bp, Homo sapiens
acaagccccaggcaggctg

SEQ ID NO: 3702632 - DNA, 18 bp, Homo sapiens
acaagcgtgagccactgc

SEQ ID NO: 3702633 - DNA, 14 bp, Homo sapiens
acaagctaaaatta

SEQ ID NO: 3702634 - DNA, 22 bp, Homo sapiens
acaagctaggtgctaattaata

SEQ ID NO: 3702635 - DNA, 19 bp, Homo sapiens
acaagctgcaccctcaggc

SEQ ID NO: 3702636 - DNA, 11 bp, Homo sapiens
acaaggcccca

SEQ ID NO: 3702637 - DNA, 16 bp, Homo sapiens
acaaggccccagagac

SEQ ID NO: 3702638 - DNA, 13 bp, Homo sapiens
acaaggttcttcc

SEQ ID NO: 3702639 - DNA, 16 bp, Homo sapiens
acaagtaaaactgtgg

SEQ ID NO: 3702640 - DNA, 20 bp, Homo sapiens
acaagtagatgcctgaactt

SEQ ID NO: 3702641 - DNA, 21 bp, Homo sapiens
acaagtatgaataaagacacc

SEQ ID NO: 3702642 - DNA, 21 bp, Homo sapiens
acaagtcattttaactttatc

SEQ ID NO: 3702643 - DNA, 18 bp, Homo sapiens
acaagtgaaaaacatcca

SEQ ID NO: 3702644 - DNA, 12 bp, Homo sapiens
acaagtgccact

SEQ ID NO: 3702645 - DNA, 16 bp, Homo sapiens
acaataaatgtattca

SEQ ID NO: 3702646 - DNA, 15 bp, Homo sapiens
acaataaatgtgctt

SEQ ID NO: 3702647 - DNA, 16 bp, Homo sapiens
acaataactactgtgt

SEQ ID NO: 3702648 - DNA, 17 bp, Homo sapiens
acaataactactgtgtt

SEQ ID NO: 3702649 - DNA, 18 bp, Homo sapiens
acaataactactgtgttc

SEQ ID NO: 3702650 - DNA, 19 bp, Homo sapiens
acaataactactgtgttcc

SEQ ID NO: 3702651 - DNA, 21 bp, Homo sapiens
acaataactactgtgttcctg

SEQ ID NO: 3702652 - DNA, 22 bp, Homo sapiens
acaataactactgtgttcctgg

SEQ ID NO: 3702653 - DNA, 12 bp, Homo sapiens
acaataatttca

SEQ ID NO: 3702654 - DNA, 20 bp, Homo sapiens
acaatagctttaccctcagg

SEQ ID NO: 3702655 - DNA, 21 bp, Homo sapiens
acaatatgaatacagggcatg

SEQ ID NO: 3702656 - DNA, 15 bp, Homo sapiens
acaatattgtttcta

SEQ ID NO: 3702657 - DNA, 15 bp, Homo sapiens
acaatatttattgta

SEQ ID NO: 3702658 - DNA, 16 bp, Homo sapiens
acaatatttattgtat

SEQ ID NO: 3702659 - DNA, 19 bp, Homo sapiens
acaatcaaaggaaaatagt

SEQ ID NO: 3702660 - DNA, 19 bp, Homo sapiens
acaatcatgaaatatgcat

SEQ ID NO: 3702661 - DNA, 17 bp, Homo sapiens
acaatgatgatgataat

SEQ ID NO: 3702662 - DNA, 19 bp, Homo sapiens
acaatgatgatgataatga

SEQ ID NO: 3702663 - DNA, 19 bp, Homo sapiens
acaatgcagatgccagagc

SEQ ID NO: 3702664 - DNA, 19 bp, Homo sapiens
acaatgcgaatggtagtct

SEQ ID NO: 3702665 - DNA, 18 bp, Homo sapiens
acaattatatcagtcctc

SEQ ID NO: 3702666 - DNA, 18 bp, Homo sapiens
acaattatttttacagtt

SEQ ID NO: 3702667 - DNA, 14 bp, Homo sapiens
acaattccaaagga

SEQ ID NO: 3702668 - DNA, 18 bp, Homo sapiens
acaattccaaaggaatct

SEQ ID NO: 3702669 - DNA, 12 bp, Homo sapiens
acaattgaaatg

SEQ ID NO: 3702670 - DNA, 17 bp, Homo sapiens
acaattgaacttaaata

SEQ ID NO: 3702671 - DNA, 13 bp, Homo sapiens
acaatttaaagca

SEQ ID NO: 3702672 - DNA, 14 bp, Homo sapiens
acaatttaaagcaa

SEQ ID NO: 3702673 - DNA, 15 bp, Homo sapiens
acaatttattttatt

SEQ ID NO: 3702674 - DNA, 14 bp, Homo sapiens
acacaaacaaacaa

SEQ ID NO: 3702675 - DNA, 22 bp, Homo sapiens
acacaaacaaacaagctaggtg

SEQ ID NO: 3702676 - DNA, 12 bp, Homo sapiens
acacaaagagag

SEQ ID NO: 3702677 - DNA, 18 bp, Homo sapiens
acacaaatacttattcat

SEQ ID NO: 3702678 - DNA, 13 bp, Homo sapiens
acacaacaaaaat

SEQ ID NO: 3702679 - DNA, 22 bp, Homo sapiens
acacaagcttttttacacaaat

SEQ ID NO: 3702680 - DNA, 14 bp, Homo sapiens
acacaatatgaata

SEQ ID NO: 3702681 - DNA, 16 bp, Homo sapiens
acacaatgttattcgt

SEQ ID NO: 3702682 - DNA, 14 bp, Homo sapiens
acacacaacaaaaa

SEQ ID NO: 3702683 - DNA, 13 bp, Homo sapiens
acacacacacagg

SEQ ID NO: 3702684 - DNA, 14 bp, Homo sapiens
acacacacacagga

SEQ ID NO: 3702685 - DNA, 12 bp, Homo sapiens
acacacacagct

SEQ ID NO: 3702686 - DNA, 13 bp, Homo sapiens
acacacacagctt

SEQ ID NO: 3702687 - DNA, 14 bp, Homo sapiens
acacacacatacac

SEQ ID NO: 3702688 - DNA, 22 bp, Homo sapiens
acacacacgcgtgcacacacca

SEQ ID NO: 3702689 - DNA, 13 bp, Homo sapiens
acacacagacaca

SEQ ID NO: 3702690 - DNA, 13 bp, Homo sapiens
acacacagaggaa

SEQ ID NO: 3702691 - DNA, 22 bp, Homo sapiens
acacacagaggaagagcaggca

SEQ ID NO: 3702692 - DNA, 16 bp, Homo sapiens
acacaccaggctgtgg

SEQ ID NO: 3702693 - DNA, 22 bp, Homo sapiens
acacaccaggctgtgggcctca

SEQ ID NO: 3702694 - DNA, 24 bp, Homo sapiens
acacacctgtagtcccagctactc

SEQ ID NO: 3702695 - DNA, 23 bp, Homo sapiens
acacagacattctgccaggcccc

SEQ ID NO: 3702696 - DNA, 20 bp, Homo sapiens
acacagactattgacatcag

SEQ ID NO: 3702697 - DNA, 12 bp, Homo sapiens
acacagaggaag

SEQ ID NO: 3702698 - DNA, 19 bp, Homo sapiens
acacagagtggtctttctg

SEQ ID NO: 3702699 - DNA, 11 bp, Homo sapiens
acacagctctg

SEQ ID NO: 3702700 - DNA, 13 bp, Homo sapiens
acacagctcttct

SEQ ID NO: 3702701 - DNA, 19 bp, Homo sapiens
acacagctcttctccaggc

SEQ ID NO: 3702702 - DNA, 20 bp, Homo sapiens
acacaggcaactgaggcaga

SEQ ID NO: 3702703 - DNA, 21 bp, Homo sapiens
acacaggcaactgaggcagac

SEQ ID NO: 3702704 - DNA, 22 bp, Homo sapiens
acacaggcccggctccaggctc

SEQ ID NO: 3702705 - DNA, 11 bp, Homo sapiens
acacagtgagt

SEQ ID NO: 3702706 - DNA, 22 bp, Homo sapiens
acacagtgctgaccagacagcc

SEQ ID NO: 3702707 - DNA, 17 bp, Homo sapiens
acacatagattcacctg

SEQ ID NO: 3702708 - DNA, 22 bp, Homo sapiens
acacatagattcacctgtaaaa

SEQ ID NO: 3702709 - DNA, 15 bp, Homo sapiens
acacatcttcaacag

SEQ ID NO: 3702710 - DNA, 16 bp, Homo sapiens
acacattcaataagca

SEQ ID NO: 3702711 - DNA, 21 bp, Homo sapiens
acacattgtgtcacatcatga

SEQ ID NO: 3702712 - DNA, 14 bp, Homo sapiens
acaccaaataaata

SEQ ID NO: 3702713 - DNA, 12 bp, Homo sapiens
acaccagagccc

SEQ ID NO: 3702714 - DNA, 20 bp, Homo sapiens
acaccagcctttctcccagg

SEQ ID NO: 3702715 - DNA, 12 bp, Homo sapiens
acaccaggctgt

SEQ ID NO: 3702716 - DNA, 18 bp, Homo sapiens
acaccaggctgtgggcct

SEQ ID NO: 3702717 - DNA, 13 bp, Homo sapiens
acaccctctccca

SEQ ID NO: 3702718 - DNA, 16 bp, Homo sapiens
acaccctctcccagga

SEQ ID NO: 3702719 - DNA, 17 bp, Homo sapiens
acaccctctcccaggac

SEQ ID NO: 3702720 - DNA, 14 bp, Homo sapiens
acaccgggcctgga

SEQ ID NO: 3702721 - DNA, 21 bp, Homo sapiens
acacctactctatcagagaaa

SEQ ID NO: 3702722 - DNA, 12 bp, Homo sapiens
acacctcagagc

SEQ ID NO: 3702723 - DNA, 18 bp, Homo sapiens
acacctcagagccccgca

SEQ ID NO: 3702724 - DNA, 22 bp, Homo sapiens
acacctcagttcccttggcctc

SEQ ID NO: 3702725 - DNA, 23 bp, Homo sapiens
acacctcagttcccttggcctca

SEQ ID NO: 3702726 - DNA, 12 bp, Homo sapiens
acacctcccagg

SEQ ID NO: 3702727 - DNA, 13 bp, Homo sapiens
acacctcccagga

SEQ ID NO: 3702728 - DNA, 16 bp, Homo sapiens
acacctccctgaacca

SEQ ID NO: 3702729 - DNA, 18 bp, Homo sapiens
acacctcgttagggaaga

SEQ ID NO: 3702730 - DNA, 19 bp, Homo sapiens
acacctctgcacaagctgc

SEQ ID NO: 3702731 - DNA, 21 bp, Homo sapiens
acacctctgcacaagctgcac

SEQ ID NO: 3702732 - DNA, 11 bp, Homo sapiens
acacctgcacc

SEQ ID NO: 3702733 - DNA, 16 bp, Homo sapiens
acacctgcacctcccc

SEQ ID NO: 3702734 - DNA, 24 bp, Homo sapiens
acacctgcacctccccccactgca

SEQ ID NO: 3702735 - DNA, 19 bp, Homo sapiens
acacctggccctggggcct

SEQ ID NO: 3702736 - DNA, 19 bp, Homo sapiens
acacctgtagtcccagcta

SEQ ID NO: 3702737 - DNA, 15 bp, Homo sapiens
acaccttgacagggc

SEQ ID NO: 3702738 - DNA, 20 bp, Homo sapiens
acacgcacacacacacacag

SEQ ID NO: 3702739 - DNA, 23 bp, Homo sapiens
acacgcacacacacacacaggag

SEQ ID NO: 3702740 - DNA, 19 bp, Homo sapiens
acacgccttgttcttggcc

SEQ ID NO: 3702741 - DNA, 16 bp, Homo sapiens
acacgtacttaaatga

SEQ ID NO: 3702742 - DNA, 19 bp, Homo sapiens
acacgtctgaccctctcca

SEQ ID NO: 3702743 - DNA, 17 bp, Homo sapiens
acacgtggaggaatgct

SEQ ID NO: 3702744 - DNA, 24 bp, Homo sapiens
acacgtggaggaatgctcccccat

SEQ ID NO: 3702745 - DNA, 15 bp, Homo sapiens
acactaaccacgctg

SEQ ID NO: 3702746 - DNA, 15 bp, Homo sapiens
acactaacctgggtt

SEQ ID NO: 3702747 - DNA, 15 bp, Homo sapiens
acactagtctgtgtg

SEQ ID NO: 3702748 - DNA, 18 bp, Homo sapiens
acactatggtatttgagt

SEQ ID NO: 3702749 - DNA, 15 bp, Homo sapiens
acactcaaaagctgg

SEQ ID NO: 3702750 - DNA, 19 bp, Homo sapiens
acactcacctctaaaacag

SEQ ID NO: 3702751 - DNA, 20 bp, Homo sapiens
acactctcaaagcaaataat

SEQ ID NO: 3702752 - DNA, 13 bp, Homo sapiens
acactctcctggg

SEQ ID NO: 3702753 - DNA, 14 bp, Homo sapiens
acactctcctgggc

SEQ ID NO: 3702754 - DNA, 15 bp, Homo sapiens
acactctcctgggcc

SEQ ID NO: 3702755 - DNA, 21 bp, Homo sapiens
acactctcctgggcccctccc

SEQ ID NO: 3702756 - DNA, 18 bp, Homo sapiens
acactgaaatatacacac

SEQ ID NO: 3702757 - DNA, 14 bp, Homo sapiens
acactgaaatgcct

SEQ ID NO: 3702758 - DNA, 21 bp, Homo sapiens
acactgaagctcttgaagaca

SEQ ID NO: 3702759 - DNA, 23 bp, Homo sapiens
acactgaatatttatatttcact

SEQ ID NO: 3702760 - DNA, 17 bp, Homo sapiens
acactgaggcagggaag

SEQ ID NO: 3702761 - DNA, 22 bp, Homo sapiens
acactgcactcttaagcttccg

SEQ ID NO: 3702762 - DNA, 18 bp, Homo sapiens
acactgctaggtgggcca

SEQ ID NO: 3702763 - DNA, 21 bp, Homo sapiens
acactgctgctccagtgcagg

SEQ ID NO: 3702764 - DNA, 19 bp, Homo sapiens
acactgcttgtgtttttaa

SEQ ID NO: 3702765 - DNA, 23 bp, Homo sapiens
acactgcttgtgtttttaactca

SEQ ID NO: 3702766 - DNA, 16 bp, Homo sapiens
acactggcccctagaa

SEQ ID NO: 3702767 - DNA, 22 bp, Homo sapiens
acactgttagaacactattttc

SEQ ID NO: 3702768 - DNA, 17 bp, Homo sapiens
aactcacctctcaaggt

SEQ ID NO: 3702769 - DNA, 21 bp, Homo sapiens
aactcagaaacatcagttact

SEQ ID NO: 3702770 - DNA, 16 bp, Homo sapiens
aactcaggactccagc

SEQ ID NO: 3702771 - DNA, 15 bp, Homo sapiens
aactcagttttaact

SEQ ID NO: 3702772 - DNA, 14 bp, Homo sapiens
aactcatcataaaa

SEQ ID NO: 3702773 - DNA, 21 bp, Homo sapiens
aactcattcctgcctgtctcc

SEQ ID NO: 3702774 - DNA, 22 bp, Homo sapiens
aactcatttcctatgtaactgc

SEQ ID NO: 3702775 - DNA, 18 bp, Homo sapiens
aactcctggaaatatcag

SEQ ID NO: 3702776 - DNA, 18 bp, Homo sapiens
aactcgcttctctgtgac

SEQ ID NO: 3702777 - DNA, 21 bp, Homo sapiens
aactctaattcccattttgca

SEQ ID NO: 3702778 - DNA, 22 bp, Homo sapiens
aactctaattcccattttgcaa

SEQ ID NO: 3702779 - DNA, 22 bp, Homo sapiens
aactctctccaccctatatgta

SEQ ID NO: 3702780 - DNA, 13 bp, Homo sapiens
aactctgatgtaa

SEQ ID NO: 3702781 - DNA, 14 bp, Homo sapiens
aactctgccagcca

SEQ ID NO: 3702782 - DNA, 23 bp, Homo sapiens
aactcttccccctctcccagttg

SEQ ID NO: 3702783 - DNA, 11 bp, Homo sapiens
aactctttgcc

SEQ ID NO: 3702784 - DNA, 14 bp, Homo sapiens
aactgaaagtgttt

SEQ ID NO: 3702785 - DNA, 22 bp, Homo sapiens
aactgaatggaaggtttgtata

SEQ ID NO: 3702786 - DNA, 15 bp, Homo sapiens
aactgacaaatcaag

SEQ ID NO: 3702787 - DNA, 19 bp, Homo sapiens
aactgacaaatcaagtttc

SEQ ID NO: 3702788 - DNA, 14 bp, Homo sapiens
aactgaccagcctc

SEQ ID NO: 3702789 - DNA, 18 bp, Homo sapiens
aactgaggaattttcttt

SEQ ID NO: 3702790 - DNA, 17 bp, Homo sapiens
aactgcaatagagactg

SEQ ID NO: 3702791 - DNA, 15 bp, Homo sapiens
aactgcatggaccta

SEQ ID NO: 3702792 - DNA, 21 bp, Homo sapiens
aactgcatggacctaacattc

SEQ ID NO: 3702793 - DNA, 19 bp, Homo sapiens
aactgcatgtataaatgaa

SEQ ID NO: 3702794 - DNA, 14 bp, Homo sapiens
aactgcattagaaa

SEQ ID NO: 3702795 - DNA, 16 bp, Homo sapiens
aactgcattagaaatt

SEQ ID NO: 3702796 - DNA, 20 bp, Homo sapiens
aactgcattgagaactgcat

SEQ ID NO: 3702797 - DNA, 20 bp, Homo sapiens
aactggaagcatgtaggaga

SEQ ID NO: 3702798 - DNA, 20 bp, Homo sapiens
aactggcatctgacacaaaa

SEQ ID NO: 3702799 - DNA, 15 bp, Homo sapiens
aactggccctcttct

SEQ ID NO: 3702800 - DNA, 21 bp, Homo sapiens
aactggccctcttcttacttg

SEQ ID NO: 3702801 - DNA, 16 bp, Homo sapiens
aactgggtacttgtgg

SEQ ID NO: 3702802 - DNA, 23 bp, Homo sapiens
aactgtactagtctgtgtgggac

SEQ ID NO: 3702803 - DNA, 15 bp, Homo sapiens
aactgtagaaatgat

SEQ ID NO: 3702804 - DNA, 17 bp, Homo sapiens
aactgtagaaatgatga

SEQ ID NO: 3702805 - DNA, 21 bp, Homo sapiens
aactgtctcctacctctgctc

SEQ ID NO: 3702806 - DNA, 22 bp, Homo sapiens
aactgtgtaactgcccaaagca

SEQ ID NO: 3702807 - DNA, 13 bp, Homo sapiens
aactgtgtatgta

SEQ ID NO: 3702808 - DNA, 15 bp, Homo sapiens
aactgtgtatgtaca

SEQ ID NO: 3702809 - DNA, 14 bp, Homo sapiens
aactgttgattgca

SEQ ID NO: 3702810 - DNA, 20 bp, Homo sapiens
aacttaaaaagtctgcatta

SEQ ID NO: 3702811 - DNA, 15 bp, Homo sapiens
aacttaaataaatgt

SEQ ID NO: 3702812 - DNA, 19 bp, Homo sapiens
aacttaaattttaatttat

SEQ ID NO: 3702813 - DNA, 16 bp, Homo sapiens
aacttagcatgtgttg

SEQ ID NO: 3702814 - DNA, 22 bp, Homo sapiens
aacttcaagtgcatgctctctg

SEQ ID NO: 3702815 - DNA, 20 bp, Homo sapiens
aacttcagctagagcttcaa

SEQ ID NO: 3702816 - DNA, 15 bp, Homo sapiens
aacttctaattgcca

SEQ ID NO: 3702817 - DNA, 17 bp, Homo sapiens
aacttctaattgccatg

SEQ ID NO: 3702818 - DNA, 22 bp, Homo sapiens
aacttctcccctggtagaaaga

SEQ ID NO: 3702819 - DNA, 19 bp, Homo sapiens
aacttgagcgtgaatctgt

SEQ ID NO: 3702820 - DNA, 20 bp, Homo sapiens
aacttgtctttttctggact

SEQ ID NO: 3702821 - DNA, 14 bp, Homo sapiens
aactttaatatgta

SEQ ID NO: 3702822 - DNA, 22 bp, Homo sapiens
aactttagagtagcatgagaga

SEQ ID NO: 3702823 - DNA, 21 bp, Homo sapiens
aactttagcagaatcaaaatg

SEQ ID NO: 3702824 - DNA, 21 bp, Homo sapiens
aactttatcacattatttgca

SEQ ID NO: 3702825 - DNA, 14 bp, Homo sapiens
aactttctcttgta

SEQ ID NO: 3702826 - DNA, 18 bp, Homo sapiens
aacttttataaattaaat

SEQ ID NO: 3702827 - DNA, 18 bp, Homo sapiens
aacttttctattaaaagt

SEQ ID NO: 3702828 - DNA, 21 bp, Homo sapiens
aacttttcttaaaaagttata

SEQ ID NO: 3702829 - DNA, 16 bp, Homo sapiens
aagaaaaaaaataaca

SEQ ID NO: 3702830 - DNA, 23 bp, Homo sapiens
aagaaaaaaataattttatgaac

SEQ ID NO: 3702831 - DNA, 18 bp, Homo sapiens
aagaaaaatgagcctggc

SEQ ID NO: 3702832 - DNA, 16 bp, Homo sapiens
aagaaaagagctttct

SEQ ID NO: 3702833 - DNA, 16 bp, Homo sapiens
aagaaaagtgggccag

SEQ ID NO: 3702834 - DNA, 17 bp, Homo sapiens
aagaaaatacaataaac

SEQ ID NO: 3702835 - DNA, 18 bp, Homo sapiens
aagaaaatacaataaact

SEQ ID NO: 3702836 - DNA, 22 bp, Homo sapiens
aagaaacacactgaggcaggga

SEQ ID NO: 3702837 - DNA, 12 bp, Homo sapiens
aagaaacactga

SEQ ID NO: 3702838 - DNA, 16 bp, Homo sapiens
aagaaacccgacagag

SEQ ID NO: 3702839 - DNA, 18 bp, Homo sapiens
aagaaacccgacagaggg

SEQ ID NO: 3702840 - DNA, 21 bp, Homo sapiens
aagaaactgaggaattttctt

SEQ ID NO: 3702841 - DNA, 15 bp, Homo sapiens
aagaaagaaggaagt

SEQ ID NO: 3702842 - DNA, 23 bp, Homo sapiens
aagaaagagcaacaatccatctc

SEQ ID NO: 3702843 - DNA, 19 bp, Homo sapiens
aagaaagcccttaggaaga

SEQ ID NO: 3702844 - DNA, 22 bp, Homo sapiens
aagaaagcttcaaactgcatga

SEQ ID NO: 3702845 - DNA, 23 bp, Homo sapiens
aagaaagtttccccaccagtgaa

SEQ ID NO: 3702846 - DNA, 12 bp, Homo sapiens
aagaaatcatgt

SEQ ID NO: 3702847 - DNA, 13 bp, Homo sapiens
aagaaatcatgtt

SEQ ID NO: 3702848 - DNA, 21 bp, Homo sapiens
aagaaatcatgttatgataaa

SEQ ID NO: 3702849 - DNA, 14 bp, Homo sapiens
aagaaatgacactt

SEQ ID NO: 3702850 - DNA, 16 bp, Homo sapiens
aagaaatgcacaatgt

SEQ ID NO: 3702851 - DNA, 18 bp, Homo sapiens
aagaacatccaaggagaa

SEQ ID NO: 3702852 - DNA, 18 bp, Homo sapiens
aagaactgaaaacataaa

SEQ ID NO: 3702853 - DNA, 13 bp, Homo sapiens
aagaactgcatgg

SEQ ID NO: 3702854 - DNA, 13 bp, Homo sapiens
aagaagaaaacac

SEQ ID NO: 3702855 - DNA, 14 bp, Homo sapiens
aagaagcaaatttt

SEQ ID NO: 3702856 - DNA, 15 bp, Homo sapiens
aagaagctctctcct

SEQ ID NO: 3702857 - DNA, 17 bp, Homo sapiens
aagaaggaaaaggcagg

SEQ ID NO: 3702858 - DNA, 16 bp, Homo sapiens
aagaaggaagacttta

SEQ ID NO: 3702859 - DNA, 11 bp, Homo sapiens
aagaaggaagt

SEQ ID NO: 3702860 - DNA, 21 bp, Homo sapiens
aagaagggtccttccctctcc

SEQ ID NO: 3702861 - DNA, 22 bp, Homo sapiens
aagaagtgaccaaggaggagtt

SEQ ID NO: 3702862 - DNA, 18 bp, Homo sapiens
aagaagtgtccgagaact

SEQ ID NO: 3702863 - DNA, 16 bp, Homo sapiens
aagaatacaaacatat

SEQ ID NO: 3702864 - DNA, 15 bp, Homo sapiens
aagaatattgttcct

SEQ ID NO: 3702865 - DNA, 21 bp, Homo sapiens
aagaatattgttcctaagttc

SEQ ID NO: 3702866 - DNA, 22 bp, Homo sapiens
aagaatattgttcctaagttct

SEQ ID NO: 3702867 - DNA, 22 bp, Homo sapiens
aagaatcattgtaaacattagt

SEQ ID NO: 3702868 - DNA, 23 bp, Homo sapiens
aagaatcgatgggggatgcttca

SEQ ID NO: 3702869 - DNA, 23 bp, Homo sapiens
aagaatgtcagaaaaacaataag

SEQ ID NO: 3702870 - DNA, 23 bp, Homo sapiens
aagaattcctacaatatatattc

SEQ ID NO: 3702871 - DNA, 13 bp, Homo sapiens
aagaattctgtga

SEQ ID NO: 3702872 - DNA, 22 bp, Homo sapiens
aagaatttcttggtaagaagcc

SEQ ID NO: 3702873 - DNA, 22 bp, Homo sapiens
aagaattttcagaccccagcgg

SEQ ID NO: 3702874 - DNA, 18 bp, Homo sapiens
aagacaaaaatactctaa

SEQ ID NO: 3702875 - DNA, 22 bp, Homo sapiens
aagacaaaaatactctaattct

SEQ ID NO: 3702876 - DNA, 23 bp, Homo sapiens
aagacaatggcttactccaggag

SEQ ID NO: 3702877 - DNA, 19 bp, Homo sapiens
aagacaatgtgaaaagaaa

SEQ ID NO: 3702878 - DNA, 14 bp, Homo sapiens
aagacactgaaata

SEQ ID NO: 3702879 - DNA, 22 bp, Homo sapiens
aagacactgaaatatacacaca

SEQ ID NO: 3702880 - DNA, 12 bp, Homo sapiens
aagacagaagcc

SEQ ID NO: 3702881 - DNA, 13 bp, Homo sapiens
aagacagaagcct

SEQ ID NO: 3702882 - DNA, 16 bp, Homo sapiens
aagacagatgccccag

SEQ ID NO: 3702883 - DNA, 22 bp, Homo sapiens
aagacagcttctcatcctgcag

SEQ ID NO: 3702884 - DNA, 23 bp, Homo sapiens
aagacatactccttccatcaaat

SEQ ID NO: 3702885 - DNA, 13 bp, Homo sapiens
aagacatgaacca

SEQ ID NO: 3702886 - DNA, 19 bp, Homo sapiens
aagaccacctcaaatttaa

SEQ ID NO: 3702887 - DNA, 13 bp, Homo sapiens
aagaccagcctgg

SEQ ID NO: 3702888 - DNA, 14 bp, Homo sapiens
aagacccctgtctt

SEQ ID NO: 3702889 - DNA, 20 bp, Homo sapiens
aagaccttctccccattctg

SEQ ID NO: 3702890 - DNA, 14 bp, Homo sapiens
aagactcagtgttc

SEQ ID NO: 3702891 - DNA, 18 bp, Homo sapiens
aagactgtggctgctagc

SEQ ID NO: 3702892 - DNA, 13 bp, Homo sapiens
aagagaaaaaata

SEQ ID NO: 3702893 - DNA, 13 bp, Homo sapiens
aagagaaaattga

SEQ ID NO: 3702894 - DNA, 21 bp, Homo sapiens
aagagaaacagggtgttgtca

SEQ ID NO: 3702895 - DNA, 21 bp, Homo sapiens
aagagaactgatgacactgag

SEQ ID NO: 3702896 - DNA, 10 bp, Homo sapiens
aagagaatgt

SEQ ID NO: 3702897 - DNA, 19 bp, Homo sapiens
aagagacaaacacctccca

SEQ ID NO: 3702898 - DNA, 21 bp, Homo sapiens
aagagagaaagaagtaggcat

SEQ ID NO: 3702899 - DNA, 14 bp, Homo sapiens
aagagagagctgag

SEQ ID NO: 3702900 - DNA, 22 bp, Homo sapiens
aagagagccttggttcatcagt

SEQ ID NO: 3702901 - DNA, 19 bp, Homo sapiens
aagagagttaatcaactga

SEQ ID NO: 3702902 - DNA, 13 bp, Homo sapiens
aagagatgaagag

SEQ ID NO: 3702903 - DNA, 17 bp, Homo sapiens
aagagatgggcttgttt

SEQ ID NO: 3702904 - DNA, 18 bp, Homo sapiens
aagagatgggcttgtttt

SEQ ID NO: 3702905 - DNA, 20 bp, Homo sapiens
aagagatgggcttgttttct

SEQ ID NO: 3702906 - DNA, 19 bp, Homo sapiens
aagagattgtggtttcatt

SEQ ID NO: 3702907 - DNA, 17 bp, Homo sapiens
aagagcagcctgtggca

SEQ ID NO: 3702908 - DNA, 23 bp, Homo sapiens
aagagcaggcacatggaggagct

SEQ ID NO: 3702909 - DNA, 22 bp, Homo sapiens
aagagccttggtgtccacctgg

SEQ ID NO: 3702910 - DNA, 18 bp, Homo sapiens
aagagctgaggcaattct

SEQ ID NO: 3702911 - DNA, 14 bp, Homo sapiens
aagaggcagggtct

SEQ ID NO: 3702912 - DNA, 14 bp, Homo sapiens
aagaggctgaggca

SEQ ID NO: 3702913 - DNA, 16 bp, Homo sapiens
aagagtgattcttgct

SEQ ID NO: 3702914 - DNA, 18 bp, Homo sapiens
aagagtgcaaaacattga

SEQ ID NO: 3702915 - DNA, 15 bp, Homo sapiens
aagagttaagaatgt

SEQ ID NO: 3702916 - DNA, 14 bp, Homo sapiens
aagagttggctggt

SEQ ID NO: 3702917 - DNA, 22 bp, Homo sapiens
aagagttgtgttgttcttttcc

SEQ ID NO: 3702918 - DNA, 14 bp, Homo sapiens
aagataaaggacag

SEQ ID NO: 3702919 - DNA, 12 bp, Homo sapiens
aagataaatgtg

SEQ ID NO: 3702920 - DNA, 19 bp, Homo sapiens
aagataacaagatctttca

SEQ ID NO: 3702921 - DNA, 22 bp, Homo sapiens
aagataacaagatctttcagga

SEQ ID NO: 3702922 - DNA, 15 bp, Homo sapiens
aagatacatcacagt

SEQ ID NO: 3702923 - DNA, 18 bp, Homo sapiens
aagatacgactttatttt

SEQ ID NO: 3702924 - DNA, 18 bp, Homo sapiens
aagataggctctgcacag

SEQ ID NO: 3702925 - DNA, 13 bp, Homo sapiens
aagatattattca

SEQ ID NO: 3702926 - DNA, 18 bp, Homo sapiens
aagatcactttgctctga

SEQ ID NO: 3702927 - DNA, 21 bp, Homo sapiens
aagatcctgtctttaaggaaa

SEQ ID NO: 3702928 - DNA, 13 bp, Homo sapiens
aagatctttcagg

SEQ ID NO: 3702929 - DNA, 14 bp, Homo sapiens
aagatgacttccca

SEQ ID NO: 3702930 - DNA, 17 bp, Homo sapiens
aagatgagagaactgga

SEQ ID NO: 3702931 - DNA, 18 bp, Homo sapiens
aagatgagagaactggag

SEQ ID NO: 3702932 - DNA, 16 bp, Homo sapiens
aagatgccatctgtgt

SEQ ID NO: 3702933 - DNA, 21 bp, Homo sapiens
aagatgctgaaacaggagaga

SEQ ID NO: 3702934 - DNA, 14 bp, Homo sapiens
aagatggattctca

SEQ ID NO: 3702935 - DNA, 16 bp, Homo sapiens
aagatggattctcaga

SEQ ID NO: 3702936 - DNA, 21 bp, Homo sapiens
aagatggattctcagatattt

SEQ ID NO: 3702937 - DNA, 18 bp, Homo sapiens
aagatggctgtgcctctg

SEQ ID NO: 3702938 - DNA, 23 bp, Homo sapiens
aagatggcttttgtttcttccct

SEQ ID NO: 3702939 - DNA, 16 bp, Homo sapiens
aagatgtcagactggc

SEQ ID NO: 3702940 - DNA, 19 bp, Homo sapiens
aagatgtgtcttcaatttg

SEQ ID NO: 3702941 - DNA, 15 bp, Homo sapiens
aagatgttatacaac

SEQ ID NO: 3702942 - DNA, 16 bp, Homo sapiens
aagatgtttgtcagat

SEQ ID NO: 3702943 - DNA, 18 bp, Homo sapiens
aagattattttttatgag

SEQ ID NO: 3702944 - DNA, 14 bp, Homo sapiens
aagattcccagaga

SEQ ID NO: 3702945 - DNA, 15 bp, Homo sapiens
aagattcccagagac

SEQ ID NO: 3702946 - DNA, 20 bp, Homo sapiens
aagattcccagagacaggaa

SEQ ID NO: 3702947 - DNA, 18 bp, Homo sapiens
aagattccttttcttgtt

SEQ ID NO: 3702948 - DNA, 22 bp, Homo sapiens
aagattccttttcttgtttatc

SEQ ID NO: 3702949 - DNA, 17 bp, Homo sapiens
aagattgatcattttta

SEQ ID NO: 3702950 - DNA, 16 bp, Homo sapiens
aagattgcttaaaata

SEQ ID NO: 3702951 - DNA, 17 bp, Homo sapiens
aagatttaatttgccaa

SEQ ID NO: 3702952 - DNA, 18 bp, Homo sapiens
aagatttaatttgccaaa

SEQ ID NO: 3702953 - DNA, 23 bp, Homo sapiens
aagatttaatttgccaaaataat

SEQ ID NO: 3702954 - DNA, 12 bp, Homo sapiens
aagatttatgtt

SEQ ID NO: 3702955 - DNA, 23 bp, Homo sapiens
aagatttattttgttaaaatctc

SEQ ID NO: 3702956 - DNA, 13 bp, Homo sapiens
aagatttcttgag

SEQ ID NO: 3702957 - DNA, 21 bp, Homo sapiens
aagatttgcccatttacactt

SEQ ID NO: 3702958 - DNA, 12 bp, Homo sapiens
aagattttgaaa

SEQ ID NO: 3702959 - DNA, 20 bp, Homo sapiens
aagattttgaaaactacatt

SEQ ID NO: 3702960 - DNA, 17 bp, Homo sapiens
aagattttgaatgcttc

SEQ ID NO: 3702961 - DNA, 14 bp, Homo sapiens
aagcaaacacatta

SEQ ID NO: 3702962 - DNA, 22 bp, Homo sapiens
aagcaaagactttcctcttagt

SEQ ID NO: 3702963 - DNA, 17 bp, Homo sapiens
aagcaaaggtgaagaga

SEQ ID NO: 3702964 - DNA, 14 bp, Homo sapiens
aagcaaatgttaca

SEQ ID NO: 3702965 - DNA, 15 bp, Homo sapiens
aagcaagagagatgt

SEQ ID NO: 3702966 - DNA, 18 bp, Homo sapiens
aagcaagagagatgtttt

SEQ ID NO: 3702967 - DNA, 19 bp, Homo sapiens
aagcaagtagctttccaca

SEQ ID NO: 3702968 - DNA, 14 bp, Homo sapiens
aagcaataaatgaa

SEQ ID NO: 3702969 - DNA, 15 bp, Homo sapiens
aagcacagtgcctgc

SEQ ID NO: 3702970 - DNA, 14 bp, Homo sapiens
aagcacctcctgcc

SEQ ID NO: 3702971 - DNA, 16 bp, Homo sapiens
aagcacctcctgcctc

SEQ ID NO: 3702972 - DNA, 12 bp, Homo sapiens
aagcacctgccg

SEQ ID NO: 3702973 - DNA, 15 bp, Homo sapiens
aagcacgaaatgtta

SEQ ID NO: 3702974 - DNA, 19 bp, Homo sapiens
aagcagatgcaaagaggca

SEQ ID NO: 3702975 - DNA, 14 bp, Homo sapiens
aagcagccaagctc

SEQ ID NO: 3702976 - DNA, 16 bp, Homo sapiens
aagcagccaagctcct

SEQ ID NO: 3702977 - DNA, 19 bp, Homo sapiens
aagcagctcaaaggcacag

SEQ ID NO: 3702978 - DNA, 22 bp, Homo sapiens
aagcagtaaaaactgttctcta

SEQ ID NO: 3702979 - DNA, 22 bp, Homo sapiens
aagcagtagaaataatatgcat

SEQ ID NO: 3702980 - DNA, 18 bp, Homo sapiens
aagcagtctacccacctc

SEQ ID NO: 3702981 - DNA, 20 bp, Homo sapiens
aagcagtgccttccataatt

SEQ ID NO: 3702982 - DNA, 17 bp, Homo sapiens
aagcagtggacaccagg

SEQ ID NO: 3702983 - DNA, 22 bp, Homo sapiens
aagcataaatgcaaacacacaa

SEQ ID NO: 3702984 - DNA, 15 bp, Homo sapiens
aagcatcacaaatga

SEQ ID NO: 3702985 - DNA, 21 bp, Homo sapiens
aagcatcacaaatgatattaa

SEQ ID NO: 3702986 - DNA, 19 bp, Homo sapiens
aagcatcacctcaggccag

SEQ ID NO: 3702987 - DNA, 23 bp, Homo sapiens
aagcatcacctcaggccaggtgc

SEQ ID NO: 3702988 - DNA, 13 bp, Homo sapiens
aagcatccaggca

SEQ ID NO: 3702989 - DNA, 19 bp, Homo sapiens
aagcatccatgtgtggact

SEQ ID NO: 3702990 - DNA, 21 bp, Homo sapiens
aagcatccatgtgtggactca

SEQ ID NO: 3702991 - DNA, 18 bp, Homo sapiens
aagcatcggagggaattg

SEQ ID NO: 3702992 - DNA, 13 bp, Homo sapiens
aagcatgaaaaag

SEQ ID NO: 3702993 - DNA, 18 bp, Homo sapiens
aagcattactcttgtaag

SEQ ID NO: 3702994 - DNA, 23 bp, Homo sapiens
aagcattactcttgtaagatttt

SEQ ID NO: 3702995 - DNA, 16 bp, Homo sapiens
aagccaaagacttagt

SEQ ID NO: 3702996 - DNA, 16 bp, Homo sapiens
actctgtggggccttg

SEQ ID NO: 3702997 - DNA, 17 bp, Homo sapiens
actctgttccttcacat

SEQ ID NO: 3702998 - DNA, 20 bp, Homo sapiens
actctgttccttcacatcct

SEQ ID NO: 3702999 - DNA, 19 bp, Homo sapiens
actcttaggaagagaaacc

SEQ ID NO: 3703000 - DNA, 20 bp, Homo sapiens
actcttaggaagagaaacca

SEQ ID NO: 3703001 - DNA, 19 bp, Homo sapiens
actcttattgcccacgctg

SEQ ID NO: 3703002 - DNA, 21 bp, Homo sapiens
actcttattgcccacgctgga

SEQ ID NO: 3703003 - DNA, 20 bp, Homo sapiens
actcttcttaacttaaattt

SEQ ID NO: 3703004 - DNA, 15 bp, Homo sapiens
actcttgacctcagg

SEQ ID NO: 3703005 - DNA, 22 bp, Homo sapiens
actcttgtaagattttgaaaac

SEQ ID NO: 3703006 - DNA, 16 bp, Homo sapiens
actctttgagatagaa

SEQ ID NO: 3703007 - DNA, 11 bp, Homo sapiens
actctttggat

SEQ ID NO: 3703008 - DNA, 12 bp, Homo sapiens
actgaaaacata

SEQ ID NO: 3703009 - DNA, 14 bp, Homo sapiens
actgaaaacataaa

SEQ ID NO: 3703010 - DNA, 13 bp, Homo sapiens
actgaaaaggaaa

SEQ ID NO: 3703011 - DNA, 14 bp, Homo sapiens
actgaaagtgtttc

SEQ ID NO: 3703012 - DNA, 14 bp, Homo sapiens
actgaacaaaaaaa

SEQ ID NO: 3703013 - DNA, 21 bp, Homo sapiens
actgaagatagaagaaaaaag

SEQ ID NO: 3703014 - DNA, 12 bp, Homo sapiens
actgaagcctgc

SEQ ID NO: 3703015 - DNA, 14 bp, Homo sapiens
actgaagcctgcag

SEQ ID NO: 3703016 - DNA, 13 bp, Homo sapiens
actgaagcttttt

SEQ ID NO: 3703017 - DNA, 14 bp, Homo sapiens
actgaagcttttta

SEQ ID NO: 3703018 - DNA, 14 bp, Homo sapiens
actgaaggagaagg

SEQ ID NO: 3703019 - DNA, 14 bp, Homo sapiens
actgaaggctttca

SEQ ID NO: 3703020 - DNA, 20 bp, Homo sapiens
actgaaggctttcagggcct

SEQ ID NO: 3703021 - DNA, 17 bp, Homo sapiens
actgaagttaacagaga

SEQ ID NO: 3703022 - DNA, 21 bp, Homo sapiens
actgaagttaacagagacaga

SEQ ID NO: 3703023 - DNA, 18 bp, Homo sapiens
actgaatatttatatttc

SEQ ID NO: 3703024 - DNA, 19 bp, Homo sapiens
actgacaaatcaagtttcc

SEQ ID NO: 3703025 - DNA, 23 bp, Homo sapiens
actgacacaaaaagtagattaag

SEQ ID NO: 3703026 - DNA, 18 bp, Homo sapiens
actgacattgttggccaa

SEQ ID NO: 3703027 - DNA, 23 bp, Homo sapiens
actgaccatccactctaccctcc

SEQ ID NO: 3703028 - DNA, 17 bp, Homo sapiens
actgaccggaggcaaaa

SEQ ID NO: 3703029 - DNA, 23 bp, Homo sapiens
actgagaaaacgaaactgctcta

SEQ ID NO: 3703030 - DNA, 18 bp, Homo sapiens
actgagcatagtggtggg

SEQ ID NO: 3703031 - DNA, 14 bp, Homo sapiens
actgagccttgtaa

SEQ ID NO: 3703032 - DNA, 16 bp, Homo sapiens
actgagctcctctggg

SEQ ID NO: 3703033 - DNA, 20 bp, Homo sapiens
actgaggaattttctttgtg

SEQ ID NO: 3703034 - DNA, 15 bp, Homo sapiens
actgaggcacgagca

SEQ ID NO: 3703035 - DNA, 13 bp, Homo sapiens
actgaggcagaca

SEQ ID NO: 3703036 - DNA, 21 bp, Homo sapiens
actgagttaaattatactgga

SEQ ID NO: 3703037 - DNA, 19 bp, Homo sapiens
actgatggaaacaaagtgg

SEQ ID NO: 3703038 - DNA, 16 bp, Homo sapiens
actgatgttaggctgg

SEQ ID NO: 3703039 - DNA, 15 bp, Homo sapiens
actgcaacaggaact

SEQ ID NO: 3703040 - DNA, 13 bp, Homo sapiens
actgcaacctccg

SEQ ID NO: 3703041 - DNA, 20 bp, Homo sapiens
actgcaacttgtaaatgtgg

SEQ ID NO: 3703042 - DNA, 15 bp, Homo sapiens
actgcaagagccttg

SEQ ID NO: 3703043 - DNA, 15 bp, Homo sapiens
actgcaatagagact

SEQ ID NO: 3703044 - DNA, 17 bp, Homo sapiens
actgcaatagagactgt

SEQ ID NO: 3703045 - DNA, 21 bp, Homo sapiens
actgcaatagagactgtagat

SEQ ID NO: 3703046 - DNA, 22 bp, Homo sapiens
actgcacagtgcatctcagccc

SEQ ID NO: 3703047 - DNA, 14 bp, Homo sapiens
actgcaccgggcca

SEQ ID NO: 3703048 - DNA, 16 bp, Homo sapiens
actgcaccgggccaca

SEQ ID NO: 3703049 - DNA, 16 bp, Homo sapiens
actgcacgtggcttct

SEQ ID NO: 3703050 - DNA, 20 bp, Homo sapiens
actgcacgtggcttctgatg

SEQ ID NO: 3703051 - DNA, 20 bp, Homo sapiens
actgcactatagcctaggtg

SEQ ID NO: 3703052 - DNA, 17 bp, Homo sapiens
actgcactccagcctgg

SEQ ID NO: 3703053 - DNA, 20 bp, Homo sapiens
actgcactccagcctgggca

SEQ ID NO: 3703054 - DNA, 22 bp, Homo sapiens
actgcagcctcaacctcctggg

SEQ ID NO: 3703055 - DNA, 21 bp, Homo sapiens
actgcagcctcgaactcctgg

SEQ ID NO: 3703056 - DNA, 22 bp, Homo sapiens
actgcagcctcgaactcctggg

SEQ ID NO: 3703057 - DNA, 16 bp, Homo sapiens
actgcagggactgcca

SEQ ID NO: 3703058 - DNA, 16 bp, Homo sapiens
actgcataccaacctg

SEQ ID NO: 3703059 - DNA, 20 bp, Homo sapiens
actgcataccaacctgggca

SEQ ID NO: 3703060 - DNA, 17 bp, Homo sapiens
actgcatggacctaaca

SEQ ID NO: 3703061 - DNA, 16 bp, Homo sapiens
actgcatggtaattta

SEQ ID NO: 3703062 - DNA, 15 bp, Homo sapiens
actgcatgtataaat

SEQ ID NO: 3703063 - DNA, 22 bp, Homo sapiens
actgccacacgtctgaccctct

SEQ ID NO: 3703064 - DNA, 18 bp, Homo sapiens
actgccatggaggcacac

SEQ ID NO: 3703065 - DNA, 21 bp, Homo sapiens
actgccatggaggcacacagc

SEQ ID NO: 3703066 - DNA, 17 bp, Homo sapiens
actgccccgtgcagact

SEQ ID NO: 3703067 - DNA, 19 bp, Homo sapiens
actgcccgagctggtgcat

SEQ ID NO: 3703068 - DNA, 15 bp, Homo sapiens
actgcccggcagggt

SEQ ID NO: 3703069 - DNA, 21 bp, Homo sapiens
actgcccggggcagctgccag

SEQ ID NO: 3703070 - DNA, 12 bp, Homo sapiens
actgccctctgt

SEQ ID NO: 3703071 - DNA, 14 bp, Homo sapiens
actgccctctgttc

SEQ ID NO: 3703072 - DNA, 21 bp, Homo sapiens
actgccctctgttcagtaaca

SEQ ID NO: 3703073 - DNA, 13 bp, Homo sapiens
actgccctgtcta

SEQ ID NO: 3703074 - DNA, 22 bp, Homo sapiens
actgccgaccgaggctggagct

SEQ ID NO: 3703075 - DNA, 14 bp, Homo sapiens
actgcctaagccct

SEQ ID NO: 3703076 - DNA, 15 bp, Homo sapiens
actgcctaagccctc

SEQ ID NO: 3703077 - DNA, 14 bp, Homo sapiens
actgcctcttcctc

SEQ ID NO: 3703078 - DNA, 12 bp, Homo sapiens
actgcctgccca

SEQ ID NO: 3703079 - DNA, 14 bp, Homo sapiens
actgccttaaaact

SEQ ID NO: 3703080 - DNA, 19 bp, Homo sapiens
actgcgggatggtcctggg

SEQ ID NO: 3703081 - DNA, 23 bp, Homo sapiens
actgctacaaatactcttaggaa

SEQ ID NO: 3703082 - DNA, 17 bp, Homo sapiens
actgctaggtgggccag

SEQ ID NO: 3703083 - DNA, 21 bp, Homo sapiens
actgctaggtgggccagcccc

SEQ ID NO: 3703084 - DNA, 22 bp, Homo sapiens
actgctaggtgggccagcccct

SEQ ID NO: 3703085 - DNA, 23 bp, Homo sapiens
actgctcatcattccttgagaaa

SEQ ID NO: 3703086 - DNA, 17 bp, Homo sapiens
actgctctaagcacacg

SEQ ID NO: 3703087 - DNA, 21 bp, Homo sapiens
actgctgcccagcctccaagc

SEQ ID NO: 3703088 - DNA, 12 bp, Homo sapiens
actgctgcccca

SEQ ID NO: 3703089 - DNA, 20 bp, Homo sapiens
actataaagaagtaacaaaa

SEQ ID NO: 3703090 - DNA, 13 bp, Homo sapiens
actataatgtaag

SEQ ID NO: 3703091 - DNA, 17 bp, Homo sapiens
actatagcctaggtgac

SEQ ID NO: 3703092 - DNA, 14 bp, Homo sapiens
actatatctgtttt

SEQ ID NO: 3703093 - DNA, 14 bp, Homo sapiens
actatcaaactgaa

SEQ ID NO: 3703094 - DNA, 13 bp, Homo sapiens
actatcctggctt

SEQ ID NO: 3703095 - DNA, 15 bp, Homo sapiens
actatggtatttgag

SEQ ID NO: 3703096 - DNA, 22 bp, Homo sapiens
actatgtacaatattttaagca

SEQ ID NO: 3703097 - DNA, 13 bp, Homo sapiens
actatgttgataa

SEQ ID NO: 3703098 - DNA, 17 bp, Homo sapiens
actatgttgcccaggca

SEQ ID NO: 3703099 - DNA, 19 bp, Homo sapiens
actatgttgcccaggcagg

SEQ ID NO: 3703100 - DNA, 16 bp, Homo sapiens
actattggaaagtact

SEQ ID NO: 3703101 - DNA, 17 bp, Homo sapiens
actattttattttctaa

SEQ ID NO: 3703102 - DNA, 12 bp, Homo sapiens
actattttcaga

SEQ ID NO: 3703103 - DNA, 19 bp, Homo sapiens
actattttcagaatctgaa

SEQ ID NO: 3703104 - DNA, 14 bp, Homo sapiens
actatttttcagaa

SEQ ID NO: 3703105 - DNA, 13 bp, Homo sapiens
actcaaaagctgg

SEQ ID NO: 3703106 - DNA, 15 bp, Homo sapiens
actcaaaatatttgt

SEQ ID NO: 3703107 - DNA, 20 bp, Homo sapiens
actcaaaatatttgtacata

SEQ ID NO: 3703108 - DNA, 15 bp, Homo sapiens
actcaaacacagaga

SEQ ID NO: 3703109 - DNA, 14 bp, Homo sapiens
actcaagccaagca

SEQ ID NO: 3703110 - DNA, 22 bp, Homo sapiens
actcaagtgtctcagtccacct

SEQ ID NO: 3703111 - DNA, 21 bp, Homo sapiens
actcaatattttccatgaaaa

SEQ ID NO: 3703112 - DNA, 17 bp, Homo sapiens
actcacaacagctgcct

SEQ ID NO: 3703113 - DNA, 16 bp, Homo sapiens
actcacagagacacag

SEQ ID NO: 3703114 - DNA, 16 bp, Homo sapiens
actcacatgctggaca

SEQ ID NO: 3703115 - DNA, 19 bp, Homo sapiens
actcacatggctatgtttt

SEQ ID NO: 3703116 - DNA, 15 bp, Homo sapiens
actcaccatgtaaaa

SEQ ID NO: 3703117 - DNA, 15 bp, Homo sapiens
actcacctctgcctc

SEQ ID NO: 3703118 - DNA, 17 bp, Homo sapiens
actcacctgctggcccc

SEQ ID NO: 3703119 - DNA, 18 bp, Homo sapiens
actcacctgctggcccct

SEQ ID NO: 3703120 - DNA, 14 bp, Homo sapiens
actcaccttgaaca

SEQ ID NO: 3703121 - DNA, 21 bp, Homo sapiens
actcaccttgaacaccacgct

SEQ ID NO: 3703122 - DNA, 15 bp, Homo sapiens
actcactcaagttca

SEQ ID NO: 3703123 - DNA, 19 bp, Homo sapiens
actcactcaagttcaagga

SEQ ID NO: 3703124 - DNA, 17 bp, Homo sapiens
actcactggcagcccca

SEQ ID NO: 3703125 - DNA, 15 bp, Homo sapiens
actcagaagacactg

SEQ ID NO: 3703126 - DNA, 16 bp, Homo sapiens
actcagaagacactga

SEQ ID NO: 3703127 - DNA, 14 bp, Homo sapiens
actcagaagcctga

SEQ ID NO: 3703128 - DNA, 18 bp, Homo sapiens
actcagaagcctgaggct

SEQ ID NO: 3703129 - DNA, 21 bp, Homo sapiens
actcagatggaaccgcaggaa

SEQ ID NO: 3703130 - DNA, 22 bp, Homo sapiens
actcagatggaaccgcaggaag

SEQ ID NO: 3703131 - DNA, 14 bp, Homo sapiens
actcagcagccctc

SEQ ID NO: 3703132 - DNA, 17 bp, Homo sapiens
actcagcagccctcctc

SEQ ID NO: 3703133 - DNA, 18 bp, Homo sapiens
actcagcagccctcctca

SEQ ID NO: 3703134 - DNA, 23 bp, Homo sapiens
actcagcagccctcctcaccccg

SEQ ID NO: 3703135 - DNA, 15 bp, Homo sapiens
actcagccctgaggt

SEQ ID NO: 3703136 - DNA, 15 bp, Homo sapiens
actcagccctgggcc

SEQ ID NO: 3703137 - DNA, 21 bp, Homo sapiens
actcagccctgggccccacca

SEQ ID NO: 3703138 - DNA, 12 bp, Homo sapiens
actcaggactcc

SEQ ID NO: 3703139 - DNA, 13 bp, Homo sapiens
actcaggaggctg

SEQ ID NO: 3703140 - DNA, 19 bp, Homo sapiens
actcaggaggctgaggcag

SEQ ID NO: 3703141 - DNA, 20 bp, Homo sapiens
actcaggaggctgaggcaga

SEQ ID NO: 3703142 - DNA, 15 bp, Homo sapiens
actcaggatgcccag

SEQ ID NO: 3703143 - DNA, 13 bp, Homo sapiens
actcagggcccca

SEQ ID NO: 3703144 - DNA, 22 bp, Homo sapiens
actcaggttgtagtaaagaaat

SEQ ID NO: 3703145 - DNA, 19 bp, Homo sapiens
actcagtccatagcagaga

SEQ ID NO: 3703146 - DNA, 15 bp, Homo sapiens
actcagtttgtcaga

SEQ ID NO: 3703147 - DNA, 19 bp, Homo sapiens
actcagtttgtcagacttt

SEQ ID NO: 3703148 - DNA, 22 bp, Homo sapiens
actcagttttaactagaattta

SEQ ID NO: 3703149 - DNA, 13 bp, Homo sapiens
actcatcataaaa

SEQ ID NO: 3703150 - DNA, 15 bp, Homo sapiens
actcatcataaaata

SEQ ID NO: 3703151 - DNA, 16 bp, Homo sapiens
actcatcataaaataa

SEQ ID NO: 3703152 - DNA, 18 bp, Homo sapiens
actcatcttagtgcctga

SEQ ID NO: 3703153 - DNA, 15 bp, Homo sapiens
actcatgatcttgtg

SEQ ID NO: 3703154 - DNA, 21 bp, Homo sapiens
actccaaacctcctgttagct

SEQ ID NO: 3703155 - DNA, 20 bp, Homo sapiens
actccaccaacccatcagaa

SEQ ID NO: 3703156 - DNA, 14 bp, Homo sapiens
actccaccacccaa

SEQ ID NO: 3703157 - DNA, 13 bp, Homo sapiens
actccagacccct

SEQ ID NO: 3703158 - DNA, 18 bp, Homo sapiens
actccagacccctggctt

SEQ ID NO: 3703159 - DNA, 15 bp, Homo sapiens
actccagatctgcac

SEQ ID NO: 3703160 - DNA, 12 bp, Homo sapiens
actccagcctgg

SEQ ID NO: 3703161 - DNA, 19 bp, Homo sapiens
actccagcctggcgacaga

SEQ ID NO: 3703162 - DNA, 15 bp, Homo sapiens
actccagcctgggcg

SEQ ID NO: 3703163 - DNA, 19 bp, Homo sapiens
actccaggaaggggctgga

SEQ ID NO: 3703164 - DNA, 17 bp, Homo sapiens
actccagtactggagct

SEQ ID NO: 3703165 - DNA, 14 bp, Homo sapiens
actcccaagaacag

SEQ ID NO: 3703166 - DNA, 19 bp, Homo sapiens
actcccaagaacagcaggc

SEQ ID NO: 3703167 - DNA, 15 bp, Homo sapiens
actccctcctcacct

SEQ ID NO: 3703168 - DNA, 18 bp, Homo sapiens
actccctggctctcagaa

SEQ ID NO: 3703169 - DNA, 15 bp, Homo sapiens
actccgtctcaagga

SEQ ID NO: 3703170 - DNA, 14 bp, Homo sapiens
actcctacctcagc

SEQ ID NO: 3703171 - DNA, 15 bp, Homo sapiens
actcctacctcagcc

SEQ ID NO: 3703172 - DNA, 14 bp, Homo sapiens
actcctacctggta

SEQ ID NO: 3703173 - DNA, 20 bp, Homo sapiens
actcctccctgatgtacagt

SEQ ID NO: 3703174 - DNA, 16 bp, Homo sapiens
actcctggggcctctt

SEQ ID NO: 3703175 - DNA, 21 bp, Homo sapiens
actctaattcccattttgcaa

SEQ ID NO: 3703176 - DNA, 13 bp, Homo sapiens
actctaattctaa

SEQ ID NO: 3703177 - DNA, 16 bp, Homo sapiens
actctacactgtgaac

SEQ ID NO: 3703178 - DNA, 15 bp, Homo sapiens
actctacagaggcca

SEQ ID NO: 3703179 - DNA, 13 bp, Homo sapiens
actctacctcata

SEQ ID NO: 3703180 - DNA, 15 bp, Homo sapiens
actctagggaaaaac

SEQ ID NO: 3703181 - DNA, 17 bp, Homo sapiens
actctaggtgcccttgg

SEQ ID NO: 3703182 - DNA, 23 bp, Homo sapiens
actctatgggtatcaaacagctc

SEQ ID NO: 3703183 - DNA, 22 bp, Homo sapiens
actctcaggatcaagaaagtgt

SEQ ID NO: 3703184 - DNA, 15 bp, Homo sapiens
actctcagtgcttct

SEQ ID NO: 3703185 - DNA, 14 bp, Homo sapiens
actctcattcccca

SEQ ID NO: 3703186 - DNA, 12 bp, Homo sapiens
actctccccaca

SEQ ID NO: 3703187 - DNA, 18 bp, Homo sapiens
actctcctggaaatatta

SEQ ID NO: 3703188 - DNA, 14 bp, Homo sapiens
actctcctgggccc

SEQ ID NO: 3703189 - DNA, 17 bp, Homo sapiens
actctcctgggcccctc

SEQ ID NO: 3703190 - DNA, 18 bp, Homo sapiens
actctcctgggcccctcc

SEQ ID NO: 3703191 - DNA, 20 bp, Homo sapiens
actctctccaccctatatgt

SEQ ID NO: 3703192 - DNA, 21 bp, Homo sapiens
actctctccaccctatatgta

SEQ ID NO: 3703193 - DNA, 23 bp, Homo sapiens
actctgaggctctttctgggcca

SEQ ID NO: 3703194 - DNA, 16 bp, Homo sapiens
actctgagtttaccat

SEQ ID NO: 3703195 - DNA, 22 bp, Homo sapiens
actctgagtttaccatttgtaa

SEQ ID NO: 3703196 - DNA, 12 bp, Homo sapiens
actctgatgtaa

SEQ ID NO: 3703197 - DNA, 14 bp, Homo sapiens
actctgatgtaaat

SEQ ID NO: 3703198 - DNA, 18 bp, Homo sapiens
actctgatgtaaatgaag

SEQ ID NO: 3703199 - DNA, 18 bp, Homo sapiens
actctgccctactcactc

SEQ ID NO: 3703200 - DNA, 22 bp, Homo sapiens
actctgctttgactgagcagac

SEQ ID NO: 3703201 - DNA, 13 bp, Homo sapiens
actctgggaaata

SEQ ID NO: 3703202 - DNA, 17 bp, Homo sapiens
actctgggctgctaccc

SEQ ID NO: 3703203 - DNA, 14 bp, Homo sapiens
actctgtcagatgg

SEQ ID NO: 3703204 - DNA, 15 bp, Homo sapiens
actctgtggccaaag

SEQ ID NO: 3703205 - DNA, 20 bp, Homo sapiens
accactagaactctccatct

SEQ ID NO: 3703206 - DNA, 20 bp, Homo sapiens
accactgcactccagcctgg

SEQ ID NO: 3703207 - DNA, 18 bp, Homo sapiens
accacttaaaaaatgtcc

SEQ ID NO: 3703208 - DNA, 17 bp, Homo sapiens
accacttcattcttgaa

SEQ ID NO: 3703209 - DNA, 16 bp, Homo sapiens
accagaagggaaacag

SEQ ID NO: 3703210 - DNA, 21 bp, Homo sapiens
accagactacttgggagcacc

SEQ ID NO: 3703211 - DNA, 13 bp, Homo sapiens
accagagcactgt

SEQ ID NO: 3703212 - DNA, 14 bp, Homo sapiens
accagagcactgta

SEQ ID NO: 3703213 - DNA, 16 bp, Homo sapiens
accagagcactgtata

SEQ ID NO: 3703214 - DNA, 17 bp, Homo sapiens
accagagcactgtatac

SEQ ID NO: 3703215 - DNA, 18 bp, Homo sapiens
accagagctctggagcca

SEQ ID NO: 3703216 - DNA, 23 bp, Homo sapiens
accagcaacttgtctttttctgg

SEQ ID NO: 3703217 - DNA, 21 bp, Homo sapiens
accagcagatcccagctcacg

SEQ ID NO: 3703218 - DNA, 17 bp, Homo sapiens
accagccccagtgccca

SEQ ID NO: 3703219 - DNA, 19 bp, Homo sapiens
accagcctccatgctgcct

SEQ ID NO: 3703220 - DNA, 21 bp, Homo sapiens
accagcctccatgctgcctcc

SEQ ID NO: 3703221 - DNA, 20 bp, Homo sapiens
accagcctccgtatttcaga

SEQ ID NO: 3703222 - DNA, 12 bp, Homo sapiens
accagcctggcc

SEQ ID NO: 3703223 - DNA, 20 bp, Homo sapiens
accaggaactctggagttca

SEQ ID NO: 3703224 - DNA, 15 bp, Homo sapiens
accaggactccctcc

SEQ ID NO: 3703225 - DNA, 18 bp, Homo sapiens
accaggactccctcctca

SEQ ID NO: 3703226 - DNA, 14 bp, Homo sapiens
accaggagaaccac

SEQ ID NO: 3703227 - DNA, 17 bp, Homo sapiens
accaggagtccctggta

SEQ ID NO: 3703228 - DNA, 21 bp, Homo sapiens
accaggcacgaacccacctgc

SEQ ID NO: 3703229 - DNA, 19 bp, Homo sapiens
accaggctgctcagggctg

SEQ ID NO: 3703230 - DNA, 20 bp, Homo sapiens
accaggtgttctacactcat

SEQ ID NO: 3703231 - DNA, 14 bp, Homo sapiens
accaggttgaaaga

SEQ ID NO: 3703232 - DNA, 18 bp, Homo sapiens
accagtatacaagataag

SEQ ID NO: 3703233 - DNA, 13 bp, Homo sapiens
accagtctgaagt

SEQ ID NO: 3703234 - DNA, 19 bp, Homo sapiens
accagtctgaagtttcatt

SEQ ID NO: 3703235 - DNA, 17 bp, Homo sapiens
accagttatgtgaatga

SEQ ID NO: 3703236 - DNA, 21 bp, Homo sapiens
accagttgcacttggcctctg

SEQ ID NO: 3703237 - DNA, 20 bp, Homo sapiens
accatatggatattagtcat

SEQ ID NO: 3703238 - DNA, 19 bp, Homo sapiens
accatattcagtgctgtgg

SEQ ID NO: 3703239 - DNA, 17 bp, Homo sapiens
accatcatgtctggcta

SEQ ID NO: 3703240 - DNA, 22 bp, Homo sapiens
accatccactctaccctcccac

SEQ ID NO: 3703241 - DNA, 16 bp, Homo sapiens
accatcctatttaact

SEQ ID NO: 3703242 - DNA, 16 bp, Homo sapiens
accatctcaggccacc

SEQ ID NO: 3703243 - DNA, 15 bp, Homo sapiens
accatgaaacaaagc

SEQ ID NO: 3703244 - DNA, 23 bp, Homo sapiens
accatgacaaccctgtggtttcc

SEQ ID NO: 3703245 - DNA, 16 bp, Homo sapiens
accatggagacaagaa

SEQ ID NO: 3703246 - DNA, 14 bp, Homo sapiens
accatgtacatagc

SEQ ID NO: 3703247 - DNA, 19 bp, Homo sapiens
accatgtttgagctcagac

SEQ ID NO: 3703248 - DNA, 12 bp, Homo sapiens
accattccccat

SEQ ID NO: 3703249 - DNA, 16 bp, Homo sapiens
accattgctgctcctt

SEQ ID NO: 3703250 - DNA, 16 bp, Homo sapiens
accattgcttcactac

SEQ ID NO: 3703251 - DNA, 20 bp, Homo sapiens
accattgcttcactacccat

SEQ ID NO: 3703252 - DNA, 19 bp, Homo sapiens
accattgtctcagagcagg

SEQ ID NO: 3703253 - DNA, 14 bp, Homo sapiens
accatttcagagag

SEQ ID NO: 3703254 - DNA, 16 bp, Homo sapiens
accatttgtaataaag

SEQ ID NO: 3703255 - DNA, 18 bp, Homo sapiens
accatttgtaataaagta

SEQ ID NO: 3703256 - DNA, 21 bp, Homo sapiens
accattttggggtacccactg

SEQ ID NO: 3703257 - DNA, 22 bp, Homo sapiens
accattttggggtacccactgc

SEQ ID NO: 3703258 - DNA, 15 bp, Homo sapiens
acccaaacctggaga

SEQ ID NO: 3703259 - DNA, 16 bp, Homo sapiens
acccaagtgggggcag

SEQ ID NO: 3703260 - DNA, 13 bp, Homo sapiens
acccacagggcta

SEQ ID NO: 3703261 - DNA, 18 bp, Homo sapiens
acccacctgagctttgga

SEQ ID NO: 3703262 - DNA, 13 bp, Homo sapiens
acccacctgctga

SEQ ID NO: 3703263 - DNA, 17 bp, Homo sapiens
acccacctgctgagaga

SEQ ID NO: 3703264 - DNA, 10 bp, Homo sapiens
acccactgct

SEQ ID NO: 3703265 - DNA, 15 bp, Homo sapiens
acccactgctctggt

SEQ ID NO: 3703266 - DNA, 11 bp, Homo sapiens
acccactgctt

SEQ ID NO: 3703267 - DNA, 15 bp, Homo sapiens
acccagacagctccc

SEQ ID NO: 3703268 - DNA, 22 bp, Homo sapiens
acccagacagctccctctgcct

SEQ ID NO: 3703269 - DNA, 17 bp, Homo sapiens
acccagagaggaatcag

SEQ ID NO: 3703270 - DNA, 19 bp, Homo sapiens
acccagcccattctctctc

SEQ ID NO: 3703271 - DNA, 23 bp, Homo sapiens
acccagcccattctctctcctgt

SEQ ID NO: 3703272 - DNA, 17 bp, Homo sapiens
acccagccccttgagaa

SEQ ID NO: 3703273 - DNA, 21 bp, Homo sapiens
acccagccccttgagaaacct

SEQ ID NO: 3703274 - DNA, 13 bp, Homo sapiens
acccagcgagccc

SEQ ID NO: 3703275 - DNA, 16 bp, Homo sapiens
acccagcgagccctgg

SEQ ID NO: 3703276 - DNA, 23 bp, Homo sapiens
acccagcgagccctggtggcagt

SEQ ID NO: 3703277 - DNA, 23 bp, Homo sapiens
acccaggagatggaagttgcagt

SEQ ID NO: 3703278 - DNA, 13 bp, Homo sapiens
acccaggagcccc

SEQ ID NO: 3703279 - DNA, 19 bp, Homo sapiens
acccaggagccccgaggcc

SEQ ID NO: 3703280 - DNA, 23 bp, Homo sapiens
acccaggaggcagaggttgcagt

SEQ ID NO: 3703281 - DNA, 19 bp, Homo sapiens
acccaggagggagggggct

SEQ ID NO: 3703282 - DNA, 15 bp, Homo sapiens
acccagtccctgggg

SEQ ID NO: 3703283 - DNA, 22 bp, Homo sapiens
acccagtgttttaggagcatga

SEQ ID NO: 3703284 - DNA, 14 bp, Homo sapiens
acccatcagaagga

SEQ ID NO: 3703285 - DNA, 18 bp, Homo sapiens
acccatcagaaggagaag

SEQ ID NO: 3703286 - DNA, 13 bp, Homo sapiens
acccatctgcacc

SEQ ID NO: 3703287 - DNA, 18 bp, Homo sapiens
acccatgatgagctcctc

SEQ ID NO: 3703288 - DNA, 17 bp, Homo sapiens
acccattcctatttctt

SEQ ID NO: 3703289 - DNA, 22 bp, Homo sapiens
acccattcgtggtgatcaatta

SEQ ID NO: 3703290 - DNA, 15 bp, Homo sapiens
accccaaagcccctt

SEQ ID NO: 3703291 - DNA, 21 bp, Homo sapiens
accccacctttattccttcat

SEQ ID NO: 3703292 - DNA, 13 bp, Homo sapiens
accccagcatcct

SEQ ID NO: 3703293 - DNA, 14 bp, Homo sapiens
accccagctcccta

SEQ ID NO: 3703294 - DNA, 17 bp, Homo sapiens
accccagctccctagga

SEQ ID NO: 3703295 - DNA, 23 bp, Homo sapiens
accccagctccctaggagaccaa

SEQ ID NO: 3703296 - DNA, 17 bp, Homo sapiens
accccatccagttcatg

SEQ ID NO: 3703297 - DNA, 23 bp, Homo sapiens
accccatgtcaccggatcctggg

SEQ ID NO: 3703298 - DNA, 13 bp, Homo sapiens
accccattctttg

SEQ ID NO: 3703299 - DNA, 15 bp, Homo sapiens
acccccacacctcag

SEQ ID NO: 3703300 - DNA, 16 bp, Homo sapiens
acccccaccccacact

SEQ ID NO: 3703301 - DNA, 11 bp, Homo sapiens
acccccaccct

SEQ ID NO: 3703302 - DNA, 17 bp, Homo sapiens
acccccactctcattcc

SEQ ID NO: 3703303 - DNA, 13 bp, Homo sapiens
acccccagcaacc

SEQ ID NO: 3703304 - DNA, 12 bp, Homo sapiens
acccccagcctg

SEQ ID NO: 3703305 - DNA, 17 bp, Homo sapiens
acccccatctctccctc

SEQ ID NO: 3703306 - DNA, 13 bp, Homo sapiens
accccccacctgc

SEQ ID NO: 3703307 - DNA, 19 bp, Homo sapiens
accccccagaacctgtcct

SEQ ID NO: 3703308 - DNA, 12 bp, Homo sapiens
acccccctcatt

SEQ ID NO: 3703309 - DNA, 15 bp, Homo sapiens
acccccctgggctga

SEQ ID NO: 3703310 - DNA, 16 bp, Homo sapiens
accccctcattgttta

SEQ ID NO: 3703311 - DNA, 20 bp, Homo sapiens
acccccttcagtgcccacca

SEQ ID NO: 3703312 - DNA, 18 bp, Homo sapiens
acccccttctactgagcc

SEQ ID NO: 3703313 - DNA, 14 bp, Homo sapiens
acccccttctctgc

SEQ ID NO: 3703314 - DNA, 17 bp, Homo sapiens
acccccttctctgctcc

SEQ ID NO: 3703315 - DNA, 13 bp, Homo sapiens
accccgggctctc

SEQ ID NO: 3703316 - DNA, 17 bp, Homo sapiens
accccgggctctctgct

SEQ ID NO: 3703317 - DNA, 23 bp, Homo sapiens
accccgtctggggttcagcccct

SEQ ID NO: 3703318 - DNA, 17 bp, Homo sapiens
acctcccctccttgcct

SEQ ID NO: 3703319 - DNA, 14 bp, Homo sapiens
acctccctgaacca

SEQ ID NO: 3703320 - DNA, 16 bp, Homo sapiens
acctcctccacaccag

SEQ ID NO: 3703321 - DNA, 20 bp, Homo sapiens
acctcctgcccaggagagcc

SEQ ID NO: 3703322 - DNA, 17 bp, Homo sapiens
acctcggtgccttcctc

SEQ ID NO: 3703323 - DNA, 14 bp, Homo sapiens
acctcgtcctcccc

SEQ ID NO: 3703324 - DNA, 20 bp, Homo sapiens
acctcgtcctccccctgcca

SEQ ID NO: 3703325 - DNA, 18 bp, Homo sapiens
acctctaaaacagtcctt

SEQ ID NO: 3703326 - DNA, 16 bp, Homo sapiens
acctctgcacaagctg

SEQ ID NO: 3703327 - DNA, 18 bp, Homo sapiens
acctctgcacaagctgca

SEQ ID NO: 3703328 - DNA, 12 bp, Homo sapiens
acctctgcctca

SEQ ID NO: 3703329 - DNA, 13 bp, Homo sapiens
acctctgcctcaa

SEQ ID NO: 3703330 - DNA, 14 bp, Homo sapiens
acctctgcctcaat

SEQ ID NO: 3703331 - DNA, 12 bp, Homo sapiens
acctctgcctga

SEQ ID NO: 3703332 - DNA, 23 bp, Homo sapiens
acctctgcctgaagtcacacagt

SEQ ID NO: 3703333 - DNA, 16 bp, Homo sapiens
acctctggactggcta

SEQ ID NO: 3703334 - DNA, 23 bp, Homo sapiens
acctctggactggctagagtcct

SEQ ID NO: 3703335 - DNA, 21 bp, Homo sapiens
acctctgtatttgaatcagcc

SEQ ID NO: 3703336 - DNA, 18 bp, Homo sapiens
acctgaagactcattctt

SEQ ID NO: 3703337 - DNA, 17 bp, Homo sapiens
acctgactcaggcatca

SEQ ID NO: 3703338 - DNA, 15 bp, Homo sapiens
acctgagctccccac

SEQ ID NO: 3703339 - DNA, 23 bp, Homo sapiens
acctgagctttggacgcacacag

SEQ ID NO: 3703340 - DNA, 15 bp, Homo sapiens
acctgatcccactcc

SEQ ID NO: 3703341 - DNA, 14 bp, Homo sapiens
acctgcacctcccc

SEQ ID NO: 3703342 - DNA, 16 bp, Homo sapiens
acctgcacctcccccc

SEQ ID NO: 3703343 - DNA, 20 bp, Homo sapiens
acctgcacctccccccactg

SEQ ID NO: 3703344 - DNA, 19 bp, Homo sapiens
acctgcatccgtagttccc

SEQ ID NO: 3703345 - DNA, 22 bp, Homo sapiens
acctgcatccgtagttccctga

SEQ ID NO: 3703346 - DNA, 19 bp, Homo sapiens
acctgccactaggctgggt

SEQ ID NO: 3703347 - DNA, 15 bp, Homo sapiens
acctgccagcctggc

SEQ ID NO: 3703348 - DNA, 18 bp, Homo sapiens
acctgccagcctggcttc

SEQ ID NO: 3703349 - DNA, 15 bp, Homo sapiens
acctgccatttgcac

SEQ ID NO: 3703350 - DNA, 12 bp, Homo sapiens
acctgccccctt

SEQ ID NO: 3703351 - DNA, 15 bp, Homo sapiens
acctgcccccttctc

SEQ ID NO: 3703352 - DNA, 20 bp, Homo sapiens
acctgcccccttctcccaca

SEQ ID NO: 3703353 - DNA, 23 bp, Homo sapiens
acctgcccccttctcccacactg

SEQ ID NO: 3703354 - DNA, 12 bp, Homo sapiens
acctgccgacct

SEQ ID NO: 3703355 - DNA, 17 bp, Homo sapiens
acctgctctcctcttgc

SEQ ID NO: 3703356 - DNA, 19 bp, Homo sapiens
acctgctctcctcttgcca

SEQ ID NO: 3703357 - DNA, 19 bp, Homo sapiens
acctgctgagggaccagcc

SEQ ID NO: 3703358 - DNA, 23 bp, Homo sapiens
acctgctgagggaccagccaaga

SEQ ID NO: 3703359 - DNA, 16 bp, Homo sapiens
acctgctgccccagct

SEQ ID NO: 3703360 - DNA, 15 bp, Homo sapiens
acctgctggcccctc

SEQ ID NO: 3703361 - DNA, 21 bp, Homo sapiens
acctggccccatgtctctcag

SEQ ID NO: 3703362 - DNA, 23 bp, Homo sapiens
acctggccccatgtctctcagaa

SEQ ID NO: 3703363 - DNA, 16 bp, Homo sapiens
acctggccctggggcc

SEQ ID NO: 3703364 - DNA, 17 bp, Homo sapiens
acctggccctggggcct

SEQ ID NO: 3703365 - DNA, 18 bp, Homo sapiens
acctggccctggggcctg

SEQ ID NO: 3703366 - DNA, 24 bp, Homo sapiens
acctggggagtgggacagagtctg

SEQ ID NO: 3703367 - DNA, 17 bp, Homo sapiens
acctgggttccctttcc

SEQ ID NO: 3703368 - DNA, 22 bp, Homo sapiens
acctggtcacaggactctgcct

SEQ ID NO: 3703369 - DNA, 23 bp, Homo sapiens
acctggtcacaggactctgcctc

SEQ ID NO: 3703370 - DNA, 10 bp, Homo sapiens
acctggtgct

SEQ ID NO: 3703371 - DNA, 13 bp, Homo sapiens
acctggtgctgga

SEQ ID NO: 3703372 - DNA, 22 bp, Homo sapiens
acctggtgctggatattttcaa

SEQ ID NO: 3703373 - DNA, 11 bp, Homo sapiens
acctgtaaaac

SEQ ID NO: 3703374 - DNA, 20 bp, Homo sapiens
acctgtaaaactttatttta

SEQ ID NO: 3703375 - DNA, 22 bp, Homo sapiens
acctgtaaaactttattttata

SEQ ID NO: 3703376 - DNA, 19 bp, Homo sapiens
acctgtaaattattttaaa

SEQ ID NO: 3703377 - DNA, 17 bp, Homo sapiens
acctgtaacttttgtaa

SEQ ID NO: 3703378 - DNA, 14 bp, Homo sapiens
acctgtaacttttt

SEQ ID NO: 3703379 - DNA, 14 bp, Homo sapiens
acctgtaatcccag

SEQ ID NO: 3703380 - DNA, 19 bp, Homo sapiens
acctgtaatcccagctact

SEQ ID NO: 3703381 - DNA, 20 bp, Homo sapiens
acctgtaatcccagctactt

SEQ ID NO: 3703382 - DNA, 18 bp, Homo sapiens
acctgtagtcccagctac

SEQ ID NO: 3703383 - DNA, 14 bp, Homo sapiens
acctgtcaatacta

SEQ ID NO: 3703384 - DNA, 13 bp, Homo sapiens
acctgtcccacct

SEQ ID NO: 3703385 - DNA, 14 bp, Homo sapiens
acctgtcccacctc

SEQ ID NO: 3703386 - DNA, 15 bp, Homo sapiens
acctgtcccacctca

SEQ ID NO: 3703387 - DNA, 19 bp, Homo sapiens
acctgtggggatttctccc

SEQ ID NO: 3703388 - DNA, 19 bp, Homo sapiens
acctgtttttaagctgttt

SEQ ID NO: 3703389 - DNA, 20 bp, Homo sapiens
acctgtttttaagctgtttc

SEQ ID NO: 3703390 - DNA, 16 bp, Homo sapiens
accttaaattaaacaa

SEQ ID NO: 3703391 - DNA, 16 bp, Homo sapiens
accttacttacagcat

SEQ ID NO: 3703392 - DNA, 13 bp, Homo sapiens
accttaggcaggg

SEQ ID NO: 3703393 - DNA, 15 bp, Homo sapiens
accttaggcagggaa

SEQ ID NO: 3703394 - DNA, 16 bp, Homo sapiens
accttaggcagggaag

SEQ ID NO: 3703395 - DNA, 22 bp, Homo sapiens
accttatctgtgcgtgaaacac

SEQ ID NO: 3703396 - DNA, 17 bp, Homo sapiens
accttattgtacctctc

SEQ ID NO: 3703397 - DNA, 22 bp, Homo sapiens
accttattgtacctctcttata

SEQ ID NO: 3703398 - DNA, 13 bp, Homo sapiens
accttcaaagctg

SEQ ID NO: 3703399 - DNA, 14 bp, Homo sapiens
accttcaaagctga

SEQ ID NO: 3703400 - DNA, 20 bp, Homo sapiens
accttcaataaagtatctac

SEQ ID NO: 3703401 - DNA, 23 bp, Homo sapiens
accttcaataaagtatctacatg

SEQ ID NO: 3703402 - DNA, 16 bp, Homo sapiens
accttcaattcctggg

SEQ ID NO: 3703403 - DNA, 17 bp, Homo sapiens
accttcaattcctgggc

SEQ ID NO: 3703404 - DNA, 17 bp, Homo sapiens
accttcagatcctaccc

SEQ ID NO: 3703405 - DNA, 19 bp, Homo sapiens
accttccatggctcttttt

SEQ ID NO: 3703406 - DNA, 11 bp, Homo sapiens
accttcccagc

SEQ ID NO: 3703407 - DNA, 19 bp, Homo sapiens
accttcccagctctccctc

SEQ ID NO: 3703408 - DNA, 17 bp, Homo sapiens
accttcccatgccctgg

SEQ ID NO: 3703409 - DNA, 13 bp, Homo sapiens
accttcctgtctt

SEQ ID NO: 3703410 - DNA, 14 bp, Homo sapiens
accttctccaaatg

SEQ ID NO: 3703411 - DNA, 17 bp, Homo sapiens
accttctccccattctg

SEQ ID NO: 3703412 - DNA, 16 bp, Homo sapiens
accttgacagggcaca

SEQ ID NO: 3703413 - DNA, 16 bp, Homo sapiens
accttgcaacacacag

SEQ ID NO: 3703414 - DNA, 17 bp, Homo sapiens
accttgcaacacacaga

SEQ ID NO: 3703415 - DNA, 14 bp, Homo sapiens
accttggctcaagt

SEQ ID NO: 3703416 - DNA, 18 bp, Homo sapiens
accttggctgcagggagt

SEQ ID NO: 3703417 - DNA, 14 bp, Homo sapiens
acctttaagaattt

SEQ ID NO: 3703418 - DNA, 22 bp, Homo sapiens
acctttaagaattttaaatatt

SEQ ID NO: 3703419 - DNA, 15 bp, Homo sapiens
acctttatggtttct

SEQ ID NO: 3703420 - DNA, 16 bp, Homo sapiens
acctttattaaaatct

SEQ ID NO: 3703421 - DNA, 21 bp, Homo sapiens
acctttattccttcatttcat

SEQ ID NO: 3703422 - DNA, 17 bp, Homo sapiens
acctttattttagaatt

SEQ ID NO: 3703423 - DNA, 15 bp, Homo sapiens
accttttatccactt

SEQ ID NO: 3703424 - DNA, 14 bp, Homo sapiens
acctttttccttcc

SEQ ID NO: 3703425 - DNA, 12 bp, Homo sapiens
acgaaatgttat

SEQ ID NO: 3703426 - DNA, 23 bp, Homo sapiens
acgaaatgttattttttaattat

SEQ ID NO: 3703427 - DNA, 12 bp, Homo sapiens
acgaagaaaaaa

SEQ ID NO: 3703428 - DNA, 17 bp, Homo sapiens
acgaagggaaatgtctt

SEQ ID NO: 3703429 - DNA, 15 bp, Homo sapiens
acgacaaagctgcta

SEQ ID NO: 3703430 - DNA, 23 bp, Homo sapiens
acgacaaagctgctaaatctcct

SEQ ID NO: 3703431 - DNA, 14 bp, Homo sapiens
acactgttctgaaa

SEQ ID NO: 3703432 - DNA, 20 bp, Homo sapiens
acactgttctgaaagtgact

SEQ ID NO: 3703433 - DNA, 19 bp, Homo sapiens
acacttcagagagctggta

SEQ ID NO: 3703434 - DNA, 19 bp, Homo sapiens
acacttccaccagcctgca

SEQ ID NO: 3703435 - DNA, 13 bp, Homo sapiens
acacttcctgtcc

SEQ ID NO: 3703436 - DNA, 20 bp, Homo sapiens
acacttctgtgagaccccca

SEQ ID NO: 3703437 - DNA, 17 bp, Homo sapiens
acacttggttgggtcct

SEQ ID NO: 3703438 - DNA, 22 bp, Homo sapiens
acacttggttgggtcctcacat

SEQ ID NO: 3703439 - DNA, 19 bp, Homo sapiens
acacttgttccagctcttt

SEQ ID NO: 3703440 - DNA, 15 bp, Homo sapiens
acatctttcacattg

SEQ ID NO: 3703441 - DNA, 13 bp, Homo sapiens
acatgaatatgat

SEQ ID NO: 3703442 - DNA, 17 bp, Homo sapiens
acatgatcttctttata

SEQ ID NO: 3703443 - DNA, 15 bp, Homo sapiens
acatgcaaggcactg

SEQ ID NO: 3703444 - DNA, 20 bp, Homo sapiens
acatgcaaggcactgtacta

SEQ ID NO: 3703445 - DNA, 17 bp, Homo sapiens
acatgcagcccatgccc

SEQ ID NO: 3703446 - DNA, 17 bp, Homo sapiens
acatgcgggctgggcag

SEQ ID NO: 3703447 - DNA, 19 bp, Homo sapiens
acatgcgggctgggcagct

SEQ ID NO: 3703448 - DNA, 21 bp, Homo sapiens
acatgcgggctgggcagctgt

SEQ ID NO: 3703449 - DNA, 22 bp, Homo sapiens
acatgcgggctgggcagctgtt

SEQ ID NO: 3703450 - DNA, 21 bp, Homo sapiens
acatgctacctgatcccactc

SEQ ID NO: 3703451 - DNA, 14 bp, Homo sapiens
acatgctgaacatc

SEQ ID NO: 3703452 - DNA, 23 bp, Homo sapiens
acatgcttcatgaaaatcctacc

SEQ ID NO: 3703453 - DNA, 16 bp, Homo sapiens
acatgcttttcttcct

SEQ ID NO: 3703454 - DNA, 15 bp, Homo sapiens
acatggagtatatgt

SEQ ID NO: 3703455 - DNA, 19 bp, Homo sapiens
acatggagtatatgtcaag

SEQ ID NO: 3703456 - DNA, 20 bp, Homo sapiens
acatggggttggctgggccc

SEQ ID NO: 3703457 - DNA, 16 bp, Homo sapiens
acatggggttttcaat

SEQ ID NO: 3703458 - DNA, 20 bp, Homo sapiens
acatgtaataaaaagtatat

SEQ ID NO: 3703459 - DNA, 23 bp, Homo sapiens
acatgtaataaaaagtatatgtt

SEQ ID NO: 3703460 - DNA, 15 bp, Homo sapiens
acatgtaattaagta

SEQ ID NO: 3703461 - DNA, 17 bp, Homo sapiens
acatgtaattaagtact

SEQ ID NO: 3703462 - DNA, 21 bp, Homo sapiens
acatgtaattaagtactatgt

SEQ ID NO: 3703463 - DNA, 16 bp, Homo sapiens
acatgtgcacatgcac

SEQ ID NO: 3703464 - DNA, 18 bp, Homo sapiens
acatgtgcacatgcacgt

SEQ ID NO: 3703465 - DNA, 19 bp, Homo sapiens
acatgtggaaagtgaattt

SEQ ID NO: 3703466 - DNA, 15 bp, Homo sapiens
acatgtggtgggaca

SEQ ID NO: 3703467 - DNA, 23 bp, Homo sapiens
acatgtggtgggacagggaccca

SEQ ID NO: 3703468 - DNA, 16 bp, Homo sapiens
acatgtgtgcgtgtgc

SEQ ID NO: 3703469 - DNA, 16 bp, Homo sapiens
acatgttactgaccag

SEQ ID NO: 3703470 - DNA, 15 bp, Homo sapiens
acatgttggtattta

SEQ ID NO: 3703471 - DNA, 20 bp, Homo sapiens
acatgttggtatttatctat

SEQ ID NO: 3703472 - DNA, 21 bp, Homo sapiens
acatgtttttcttctccctca

SEQ ID NO: 3703473 - DNA, 22 bp, Homo sapiens
acattagcagtttgctttgtat

SEQ ID NO: 3703474 - DNA, 14 bp, Homo sapiens
acattatattgcaa

SEQ ID NO: 3703475 - DNA, 17 bp, Homo sapiens
acattatattgcaatga

SEQ ID NO: 3703476 - DNA, 18 bp, Homo sapiens
acattatattgcaatgaa

SEQ ID NO: 3703477 - DNA, 18 bp, Homo sapiens
acattattatcaacaata

SEQ ID NO: 3703478 - DNA, 14 bp, Homo sapiens
acattatttgcatg

SEQ ID NO: 3703479 - DNA, 22 bp, Homo sapiens
acattcaagattaaactgagtg

SEQ ID NO: 3703480 - DNA, 23 bp, Homo sapiens
acattccgacaaccgatgctcca

SEQ ID NO: 3703481 - DNA, 16 bp, Homo sapiens
acattcgatctcattc

SEQ ID NO: 3703482 - DNA, 18 bp, Homo sapiens
acattctgctttcatctt

SEQ ID NO: 3703483 - DNA, 18 bp, Homo sapiens
acattgaagtaatgaatt

SEQ ID NO: 3703484 - DNA, 18 bp, Homo sapiens
acattgaccaagaactgc

SEQ ID NO: 3703485 - DNA, 19 bp, Homo sapiens
acattgaccaagaactgca

SEQ ID NO: 3703486 - DNA, 22 bp, Homo sapiens
acattgcggacagccacggcca

SEQ ID NO: 3703487 - DNA, 19 bp, Homo sapiens
acattgctggtcttgtaag

SEQ ID NO: 3703488 - DNA, 20 bp, Homo sapiens
acattgctggtcttgtaaga

SEQ ID NO: 3703489 - DNA, 14 bp, Homo sapiens
acattgtcaataaa

SEQ ID NO: 3703490 - DNA, 12 bp, Homo sapiens
acattgtctgcg

SEQ ID NO: 3703491 - DNA, 17 bp, Homo sapiens
acatttaaacttgtcag

SEQ ID NO: 3703492 - DNA, 20 bp, Homo sapiens
acatttataatgtttgctat

SEQ ID NO: 3703493 - DNA, 15 bp, Homo sapiens
acatttattctgctc

SEQ ID NO: 3703494 - DNA, 21 bp, Homo sapiens
acatttccccagacctgagct

SEQ ID NO: 3703495 - DNA, 22 bp, Homo sapiens
acatttctaactctgatgtaaa

SEQ ID NO: 3703496 - DNA, 18 bp, Homo sapiens
acatttgggtaaatcatg

SEQ ID NO: 3703497 - DNA, 15 bp, Homo sapiens
acatttgtcacagaa

SEQ ID NO: 3703498 - DNA, 11 bp, Homo sapiens
acattttaaca

SEQ ID NO: 3703499 - DNA, 12 bp, Homo sapiens
acattttaacat

SEQ ID NO: 3703500 - DNA, 13 bp, Homo sapiens
acattttcacaca

SEQ ID NO: 3703501 - DNA, 13 bp, Homo sapiens
acattttcatatg

SEQ ID NO: 3703502 - DNA, 20 bp, Homo sapiens
acatttttgatttcaggttt

SEQ ID NO: 3703503 - DNA, 20 bp, Homo sapiens
acatttttttttttaatttt

SEQ ID NO: 3703504 - DNA, 16 bp, Homo sapiens
accaaaatgacaatga

SEQ ID NO: 3703505 - DNA, 20 bp, Homo sapiens
accaaagcaccttagctggc

SEQ ID NO: 3703506 - DNA, 21 bp, Homo sapiens
accaaagctgacgaggctggg

SEQ ID NO: 3703507 - DNA, 16 bp, Homo sapiens
accaacaagggcagtg

SEQ ID NO: 3703508 - DNA, 21 bp, Homo sapiens
accaacatcccattgccctgg

SEQ ID NO: 3703509 - DNA, 15 bp, Homo sapiens
accaaccctcagagc

SEQ ID NO: 3703510 - DNA, 13 bp, Homo sapiens
accaactggaagc

SEQ ID NO: 3703511 - DNA, 17 bp, Homo sapiens
accaactggaagcacag

SEQ ID NO: 3703512 - DNA, 22 bp, Homo sapiens
accaagatgccatctgtgtcct

SEQ ID NO: 3703513 - DNA, 14 bp, Homo sapiens
accaagcaggaagc

SEQ ID NO: 3703514 - DNA, 17 bp, Homo sapiens
accaagcaggaagctca

SEQ ID NO: 3703515 - DNA, 17 bp, Homo sapiens
accaagccgtggcttcc

SEQ ID NO: 3703516 - DNA, 18 bp, Homo sapiens
accaagccgtggcttccc

SEQ ID NO: 3703517 - DNA, 18 bp, Homo sapiens
accaagctcacagttcct

SEQ ID NO: 3703518 - DNA, 20 bp, Homo sapiens
accaagctgtgaccctcaat

SEQ ID NO: 3703519 - DNA, 17 bp, Homo sapiens
accaaggagatgaagca

SEQ ID NO: 3703520 - DNA, 16 bp, Homo sapiens
accaagtggaccttga

SEQ ID NO: 3703521 - DNA, 23 bp, Homo sapiens
accaagttataaatcaatgtcac

SEQ ID NO: 3703522 - DNA, 13 bp, Homo sapiens
accaagttatata

SEQ ID NO: 3703523 - DNA, 15 bp, Homo sapiens
accaagttatataaa

SEQ ID NO: 3703524 - DNA, 22 bp, Homo sapiens
accaagttatataaagagaaaa

SEQ ID NO: 3703525 - DNA, 13 bp, Homo sapiens
accaatatttgta

SEQ ID NO: 3703526 - DNA, 16 bp, Homo sapiens
accaattcaacccttt

SEQ ID NO: 3703527 - DNA, 17 bp, Homo sapiens
accacaatgcagtgcct

SEQ ID NO: 3703528 - DNA, 15 bp, Homo sapiens
accacacccagccca

SEQ ID NO: 3703529 - DNA, 15 bp, Homo sapiens
accacacctccctga

SEQ ID NO: 3703530 - DNA, 22 bp, Homo sapiens
accacacctccctgaaccatcc

SEQ ID NO: 3703531 - DNA, 16 bp, Homo sapiens
accacacttcctgtcc

SEQ ID NO: 3703532 - DNA, 22 bp, Homo sapiens
accacagggttcaaaatgtctg

SEQ ID NO: 3703533 - DNA, 12 bp, Homo sapiens
accacagtgtct

SEQ ID NO: 3703534 - DNA, 21 bp, Homo sapiens
accacatcctccgtccagccg

SEQ ID NO: 3703535 - DNA, 17 bp, Homo sapiens
accacatcttgctctgc

SEQ ID NO: 3703536 - DNA, 23 bp, Homo sapiens
accaccacttatgcccctagaag

SEQ ID NO: 3703537 - DNA, 13 bp, Homo sapiens
accaccaggtctc

SEQ ID NO: 3703538 - DNA, 13 bp, Homo sapiens
accaccgctcccc

SEQ ID NO: 3703539 - DNA, 14 bp, Homo sapiens
accaccgctcccca

SEQ ID NO: 3703540 - DNA, 17 bp, Homo sapiens
accacctcaaatttaaa

SEQ ID NO: 3703541 - DNA, 17 bp, Homo sapiens
accaccttcccagctct

SEQ ID NO: 3703542 - DNA, 19 bp, Homo sapiens
accaccttcccagctctcc

SEQ ID NO: 3703543 - DNA, 20 bp, Homo sapiens
accaccttcccagctctccc

SEQ ID NO: 3703544 - DNA, 21 bp, Homo sapiens
accaccttcccagctctccct

SEQ ID NO: 3703545 - DNA, 17 bp, Homo sapiens
accaccttttattacat

SEQ ID NO: 3703546 - DNA, 14 bp, Homo sapiens
accacgctggacct

SEQ ID NO: 3703547 - DNA, 14 bp, Homo sapiens
accacggaaaagag

SEQ ID NO: 3703548 - DNA, 13 bp, Homo sapiens
agctctgcttgcc

SEQ ID NO: 3703549 - DNA, 21 bp, Homo sapiens
agctctgcttgccgaaactgg

SEQ ID NO: 3703550 - DNA, 16 bp, Homo sapiens
agctctggagccacct

SEQ ID NO: 3703551 - DNA, 18 bp, Homo sapiens
agctctggagccacctgt

SEQ ID NO: 3703552 - DNA, 19 bp, Homo sapiens
agctctggagccacctgtc

SEQ ID NO: 3703553 - DNA, 20 bp, Homo sapiens
agctctggcttccagaaaac

SEQ ID NO: 3703554 - DNA, 12 bp, Homo sapiens
agctctgtcctg

SEQ ID NO: 3703555 - DNA, 21 bp, Homo sapiens
agctctgtcctgggagtgagc

SEQ ID NO: 3703556 - DNA, 18 bp, Homo sapiens
agctctgtgttgccatgt

SEQ ID NO: 3703557 - DNA, 15 bp, Homo sapiens
agctcttcaggcctc

SEQ ID NO: 3703558 - DNA, 12 bp, Homo sapiens
agctgaaatact

SEQ ID NO: 3703559 - DNA, 24 bp, Homo sapiens
agctgaacagtgttggctttcatg

SEQ ID NO: 3703560 - DNA, 14 bp, Homo sapiens
agctgaagccgcca

SEQ ID NO: 3703561 - DNA, 16 bp, Homo sapiens
agctgacccagcccct

SEQ ID NO: 3703562 - DNA, 23 bp, Homo sapiens
agctgacccagccccttgagaaa

SEQ ID NO: 3703563 - DNA, 18 bp, Homo sapiens
agctgacgaggctgggcc

SEQ ID NO: 3703564 - DNA, 13 bp, Homo sapiens
agctgactgtggc

SEQ ID NO: 3703565 - DNA, 14 bp, Homo sapiens
agctgactgtggcc

SEQ ID NO: 3703566 - DNA, 19 bp, Homo sapiens
agctgactgtggccccctc

SEQ ID NO: 3703567 - DNA, 15 bp, Homo sapiens
agctgagaatagaag

SEQ ID NO: 3703568 - DNA, 20 bp, Homo sapiens
agctgagaatagaaggaaac

SEQ ID NO: 3703569 - DNA, 13 bp, Homo sapiens
agctgagcaggga

SEQ ID NO: 3703570 - DNA, 21 bp, Homo sapiens
agctgaggtctcttgagggag

SEQ ID NO: 3703571 - DNA, 23 bp, Homo sapiens
agctgaggtctcttgagggagct

SEQ ID NO: 3703572 - DNA, 15 bp, Homo sapiens
agctgagtgagctga

SEQ ID NO: 3703573 - DNA, 16 bp, Homo sapiens
agctgattttaacaat

SEQ ID NO: 3703574 - DNA, 13 bp, Homo sapiens
agctgcaccctca

SEQ ID NO: 3703575 - DNA, 17 bp, Homo sapiens
agctgcaccctcaggca

SEQ ID NO: 3703576 - DNA, 18 bp, Homo sapiens
agctgcaccctcaggcag

SEQ ID NO: 3703577 - DNA, 22 bp, Homo sapiens
agctgcaccctcaggcaggtgg

SEQ ID NO: 3703578 - DNA, 16 bp, Homo sapiens
agctgcacctgccagc

SEQ ID NO: 3703579 - DNA, 13 bp, Homo sapiens
agctgcagtgagc

SEQ ID NO: 3703580 - DNA, 22 bp, Homo sapiens
agctgccaagtaaatagcaaca

SEQ ID NO: 3703581 - DNA, 14 bp, Homo sapiens
agctgccagagaag

SEQ ID NO: 3703582 - DNA, 13 bp, Homo sapiens
agctgcccctccc

SEQ ID NO: 3703583 - DNA, 18 bp, Homo sapiens
agctgccgaccagagccc

SEQ ID NO: 3703584 - DNA, 14 bp, Homo sapiens
agctgcctaagagg

SEQ ID NO: 3703585 - DNA, 21 bp, Homo sapiens
agctgcctggaagagcagccc

SEQ ID NO: 3703586 - DNA, 10 bp, Homo sapiens
agctgcctgt

SEQ ID NO: 3703587 - DNA, 20 bp, Homo sapiens
agctgcctgtagttaggaaa

SEQ ID NO: 3703588 - DNA, 23 bp, Homo sapiens
agctgcctgtagttaggaaataa

SEQ ID NO: 3703589 - DNA, 18 bp, Homo sapiens
agctgcggtccacccagg

SEQ ID NO: 3703590 - DNA, 14 bp, Homo sapiens
agctgctcccctcc

SEQ ID NO: 3703591 - DNA, 19 bp, Homo sapiens
agctgctcccctccctcct

SEQ ID NO: 3703592 - DNA, 13 bp, Homo sapiens
agctgctctgccc

SEQ ID NO: 3703593 - DNA, 14 bp, Homo sapiens
agctgctctgccca

SEQ ID NO: 3703594 - DNA, 15 bp, Homo sapiens
agctgctctgcccag

SEQ ID NO: 3703595 - DNA, 13 bp, Homo sapiens
agctgctgacagt

SEQ ID NO: 3703596 - DNA, 14 bp, Homo sapiens
agctgctgacagtg

SEQ ID NO: 3703597 - DNA, 18 bp, Homo sapiens
agctggaattttttattc

SEQ ID NO: 3703598 - DNA, 15 bp, Homo sapiens
agctggaccagtggt

SEQ ID NO: 3703599 - DNA, 22 bp, Homo sapiens
agctggatctccattctctcag

SEQ ID NO: 3703600 - DNA, 16 bp, Homo sapiens
agctggcagcagagtg

SEQ ID NO: 3703601 - DNA, 15 bp, Homo sapiens
agctggcattacagc

SEQ ID NO: 3703602 - DNA, 21 bp, Homo sapiens
agctggccgagggtcctggct

SEQ ID NO: 3703603 - DNA, 16 bp, Homo sapiens
agctgggactacaggc

SEQ ID NO: 3703604 - DNA, 19 bp, Homo sapiens
agctgggactacaggcacc

SEQ ID NO: 3703605 - DNA, 16 bp, Homo sapiens
agctgggactacaggt

SEQ ID NO: 3703606 - DNA, 14 bp, Homo sapiens
agctgggaggaaaa

SEQ ID NO: 3703607 - DNA, 15 bp, Homo sapiens
agctgggaggaaaag

SEQ ID NO: 3703608 - DNA, 14 bp, Homo sapiens
agctgggcaggttg

SEQ ID NO: 3703609 - DNA, 20 bp, Homo sapiens
agctgggtaatcgatggggg

SEQ ID NO: 3703610 - DNA, 22 bp, Homo sapiens
agctgggtgtcaagagggtctg

SEQ ID NO: 3703611 - DNA, 14 bp, Homo sapiens
agctgggttggaaa

SEQ ID NO: 3703612 - DNA, 15 bp, Homo sapiens
agctggtagttagta

SEQ ID NO: 3703613 - DNA, 19 bp, Homo sapiens
agctggtagttagtagcat

SEQ ID NO: 3703614 - DNA, 22 bp, Homo sapiens
agctggtagttagtagcatgtt

SEQ ID NO: 3703615 - DNA, 12 bp, Homo sapiens
agctggtgcatt

SEQ ID NO: 3703616 - DNA, 18 bp, Homo sapiens
agctggtgcattacagag

SEQ ID NO: 3703617 - DNA, 21 bp, Homo sapiens
agctggtgcattacagagagg

SEQ ID NO: 3703618 - DNA, 21 bp, Homo sapiens
agctggtggtatctgagttga

SEQ ID NO: 3703619 - DNA, 16 bp, Homo sapiens
agctggttgaggtttc

SEQ ID NO: 3703620 - DNA, 22 bp, Homo sapiens
agctggtttcctcattcctgaa

SEQ ID NO: 3703621 - DNA, 20 bp, Homo sapiens
agctgtaggtgtgcgggacc

SEQ ID NO: 3703622 - DNA, 18 bp, Homo sapiens
agctgtgctctggacagg

SEQ ID NO: 3703623 - DNA, 20 bp, Homo sapiens
agctgtgctctggacaggca

SEQ ID NO: 3703624 - DNA, 23 bp, Homo sapiens
agctgtgctctggacaggcatgt

SEQ ID NO: 3703625 - DNA, 18 bp, Homo sapiens
agctgttactgtcttcag

SEQ ID NO: 3703626 - DNA, 13 bp, Homo sapiens
agctgttcagctg

SEQ ID NO: 3703627 - DNA, 15 bp, Homo sapiens
agctgttgagctgtt

SEQ ID NO: 3703628 - DNA, 17 bp, Homo sapiens
agctgttgagctgtttt

SEQ ID NO: 3703629 - DNA, 19 bp, Homo sapiens
agctgtttatggcctcagc

SEQ ID NO: 3703630 - DNA, 20 bp, Homo sapiens
agctgtttatggcctcagct

SEQ ID NO: 3703631 - DNA, 14 bp, Homo sapiens
agcttacatgagaa

SEQ ID NO: 3703632 - DNA, 17 bp, Homo sapiens
agcttacctcccacctt

SEQ ID NO: 3703633 - DNA, 13 bp, Homo sapiens
agcttatcaattt

SEQ ID NO: 3703634 - DNA, 14 bp, Homo sapiens
agcttatctcaggg

SEQ ID NO: 3703635 - DNA, 15 bp, Homo sapiens
agcttatctcagggg

SEQ ID NO: 3703636 - DNA, 14 bp, Homo sapiens
agcttattaatgct

SEQ ID NO: 3703637 - DNA, 19 bp, Homo sapiens
agcttattaatgctaaggg

SEQ ID NO: 3703638 - DNA, 12 bp, Homo sapiens
agcttatttaat

SEQ ID NO: 3703639 - DNA, 20 bp, Homo sapiens
agcttatttcctcattttta

SEQ ID NO: 3703640 - DNA, 21 bp, Homo sapiens
agcttcaagtctgtgcctgga

SEQ ID NO: 3703641 - DNA, 17 bp, Homo sapiens
agcttcatgcctttgta

SEQ ID NO: 3703642 - DNA, 14 bp, Homo sapiens
agcttccaggaaaa

SEQ ID NO: 3703643 - DNA, 21 bp, Homo sapiens
agcttccaggctgcatagaag

SEQ ID NO: 3703644 - DNA, 14 bp, Homo sapiens
agcttctctttaac

SEQ ID NO: 3703645 - DNA, 22 bp, Homo sapiens
agcttcttaatataactgcctt

SEQ ID NO: 3703646 - DNA, 22 bp, Homo sapiens
agcttgaaagttttcagaacct

SEQ ID NO: 3703647 - DNA, 22 bp, Homo sapiens
agcttgaagatcgttagtatct

SEQ ID NO: 3703648 - DNA, 19 bp, Homo sapiens
agcttgaaggatctgtttt

SEQ ID NO: 3703649 - DNA, 14 bp, Homo sapiens
agcttgctcttcag

SEQ ID NO: 3703650 - DNA, 22 bp, Homo sapiens
agcttgctcttcagtgggagaa

SEQ ID NO: 3703651 - DNA, 16 bp, Homo sapiens
agcttgctgccctagg

SEQ ID NO: 3703652 - DNA, 23 bp, Homo sapiens
agcttggaaactggatgaggtca

SEQ ID NO: 3703653 - DNA, 12 bp, Homo sapiens
agcttgggaatg

SEQ ID NO: 3703654 - DNA, 21 bp, Homo sapiens
agcttgggggatgactagagg

SEQ ID NO: 3703655 - DNA, 19 bp, Homo sapiens
agcttgtaaatagctcagg

SEQ ID NO: 3703656 - DNA, 22 bp, Homo sapiens
agcttgtccaacccgaggcccg

SEQ ID NO: 3703657 - DNA, 18 bp, Homo sapiens
agctttaccctcaggcat

SEQ ID NO: 3703658 - DNA, 22 bp, Homo sapiens
agctttatgtaataatgtgaat

SEQ ID NO: 3703659 - DNA, 22 bp, Homo sapiens
agctttattttttaagtattta

SEQ ID NO: 3703660 - DNA, 23 bp, Homo sapiens
agctttcctttttcccaataaat

SEQ ID NO: 3703661 - DNA, 20 bp, Homo sapiens
agctttctgtccttttggca

SEQ ID NO: 3703662 - DNA, 19 bp, Homo sapiens
agcctgtgcctctgggact

SEQ ID NO: 3703663 - DNA, 21 bp, Homo sapiens
agcctgtgcctctgggactgg

SEQ ID NO: 3703664 - DNA, 11 bp, Homo sapiens
agcctgtggca

SEQ ID NO: 3703665 - DNA, 21 bp, Homo sapiens
agcctgtggcatctttgcctt

SEQ ID NO: 3703666 - DNA, 19 bp, Homo sapiens
agcctgtggttacagtgca

SEQ ID NO: 3703667 - DNA, 20 bp, Homo sapiens
agccttagaagtcacacagt

SEQ ID NO: 3703668 - DNA, 23 bp, Homo sapiens
agccttcagtcttgaatttctaa

SEQ ID NO: 3703669 - DNA, 19 bp, Homo sapiens
agccttccccctcccaggg

SEQ ID NO: 3703670 - DNA, 19 bp, Homo sapiens
agccttggataatgctgtt

SEQ ID NO: 3703671 - DNA, 22 bp, Homo sapiens
agccttggataatgctgttgcc

SEQ ID NO: 3703672 - DNA, 16 bp, Homo sapiens
agccttggatgtatat

SEQ ID NO: 3703673 - DNA, 14 bp, Homo sapiens
agcctttccataag

SEQ ID NO: 3703674 - DNA, 16 bp, Homo sapiens
agcctttctcccaggc

SEQ ID NO: 3703675 - DNA, 15 bp, Homo sapiens
agcctttgcctcccc

SEQ ID NO: 3703676 - DNA, 13 bp, Homo sapiens
agcgagccctggt

SEQ ID NO: 3703677 - DNA, 17 bp, Homo sapiens
agcgaggctctaaccac

SEQ ID NO: 3703678 - DNA, 24 bp, Homo sapiens
agcgaggctgagcctacagatgaa

SEQ ID NO: 3703679 - DNA, 19 bp, Homo sapiens
agcgattcttctgcttcag

SEQ ID NO: 3703680 - DNA, 22 bp, Homo sapiens
agcgcctagtggggtctccctc

SEQ ID NO: 3703681 - DNA, 18 bp, Homo sapiens
agcgcctgcccctcccag

SEQ ID NO: 3703682 - DNA, 12 bp, Homo sapiens
agcgcgccactc

SEQ ID NO: 3703683 - DNA, 20 bp, Homo sapiens
agcgcgccactcgcttcccc

SEQ ID NO: 3703684 - DNA, 20 bp, Homo sapiens
agcgctagaggaagcagcca

SEQ ID NO: 3703685 - DNA, 19 bp, Homo sapiens
agcgctgccgcaccccaga

SEQ ID NO: 3703686 - DNA, 20 bp, Homo sapiens
agcgctgccgcaccccagag

SEQ ID NO: 3703687 - DNA, 19 bp, Homo sapiens
agcggagttcctaacagga

SEQ ID NO: 3703688 - DNA, 16 bp, Homo sapiens
agcggctgagtcatga

SEQ ID NO: 3703689 - DNA, 19 bp, Homo sapiens
agcggctgagtcatgatct

SEQ ID NO: 3703690 - DNA, 21 bp, Homo sapiens
agcggctgagtcatgatctcc

SEQ ID NO: 3703691 - DNA, 23 bp, Homo sapiens
agcggctggcagcccacccctca

SEQ ID NO: 3703692 - DNA, 19 bp, Homo sapiens
agcggctggtgcagggcct

SEQ ID NO: 3703693 - DNA, 15 bp, Homo sapiens
agcggggacagctcc

SEQ ID NO: 3703694 - DNA, 16 bp, Homo sapiens
agcggggacagctcct

SEQ ID NO: 3703695 - DNA, 20 bp, Homo sapiens
agcggggacagctccttctg

SEQ ID NO: 3703696 - DNA, 22 bp, Homo sapiens
agcggggacagctccttctgtc

SEQ ID NO: 3703697 - DNA, 19 bp, Homo sapiens
agcggtttggggagcagag

SEQ ID NO: 3703698 - DNA, 16 bp, Homo sapiens
agcgtccttccccctg

SEQ ID NO: 3703699 - DNA, 23 bp, Homo sapiens
agcgtgaaggccgagaagcaaga

SEQ ID NO: 3703700 - DNA, 16 bp, Homo sapiens
agcgtgagccactgca

SEQ ID NO: 3703701 - DNA, 19 bp, Homo sapiens
agcgtgagccactgcaccg

SEQ ID NO: 3703702 - DNA, 22 bp, Homo sapiens
agcgtgagccactgcaccgggc

SEQ ID NO: 3703703 - DNA, 15 bp, Homo sapiens
agcgtgcataagtta

SEQ ID NO: 3703704 - DNA, 16 bp, Homo sapiens
agctaaagcccaacct

SEQ ID NO: 3703705 - DNA, 13 bp, Homo sapiens
agctaaatccttt

SEQ ID NO: 3703706 - DNA, 16 bp, Homo sapiens
agctaacactggcccc

SEQ ID NO: 3703707 - DNA, 18 bp, Homo sapiens
agctaacactggccccta

SEQ ID NO: 3703708 - DNA, 23 bp, Homo sapiens
agctaacccccttctactgagcc

SEQ ID NO: 3703709 - DNA, 16 bp, Homo sapiens
agctaataaaatatca

SEQ ID NO: 3703710 - DNA, 17 bp, Homo sapiens
agctaataaaatatcat

SEQ ID NO: 3703711 - DNA, 19 bp, Homo sapiens
agctaataaaatatcattc

SEQ ID NO: 3703712 - DNA, 16 bp, Homo sapiens
agctaatcagcattct

SEQ ID NO: 3703713 - DNA, 17 bp, Homo sapiens
agctaatggaaaatgat

SEQ ID NO: 3703714 - DNA, 14 bp, Homo sapiens
agctaatgggacac

SEQ ID NO: 3703715 - DNA, 15 bp, Homo sapiens
agctaattattttaa

SEQ ID NO: 3703716 - DNA, 14 bp, Homo sapiens
agctacaggaagca

SEQ ID NO: 3703717 - DNA, 14 bp, Homo sapiens
agctaccatgacaa

SEQ ID NO: 3703718 - DNA, 16 bp, Homo sapiens
agctactaatgatgtt

SEQ ID NO: 3703719 - DNA, 22 bp, Homo sapiens
agctactcaagaggctgaggca

SEQ ID NO: 3703720 - DNA, 20 bp, Homo sapiens
agctactcagaagcctgagg

SEQ ID NO: 3703721 - DNA, 21 bp, Homo sapiens
agctactcagaagcctgaggc

SEQ ID NO: 3703722 - DNA, 15 bp, Homo sapiens
agctactcaggaggc

SEQ ID NO: 3703723 - DNA, 15 bp, Homo sapiens
agctagaagtgggcc

SEQ ID NO: 3703724 - DNA, 19 bp, Homo sapiens
agctagcaaaagaagtaac

SEQ ID NO: 3703725 - DNA, 20 bp, Homo sapiens
agctagcaaaagaagtaaca

SEQ ID NO: 3703726 - DNA, 12 bp, Homo sapiens
agctaggaatga

SEQ ID NO: 3703727 - DNA, 15 bp, Homo sapiens
agctaggcctggcca

SEQ ID NO: 3703728 - DNA, 21 bp, Homo sapiens
agctaggcctggccagatgca

SEQ ID NO: 3703729 - DNA, 17 bp, Homo sapiens
agctatagacccgagga

SEQ ID NO: 3703730 - DNA, 18 bp, Homo sapiens
agctatagacccgaggaa

SEQ ID NO: 3703731 - DNA, 14 bp, Homo sapiens
agctatatccatgt

SEQ ID NO: 3703732 - DNA, 22 bp, Homo sapiens
agctatatttaagtattcaaga

SEQ ID NO: 3703733 - DNA, 14 bp, Homo sapiens
agctatcaggaaca

SEQ ID NO: 3703734 - DNA, 15 bp, Homo sapiens
agctatctaggtgga

SEQ ID NO: 3703735 - DNA, 17 bp, Homo sapiens
agctatctctcagtgaa

SEQ ID NO: 3703736 - DNA, 18 bp, Homo sapiens
agctatgggagccccagg

SEQ ID NO: 3703737 - DNA, 13 bp, Homo sapiens
agctcaaaggcac

SEQ ID NO: 3703738 - DNA, 13 bp, Homo sapiens
agctcaccagccc

SEQ ID NO: 3703739 - DNA, 14 bp, Homo sapiens
agctcaccagcccc

SEQ ID NO: 3703740 - DNA, 16 bp, Homo sapiens
agctcaccagccccag

SEQ ID NO: 3703741 - DNA, 20 bp, Homo sapiens
agctcaccagccccagtgcc

SEQ ID NO: 3703742 - DNA, 21 bp, Homo sapiens
agctcaccagccccagtgccc

SEQ ID NO: 3703743 - DNA, 16 bp, Homo sapiens
agctcacgtcacactt

SEQ ID NO: 3703744 - DNA, 18 bp, Homo sapiens
agctcagacccccactct

SEQ ID NO: 3703745 - DNA, 20 bp, Homo sapiens
agctcagacccccactctca

SEQ ID NO: 3703746 - DNA, 15 bp, Homo sapiens
agctcagcccacccc

SEQ ID NO: 3703747 - DNA, 17 bp, Homo sapiens
agctcagccccagccca

SEQ ID NO: 3703748 - DNA, 20 bp, Homo sapiens
agctcagctttttgtctttt

SEQ ID NO: 3703749 - DNA, 22 bp, Homo sapiens
agctcagctttttgtcttttct

SEQ ID NO: 3703750 - DNA, 17 bp, Homo sapiens
agctcaggtgtccctgc

SEQ ID NO: 3703751 - DNA, 21 bp, Homo sapiens
agctcaggtgtccctgcactt

SEQ ID NO: 3703752 - DNA, 22 bp, Homo sapiens
agctcaggtgtccctgcacttg

SEQ ID NO: 3703753 - DNA, 19 bp, Homo sapiens
agctcagtttatccaaggt

SEQ ID NO: 3703754 - DNA, 22 bp, Homo sapiens
agctccacaccctctcccagga

SEQ ID NO: 3703755 - DNA, 14 bp, Homo sapiens
agctccagaccccc

SEQ ID NO: 3703756 - DNA, 17 bp, Homo sapiens
agctccagacccccagc

SEQ ID NO: 3703757 - DNA, 19 bp, Homo sapiens
agctccagctcaccagccc

SEQ ID NO: 3703758 - DNA, 13 bp, Homo sapiens
agctccagggcca

SEQ ID NO: 3703759 - DNA, 17 bp, Homo sapiens
agctccagtcctgctct

SEQ ID NO: 3703760 - DNA, 14 bp, Homo sapiens
agctccagtggaag

SEQ ID NO: 3703761 - DNA, 20 bp, Homo sapiens
agctccagtggaagaagaaa

SEQ ID NO: 3703762 - DNA, 13 bp, Homo sapiens
agctccatctcca

SEQ ID NO: 3703763 - DNA, 21 bp, Homo sapiens
agctccatctccactccagat

SEQ ID NO: 3703764 - DNA, 23 bp, Homo sapiens
agctcccaccccacccccttcag

SEQ ID NO: 3703765 - DNA, 20 bp, Homo sapiens
agctccccaccaccccagct

SEQ ID NO: 3703766 - DNA, 21 bp, Homo sapiens
agctccccgcttctgcctgca

SEQ ID NO: 3703767 - DNA, 15 bp, Homo sapiens
agctccctaggagac

SEQ ID NO: 3703768 - DNA, 15 bp, Homo sapiens
agctcctctgggcag

SEQ ID NO: 3703769 - DNA, 20 bp, Homo sapiens
agctcctctgggcaggacct

SEQ ID NO: 3703770 - DNA, 13 bp, Homo sapiens
agctcctcttcct

SEQ ID NO: 3703771 - DNA, 16 bp, Homo sapiens
agctcggtggacccag

SEQ ID NO: 3703772 - DNA, 20 bp, Homo sapiens
agctctagacaaccctgcaa

SEQ ID NO: 3703773 - DNA, 18 bp, Homo sapiens
agctctccctctggccct

SEQ ID NO: 3703774 - DNA, 22 bp, Homo sapiens
agctctccctctggccctgcct

SEQ ID NO: 3703775 - DNA, 20 bp, Homo sapiens
agctctgaggactgcaccat

SEQ ID NO: 3703776 - DNA, 13 bp, Homo sapiens
agcatgctttctg

SEQ ID NO: 3703777 - DNA, 16 bp, Homo sapiens
agcatggagaacagtg

SEQ ID NO: 3703778 - DNA, 17 bp, Homo sapiens
agcatgtggcatgttca

SEQ ID NO: 3703779 - DNA, 20 bp, Homo sapiens
agcatgttgagccaggcctg

SEQ ID NO: 3703780 - DNA, 18 bp, Homo sapiens
agcattactcttgtaaga

SEQ ID NO: 3703781 - DNA, 22 bp, Homo sapiens
agcattcaatttattcaagaaa

SEQ ID NO: 3703782 - DNA, 20 bp, Homo sapiens
agcattcttagcctgtggca

SEQ ID NO: 3703783 - DNA, 23 bp, Homo sapiens
agcattcttagcctgtggcagta

SEQ ID NO: 3703784 - DNA, 20 bp, Homo sapiens
agcattcttgtcacaataaa

SEQ ID NO: 3703785 - DNA, 12 bp, Homo sapiens
agcattgctttc

SEQ ID NO: 3703786 - DNA, 14 bp, Homo sapiens
agcattgctttctg

SEQ ID NO: 3703787 - DNA, 17 bp, Homo sapiens
agcatttactttgaatt

SEQ ID NO: 3703788 - DNA, 23 bp, Homo sapiens
agcattttagcaatttatacaat

SEQ ID NO: 3703789 - DNA, 19 bp, Homo sapiens
agccaaacccatgaggcaa

SEQ ID NO: 3703790 - DNA, 14 bp, Homo sapiens
agccaaaccctgtc

SEQ ID NO: 3703791 - DNA, 14 bp, Homo sapiens
agccaaactctgcc

SEQ ID NO: 3703792 - DNA, 13 bp, Homo sapiens
agccaaaggtcta

SEQ ID NO: 3703793 - DNA, 23 bp, Homo sapiens
agccaaatgtggcatttgtgatc

SEQ ID NO: 3703794 - DNA, 15 bp, Homo sapiens
agccaacttttgcat

SEQ ID NO: 3703795 - DNA, 15 bp, Homo sapiens
agccaagctccttgg

SEQ ID NO: 3703796 - DNA, 17 bp, Homo sapiens
agccaagctccttggga

SEQ ID NO: 3703797 - DNA, 23 bp, Homo sapiens
agccaagctccttgggaggcccc

SEQ ID NO: 3703798 - DNA, 19 bp, Homo sapiens
agccaaggtgggctgagcc

SEQ ID NO: 3703799 - DNA, 20 bp, Homo sapiens
agccaaggtgggctgagccc

SEQ ID NO: 3703800 - DNA, 23 bp, Homo sapiens
agccaagtgtggtagagtgtgcc

SEQ ID NO: 3703801 - DNA, 21 bp, Homo sapiens
agccacagcccaggcctccag

SEQ ID NO: 3703802 - DNA, 13 bp, Homo sapiens
agccacagctggt

SEQ ID NO: 3703803 - DNA, 18 bp, Homo sapiens
agccaccccagaaatggt

SEQ ID NO: 3703804 - DNA, 21 bp, Homo sapiens
agccaccccgggctctctgct

SEQ ID NO: 3703805 - DNA, 23 bp, Homo sapiens
agccaccccgggctctctgctgt

SEQ ID NO: 3703806 - DNA, 21 bp, Homo sapiens
agccaccgctgccagcacaga

SEQ ID NO: 3703807 - DNA, 14 bp, Homo sapiens
agccacctctcttt

SEQ ID NO: 3703808 - DNA, 20 bp, Homo sapiens
agccacgttccttactgcag

SEQ ID NO: 3703809 - DNA, 21 bp, Homo sapiens
agccacgttccttactgcaga

SEQ ID NO: 3703810 - DNA, 22 bp, Homo sapiens
agccacgttccttactgcagaa

SEQ ID NO: 3703811 - DNA, 22 bp, Homo sapiens
agccactcaggaggctgaggca

SEQ ID NO: 3703812 - DNA, 13 bp, Homo sapiens
agccactctgttc

SEQ ID NO: 3703813 - DNA, 15 bp, Homo sapiens
agccactctgttcct

SEQ ID NO: 3703814 - DNA, 13 bp, Homo sapiens
agccactgcaccg

SEQ ID NO: 3703815 - DNA, 16 bp, Homo sapiens
agccactgcaccgggc

SEQ ID NO: 3703816 - DNA, 18 bp, Homo sapiens
agccactgcaccgggcca

SEQ ID NO: 3703817 - DNA, 15 bp, Homo sapiens
agccacttaccttca

SEQ ID NO: 3703818 - DNA, 17 bp, Homo sapiens
agccacttaccttcaat

SEQ ID NO: 3703819 - DNA, 23 bp, Homo sapiens
agccacttaccttcaataaagta

SEQ ID NO: 3703820 - DNA, 19 bp, Homo sapiens
agccagaaataaagttggt

SEQ ID NO: 3703821 - DNA, 14 bp, Homo sapiens
agccagaagctgag

SEQ ID NO: 3703822 - DNA, 11 bp, Homo sapiens
agccagcagcc

SEQ ID NO: 3703823 - DNA, 14 bp, Homo sapiens
agccagcagccagc

SEQ ID NO: 3703824 - DNA, 14 bp, Homo sapiens
agccagcccagccc

SEQ ID NO: 3703825 - DNA, 17 bp, Homo sapiens
agccagcccagcccagc

SEQ ID NO: 3703826 - DNA, 18 bp, Homo sapiens
agccagcccagcccagct

SEQ ID NO: 3703827 - DNA, 12 bp, Homo sapiens
agccagccctcc

SEQ ID NO: 3703828 - DNA, 16 bp, Homo sapiens
agccagccctccctgt

SEQ ID NO: 3703829 - DNA, 18 bp, Homo sapiens
agccagccctccctgtcc

SEQ ID NO: 3703830 - DNA, 13 bp, Homo sapiens
agccagctctcag

SEQ ID NO: 3703831 - DNA, 16 bp, Homo sapiens
agccagctgccgacca

SEQ ID NO: 3703832 - DNA, 18 bp, Homo sapiens
agccaggagctgggcaga

SEQ ID NO: 3703833 - DNA, 13 bp, Homo sapiens
agccgtggcttcc

SEQ ID NO: 3703834 - DNA, 21 bp, Homo sapiens
agccgtggcttcccgctcagc

SEQ ID NO: 3703835 - DNA, 22 bp, Homo sapiens
agccgtggcttcccgctcagcc

SEQ ID NO: 3703836 - DNA, 23 bp, Homo sapiens
agccgtggcttcccgctcagccc

SEQ ID NO: 3703837 - DNA, 23 bp, Homo sapiens
agcctaatccctgggcattgctt

SEQ ID NO: 3703838 - DNA, 13 bp, Homo sapiens
agcctacaggcct

SEQ ID NO: 3703839 - DNA, 14 bp, Homo sapiens
agcctacaggcctc

SEQ ID NO: 3703840 - DNA, 22 bp, Homo sapiens
agcctaccggcaatttccggcc

SEQ ID NO: 3703841 - DNA, 15 bp, Homo sapiens
agcctagaccctcct

SEQ ID NO: 3703842 - DNA, 18 bp, Homo sapiens
agcctagaccctcctcct

SEQ ID NO: 3703843 - DNA, 17 bp, Homo sapiens
agcctagccgacctcag

SEQ ID NO: 3703844 - DNA, 19 bp, Homo sapiens
agcctagccgacctcagcc

SEQ ID NO: 3703845 - DNA, 20 bp, Homo sapiens
agcctagccgacctcagcct

SEQ ID NO: 3703846 - DNA, 14 bp, Homo sapiens
agcctaggggtcag

SEQ ID NO: 3703847 - DNA, 20 bp, Homo sapiens
agcctaggggtcagggacca

SEQ ID NO: 3703848 - DNA, 20 bp, Homo sapiens
agcctcaacctcctgggcta

SEQ ID NO: 3703849 - DNA, 17 bp, Homo sapiens
agcctcacttgaatgtg

SEQ ID NO: 3703850 - DNA, 15 bp, Homo sapiens
agcctcagcatcctg

SEQ ID NO: 3703851 - DNA, 17 bp, Homo sapiens
agcctcagcatcctggc

SEQ ID NO: 3703852 - DNA, 21 bp, Homo sapiens
agcctcagcatcctggcaccc

SEQ ID NO: 3703853 - DNA, 21 bp, Homo sapiens
agcctccaagctccatctcca

SEQ ID NO: 3703854 - DNA, 20 bp, Homo sapiens
agcctccactgcctctggaa

SEQ ID NO: 3703855 - DNA, 18 bp, Homo sapiens
agcctccatgctgcctcc

SEQ ID NO: 3703856 - DNA, 20 bp, Homo sapiens
agcctccatttagttctttg

SEQ ID NO: 3703857 - DNA, 18 bp, Homo sapiens
agcctcccaaagtgctgg

SEQ ID NO: 3703858 - DNA, 18 bp, Homo sapiens
agcctcccgaatagctgg

SEQ ID NO: 3703859 - DNA, 17 bp, Homo sapiens
agcctcccgagtagctg

SEQ ID NO: 3703860 - DNA, 19 bp, Homo sapiens
agcctcccgagtagctggg

SEQ ID NO: 3703861 - DNA, 21 bp, Homo sapiens
agcctccctctgacctgcagg

SEQ ID NO: 3703862 - DNA, 12 bp, Homo sapiens
agcctccctgaa

SEQ ID NO: 3703863 - DNA, 14 bp, Homo sapiens
agcctcctccagcc

SEQ ID NO: 3703864 - DNA, 21 bp, Homo sapiens
agcctcctgtgtagctgggat

SEQ ID NO: 3703865 - DNA, 16 bp, Homo sapiens
agcctcctttctggct

SEQ ID NO: 3703866 - DNA, 20 bp, Homo sapiens
agcctctccggcagaaggga

SEQ ID NO: 3703867 - DNA, 19 bp, Homo sapiens
agcctctgaagttggacag

SEQ ID NO: 3703868 - DNA, 20 bp, Homo sapiens
agcctctgaagttggacagc

SEQ ID NO: 3703869 - DNA, 13 bp, Homo sapiens
agcctctgctgcc

SEQ ID NO: 3703870 - DNA, 18 bp, Homo sapiens
agcctctgctgccatggc

SEQ ID NO: 3703871 - DNA, 12 bp, Homo sapiens
agcctctggcta

SEQ ID NO: 3703872 - DNA, 20 bp, Homo sapiens
agcctgaaatagtggttctt

SEQ ID NO: 3703873 - DNA, 14 bp, Homo sapiens
agcctgcctggagt

SEQ ID NO: 3703874 - DNA, 18 bp, Homo sapiens
agcctgcggcctgctgga

SEQ ID NO: 3703875 - DNA, 16 bp, Homo sapiens
agcctgcgtggctgac

SEQ ID NO: 3703876 - DNA, 18 bp, Homo sapiens
agcctgcgtggctgaccc

SEQ ID NO: 3703877 - DNA, 15 bp, Homo sapiens
agcctgctccagctg

SEQ ID NO: 3703878 - DNA, 17 bp, Homo sapiens
agcctgctccagctgtt

SEQ ID NO: 3703879 - DNA, 11 bp, Homo sapiens
agcctgctccc

SEQ ID NO: 3703880 - DNA, 15 bp, Homo sapiens
agcctgctcccccac

SEQ ID NO: 3703881 - DNA, 21 bp, Homo sapiens
agcctgctcccccaccccctc

SEQ ID NO: 3703882 - DNA, 15 bp, Homo sapiens
agcctggcttctgga

SEQ ID NO: 3703883 - DNA, 23 bp, Homo sapiens
agcctggcttctggagcccttgg

SEQ ID NO: 3703884 - DNA, 18 bp, Homo sapiens
agcctgggcaacagagca

SEQ ID NO: 3703885 - DNA, 18 bp, Homo sapiens
agcctgggcaatgtgata

SEQ ID NO: 3703886 - DNA, 15 bp, Homo sapiens
agcctgggcagccag

SEQ ID NO: 3703887 - DNA, 15 bp, Homo sapiens
agcctgggcgacaga

SEQ ID NO: 3703888 - DNA, 16 bp, Homo sapiens
agcctggtgctgctgc

SEQ ID NO: 3703889 - DNA, 16 bp, Homo sapiens
agcctggtgggcctcc

SEQ ID NO: 3703890 - DNA, 21 bp, Homo sapiens
agcctggtgggcctcctctgt

SEQ ID NO: 3703891 - DNA, 22 bp, Homo sapiens
agcctggtgggcctcctctgtc

SEQ ID NO: 3703892 - DNA, 12 bp, Homo sapiens
agcctgtgcctc

SEQ ID NO: 3703893 - DNA, 17 bp, Homo sapiens
agcctgtgcctctggga

SEQ ID NO: 3703894 - DNA, 18 bp, Homo sapiens
agcctgtgcctctgggac

SEQ ID NO: 3703895 - DNA, 14 bp, Homo sapiens
actggcagcatctt

SEQ ID NO: 3703896 - DNA, 21 bp, Homo sapiens
actggcatctgacacaaaaaa

SEQ ID NO: 3703897 - DNA, 17 bp, Homo sapiens
actggcctgaggagcag

SEQ ID NO: 3703898 - DNA, 19 bp, Homo sapiens
actggcctgaggagcagca

SEQ ID NO: 3703899 - DNA, 21 bp, Homo sapiens
actggctagagtcctcactcc

SEQ ID NO: 3703900 - DNA, 22 bp, Homo sapiens
actggctgcaaagggtatcagg

SEQ ID NO: 3703901 - DNA, 21 bp, Homo sapiens
actggctgtcagtatgacatt

SEQ ID NO: 3703902 - DNA, 17 bp, Homo sapiens
actggctgtgggctccc

SEQ ID NO: 3703903 - DNA, 19 bp, Homo sapiens
actggctgtgggctccctt

SEQ ID NO: 3703904 - DNA, 20 bp, Homo sapiens
actggctgtgggctcccttc

SEQ ID NO: 3703905 - DNA, 21 bp, Homo sapiens
actggctgtgggctcccttcc

SEQ ID NO: 3703906 - DNA, 22 bp, Homo sapiens
actggctgtgggctcccttcct

SEQ ID NO: 3703907 - DNA, 16 bp, Homo sapiens
actggctttgtcccac

SEQ ID NO: 3703908 - DNA, 13 bp, Homo sapiens
actgggggagggg

SEQ ID NO: 3703909 - DNA, 18 bp, Homo sapiens
actgggttggaagaaata

SEQ ID NO: 3703910 - DNA, 14 bp, Homo sapiens
actggtgagcagac

SEQ ID NO: 3703911 - DNA, 21 bp, Homo sapiens
actggtggcccgacagcctgg

SEQ ID NO: 3703912 - DNA, 22 bp, Homo sapiens
actggtggcccgacagcctggc

SEQ ID NO: 3703913 - DNA, 14 bp, Homo sapiens
actgtacaaagtag

SEQ ID NO: 3703914 - DNA, 15 bp, Homo sapiens
actgtacaaagtaga

SEQ ID NO: 3703915 - DNA, 22 bp, Homo sapiens
actgtacaaagtagaagtctta

SEQ ID NO: 3703916 - DNA, 13 bp, Homo sapiens
actgtacacactt

SEQ ID NO: 3703917 - DNA, 17 bp, Homo sapiens
actgtacacactttatt

SEQ ID NO: 3703918 - DNA, 22 bp, Homo sapiens
actgtacacactttatttactt

SEQ ID NO: 3703919 - DNA, 23 bp, Homo sapiens
actgtacacactttatttacttc

SEQ ID NO: 3703920 - DNA, 15 bp, Homo sapiens
actgtagaaatgatg

SEQ ID NO: 3703921 - DNA, 20 bp, Homo sapiens
actgtagattgcttctgtag

SEQ ID NO: 3703922 - DNA, 22 bp, Homo sapiens
actgtagcctcgccgtctgtga

SEQ ID NO: 3703923 - DNA, 13 bp, Homo sapiens
actgtcaataaac

SEQ ID NO: 3703924 - DNA, 18 bp, Homo sapiens
actgtcaataaacagctt

SEQ ID NO: 3703925 - DNA, 13 bp, Homo sapiens
actgtcatagaaa

SEQ ID NO: 3703926 - DNA, 23 bp, Homo sapiens
actgtcctacccaccctcctttc

SEQ ID NO: 3703927 - DNA, 21 bp, Homo sapiens
actgtcctctttcagaaaaca

SEQ ID NO: 3703928 - DNA, 22 bp, Homo sapiens
actgtcctctttcagaaaacag

SEQ ID NO: 3703929 - DNA, 19 bp, Homo sapiens
actgtctcaagagggcact

SEQ ID NO: 3703930 - DNA, 11 bp, Homo sapiens
actgtcttaat

SEQ ID NO: 3703931 - DNA, 19 bp, Homo sapiens
actgtcttaattaagtaaa

SEQ ID NO: 3703932 - DNA, 12 bp, Homo sapiens
actgtcttcagt

SEQ ID NO: 3703933 - DNA, 16 bp, Homo sapiens
actgtgccatgtgcca

SEQ ID NO: 3703934 - DNA, 18 bp, Homo sapiens
actgtgccatgtgccagg

SEQ ID NO: 3703935 - DNA, 19 bp, Homo sapiens
actgtggaaaaatatttaa

SEQ ID NO: 3703936 - DNA, 19 bp, Homo sapiens
actgtggccccctccgtga

SEQ ID NO: 3703937 - DNA, 15 bp, Homo sapiens
actgtggccttggtc

SEQ ID NO: 3703938 - DNA, 12 bp, Homo sapiens
actgtggctgct

SEQ ID NO: 3703939 - DNA, 16 bp, Homo sapiens
actgtgtatgtacata

SEQ ID NO: 3703940 - DNA, 18 bp, Homo sapiens
actgtgtccctctctctg

SEQ ID NO: 3703941 - DNA, 22 bp, Homo sapiens
actgtgtccctctctctggaaa

SEQ ID NO: 3703942 - DNA, 19 bp, Homo sapiens
actgtgtgcagactcaata

SEQ ID NO: 3703943 - DNA, 17 bp, Homo sapiens
actgtgtggactgtgat

SEQ ID NO: 3703944 - DNA, 15 bp, Homo sapiens
actgttagaacacta

SEQ ID NO: 3703945 - DNA, 16 bp, Homo sapiens
actgttagaacactat

SEQ ID NO: 3703946 - DNA, 14 bp, Homo sapiens
actgttgccagaga

SEQ ID NO: 3703947 - DNA, 20 bp, Homo sapiens
actgtttacaagaaaaaatg

SEQ ID NO: 3703948 - DNA, 21 bp, Homo sapiens
actgtttgccttctactttta

SEQ ID NO: 3703949 - DNA, 19 bp, Homo sapiens
actgtttttgaaaaattac

SEQ ID NO: 3703950 - DNA, 17 bp, Homo sapiens
actgttttttcctgagc

SEQ ID NO: 3703951 - DNA, 15 bp, Homo sapiens
acttaaaaaaatgac

SEQ ID NO: 3703952 - DNA, 16 bp, Homo sapiens
acttaaaaaaatgaca

SEQ ID NO: 3703953 - DNA, 20 bp, Homo sapiens
acttaaaaagtctgcattac

SEQ ID NO: 3703954 - DNA, 13 bp, Homo sapiens
acttaaatgaaag

SEQ ID NO: 3703955 - DNA, 21 bp, Homo sapiens
acttaacagatgcaatgtgct

SEQ ID NO: 3703956 - DNA, 16 bp, Homo sapiens
acttacactttatgca

SEQ ID NO: 3703957 - DNA, 17 bp, Homo sapiens
acttacactttatgcac

SEQ ID NO: 3703958 - DNA, 23 bp, Homo sapiens
acttacagataggccttcttgtg

SEQ ID NO: 3703959 - DNA, 16 bp, Homo sapiens
acttaccttcaataaa

SEQ ID NO: 3703960 - DNA, 17 bp, Homo sapiens
acttaccttcaataaag

SEQ ID NO: 3703961 - DNA, 16 bp, Homo sapiens
acttagaaattgcatt

SEQ ID NO: 3703962 - DNA, 20 bp, Homo sapiens
acttagaggtggggagcaga

SEQ ID NO: 3703963 - DNA, 15 bp, Homo sapiens
acttagcatgcacaa

SEQ ID NO: 3703964 - DNA, 23 bp, Homo sapiens
acttagcatgcacaaagtgtatt

SEQ ID NO: 3703965 - DNA, 14 bp, Homo sapiens
acttagcttatcaa

SEQ ID NO: 3703966 - DNA, 21 bp, Homo sapiens
acttaggcatgcacagctgta

SEQ ID NO: 3703967 - DNA, 18 bp, Homo sapiens
acttatcctaaaacaaat

SEQ ID NO: 3703968 - DNA, 20 bp, Homo sapiens
acttattcattgtggttatt

SEQ ID NO: 3703969 - DNA, 15 bp, Homo sapiens
acttattgctttgaa

SEQ ID NO: 3703970 - DNA, 14 bp, Homo sapiens
acttatttttgaca

SEQ ID NO: 3703971 - DNA, 22 bp, Homo sapiens
acttatttttgacagtgttgaa

SEQ ID NO: 3703972 - DNA, 16 bp, Homo sapiens
acttcaaaaactgtca

SEQ ID NO: 3703973 - DNA, 16 bp, Homo sapiens
acttcaagttaaagtg

SEQ ID NO: 3703974 - DNA, 16 bp, Homo sapiens
acttcacacacaggca

SEQ ID NO: 3703975 - DNA, 13 bp, Homo sapiens
acttcacactgca

SEQ ID NO: 3703976 - DNA, 19 bp, Homo sapiens
acttcagactgaacatgta

SEQ ID NO: 3703977 - DNA, 16 bp, Homo sapiens
acttcagagagctggt

SEQ ID NO: 3703978 - DNA, 13 bp, Homo sapiens
acttcagctctgt

SEQ ID NO: 3703979 - DNA, 17 bp, Homo sapiens
acttcaggctcttctcc

SEQ ID NO: 3703980 - DNA, 19 bp, Homo sapiens
acttcagggcagggctctg

SEQ ID NO: 3703981 - DNA, 18 bp, Homo sapiens
acttccaatttacatact

SEQ ID NO: 3703982 - DNA, 17 bp, Homo sapiens
acttccactgccatcct

SEQ ID NO: 3703983 - DNA, 17 bp, Homo sapiens
agatgaagagtgagagg

SEQ ID NO: 3703984 - DNA, 19 bp, Homo sapiens
agatgaagcaaacacatta

SEQ ID NO: 3703985 - DNA, 17 bp, Homo sapiens
agatgagaattcagctg

SEQ ID NO: 3703986 - DNA, 13 bp, Homo sapiens
agatgatccatga

SEQ ID NO: 3703987 - DNA, 18 bp, Homo sapiens
agatgcaatgtgctactg

SEQ ID NO: 3703988 - DNA, 16 bp, Homo sapiens
agatgccatctgtgtc

SEQ ID NO: 3703989 - DNA, 12 bp, Homo sapiens
agatgccccaga

SEQ ID NO: 3703990 - DNA, 16 bp, Homo sapiens
agatgccgcatttgga

SEQ ID NO: 3703991 - DNA, 13 bp, Homo sapiens
agatgcctccacc

SEQ ID NO: 3703992 - DNA, 13 bp, Homo sapiens
agatgctctttta

SEQ ID NO: 3703993 - DNA, 21 bp, Homo sapiens
agatgctgaaacaggagagaa

SEQ ID NO: 3703994 - DNA, 15 bp, Homo sapiens
agatggattctcaga

SEQ ID NO: 3703995 - DNA, 16 bp, Homo sapiens
agatggattctcagat

SEQ ID NO: 3703996 - DNA, 15 bp, Homo sapiens
agatggccctctggt

SEQ ID NO: 3703997 - DNA, 22 bp, Homo sapiens
agatggctgactttgctctttc

SEQ ID NO: 3703998 - DNA, 14 bp, Homo sapiens
agatggctgtgcct

SEQ ID NO: 3703999 - DNA, 19 bp, Homo sapiens
agatggctgtgcctctgcc

SEQ ID NO: 3704000 - DNA, 20 bp, Homo sapiens
agatggctgtgcctctgcct

SEQ ID NO: 3704001 - DNA, 14 bp, Homo sapiens
agatggcttttgtt

SEQ ID NO: 3704002 - DNA, 14 bp, Homo sapiens
agatggttacactg

SEQ ID NO: 3704003 - DNA, 21 bp, Homo sapiens
agatgtaagagctttacaaaa

SEQ ID NO: 3704004 - DNA, 19 bp, Homo sapiens
agatgtagataaactcaga

SEQ ID NO: 3704005 - DNA, 21 bp, Homo sapiens
agatgtccctttcttggccag

SEQ ID NO: 3704006 - DNA, 22 bp, Homo sapiens
agatgtccctttcttggccagt

SEQ ID NO: 3704007 - DNA, 18 bp, Homo sapiens
agatgtctaatagttatt

SEQ ID NO: 3704008 - DNA, 23 bp, Homo sapiens
agatgtctttaggcagcagcttt

SEQ ID NO: 3704009 - DNA, 17 bp, Homo sapiens
agatgtttgtcagatat

SEQ ID NO: 3704010 - DNA, 15 bp, Homo sapiens
agattagatctttta

SEQ ID NO: 3704011 - DNA, 16 bp, Homo sapiens
agattagatcttttaa

SEQ ID NO: 3704012 - DNA, 17 bp, Homo sapiens
agattcaattttcttta

SEQ ID NO: 3704013 - DNA, 16 bp, Homo sapiens
agattcacctgtaaaa

SEQ ID NO: 3704014 - DNA, 20 bp, Homo sapiens
agattcacctgtaaaacttt

SEQ ID NO: 3704015 - DNA, 21 bp, Homo sapiens
agattcacctgtaaaacttta

SEQ ID NO: 3704016 - DNA, 19 bp, Homo sapiens
agattcatatttacttctt

SEQ ID NO: 3704017 - DNA, 17 bp, Homo sapiens
agattcatttttctttc

SEQ ID NO: 3704018 - DNA, 14 bp, Homo sapiens
agattcctttccct

SEQ ID NO: 3704019 - DNA, 20 bp, Homo sapiens
agattcctttccctttagca

SEQ ID NO: 3704020 - DNA, 14 bp, Homo sapiens
agattccttttctt

SEQ ID NO: 3704021 - DNA, 17 bp, Homo sapiens
agattccttttcttgtt

SEQ ID NO: 3704022 - DNA, 19 bp, Homo sapiens
agattgagagaagagacaa

SEQ ID NO: 3704023 - DNA, 16 bp, Homo sapiens
agattgcaacaggctg

SEQ ID NO: 3704024 - DNA, 20 bp, Homo sapiens
agattgcaacaggctgggct

SEQ ID NO: 3704025 - DNA, 17 bp, Homo sapiens
agatttaatttgccaaa

SEQ ID NO: 3704026 - DNA, 21 bp, Homo sapiens
agatttaatttgccaaaataa

SEQ ID NO: 3704027 - DNA, 18 bp, Homo sapiens
agatttagtgaaagctag

SEQ ID NO: 3704028 - DNA, 15 bp, Homo sapiens
agatttcagtctttt

SEQ ID NO: 3704029 - DNA, 14 bp, Homo sapiens
agatttgcccattt

SEQ ID NO: 3704030 - DNA, 22 bp, Homo sapiens
agatttgcccatttacactttt

SEQ ID NO: 3704031 - DNA, 16 bp, Homo sapiens
agtatatttatataat

SEQ ID NO: 3704032 - DNA, 15 bp, Homo sapiens
agtatcaggcctgcc

SEQ ID NO: 3704033 - DNA, 19 bp, Homo sapiens
agtatcatggaaatattat

SEQ ID NO: 3704034 - DNA, 18 bp, Homo sapiens
agtatcgggggctggggc

SEQ ID NO: 3704035 - DNA, 14 bp, Homo sapiens
agtatggtggctgg

SEQ ID NO: 3704036 - DNA, 16 bp, Homo sapiens
agtatggtggctgggt

SEQ ID NO: 3704037 - DNA, 17 bp, Homo sapiens
agtatggtggctgggtt

SEQ ID NO: 3704038 - DNA, 20 bp, Homo sapiens
agtatgttttagcatgtgtt

SEQ ID NO: 3704039 - DNA, 18 bp, Homo sapiens
agtattacttctgctaca

SEQ ID NO: 3704040 - DNA, 23 bp, Homo sapiens
agtattcaagaaagccagtctta

SEQ ID NO: 3704041 - DNA, 13 bp, Homo sapiens
agtattctgcctt

SEQ ID NO: 3704042 - DNA, 14 bp, Homo sapiens
agtatttatatatt

SEQ ID NO: 3704043 - DNA, 20 bp, Homo sapiens
agtatttatatatttataac

SEQ ID NO: 3704044 - DNA, 23 bp, Homo sapiens
agtatttatatatttataactca

SEQ ID NO: 3704045 - DNA, 20 bp, Homo sapiens
agtatttatttaatgttatg

SEQ ID NO: 3704046 - DNA, 14 bp, Homo sapiens
agtattttcccaat

SEQ ID NO: 3704047 - DNA, 15 bp, Homo sapiens
agtcaaaaggtgcct

SEQ ID NO: 3704048 - DNA, 12 bp, Homo sapiens
agtcaaagtaaa

SEQ ID NO: 3704049 - DNA, 14 bp, Homo sapiens
agtcaaataactcc

SEQ ID NO: 3704050 - DNA, 18 bp, Homo sapiens
agtcaatcccctcattca

SEQ ID NO: 3704051 - DNA, 22 bp, Homo sapiens
agtcacacagtattacttctgc

SEQ ID NO: 3704052 - DNA, 14 bp, Homo sapiens
agtcacatcacagg

SEQ ID NO: 3704053 - DNA, 16 bp, Homo sapiens
agtcacccatgaagac

SEQ ID NO: 3704054 - DNA, 20 bp, Homo sapiens
agtcacccggcccccatgca

SEQ ID NO: 3704055 - DNA, 19 bp, Homo sapiens
agtcaccctacctgtgcct

SEQ ID NO: 3704056 - DNA, 20 bp, Homo sapiens
agtcaccctacctgtgcctg

SEQ ID NO: 3704057 - DNA, 21 bp, Homo sapiens
agtcaccttttaaatcctgtt

SEQ ID NO: 3704058 - DNA, 15 bp, Homo sapiens
agtcagactgctggg

SEQ ID NO: 3704059 - DNA, 19 bp, Homo sapiens
agtcagctttgccttccac

SEQ ID NO: 3704060 - DNA, 16 bp, Homo sapiens
agtcagggacccctgc

SEQ ID NO: 3704061 - DNA, 21 bp, Homo sapiens
agtcagtcatgatggcaccac

SEQ ID NO: 3704062 - DNA, 19 bp, Homo sapiens
agtcagtctgcacttaaat

SEQ ID NO: 3704063 - DNA, 20 bp, Homo sapiens
agtcagtgcccaactgttat

SEQ ID NO: 3704064 - DNA, 17 bp, Homo sapiens
agtcataccaactttag

SEQ ID NO: 3704065 - DNA, 14 bp, Homo sapiens
agtcatagaagaac

SEQ ID NO: 3704066 - DNA, 17 bp, Homo sapiens
agtcatctccatcagct

SEQ ID NO: 3704067 - DNA, 19 bp, Homo sapiens
agtcatctccatcagctgt

SEQ ID NO: 3704068 - DNA, 14 bp, Homo sapiens
agtcatgaacacat

SEQ ID NO: 3704069 - DNA, 19 bp, Homo sapiens
agtcatgaacacatcagct

SEQ ID NO: 3704070 - DNA, 13 bp, Homo sapiens
agtcatgaagccc

SEQ ID NO: 3704071 - DNA, 22 bp, Homo sapiens
agtcatgagctgagcagggaga

SEQ ID NO: 3704072 - DNA, 18 bp, Homo sapiens
agtcatgatctccctgcc

SEQ ID NO: 3704073 - DNA, 19 bp, Homo sapiens
agtcatgatctccctgccg

SEQ ID NO: 3704074 - DNA, 19 bp, Homo sapiens
agtcatgcgtttaatcaca

SEQ ID NO: 3704075 - DNA, 19 bp, Homo sapiens
agtcattttaactttatca

SEQ ID NO: 3704076 - DNA, 16 bp, Homo sapiens
agtccaaatgtcctcc

SEQ ID NO: 3704077 - DNA, 18 bp, Homo sapiens
agtccaacgtggggcagc

SEQ ID NO: 3704078 - DNA, 20 bp, Homo sapiens
agtccaacgtggggcagcac

SEQ ID NO: 3704079 - DNA, 18 bp, Homo sapiens
agtccaatgtctttttaa

SEQ ID NO: 3704080 - DNA, 12 bp, Homo sapiens
agtccacctgag

SEQ ID NO: 3704081 - DNA, 13 bp, Homo sapiens
agtccaggcccca

SEQ ID NO: 3704082 - DNA, 23 bp, Homo sapiens
agtccaggtcgggctcagctctg

SEQ ID NO: 3704083 - DNA, 17 bp, Homo sapiens
agtcccaaggaaagccc

SEQ ID NO: 3704084 - DNA, 20 bp, Homo sapiens
agtcccaccggttgcttctg

SEQ ID NO: 3704085 - DNA, 11 bp, Homo sapiens
agtcccagcta

SEQ ID NO: 3704086 - DNA, 16 bp, Homo sapiens
agtccccaggccccag

SEQ ID NO: 3704087 - DNA, 19 bp, Homo sapiens
agtccccaggccccaggaa

SEQ ID NO: 3704088 - DNA, 13 bp, Homo sapiens
agtcccgtcagga

SEQ ID NO: 3704089 - DNA, 19 bp, Homo sapiens
agtccctgactctctgtga

SEQ ID NO: 3704090 - DNA, 17 bp, Homo sapiens
agtccctgggggaagcc

SEQ ID NO: 3704091 - DNA, 21 bp, Homo sapiens
agtccctgtgaagactgggtg

SEQ ID NO: 3704092 - DNA, 13 bp, Homo sapiens
agtcccttcccct

SEQ ID NO: 3704093 - DNA, 20 bp, Homo sapiens
agtcccttcccctccctggc

SEQ ID NO: 3704094 - DNA, 20 bp, Homo sapiens
agtcctacaagctaaaatta

SEQ ID NO: 3704095 - DNA, 19 bp, Homo sapiens
agtcctcttttctgagagg

SEQ ID NO: 3704096 - DNA, 17 bp, Homo sapiens
agtcctgcctggccagg

SEQ ID NO: 3704097 - DNA, 20 bp, Homo sapiens
agtcctgcctggccaggcag

SEQ ID NO: 3704098 - DNA, 14 bp, Homo sapiens
agtcctgctctcta

SEQ ID NO: 3704099 - DNA, 13 bp, Homo sapiens
agtcctggctaca

SEQ ID NO: 3704100 - DNA, 18 bp, Homo sapiens
agtccttgcaagaatcag

SEQ ID NO: 3704101 - DNA, 16 bp, Homo sapiens
agtcgaggacagggag

SEQ ID NO: 3704102 - DNA, 15 bp, Homo sapiens
agtcgctgaggaaaa

SEQ ID NO: 3704103 - DNA, 12 bp, Homo sapiens
agtcggattaga

SEQ ID NO: 3704104 - DNA, 16 bp, Homo sapiens
agtctaaatatttcct

SEQ ID NO: 3704105 - DNA, 18 bp, Homo sapiens
agtctaggagctgggagg

SEQ ID NO: 3704106 - DNA, 22 bp, Homo sapiens
agtctaggagctgggaggaaaa

SEQ ID NO: 3704107 - DNA, 14 bp, Homo sapiens
agtctcactcccct

SEQ ID NO: 3704108 - DNA, 19 bp, Homo sapiens
agtctcccaggccccctgc

SEQ ID NO: 3704109 - DNA, 23 bp, Homo sapiens
agtctcccaggccccctgcatct

SEQ ID NO: 3704110 - DNA, 14 bp, Homo sapiens
agtctccttcccct

SEQ ID NO: 3704111 - DNA, 12 bp, Homo sapiens
agtctctattta

SEQ ID NO: 3704112 - DNA, 15 bp, Homo sapiens
agtctctatttaaat

SEQ ID NO: 3704113 - DNA, 18 bp, Homo sapiens
agtctctatttaaattct

SEQ ID NO: 3704114 - DNA, 20 bp, Homo sapiens
agtctctatttaaattcttt

SEQ ID NO: 3704115 - DNA, 22 bp, Homo sapiens
agtctctatttaaattcttttt

SEQ ID NO: 3704116 - DNA, 19 bp, Homo sapiens
agtctctcttacccttctg

SEQ ID NO: 3704117 - DNA, 17 bp, Homo sapiens
agtctctgctggcccag

SEQ ID NO: 3704118 - DNA, 12 bp, Homo sapiens
agtctctgtgaa

SEQ ID NO: 3704119 - DNA, 17 bp, Homo sapiens
agtctcttctccactgg

SEQ ID NO: 3704120 - DNA, 18 bp, Homo sapiens
agtctcttctccactgga

SEQ ID NO: 3704121 - DNA, 17 bp, Homo sapiens
agtctctttaatcttca

SEQ ID NO: 3704122 - DNA, 22 bp, Homo sapiens
agtctctttaatcttcagtttt

SEQ ID NO: 3704123 - DNA, 23 bp, Homo sapiens
agtctctttaatcttcagtttta

SEQ ID NO: 3704124 - DNA, 23 bp, Homo sapiens
agtctgacttccccgcattccag

SEQ ID NO: 3704125 - DNA, 16 bp, Homo sapiens
agtctgattcccaagc

SEQ ID NO: 3704126 - DNA, 20 bp, Homo sapiens
agtctgattcccaagctctg

SEQ ID NO: 3704127 - DNA, 18 bp, Homo sapiens
agtctgctgccctccatc

SEQ ID NO: 3704128 - DNA, 18 bp, Homo sapiens
agtctggaatgcagtggt

SEQ ID NO: 3704129 - DNA, 22 bp, Homo sapiens
agtctggaggggcatggccagc

SEQ ID NO: 3704130 - DNA, 20 bp, Homo sapiens
agtctggtttctagacttgt

SEQ ID NO: 3704131 - DNA, 17 bp, Homo sapiens
agtctgtctcaaaagaa

SEQ ID NO: 3704132 - DNA, 21 bp, Homo sapiens
agtctgtgtgctgtggttcct

SEQ ID NO: 3704133 - DNA, 18 bp, Homo sapiens
agtctgtgtgggactgta

SEQ ID NO: 3704134 - DNA, 19 bp, Homo sapiens
agtctgtgtgggactgtac

SEQ ID NO: 3704135 - DNA, 24 bp, Homo sapiens
agtcttagacttgaaatactactt

SEQ ID NO: 3704136 - DNA, 23 bp, Homo sapiens
agtcttcaagcagattggagaaa

SEQ ID NO: 3704137 - DNA, 16 bp, Homo sapiens
agtcttccacctggaa

SEQ ID NO: 3704138 - DNA, 13 bp, Homo sapiens
agtcttccctgat

SEQ ID NO: 3704139 - DNA, 18 bp, Homo sapiens
agtcttctcatagcatta

SEQ ID NO: 3704140 - DNA, 16 bp, Homo sapiens
agtcttgcagtgatta

SEQ ID NO: 3704141 - DNA, 15 bp, Homo sapiens
agtcttttccatgaa

SEQ ID NO: 3704142 - DNA, 23 bp, Homo sapiens
agtgaaaaaggaggaagagaaaa

SEQ ID NO: 3704143 - DNA, 18 bp, Homo sapiens
agtgaacatttgggtaaa

SEQ ID NO: 3704144 - DNA, 20 bp, Homo sapiens
agtgaacttgggccactgtg

SEQ ID NO: 3704145 - DNA, 17 bp, Homo sapiens
aggtcagtacccacctg

SEQ ID NO: 3704146 - DNA, 19 bp, Homo sapiens
aggtcagtacccacctgag

SEQ ID NO: 3704147 - DNA, 12 bp, Homo sapiens
aggtcccaaggc

SEQ ID NO: 3704148 - DNA, 13 bp, Homo sapiens
aggtcccaggcag

SEQ ID NO: 3704149 - DNA, 21 bp, Homo sapiens
aggtcctgggggcctgacctc

SEQ ID NO: 3704150 - DNA, 16 bp, Homo sapiens
aggtccttctgctgga

SEQ ID NO: 3704151 - DNA, 15 bp, Homo sapiens
aggtcgggctcagct

SEQ ID NO: 3704152 - DNA, 22 bp, Homo sapiens
aggtctaggaacatacttcagc

SEQ ID NO: 3704153 - DNA, 13 bp, Homo sapiens
aggtctcccggga

SEQ ID NO: 3704154 - DNA, 11 bp, Homo sapiens
aggtctcctct

SEQ ID NO: 3704155 - DNA, 15 bp, Homo sapiens
aggtctcctcttaaa

SEQ ID NO: 3704156 - DNA, 17 bp, Homo sapiens
aggtctcctcttaaaaa

SEQ ID NO: 3704157 - DNA, 23 bp, Homo sapiens
aggtctctctttggactctcccc

SEQ ID NO: 3704158 - DNA, 15 bp, Homo sapiens
aggtctcttgaggga

SEQ ID NO: 3704159 - DNA, 21 bp, Homo sapiens
aggtctgaaatggaggtcctt

SEQ ID NO: 3704160 - DNA, 14 bp, Homo sapiens
aggtctgctcggcc

SEQ ID NO: 3704161 - DNA, 18 bp, Homo sapiens
aggtctgggagaggcaga

SEQ ID NO: 3704162 - DNA, 17 bp, Homo sapiens
aggtcttgaactcctgg

SEQ ID NO: 3704163 - DNA, 21 bp, Homo sapiens
aggtcttgaactcctggcctc

SEQ ID NO: 3704164 - DNA, 20 bp, Homo sapiens
aggtcttgatttgttttaga

SEQ ID NO: 3704165 - DNA, 16 bp, Homo sapiens
aggtcttttgacatgt

SEQ ID NO: 3704166 - DNA, 13 bp, Homo sapiens
aggtgacagagtg

SEQ ID NO: 3704167 - DNA, 15 bp, Homo sapiens
aggtgacagagtgag

SEQ ID NO: 3704168 - DNA, 18 bp, Homo sapiens
aggtgacagtgaggtcct

SEQ ID NO: 3704169 - DNA, 16 bp, Homo sapiens
aggtgaccttctggga

SEQ ID NO: 3704170 - DNA, 18 bp, Homo sapiens
aggtgcagagtgcccaga

SEQ ID NO: 3704171 - DNA, 19 bp, Homo sapiens
aggtgcagagtgcccagaa

SEQ ID NO: 3704172 - DNA, 17 bp, Homo sapiens
aggtgccccaaaatgca

SEQ ID NO: 3704173 - DNA, 20 bp, Homo sapiens
aggtgcccttggaggccagc

SEQ ID NO: 3704174 - DNA, 11 bp, Homo sapiens
aggtgcctgtg

SEQ ID NO: 3704175 - DNA, 17 bp, Homo sapiens
aggtgcctgtgaggcag

SEQ ID NO: 3704176 - DNA, 21 bp, Homo sapiens
aggtgcctgtgaggcaggggc

SEQ ID NO: 3704177 - DNA, 15 bp, Homo sapiens
aggtgctgggaggga

SEQ ID NO: 3704178 - DNA, 14 bp, Homo sapiens
aggtggacacacaa

SEQ ID NO: 3704179 - DNA, 16 bp, Homo sapiens
aggtggactggaaggg

SEQ ID NO: 3704180 - DNA, 20 bp, Homo sapiens
aggtggaggttgcagtgagc

SEQ ID NO: 3704181 - DNA, 15 bp, Homo sapiens
aggtggcagccctgt

SEQ ID NO: 3704182 - DNA, 23 bp, Homo sapiens
aggtggctctggaatgacatgtg

SEQ ID NO: 3704183 - DNA, 19 bp, Homo sapiens
aggtggctgacccagtccc

SEQ ID NO: 3704184 - DNA, 17 bp, Homo sapiens
aggtggctgcctggagc

SEQ ID NO: 3704185 - DNA, 15 bp, Homo sapiens
aggtgggccagcccc

SEQ ID NO: 3704186 - DNA, 17 bp, Homo sapiens
aggtgggccagcccctc

SEQ ID NO: 3704187 - DNA, 19 bp, Homo sapiens
aggtgggccttgctacctc

SEQ ID NO: 3704188 - DNA, 21 bp, Homo sapiens
aggtgggccttgctacctcaa

SEQ ID NO: 3704189 - DNA, 15 bp, Homo sapiens
aggtgggctgagccc

SEQ ID NO: 3704190 - DNA, 17 bp, Homo sapiens
aggtgggctgagccctg

SEQ ID NO: 3704191 - DNA, 13 bp, Homo sapiens
aggtggggagtca

SEQ ID NO: 3704192 - DNA, 13 bp, Homo sapiens
aggtggggcagct

SEQ ID NO: 3704193 - DNA, 22 bp, Homo sapiens
aggtgggttttcttcccatcac

SEQ ID NO: 3704194 - DNA, 18 bp, Homo sapiens
aggtggtatgtgtgtgta

SEQ ID NO: 3704195 - DNA, 15 bp, Homo sapiens
aggtggtctgaatgt

SEQ ID NO: 3704196 - DNA, 16 bp, Homo sapiens
aggtggtctgaatgtt

SEQ ID NO: 3704197 - DNA, 17 bp, Homo sapiens
aggtgtccccagcccac

SEQ ID NO: 3704198 - DNA, 14 bp, Homo sapiens
aggtgtgagtcacc

SEQ ID NO: 3704199 - DNA, 20 bp, Homo sapiens
aggtgtgagtcaccaagccc

SEQ ID NO: 3704200 - DNA, 21 bp, Homo sapiens
aggtgtgagtcaccaagccca

SEQ ID NO: 3704201 - DNA, 20 bp, Homo sapiens
aggtgtgctctgatcatcca

SEQ ID NO: 3704202 - DNA, 22 bp, Homo sapiens
aggtgttcaagaccagcctgac

SEQ ID NO: 3704203 - DNA, 20 bp, Homo sapiens
aggtgttctacactcatctt

SEQ ID NO: 3704204 - DNA, 16 bp, Homo sapiens
aggttaactatgtaca

SEQ ID NO: 3704205 - DNA, 16 bp, Homo sapiens
aggttaaggctgagga

SEQ ID NO: 3704206 - DNA, 17 bp, Homo sapiens
aggttaccctgtaacat

SEQ ID NO: 3704207 - DNA, 14 bp, Homo sapiens
aggttataggtcac

SEQ ID NO: 3704208 - DNA, 21 bp, Homo sapiens
aggttcatgccaccatggcca

SEQ ID NO: 3704209 - DNA, 17 bp, Homo sapiens
aggttgcagtgagctga

SEQ ID NO: 3704210 - DNA, 18 bp, Homo sapiens
aggttgcagtgagctgag

SEQ ID NO: 3704211 - DNA, 20 bp, Homo sapiens
aggttgtctgaagtcactgc

SEQ ID NO: 3704212 - DNA, 15 bp, Homo sapiens
aggtttctgaaaatt

SEQ ID NO: 3704213 - DNA, 23 bp, Homo sapiens
aggtttctgaaaattaacactgc

SEQ ID NO: 3704214 - DNA, 22 bp, Homo sapiens
aggtttgtgagagcgaggctga

SEQ ID NO: 3704215 - DNA, 20 bp, Homo sapiens
aggtttttggaattatgtct

SEQ ID NO: 3704216 - DNA, 19 bp, Homo sapiens
agtaaaaaacaacttcttt

SEQ ID NO: 3704217 - DNA, 12 bp, Homo sapiens
agtaaaaataaa

SEQ ID NO: 3704218 - DNA, 16 bp, Homo sapiens
agtaaactatttatct

SEQ ID NO: 3704219 - DNA, 14 bp, Homo sapiens
agtaaagagaaact

SEQ ID NO: 3704220 - DNA, 17 bp, Homo sapiens
agtaacagggccttgct

SEQ ID NO: 3704221 - DNA, 18 bp, Homo sapiens
agtaacattcatgttcta

SEQ ID NO: 3704222 - DNA, 17 bp, Homo sapiens
agtaacttacttaggtg

SEQ ID NO: 3704223 - DNA, 17 bp, Homo sapiens
agtaacttggttataca

SEQ ID NO: 3704224 - DNA, 19 bp, Homo sapiens
agtaacttggttatacatg

SEQ ID NO: 3704225 - DNA, 16 bp, Homo sapiens
agtaagaccggaagct

SEQ ID NO: 3704226 - DNA, 19 bp, Homo sapiens
agtaagagctggtgtctga

SEQ ID NO: 3704227 - DNA, 20 bp, Homo sapiens
agtaagtaccactcaggcca

SEQ ID NO: 3704228 - DNA, 16 bp, Homo sapiens
agtaataaaacatctt

SEQ ID NO: 3704229 - DNA, 17 bp, Homo sapiens
agtaataaaacatcttt

SEQ ID NO: 3704230 - DNA, 22 bp, Homo sapiens
agtaattatcgggaacagtgtt

SEQ ID NO: 3704231 - DNA, 12 bp, Homo sapiens
agtaattgtgaa

SEQ ID NO: 3704232 - DNA, 19 bp, Homo sapiens
agtacaggcagcacagaga

SEQ ID NO: 3704233 - DNA, 21 bp, Homo sapiens
agtacaggtaaggtgagggaa

SEQ ID NO: 3704234 - DNA, 21 bp, Homo sapiens
agtacagtggttctacaatct

SEQ ID NO: 3704235 - DNA, 22 bp, Homo sapiens
agtacataaaggtggtatgtgt

SEQ ID NO: 3704236 - DNA, 16 bp, Homo sapiens
agtaccaatcatttta

SEQ ID NO: 3704237 - DNA, 13 bp, Homo sapiens
agtacccacctga

SEQ ID NO: 3704238 - DNA, 20 bp, Homo sapiens
agtaccttcagatcctaccc

SEQ ID NO: 3704239 - DNA, 14 bp, Homo sapiens
agtacctttgtcac

SEQ ID NO: 3704240 - DNA, 16 bp, Homo sapiens
agtactatatctgttt

SEQ ID NO: 3704241 - DNA, 18 bp, Homo sapiens
agtactcctgcaaaattt

SEQ ID NO: 3704242 - DNA, 20 bp, Homo sapiens
agtactcctgcaaaatttta

SEQ ID NO: 3704243 - DNA, 18 bp, Homo sapiens
agtactccttaagaacac

SEQ ID NO: 3704244 - DNA, 20 bp, Homo sapiens
agtactggctgatggagtaa

SEQ ID NO: 3704245 - DNA, 23 bp, Homo sapiens
agtacttgggagacctgtaatca

SEQ ID NO: 3704246 - DNA, 17 bp, Homo sapiens
agtagaaattttacaat

SEQ ID NO: 3704247 - DNA, 19 bp, Homo sapiens
agtagaagtcttagatgta

SEQ ID NO: 3704248 - DNA, 19 bp, Homo sapiens
agtagcatgttgagccagg

SEQ ID NO: 3704249 - DNA, 23 bp, Homo sapiens
agtagccccaacccaaacctgga

SEQ ID NO: 3704250 - DNA, 22 bp, Homo sapiens
agtagctgggactacaggcacc

SEQ ID NO: 3704251 - DNA, 21 bp, Homo sapiens
agtagctgggactacaggcgt

SEQ ID NO: 3704252 - DNA, 13 bp, Homo sapiens
agtagggtcaggc

SEQ ID NO: 3704253 - DNA, 13 bp, Homo sapiens
agtagtcagactg

SEQ ID NO: 3704254 - DNA, 17 bp, Homo sapiens
agtagtgagaagaatat

SEQ ID NO: 3704255 - DNA, 23 bp, Homo sapiens
agtagtgtcactgcttgttatgc

SEQ ID NO: 3704256 - DNA, 17 bp, Homo sapiens
agtatattaaaaatggt

SEQ ID NO: 3704257 - DNA, 22 bp, Homo sapiens
agtatattaaaaatggtaaaat

SEQ ID NO: 3704258 - DNA, 11 bp, Homo sapiens
agtatatttat

SEQ ID NO: 3704259 - DNA, 20 bp, Homo sapiens
agggcaggcccaaattatca

SEQ ID NO: 3704260 - DNA, 17 bp, Homo sapiens
agggcatcatgcatctt

SEQ ID NO: 3704261 - DNA, 12 bp, Homo sapiens
agggcatctcct

SEQ ID NO: 3704262 - DNA, 23 bp, Homo sapiens
agggcatctcctgtgcatgggtg

SEQ ID NO: 3704263 - DNA, 18 bp, Homo sapiens
agggcatgcattttgcag

SEQ ID NO: 3704264 - DNA, 17 bp, Homo sapiens
agggcatggccaggtgg

SEQ ID NO: 3704265 - DNA, 14 bp, Homo sapiens
agggccagggccct

SEQ ID NO: 3704266 - DNA, 18 bp, Homo sapiens
agggccagtcctgcctgg

SEQ ID NO: 3704267 - DNA, 23 bp, Homo sapiens
agggccagtcctgcctggccagg

SEQ ID NO: 3704268 - DNA, 17 bp, Homo sapiens
agggcccaggcaggcca

SEQ ID NO: 3704269 - DNA, 12 bp, Homo sapiens
agggccccagca

SEQ ID NO: 3704270 - DNA, 14 bp, Homo sapiens
agggccccagcact

SEQ ID NO: 3704271 - DNA, 16 bp, Homo sapiens
agggccctgagctcgg

SEQ ID NO: 3704272 - DNA, 18 bp, Homo sapiens
agggccttgcccagagat

SEQ ID NO: 3704273 - DNA, 15 bp, Homo sapiens
agggcgtgactcacc

SEQ ID NO: 3704274 - DNA, 12 bp, Homo sapiens
agggctcagcct

SEQ ID NO: 3704275 - DNA, 20 bp, Homo sapiens
agggctcagcggggacagct

SEQ ID NO: 3704276 - DNA, 23 bp, Homo sapiens
agggctcagcggggacagctcct

SEQ ID NO: 3704277 - DNA, 15 bp, Homo sapiens
agggctctgatattc

SEQ ID NO: 3704278 - DNA, 22 bp, Homo sapiens
agggctctgatattccatgaat

SEQ ID NO: 3704279 - DNA, 22 bp, Homo sapiens
aggggaaaatcagcctgctcca

SEQ ID NO: 3704280 - DNA, 18 bp, Homo sapiens
aggggaataatagaagaa

SEQ ID NO: 3704281 - DNA, 11 bp, Homo sapiens
aggggaatatt

SEQ ID NO: 3704282 - DNA, 16 bp, Homo sapiens
aggggaatattttatt

SEQ ID NO: 3704283 - DNA, 22 bp, Homo sapiens
aggggaatattttattcaaggt

SEQ ID NO: 3704284 - DNA, 20 bp, Homo sapiens
aggggaatgtttgcctctgc

SEQ ID NO: 3704285 - DNA, 21 bp, Homo sapiens
aggggaatgtttgcctctgcc

SEQ ID NO: 3704286 - DNA, 10 bp, Homo sapiens
aggggagagg

SEQ ID NO: 3704287 - DNA, 17 bp, Homo sapiens
aggggaggacctctggg

SEQ ID NO: 3704288 - DNA, 14 bp, Homo sapiens
aggggaggagggcg

SEQ ID NO: 3704289 - DNA, 19 bp, Homo sapiens
aggggaggatcactggagc

SEQ ID NO: 3704290 - DNA, 13 bp, Homo sapiens
aggggaggcagcc

SEQ ID NO: 3704291 - DNA, 21 bp, Homo sapiens
aggggaggcagccggcaccca

SEQ ID NO: 3704292 - DNA, 21 bp, Homo sapiens
aggggatagagagagaccact

SEQ ID NO: 3704293 - DNA, 14 bp, Homo sapiens
aggggatgggaggt

SEQ ID NO: 3704294 - DNA, 15 bp, Homo sapiens
aggggcacagggtct

SEQ ID NO: 3704295 - DNA, 17 bp, Homo sapiens
aggggcagaaaaactct

SEQ ID NO: 3704296 - DNA, 17 bp, Homo sapiens
aggggcaggagctcaga

SEQ ID NO: 3704297 - DNA, 19 bp, Homo sapiens
aggggcaggagctcagatg

SEQ ID NO: 3704298 - DNA, 20 bp, Homo sapiens
aggggcaggagctcagatga

SEQ ID NO: 3704299 - DNA, 17 bp, Homo sapiens
aggggcagtctggaggg

SEQ ID NO: 3704300 - DNA, 14 bp, Homo sapiens
aggggcatctgccc

SEQ ID NO: 3704301 - DNA, 15 bp, Homo sapiens
aggggcatctgcccc

SEQ ID NO: 3704302 - DNA, 20 bp, Homo sapiens
aggggcatctgcccctcccc

SEQ ID NO: 3704303 - DNA, 18 bp, Homo sapiens
aggggcatggccagcagc

SEQ ID NO: 3704304 - DNA, 12 bp, Homo sapiens
aggggcctgcct

SEQ ID NO: 3704305 - DNA, 13 bp, Homo sapiens
aggggcctggcag

SEQ ID NO: 3704306 - DNA, 18 bp, Homo sapiens
aggggcctggcagccgtg

SEQ ID NO: 3704307 - DNA, 17 bp, Homo sapiens
aggggcggcaggaggga

SEQ ID NO: 3704308 - DNA, 17 bp, Homo sapiens
aggggcgtgtggctcac

SEQ ID NO: 3704309 - DNA, 14 bp, Homo sapiens
aggggctcctggaa

SEQ ID NO: 3704310 - DNA, 14 bp, Homo sapiens
aggggctttctgga

SEQ ID NO: 3704311 - DNA, 16 bp, Homo sapiens
aggggctttctggaga

SEQ ID NO: 3704312 - DNA, 22 bp, Homo sapiens
agggggagggggttacaaactg

SEQ ID NO: 3704313 - DNA, 15 bp, Homo sapiens
agggggccaggtgca

SEQ ID NO: 3704314 - DNA, 17 bp, Homo sapiens
aggggggagggggaggg

SEQ ID NO: 3704315 - DNA, 16 bp, Homo sapiens
agggggtttgggggct

SEQ ID NO: 3704316 - DNA, 15 bp, Homo sapiens
aggggtcaagttatt

SEQ ID NO: 3704317 - DNA, 14 bp, Homo sapiens
aggggtcagggacc

SEQ ID NO: 3704318 - DNA, 15 bp, Homo sapiens
aggggtcccagccac

SEQ ID NO: 3704319 - DNA, 19 bp, Homo sapiens
aggggtcccagccaccccg

SEQ ID NO: 3704320 - DNA, 19 bp, Homo sapiens
aggggtctccaggaggaga

SEQ ID NO: 3704321 - DNA, 20 bp, Homo sapiens
aggggtgggttcctcttccc

SEQ ID NO: 3704322 - DNA, 15 bp, Homo sapiens
aggggtggtcctgac

SEQ ID NO: 3704323 - DNA, 15 bp, Homo sapiens
aggggtttctaacac

SEQ ID NO: 3704324 - DNA, 22 bp, Homo sapiens
aggggttttcgaagctcagccc

SEQ ID NO: 3704325 - DNA, 15 bp, Homo sapiens
agggtaaggtgcctt

SEQ ID NO: 3704326 - DNA, 19 bp, Homo sapiens
agggtaccttgaacactgg

SEQ ID NO: 3704327 - DNA, 21 bp, Homo sapiens
agggtatccaagttggactgg

SEQ ID NO: 3704328 - DNA, 13 bp, Homo sapiens
agggtattccaga

SEQ ID NO: 3704329 - DNA, 20 bp, Homo sapiens
agggtcaacatcttttacat

SEQ ID NO: 3704330 - DNA, 15 bp, Homo sapiens
agggtcaggagaggg

SEQ ID NO: 3704331 - DNA, 14 bp, Homo sapiens
agggtccctgacct

SEQ ID NO: 3704332 - DNA, 22 bp, Homo sapiens
agggtcctgctatttcccaagc

SEQ ID NO: 3704333 - DNA, 17 bp, Homo sapiens
agggtcctggctcctga

SEQ ID NO: 3704334 - DNA, 19 bp, Homo sapiens
agggtcctggctcctgagg

SEQ ID NO: 3704335 - DNA, 20 bp, Homo sapiens
agggtcctggctcctgaggg

SEQ ID NO: 3704336 - DNA, 17 bp, Homo sapiens
agggtccttccctctcc

SEQ ID NO: 3704337 - DNA, 22 bp, Homo sapiens
agggtccttccctctccccaag

SEQ ID NO: 3704338 - DNA, 20 bp, Homo sapiens
agggtctcactatgttgccc

SEQ ID NO: 3704339 - DNA, 21 bp, Homo sapiens
agggtctcactctgtcgccca

SEQ ID NO: 3704340 - DNA, 22 bp, Homo sapiens
agggtctcactctgtcgcccag

SEQ ID NO: 3704341 - DNA, 15 bp, Homo sapiens
agggtcttccctacc

SEQ ID NO: 3704342 - DNA, 17 bp, Homo sapiens
agggtcttccctacctc

SEQ ID NO: 3704343 - DNA, 15 bp, Homo sapiens
agggtggcatcccag

SEQ ID NO: 3704344 - DNA, 16 bp, Homo sapiens
agggtggtgacctctg

SEQ ID NO: 3704345 - DNA, 22 bp, Homo sapiens
agggtgtccggtccctgtccca

SEQ ID NO: 3704346 - DNA, 15 bp, Homo sapiens
agggttatattttac

SEQ ID NO: 3704347 - DNA, 18 bp, Homo sapiens
agggttcaaaatgtctgt

SEQ ID NO: 3704348 - DNA, 16 bp, Homo sapiens
agggttcagagactca

SEQ ID NO: 3704349 - DNA, 15 bp, Homo sapiens
agggttcccccagcc

SEQ ID NO: 3704350 - DNA, 18 bp, Homo sapiens
agggttcccccagccctg

SEQ ID NO: 3704351 - DNA, 19 bp, Homo sapiens
agggttcccccagccctgt

SEQ ID NO: 3704352 - DNA, 17 bp, Homo sapiens
agggttggcccctgccc

SEQ ID NO: 3704353 - DNA, 15 bp, Homo sapiens
agggtttatcttttg

SEQ ID NO: 3704354 - DNA, 15 bp, Homo sapiens
agggttttccaccct

SEQ ID NO: 3704355 - DNA, 16 bp, Homo sapiens
aggtaatgtgaataaa

SEQ ID NO: 3704356 - DNA, 16 bp, Homo sapiens
aggtacacagctctag

SEQ ID NO: 3704357 - DNA, 21 bp, Homo sapiens
aggtaccactgatttggagat

SEQ ID NO: 3704358 - DNA, 11 bp, Homo sapiens
aggtacttttg

SEQ ID NO: 3704359 - DNA, 17 bp, Homo sapiens
aggtagaaatatctgaa

SEQ ID NO: 3704360 - DNA, 20 bp, Homo sapiens
aggtagccctggccagaggc

SEQ ID NO: 3704361 - DNA, 11 bp, Homo sapiens
aggtataattt

SEQ ID NO: 3704362 - DNA, 20 bp, Homo sapiens
aggtatgaccttctaggaag

SEQ ID NO: 3704363 - DNA, 16 bp, Homo sapiens
aggtatgaggtctagg

SEQ ID NO: 3704364 - DNA, 22 bp, Homo sapiens
aggtattccttttgtgtacagt

SEQ ID NO: 3704365 - DNA, 17 bp, Homo sapiens
aggtattcgtgcagcat

SEQ ID NO: 3704366 - DNA, 19 bp, Homo sapiens
aggtcaaggcctgtccctg

SEQ ID NO: 3704367 - DNA, 19 bp, Homo sapiens
aggtcaagtaagaagacat

SEQ ID NO: 3704368 - DNA, 18 bp, Homo sapiens
aggtcaatacagtacagg

SEQ ID NO: 3704369 - DNA, 22 bp, Homo sapiens
aggtcaatacagtacaggcagc

SEQ ID NO: 3704370 - DNA, 15 bp, Homo sapiens
aggtcactcctgggg

SEQ ID NO: 3704371 - DNA, 18 bp, Homo sapiens
aggtcactcctggggcct

SEQ ID NO: 3704372 - DNA, 18 bp, Homo sapiens
aggtcagcttgctgccct

SEQ ID NO: 3704373 - DNA, 20 bp, Homo sapiens
aggtcaggagttcctaacca

SEQ ID NO: 3704374 - DNA, 21 bp, Homo sapiens
agcagatgcaaagaggcaaga

SEQ ID NO: 3704375 - DNA, 21 bp, Homo sapiens
agcagattttaattttgaata

SEQ ID NO: 3704376 - DNA, 14 bp, Homo sapiens
agcagcacttataa

SEQ ID NO: 3704377 - DNA, 20 bp, Homo sapiens
agcagccaagctccttggga

SEQ ID NO: 3704378 - DNA, 14 bp, Homo sapiens
agcagccagctctc

SEQ ID NO: 3704379 - DNA, 19 bp, Homo sapiens
agcagccagctctcagcca

SEQ ID NO: 3704380 - DNA, 12 bp, Homo sapiens
agcagccctcct

SEQ ID NO: 3704381 - DNA, 13 bp, Homo sapiens
agcagccctcctc

SEQ ID NO: 3704382 - DNA, 16 bp, Homo sapiens
agcagccctcctcacc

SEQ ID NO: 3704383 - DNA, 23 bp, Homo sapiens
agcagccctcctcaccccgtctg

SEQ ID NO: 3704384 - DNA, 12 bp, Homo sapiens
agcagcctctga

SEQ ID NO: 3704385 - DNA, 22 bp, Homo sapiens
agcagcggtttggggagcagag

SEQ ID NO: 3704386 - DNA, 15 bp, Homo sapiens
agcagctcaaaggca

SEQ ID NO: 3704387 - DNA, 19 bp, Homo sapiens
agcagctcaaaggcacagt

SEQ ID NO: 3704388 - DNA, 17 bp, Homo sapiens
agcagcttgctgcaccc

SEQ ID NO: 3704389 - DNA, 14 bp, Homo sapiens
agcaggaagctcag

SEQ ID NO: 3704390 - DNA, 14 bp, Homo sapiens
agcaggcacatgga

SEQ ID NO: 3704391 - DNA, 16 bp, Homo sapiens
agcaggcctgttgctt

SEQ ID NO: 3704392 - DNA, 18 bp, Homo sapiens
agcaggcctgttgctttt

SEQ ID NO: 3704393 - DNA, 13 bp, Homo sapiens
agcagggaaacag

SEQ ID NO: 3704394 - DNA, 22 bp, Homo sapiens
agcagggctcagcggggacagc

SEQ ID NO: 3704395 - DNA, 14 bp, Homo sapiens
agcaggtaccactg

SEQ ID NO: 3704396 - DNA, 22 bp, Homo sapiens
agcagtagaaataatatgcatt

SEQ ID NO: 3704397 - DNA, 23 bp, Homo sapiens
agcagtcacttttcctgtgctgt

SEQ ID NO: 3704398 - DNA, 21 bp, Homo sapiens
agcagtctacccacctcagcc

SEQ ID NO: 3704399 - DNA, 16 bp, Homo sapiens
agcagtgagtctcttc

SEQ ID NO: 3704400 - DNA, 23 bp, Homo sapiens
agcagtgccttccataattatga

SEQ ID NO: 3704401 - DNA, 12 bp, Homo sapiens
agcagtggacac

SEQ ID NO: 3704402 - DNA, 20 bp, Homo sapiens
agcagtgtcttccataatgt

SEQ ID NO: 3704403 - DNA, 17 bp, Homo sapiens
agcagtgtgtctcctgc

SEQ ID NO: 3704404 - DNA, 21 bp, Homo sapiens
agcagtgtgtctcctgcatgc

SEQ ID NO: 3704405 - DNA, 22 bp, Homo sapiens
agcagttcacctatttcaaaaa

SEQ ID NO: 3704406 - DNA, 13 bp, Homo sapiens
agcagttctgcaa

SEQ ID NO: 3704407 - DNA, 23 bp, Homo sapiens
agcataaaaattagccaagtgtg

SEQ ID NO: 3704408 - DNA, 12 bp, Homo sapiens
agcatatgagga

SEQ ID NO: 3704409 - DNA, 16 bp, Homo sapiens
agcatatgaggatgca

SEQ ID NO: 3704410 - DNA, 23 bp, Homo sapiens
agcatatgaggatgcagagtcag

SEQ ID NO: 3704411 - DNA, 20 bp, Homo sapiens
agcatcacctcaggccaggt

SEQ ID NO: 3704412 - DNA, 22 bp, Homo sapiens
agcatcctgtctggcattttgt

SEQ ID NO: 3704413 - DNA, 20 bp, Homo sapiens
agcatccttaagtatcagaa

SEQ ID NO: 3704414 - DNA, 19 bp, Homo sapiens
agcatccttttctgcagag

SEQ ID NO: 3704415 - DNA, 21 bp, Homo sapiens
agcatccttttctgcagaggg

SEQ ID NO: 3704416 - DNA, 13 bp, Homo sapiens
agcatctaaactt

SEQ ID NO: 3704417 - DNA, 17 bp, Homo sapiens
agcatctaaactttaat

SEQ ID NO: 3704418 - DNA, 13 bp, Homo sapiens
agcatctgctaat

SEQ ID NO: 3704419 - DNA, 18 bp, Homo sapiens
agcatcttcacttctaaa

SEQ ID NO: 3704420 - DNA, 14 bp, Homo sapiens
agcatgaaaaagca

SEQ ID NO: 3704421 - DNA, 15 bp, Homo sapiens
agcatgaagacagag

SEQ ID NO: 3704422 - DNA, 22 bp, Homo sapiens
agcatgaatggtatggaactct

SEQ ID NO: 3704423 - DNA, 20 bp, Homo sapiens
agcatgacaagccccaggca

SEQ ID NO: 3704424 - DNA, 21 bp, Homo sapiens
agcatgacaagccccaggcag

SEQ ID NO: 3704425 - DNA, 19 bp, Homo sapiens
agcatgagagaattgtatc

SEQ ID NO: 3704426 - DNA, 20 bp, Homo sapiens
agcatgattctttaatagaa

SEQ ID NO: 3704427 - DNA, 21 bp, Homo sapiens
aggaatggaggctctaattga

SEQ ID NO: 3704428 - DNA, 14 bp, Homo sapiens
aggaatgttaaagt

SEQ ID NO: 3704429 - DNA, 23 bp, Homo sapiens
aggaattaagttagggaatggca

SEQ ID NO: 3704430 - DNA, 16 bp, Homo sapiens
aggacaaagtctccag

SEQ ID NO: 3704431 - DNA, 14 bp, Homo sapiens
aggacaaggctaga

SEQ ID NO: 3704432 - DNA, 22 bp, Homo sapiens
aggacacctgtactggagagca

SEQ ID NO: 3704433 - DNA, 18 bp, Homo sapiens
aggacactaaccacgctg

SEQ ID NO: 3704434 - DNA, 22 bp, Homo sapiens
aggacagcctgtggcggtgcct

SEQ ID NO: 3704435 - DNA, 17 bp, Homo sapiens
aggacaggcagaaagag

SEQ ID NO: 3704436 - DNA, 12 bp, Homo sapiens
aggacaggcccg

SEQ ID NO: 3704437 - DNA, 15 bp, Homo sapiens
aggacagtgcttcag

SEQ ID NO: 3704438 - DNA, 21 bp, Homo sapiens
aggacagtgcttcagcctgag

SEQ ID NO: 3704439 - DNA, 18 bp, Homo sapiens
aggacattgcggacagcc

SEQ ID NO: 3704440 - DNA, 13 bp, Homo sapiens
aggaccaggactc

SEQ ID NO: 3704441 - DNA, 18 bp, Homo sapiens
aggaccaggactccctcc

SEQ ID NO: 3704442 - DNA, 20 bp, Homo sapiens
aggacccctccatgtgggct

SEQ ID NO: 3704443 - DNA, 13 bp, Homo sapiens
aggacccttccct

SEQ ID NO: 3704444 - DNA, 20 bp, Homo sapiens
aggacctcaggtgagaagca

SEQ ID NO: 3704445 - DNA, 11 bp, Homo sapiens
aggacctctgg

SEQ ID NO: 3704446 - DNA, 13 bp, Homo sapiens
aggacctctgggc

SEQ ID NO: 3704447 - DNA, 14 bp, Homo sapiens
aggactccctcctc

SEQ ID NO: 3704448 - DNA, 14 bp, Homo sapiens
aggactctgaggct

SEQ ID NO: 3704449 - DNA, 17 bp, Homo sapiens
aggactctgaggctctt

SEQ ID NO: 3704450 - DNA, 18 bp, Homo sapiens
aggactctgcccagacca

SEQ ID NO: 3704451 - DNA, 14 bp, Homo sapiens
aggactctgcctcc

SEQ ID NO: 3704452 - DNA, 16 bp, Homo sapiens
aggactctgcctcctc

SEQ ID NO: 3704453 - DNA, 20 bp, Homo sapiens
aggactgcatggtaatttat

SEQ ID NO: 3704454 - DNA, 17 bp, Homo sapiens
aggactgccgaccgagg

SEQ ID NO: 3704455 - DNA, 13 bp, Homo sapiens
aggacttgtgtct

SEQ ID NO: 3704456 - DNA, 12 bp, Homo sapiens
aggagaaacaca

SEQ ID NO: 3704457 - DNA, 18 bp, Homo sapiens
aggagaaacagagacagg

SEQ ID NO: 3704458 - DNA, 12 bp, Homo sapiens
aggagaaatgca

SEQ ID NO: 3704459 - DNA, 14 bp, Homo sapiens
aggagaaccactac

SEQ ID NO: 3704460 - DNA, 15 bp, Homo sapiens
aggagaaccactaca

SEQ ID NO: 3704461 - DNA, 16 bp, Homo sapiens
aggagaagaaggaaat

SEQ ID NO: 3704462 - DNA, 20 bp, Homo sapiens
aggagaagaaggaaatgaat

SEQ ID NO: 3704463 - DNA, 16 bp, Homo sapiens
aggagactcacctctg

SEQ ID NO: 3704464 - DNA, 17 bp, Homo sapiens
aggagagaaggggagga

SEQ ID NO: 3704465 - DNA, 20 bp, Homo sapiens
aggagagagatcatgagaaa

SEQ ID NO: 3704466 - DNA, 14 bp, Homo sapiens
aggagagcctgctg

SEQ ID NO: 3704467 - DNA, 16 bp, Homo sapiens
aggagagcctgctgca

SEQ ID NO: 3704468 - DNA, 15 bp, Homo sapiens
aggagagctagcagc

SEQ ID NO: 3704469 - DNA, 16 bp, Homo sapiens
aggagagggaaaatgt

SEQ ID NO: 3704470 - DNA, 17 bp, Homo sapiens
aggagagggaaaatgtt

SEQ ID NO: 3704471 - DNA, 22 bp, Homo sapiens
aggagatccagggcaaggccat

SEQ ID NO: 3704472 - DNA, 19 bp, Homo sapiens
aggagcaggagcctgagcc

SEQ ID NO: 3704473 - DNA, 21 bp, Homo sapiens
aggagctcttcaggcctccct

SEQ ID NO: 3704474 - DNA, 16 bp, Homo sapiens
aggagctgagaataga

SEQ ID NO: 3704475 - DNA, 12 bp, Homo sapiens
aggagctgctgg

SEQ ID NO: 3704476 - DNA, 13 bp, Homo sapiens
aggagctgctggc

SEQ ID NO: 3704477 - DNA, 14 bp, Homo sapiens
aggagctgctggct

SEQ ID NO: 3704478 - DNA, 18 bp, Homo sapiens
aggagctgggatcctaag

SEQ ID NO: 3704479 - DNA, 20 bp, Homo sapiens
aggagcttacctcccacctt

SEQ ID NO: 3704480 - DNA, 12 bp, Homo sapiens
aggaggaggagg

SEQ ID NO: 3704481 - DNA, 23 bp, Homo sapiens
aggaggaggcaattgggatggcg

SEQ ID NO: 3704482 - DNA, 14 bp, Homo sapiens
aggaggcagaaagc

SEQ ID NO: 3704483 - DNA, 22 bp, Homo sapiens
aggaggcagaaagcagaggctg

SEQ ID NO: 3704484 - DNA, 20 bp, Homo sapiens
aggaggcagaggttgcagtg

SEQ ID NO: 3704485 - DNA, 17 bp, Homo sapiens
aggaggctgaggcagaa

SEQ ID NO: 3704486 - DNA, 19 bp, Homo sapiens
aggaggctgaggcaggagg

SEQ ID NO: 3704487 - DNA, 13 bp, Homo sapiens
aggaggctgaggt

SEQ ID NO: 3704488 - DNA, 16 bp, Homo sapiens
aggaggctggaggaag

SEQ ID NO: 3704489 - DNA, 14 bp, Homo sapiens
aggagggtcaggaa

SEQ ID NO: 3704490 - DNA, 23 bp, Homo sapiens
aggaggtggcagccctgtaggga

SEQ ID NO: 3704491 - DNA, 16 bp, Homo sapiens
aggagtgtgagaatca

SEQ ID NO: 3704492 - DNA, 17 bp, Homo sapiens
aggagttagaggccagc

SEQ ID NO: 3704493 - DNA, 22 bp, Homo sapiens
aggagttcaagaccagcctggc

SEQ ID NO: 3704494 - DNA, 19 bp, Homo sapiens
aggagttcctaaccagcct

SEQ ID NO: 3704495 - DNA, 20 bp, Homo sapiens
aggagttccttgatctgtat

SEQ ID NO: 3704496 - DNA, 16 bp, Homo sapiens
aggagttcgagaccag

SEQ ID NO: 3704497 - DNA, 17 bp, Homo sapiens
aggagttcgaggctgca

SEQ ID NO: 3704498 - DNA, 14 bp, Homo sapiens
aggagttgctgttt

SEQ ID NO: 3704499 - DNA, 21 bp, Homo sapiens
aggagtttgagaccaacctgg

SEQ ID NO: 3704500 - DNA, 20 bp, Homo sapiens
aggagtttgaggctgcagcg

SEQ ID NO: 3704501 - DNA, 18 bp, Homo sapiens
aggataacacaagtaaaa

SEQ ID NO: 3704502 - DNA, 14 bp, Homo sapiens
aggatatttaagaa

SEQ ID NO: 3704503 - DNA, 21 bp, Homo sapiens
atccctaccccctaagagcca

SEQ ID NO: 3704504 - DNA, 14 bp, Homo sapiens
atccctgccagctc

SEQ ID NO: 3704505 - DNA, 12 bp, Homo sapiens
atccctgttcat

SEQ ID NO: 3704506 - DNA, 13 bp, Homo sapiens
atccctgttcatt

SEQ ID NO: 3704507 - DNA, 21 bp, Homo sapiens
atcccttccttttagcctagt

SEQ ID NO: 3704508 - DNA, 15 bp, Homo sapiens
atcccttttcttgac

SEQ ID NO: 3704509 - DNA, 13 bp, Homo sapiens
atccgaggcaggg

SEQ ID NO: 3704510 - DNA, 15 bp, Homo sapiens
atccggcagcctgga

SEQ ID NO: 3704511 - DNA, 22 bp, Homo sapiens
atccgtgagcagtgtgtctcct

SEQ ID NO: 3704512 - DNA, 12 bp, Homo sapiens
atcctaagctat

SEQ ID NO: 3704513 - DNA, 21 bp, Homo sapiens
atcctaagctattcagtaata

SEQ ID NO: 3704514 - DNA, 19 bp, Homo sapiens
atcctaagttacctttcta

SEQ ID NO: 3704515 - DNA, 19 bp, Homo sapiens
atcctaatcatccaatgct

SEQ ID NO: 3704516 - DNA, 21 bp, Homo sapiens
atcctaccacaatgcagtgcc

SEQ ID NO: 3704517 - DNA, 22 bp, Homo sapiens
atcctaccacaatgcagtgcct

SEQ ID NO: 3704518 - DNA, 13 bp, Homo sapiens
atcctagctgtgt

SEQ ID NO: 3704519 - DNA, 14 bp, Homo sapiens
atcctagctgtgtg

SEQ ID NO: 3704520 - DNA, 15 bp, Homo sapiens
atcctagctgtgtgc

SEQ ID NO: 3704521 - DNA, 19 bp, Homo sapiens
atcctcagttcctgcagca

SEQ ID NO: 3704522 - DNA, 23 bp, Homo sapiens
atcctccaacttcatttgatgct

SEQ ID NO: 3704523 - DNA, 18 bp, Homo sapiens
atcctcccacctcagcct

SEQ ID NO: 3704524 - DNA, 15 bp, Homo sapiens
atcctccccttccct

SEQ ID NO: 3704525 - DNA, 16 bp, Homo sapiens
atcctccgtccagccg

SEQ ID NO: 3704526 - DNA, 16 bp, Homo sapiens
atcctgaaatttcaga

SEQ ID NO: 3704527 - DNA, 17 bp, Homo sapiens
atcctgaaatttcagat

SEQ ID NO: 3704528 - DNA, 12 bp, Homo sapiens
atcctgagccat

SEQ ID NO: 3704529 - DNA, 14 bp, Homo sapiens
atcctgcccagtgt

SEQ ID NO: 3704530 - DNA, 20 bp, Homo sapiens
atcctggcacccggcccctg

SEQ ID NO: 3704531 - DNA, 23 bp, Homo sapiens
atcctggcacccggcccctgctg

SEQ ID NO: 3704532 - DNA, 18 bp, Homo sapiens
atcctggctctgtggctt

SEQ ID NO: 3704533 - DNA, 22 bp, Homo sapiens
atcctggctctgtggcttgcta

SEQ ID NO: 3704534 - DNA, 15 bp, Homo sapiens
atcctggctttgccc

SEQ ID NO: 3704535 - DNA, 14 bp, Homo sapiens
atcctgtcctcagc

SEQ ID NO: 3704536 - DNA, 17 bp, Homo sapiens
atcctgtcctcagcttc

SEQ ID NO: 3704537 - DNA, 19 bp, Homo sapiens
atcctgtctttaaggaaaa

SEQ ID NO: 3704538 - DNA, 21 bp, Homo sapiens
atcctgtctttaaggaaaaaa

SEQ ID NO: 3704539 - DNA, 21 bp, Homo sapiens
atcctgtgtggtttagtgtaa

SEQ ID NO: 3704540 - DNA, 12 bp, Homo sapiens
atcctgttgaaa

SEQ ID NO: 3704541 - DNA, 13 bp, Homo sapiens
atcctgttgaaaa

SEQ ID NO: 3704542 - DNA, 19 bp, Homo sapiens
atccttaagtatcagaaag

SEQ ID NO: 3704543 - DNA, 20 bp, Homo sapiens
atccttcaagaactctgggc

SEQ ID NO: 3704544 - DNA, 12 bp, Homo sapiens
atccttccacgg

SEQ ID NO: 3704545 - DNA, 16 bp, Homo sapiens
atccttttctcctatc

SEQ ID NO: 3704546 - DNA, 20 bp, Homo sapiens
atcgatgggggatgcttcat

SEQ ID NO: 3704547 - DNA, 19 bp, Homo sapiens
atcgccctccacatccctg

SEQ ID NO: 3704548 - DNA, 21 bp, Homo sapiens
atcgctccaccttgcagctct

SEQ ID NO: 3704549 - DNA, 13 bp, Homo sapiens
atcggagacagtg

SEQ ID NO: 3704550 - DNA, 16 bp, Homo sapiens
atcgggaacagtgttt

SEQ ID NO: 3704551 - DNA, 17 bp, Homo sapiens
atcgggagcagtgtctt

SEQ ID NO: 3704552 - DNA, 21 bp, Homo sapiens
atcgggagcagtgtcttccat

SEQ ID NO: 3704553 - DNA, 15 bp, Homo sapiens
atcgggggctggggc

SEQ ID NO: 3704554 - DNA, 13 bp, Homo sapiens
atcgtctaaactt

SEQ ID NO: 3704555 - DNA, 14 bp, Homo sapiens
atcgtgacaacact

SEQ ID NO: 3704556 - DNA, 15 bp, Homo sapiens
atcgtgacaacactt

SEQ ID NO: 3704557 - DNA, 18 bp, Homo sapiens
atcgtgccgttactctcc

SEQ ID NO: 3704558 - DNA, 14 bp, Homo sapiens
atcgttatgtgtgt

SEQ ID NO: 3704559 - DNA, 15 bp, Homo sapiens
atcgttatgtgtgta

SEQ ID NO: 3704560 - DNA, 22 bp, Homo sapiens
atctaaactttaatatgtattt

SEQ ID NO: 3704561 - DNA, 15 bp, Homo sapiens
atctaacaatggaag

SEQ ID NO: 3704562 - DNA, 23 bp, Homo sapiens
atctaatatgtaacaagccaccc

SEQ ID NO: 3704563 - DNA, 16 bp, Homo sapiens
atctaccttttctctt

SEQ ID NO: 3704564 - DNA, 15 bp, Homo sapiens
atctagaagaaatga

SEQ ID NO: 3704565 - DNA, 17 bp, Homo sapiens
atctagaagaaatgaaa

SEQ ID NO: 3704566 - DNA, 21 bp, Homo sapiens
atctagaagaaatgaaatttt

SEQ ID NO: 3704567 - DNA, 22 bp, Homo sapiens
atctagaagaaatgaaatttta

SEQ ID NO: 3704568 - DNA, 14 bp, Homo sapiens
atctagtgcagctg

SEQ ID NO: 3704569 - DNA, 15 bp, Homo sapiens
atctagtgcagctga

SEQ ID NO: 3704570 - DNA, 22 bp, Homo sapiens
atctagtgcagctgattttaac

SEQ ID NO: 3704571 - DNA, 15 bp, Homo sapiens
atctatatttaacaa

SEQ ID NO: 3704572 - DNA, 14 bp, Homo sapiens
atctatcagagtat

SEQ ID NO: 3704573 - DNA, 17 bp, Homo sapiens
atctatcgagtttgcaa

SEQ ID NO: 3704574 - DNA, 23 bp, Homo sapiens
atctattgctggcaaagacagaa

SEQ ID NO: 3704575 - DNA, 17 bp, Homo sapiens
atctattgggttcatta

SEQ ID NO: 3704576 - DNA, 20 bp, Homo sapiens
atctattgtaagataaaaaa

SEQ ID NO: 3704577 - DNA, 14 bp, Homo sapiens
atctatttattgga

SEQ ID NO: 3704578 - DNA, 14 bp, Homo sapiens
atctcaatttgagt

SEQ ID NO: 3704579 - DNA, 14 bp, Homo sapiens
atctcaccccatcc

SEQ ID NO: 3704580 - DNA, 15 bp, Homo sapiens
atctcacttttctcc

SEQ ID NO: 3704581 - DNA, 19 bp, Homo sapiens
atctcacttttctccatga

SEQ ID NO: 3704582 - DNA, 20 bp, Homo sapiens
atctcagaattccttttcta

SEQ ID NO: 3704583 - DNA, 14 bp, Homo sapiens
atctcaggccacct

SEQ ID NO: 3704584 - DNA, 16 bp, Homo sapiens
atctcagggaagccca

SEQ ID NO: 3704585 - DNA, 17 bp, Homo sapiens
atctcagggaagcccag

SEQ ID NO: 3704586 - DNA, 22 bp, Homo sapiens
atctcagggaagcccagctcca

SEQ ID NO: 3704587 - DNA, 14 bp, Homo sapiens
atctcagggcctgg

SEQ ID NO: 3704588 - DNA, 16 bp, Homo sapiens
atctcagggcctggtc

SEQ ID NO: 3704589 - DNA, 14 bp, Homo sapiens
atctccagggagca

SEQ ID NO: 3704590 - DNA, 16 bp, Homo sapiens
atctccagggagcaag

SEQ ID NO: 3704591 - DNA, 15 bp, Homo sapiens
atctccctgccgcct

SEQ ID NO: 3704592 - DNA, 22 bp, Homo sapiens
atctcctgaggatcagaaagta

SEQ ID NO: 3704593 - DNA, 15 bp, Homo sapiens
atctcctgtgcatgg

SEQ ID NO: 3704594 - DNA, 16 bp, Homo sapiens
atctccttgtcttttt

SEQ ID NO: 3704595 - DNA, 18 bp, Homo sapiens
atctctactaaaaataca

SEQ ID NO: 3704596 - DNA, 20 bp, Homo sapiens
atctctactaaaaatacaaa

SEQ ID NO: 3704597 - DNA, 23 bp, Homo sapiens
atctctccctcccctgccatttt

SEQ ID NO: 3704598 - DNA, 21 bp, Homo sapiens
atctctctactcctacctcag

SEQ ID NO: 3704599 - DNA, 17 bp, Homo sapiens
atctctgctttggaaat

SEQ ID NO: 3704600 - DNA, 15 bp, Homo sapiens
atctcttgagcctgg

SEQ ID NO: 3704601 - DNA, 22 bp, Homo sapiens
atctcttttgaatccatgcttg

SEQ ID NO: 3704602 - DNA, 12 bp, Homo sapiens
atctgaaaatgt

SEQ ID NO: 3704603 - DNA, 14 bp, Homo sapiens
atctgaaaatgtat

SEQ ID NO: 3704604 - DNA, 20 bp, Homo sapiens
atctgaaaatgtatgtgtaa

SEQ ID NO: 3704605 - DNA, 17 bp, Homo sapiens
atctgaatgtaatttgt

SEQ ID NO: 3704606 - DNA, 21 bp, Homo sapiens
atctgagaccccaaactctcc

SEQ ID NO: 3704607 - DNA, 16 bp, Homo sapiens
atctgatcgttctttc

SEQ ID NO: 3704608 - DNA, 20 bp, Homo sapiens
atctgatcgttctttctagc

SEQ ID NO: 3704609 - DNA, 18 bp, Homo sapiens
atctgcacccccctgggc

SEQ ID NO: 3704610 - DNA, 14 bp, Homo sapiens
atctgcatttagca

SEQ ID NO: 3704611 - DNA, 22 bp, Homo sapiens
atctgcattttcaccccaccct

SEQ ID NO: 3704612 - DNA, 12 bp, Homo sapiens
atctgcccctcc

SEQ ID NO: 3704613 - DNA, 15 bp, Homo sapiens
atctgcccctccccc

SEQ ID NO: 3704614 - DNA, 15 bp, Homo sapiens
atctggactcctctg

SEQ ID NO: 3704615 - DNA, 11 bp, Homo sapiens
atctggcctta

SEQ ID NO: 3704616 - DNA, 16 bp, Homo sapiens
atctgggaagatttct

SEQ ID NO: 3704617 - DNA, 17 bp, Homo sapiens
atctggtagatttttaa

SEQ ID NO: 3704618 - DNA, 18 bp, Homo sapiens
atcaaattctacaacttt

SEQ ID NO: 3704619 - DNA, 21 bp, Homo sapiens
atcaaatttgtagggtttcta

SEQ ID NO: 3704620 - DNA, 20 bp, Homo sapiens
atcaaccccttcgctcctgt

SEQ ID NO: 3704621 - DNA, 23 bp, Homo sapiens
atcaactgaaagtgtttccttca

SEQ ID NO: 3704622 - DNA, 18 bp, Homo sapiens
atcaagatgtcagactgg

SEQ ID NO: 3704623 - DNA, 22 bp, Homo sapiens
atcaagttggcttctaatcaaa

SEQ ID NO: 3704624 - DNA, 22 bp, Homo sapiens
atcaagtttccaagcaaatgtt

SEQ ID NO: 3704625 - DNA, 14 bp, Homo sapiens
atcaatgagtaaca

SEQ ID NO: 3704626 - DNA, 14 bp, Homo sapiens
atcaatgttcattg

SEQ ID NO: 3704627 - DNA, 15 bp, Homo sapiens
atcaatgttcattgt

SEQ ID NO: 3704628 - DNA, 17 bp, Homo sapiens
atcaatgttcattgtaa

SEQ ID NO: 3704629 - DNA, 15 bp, Homo sapiens
atcaattaaatgtag

SEQ ID NO: 3704630 - DNA, 20 bp, Homo sapiens
atcaatttgtcattttgaag

SEQ ID NO: 3704631 - DNA, 13 bp, Homo sapiens
atcacagcctctg

SEQ ID NO: 3704632 - DNA, 22 bp, Homo sapiens
atcacagggccccagaaggcag

SEQ ID NO: 3704633 - DNA, 19 bp, Homo sapiens
atcacagggttgggcccag

SEQ ID NO: 3704634 - DNA, 15 bp, Homo sapiens
atcacataacagaat

SEQ ID NO: 3704635 - DNA, 15 bp, Homo sapiens
atcacattatttgca

SEQ ID NO: 3704636 - DNA, 20 bp, Homo sapiens
atcaccgagagtagccgaga

SEQ ID NO: 3704637 - DNA, 15 bp, Homo sapiens
atcacctagaaactt

SEQ ID NO: 3704638 - DNA, 13 bp, Homo sapiens
atcacctcccctc

SEQ ID NO: 3704639 - DNA, 15 bp, Homo sapiens
atcaccttaggcagg

SEQ ID NO: 3704640 - DNA, 18 bp, Homo sapiens
atcaccttaggcagggaa

SEQ ID NO: 3704641 - DNA, 20 bp, Homo sapiens
atcaccttaggcagggaagt

SEQ ID NO: 3704642 - DNA, 20 bp, Homo sapiens
atcacgaggtcaggagttca

SEQ ID NO: 3704643 - DNA, 16 bp, Homo sapiens
atcactaacattatat

SEQ ID NO: 3704644 - DNA, 21 bp, Homo sapiens
atcactaacattatattgcaa

SEQ ID NO: 3704645 - DNA, 21 bp, Homo sapiens
atcactctcagtgcttcttac

SEQ ID NO: 3704646 - DNA, 10 bp, Homo sapiens
atcactggag

SEQ ID NO: 3704647 - DNA, 19 bp, Homo sapiens
atcactggagcaccaggca

SEQ ID NO: 3704648 - DNA, 23 bp, Homo sapiens
atcactggagcaccaggcacgaa

SEQ ID NO: 3704649 - DNA, 14 bp, Homo sapiens
atcactggagccca

SEQ ID NO: 3704650 - DNA, 22 bp, Homo sapiens
atcactggcaatgaaaaattct

SEQ ID NO: 3704651 - DNA, 14 bp, Homo sapiens
atcacttgtacaaa

SEQ ID NO: 3704652 - DNA, 17 bp, Homo sapiens
atcacttgtacaaaata

SEQ ID NO: 3704653 - DNA, 18 bp, Homo sapiens
atcacttgtacaaaataa

SEQ ID NO: 3704654 - DNA, 12 bp, Homo sapiens
atcactttgctc

SEQ ID NO: 3704655 - DNA, 15 bp, Homo sapiens
atcactttgctctga

SEQ ID NO: 3704656 - DNA, 14 bp, Homo sapiens
atcacttttctgta

SEQ ID NO: 3704657 - DNA, 18 bp, Homo sapiens
atcagaagtttctcagct

SEQ ID NO: 3704658 - DNA, 11 bp, Homo sapiens
atcagaattct

SEQ ID NO: 3704659 - DNA, 12 bp, Homo sapiens
atcagaattctc

SEQ ID NO: 3704660 - DNA, 20 bp, Homo sapiens
atcagaccataatgttacat

SEQ ID NO: 3704661 - DNA, 15 bp, Homo sapiens
atcagaccctacccc

SEQ ID NO: 3704662 - DNA, 12 bp, Homo sapiens
atcagacctgtc

SEQ ID NO: 3704663 - DNA, 14 bp, Homo sapiens
atcagacctgtctt

SEQ ID NO: 3704664 - DNA, 16 bp, Homo sapiens
atcagacctgtcttcc

SEQ ID NO: 3704665 - DNA, 18 bp, Homo sapiens
atcagatcatttcaaaac

SEQ ID NO: 3704666 - DNA, 13 bp, Homo sapiens
atcagcaaagaat

SEQ ID NO: 3704667 - DNA, 24 bp, Homo sapiens
atcagccctgcccttcagcatcct

SEQ ID NO: 3704668 - DNA, 17 bp, Homo sapiens
atcagcctgctccagct

SEQ ID NO: 3704669 - DNA, 20 bp, Homo sapiens
atcagcctgctccagctgtt

SEQ ID NO: 3704670 - DNA, 11 bp, Homo sapiens
atcagcctggg

SEQ ID NO: 3704671 - DNA, 23 bp, Homo sapiens
atcagctagcaaaagaagtaaca

SEQ ID NO: 3704672 - DNA, 18 bp, Homo sapiens
atcagctccactttcagt

SEQ ID NO: 3704673 - DNA, 16 bp, Homo sapiens
atcagctgtttgtcat

SEQ ID NO: 3704674 - DNA, 20 bp, Homo sapiens
atcaggaaatatatatgtgt

SEQ ID NO: 3704675 - DNA, 21 bp, Homo sapiens
atcagggcaatcccaacacat

SEQ ID NO: 3704676 - DNA, 19 bp, Homo sapiens
atcaggtgctgccatccag

SEQ ID NO: 3704677 - DNA, 21 bp, Homo sapiens
atcagtcctctttcaaaggta

SEQ ID NO: 3704678 - DNA, 19 bp, Homo sapiens
atcagtggttatttaggga

SEQ ID NO: 3704679 - DNA, 18 bp, Homo sapiens
atcagttactcagccctg

SEQ ID NO: 3704680 - DNA, 19 bp, Homo sapiens
atcagttactcagccctgg

SEQ ID NO: 3704681 - DNA, 14 bp, Homo sapiens
atcataaactgtgt

SEQ ID NO: 3704682 - DNA, 15 bp, Homo sapiens
atcatagaaatgtaa

SEQ ID NO: 3704683 - DNA, 19 bp, Homo sapiens
atcatagatttctgatttt

SEQ ID NO: 3704684 - DNA, 20 bp, Homo sapiens
atcatgacactcgtataagc

SEQ ID NO: 3704685 - DNA, 15 bp, Homo sapiens
atcatggaaatatta

SEQ ID NO: 3704686 - DNA, 19 bp, Homo sapiens
atcatggaggtttgaagat

SEQ ID NO: 3704687 - DNA, 18 bp, Homo sapiens
atcatggctcactgcagc

SEQ ID NO: 3704688 - DNA, 14 bp, Homo sapiens
atcatgtctggcta

SEQ ID NO: 3704689 - DNA, 20 bp, Homo sapiens
atcatgttatgataaaaaat

SEQ ID NO: 3704690 - DNA, 23 bp, Homo sapiens
atcattaaatttttccttagcat

SEQ ID NO: 3704691 - DNA, 22 bp, Homo sapiens
atcattataactgaaggagaag

SEQ ID NO: 3704692 - DNA, 12 bp, Homo sapiens
atcattcagcaa

SEQ ID NO: 3704693 - DNA, 18 bp, Homo sapiens
atcattgattgtcagcta

SEQ ID NO: 3704694 - DNA, 19 bp, Homo sapiens
atcatttattttttacatt

SEQ ID NO: 3704695 - DNA, 22 bp, Homo sapiens
atcatttattttttacattatt

SEQ ID NO: 3704696 - DNA, 18 bp, Homo sapiens
atcatttcttgggccctc

SEQ ID NO: 3704697 - DNA, 19 bp, Homo sapiens
atcatttcttgggccctcc

SEQ ID NO: 3704698 - DNA, 22 bp, Homo sapiens
atcatttcttgggccctcctga

SEQ ID NO: 3704699 - DNA, 18 bp, Homo sapiens
atccaaccccccacctgc

SEQ ID NO: 3704700 - DNA, 20 bp, Homo sapiens
atccaaccccccacctgcca

SEQ ID NO: 3704701 - DNA, 22 bp, Homo sapiens
atccaagacagaataatgaatg

SEQ ID NO: 3704702 - DNA, 21 bp, Homo sapiens
atccaagctggtcccactcag

SEQ ID NO: 3704703 - DNA, 14 bp, Homo sapiens
atccaatcctcact

SEQ ID NO: 3704704 - DNA, 23 bp, Homo sapiens
atccacacacagaggaagagcag

SEQ ID NO: 3704705 - DNA, 16 bp, Homo sapiens
atccacccacctcagc

SEQ ID NO: 3704706 - DNA, 20 bp, Homo sapiens
atccacccacctcagcctcc

SEQ ID NO: 3704707 - DNA, 13 bp, Homo sapiens
atccacccagccc

SEQ ID NO: 3704708 - DNA, 21 bp, Homo sapiens
atccacctgtctcagcctccc

SEQ ID NO: 3704709 - DNA, 23 bp, Homo sapiens
atccactctaccctcccaccccc

SEQ ID NO: 3704710 - DNA, 21 bp, Homo sapiens
atccactgtgccatgtgccag

SEQ ID NO: 3704711 - DNA, 12 bp, Homo sapiens
atccactttgca

SEQ ID NO: 3704712 - DNA, 20 bp, Homo sapiens
atccagaattgaccttttga

SEQ ID NO: 3704713 - DNA, 22 bp, Homo sapiens
atccagagtttagaggaaaaaa

SEQ ID NO: 3704714 - DNA, 20 bp, Homo sapiens
atccagatacacccaaagta

SEQ ID NO: 3704715 - DNA, 13 bp, Homo sapiens
atccatcaggcca

SEQ ID NO: 3704716 - DNA, 19 bp, Homo sapiens
atccatgggggcagggcat

SEQ ID NO: 3704717 - DNA, 18 bp, Homo sapiens
atccatttcatctatttc

SEQ ID NO: 3704718 - DNA, 14 bp, Homo sapiens
atcccacaccctgg

SEQ ID NO: 3704719 - DNA, 16 bp, Homo sapiens
atcccacttgcccctg

SEQ ID NO: 3704720 - DNA, 21 bp, Homo sapiens
atcccagcactttgggaggcc

SEQ ID NO: 3704721 - DNA, 23 bp, Homo sapiens
atcccagctactcaagaggctga

SEQ ID NO: 3704722 - DNA, 12 bp, Homo sapiens
atcccaggggac

SEQ ID NO: 3704723 - DNA, 23 bp, Homo sapiens
atcccaggggaccacacctccct

SEQ ID NO: 3704724 - DNA, 18 bp, Homo sapiens
atcccatcccatcccatc

SEQ ID NO: 3704725 - DNA, 18 bp, Homo sapiens
atcccatgagcctcagca

SEQ ID NO: 3704726 - DNA, 17 bp, Homo sapiens
atcccattgccctggtt

SEQ ID NO: 3704727 - DNA, 21 bp, Homo sapiens
atccccaggggtcccagccac

SEQ ID NO: 3704728 - DNA, 16 bp, Homo sapiens
atccccgctggctggg

SEQ ID NO: 3704729 - DNA, 15 bp, Homo sapiens
atcccctgtagagtg

SEQ ID NO: 3704730 - DNA, 20 bp, Homo sapiens
atcccgattcaccctgtcca

SEQ ID NO: 3704731 - DNA, 17 bp, Homo sapiens
atcccgctcttttccta

SEQ ID NO: 3704732 - DNA, 13 bp, Homo sapiens
atataactgcctt

SEQ ID NO: 3704733 - DNA, 14 bp, Homo sapiens
atataataaagtat

SEQ ID NO: 3704734 - DNA, 20 bp, Homo sapiens
atataataaagtattccacc

SEQ ID NO: 3704735 - DNA, 21 bp, Homo sapiens
atataataaatgtacattaat

SEQ ID NO: 3704736 - DNA, 22 bp, Homo sapiens
atataatgttgttatttaaaga

SEQ ID NO: 3704737 - DNA, 21 bp, Homo sapiens
atataattatcggaagcagtg

SEQ ID NO: 3704738 - DNA, 14 bp, Homo sapiens
atataattatgtta

SEQ ID NO: 3704739 - DNA, 20 bp, Homo sapiens
atataattttttagagagct

SEQ ID NO: 3704740 - DNA, 18 bp, Homo sapiens
atatacaataacataatt

SEQ ID NO: 3704741 - DNA, 18 bp, Homo sapiens
atatacacacacaaagag

SEQ ID NO: 3704742 - DNA, 21 bp, Homo sapiens
atatacacacacaaagagagt

SEQ ID NO: 3704743 - DNA, 13 bp, Homo sapiens
atatacacacagc

SEQ ID NO: 3704744 - DNA, 14 bp, Homo sapiens
atatacataacagg

SEQ ID NO: 3704745 - DNA, 22 bp, Homo sapiens
atatacttttttcttatttaac

SEQ ID NO: 3704746 - DNA, 21 bp, Homo sapiens
atatagaattgcaattttaac

SEQ ID NO: 3704747 - DNA, 14 bp, Homo sapiens
atatagatcacata

SEQ ID NO: 3704748 - DNA, 20 bp, Homo sapiens
atatagatcacataacagaa

SEQ ID NO: 3704749 - DNA, 14 bp, Homo sapiens
atatatacataaca

SEQ ID NO: 3704750 - DNA, 14 bp, Homo sapiens
atatatacatatat

SEQ ID NO: 3704751 - DNA, 13 bp, Homo sapiens
atatatagaatct

SEQ ID NO: 3704752 - DNA, 15 bp, Homo sapiens
atatatgtatgtaaa

SEQ ID NO: 3704753 - DNA, 16 bp, Homo sapiens
atatatgtgtgtgtat

SEQ ID NO: 3704754 - DNA, 15 bp, Homo sapiens
atatatgtgtttttc

SEQ ID NO: 3704755 - DNA, 21 bp, Homo sapiens
atatatgtgtttttcacattt

SEQ ID NO: 3704756 - DNA, 16 bp, Homo sapiens
atatatgttgatttct

SEQ ID NO: 3704757 - DNA, 13 bp, Homo sapiens
atatatgttttaa

SEQ ID NO: 3704758 - DNA, 12 bp, Homo sapiens
atatattctctt

SEQ ID NO: 3704759 - DNA, 14 bp, Homo sapiens
atatattctctttg

SEQ ID NO: 3704760 - DNA, 14 bp, Homo sapiens
atatatttataact

SEQ ID NO: 3704761 - DNA, 21 bp, Homo sapiens
atatatttttcacagtttttc

SEQ ID NO: 3704762 - DNA, 23 bp, Homo sapiens
atatcagttactcagccctgggc

SEQ ID NO: 3704763 - DNA, 14 bp, Homo sapiens
atatccatgtactg

SEQ ID NO: 3704764 - DNA, 13 bp, Homo sapiens
atatctatcttat

SEQ ID NO: 3704765 - DNA, 14 bp, Homo sapiens
atatctatcttata

SEQ ID NO: 3704766 - DNA, 13 bp, Homo sapiens
atatgaaaaatat

SEQ ID NO: 3704767 - DNA, 17 bp, Homo sapiens
atatgaaaaatatgata

SEQ ID NO: 3704768 - DNA, 16 bp, Homo sapiens
atatgaaaatacaact

SEQ ID NO: 3704769 - DNA, 14 bp, Homo sapiens
atatgacagctgtc

SEQ ID NO: 3704770 - DNA, 13 bp, Homo sapiens
atatgactcacat

SEQ ID NO: 3704771 - DNA, 20 bp, Homo sapiens
atatgagctttatgtaataa

SEQ ID NO: 3704772 - DNA, 16 bp, Homo sapiens
atatgatatgtaaaca

SEQ ID NO: 3704773 - DNA, 21 bp, Homo sapiens
atatgattagtaaagaaatga

SEQ ID NO: 3704774 - DNA, 17 bp, Homo sapiens
atatgctctgcatgtta

SEQ ID NO: 3704775 - DNA, 22 bp, Homo sapiens
atatgctgccaaattttggcca

SEQ ID NO: 3704776 - DNA, 17 bp, Homo sapiens
atatggggggccaacac

SEQ ID NO: 3704777 - DNA, 13 bp, Homo sapiens
atatgtaaaataa

SEQ ID NO: 3704778 - DNA, 14 bp, Homo sapiens
atatgtaccatgta

SEQ ID NO: 3704779 - DNA, 16 bp, Homo sapiens
atatgtatgtgtgtat

SEQ ID NO: 3704780 - DNA, 13 bp, Homo sapiens
atatgtattttat

SEQ ID NO: 3704781 - DNA, 19 bp, Homo sapiens
atatgtattttatgtatgt

SEQ ID NO: 3704782 - DNA, 14 bp, Homo sapiens
atatgtcaagccat

SEQ ID NO: 3704783 - DNA, 14 bp, Homo sapiens
atatgtcagggcgt

SEQ ID NO: 3704784 - DNA, 16 bp, Homo sapiens
atatgtgtgtgtatgt

SEQ ID NO: 3704785 - DNA, 17 bp, Homo sapiens
atatgtgtttttcacat

SEQ ID NO: 3704786 - DNA, 20 bp, Homo sapiens
atatgttaacctcagtgtca

SEQ ID NO: 3704787 - DNA, 22 bp, Homo sapiens
atatgttgatgaaaaatagcaa

SEQ ID NO: 3704788 - DNA, 20 bp, Homo sapiens
atatgttttaagaggcaggg

SEQ ID NO: 3704789 - DNA, 22 bp, Homo sapiens
atattagcatttagtccaatgt

SEQ ID NO: 3704790 - DNA, 20 bp, Homo sapiens
atattatactaagaaaagat

SEQ ID NO: 3704791 - DNA, 22 bp, Homo sapiens
atattatatatattttgtttct

SEQ ID NO: 3704792 - DNA, 19 bp, Homo sapiens
atattatcatgcaaatgct

SEQ ID NO: 3704793 - DNA, 21 bp, Homo sapiens
atattatcatgcaaatgctgt

SEQ ID NO: 3704794 - DNA, 23 bp, Homo sapiens
atattattcaccatgtaaaacaa

SEQ ID NO: 3704795 - DNA, 22 bp, Homo sapiens
atattcagtgctgtggcctggg

SEQ ID NO: 3704796 - DNA, 23 bp, Homo sapiens
atattcagtgctgtggcctgggc

SEQ ID NO: 3704797 - DNA, 15 bp, Homo sapiens
atattcattgtataa

SEQ ID NO: 3704798 - DNA, 21 bp, Homo sapiens
atattcattgtataaaaatag

SEQ ID NO: 3704799 - DNA, 13 bp, Homo sapiens
atattcatttgga

SEQ ID NO: 3704800 - DNA, 15 bp, Homo sapiens
atattcatttggaaa

SEQ ID NO: 3704801 - DNA, 16 bp, Homo sapiens
atattccatgaatgta

SEQ ID NO: 3704802 - DNA, 19 bp, Homo sapiens
atattccatgaatgtatca

SEQ ID NO: 3704803 - DNA, 18 bp, Homo sapiens
atattcccctatctctag

SEQ ID NO: 3704804 - DNA, 15 bp, Homo sapiens
atattcctgaatgaa

SEQ ID NO: 3704805 - DNA, 17 bp, Homo sapiens
atattcctgaatgaaat

SEQ ID NO: 3704806 - DNA, 13 bp, Homo sapiens
atattctctttgg

SEQ ID NO: 3704807 - DNA, 22 bp, Homo sapiens
atattctctttggtgtacaaaa

SEQ ID NO: 3704808 - DNA, 16 bp, Homo sapiens
atattctgttggccag

SEQ ID NO: 3704809 - DNA, 13 bp, Homo sapiens
atattctttcaat

SEQ ID NO: 3704810 - DNA, 20 bp, Homo sapiens
atattgagacaaaaattatc

SEQ ID NO: 3704811 - DNA, 16 bp, Homo sapiens
atattgcatatgcata

SEQ ID NO: 3704812 - DNA, 15 bp, Homo sapiens
atattgtcagatatt

SEQ ID NO: 3704813 - DNA, 13 bp, Homo sapiens
atattgttcctaa

SEQ ID NO: 3704814 - DNA, 13 bp, Homo sapiens
atattgttttcag

SEQ ID NO: 3704815 - DNA, 17 bp, Homo sapiens
atattgttttcagtgta

SEQ ID NO: 3704816 - DNA, 19 bp, Homo sapiens
atatttaaatgtaaagaca

SEQ ID NO: 3704817 - DNA, 18 bp, Homo sapiens
atatttaagaaaatacaa

SEQ ID NO: 3704818 - DNA, 22 bp, Homo sapiens
atatttaagaaaatacaataaa

SEQ ID NO: 3704819 - DNA, 23 bp, Homo sapiens
atatttaagaaaatacaataaac

SEQ ID NO: 3704820 - DNA, 23 bp, Homo sapiens
atatttaaggagatgtaagagct

SEQ ID NO: 3704821 - DNA, 20 bp, Homo sapiens
atatttaagtattcaagaaa

SEQ ID NO: 3704822 - DNA, 16 bp, Homo sapiens
atatttataacagcat

SEQ ID NO: 3704823 - DNA, 23 bp, Homo sapiens
atatttataactcatcataaaat

SEQ ID NO: 3704824 - DNA, 20 bp, Homo sapiens
atatttatataattatgtta

SEQ ID NO: 3704825 - DNA, 22 bp, Homo sapiens
atatttgttaaatatttacata

SEQ ID NO: 3704826 - DNA, 19 bp, Homo sapiens
atattttaacctgcataaa

SEQ ID NO: 3704827 - DNA, 15 bp, Homo sapiens
atattttaagcatta

SEQ ID NO: 3704828 - DNA, 21 bp, Homo sapiens
atattttaagcattactcttg

SEQ ID NO: 3704829 - DNA, 15 bp, Homo sapiens
atattttatgtgaga

SEQ ID NO: 3704830 - DNA, 19 bp, Homo sapiens
atattttcaaagtacataa

SEQ ID NO: 3704831 - DNA, 17 bp, Homo sapiens
atattttcaaattgtat

SEQ ID NO: 3704832 - DNA, 16 bp, Homo sapiens
atattttcaattcaaa

SEQ ID NO: 3704833 - DNA, 16 bp, Homo sapiens
atattttccatgaaaa

SEQ ID NO: 3704834 - DNA, 15 bp, Homo sapiens
atatttttaataaaa

SEQ ID NO: 3704835 - DNA, 19 bp, Homo sapiens
atatttttaataaaagttg

SEQ ID NO: 3704836 - DNA, 19 bp, Homo sapiens
atatttttatagacaaata

SEQ ID NO: 3704837 - DNA, 20 bp, Homo sapiens
atatttttgtttgttttgtg

SEQ ID NO: 3704838 - DNA, 14 bp, Homo sapiens
atatttttttaagt

SEQ ID NO: 3704839 - DNA, 20 bp, Homo sapiens
atcaaaaggttaataaagta

SEQ ID NO: 3704840 - DNA, 24 bp, Homo sapiens
atcaaaaggttaataaagtaatta

SEQ ID NO: 3704841 - DNA, 17 bp, Homo sapiens
atcaaaataaattgaaa

SEQ ID NO: 3704842 - DNA, 21 bp, Homo sapiens
atcaaaatctgtagagcaggg

SEQ ID NO: 3704843 - DNA, 14 bp, Homo sapiens
atcaaactgaagcc

SEQ ID NO: 3704844 - DNA, 16 bp, Homo sapiens
atcaaactgaagccag

SEQ ID NO: 3704845 - DNA, 20 bp, Homo sapiens
atcaaatagaaccactatga

SEQ ID NO: 3704846 - DNA, 18 bp, Homo sapiens
ataatgttgtggtttgtt

SEQ ID NO: 3704847 - DNA, 21 bp, Homo sapiens
ataatgttgtggtttgttgcc

SEQ ID NO: 3704848 - DNA, 19 bp, Homo sapiens
ataatgtttaatattgaga

SEQ ID NO: 3704849 - DNA, 22 bp, Homo sapiens
ataatgtttaatattgagaaag

SEQ ID NO: 3704850 - DNA, 14 bp, Homo sapiens
ataatgtttgctat

SEQ ID NO: 3704851 - DNA, 16 bp, Homo sapiens
ataattataatatact

SEQ ID NO: 3704852 - DNA, 20 bp, Homo sapiens
ataattatgacagttatact

SEQ ID NO: 3704853 - DNA, 12 bp, Homo sapiens
ataattccctat

SEQ ID NO: 3704854 - DNA, 19 bp, Homo sapiens
ataattccctatcttttag

SEQ ID NO: 3704855 - DNA, 20 bp, Homo sapiens
ataattccctatcttttagt

SEQ ID NO: 3704856 - DNA, 16 bp, Homo sapiens
ataattctttgattat

SEQ ID NO: 3704857 - DNA, 14 bp, Homo sapiens
ataattgtttttta

SEQ ID NO: 3704858 - DNA, 18 bp, Homo sapiens
ataattgttttttatctt

SEQ ID NO: 3704859 - DNA, 21 bp, Homo sapiens
ataatttcccaattaggaagt

SEQ ID NO: 3704860 - DNA, 12 bp, Homo sapiens
ataattttatga

SEQ ID NO: 3704861 - DNA, 21 bp, Homo sapiens
ataattttgcataaaattgga

SEQ ID NO: 3704862 - DNA, 12 bp, Homo sapiens
atacaagataag

SEQ ID NO: 3704863 - DNA, 22 bp, Homo sapiens
atacaagccattctaaggaaat

SEQ ID NO: 3704864 - DNA, 17 bp, Homo sapiens
atacaagttctatttaa

SEQ ID NO: 3704865 - DNA, 12 bp, Homo sapiens
atacaagtttca

SEQ ID NO: 3704866 - DNA, 10 bp, Homo sapiens
atacaataaa

SEQ ID NO: 3704867 - DNA, 16 bp, Homo sapiens
atacaatgacaagtat

SEQ ID NO: 3704868 - DNA, 17 bp, Homo sapiens
atacacgaggtatgagg

SEQ ID NO: 3704869 - DNA, 23 bp, Homo sapiens
atacagaaagatggatgtgcttt

SEQ ID NO: 3704870 - DNA, 16 bp, Homo sapiens
atacagaggcaactgc

SEQ ID NO: 3704871 - DNA, 17 bp, Homo sapiens
atacagaggcaactgca

SEQ ID NO: 3704872 - DNA, 14 bp, Homo sapiens
atacaggaaaagct

SEQ ID NO: 3704873 - DNA, 20 bp, Homo sapiens
atacaggaaaagctgctgac

SEQ ID NO: 3704874 - DNA, 20 bp, Homo sapiens
atacaggggaatattttatt

SEQ ID NO: 3704875 - DNA, 15 bp, Homo sapiens
atacagtacaggcag

SEQ ID NO: 3704876 - DNA, 15 bp, Homo sapiens
atacagtacagtggt

SEQ ID NO: 3704877 - DNA, 16 bp, Homo sapiens
atacagtacagtggtt

SEQ ID NO: 3704878 - DNA, 19 bp, Homo sapiens
atacagtagtgagaagaat

SEQ ID NO: 3704879 - DNA, 15 bp, Homo sapiens
atacagtattctgta

SEQ ID NO: 3704880 - DNA, 14 bp, Homo sapiens
atacagtgttattt

SEQ ID NO: 3704881 - DNA, 15 bp, Homo sapiens
atacagttttaaaga

SEQ ID NO: 3704882 - DNA, 16 bp, Homo sapiens
atacatgacactgaaa

SEQ ID NO: 3704883 - DNA, 24 bp, Homo sapiens
atacatgggtagcttctgacctca

SEQ ID NO: 3704884 - DNA, 15 bp, Homo sapiens
atacatttataatgt

SEQ ID NO: 3704885 - DNA, 21 bp, Homo sapiens
atacatttgtatgttgtgaag

SEQ ID NO: 3704886 - DNA, 19 bp, Homo sapiens
ataccaaaattatttcaga

SEQ ID NO: 3704887 - DNA, 18 bp, Homo sapiens
ataccagcttagatttta

SEQ ID NO: 3704888 - DNA, 16 bp, Homo sapiens
ataccaggttgaaaga

SEQ ID NO: 3704889 - DNA, 11 bp, Homo sapiens
ataccatcagc

SEQ ID NO: 3704890 - DNA, 19 bp, Homo sapiens
ataccccttacttagcatg

SEQ ID NO: 3704891 - DNA, 20 bp, Homo sapiens
atacgccagaactgctttat

SEQ ID NO: 3704892 - DNA, 21 bp, Homo sapiens
atacgcctgtagtcctagcca

SEQ ID NO: 3704893 - DNA, 20 bp, Homo sapiens
atactaagatgttcactgtg

SEQ ID NO: 3704894 - DNA, 16 bp, Homo sapiens
atactagccagagctc

SEQ ID NO: 3704895 - DNA, 22 bp, Homo sapiens
atactagccagagctcctcctt

SEQ ID NO: 3704896 - DNA, 16 bp, Homo sapiens
atactctgtcagatgg

SEQ ID NO: 3704897 - DNA, 22 bp, Homo sapiens
atactgagggaccaactgggcc

SEQ ID NO: 3704898 - DNA, 22 bp, Homo sapiens
atactgcccggggcagctgcca

SEQ ID NO: 3704899 - DNA, 13 bp, Homo sapiens
atactggaagttt

SEQ ID NO: 3704900 - DNA, 18 bp, Homo sapiens
atactggaagttttgcat

SEQ ID NO: 3704901 - DNA, 16 bp, Homo sapiens
atactgtacttaataa

SEQ ID NO: 3704902 - DNA, 21 bp, Homo sapiens
atactgtcggttttttttaaa

SEQ ID NO: 3704903 - DNA, 22 bp, Homo sapiens
atacttagcaaagttttacctg

SEQ ID NO: 3704904 - DNA, 12 bp, Homo sapiens
atactttacatg

SEQ ID NO: 3704905 - DNA, 22 bp, Homo sapiens
atagaaaacaggaaaaaaactt

SEQ ID NO: 3704906 - DNA, 14 bp, Homo sapiens
atagaagaaaaaag

SEQ ID NO: 3704907 - DNA, 19 bp, Homo sapiens
atagaagaaaaaagaatgt

SEQ ID NO: 3704908 - DNA, 14 bp, Homo sapiens
atagaagatgtttg

SEQ ID NO: 3704909 - DNA, 17 bp, Homo sapiens
atagaaggaaactagct

SEQ ID NO: 3704910 - DNA, 19 bp, Homo sapiens
atagaaggatgtacatttc

SEQ ID NO: 3704911 - DNA, 18 bp, Homo sapiens
atagaattgcaattttaa

SEQ ID NO: 3704912 - DNA, 20 bp, Homo sapiens
atagaattgcaattttaaca

SEQ ID NO: 3704913 - DNA, 13 bp, Homo sapiens
atagaatttttaa

SEQ ID NO: 3704914 - DNA, 17 bp, Homo sapiens
atagaatttttaatgtt

SEQ ID NO: 3704915 - DNA, 23 bp, Homo sapiens
atagagactgtagattgcttctg

SEQ ID NO: 3704916 - DNA, 15 bp, Homo sapiens
atagagtatatgcac

SEQ ID NO: 3704917 - DNA, 15 bp, Homo sapiens
atagataactctttg

SEQ ID NO: 3704918 - DNA, 17 bp, Homo sapiens
atagatcacataacaga

SEQ ID NO: 3704919 - DNA, 23 bp, Homo sapiens
atagatgtccctttcttggccag

SEQ ID NO: 3704920 - DNA, 23 bp, Homo sapiens
atagattagattatattgagaca

SEQ ID NO: 3704921 - DNA, 17 bp, Homo sapiens
atagcaagattgcttaa

SEQ ID NO: 3704922 - DNA, 13 bp, Homo sapiens
atagcattaacta

SEQ ID NO: 3704923 - DNA, 15 bp, Homo sapiens
atagcattaactaat

SEQ ID NO: 3704924 - DNA, 21 bp, Homo sapiens
atagcattaactaatctattg

SEQ ID NO: 3704925 - DNA, 16 bp, Homo sapiens
atagccaccccagaaa

SEQ ID NO: 3704926 - DNA, 23 bp, Homo sapiens
atagccacttaccttcaataaag

SEQ ID NO: 3704927 - DNA, 18 bp, Homo sapiens
atagccgggcatggtggc

SEQ ID NO: 3704928 - DNA, 15 bp, Homo sapiens
atagcctaggtgaca

SEQ ID NO: 3704929 - DNA, 18 bp, Homo sapiens
atagcctgcctcttctct

SEQ ID NO: 3704930 - DNA, 20 bp, Homo sapiens
atagcgttggaattaaaaca

SEQ ID NO: 3704931 - DNA, 21 bp, Homo sapiens
atagcgttggaattaaaacaa

SEQ ID NO: 3704932 - DNA, 16 bp, Homo sapiens
atagctacaggaagca

SEQ ID NO: 3704933 - DNA, 23 bp, Homo sapiens
atagctatatccatgtactgtag

SEQ ID NO: 3704934 - DNA, 19 bp, Homo sapiens
atagctcaggtgtccctgc

SEQ ID NO: 3704935 - DNA, 21 bp, Homo sapiens
atagctcaggtgtccctgcac

SEQ ID NO: 3704936 - DNA, 20 bp, Homo sapiens
atagctccccgcttctgcct

SEQ ID NO: 3704937 - DNA, 21 bp, Homo sapiens
ataggaaagtatttttttaag

SEQ ID NO: 3704938 - DNA, 15 bp, Homo sapiens
ataggaacatatgaa

SEQ ID NO: 3704939 - DNA, 16 bp, Homo sapiens
ataggaacatatgaaa

SEQ ID NO: 3704940 - DNA, 14 bp, Homo sapiens
ataggcctgggtgc

SEQ ID NO: 3704941 - DNA, 22 bp, Homo sapiens
ataggctctgcacagatggatt

SEQ ID NO: 3704942 - DNA, 15 bp, Homo sapiens
ataggtcactcctgg

SEQ ID NO: 3704943 - DNA, 18 bp, Homo sapiens
ataggttgtaaatgtgtt

SEQ ID NO: 3704944 - DNA, 12 bp, Homo sapiens
ataggtttagag

SEQ ID NO: 3704945 - DNA, 15 bp, Homo sapiens
atagtacctttgctc

SEQ ID NO: 3704946 - DNA, 18 bp, Homo sapiens
atagtacctttgctcttg

SEQ ID NO: 3704947 - DNA, 18 bp, Homo sapiens
atagtactctttgtagca

SEQ ID NO: 3704948 - DNA, 16 bp, Homo sapiens
atagtatattaaaaat

SEQ ID NO: 3704949 - DNA, 19 bp, Homo sapiens
atagtcaatgtttctttta

SEQ ID NO: 3704950 - DNA, 14 bp, Homo sapiens
atagtgacgatact

SEQ ID NO: 3704951 - DNA, 21 bp, Homo sapiens
atagtggccagaccagagctc

SEQ ID NO: 3704952 - DNA, 20 bp, Homo sapiens
atagtgtaggctttacttag

SEQ ID NO: 3704953 - DNA, 13 bp, Homo sapiens
atagtgtgaggga

SEQ ID NO: 3704954 - DNA, 15 bp, Homo sapiens
atataaacactatat

SEQ ID NO: 3704955 - DNA, 18 bp, Homo sapiens
atataaagacctataaat

SEQ ID NO: 3704956 - DNA, 18 bp, Homo sapiens
atataaagagaaaattga

SEQ ID NO: 3704957 - DNA, 19 bp, Homo sapiens
atataaagagaaaattgaa

SEQ ID NO: 3704958 - DNA, 20 bp, Homo sapiens
atataaagagaaaattgaat

SEQ ID NO: 3704959 - DNA, 20 bp, Homo sapiens
atataaagcatctaaacttt

SEQ ID NO: 3704960 - DNA, 20 bp, Homo sapiens
agtgaatttgaatgaaaaat

SEQ ID NO: 3704961 - DNA, 15 bp, Homo sapiens
agtgaatttttctct

SEQ ID NO: 3704962 - DNA, 15 bp, Homo sapiens
agtgacaaggcccca

SEQ ID NO: 3704963 - DNA, 20 bp, Homo sapiens
agtgacaaggccccagagac

SEQ ID NO: 3704964 - DNA, 15 bp, Homo sapiens
agtgacacttcagag

SEQ ID NO: 3704965 - DNA, 16 bp, Homo sapiens
agtgacagaggcagcc

SEQ ID NO: 3704966 - DNA, 13 bp, Homo sapiens
agtgacagagtaa

SEQ ID NO: 3704967 - DNA, 21 bp, Homo sapiens
agtgactgatggctaatgtac

SEQ ID NO: 3704968 - DNA, 20 bp, Homo sapiens
agtgactgtggccatggtcc

SEQ ID NO: 3704969 - DNA, 12 bp, Homo sapiens
agtgagaagaat

SEQ ID NO: 3704970 - DNA, 14 bp, Homo sapiens
agtgagaagaatat

SEQ ID NO: 3704971 - DNA, 16 bp, Homo sapiens
agtgagaccctgtctc

SEQ ID NO: 3704972 - DNA, 17 bp, Homo sapiens
agtgagactctgtctca

SEQ ID NO: 3704973 - DNA, 14 bp, Homo sapiens
agtgagagctgggt

SEQ ID NO: 3704974 - DNA, 14 bp, Homo sapiens
agtgagagggcatg

SEQ ID NO: 3704975 - DNA, 22 bp, Homo sapiens
agtgagagggcatgcgcacaag

SEQ ID NO: 3704976 - DNA, 22 bp, Homo sapiens
agtgagcactaaggtgtgctct

SEQ ID NO: 3704977 - DNA, 22 bp, Homo sapiens
agtgagccgcatcttctccatc

SEQ ID NO: 3704978 - DNA, 11 bp, Homo sapiens
agtgagcctga

SEQ ID NO: 3704979 - DNA, 13 bp, Homo sapiens
agtgaggcccagg

SEQ ID NO: 3704980 - DNA, 16 bp, Homo sapiens
agtgagggtcagagag

SEQ ID NO: 3704981 - DNA, 15 bp, Homo sapiens
agtgagtcgaggaca

SEQ ID NO: 3704982 - DNA, 16 bp, Homo sapiens
agtgagtgtggctccc

SEQ ID NO: 3704983 - DNA, 18 bp, Homo sapiens
agtgagtgtggctcccct

SEQ ID NO: 3704984 - DNA, 22 bp, Homo sapiens
agtgagttcagcctttaagata

SEQ ID NO: 3704985 - DNA, 17 bp, Homo sapiens
agtgatcaataaaatgt

SEQ ID NO: 3704986 - DNA, 19 bp, Homo sapiens
agtgatcctcccacctcag

SEQ ID NO: 3704987 - DNA, 20 bp, Homo sapiens
agtgatcctcccacctcagc

SEQ ID NO: 3704988 - DNA, 24 bp, Homo sapiens
agtgatcctcccacctcagcctcc

SEQ ID NO: 3704989 - DNA, 19 bp, Homo sapiens
agtgatcctcctgcctcag

SEQ ID NO: 3704990 - DNA, 21 bp, Homo sapiens
agtgatgctgtgctatgaatt

SEQ ID NO: 3704991 - DNA, 18 bp, Homo sapiens
agtgattaaggtctctct

SEQ ID NO: 3704992 - DNA, 23 bp, Homo sapiens
agtgattaaggtctctctttgga

SEQ ID NO: 3704993 - DNA, 17 bp, Homo sapiens
agtgattctcctgcctc

SEQ ID NO: 3704994 - DNA, 18 bp, Homo sapiens
agtgattctcctgcctca

SEQ ID NO: 3704995 - DNA, 22 bp, Homo sapiens
agtgattctcctgcctcagcct

SEQ ID NO: 3704996 - DNA, 21 bp, Homo sapiens
agtgcaaagatttgctttaat

SEQ ID NO: 3704997 - DNA, 13 bp, Homo sapiens
agtgcacccactc

SEQ ID NO: 3704998 - DNA, 19 bp, Homo sapiens
agtgcagcaaccagagcac

SEQ ID NO: 3704999 - DNA, 21 bp, Homo sapiens
agtgcagcccgtgtggcccct

SEQ ID NO: 3705000 - DNA, 14 bp, Homo sapiens
agtgcagctgattt

SEQ ID NO: 3705001 - DNA, 11 bp, Homo sapiens
agtgcaggctg

SEQ ID NO: 3705002 - DNA, 16 bp, Homo sapiens
agtgcatctcagccca

SEQ ID NO: 3705003 - DNA, 17 bp, Homo sapiens
agtgcatctcagcccac

SEQ ID NO: 3705004 - DNA, 16 bp, Homo sapiens
agtgcatgctctctgc

SEQ ID NO: 3705005 - DNA, 20 bp, Homo sapiens
agtgcatgctctctgcagcc

SEQ ID NO: 3705006 - DNA, 19 bp, Homo sapiens
agtgcccaccaacatccca

SEQ ID NO: 3705007 - DNA, 20 bp, Homo sapiens
agtgcccaccaacatcccat

SEQ ID NO: 3705008 - DNA, 14 bp, Homo sapiens
agtgccccacctgc

SEQ ID NO: 3705009 - DNA, 23 bp, Homo sapiens
agtgccccacctgccactaggct

SEQ ID NO: 3705010 - DNA, 12 bp, Homo sapiens
agtgcccctgct

SEQ ID NO: 3705011 - DNA, 14 bp, Homo sapiens
agtgcccctgctgc

SEQ ID NO: 3705012 - DNA, 19 bp, Homo sapiens
agtgcccctgctgcctccc

SEQ ID NO: 3705013 - DNA, 22 bp, Homo sapiens
agtgcccctgctgcctccccaa

SEQ ID NO: 3705014 - DNA, 23 bp, Homo sapiens
agtgccctggggctgatctcagg

SEQ ID NO: 3705015 - DNA, 13 bp, Homo sapiens
agtgcctgggaat

SEQ ID NO: 3705016 - DNA, 17 bp, Homo sapiens
agtgcctgggaatgtat

SEQ ID NO: 3705017 - DNA, 16 bp, Homo sapiens
agtgccttccataatt

SEQ ID NO: 3705018 - DNA, 12 bp, Homo sapiens
agtgctgaagct

SEQ ID NO: 3705019 - DNA, 22 bp, Homo sapiens
agtgctgaagcttattaatgct

SEQ ID NO: 3705020 - DNA, 17 bp, Homo sapiens
agtgcttaaaaatcatt

SEQ ID NO: 3705021 - DNA, 14 bp, Homo sapiens
agtgcttcttacta

SEQ ID NO: 3705022 - DNA, 13 bp, Homo sapiens
agtgctttgtaat

SEQ ID NO: 3705023 - DNA, 11 bp, Homo sapiens
agtggaaaaat

SEQ ID NO: 3705024 - DNA, 18 bp, Homo sapiens
agtggaaaaatagcctgc

SEQ ID NO: 3705025 - DNA, 22 bp, Homo sapiens
agtggaaagacagcttctcatc

SEQ ID NO: 3705026 - DNA, 16 bp, Homo sapiens
agtggaccaggacagg

SEQ ID NO: 3705027 - DNA, 17 bp, Homo sapiens
agtggactttccacccc

SEQ ID NO: 3705028 - DNA, 19 bp, Homo sapiens
agtggactttccaccccct

SEQ ID NO: 3705029 - DNA, 22 bp, Homo sapiens
agtggactttccaccccctccc

SEQ ID NO: 3705030 - DNA, 15 bp, Homo sapiens
agtggatagatgccc

SEQ ID NO: 3705031 - DNA, 20 bp, Homo sapiens
agtggatgatgtttcgtgaa

SEQ ID NO: 3705032 - DNA, 14 bp, Homo sapiens
agtggattgcattt

SEQ ID NO: 3705033 - DNA, 11 bp, Homo sapiens
agtggcagctg

SEQ ID NO: 3705034 - DNA, 18 bp, Homo sapiens
agtggcatggctccagtc

SEQ ID NO: 3705035 - DNA, 16 bp, Homo sapiens
agtggcatgtgctgtg

SEQ ID NO: 3705036 - DNA, 23 bp, Homo sapiens
agtggccagaccagagctctgga

SEQ ID NO: 3705037 - DNA, 22 bp, Homo sapiens
agtggcctcaaccctccctcag

SEQ ID NO: 3705038 - DNA, 15 bp, Homo sapiens
agtggcctggccagg

SEQ ID NO: 3705039 - DNA, 19 bp, Homo sapiens
agtggcctggccaggagct

SEQ ID NO: 3705040 - DNA, 22 bp, Homo sapiens
agtggcctggccaggagctctt

SEQ ID NO: 3705041 - DNA, 23 bp, Homo sapiens
agtggcctggctccgctgtgtgg

SEQ ID NO: 3705042 - DNA, 23 bp, Homo sapiens
agtggcttaaaacaacactcaca

SEQ ID NO: 3705043 - DNA, 19 bp, Homo sapiens
agtggcttactacatgtgg

SEQ ID NO: 3705044 - DNA, 17 bp, Homo sapiens
agtgggacagagtctgg

SEQ ID NO: 3705045 - DNA, 15 bp, Homo sapiens
agtgggagctgcctg

SEQ ID NO: 3705046 - DNA, 19 bp, Homo sapiens
agtgggccaggacaggccc

SEQ ID NO: 3705047 - DNA, 19 bp, Homo sapiens
agtggggagacacctcaga

SEQ ID NO: 3705048 - DNA, 22 bp, Homo sapiens
agtggggtctccctctcctgcc

SEQ ID NO: 3705049 - DNA, 18 bp, Homo sapiens
agtgggtgaataatacag

SEQ ID NO: 3705050 - DNA, 15 bp, Homo sapiens
agtggtggctctgag

SEQ ID NO: 3705051 - DNA, 22 bp, Homo sapiens
agtggtgttttaaagagaatgt

SEQ ID NO: 3705052 - DNA, 14 bp, Homo sapiens
agtgtaaaaatgag

SEQ ID NO: 3705053 - DNA, 21 bp, Homo sapiens
agtgtaaatcctttttcttta

SEQ ID NO: 3705054 - DNA, 16 bp, Homo sapiens
agtgtaacaagaaagg

SEQ ID NO: 3705055 - DNA, 17 bp, Homo sapiens
agtgtaacaagaaagga

SEQ ID NO: 3705056 - DNA, 17 bp, Homo sapiens
agtgtaacagctgaggt

SEQ ID NO: 3705057 - DNA, 22 bp, Homo sapiens
agtgtaacatatgcaaacataa

SEQ ID NO: 3705058 - DNA, 13 bp, Homo sapiens
agtgtaagtgtga

SEQ ID NO: 3705059 - DNA, 21 bp, Homo sapiens
agtgtacatggaataacatgt

SEQ ID NO: 3705060 - DNA, 23 bp, Homo sapiens
agtgtacatggaataacatgtaa

SEQ ID NO: 3705061 - DNA, 23 bp, Homo sapiens
agtgtactaattaacatataata

SEQ ID NO: 3705062 - DNA, 21 bp, Homo sapiens
agtgtagccccaagaaggctg

SEQ ID NO: 3705063 - DNA, 19 bp, Homo sapiens
agtgtcatttatgaaaaga

SEQ ID NO: 3705064 - DNA, 22 bp, Homo sapiens
agtgtctcggagggattcccct

SEQ ID NO: 3705065 - DNA, 22 bp, Homo sapiens
agtgtctgtatcggagacagtg

SEQ ID NO: 3705066 - DNA, 22 bp, Homo sapiens
agtgtctttctttggtgccttt

SEQ ID NO: 3705067 - DNA, 14 bp, Homo sapiens
agtgtgaccaggca

SEQ ID NO: 3705068 - DNA, 12 bp, Homo sapiens
agtgtgagaatc

SEQ ID NO: 3705069 - DNA, 22 bp, Homo sapiens
agtgtgcacgagtgggaaggac

SEQ ID NO: 3705070 - DNA, 14 bp, Homo sapiens
agtgtgggaatgcg

SEQ ID NO: 3705071 - DNA, 21 bp, Homo sapiens
agtgtggtagggacttaaaaa

SEQ ID NO: 3705072 - DNA, 19 bp, Homo sapiens
agtgtgtattgttcccagt

SEQ ID NO: 3705073 - DNA, 21 bp, Homo sapiens
agtgtgtattgttcccagtga

SEQ ID NO: 3705074 - DNA, 22 bp, Homo sapiens
agtttttacctaccacagtgtc

SEQ ID NO: 3705075 - DNA, 18 bp, Homo sapiens
ataaaaaaaatgaaatgt

SEQ ID NO: 3705076 - DNA, 20 bp, Homo sapiens
ataaaaaaaatgaaatgttt

SEQ ID NO: 3705077 - DNA, 22 bp, Homo sapiens
ataaaaaagctggtgggtgaaa

SEQ ID NO: 3705078 - DNA, 15 bp, Homo sapiens
ataaaaaattttgta

SEQ ID NO: 3705079 - DNA, 21 bp, Homo sapiens
ataaaaaggcacctataaaac

SEQ ID NO: 3705080 - DNA, 21 bp, Homo sapiens
ataaaacctttcaaatttcac

SEQ ID NO: 3705081 - DNA, 22 bp, Homo sapiens
ataaaacctttcaaatttcaca

SEQ ID NO: 3705082 - DNA, 18 bp, Homo sapiens
ataaaagaaatgcacaat

SEQ ID NO: 3705083 - DNA, 12 bp, Homo sapiens
ataaaagacaca

SEQ ID NO: 3705084 - DNA, 14 bp, Homo sapiens
ataaaagacacaga

SEQ ID NO: 3705085 - DNA, 14 bp, Homo sapiens
ataaaagatacatt

SEQ ID NO: 3705086 - DNA, 20 bp, Homo sapiens
ataaaagcataaatgcaaac

SEQ ID NO: 3705087 - DNA, 16 bp, Homo sapiens
ataaaaggtctatgct

SEQ ID NO: 3705088 - DNA, 16 bp, Homo sapiens
ataaaagttttctcca

SEQ ID NO: 3705089 - DNA, 14 bp, Homo sapiens
ataaaataaagtat

SEQ ID NO: 3705090 - DNA, 15 bp, Homo sapiens
ataaaatatcattca

SEQ ID NO: 3705091 - DNA, 16 bp, Homo sapiens
ataaaatatcattcag

SEQ ID NO: 3705092 - DNA, 19 bp, Homo sapiens
ataaaatatcattcagcaa

SEQ ID NO: 3705093 - DNA, 15 bp, Homo sapiens
ataaaattaaagaaa

SEQ ID NO: 3705094 - DNA, 17 bp, Homo sapiens
ataaaattaaagaaaat

SEQ ID NO: 3705095 - DNA, 13 bp, Homo sapiens
ataaaattaagaa

SEQ ID NO: 3705096 - DNA, 22 bp, Homo sapiens
ataaaattctattacagtatgt

SEQ ID NO: 3705097 - DNA, 20 bp, Homo sapiens
ataaacacatagattcacct

SEQ ID NO: 3705098 - DNA, 15 bp, Homo sapiens
ataaactcatttcta

SEQ ID NO: 3705099 - DNA, 12 bp, Homo sapiens
ataaactgtgtg

SEQ ID NO: 3705100 - DNA, 21 bp, Homo sapiens
ataaagaacaaggtagttttt

SEQ ID NO: 3705101 - DNA, 17 bp, Homo sapiens
ataaagagaaaattgaa

SEQ ID NO: 3705102 - DNA, 18 bp, Homo sapiens
ataaagagaaaattgaat

SEQ ID NO: 3705103 - DNA, 14 bp, Homo sapiens
ataaagatgctctt

SEQ ID NO: 3705104 - DNA, 15 bp, Homo sapiens
ataaagatgctcttt

SEQ ID NO: 3705105 - DNA, 18 bp, Homo sapiens
ataaagattatataaaga

SEQ ID NO: 3705106 - DNA, 15 bp, Homo sapiens
ataaagcatctaaac

SEQ ID NO: 3705107 - DNA, 20 bp, Homo sapiens
ataaagcctgttttgtcttt

SEQ ID NO: 3705108 - DNA, 20 bp, Homo sapiens
ataaagccttggatgtatat

SEQ ID NO: 3705109 - DNA, 21 bp, Homo sapiens
ataaaggataaacttttagaa

SEQ ID NO: 3705110 - DNA, 20 bp, Homo sapiens
ataaaggtggtatgtgtgtg

SEQ ID NO: 3705111 - DNA, 21 bp, Homo sapiens
ataaaggtggtatgtgtgtgt

SEQ ID NO: 3705112 - DNA, 22 bp, Homo sapiens
ataaaggttgacaataaatgtg

SEQ ID NO: 3705113 - DNA, 14 bp, Homo sapiens
ataaagtatctaca

SEQ ID NO: 3705114 - DNA, 16 bp, Homo sapiens
ataaagtgctttaaaa

SEQ ID NO: 3705115 - DNA, 13 bp, Homo sapiens
ataaagtgttttc

SEQ ID NO: 3705116 - DNA, 15 bp, Homo sapiens
ataaagtgttttcag

SEQ ID NO: 3705117 - DNA, 16 bp, Homo sapiens
ataaagttggtgacag

SEQ ID NO: 3705118 - DNA, 15 bp, Homo sapiens
ataaataaaaatgga

SEQ ID NO: 3705119 - DNA, 15 bp, Homo sapiens
ataaataaataaata

SEQ ID NO: 3705120 - DNA, 12 bp, Homo sapiens
ataaataaatgt

SEQ ID NO: 3705121 - DNA, 21 bp, Homo sapiens
ataaataatcggcccacagct

SEQ ID NO: 3705122 - DNA, 14 bp, Homo sapiens
ataaatagctatat

SEQ ID NO: 3705123 - DNA, 15 bp, Homo sapiens
ataaatcaatgtcac

SEQ ID NO: 3705124 - DNA, 17 bp, Homo sapiens
ataaatgaagtttatac

SEQ ID NO: 3705125 - DNA, 18 bp, Homo sapiens
ataaatgaagtttataca

SEQ ID NO: 3705126 - DNA, 13 bp, Homo sapiens
ataaattataagt

SEQ ID NO: 3705127 - DNA, 16 bp, Homo sapiens
ataaattcagatatat

SEQ ID NO: 3705128 - DNA, 22 bp, Homo sapiens
ataaattcagatatatttttca

SEQ ID NO: 3705129 - DNA, 16 bp, Homo sapiens
ataaattctataggaa

SEQ ID NO: 3705130 - DNA, 20 bp, Homo sapiens
ataaattgcatgctgcttta

SEQ ID NO: 3705131 - DNA, 13 bp, Homo sapiens
ataaattgctcct

SEQ ID NO: 3705132 - DNA, 19 bp, Homo sapiens
ataacagggtaaattattc

SEQ ID NO: 3705133 - DNA, 14 bp, Homo sapiens
ataacagtgccatt

SEQ ID NO: 3705134 - DNA, 15 bp, Homo sapiens
ataacagtgccattg

SEQ ID NO: 3705135 - DNA, 19 bp, Homo sapiens
ataacagtgtggtagttaa

SEQ ID NO: 3705136 - DNA, 13 bp, Homo sapiens
ataacatgtaatt

SEQ ID NO: 3705137 - DNA, 20 bp, Homo sapiens
ataaccaatgtttaaaaaag

SEQ ID NO: 3705138 - DNA, 12 bp, Homo sapiens
ataaccactgct

SEQ ID NO: 3705139 - DNA, 14 bp, Homo sapiens
ataaccactgcttc

SEQ ID NO: 3705140 - DNA, 22 bp, Homo sapiens
ataaccacttaaaaaatgtcca

SEQ ID NO: 3705141 - DNA, 18 bp, Homo sapiens
ataaccccattctttgct

SEQ ID NO: 3705142 - DNA, 14 bp, Homo sapiens
ataactaaataaag

SEQ ID NO: 3705143 - DNA, 19 bp, Homo sapiens
ataactactgtgttcctgg

SEQ ID NO: 3705144 - DNA, 15 bp, Homo sapiens
ataactatgttgata

SEQ ID NO: 3705145 - DNA, 16 bp, Homo sapiens
ataactcatcataaaa

SEQ ID NO: 3705146 - DNA, 18 bp, Homo sapiens
ataactcatcataaaata

SEQ ID NO: 3705147 - DNA, 17 bp, Homo sapiens
ataactcctcattgtaa

SEQ ID NO: 3705148 - DNA, 12 bp, Homo sapiens
ataactctttgg

SEQ ID NO: 3705149 - DNA, 16 bp, Homo sapiens
ataactgaaggagaag

SEQ ID NO: 3705150 - DNA, 16 bp, Homo sapiens
ataactgacaaatcaa

SEQ ID NO: 3705151 - DNA, 18 bp, Homo sapiens
ataactgccttaaaactt

SEQ ID NO: 3705152 - DNA, 12 bp, Homo sapiens
ataacttaaaaa

SEQ ID NO: 3705153 - DNA, 19 bp, Homo sapiens
ataagaatgctggttttcc

SEQ ID NO: 3705154 - DNA, 21 bp, Homo sapiens
ataagaatgctggttttccta

SEQ ID NO: 3705155 - DNA, 22 bp, Homo sapiens
ataagaatgctggttttcctaa

SEQ ID NO: 3705156 - DNA, 12 bp, Homo sapiens
ataagagatttg

SEQ ID NO: 3705157 - DNA, 21 bp, Homo sapiens
ataagattcatatttacttct

SEQ ID NO: 3705158 - DNA, 10 bp, Homo sapiens
ataagcaaaa

SEQ ID NO: 3705159 - DNA, 14 bp, Homo sapiens
ataagcaagagaga

SEQ ID NO: 3705160 - DNA, 16 bp, Homo sapiens
ataagcaagagagatg

SEQ ID NO: 3705161 - DNA, 16 bp, Homo sapiens
ataagcagatttaaca

SEQ ID NO: 3705162 - DNA, 18 bp, Homo sapiens
ataaggaaagcaataaat

SEQ ID NO: 3705163 - DNA, 10 bp, Homo sapiens
ataaggactg

SEQ ID NO: 3705164 - DNA, 14 bp, Homo sapiens
ataaggactgcatg

SEQ ID NO: 3705165 - DNA, 15 bp, Homo sapiens
ataaggactgcatgg

SEQ ID NO: 3705166 - DNA, 14 bp, Homo sapiens
ataaggatcagaac

SEQ ID NO: 3705167 - DNA, 22 bp, Homo sapiens
ataaggatcagaacagcagagg

SEQ ID NO: 3705168 - DNA, 21 bp, Homo sapiens
ataagggagcgtagaatctgt

SEQ ID NO: 3705169 - DNA, 13 bp, Homo sapiens
ataagtaagtttg

SEQ ID NO: 3705170 - DNA, 13 bp, Homo sapiens
ataagtactgtgt

SEQ ID NO: 3705171 - DNA, 16 bp, Homo sapiens
ataagtactgtgtaca

SEQ ID NO: 3705172 - DNA, 21 bp, Homo sapiens
ataagtccttgcaagaatcag

SEQ ID NO: 3705173 - DNA, 17 bp, Homo sapiens
ataagttaacttccaat

SEQ ID NO: 3705174 - DNA, 20 bp, Homo sapiens
ataagtttcactgacttaga

SEQ ID NO: 3705175 - DNA, 19 bp, Homo sapiens
ataataaacttttttgaaa

SEQ ID NO: 3705176 - DNA, 13 bp, Homo sapiens
ataataaagtatt

SEQ ID NO: 3705177 - DNA, 23 bp, Homo sapiens
ataataaagtattccaccttaaa

SEQ ID NO: 3705178 - DNA, 21 bp, Homo sapiens
ataatacagccaaagataatc

SEQ ID NO: 3705179 - DNA, 12 bp, Homo sapiens
ataatagaagaa

SEQ ID NO: 3705180 - DNA, 12 bp, Homo sapiens
ataatatgcaca

SEQ ID NO: 3705181 - DNA, 20 bp, Homo sapiens
ataatatgcacacagtgctt

SEQ ID NO: 3705182 - DNA, 21 bp, Homo sapiens
ataatatgctgccaaattttg

SEQ ID NO: 3705183 - DNA, 16 bp, Homo sapiens
ataatcagcctcttaa

SEQ ID NO: 3705184 - DNA, 18 bp, Homo sapiens
ataatctggactcctctg

SEQ ID NO: 3705185 - DNA, 14 bp, Homo sapiens
ataatggttgactg

SEQ ID NO: 3705186 - DNA, 18 bp, Homo sapiens
ataatggttgactgggtt

SEQ ID NO: 3705187 - DNA, 14 bp, Homo sapiens
ataatgtaagctct

SEQ ID NO: 3705188 - DNA, 15 bp, Homo sapiens
ataatgtcccttcac

SEQ ID NO: 3705189 - DNA, 17 bp, Homo sapiens
ataatgtgggaagaaac

SEQ ID NO: 3705190 - DNA, 18 bp, Homo sapiens
agtgtgtccaagtgtgtg

SEQ ID NO: 3705191 - DNA, 14 bp, Homo sapiens
agtgtgtctcctgc

SEQ ID NO: 3705192 - DNA, 18 bp, Homo sapiens
agtgtgtgcacatgtgtg

SEQ ID NO: 3705193 - DNA, 20 bp, Homo sapiens
agtgtgtgcacatgtgtgcg

SEQ ID NO: 3705194 - DNA, 22 bp, Homo sapiens
agtgtgtgcacatgtgtgcgtg

SEQ ID NO: 3705195 - DNA, 14 bp, Homo sapiens
agtgtgtgcatgtg

SEQ ID NO: 3705196 - DNA, 23 bp, Homo sapiens
agtgtgtgcatgtgtgtgctcag

SEQ ID NO: 3705197 - DNA, 13 bp, Homo sapiens
agtgtgttctgat

SEQ ID NO: 3705198 - DNA, 21 bp, Homo sapiens
agtgtgttctgattagaaatg

SEQ ID NO: 3705199 - DNA, 16 bp, Homo sapiens
agtgttatcagtcata

SEQ ID NO: 3705200 - DNA, 23 bp, Homo sapiens
agtgttatcagtcataactaaat

SEQ ID NO: 3705201 - DNA, 22 bp, Homo sapiens
agtgttattttctttgaaattg

SEQ ID NO: 3705202 - DNA, 18 bp, Homo sapiens
agtgttccctttcctact

SEQ ID NO: 3705203 - DNA, 20 bp, Homo sapiens
agtgttgtttgtaaataaga

SEQ ID NO: 3705204 - DNA, 19 bp, Homo sapiens
agtgtttcgacagctgatt

SEQ ID NO: 3705205 - DNA, 13 bp, Homo sapiens
agtgttttcagag

SEQ ID NO: 3705206 - DNA, 20 bp, Homo sapiens
agttaaaaaaaataataaat

SEQ ID NO: 3705207 - DNA, 16 bp, Homo sapiens
agttaaagtgaataac

SEQ ID NO: 3705208 - DNA, 18 bp, Homo sapiens
agttaagaaaaaaataat

SEQ ID NO: 3705209 - DNA, 15 bp, Homo sapiens
agttaatattgtgaa

SEQ ID NO: 3705210 - DNA, 14 bp, Homo sapiens
agttaatcaactga

SEQ ID NO: 3705211 - DNA, 16 bp, Homo sapiens
agttaatcaactgaaa

SEQ ID NO: 3705212 - DNA, 15 bp, Homo sapiens
agttactatcctggc

SEQ ID NO: 3705213 - DNA, 15 bp, Homo sapiens
agttactctgaaggg

SEQ ID NO: 3705214 - DNA, 14 bp, Homo sapiens
agttagagatgcct

SEQ ID NO: 3705215 - DNA, 16 bp, Homo sapiens
agttagctcaggaggc

SEQ ID NO: 3705216 - DNA, 19 bp, Homo sapiens
agttagctcaggaggcttg

SEQ ID NO: 3705217 - DNA, 22 bp, Homo sapiens
agttagctcaggaggcttggaa

SEQ ID NO: 3705218 - DNA, 18 bp, Homo sapiens
agttaggaaataaaacct

SEQ ID NO: 3705219 - DNA, 22 bp, Homo sapiens
agttaggaaataaaacctttca

SEQ ID NO: 3705220 - DNA, 19 bp, Homo sapiens
agttaggtttaacataaag

SEQ ID NO: 3705221 - DNA, 15 bp, Homo sapiens
agttagtagcatgtt

SEQ ID NO: 3705222 - DNA, 12 bp, Homo sapiens
agttataaatca

SEQ ID NO: 3705223 - DNA, 17 bp, Homo sapiens
agttatataaagagaaa

SEQ ID NO: 3705224 - DNA, 23 bp, Homo sapiens
agttatggtgccgaattgtcttt

SEQ ID NO: 3705225 - DNA, 21 bp, Homo sapiens
agttatttttatttatttaaa

SEQ ID NO: 3705226 - DNA, 18 bp, Homo sapiens
agttcaagaccagcctgg

SEQ ID NO: 3705227 - DNA, 19 bp, Homo sapiens
agttcaagaccagcctggc

SEQ ID NO: 3705228 - DNA, 16 bp, Homo sapiens
agttcaattctcattt

SEQ ID NO: 3705229 - DNA, 17 bp, Homo sapiens
agttcacctatttcaaa

SEQ ID NO: 3705230 - DNA, 15 bp, Homo sapiens
agttcagcaccaccc

SEQ ID NO: 3705231 - DNA, 16 bp, Homo sapiens
agttcagctgcttctc

SEQ ID NO: 3705232 - DNA, 16 bp, Homo sapiens
agttcaggagtcccaa

SEQ ID NO: 3705233 - DNA, 20 bp, Homo sapiens
agttcaggagtcccaaggaa

SEQ ID NO: 3705234 - DNA, 21 bp, Homo sapiens
agttcaggagtcccaaggaaa

SEQ ID NO: 3705235 - DNA, 20 bp, Homo sapiens
agttcaggtaacaggcagat

SEQ ID NO: 3705236 - DNA, 21 bp, Homo sapiens
agttcaggtagctgcccctgg

SEQ ID NO: 3705237 - DNA, 17 bp, Homo sapiens
agttcataacagtgcca

SEQ ID NO: 3705238 - DNA, 14 bp, Homo sapiens
agttcataccctgt

SEQ ID NO: 3705239 - DNA, 20 bp, Homo sapiens
agttcatagggtctcttcag

SEQ ID NO: 3705240 - DNA, 15 bp, Homo sapiens
agttcccccagtacc

SEQ ID NO: 3705241 - DNA, 19 bp, Homo sapiens
agttcccccagtacctcca

SEQ ID NO: 3705242 - DNA, 23 bp, Homo sapiens
agttcccccatcagttcccccag

SEQ ID NO: 3705243 - DNA, 15 bp, Homo sapiens
agttccctacttcct

SEQ ID NO: 3705244 - DNA, 17 bp, Homo sapiens
agttccctacttcctgt

SEQ ID NO: 3705245 - DNA, 19 bp, Homo sapiens
agttccctgaaaacccaga

SEQ ID NO: 3705246 - DNA, 13 bp, Homo sapiens
agttcctcgccct

SEQ ID NO: 3705247 - DNA, 19 bp, Homo sapiens
agttcctgatgacccaggc

SEQ ID NO: 3705248 - DNA, 17 bp, Homo sapiens
agttcgagaccagcctg

SEQ ID NO: 3705249 - DNA, 21 bp, Homo sapiens
agttcgatgggcccaattctt

SEQ ID NO: 3705250 - DNA, 22 bp, Homo sapiens
agttctatttctatcccaaact

SEQ ID NO: 3705251 - DNA, 14 bp, Homo sapiens
agttctgagtgttt

SEQ ID NO: 3705252 - DNA, 22 bp, Homo sapiens
agttctgagtgtttttactaca

SEQ ID NO: 3705253 - DNA, 16 bp, Homo sapiens
agttctgcaaatagaa

SEQ ID NO: 3705254 - DNA, 12 bp, Homo sapiens
agttctgggtgc

SEQ ID NO: 3705255 - DNA, 16 bp, Homo sapiens
agttctgtgtatttaa

SEQ ID NO: 3705256 - DNA, 17 bp, Homo sapiens
agttgaggagtttccta

SEQ ID NO: 3705257 - DNA, 16 bp, Homo sapiens
agttgaggccaggagt

SEQ ID NO: 3705258 - DNA, 15 bp, Homo sapiens
agttgatgttgcatt

SEQ ID NO: 3705259 - DNA, 14 bp, Homo sapiens
agttgattcagctc

SEQ ID NO: 3705260 - DNA, 18 bp, Homo sapiens
agttgattcagctctgca

SEQ ID NO: 3705261 - DNA, 19 bp, Homo sapiens
agttgcaattgaattaaat

SEQ ID NO: 3705262 - DNA, 22 bp, Homo sapiens
agttgcagactcagtttgtcag

SEQ ID NO: 3705263 - DNA, 17 bp, Homo sapiens
agttgctcaaagagcct

SEQ ID NO: 3705264 - DNA, 14 bp, Homo sapiens
agttgctgtcataa

SEQ ID NO: 3705265 - DNA, 20 bp, Homo sapiens
agttggacagcaaaaccatt

SEQ ID NO: 3705266 - DNA, 22 bp, Homo sapiens
agttgtatctcttttgaatcca

SEQ ID NO: 3705267 - DNA, 14 bp, Homo sapiens
agttgtgttgttct

SEQ ID NO: 3705268 - DNA, 15 bp, Homo sapiens
agttgtgttgttctt

SEQ ID NO: 3705269 - DNA, 19 bp, Homo sapiens
agttgttattacatccttg

SEQ ID NO: 3705270 - DNA, 16 bp, Homo sapiens
agttgtttcattgact

SEQ ID NO: 3705271 - DNA, 12 bp, Homo sapiens
agtttaaagcaa

SEQ ID NO: 3705272 - DNA, 13 bp, Homo sapiens
agtttaacttttt

SEQ ID NO: 3705273 - DNA, 17 bp, Homo sapiens
agtttaagaccagcctg

SEQ ID NO: 3705274 - DNA, 16 bp, Homo sapiens
agtttaccatttgtaa

SEQ ID NO: 3705275 - DNA, 19 bp, Homo sapiens
agtttaccatttgtaataa

SEQ ID NO: 3705276 - DNA, 16 bp, Homo sapiens
agtttactattttact

SEQ ID NO: 3705277 - DNA, 13 bp, Homo sapiens
agtttaggagaaa

SEQ ID NO: 3705278 - DNA, 14 bp, Homo sapiens
agtttaggagaaac

SEQ ID NO: 3705279 - DNA, 20 bp, Homo sapiens
agtttagtgtgataaaggca

SEQ ID NO: 3705280 - DNA, 14 bp, Homo sapiens
agtttatacagttt

SEQ ID NO: 3705281 - DNA, 18 bp, Homo sapiens
agtttccaagcaaatgtt

SEQ ID NO: 3705282 - DNA, 19 bp, Homo sapiens
agtttccaagcaaatgtta

SEQ ID NO: 3705283 - DNA, 17 bp, Homo sapiens
agtttcctaaaagttca

SEQ ID NO: 3705284 - DNA, 17 bp, Homo sapiens
agtttcctcaggctgct

SEQ ID NO: 3705285 - DNA, 18 bp, Homo sapiens
agtttcctcaggctgctg

SEQ ID NO: 3705286 - DNA, 11 bp, Homo sapiens
agtttgcagtt

SEQ ID NO: 3705287 - DNA, 12 bp, Homo sapiens
agtttgccctgg

SEQ ID NO: 3705288 - DNA, 21 bp, Homo sapiens
agtttggttgtgtaagagaat

SEQ ID NO: 3705289 - DNA, 22 bp, Homo sapiens
agtttgtacagacgtatgctta

SEQ ID NO: 3705290 - DNA, 23 bp, Homo sapiens
agtttgtacagacgtatgcttat

SEQ ID NO: 3705291 - DNA, 22 bp, Homo sapiens
agtttgtatgccaagtgagaag

SEQ ID NO: 3705292 - DNA, 21 bp, Homo sapiens
agtttgtgattttacatttat

SEQ ID NO: 3705293 - DNA, 21 bp, Homo sapiens
agtttgtttattacttatttg

SEQ ID NO: 3705294 - DNA, 21 bp, Homo sapiens
agttttacagattgcctcctt

SEQ ID NO: 3705295 - DNA, 13 bp, Homo sapiens
agttttatcattt

SEQ ID NO: 3705296 - DNA, 16 bp, Homo sapiens
agttttattgagaatt

SEQ ID NO: 3705297 - DNA, 21 bp, Homo sapiens
agttttattgagaattttaaa

SEQ ID NO: 3705298 - DNA, 20 bp, Homo sapiens
agttttcagaacctcttccc

SEQ ID NO: 3705299 - DNA, 22 bp, Homo sapiens
agttttcagaacctcttcccca

SEQ ID NO: 3705300 - DNA, 17 bp, Homo sapiens
agttttcctaaatgtat

SEQ ID NO: 3705301 - DNA, 18 bp, Homo sapiens
agttttcctaaatgtata

SEQ ID NO: 3705302 - DNA, 17 bp, Homo sapiens
agttttctcctcccagg

SEQ ID NO: 3705303 - DNA, 18 bp, Homo sapiens
agttttgttttaaaatta

SEQ ID NO: 3705304 - DNA, 23 bp, Homo sapiens
catccttcaagaactctgggctg

SEQ ID NO: 3705305 - DNA, 20 bp, Homo sapiens
catccttgtggcacattttt

SEQ ID NO: 3705306 - DNA, 17 bp, Homo sapiens
catccttttctgcagag

SEQ ID NO: 3705307 - DNA, 19 bp, Homo sapiens
catccttttctgcagaggg

SEQ ID NO: 3705308 - DNA, 18 bp, Homo sapiens
catcgtaggtgatttgaa

SEQ ID NO: 3705309 - DNA, 12 bp, Homo sapiens
catctaaacttt

SEQ ID NO: 3705310 - DNA, 14 bp, Homo sapiens
catctaaactttaa

SEQ ID NO: 3705311 - DNA, 17 bp, Homo sapiens
catctaaactttaatat

SEQ ID NO: 3705312 - DNA, 22 bp, Homo sapiens
catctaaactttaatatgtatt

SEQ ID NO: 3705313 - DNA, 23 bp, Homo sapiens
catctaaactttaatatgtattt

SEQ ID NO: 3705314 - DNA, 14 bp, Homo sapiens
catctatcgagttt

SEQ ID NO: 3705315 - DNA, 14 bp, Homo sapiens
catctcaggccacc

SEQ ID NO: 3705316 - DNA, 20 bp, Homo sapiens
catctcaggccacctgcccc

SEQ ID NO: 3705317 - DNA, 21 bp, Homo sapiens
catctcaggccacctgccccc

SEQ ID NO: 3705318 - DNA, 22 bp, Homo sapiens
catctcaggccacctgccccct

SEQ ID NO: 3705319 - DNA, 17 bp, Homo sapiens
catctcattccaacttc

SEQ ID NO: 3705320 - DNA, 24 bp, Homo sapiens
catctccctcgaacccacactgca

SEQ ID NO: 3705321 - DNA, 13 bp, Homo sapiens
catctcctgtgca

SEQ ID NO: 3705322 - DNA, 20 bp, Homo sapiens
catctcctgtgcatgggtga

SEQ ID NO: 3705323 - DNA, 12 bp, Homo sapiens
catctctccctc

SEQ ID NO: 3705324 - DNA, 23 bp, Homo sapiens
catctctccctcccctgccattt

SEQ ID NO: 3705325 - DNA, 22 bp, Homo sapiens
catctctctactcctacctcag

SEQ ID NO: 3705326 - DNA, 23 bp, Homo sapiens
catctctctactcctacctcagc

SEQ ID NO: 3705327 - DNA, 18 bp, Homo sapiens
catctctgaacttcagct

SEQ ID NO: 3705328 - DNA, 12 bp, Homo sapiens
catctgaaagcc

SEQ ID NO: 3705329 - DNA, 15 bp, Homo sapiens
catctgaagagcaga

SEQ ID NO: 3705330 - DNA, 20 bp, Homo sapiens
catctgcattttcaccccac

SEQ ID NO: 3705331 - DNA, 22 bp, Homo sapiens
catctggaaaataaaaggtcta

SEQ ID NO: 3705332 - DNA, 15 bp, Homo sapiens
catctgtctggaggg

SEQ ID NO: 3705333 - DNA, 15 bp, Homo sapiens
catctgtgattccct

SEQ ID NO: 3705334 - DNA, 14 bp, Homo sapiens
catctgtgtcctgg

SEQ ID NO: 3705335 - DNA, 19 bp, Homo sapiens
catcttaactctttgcctt

SEQ ID NO: 3705336 - DNA, 14 bp, Homo sapiens
catcttactgaagg

SEQ ID NO: 3705337 - DNA, 15 bp, Homo sapiens
catcttactgaaggt

SEQ ID NO: 3705338 - DNA, 19 bp, Homo sapiens
catcttagtatttgcatat

SEQ ID NO: 3705339 - DNA, 14 bp, Homo sapiens
catcttagtgcctg

SEQ ID NO: 3705340 - DNA, 14 bp, Homo sapiens
catcttcacttcta

SEQ ID NO: 3705341 - DNA, 21 bp, Homo sapiens
catcttcacttctaaatgcat

SEQ ID NO: 3705342 - DNA, 22 bp, Homo sapiens
catcttccaagggtactaagga

SEQ ID NO: 3705343 - DNA, 22 bp, Homo sapiens
catcttccacaggtctcagaat

SEQ ID NO: 3705344 - DNA, 24 bp, Homo sapiens
catcttgaccaagcaggaagctca

SEQ ID NO: 3705345 - DNA, 18 bp, Homo sapiens
catcttgcccgctcaggc

SEQ ID NO: 3705346 - DNA, 19 bp, Homo sapiens
catcttgcccgctcaggct

SEQ ID NO: 3705347 - DNA, 15 bp, Homo sapiens
catctttgccttggg

SEQ ID NO: 3705348 - DNA, 17 bp, Homo sapiens
catgaaaacgttttatt

SEQ ID NO: 3705349 - DNA, 15 bp, Homo sapiens
catgaaacagaaaca

SEQ ID NO: 3705350 - DNA, 15 bp, Homo sapiens
catgaaatatgcatc

SEQ ID NO: 3705351 - DNA, 19 bp, Homo sapiens
catgaacacatcagctagc

SEQ ID NO: 3705352 - DNA, 14 bp, Homo sapiens
catgaagacaggac

SEQ ID NO: 3705353 - DNA, 17 bp, Homo sapiens
catgaagacaggacagt

SEQ ID NO: 3705354 - DNA, 15 bp, Homo sapiens
catgaaggtttctga

SEQ ID NO: 3705355 - DNA, 13 bp, Homo sapiens
catgaatgtatca

SEQ ID NO: 3705356 - DNA, 17 bp, Homo sapiens
catgacaagccccaggc

SEQ ID NO: 3705357 - DNA, 18 bp, Homo sapiens
catgacaagccccaggca

SEQ ID NO: 3705358 - DNA, 19 bp, Homo sapiens
catgacgacaaagctgcta

SEQ ID NO: 3705359 - DNA, 23 bp, Homo sapiens
catgacgacaaagctgctaaatc

SEQ ID NO: 3705360 - DNA, 23 bp, Homo sapiens
catgactcgtatatgtctcaggt

SEQ ID NO: 3705361 - DNA, 23 bp, Homo sapiens
catgactgcattttactgtacag

SEQ ID NO: 3705362 - DNA, 22 bp, Homo sapiens
catgacttgagaaacaaataat

SEQ ID NO: 3705363 - DNA, 12 bp, Homo sapiens
catgagaacaga

SEQ ID NO: 3705364 - DNA, 16 bp, Homo sapiens
catgagaagccataca

SEQ ID NO: 3705365 - DNA, 19 bp, Homo sapiens
catgagaatctatatttaa

SEQ ID NO: 3705366 - DNA, 23 bp, Homo sapiens
catgagagaattgtatcatttga

SEQ ID NO: 3705367 - DNA, 20 bp, Homo sapiens
catgagatctaggtgaggat

SEQ ID NO: 3705368 - DNA, 17 bp, Homo sapiens
catgagcctcagcatcc

SEQ ID NO: 3705369 - DNA, 17 bp, Homo sapiens
catgagctccagacccc

SEQ ID NO: 3705370 - DNA, 21 bp, Homo sapiens
catgaggacatgatggagcgc

SEQ ID NO: 3705371 - DNA, 15 bp, Homo sapiens
catgaggagttgctg

SEQ ID NO: 3705372 - DNA, 15 bp, Homo sapiens
catgagtttgccctg

SEQ ID NO: 3705373 - DNA, 16 bp, Homo sapiens
catgagtttgccctgg

SEQ ID NO: 3705374 - DNA, 14 bp, Homo sapiens
catgatatgtcagg

SEQ ID NO: 3705375 - DNA, 13 bp, Homo sapiens
catgatcctgagt

SEQ ID NO: 3705376 - DNA, 15 bp, Homo sapiens
catgatctccctgcc

SEQ ID NO: 3705377 - DNA, 19 bp, Homo sapiens
catgatctccctgccgcct

SEQ ID NO: 3705378 - DNA, 20 bp, Homo sapiens
catgatctccctgccgcctc

SEQ ID NO: 3705379 - DNA, 18 bp, Homo sapiens
catgatgagctcctcttc

SEQ ID NO: 3705380 - DNA, 19 bp, Homo sapiens
catgatggagcgcacctgc

SEQ ID NO: 3705381 - DNA, 22 bp, Homo sapiens
catgatgttaaccagaataaag

SEQ ID NO: 3705382 - DNA, 21 bp, Homo sapiens
catgattcgcccaaagccaga

SEQ ID NO: 3705383 - DNA, 14 bp, Homo sapiens
catgcacagctgta

SEQ ID NO: 3705384 - DNA, 12 bp, Homo sapiens
catgcagcagct

SEQ ID NO: 3705385 - DNA, 16 bp, Homo sapiens
catgcatcttactgaa

SEQ ID NO: 3705386 - DNA, 17 bp, Homo sapiens
catgcatcttactgaag

SEQ ID NO: 3705387 - DNA, 11 bp, Homo sapiens
catgcattgtt

SEQ ID NO: 3705388 - DNA, 14 bp, Homo sapiens
catgcattttgcag

SEQ ID NO: 3705389 - DNA, 19 bp, Homo sapiens
catgcattttgcagcagtg

SEQ ID NO: 3705390 - DNA, 22 bp, Homo sapiens
catgccaaccccgccctaggcc

SEQ ID NO: 3705391 - DNA, 21 bp, Homo sapiens
catgcccacctgcccatcaca

SEQ ID NO: 3705392 - DNA, 20 bp, Homo sapiens
catgcctgccccaaacaaat

SEQ ID NO: 3705393 - DNA, 17 bp, Homo sapiens
catgcctggacaaaccc

SEQ ID NO: 3705394 - DNA, 23 bp, Homo sapiens
catgcctgtccagcctgggcagc

SEQ ID NO: 3705395 - DNA, 13 bp, Homo sapiens
catgccttccagc

SEQ ID NO: 3705396 - DNA, 15 bp, Homo sapiens
catgcctttgtaagt

SEQ ID NO: 3705397 - DNA, 21 bp, Homo sapiens
catgcgggctgggcagctgtt

SEQ ID NO: 3705398 - DNA, 22 bp, Homo sapiens
catgcgtgggtggggagggagg

SEQ ID NO: 3705399 - DNA, 23 bp, Homo sapiens
catgcgtgggtggggagggaggt

SEQ ID NO: 3705400 - DNA, 13 bp, Homo sapiens
catgctcctggcc

SEQ ID NO: 3705401 - DNA, 16 bp, Homo sapiens
catgctcctggcccac

SEQ ID NO: 3705402 - DNA, 16 bp, Homo sapiens
catgctctctgcagcc

SEQ ID NO: 3705403 - DNA, 19 bp, Homo sapiens
catgctctctgcagccagc

SEQ ID NO: 3705404 - DNA, 23 bp, Homo sapiens
catgctctctgcagccagcccag

SEQ ID NO: 3705405 - DNA, 12 bp, Homo sapiens
catgctgcctcc

SEQ ID NO: 3705406 - DNA, 14 bp, Homo sapiens
catgctgcctccag

SEQ ID NO: 3705407 - DNA, 18 bp, Homo sapiens
catgctgctttaattgtg

SEQ ID NO: 3705408 - DNA, 20 bp, Homo sapiens
catgctgctttaattgtgaa

SEQ ID NO: 3705409 - DNA, 21 bp, Homo sapiens
catgctgctttaattgtgaat

SEQ ID NO: 3705410 - DNA, 18 bp, Homo sapiens
catgctggacaggtctgg

SEQ ID NO: 3705411 - DNA, 20 bp, Homo sapiens
catgctggacaggtctggga

SEQ ID NO: 3705412 - DNA, 22 bp, Homo sapiens
catgctggctcccagggccatg

SEQ ID NO: 3705413 - DNA, 19 bp, Homo sapiens
catgcttcatgaaaatcct

SEQ ID NO: 3705414 - DNA, 14 bp, Homo sapiens
catggaaatattat

SEQ ID NO: 3705415 - DNA, 17 bp, Homo sapiens
catggaaatattatgca

SEQ ID NO: 3705416 - DNA, 22 bp, Homo sapiens
catggaaatattatgcaaattc

SEQ ID NO: 3705417 - DNA, 21 bp, Homo sapiens
catggacagaagaaggcagca

SEQ ID NO: 3705418 - DNA, 16 bp, Homo sapiens
cagttttccatgaaaa

SEQ ID NO: 3705419 - DNA, 21 bp, Homo sapiens
cataaaaattagccaagtgtg

SEQ ID NO: 3705420 - DNA, 20 bp, Homo sapiens
cataaaataaagtatatata

SEQ ID NO: 3705421 - DNA, 13 bp, Homo sapiens
cataaaattggat

SEQ ID NO: 3705422 - DNA, 21 bp, Homo sapiens
cataaagccttggatgtatat

SEQ ID NO: 3705423 - DNA, 22 bp, Homo sapiens
cataaataaattaaataaaata

SEQ ID NO: 3705424 - DNA, 14 bp, Homo sapiens
cataaatgaggaaa

SEQ ID NO: 3705425 - DNA, 15 bp, Homo sapiens
cataacaacttcata

SEQ ID NO: 3705426 - DNA, 17 bp, Homo sapiens
cataacagggtaaatta

SEQ ID NO: 3705427 - DNA, 13 bp, Homo sapiens
cataacagtgcca

SEQ ID NO: 3705428 - DNA, 13 bp, Homo sapiens
cataaccactgct

SEQ ID NO: 3705429 - DNA, 14 bp, Homo sapiens
cataaccactgctt

SEQ ID NO: 3705430 - DNA, 16 bp, Homo sapiens
cataacctagccttag

SEQ ID NO: 3705431 - DNA, 16 bp, Homo sapiens
cataactgacaaatca

SEQ ID NO: 3705432 - DNA, 12 bp, Homo sapiens
cataagaatgaa

SEQ ID NO: 3705433 - DNA, 22 bp, Homo sapiens
cataagctatagacccgaggaa

SEQ ID NO: 3705434 - DNA, 18 bp, Homo sapiens
cataagtgacagtttaac

SEQ ID NO: 3705435 - DNA, 12 bp, Homo sapiens
cataagtttctg

SEQ ID NO: 3705436 - DNA, 19 bp, Homo sapiens
cataatctggactcctctg

SEQ ID NO: 3705437 - DNA, 15 bp, Homo sapiens
cataatgtataaaga

SEQ ID NO: 3705438 - DNA, 17 bp, Homo sapiens
cataatgttacattatt

SEQ ID NO: 3705439 - DNA, 19 bp, Homo sapiens
cagtgaggtcctgggggcc

SEQ ID NO: 3705440 - DNA, 17 bp, Homo sapiens
cagtgagtcgaggacag

SEQ ID NO: 3705441 - DNA, 18 bp, Homo sapiens
cagtgagtcgaggacagg

SEQ ID NO: 3705442 - DNA, 17 bp, Homo sapiens
cagtgagtctcttcaga

SEQ ID NO: 3705443 - DNA, 18 bp, Homo sapiens
cagtgagtctcttcagaa

SEQ ID NO: 3705444 - DNA, 21 bp, Homo sapiens
cagtgatctccatatgttaca

SEQ ID NO: 3705445 - DNA, 18 bp, Homo sapiens
cagtgatgctggatgctc

SEQ ID NO: 3705446 - DNA, 20 bp, Homo sapiens
cagtgattaaggtctctctt

SEQ ID NO: 3705447 - DNA, 23 bp, Homo sapiens
cagtgattaaggtctctctttgg

SEQ ID NO: 3705448 - DNA, 20 bp, Homo sapiens
cagtgattcgagctatattt

SEQ ID NO: 3705449 - DNA, 13 bp, Homo sapiens
cagtgatttttat

SEQ ID NO: 3705450 - DNA, 15 bp, Homo sapiens
cagtgatttttatcc

SEQ ID NO: 3705451 - DNA, 20 bp, Homo sapiens
cagtgcaagtgagtataact

SEQ ID NO: 3705452 - DNA, 17 bp, Homo sapiens
cagtgcacctgtcatat

SEQ ID NO: 3705453 - DNA, 19 bp, Homo sapiens
cagtgcactaattctgcat

SEQ ID NO: 3705454 - DNA, 15 bp, Homo sapiens
caggcagaaagagtt

SEQ ID NO: 3705455 - DNA, 17 bp, Homo sapiens
caggcagatctgtgccc

SEQ ID NO: 3705456 - DNA, 13 bp, Homo sapiens
caggcagcattta

SEQ ID NO: 3705457 - DNA, 19 bp, Homo sapiens
caggcagctttttctctcc

SEQ ID NO: 3705458 - DNA, 19 bp, Homo sapiens
caggcaggtccagggtttg

SEQ ID NO: 3705459 - DNA, 12 bp, Homo sapiens
caggcaggtctt

SEQ ID NO: 3705460 - DNA, 23 bp, Homo sapiens
caggcaggtcttgaactcctggc

SEQ ID NO: 3705461 - DNA, 20 bp, Homo sapiens
caggcagtgatgctggatgc

SEQ ID NO: 3705462 - DNA, 18 bp, Homo sapiens
caggcataggcctgggtg

SEQ ID NO: 3705463 - DNA, 19 bp, Homo sapiens
caggcataggcctgggtgc

SEQ ID NO: 3705464 - DNA, 24 bp, Homo sapiens
caggcatgctggctcccagggcca

SEQ ID NO: 3705465 - DNA, 18 bp, Homo sapiens
caggcatgttctctgagg

SEQ ID NO: 3705466 - DNA, 19 bp, Homo sapiens
caggcatgttctctgagga

SEQ ID NO: 3705467 - DNA, 16 bp, Homo sapiens
caggccacctgccccc

SEQ ID NO: 3705468 - DNA, 17 bp, Homo sapiens
caggccacctgccccct

SEQ ID NO: 3705469 - DNA, 19 bp, Homo sapiens
caggccacctgcccccttc

SEQ ID NO: 3705470 - DNA, 21 bp, Homo sapiens
caggccacctgcccccttctc

SEQ ID NO: 3705471 - DNA, 22 bp, Homo sapiens
caggccacctgcccccttctcc

SEQ ID NO: 3705472 - DNA, 17 bp, Homo sapiens
caggccacggcagccta

SEQ ID NO: 3705473 - DNA, 23 bp, Homo sapiens
caggccagagggagtgacagagg

SEQ ID NO: 3705474 - DNA, 12 bp, Homo sapiens
caggccagctgt

SEQ ID NO: 3705475 - DNA, 21 bp, Homo sapiens
caggccaggctccttcctgtc

SEQ ID NO: 3705476 - DNA, 17 bp, Homo sapiens
caggccccaaaaccaca

SEQ ID NO: 3705477 - DNA, 19 bp, Homo sapiens
caggccccaaaaccacagc

SEQ ID NO: 3705478 - DNA, 12 bp, Homo sapiens
caggccccaagg

SEQ ID NO: 3705479 - DNA, 16 bp, Homo sapiens
caggccccctgcatct

SEQ ID NO: 3705480 - DNA, 19 bp, Homo sapiens
caggccccgcttgtccagc

SEQ ID NO: 3705481 - DNA, 22 bp, Homo sapiens
caggccccgcttgtccagcgcc

SEQ ID NO: 3705482 - DNA, 13 bp, Homo sapiens
caggcccctgcca

SEQ ID NO: 3705483 - DNA, 15 bp, Homo sapiens
caggcccctgccacc

SEQ ID NO: 3705484 - DNA, 16 bp, Homo sapiens
caggcccggctccagg

SEQ ID NO: 3705485 - DNA, 19 bp, Homo sapiens
caggcccggctccaggctc

SEQ ID NO: 3705486 - DNA, 17 bp, Homo sapiens
caggcccttcctctcca

SEQ ID NO: 3705487 - DNA, 19 bp, Homo sapiens
caggcccttcctctccact

SEQ ID NO: 3705488 - DNA, 12 bp, Homo sapiens
caggcctccctc

SEQ ID NO: 3705489 - DNA, 13 bp, Homo sapiens
caggcctccctct

SEQ ID NO: 3705490 - DNA, 16 bp, Homo sapiens
caggcctccctctctc

SEQ ID NO: 3705491 - DNA, 18 bp, Homo sapiens
caggcctccctctctctt

SEQ ID NO: 3705492 - DNA, 19 bp, Homo sapiens
caggcctccctctctcttc

SEQ ID NO: 3705493 - DNA, 23 bp, Homo sapiens
caggcctccctctctcttctgct

SEQ ID NO: 3705494 - DNA, 19 bp, Homo sapiens
caggcgatccacctgtctc

SEQ ID NO: 3705495 - DNA, 22 bp, Homo sapiens
caggctcatagggaagacctgc

SEQ ID NO: 3705496 - DNA, 13 bp, Homo sapiens
caggctccttcct

SEQ ID NO: 3705497 - DNA, 14 bp, Homo sapiens
caggctccttcctg

SEQ ID NO: 3705498 - DNA, 20 bp, Homo sapiens
caggctccttcctgtcttcc

SEQ ID NO: 3705499 - DNA, 21 bp, Homo sapiens
caggctccttcctgtcttcct

SEQ ID NO: 3705500 - DNA, 14 bp, Homo sapiens
caggctcctttagc

SEQ ID NO: 3705501 - DNA, 20 bp, Homo sapiens
caggctcctttagcgcccag

SEQ ID NO: 3705502 - DNA, 18 bp, Homo sapiens
caggctcttctcctttca

SEQ ID NO: 3705503 - DNA, 22 bp, Homo sapiens
caggctcttctcctttcacaac

SEQ ID NO: 3705504 - DNA, 22 bp, Homo sapiens
caggctgcatagaaggaggaga

SEQ ID NO: 3705505 - DNA, 22 bp, Homo sapiens
caggctgccaaggccagagtgg

SEQ ID NO: 3705506 - DNA, 15 bp, Homo sapiens
caggctgcctgagca

SEQ ID NO: 3705507 - DNA, 21 bp, Homo sapiens
caggctgcctgagcacctccc

SEQ ID NO: 3705508 - DNA, 15 bp, Homo sapiens
caggctgctggagga

SEQ ID NO: 3705509 - DNA, 20 bp, Homo sapiens
caggctggcaccgccttctc

SEQ ID NO: 3705510 - DNA, 15 bp, Homo sapiens
caggctggcgtgcag

SEQ ID NO: 3705511 - DNA, 18 bp, Homo sapiens
caggctggcgtgcagtgg

SEQ ID NO: 3705512 - DNA, 19 bp, Homo sapiens
caggctggcgtgcagtggt

SEQ ID NO: 3705513 - DNA, 23 bp, Homo sapiens
caggctgggcttcagtggcagct

SEQ ID NO: 3705514 - DNA, 20 bp, Homo sapiens
caggctgtatcccatgagcc

SEQ ID NO: 3705515 - DNA, 21 bp, Homo sapiens
caggctgtatcccatgagcct

SEQ ID NO: 3705516 - DNA, 18 bp, Homo sapiens
caggctgtttttgggtgc

SEQ ID NO: 3705517 - DNA, 14 bp, Homo sapiens
caggcttccttggc

SEQ ID NO: 3705518 - DNA, 17 bp, Homo sapiens
cagggaagctggccgag

SEQ ID NO: 3705519 - DNA, 19 bp, Homo sapiens
cagggaaggggaggcagcc

SEQ ID NO: 3705520 - DNA, 14 bp, Homo sapiens
cagggaagtcccca

SEQ ID NO: 3705521 - DNA, 18 bp, Homo sapiens
cagggacagagacacctg

SEQ ID NO: 3705522 - DNA, 14 bp, Homo sapiens
cagggaccaaggac

SEQ ID NO: 3705523 - DNA, 19 bp, Homo sapiens
cagggaccaaggacccctc

SEQ ID NO: 3705524 - DNA, 22 bp, Homo sapiens
cagggacccacttcacacacag

SEQ ID NO: 3705525 - DNA, 16 bp, Homo sapiens
cagggacccctgccct

SEQ ID NO: 3705526 - DNA, 22 bp, Homo sapiens
cagggaggcaccattcaggaac

SEQ ID NO: 3705527 - DNA, 24 bp, Homo sapiens
cagggaggcaccattcaggaacct

SEQ ID NO: 3705528 - DNA, 18 bp, Homo sapiens
cagggaggtgaccccagg

SEQ ID NO: 3705529 - DNA, 17 bp, Homo sapiens
cagggcacaccgggcac

SEQ ID NO: 3705530 - DNA, 23 bp, Homo sapiens
cagggcacaccgggcactcagaa

SEQ ID NO: 3705531 - DNA, 15 bp, Homo sapiens
cagggcactgctgct

SEQ ID NO: 3705532 - DNA, 16 bp, Homo sapiens
cagggcagagccggga

SEQ ID NO: 3705533 - DNA, 13 bp, Homo sapiens
cagggcagcagat

SEQ ID NO: 3705534 - DNA, 13 bp, Homo sapiens
cagggcatctcct

SEQ ID NO: 3705535 - DNA, 14 bp, Homo sapiens
cagggcatctcctg

SEQ ID NO: 3705536 - DNA, 18 bp, Homo sapiens
cagggccactctgcctct

SEQ ID NO: 3705537 - DNA, 15 bp, Homo sapiens
cagggccagggccct

SEQ ID NO: 3705538 - DNA, 16 bp, Homo sapiens
cagggccagggccctg

SEQ ID NO: 3705539 - DNA, 19 bp, Homo sapiens
cagggccagggccctgcag

SEQ ID NO: 3705540 - DNA, 15 bp, Homo sapiens
cagggccctgagctc

SEQ ID NO: 3705541 - DNA, 14 bp, Homo sapiens
cagggccctgcaga

SEQ ID NO: 3705542 - DNA, 18 bp, Homo sapiens
cagggccctgcagagggg

SEQ ID NO: 3705543 - DNA, 20 bp, Homo sapiens
cagggcgagactctgtctca

SEQ ID NO: 3705544 - DNA, 12 bp, Homo sapiens
cagggctcagcc

SEQ ID NO: 3705545 - DNA, 13 bp, Homo sapiens
cagggctcagcct

SEQ ID NO: 3705546 - DNA, 14 bp, Homo sapiens
cagggctcagcctg

SEQ ID NO: 3705547 - DNA, 21 bp, Homo sapiens
cagggctgacacgtccacccc

SEQ ID NO: 3705548 - DNA, 19 bp, Homo sapiens
caggggaatattttattca

SEQ ID NO: 3705549 - DNA, 17 bp, Homo sapiens
caggggagagggtctgg

SEQ ID NO: 3705550 - DNA, 21 bp, Homo sapiens
caggggagagggtctggagaa

SEQ ID NO: 3705551 - DNA, 18 bp, Homo sapiens
caggggagtcccgtcagg

SEQ ID NO: 3705552 - DNA, 17 bp, Homo sapiens
caggggcaaacacctgc

SEQ ID NO: 3705553 - DNA, 18 bp, Homo sapiens
caggggcgtgtggctcac

SEQ ID NO: 3705554 - DNA, 15 bp, Homo sapiens
caggggctggtgggc

SEQ ID NO: 3705555 - DNA, 16 bp, Homo sapiens
cagggggtgtgtctgc

SEQ ID NO: 3705556 - DNA, 18 bp, Homo sapiens
caggggtcccagccaccc

SEQ ID NO: 3705557 - DNA, 21 bp, Homo sapiens
caggggtcgtcaccacctctc

SEQ ID NO: 3705558 - DNA, 13 bp, Homo sapiens
caggggtggagga

SEQ ID NO: 3705559 - DNA, 17 bp, Homo sapiens
caggggtggaggagagc

SEQ ID NO: 3705560 - DNA, 18 bp, Homo sapiens
caggggtggaggagagcc

SEQ ID NO: 3705561 - DNA, 19 bp, Homo sapiens
cagggtagaaaaaggagct

SEQ ID NO: 3705562 - DNA, 16 bp, Homo sapiens
cagggtagcaggtacc

SEQ ID NO: 3705563 - DNA, 12 bp, Homo sapiens
cagggtcctgct

SEQ ID NO: 3705564 - DNA, 13 bp, Homo sapiens
cagggtcctgcta

SEQ ID NO: 3705565 - DNA, 14 bp, Homo sapiens
cagggtcctgctat

SEQ ID NO: 3705566 - DNA, 20 bp, Homo sapiens
cagggtcctgctatttccca

SEQ ID NO: 3705567 - DNA, 18 bp, Homo sapiens
cagggtcctgtagcccta

SEQ ID NO: 3705568 - DNA, 21 bp, Homo sapiens
caggcaagcacctcctgcctc

SEQ ID NO: 3705569 - DNA, 21 bp, Homo sapiens
caggcaatgctggctgttggc

SEQ ID NO: 3705570 - DNA, 18 bp, Homo sapiens
caggcacccaccatcatg

SEQ ID NO: 3705571 - DNA, 22 bp, Homo sapiens
caggcacccaccatcatgtctg

SEQ ID NO: 3705572 - DNA, 21 bp, Homo sapiens
caggcacgaacccacctgctg

SEQ ID NO: 3705573 - DNA, 22 bp, Homo sapiens
caggcacgaacccacctgctga

SEQ ID NO: 3705574 - DNA, 13 bp, Homo sapiens
caggcagaaagag

SEQ ID NO: 3705575 - DNA, 14 bp, Homo sapiens
cagatgccagagca

SEQ ID NO: 3705576 - DNA, 12 bp, Homo sapiens
cagatgcttctg

SEQ ID NO: 3705577 - DNA, 17 bp, Homo sapiens
cagatgcttctgggaga

SEQ ID NO: 3705578 - DNA, 14 bp, Homo sapiens
cagatggaaccgca

SEQ ID NO: 3705579 - DNA, 16 bp, Homo sapiens
cagctgcatctactca

SEQ ID NO: 3705580 - DNA, 14 bp, Homo sapiens
cagctgccagagaa

SEQ ID NO: 3705581 - DNA, 21 bp, Homo sapiens
cagactctacagaggccatgg

SEQ ID NO: 3705582 - DNA, 20 bp, Homo sapiens
cagactgcttccaattttct

SEQ ID NO: 3705583 - DNA, 16 bp, Homo sapiens
cagactggaagcacag

SEQ ID NO: 3705584 - DNA, 17 bp, Homo sapiens
cagactggaagcacagc

SEQ ID NO: 3705585 - DNA, 16 bp, Homo sapiens
cagactggctggctgc

SEQ ID NO: 3705586 - DNA, 13 bp, Homo sapiens
cagacttctccag

SEQ ID NO: 3705587 - DNA, 15 bp, Homo sapiens
cagacttctccagac

SEQ ID NO: 3705588 - DNA, 15 bp, Homo sapiens
cagactttaaagaat

SEQ ID NO: 3705589 - DNA, 20 bp, Homo sapiens
cagactttttttaaatagta

SEQ ID NO: 3705590 - DNA, 23 bp, Homo sapiens
cagagaaagtacttctccaccct

SEQ ID NO: 3705591 - DNA, 17 bp, Homo sapiens
cagagaactagtggtgg

SEQ ID NO: 3705592 - DNA, 17 bp, Homo sapiens
cagagaaggcaggaatg

SEQ ID NO: 3705593 - DNA, 13 bp, Homo sapiens
cagagaatttcta

SEQ ID NO: 3705594 - DNA, 15 bp, Homo sapiens
cagagaatttctacc

SEQ ID NO: 3705595 - DNA, 23 bp, Homo sapiens
cagagaatttctaccatttcaga

SEQ ID NO: 3705596 - DNA, 14 bp, Homo sapiens
cagagacacctgca

SEQ ID NO: 3705597 - DNA, 16 bp, Homo sapiens
cagagacacctgcacc

SEQ ID NO: 3705598 - DNA, 14 bp, Homo sapiens
cagagacaggccca

SEQ ID NO: 3705599 - DNA, 15 bp, Homo sapiens
cagagacgcaggaat

SEQ ID NO: 3705600 - DNA, 18 bp, Homo sapiens
cagagacgcaggaatgga

SEQ ID NO: 3705601 - DNA, 20 bp, Homo sapiens
cagagactcagggccccagc

SEQ ID NO: 3705602 - DNA, 15 bp, Homo sapiens
cagagagacagactt

SEQ ID NO: 3705603 - DNA, 19 bp, Homo sapiens
cagagagagaagtgcccct

SEQ ID NO: 3705604 - DNA, 20 bp, Homo sapiens
cagagagagaagtgcccctg

SEQ ID NO: 3705605 - DNA, 24 bp, Homo sapiens
cagagagagaagtgcccctgctgc

SEQ ID NO: 3705606 - DNA, 12 bp, Homo sapiens
cagagagagtgt

SEQ ID NO: 3705607 - DNA, 19 bp, Homo sapiens
cagagagcctggtgctgct

SEQ ID NO: 3705608 - DNA, 13 bp, Homo sapiens
cagagagctggta

SEQ ID NO: 3705609 - DNA, 13 bp, Homo sapiens
cagagaggaatca

SEQ ID NO: 3705610 - DNA, 15 bp, Homo sapiens
cagagaggaatcaga

SEQ ID NO: 3705611 - DNA, 18 bp, Homo sapiens
cagagaggacgtgggcgg

SEQ ID NO: 3705612 - DNA, 21 bp, Homo sapiens
cagagaggacgtgggcggcag

SEQ ID NO: 3705613 - DNA, 13 bp, Homo sapiens
cagagaggagaaa

SEQ ID NO: 3705614 - DNA, 16 bp, Homo sapiens
cagagaggagaaacac

SEQ ID NO: 3705615 - DNA, 18 bp, Homo sapiens
cagagaggagaaacacat

SEQ ID NO: 3705616 - DNA, 17 bp, Homo sapiens
cagagaggagtcagaga

SEQ ID NO: 3705617 - DNA, 15 bp, Homo sapiens
cagagagggggccac

SEQ ID NO: 3705618 - DNA, 17 bp, Homo sapiens
cagagagggtggtgacc

SEQ ID NO: 3705619 - DNA, 20 bp, Homo sapiens
cagagagggtggtgacctct

SEQ ID NO: 3705620 - DNA, 22 bp, Homo sapiens
cagagagggtggtgacctctgc

SEQ ID NO: 3705621 - DNA, 19 bp, Homo sapiens
cagagaggtcaagcccagg

SEQ ID NO: 3705622 - DNA, 21 bp, Homo sapiens
cagagaggtcaagcccaggag

SEQ ID NO: 3705623 - DNA, 13 bp, Homo sapiens
cagagagtggctc

SEQ ID NO: 3705624 - DNA, 15 bp, Homo sapiens
cagagagtggctcct

SEQ ID NO: 3705625 - DNA, 15 bp, Homo sapiens
cagagatgcctccac

SEQ ID NO: 3705626 - DNA, 18 bp, Homo sapiens
cagagatgggactgggag

SEQ ID NO: 3705627 - DNA, 16 bp, Homo sapiens
cagagcaaagggccag

SEQ ID NO: 3705628 - DNA, 18 bp, Homo sapiens
cagagcaagatcctgtct

SEQ ID NO: 3705629 - DNA, 18 bp, Homo sapiens
cagagcacagcagcccct

SEQ ID NO: 3705630 - DNA, 14 bp, Homo sapiens
cagagcaggggcag

SEQ ID NO: 3705631 - DNA, 22 bp, Homo sapiens
cagagccacccctaaagagata

SEQ ID NO: 3705632 - DNA, 14 bp, Homo sapiens
cagagccatggact

SEQ ID NO: 3705633 - DNA, 17 bp, Homo sapiens
cagagcccaccttggct

SEQ ID NO: 3705634 - DNA, 19 bp, Homo sapiens
cagagcccaccttggctca

SEQ ID NO: 3705635 - DNA, 20 bp, Homo sapiens
cagagccccaccctcagatg

SEQ ID NO: 3705636 - DNA, 13 bp, Homo sapiens
cagagcctgcagt

SEQ ID NO: 3705637 - DNA, 14 bp, Homo sapiens
cagagcgtccttcc

SEQ ID NO: 3705638 - DNA, 16 bp, Homo sapiens
cagagctggaccagtg

SEQ ID NO: 3705639 - DNA, 13 bp, Homo sapiens
cagagctgggtga

SEQ ID NO: 3705640 - DNA, 22 bp, Homo sapiens
cagagctgtttatggcctcagc

SEQ ID NO: 3705641 - DNA, 12 bp, Homo sapiens
cagaggaagagc

SEQ ID NO: 3705642 - DNA, 16 bp, Homo sapiens
cagaggaagagcaggc

SEQ ID NO: 3705643 - DNA, 13 bp, Homo sapiens
cagaggcagaacc

SEQ ID NO: 3705644 - DNA, 11 bp, Homo sapiens
cagaggcagcc

SEQ ID NO: 3705645 - DNA, 14 bp, Homo sapiens
cagaggcagcccca

SEQ ID NO: 3705646 - DNA, 18 bp, Homo sapiens
cagaggcagccccattct

SEQ ID NO: 3705647 - DNA, 14 bp, Homo sapiens
cagaggccatggca

SEQ ID NO: 3705648 - DNA, 20 bp, Homo sapiens
cagaggcctagtcagccaca

SEQ ID NO: 3705649 - DNA, 20 bp, Homo sapiens
cagaggctggaggcagggcc

SEQ ID NO: 3705650 - DNA, 23 bp, Homo sapiens
cagagggaaagtaaatatttcag

SEQ ID NO: 3705651 - DNA, 22 bp, Homo sapiens
cagagggaggaatcgaggaacc

SEQ ID NO: 3705652 - DNA, 18 bp, Homo sapiens
cagagggagtgacagagg

SEQ ID NO: 3705653 - DNA, 20 bp, Homo sapiens
cagaggtggctctggaatga

SEQ ID NO: 3705654 - DNA, 14 bp, Homo sapiens
cagagtcagcagaa

SEQ ID NO: 3705655 - DNA, 16 bp, Homo sapiens
cagagtccaggcccca

SEQ ID NO: 3705656 - DNA, 15 bp, Homo sapiens
cagagtcggaacgga

SEQ ID NO: 3705657 - DNA, 14 bp, Homo sapiens
cagagtgcccagaa

SEQ ID NO: 3705658 - DNA, 15 bp, Homo sapiens
cagagtgcccagaac

SEQ ID NO: 3705659 - DNA, 12 bp, Homo sapiens
cagagtgcccca

SEQ ID NO: 3705660 - DNA, 15 bp, Homo sapiens
cagagtgccccacct

SEQ ID NO: 3705661 - DNA, 17 bp, Homo sapiens
cagagtgccccacctgc

SEQ ID NO: 3705662 - DNA, 19 bp, Homo sapiens
cagagtgccccacctgcca

SEQ ID NO: 3705663 - DNA, 23 bp, Homo sapiens
cagagtgccccacctgccactag

SEQ ID NO: 3705664 - DNA, 17 bp, Homo sapiens
cagagtggcctggccag

SEQ ID NO: 3705665 - DNA, 19 bp, Homo sapiens
cagagtgtgggaagggaga

SEQ ID NO: 3705666 - DNA, 20 bp, Homo sapiens
cagataagcaagagagatgt

SEQ ID NO: 3705667 - DNA, 22 bp, Homo sapiens
cagataagcaagagagatgttt

SEQ ID NO: 3705668 - DNA, 15 bp, Homo sapiens
cagataatcagcctc

SEQ ID NO: 3705669 - DNA, 18 bp, Homo sapiens
cagataatcagcctctta

SEQ ID NO: 3705670 - DNA, 15 bp, Homo sapiens
cagatatatttttca

SEQ ID NO: 3705671 - DNA, 16 bp, Homo sapiens
cagatatatttttcac

SEQ ID NO: 3705672 - DNA, 18 bp, Homo sapiens
cagatatgatatgtaaac

SEQ ID NO: 3705673 - DNA, 16 bp, Homo sapiens
cagatatttatatttt

SEQ ID NO: 3705674 - DNA, 18 bp, Homo sapiens
cagatcacagcttcagcc

SEQ ID NO: 3705675 - DNA, 22 bp, Homo sapiens
cagatcacagcttcagccagga

SEQ ID NO: 3705676 - DNA, 11 bp, Homo sapiens
cagatcctacc

SEQ ID NO: 3705677 - DNA, 23 bp, Homo sapiens
cagatctgtatatttttttctaa

SEQ ID NO: 3705678 - DNA, 12 bp, Homo sapiens
cagatctgtgcc

SEQ ID NO: 3705679 - DNA, 13 bp, Homo sapiens
cagatctgtgccc

SEQ ID NO: 3705680 - DNA, 15 bp, Homo sapiens
cagatctgtgcccca

SEQ ID NO: 3705681 - DNA, 18 bp, Homo sapiens
cagatctgtgccccatgc

SEQ ID NO: 3705682 - DNA, 23 bp, Homo sapiens
cagatctgtgccccatgcctgtc

SEQ ID NO: 3705683 - DNA, 13 bp, Homo sapiens
cagatgacccctc

SEQ ID NO: 3705684 - DNA, 14 bp, Homo sapiens
cagatgactagaaa

SEQ ID NO: 3705685 - DNA, 16 bp, Homo sapiens
cagatgagcagaagct

SEQ ID NO: 3705686 - DNA, 15 bp, Homo sapiens
cagatgcaatgtgct

SEQ ID NO: 3705687 - DNA, 17 bp, Homo sapiens
cagatgcacatgagctg

SEQ ID NO: 3705688 - DNA, 16 bp, Homo sapiens
cacttcaggctcttct

SEQ ID NO: 3705689 - DNA, 20 bp, Homo sapiens
cacttcaggctcttctcctt

SEQ ID NO: 3705690 - DNA, 18 bp, Homo sapiens
cacttcaggtcaggagtt

SEQ ID NO: 3705691 - DNA, 22 bp, Homo sapiens
cacttcattcttgaaagctgtg

SEQ ID NO: 3705692 - DNA, 15 bp, Homo sapiens
cacttccaccagcct

SEQ ID NO: 3705693 - DNA, 18 bp, Homo sapiens
cacttccaccagcctgca

SEQ ID NO: 3705694 - DNA, 20 bp, Homo sapiens
cacttccataatctggactc

SEQ ID NO: 3705695 - DNA, 23 bp, Homo sapiens
cacttcctacaagagcagcctgt

SEQ ID NO: 3705696 - DNA, 14 bp, Homo sapiens
cacttcctgtccag

SEQ ID NO: 3705697 - DNA, 17 bp, Homo sapiens
cacttcctgtccagaga

SEQ ID NO: 3705698 - DNA, 21 bp, Homo sapiens
cacttcgggaggtcgaggcag

SEQ ID NO: 3705699 - DNA, 17 bp, Homo sapiens
cacttctaaatgaagtg

SEQ ID NO: 3705700 - DNA, 16 bp, Homo sapiens
cacttctgaccacact

SEQ ID NO: 3705701 - DNA, 21 bp, Homo sapiens
cacttctgtgagacccccaca

SEQ ID NO: 3705702 - DNA, 17 bp, Homo sapiens
cacttgagaattaccct

SEQ ID NO: 3705703 - DNA, 23 bp, Homo sapiens
cacttgcacgcccatgtgtgagt

SEQ ID NO: 3705704 - DNA, 24 bp, Homo sapiens
cacttgcagactctacagaggcca

SEQ ID NO: 3705705 - DNA, 12 bp, Homo sapiens
cacttggagcca

SEQ ID NO: 3705706 - DNA, 19 bp, Homo sapiens
cacttgtatcctctggttc

SEQ ID NO: 3705707 - DNA, 23 bp, Homo sapiens
cacttgtgtgtgggctgtgagtg

SEQ ID NO: 3705708 - DNA, 18 bp, Homo sapiens
cacttgtgttatgaagca

SEQ ID NO: 3705709 - DNA, 15 bp, Homo sapiens
cacttgttccagctc

SEQ ID NO: 3705710 - DNA, 16 bp, Homo sapiens
cacttgttccagctct

SEQ ID NO: 3705711 - DNA, 14 bp, Homo sapiens
cactttcattgcca

SEQ ID NO: 3705712 - DNA, 17 bp, Homo sapiens
cactttgcacagctctc

SEQ ID NO: 3705713 - DNA, 13 bp, Homo sapiens
cactttgctctga

SEQ ID NO: 3705714 - DNA, 20 bp, Homo sapiens
cactttggaagtttgtgttc

SEQ ID NO: 3705715 - DNA, 16 bp, Homo sapiens
cactttgggaggccaa

SEQ ID NO: 3705716 - DNA, 19 bp, Homo sapiens
cactttggtacatggccag

SEQ ID NO: 3705717 - DNA, 15 bp, Homo sapiens
cacttttgagacttt

SEQ ID NO: 3705718 - DNA, 21 bp, Homo sapiens
cacttttttgagtggatgatg

SEQ ID NO: 3705719 - DNA, 16 bp, Homo sapiens
cagaaaaacaataaga

SEQ ID NO: 3705720 - DNA, 14 bp, Homo sapiens
cagaaaacaacaaa

SEQ ID NO: 3705721 - DNA, 17 bp, Homo sapiens
cagaaaacaacaaaaaa

SEQ ID NO: 3705722 - DNA, 10 bp, Homo sapiens
cagaaaacag

SEQ ID NO: 3705723 - DNA, 11 bp, Homo sapiens
cagaaaacaga

SEQ ID NO: 3705724 - DNA, 15 bp, Homo sapiens
cagaaaagcacctgc

SEQ ID NO: 3705725 - DNA, 20 bp, Homo sapiens
cagaaacaaaaacactaaaa

SEQ ID NO: 3705726 - DNA, 17 bp, Homo sapiens
cagaaacatcagttact

SEQ ID NO: 3705727 - DNA, 14 bp, Homo sapiens
cagaaaccagttat

SEQ ID NO: 3705728 - DNA, 19 bp, Homo sapiens
cagaaagatggatgtgctt

SEQ ID NO: 3705729 - DNA, 17 bp, Homo sapiens
cagaaagcagaggctgg

SEQ ID NO: 3705730 - DNA, 20 bp, Homo sapiens
cagaaagcagaggctggcct

SEQ ID NO: 3705731 - DNA, 18 bp, Homo sapiens
cagaaagcataaaattct

SEQ ID NO: 3705732 - DNA, 18 bp, Homo sapiens
cagaaagtaatttcttct

SEQ ID NO: 3705733 - DNA, 20 bp, Homo sapiens
cagaaataaagttggtgaca

SEQ ID NO: 3705734 - DNA, 14 bp, Homo sapiens
cagaaatcagagga

SEQ ID NO: 3705735 - DNA, 23 bp, Homo sapiens
cagaaatgtacaactttttacct

SEQ ID NO: 3705736 - DNA, 16 bp, Homo sapiens
cagaaattagccgggc

SEQ ID NO: 3705737 - DNA, 18 bp, Homo sapiens
cagaacacactccatcag

SEQ ID NO: 3705738 - DNA, 14 bp, Homo sapiens
cagaacacattctt

SEQ ID NO: 3705739 - DNA, 12 bp, Homo sapiens
cagaacagcaga

SEQ ID NO: 3705740 - DNA, 17 bp, Homo sapiens
cagaacagccgctcctg

SEQ ID NO: 3705741 - DNA, 16 bp, Homo sapiens
cagaacagtttgtaca

SEQ ID NO: 3705742 - DNA, 23 bp, Homo sapiens
cagaacccctacatgaaacagaa

SEQ ID NO: 3705743 - DNA, 22 bp, Homo sapiens
cagaaccctggtgaggaagctc

SEQ ID NO: 3705744 - DNA, 16 bp, Homo sapiens
cagaacctcttcccca

SEQ ID NO: 3705745 - DNA, 21 bp, Homo sapiens
cagaagaattgaacccaggag

SEQ ID NO: 3705746 - DNA, 19 bp, Homo sapiens
cagaagacactgcaaaggc

SEQ ID NO: 3705747 - DNA, 17 bp, Homo sapiens
cagaagcctattgtaaa

SEQ ID NO: 3705748 - DNA, 21 bp, Homo sapiens
cagaagctgagcaccagggga

SEQ ID NO: 3705749 - DNA, 14 bp, Homo sapiens
cagaaggagaagga

SEQ ID NO: 3705750 - DNA, 15 bp, Homo sapiens
cagaagggggccatg

SEQ ID NO: 3705751 - DNA, 19 bp, Homo sapiens
cagaagtttctcagctccc

SEQ ID NO: 3705752 - DNA, 20 bp, Homo sapiens
cagaagtttgagatcagcct

SEQ ID NO: 3705753 - DNA, 14 bp, Homo sapiens
cagaatcattgctt

SEQ ID NO: 3705754 - DNA, 15 bp, Homo sapiens
cagaatctgaatgta

SEQ ID NO: 3705755 - DNA, 16 bp, Homo sapiens
cagaatctgaatgtaa

SEQ ID NO: 3705756 - DNA, 21 bp, Homo sapiens
cagaatctttccttcctctca

SEQ ID NO: 3705757 - DNA, 15 bp, Homo sapiens
cagaattcccagctg

SEQ ID NO: 3705758 - DNA, 23 bp, Homo sapiens
cagaattctgctacctcactggg

SEQ ID NO: 3705759 - DNA, 17 bp, Homo sapiens
cagacaacacgttacta

SEQ ID NO: 3705760 - DNA, 16 bp, Homo sapiens
cagacaaggtagccct

SEQ ID NO: 3705761 - DNA, 23 bp, Homo sapiens
cagacaaggtagccctggccaga

SEQ ID NO: 3705762 - DNA, 21 bp, Homo sapiens
cagacaagtgactgtatctgt

SEQ ID NO: 3705763 - DNA, 18 bp, Homo sapiens
cagacacacgcacacaca

SEQ ID NO: 3705764 - DNA, 23 bp, Homo sapiens
cagacacaggcccggctccaggc

SEQ ID NO: 3705765 - DNA, 20 bp, Homo sapiens
cagacaccttgacagggcac

SEQ ID NO: 3705766 - DNA, 23 bp, Homo sapiens
cagacagaagtcactcaattgtt

SEQ ID NO: 3705767 - DNA, 21 bp, Homo sapiens
cagacagatggaaaagggaga

SEQ ID NO: 3705768 - DNA, 12 bp, Homo sapiens
cagacagctccc

SEQ ID NO: 3705769 - DNA, 19 bp, Homo sapiens
cagacagctccctctgcct

SEQ ID NO: 3705770 - DNA, 21 bp, Homo sapiens
cagacaggagaaatgcatcca

SEQ ID NO: 3705771 - DNA, 13 bp, Homo sapiens
cagacaggcaagc

SEQ ID NO: 3705772 - DNA, 18 bp, Homo sapiens
cagacaggcaagcacctc

SEQ ID NO: 3705773 - DNA, 20 bp, Homo sapiens
cagacaggcaagcacctcct

SEQ ID NO: 3705774 - DNA, 20 bp, Homo sapiens
cagacagggtctgaaggact

SEQ ID NO: 3705775 - DNA, 19 bp, Homo sapiens
cagacagtgttttctggga

SEQ ID NO: 3705776 - DNA, 18 bp, Homo sapiens
cagacatgtggtgggaca

SEQ ID NO: 3705777 - DNA, 16 bp, Homo sapiens
cagacattaaataatc

SEQ ID NO: 3705778 - DNA, 14 bp, Homo sapiens
cagaccccagcggc

SEQ ID NO: 3705779 - DNA, 21 bp, Homo sapiens
cagacccccaccccttcccca

SEQ ID NO: 3705780 - DNA, 23 bp, Homo sapiens
cagacccccaccccttccccact

SEQ ID NO: 3705781 - DNA, 16 bp, Homo sapiens
cagacccccactctca

SEQ ID NO: 3705782 - DNA, 13 bp, Homo sapiens
cagacccccagca

SEQ ID NO: 3705783 - DNA, 21 bp, Homo sapiens
cagacccctctggccaggatg

SEQ ID NO: 3705784 - DNA, 13 bp, Homo sapiens
cagacccctggct

SEQ ID NO: 3705785 - DNA, 16 bp, Homo sapiens
cagacccctggctttt

SEQ ID NO: 3705786 - DNA, 21 bp, Homo sapiens
cagacccctggcttttcactg

SEQ ID NO: 3705787 - DNA, 14 bp, Homo sapiens
cagacccggctgcg

SEQ ID NO: 3705788 - DNA, 17 bp, Homo sapiens
cagaccctaccccacca

SEQ ID NO: 3705789 - DNA, 23 bp, Homo sapiens
caccctgtccaaactgcctaagc

SEQ ID NO: 3705790 - DNA, 22 bp, Homo sapiens
cacccttcccctccttctccct

SEQ ID NO: 3705791 - DNA, 21 bp, Homo sapiens
cacccttggaggctgtcttct

SEQ ID NO: 3705792 - DNA, 18 bp, Homo sapiens
caccgccggccagctggg

SEQ ID NO: 3705793 - DNA, 20 bp, Homo sapiens
caccgctccccagcccaggg

SEQ ID NO: 3705794 - DNA, 12 bp, Homo sapiens
caccgctgccta

SEQ ID NO: 3705795 - DNA, 13 bp, Homo sapiens
caccgctgcctaa

SEQ ID NO: 3705796 - DNA, 15 bp, Homo sapiens
caccgggcactcaga

SEQ ID NO: 3705797 - DNA, 17 bp, Homo sapiens
caccggttgcttctggg

SEQ ID NO: 3705798 - DNA, 14 bp, Homo sapiens
caccgttcattcag

SEQ ID NO: 3705799 - DNA, 16 bp, Homo sapiens
cacctaagtctctgtg

SEQ ID NO: 3705800 - DNA, 21 bp, Homo sapiens
cacctaatgtttatgagccag

SEQ ID NO: 3705801 - DNA, 17 bp, Homo sapiens
cacctagaaacttgtta

SEQ ID NO: 3705802 - DNA, 18 bp, Homo sapiens
cacctaggccactcctcc

SEQ ID NO: 3705803 - DNA, 20 bp, Homo sapiens
cacctataataccagctact

SEQ ID NO: 3705804 - DNA, 16 bp, Homo sapiens
cacctatagtcccagc

SEQ ID NO: 3705805 - DNA, 12 bp, Homo sapiens
cacctcagagcc

SEQ ID NO: 3705806 - DNA, 13 bp, Homo sapiens
cacctcagcctcc

SEQ ID NO: 3705807 - DNA, 23 bp, Homo sapiens
cacctcaggccaggtgcagtggc

SEQ ID NO: 3705808 - DNA, 11 bp, Homo sapiens
cacctcagttc

SEQ ID NO: 3705809 - DNA, 18 bp, Homo sapiens
cacctcagttcccttggc

SEQ ID NO: 3705810 - DNA, 19 bp, Homo sapiens
cacctcagttcccttggcc

SEQ ID NO: 3705811 - DNA, 23 bp, Homo sapiens
cacctcagttcccttggcctcag

SEQ ID NO: 3705812 - DNA, 17 bp, Homo sapiens
cactcacaacagctgcc

SEQ ID NO: 3705813 - DNA, 23 bp, Homo sapiens
cactcacatgctggacaggtctg

SEQ ID NO: 3705814 - DNA, 21 bp, Homo sapiens
cactcagcacccccttctctg

SEQ ID NO: 3705815 - DNA, 19 bp, Homo sapiens
cactcaggccaacaagcca

SEQ ID NO: 3705816 - DNA, 14 bp, Homo sapiens
cactccaccaccca

SEQ ID NO: 3705817 - DNA, 19 bp, Homo sapiens
cactccaccacccaaaagt

SEQ ID NO: 3705818 - DNA, 15 bp, Homo sapiens
cactccagcctgagc

SEQ ID NO: 3705819 - DNA, 21 bp, Homo sapiens
cactccagcctgagcaacaga

SEQ ID NO: 3705820 - DNA, 15 bp, Homo sapiens
cactccagcctgggc

SEQ ID NO: 3705821 - DNA, 23 bp, Homo sapiens
cactccagcctgggcgacagagc

SEQ ID NO: 3705822 - DNA, 15 bp, Homo sapiens
cactccccaccttca

SEQ ID NO: 3705823 - DNA, 14 bp, Homo sapiens
cactcccctgcact

SEQ ID NO: 3705824 - DNA, 15 bp, Homo sapiens
cactcccttctcctt

SEQ ID NO: 3705825 - DNA, 17 bp, Homo sapiens
cactccggtgtgcctgc

SEQ ID NO: 3705826 - DNA, 22 bp, Homo sapiens
cactccggtgtgcctgcagccc

SEQ ID NO: 3705827 - DNA, 15 bp, Homo sapiens
cactcctccaaagga

SEQ ID NO: 3705828 - DNA, 19 bp, Homo sapiens
cactcctggggcctcttgg

SEQ ID NO: 3705829 - DNA, 24 bp, Homo sapiens
cactccttcctgccacctgctgct

SEQ ID NO: 3705830 - DNA, 13 bp, Homo sapiens
cactcgcttcccc

SEQ ID NO: 3705831 - DNA, 16 bp, Homo sapiens
cactcgcttcccccat

SEQ ID NO: 3705832 - DNA, 15 bp, Homo sapiens
cactctaccctccca

SEQ ID NO: 3705833 - DNA, 16 bp, Homo sapiens
cactctaccctcccac

SEQ ID NO: 3705834 - DNA, 17 bp, Homo sapiens
cactctaccctcccacc

SEQ ID NO: 3705835 - DNA, 18 bp, Homo sapiens
cactctaccctcccaccc

SEQ ID NO: 3705836 - DNA, 21 bp, Homo sapiens
cactctaccctcccaccccct

SEQ ID NO: 3705837 - DNA, 14 bp, Homo sapiens
cactctacttagca

SEQ ID NO: 3705838 - DNA, 21 bp, Homo sapiens
cactctccccacactaacctg

SEQ ID NO: 3705839 - DNA, 11 bp, Homo sapiens
cactctcctgg

SEQ ID NO: 3705840 - DNA, 20 bp, Homo sapiens
cactctcctgggcccctccc

SEQ ID NO: 3705841 - DNA, 19 bp, Homo sapiens
cactctgcctctgcctgca

SEQ ID NO: 3705842 - DNA, 19 bp, Homo sapiens
cactctgctttgactgagc

SEQ ID NO: 3705843 - DNA, 12 bp, Homo sapiens
cactctgttcct

SEQ ID NO: 3705844 - DNA, 16 bp, Homo sapiens
cactcttaagcttccg

SEQ ID NO: 3705845 - DNA, 18 bp, Homo sapiens
cactcttattgcccacgc

SEQ ID NO: 3705846 - DNA, 15 bp, Homo sapiens
cactctttgtaagag

SEQ ID NO: 3705847 - DNA, 21 bp, Homo sapiens
cactgaaacttcaagcaccag

SEQ ID NO: 3705848 - DNA, 22 bp, Homo sapiens
cactgaagttaacagagacaga

SEQ ID NO: 3705849 - DNA, 13 bp, Homo sapiens
cactgaatattta

SEQ ID NO: 3705850 - DNA, 13 bp, Homo sapiens
cactgacagcctc

SEQ ID NO: 3705851 - DNA, 14 bp, Homo sapiens
cactgacagcctcc

SEQ ID NO: 3705852 - DNA, 16 bp, Homo sapiens
cactgaccatccactc

SEQ ID NO: 3705853 - DNA, 17 bp, Homo sapiens
cactgaccatccactct

SEQ ID NO: 3705854 - DNA, 22 bp, Homo sapiens
cactgacccacagcctctgcct

SEQ ID NO: 3705855 - DNA, 14 bp, Homo sapiens
cactgagcaaagca

SEQ ID NO: 3705856 - DNA, 13 bp, Homo sapiens
cactgaggcaggg

SEQ ID NO: 3705857 - DNA, 16 bp, Homo sapiens
cactgaggcagggaag

SEQ ID NO: 3705858 - DNA, 17 bp, Homo sapiens
cactgaggcagggaagt

SEQ ID NO: 3705859 - DNA, 18 bp, Homo sapiens
cactgatgggcaaccccc

SEQ ID NO: 3705860 - DNA, 24 bp, Homo sapiens
cactgatgggcaacccccagcctg

SEQ ID NO: 3705861 - DNA, 13 bp, Homo sapiens
cactgcaagagcc

SEQ ID NO: 3705862 - DNA, 17 bp, Homo sapiens
cactgcaagagccttgg

SEQ ID NO: 3705863 - DNA, 19 bp, Homo sapiens
cactgcaagagccttggtg

SEQ ID NO: 3705864 - DNA, 19 bp, Homo sapiens
cactgcacagtgcatctca

SEQ ID NO: 3705865 - DNA, 21 bp, Homo sapiens
cactgcacagtgcatctcagc

SEQ ID NO: 3705866 - DNA, 18 bp, Homo sapiens
cactgcaccgggccacag

SEQ ID NO: 3705867 - DNA, 19 bp, Homo sapiens
cactgcactatagcctagg

SEQ ID NO: 3705868 - DNA, 15 bp, Homo sapiens
cactgcactccagcc

SEQ ID NO: 3705869 - DNA, 16 bp, Homo sapiens
cactgcactccagcct

SEQ ID NO: 3705870 - DNA, 18 bp, Homo sapiens
cactgcactctagccgga

SEQ ID NO: 3705871 - DNA, 23 bp, Homo sapiens
cactgcagcctcaacctcctggg

SEQ ID NO: 3705872 - DNA, 17 bp, Homo sapiens
cactgccatgccagctt

SEQ ID NO: 3705873 - DNA, 15 bp, Homo sapiens
cactgcccgagctgg

SEQ ID NO: 3705874 - DNA, 17 bp, Homo sapiens
cactgcccgagctggtg

SEQ ID NO: 3705875 - DNA, 18 bp, Homo sapiens
cactgcccgagctggtgc

SEQ ID NO: 3705876 - DNA, 16 bp, Homo sapiens
cactgcctcttcctcc

SEQ ID NO: 3705877 - DNA, 17 bp, Homo sapiens
cactgctaggtgggcca

SEQ ID NO: 3705878 - DNA, 22 bp, Homo sapiens
cactgctaggtgggccagcccc

SEQ ID NO: 3705879 - DNA, 11 bp, Homo sapiens
cactgctgtga

SEQ ID NO: 3705880 - DNA, 17 bp, Homo sapiens
cactgcttccatttaat

SEQ ID NO: 3705881 - DNA, 20 bp, Homo sapiens
cactgcttttggtctgtgtg

SEQ ID NO: 3705882 - DNA, 17 bp, Homo sapiens
cactggagcaccaggca

SEQ ID NO: 3705883 - DNA, 21 bp, Homo sapiens
cactggagcaccaggcacgaa

SEQ ID NO: 3705884 - DNA, 11 bp, Homo sapiens
cactggagccc

SEQ ID NO: 3705885 - DNA, 13 bp, Homo sapiens
cactggcagcccc

SEQ ID NO: 3705886 - DNA, 14 bp, Homo sapiens
cactggcagcccca

SEQ ID NO: 3705887 - DNA, 13 bp, Homo sapiens
cactggctgtggg

SEQ ID NO: 3705888 - DNA, 17 bp, Homo sapiens
cactggctgtgggctcc

SEQ ID NO: 3705889 - DNA, 21 bp, Homo sapiens
cactggctgtgggctcccttc

SEQ ID NO: 3705890 - DNA, 18 bp, Homo sapiens
cactgggggaggggacat

SEQ ID NO: 3705891 - DNA, 15 bp, Homo sapiens
cactggggtcctggg

SEQ ID NO: 3705892 - DNA, 19 bp, Homo sapiens
cactgggtggggtgaggac

SEQ ID NO: 3705893 - DNA, 20 bp, Homo sapiens
cactggtagaccaaaataaa

SEQ ID NO: 3705894 - DNA, 13 bp, Homo sapiens
cactggtggcccg

SEQ ID NO: 3705895 - DNA, 23 bp, Homo sapiens
cactggtggcccgacagcctggc

SEQ ID NO: 3705896 - DNA, 13 bp, Homo sapiens
cactgtaaaatga

SEQ ID NO: 3705897 - DNA, 14 bp, Homo sapiens
cactgtaaaatgaa

SEQ ID NO: 3705898 - DNA, 18 bp, Homo sapiens
cactgtagaatgatttca

SEQ ID NO: 3705899 - DNA, 18 bp, Homo sapiens
cactgtatgctggacggc

SEQ ID NO: 3705900 - DNA, 12 bp, Homo sapiens
cactgtggcctt

SEQ ID NO: 3705901 - DNA, 15 bp, Homo sapiens
cactgttagaacact

SEQ ID NO: 3705902 - DNA, 19 bp, Homo sapiens
cactgttagaacactattt

SEQ ID NO: 3705903 - DNA, 20 bp, Homo sapiens
cactgttagaacactatttt

SEQ ID NO: 3705904 - DNA, 13 bp, Homo sapiens
cactgttgaattt

SEQ ID NO: 3705905 - DNA, 17 bp, Homo sapiens
cactgttgaattttctc

SEQ ID NO: 3705906 - DNA, 17 bp, Homo sapiens
cactgttgcccaggctg

SEQ ID NO: 3705907 - DNA, 23 bp, Homo sapiens
cactgttgcccaggctggcgtgc

SEQ ID NO: 3705908 - DNA, 18 bp, Homo sapiens
cactgtttacaagaaaaa

SEQ ID NO: 3705909 - DNA, 13 bp, Homo sapiens
atgtattattctg

SEQ ID NO: 3705910 - DNA, 17 bp, Homo sapiens
atgtattattctgcagc

SEQ ID NO: 3705911 - DNA, 14 bp, Homo sapiens
atgtattcaaatac

SEQ ID NO: 3705912 - DNA, 14 bp, Homo sapiens
atgtattttatgta

SEQ ID NO: 3705913 - DNA, 20 bp, Homo sapiens
atgtattttatgtatgttta

SEQ ID NO: 3705914 - DNA, 20 bp, Homo sapiens
atgtcaaggtgctgttgtca

SEQ ID NO: 3705915 - DNA, 14 bp, Homo sapiens
atgtcacaacctct

SEQ ID NO: 3705916 - DNA, 22 bp, Homo sapiens
atgtcacaacctctctgatctt

SEQ ID NO: 3705917 - DNA, 13 bp, Homo sapiens
atgtcacaggcag

SEQ ID NO: 3705918 - DNA, 14 bp, Homo sapiens
atgtcacaggcagg

SEQ ID NO: 3705919 - DNA, 13 bp, Homo sapiens
atgtcaccacctt

SEQ ID NO: 3705920 - DNA, 20 bp, Homo sapiens
atgtcaccaccttcccagct

SEQ ID NO: 3705921 - DNA, 20 bp, Homo sapiens
atgtcaccggatcctgggtg

SEQ ID NO: 3705922 - DNA, 16 bp, Homo sapiens
atgtcagattcctttc

SEQ ID NO: 3705923 - DNA, 19 bp, Homo sapiens
atgtcaggaacagaaggat

SEQ ID NO: 3705924 - DNA, 17 bp, Homo sapiens
atgtcattaaaataaat

SEQ ID NO: 3705925 - DNA, 16 bp, Homo sapiens
atgtccacagatgcct

SEQ ID NO: 3705926 - DNA, 19 bp, Homo sapiens
atgtccatatctaaccagt

SEQ ID NO: 3705927 - DNA, 17 bp, Homo sapiens
atgtcccattttcagac

SEQ ID NO: 3705928 - DNA, 14 bp, Homo sapiens
atgtcccttgctgt

SEQ ID NO: 3705929 - DNA, 19 bp, Homo sapiens
atgtcctccagaagcctct

SEQ ID NO: 3705930 - DNA, 13 bp, Homo sapiens
atgtcgcctctgc

SEQ ID NO: 3705931 - DNA, 14 bp, Homo sapiens
atgtcgcctctgca

SEQ ID NO: 3705932 - DNA, 16 bp, Homo sapiens
atgtctctcagaattc

SEQ ID NO: 3705933 - DNA, 22 bp, Homo sapiens
atgtctggagaataattctttg

SEQ ID NO: 3705934 - DNA, 18 bp, Homo sapiens
atgtctgtagctcctcaa

SEQ ID NO: 3705935 - DNA, 11 bp, Homo sapiens
atgtcttattt

SEQ ID NO: 3705936 - DNA, 16 bp, Homo sapiens
atgtcttatttttaga

SEQ ID NO: 3705937 - DNA, 13 bp, Homo sapiens
atgtcttggtact

SEQ ID NO: 3705938 - DNA, 15 bp, Homo sapiens
atgtcttggtacttg

SEQ ID NO: 3705939 - DNA, 18 bp, Homo sapiens
atgtcttggtacttgctg

SEQ ID NO: 3705940 - DNA, 23 bp, Homo sapiens
atgtcttggtacttgctgctatt

SEQ ID NO: 3705941 - DNA, 22 bp, Homo sapiens
atgtctttaggcagcagctttt

SEQ ID NO: 3705942 - DNA, 20 bp, Homo sapiens
atgtctttgttggaaaagaa

SEQ ID NO: 3705943 - DNA, 20 bp, Homo sapiens
atgtgacaattttgtacaaa

SEQ ID NO: 3705944 - DNA, 15 bp, Homo sapiens
atgtgagagaaagtg

SEQ ID NO: 3705945 - DNA, 22 bp, Homo sapiens
atgtgagccaccgctgccagca

SEQ ID NO: 3705946 - DNA, 21 bp, Homo sapiens
atgtgatacccatagcttcca

SEQ ID NO: 3705947 - DNA, 16 bp, Homo sapiens
atgtgcaaaaattttt

SEQ ID NO: 3705948 - DNA, 23 bp, Homo sapiens
atgtgcacatgcacgtgtgtgca

SEQ ID NO: 3705949 - DNA, 14 bp, Homo sapiens
atgtgcccccagac

SEQ ID NO: 3705950 - DNA, 21 bp, Homo sapiens
atgtgccgtgttattgtatta

SEQ ID NO: 3705951 - DNA, 20 bp, Homo sapiens
atgtgcgtgtgtgcaagtgt

SEQ ID NO: 3705952 - DNA, 18 bp, Homo sapiens
atgtgctgtgaccattta

SEQ ID NO: 3705953 - DNA, 16 bp, Homo sapiens
atgtggaaagtgaatt

SEQ ID NO: 3705954 - DNA, 15 bp, Homo sapiens
atgtggaatataaag

SEQ ID NO: 3705955 - DNA, 23 bp, Homo sapiens
atgtggagcacaaaagcctctca

SEQ ID NO: 3705956 - DNA, 18 bp, Homo sapiens
atgtggcccctgaacaag

SEQ ID NO: 3705957 - DNA, 16 bp, Homo sapiens
atgtggccctggcctg

SEQ ID NO: 3705958 - DNA, 19 bp, Homo sapiens
atgtggccctggcctgctg

SEQ ID NO: 3705959 - DNA, 22 bp, Homo sapiens
atgtggctgtatcttgtttttc

SEQ ID NO: 3705960 - DNA, 18 bp, Homo sapiens
atgtgggaagaaacaaac

SEQ ID NO: 3705961 - DNA, 16 bp, Homo sapiens
atgtgggtcaaggaat

SEQ ID NO: 3705962 - DNA, 15 bp, Homo sapiens
atgtggtgggacagg

SEQ ID NO: 3705963 - DNA, 15 bp, Homo sapiens
atgtggttacacact

SEQ ID NO: 3705964 - DNA, 20 bp, Homo sapiens
atgtggttgcaaggccgctg

SEQ ID NO: 3705965 - DNA, 16 bp, Homo sapiens
atgtgtccatcccagc

SEQ ID NO: 3705966 - DNA, 13 bp, Homo sapiens
atgtgtcttcaat

SEQ ID NO: 3705967 - DNA, 17 bp, Homo sapiens
atgtgtgagtgtgtgca

SEQ ID NO: 3705968 - DNA, 19 bp, Homo sapiens
atgtgtgcgagtgtgtgca

SEQ ID NO: 3705969 - DNA, 15 bp, Homo sapiens
atgtgtggcagattt

SEQ ID NO: 3705970 - DNA, 10 bp, Homo sapiens
atgtgtgtat

SEQ ID NO: 3705971 - DNA, 12 bp, Homo sapiens
atgtgtgtatat

SEQ ID NO: 3705972 - DNA, 16 bp, Homo sapiens
atgtgtgtatatgtat

SEQ ID NO: 3705973 - DNA, 18 bp, Homo sapiens
atgtgtgtatatgtatgt

SEQ ID NO: 3705974 - DNA, 11 bp, Homo sapiens
atgtgtgtgca

SEQ ID NO: 3705975 - DNA, 16 bp, Homo sapiens
atgtgtgtgcaagtgt

SEQ ID NO: 3705976 - DNA, 12 bp, Homo sapiens
atgtgtgtgtat

SEQ ID NO: 3705977 - DNA, 19 bp, Homo sapiens
atgtgtgtgtatgctacta

SEQ ID NO: 3705978 - DNA, 18 bp, Homo sapiens
atgtgtttggttctgggg

SEQ ID NO: 3705979 - DNA, 20 bp, Homo sapiens
atgttacatctgttttaaat

SEQ ID NO: 3705980 - DNA, 14 bp, Homo sapiens
atgttacattatta

SEQ ID NO: 3705981 - DNA, 14 bp, Homo sapiens
atgttactgaccag

SEQ ID NO: 3705982 - DNA, 20 bp, Homo sapiens
atgttactgatcatgcattg

SEQ ID NO: 3705983 - DNA, 22 bp, Homo sapiens
atgttactgatcatgcattgtt

SEQ ID NO: 3705984 - DNA, 13 bp, Homo sapiens
atgttatgataaa

SEQ ID NO: 3705985 - DNA, 17 bp, Homo sapiens
atgcttgtaacaagaaa

SEQ ID NO: 3705986 - DNA, 13 bp, Homo sapiens
atgcttttcaaac

SEQ ID NO: 3705987 - DNA, 20 bp, Homo sapiens
atggaaaaggaagactagag

SEQ ID NO: 3705988 - DNA, 22 bp, Homo sapiens
atggaaaagtcttcaagggctg

SEQ ID NO: 3705989 - DNA, 15 bp, Homo sapiens
atggaaacaaagtgg

SEQ ID NO: 3705990 - DNA, 20 bp, Homo sapiens
atggaaactgttgccagaga

SEQ ID NO: 3705991 - DNA, 22 bp, Homo sapiens
atggaaactgttgccagagatg

SEQ ID NO: 3705992 - DNA, 15 bp, Homo sapiens
atggaaatattatgc

SEQ ID NO: 3705993 - DNA, 22 bp, Homo sapiens
atggaaatattatgcaaattcc

SEQ ID NO: 3705994 - DNA, 21 bp, Homo sapiens
atggaactctagggatagtca

SEQ ID NO: 3705995 - DNA, 16 bp, Homo sapiens
atggaagggtttgtgg

SEQ ID NO: 3705996 - DNA, 22 bp, Homo sapiens
atggaaggtttgtatattgtca

SEQ ID NO: 3705997 - DNA, 15 bp, Homo sapiens
atggaataacatgta

SEQ ID NO: 3705998 - DNA, 16 bp, Homo sapiens
atggaataactctgtg

SEQ ID NO: 3705999 - DNA, 20 bp, Homo sapiens
atggacagaagaaggcagca

SEQ ID NO: 3706000 - DNA, 12 bp, Homo sapiens
atggacctaaca

SEQ ID NO: 3706001 - DNA, 16 bp, Homo sapiens
atggactctacactgt

SEQ ID NO: 3706002 - DNA, 14 bp, Homo sapiens
atggagaaaccctg

SEQ ID NO: 3706003 - DNA, 14 bp, Homo sapiens
atggagagagggga

SEQ ID NO: 3706004 - DNA, 17 bp, Homo sapiens
atggagagaggggaata

SEQ ID NO: 3706005 - DNA, 17 bp, Homo sapiens
atggagcgcacctgccc

SEQ ID NO: 3706006 - DNA, 11 bp, Homo sapiens
atggaggagaa

SEQ ID NO: 3706007 - DNA, 14 bp, Homo sapiens
atggaggaggaggc

SEQ ID NO: 3706008 - DNA, 16 bp, Homo sapiens
atggaggatggagaga

SEQ ID NO: 3706009 - DNA, 18 bp, Homo sapiens
atggaggatggagagagg

SEQ ID NO: 3706010 - DNA, 15 bp, Homo sapiens
atggaggcctgtcct

SEQ ID NO: 3706011 - DNA, 18 bp, Homo sapiens
atggaggggtggtcctga

SEQ ID NO: 3706012 - DNA, 23 bp, Homo sapiens
atggatattagtcatagaagaac

SEQ ID NO: 3706013 - DNA, 17 bp, Homo sapiens
atggatccccagtgaaa

SEQ ID NO: 3706014 - DNA, 14 bp, Homo sapiens
atggattctcagat

SEQ ID NO: 3706015 - DNA, 18 bp, Homo sapiens
atggattctcagatattt

SEQ ID NO: 3706016 - DNA, 19 bp, Homo sapiens
atggattctcagatattta

SEQ ID NO: 3706017 - DNA, 21 bp, Homo sapiens
atggatttgcctgtgccaccc

SEQ ID NO: 3706018 - DNA, 15 bp, Homo sapiens
atggcaattttgtaa

SEQ ID NO: 3706019 - DNA, 23 bp, Homo sapiens
atggcacagcccaaagaaggaaa

SEQ ID NO: 3706020 - DNA, 22 bp, Homo sapiens
atggccaggtggccactccaga

SEQ ID NO: 3706021 - DNA, 14 bp, Homo sapiens
atggcctcagctgc

SEQ ID NO: 3706022 - DNA, 21 bp, Homo sapiens
atggcctcagctgcctcactt

SEQ ID NO: 3706023 - DNA, 20 bp, Homo sapiens
atggcgtagagggtgctgcc

SEQ ID NO: 3706024 - DNA, 21 bp, Homo sapiens
atggcgtagagggtgctgccc

SEQ ID NO: 3706025 - DNA, 16 bp, Homo sapiens
atggctcactgcagcc

SEQ ID NO: 3706026 - DNA, 20 bp, Homo sapiens
atggctcactgcagcctcga

SEQ ID NO: 3706027 - DNA, 13 bp, Homo sapiens
atggctccagtct

SEQ ID NO: 3706028 - DNA, 23 bp, Homo sapiens
atggctcccctttttcttcctca

SEQ ID NO: 3706029 - DNA, 18 bp, Homo sapiens
atggctgtgcctctgcct

SEQ ID NO: 3706030 - DNA, 19 bp, Homo sapiens
atggctgtgcctctgcctg

SEQ ID NO: 3706031 - DNA, 16 bp, Homo sapiens
atgggaaactttccct

SEQ ID NO: 3706032 - DNA, 14 bp, Homo sapiens
atgggaagacatga

SEQ ID NO: 3706033 - DNA, 14 bp, Homo sapiens
atgggaaggaggga

SEQ ID NO: 3706034 - DNA, 16 bp, Homo sapiens
atgggactgggagggc

SEQ ID NO: 3706035 - DNA, 22 bp, Homo sapiens
atgggagccccagggtcttccc

SEQ ID NO: 3706036 - DNA, 18 bp, Homo sapiens
atgggcaacccccagcct

SEQ ID NO: 3706037 - DNA, 19 bp, Homo sapiens
atgggcaacccccagcctg

SEQ ID NO: 3706038 - DNA, 18 bp, Homo sapiens
atgggcttgttttcttgc

SEQ ID NO: 3706039 - DNA, 20 bp, Homo sapiens
atggggagatcggggccaga

SEQ ID NO: 3706040 - DNA, 12 bp, Homo sapiens
atggggatgcag

SEQ ID NO: 3706041 - DNA, 19 bp, Homo sapiens
atggggctgaacggggaga

SEQ ID NO: 3706042 - DNA, 21 bp, Homo sapiens
atgggggagtctgaagcagat

SEQ ID NO: 3706043 - DNA, 16 bp, Homo sapiens
atgggggatgcttcat

SEQ ID NO: 3706044 - DNA, 17 bp, Homo sapiens
atgggggcactgaggac

SEQ ID NO: 3706045 - DNA, 16 bp, Homo sapiens
atggggggccaacacc

SEQ ID NO: 3706046 - DNA, 15 bp, Homo sapiens
atgggtagcttctga

SEQ ID NO: 3706047 - DNA, 22 bp, Homo sapiens
atgggtgaagggagagccagct

SEQ ID NO: 3706048 - DNA, 19 bp, Homo sapiens
atgggtgtgtgtttgtgtg

SEQ ID NO: 3706049 - DNA, 15 bp, Homo sapiens
atgggttatgtgtat

SEQ ID NO: 3706050 - DNA, 14 bp, Homo sapiens
atggtaaaattgca

SEQ ID NO: 3706051 - DNA, 18 bp, Homo sapiens
atggtaaagatattattc

SEQ ID NO: 3706052 - DNA, 21 bp, Homo sapiens
atggtagtctaaccaaatgca

SEQ ID NO: 3706053 - DNA, 22 bp, Homo sapiens
atggtagtctaaccaaatgcat

SEQ ID NO: 3706054 - DNA, 13 bp, Homo sapiens
atggtccccatgg

SEQ ID NO: 3706055 - DNA, 12 bp, Homo sapiens
atggtcctgggg

SEQ ID NO: 3706056 - DNA, 14 bp, Homo sapiens
atggtcctggggct

SEQ ID NO: 3706057 - DNA, 19 bp, Homo sapiens
atggtcctggggctctgtg

SEQ ID NO: 3706058 - DNA, 15 bp, Homo sapiens
atggtcgcccaggag

SEQ ID NO: 3706059 - DNA, 21 bp, Homo sapiens
atggtgaaaccccatctctac

SEQ ID NO: 3706060 - DNA, 20 bp, Homo sapiens
atggtgaggcttaacaatgt

SEQ ID NO: 3706061 - DNA, 12 bp, Homo sapiens
atggtgcctctg

SEQ ID NO: 3706062 - DNA, 16 bp, Homo sapiens
atggtgctcatttcat

SEQ ID NO: 3706063 - DNA, 13 bp, Homo sapiens
atggtggctgggt

SEQ ID NO: 3706064 - DNA, 16 bp, Homo sapiens
atggtgttttcatgta

SEQ ID NO: 3706065 - DNA, 13 bp, Homo sapiens
atggttaactaat

SEQ ID NO: 3706066 - DNA, 22 bp, Homo sapiens
atgagctttatgtaataatgtg

SEQ ID NO: 3706067 - DNA, 15 bp, Homo sapiens
atgaggggcccgagc

SEQ ID NO: 3706068 - DNA, 19 bp, Homo sapiens
atgaggtcccaggcagaga

SEQ ID NO: 3706069 - DNA, 15 bp, Homo sapiens
atgaggtctgaaatg

SEQ ID NO: 3706070 - DNA, 17 bp, Homo sapiens
atgaggtctgaaatgga

SEQ ID NO: 3706071 - DNA, 16 bp, Homo sapiens
atgaggtgctgggagg

SEQ ID NO: 3706072 - DNA, 22 bp, Homo sapiens
atgagtttgccctggtttcact

SEQ ID NO: 3706073 - DNA, 13 bp, Homo sapiens
atgagtttttgat

SEQ ID NO: 3706074 - DNA, 20 bp, Homo sapiens
atgagtttttgatagcttta

SEQ ID NO: 3706075 - DNA, 17 bp, Homo sapiens
atgataaaaaattttgt

SEQ ID NO: 3706076 - DNA, 22 bp, Homo sapiens
atgataaaaaattttgtaattt

SEQ ID NO: 3706077 - DNA, 22 bp, Homo sapiens
atgataccctgaatttggcctg

SEQ ID NO: 3706078 - DNA, 21 bp, Homo sapiens
atgatatgtaaacataattct

SEQ ID NO: 3706079 - DNA, 18 bp, Homo sapiens
atgatattaaaaattggc

SEQ ID NO: 3706080 - DNA, 16 bp, Homo sapiens
atgatattccatagta

SEQ ID NO: 3706081 - DNA, 21 bp, Homo sapiens
atgatatttttttaagtcttt

SEQ ID NO: 3706082 - DNA, 19 bp, Homo sapiens
atgatcagctgtttgtcat

SEQ ID NO: 3706083 - DNA, 15 bp, Homo sapiens
atgatcctaatgaat

SEQ ID NO: 3706084 - DNA, 14 bp, Homo sapiens
atgatctccctgcc

SEQ ID NO: 3706085 - DNA, 18 bp, Homo sapiens
atgatctttgcagacagg

SEQ ID NO: 3706086 - DNA, 23 bp, Homo sapiens
atgatgaaatgaggtcagagcct

SEQ ID NO: 3706087 - DNA, 22 bp, Homo sapiens
atgatgacgacgacaacgatga

SEQ ID NO: 3706088 - DNA, 16 bp, Homo sapiens
atgatgcacatttcat

SEQ ID NO: 3706089 - DNA, 18 bp, Homo sapiens
atgatgttgaatatttgt

SEQ ID NO: 3706090 - DNA, 20 bp, Homo sapiens
atgattaaccacttcagctg

SEQ ID NO: 3706091 - DNA, 23 bp, Homo sapiens
atgattctaatttttaagcaaaa

SEQ ID NO: 3706092 - DNA, 20 bp, Homo sapiens
atgattctttgttacaggca

SEQ ID NO: 3706093 - DNA, 22 bp, Homo sapiens
atgattgtgcacatacttgaga

SEQ ID NO: 3706094 - DNA, 21 bp, Homo sapiens
atgatttcatgctatctctgt

SEQ ID NO: 3706095 - DNA, 23 bp, Homo sapiens
atgcaaaaggttcactaaagcag

SEQ ID NO: 3706096 - DNA, 20 bp, Homo sapiens
atgcaaacataacaaaatca

SEQ ID NO: 3706097 - DNA, 16 bp, Homo sapiens
atgcaaggaaggaaag

SEQ ID NO: 3706098 - DNA, 18 bp, Homo sapiens
atgcaaggaaggaaagaa

SEQ ID NO: 3706099 - DNA, 14 bp, Homo sapiens
atgcaaggaccagg

SEQ ID NO: 3706100 - DNA, 12 bp, Homo sapiens
atgcaatgagat

SEQ ID NO: 3706101 - DNA, 18 bp, Homo sapiens
atgcaatgtgctactgat

SEQ ID NO: 3706102 - DNA, 20 bp, Homo sapiens
atgcaattttgcatttgaat

SEQ ID NO: 3706103 - DNA, 15 bp, Homo sapiens
atgcacaaagtgtat

SEQ ID NO: 3706104 - DNA, 15 bp, Homo sapiens
atgcacaatgtcttg

SEQ ID NO: 3706105 - DNA, 22 bp, Homo sapiens
atgcaccagcccttagcaggga

SEQ ID NO: 3706106 - DNA, 15 bp, Homo sapiens
atgcagagtcagcag

SEQ ID NO: 3706107 - DNA, 20 bp, Homo sapiens
atgcagcgaaccaatatttg

SEQ ID NO: 3706108 - DNA, 20 bp, Homo sapiens
atgcaggggcaaacacctgc

SEQ ID NO: 3706109 - DNA, 22 bp, Homo sapiens
atgcaggggcaaacacctgctg

SEQ ID NO: 3706110 - DNA, 13 bp, Homo sapiens
atgcagtgcttcc

SEQ ID NO: 3706111 - DNA, 14 bp, Homo sapiens
atgcatacatacac

SEQ ID NO: 3706112 - DNA, 17 bp, Homo sapiens
atgcatacatacacata

SEQ ID NO: 3706113 - DNA, 23 bp, Homo sapiens
atgcatagtcccagctacccagg

SEQ ID NO: 3706114 - DNA, 18 bp, Homo sapiens
atgcatatcctgagccat

SEQ ID NO: 3706115 - DNA, 23 bp, Homo sapiens
atgcatccattcctcagggacag

SEQ ID NO: 3706116 - DNA, 18 bp, Homo sapiens
atgcatcttactgaaggt

SEQ ID NO: 3706117 - DNA, 23 bp, Homo sapiens
atgcatttgaggtcaagtaagaa

SEQ ID NO: 3706118 - DNA, 19 bp, Homo sapiens
atgcattttgcagcagtga

SEQ ID NO: 3706119 - DNA, 15 bp, Homo sapiens
atgccacacagagtg

SEQ ID NO: 3706120 - DNA, 23 bp, Homo sapiens
atgccacgcggtacaaaggaaaa

SEQ ID NO: 3706121 - DNA, 19 bp, Homo sapiens
atgccagctcagtcccatc

SEQ ID NO: 3706122 - DNA, 19 bp, Homo sapiens
atgccatggacagaagaag

SEQ ID NO: 3706123 - DNA, 23 bp, Homo sapiens
atgccatttgcacttacacaaga

SEQ ID NO: 3706124 - DNA, 15 bp, Homo sapiens
atgcccacctgccca

SEQ ID NO: 3706125 - DNA, 20 bp, Homo sapiens
atgcccacctgcccatcaca

SEQ ID NO: 3706126 - DNA, 22 bp, Homo sapiens
atgcccagacatttttttccct

SEQ ID NO: 3706127 - DNA, 21 bp, Homo sapiens
atgcccagggccactctgcct

SEQ ID NO: 3706128 - DNA, 22 bp, Homo sapiens
atgccctgctagatgagaattc

SEQ ID NO: 3706129 - DNA, 14 bp, Homo sapiens
atgccctggatcca

SEQ ID NO: 3706130 - DNA, 22 bp, Homo sapiens
atgccctttcttgaattgcatt

SEQ ID NO: 3706131 - DNA, 15 bp, Homo sapiens
atgcctaagaagatg

SEQ ID NO: 3706132 - DNA, 16 bp, Homo sapiens
atgcctaagaagatga

SEQ ID NO: 3706133 - DNA, 20 bp, Homo sapiens
atgcctaagaagatgacttc

SEQ ID NO: 3706134 - DNA, 18 bp, Homo sapiens
atgcctccctgaccctgc

SEQ ID NO: 3706135 - DNA, 11 bp, Homo sapiens
atgcctggtgg

SEQ ID NO: 3706136 - DNA, 14 bp, Homo sapiens
atgcctggtggcag

SEQ ID NO: 3706137 - DNA, 18 bp, Homo sapiens
atgcctgtccagcctggg

SEQ ID NO: 3706138 - DNA, 12 bp, Homo sapiens
atgcctgtgcca

SEQ ID NO: 3706139 - DNA, 16 bp, Homo sapiens
atgccttactttgtat

SEQ ID NO: 3706140 - DNA, 15 bp, Homo sapiens
atgccttctccagac

SEQ ID NO: 3706141 - DNA, 12 bp, Homo sapiens
atgcctttgtaa

SEQ ID NO: 3706142 - DNA, 13 bp, Homo sapiens
atgcctttgtaag

SEQ ID NO: 3706143 - DNA, 15 bp, Homo sapiens
atgcctttgtaagtt

SEQ ID NO: 3706144 - DNA, 14 bp, Homo sapiens
atgccttttatttc

SEQ ID NO: 3706145 - DNA, 18 bp, Homo sapiens
atgcgggctgggcagctg

SEQ ID NO: 3706146 - DNA, 19 bp, Homo sapiens
atgcgggctgggcagctgt

SEQ ID NO: 3706147 - DNA, 21 bp, Homo sapiens
atgctaaatgtaagaatcatt

SEQ ID NO: 3706148 - DNA, 19 bp, Homo sapiens
atgctaacagttcacttgc

SEQ ID NO: 3706149 - DNA, 13 bp, Homo sapiens
atgctatctctgt

SEQ ID NO: 3706150 - DNA, 16 bp, Homo sapiens
attgatcatttttata

SEQ ID NO: 3706151 - DNA, 17 bp, Homo sapiens
attgatgtgcaaaaatt

SEQ ID NO: 3706152 - DNA, 20 bp, Homo sapiens
attgatgtgcaaaaattttt

SEQ ID NO: 3706153 - DNA, 13 bp, Homo sapiens
attgattgctgtg

SEQ ID NO: 3706154 - DNA, 23 bp, Homo sapiens
attgattgctgtgtccaactcca

SEQ ID NO: 3706155 - DNA, 15 bp, Homo sapiens
attgcaacaggctgg

SEQ ID NO: 3706156 - DNA, 18 bp, Homo sapiens
attgcacaaaatataaag

SEQ ID NO: 3706157 - DNA, 12 bp, Homo sapiens
attgcaccactg

SEQ ID NO: 3706158 - DNA, 17 bp, Homo sapiens
attgcactccagcctgg

SEQ ID NO: 3706159 - DNA, 15 bp, Homo sapiens
attgcatgctgcttt

SEQ ID NO: 3706160 - DNA, 16 bp, Homo sapiens
attgcatgctgcttta

SEQ ID NO: 3706161 - DNA, 17 bp, Homo sapiens
attgcatgctgctttaa

SEQ ID NO: 3706162 - DNA, 23 bp, Homo sapiens
attgcattaaatataatatgcac

SEQ ID NO: 3706163 - DNA, 19 bp, Homo sapiens
attgcattttttaaaacaa

SEQ ID NO: 3706164 - DNA, 20 bp, Homo sapiens
attgcattttttaaaacaag

SEQ ID NO: 3706165 - DNA, 21 bp, Homo sapiens
attgccaccaggagaaccact

SEQ ID NO: 3706166 - DNA, 18 bp, Homo sapiens
attgccttaactggagcc

SEQ ID NO: 3706167 - DNA, 18 bp, Homo sapiens
attgcggacagccacggc

SEQ ID NO: 3706168 - DNA, 20 bp, Homo sapiens
attgcgtcttagcagtgatt

SEQ ID NO: 3706169 - DNA, 21 bp, Homo sapiens
attgcgtcttagcagtgattt

SEQ ID NO: 3706170 - DNA, 18 bp, Homo sapiens
attgctgctccttagctg

SEQ ID NO: 3706171 - DNA, 20 bp, Homo sapiens
attgctggcaaagacagaag

SEQ ID NO: 3706172 - DNA, 22 bp, Homo sapiens
attgctggcaaagacagaagcc

SEQ ID NO: 3706173 - DNA, 17 bp, Homo sapiens
attgctggtcttgtaag

SEQ ID NO: 3706174 - DNA, 20 bp, Homo sapiens
attgctgtgtccaactccag

SEQ ID NO: 3706175 - DNA, 13 bp, Homo sapiens
attgcttctgtag

SEQ ID NO: 3706176 - DNA, 23 bp, Homo sapiens
attgcttgaaagaaaatatgcat

SEQ ID NO: 3706177 - DNA, 14 bp, Homo sapiens
attgcttgagctca

SEQ ID NO: 3706178 - DNA, 13 bp, Homo sapiens
attgctttactgg

SEQ ID NO: 3706179 - DNA, 12 bp, Homo sapiens
attggaattaac

SEQ ID NO: 3706180 - DNA, 14 bp, Homo sapiens
attggaattaacct

SEQ ID NO: 3706181 - DNA, 15 bp, Homo sapiens
attggaattaacctg

SEQ ID NO: 3706182 - DNA, 22 bp, Homo sapiens
attggaggaccaaaaaaataag

SEQ ID NO: 3706183 - DNA, 22 bp, Homo sapiens
attggagggtgggagagcccag

SEQ ID NO: 3706184 - DNA, 17 bp, Homo sapiens
attggctagttgaatct

SEQ ID NO: 3706185 - DNA, 19 bp, Homo sapiens
attggctatttaaagacaa

SEQ ID NO: 3706186 - DNA, 18 bp, Homo sapiens
attgggagcttgggaatg

SEQ ID NO: 3706187 - DNA, 21 bp, Homo sapiens
attgggagcttgggaatggat

SEQ ID NO: 3706188 - DNA, 14 bp, Homo sapiens
attggggttatttt

SEQ ID NO: 3706189 - DNA, 15 bp, Homo sapiens
attgggtatcaccac

SEQ ID NO: 3706190 - DNA, 15 bp, Homo sapiens
attggtccagcttgc

SEQ ID NO: 3706191 - DNA, 21 bp, Homo sapiens
attggtggcagattttacaaa

SEQ ID NO: 3706192 - DNA, 17 bp, Homo sapiens
attggttccctttgctc

SEQ ID NO: 3706193 - DNA, 21 bp, Homo sapiens
attggttttaattgaaggaaa

SEQ ID NO: 3706194 - DNA, 17 bp, Homo sapiens
attgtaaactgtactag

SEQ ID NO: 3706195 - DNA, 16 bp, Homo sapiens
attgtaaatacaagtt

SEQ ID NO: 3706196 - DNA, 23 bp, Homo sapiens
attgtaaatacaagttctattta

SEQ ID NO: 3706197 - DNA, 14 bp, Homo sapiens
attgtaagataaaa

SEQ ID NO: 3706198 - DNA, 14 bp, Homo sapiens
attgtataaaaata

SEQ ID NO: 3706199 - DNA, 15 bp, Homo sapiens
attgtataaaaatag

SEQ ID NO: 3706200 - DNA, 21 bp, Homo sapiens
attgtatctagtgcagctgat

SEQ ID NO: 3706201 - DNA, 23 bp, Homo sapiens
attgtattaggtgtcatttccat

SEQ ID NO: 3706202 - DNA, 15 bp, Homo sapiens
attgtattttagtat

SEQ ID NO: 3706203 - DNA, 19 bp, Homo sapiens
attgtcagctactaatgat

SEQ ID NO: 3706204 - DNA, 14 bp, Homo sapiens
attgtctcagagca

SEQ ID NO: 3706205 - DNA, 18 bp, Homo sapiens
attgtctttggtgctttt

SEQ ID NO: 3706206 - DNA, 14 bp, Homo sapiens
attgtgaagtacat

SEQ ID NO: 3706207 - DNA, 14 bp, Homo sapiens
attgtgaattgata

SEQ ID NO: 3706208 - DNA, 19 bp, Homo sapiens
attgtgcacatacttgaga

SEQ ID NO: 3706209 - DNA, 23 bp, Homo sapiens
attgtggttatttttatacagta

SEQ ID NO: 3706210 - DNA, 20 bp, Homo sapiens
attgtgtggtcagtggctct

SEQ ID NO: 3706211 - DNA, 18 bp, Homo sapiens
attgtgtgttatttaaat

SEQ ID NO: 3706212 - DNA, 16 bp, Homo sapiens
attaaacaatttattt

SEQ ID NO: 3706213 - DNA, 20 bp, Homo sapiens
attaaacaatttattttatt

SEQ ID NO: 3706214 - DNA, 18 bp, Homo sapiens
attaaagaaaataaaatt

SEQ ID NO: 3706215 - DNA, 17 bp, Homo sapiens
attaaatatatgtatgt

SEQ ID NO: 3706216 - DNA, 22 bp, Homo sapiens
attaaatatgttagcaaagagt

SEQ ID NO: 3706217 - DNA, 14 bp, Homo sapiens
attaaatttttcct

SEQ ID NO: 3706218 - DNA, 20 bp, Homo sapiens
attaaattttttaaaaagca

SEQ ID NO: 3706219 - DNA, 20 bp, Homo sapiens
attaacaaattatgttacat

SEQ ID NO: 3706220 - DNA, 14 bp, Homo sapiens
attaacagttttcc

SEQ ID NO: 3706221 - DNA, 18 bp, Homo sapiens
attaacagttttccatga

SEQ ID NO: 3706222 - DNA, 21 bp, Homo sapiens
attaacagttttccatgaaaa

SEQ ID NO: 3706223 - DNA, 23 bp, Homo sapiens
attaacagttttccatgaaaacg

SEQ ID NO: 3706224 - DNA, 17 bp, Homo sapiens
attaacatataatatat

SEQ ID NO: 3706225 - DNA, 18 bp, Homo sapiens
attaacatataatatatg

SEQ ID NO: 3706226 - DNA, 19 bp, Homo sapiens
attaacattgggaaatctt

SEQ ID NO: 3706227 - DNA, 22 bp, Homo sapiens
attaacattgggaaatcttata

SEQ ID NO: 3706228 - DNA, 15 bp, Homo sapiens
attaaccatagatgt

SEQ ID NO: 3706229 - DNA, 12 bp, Homo sapiens
attaagaatgtt

SEQ ID NO: 3706230 - DNA, 23 bp, Homo sapiens
attaagatggattctcagatatt

SEQ ID NO: 3706231 - DNA, 15 bp, Homo sapiens
attaagcagtaaaaa

SEQ ID NO: 3706232 - DNA, 18 bp, Homo sapiens
attaagcatcacaaatga

SEQ ID NO: 3706233 - DNA, 20 bp, Homo sapiens
attaaggcaactgaacaaaa

SEQ ID NO: 3706234 - DNA, 21 bp, Homo sapiens
attaaggcaactgaacaaaaa

SEQ ID NO: 3706235 - DNA, 15 bp, Homo sapiens
attaaggtctctctt

SEQ ID NO: 3706236 - DNA, 15 bp, Homo sapiens
attaagtaaactaat

SEQ ID NO: 3706237 - DNA, 18 bp, Homo sapiens
attaagtaaactaatgag

SEQ ID NO: 3706238 - DNA, 16 bp, Homo sapiens
attaagtactatgtat

SEQ ID NO: 3706239 - DNA, 16 bp, Homo sapiens
attaatgacagagcca

SEQ ID NO: 3706240 - DNA, 23 bp, Homo sapiens
attaatgctaagggcaggcccaa

SEQ ID NO: 3706241 - DNA, 14 bp, Homo sapiens
attaatttcttcac

SEQ ID NO: 3706242 - DNA, 15 bp, Homo sapiens
attacagagaggaga

SEQ ID NO: 3706243 - DNA, 13 bp, Homo sapiens
attacagcttcac

SEQ ID NO: 3706244 - DNA, 22 bp, Homo sapiens
attacataaataaattaaataa

SEQ ID NO: 3706245 - DNA, 14 bp, Homo sapiens
attacatccttgtg

SEQ ID NO: 3706246 - DNA, 15 bp, Homo sapiens
attacatccttgtgg

SEQ ID NO: 3706247 - DNA, 18 bp, Homo sapiens
attacatctttcacattg

SEQ ID NO: 3706248 - DNA, 17 bp, Homo sapiens
attacattccttgataa

SEQ ID NO: 3706249 - DNA, 21 bp, Homo sapiens
attacattccttgataatgtt

SEQ ID NO: 3706250 - DNA, 19 bp, Homo sapiens
attaccactgaagatagaa

SEQ ID NO: 3706251 - DNA, 23 bp, Homo sapiens
attaccagtaaagtgtaacatat

SEQ ID NO: 3706252 - DNA, 16 bp, Homo sapiens
attacggctcctctct

SEQ ID NO: 3706253 - DNA, 20 bp, Homo sapiens
attactacaaaatttgaaat

SEQ ID NO: 3706254 - DNA, 13 bp, Homo sapiens
attactcttgtaa

SEQ ID NO: 3706255 - DNA, 17 bp, Homo sapiens
attactcttgtaagatt

SEQ ID NO: 3706256 - DNA, 18 bp, Homo sapiens
attactcttgtaagattt

SEQ ID NO: 3706257 - DNA, 16 bp, Homo sapiens
attactgtcaataaac

SEQ ID NO: 3706258 - DNA, 17 bp, Homo sapiens
attactgtcaataaaca

SEQ ID NO: 3706259 - DNA, 22 bp, Homo sapiens
attagaaatagacagtatattt

SEQ ID NO: 3706260 - DNA, 15 bp, Homo sapiens
attagaaattagctg

SEQ ID NO: 3706261 - DNA, 23 bp, Homo sapiens
attagaaattagctgtgtgaaat

SEQ ID NO: 3706262 - DNA, 18 bp, Homo sapiens
attagaagtgttaactta

SEQ ID NO: 3706263 - DNA, 20 bp, Homo sapiens
attagaagtgttaacttagc

SEQ ID NO: 3706264 - DNA, 14 bp, Homo sapiens
attagattatattg

SEQ ID NO: 3706265 - DNA, 22 bp, Homo sapiens
attagcaattgactgtcactgt

SEQ ID NO: 3706266 - DNA, 16 bp, Homo sapiens
attagtaaatgcttat

SEQ ID NO: 3706267 - DNA, 23 bp, Homo sapiens
attagtatttatttaatgttatg

SEQ ID NO: 3706268 - DNA, 13 bp, Homo sapiens
attagtcatagaa

SEQ ID NO: 3706269 - DNA, 15 bp, Homo sapiens
attataacttaaaaa

SEQ ID NO: 3706270 - DNA, 20 bp, Homo sapiens
attataacttaaaatatttt

SEQ ID NO: 3706271 - DNA, 10 bp, Homo sapiens
attataagga

SEQ ID NO: 3706272 - DNA, 12 bp, Homo sapiens
attataaggact

SEQ ID NO: 3706273 - DNA, 14 bp, Homo sapiens
attataaggactgc

SEQ ID NO: 3706274 - DNA, 15 bp, Homo sapiens
attataaggactgca

SEQ ID NO: 3706275 - DNA, 16 bp, Homo sapiens
attataaggactgcat

SEQ ID NO: 3706276 - DNA, 22 bp, Homo sapiens
attataatatactatatttatg

SEQ ID NO: 3706277 - DNA, 13 bp, Homo sapiens
attataatgaatt

SEQ ID NO: 3706278 - DNA, 15 bp, Homo sapiens
attataatttaatgc

SEQ ID NO: 3706279 - DNA, 17 bp, Homo sapiens
attataatttaatgcat

SEQ ID NO: 3706280 - DNA, 15 bp, Homo sapiens
attatactaagaaaa

SEQ ID NO: 3706281 - DNA, 15 bp, Homo sapiens
attatagtgtagaaa

SEQ ID NO: 3706282 - DNA, 15 bp, Homo sapiens
attatattgcaatga

SEQ ID NO: 3706283 - DNA, 18 bp, Homo sapiens
attatattgttaatcaat

SEQ ID NO: 3706284 - DNA, 19 bp, Homo sapiens
attctcctgcctcagcctc

SEQ ID NO: 3706285 - DNA, 10 bp, Homo sapiens
attctctctc

SEQ ID NO: 3706286 - DNA, 12 bp, Homo sapiens
attctctctcct

SEQ ID NO: 3706287 - DNA, 16 bp, Homo sapiens
attctctctcctgtcc

SEQ ID NO: 3706288 - DNA, 17 bp, Homo sapiens
attctctctcctgtcca

SEQ ID NO: 3706289 - DNA, 19 bp, Homo sapiens
attctgcaagcacatctgc

SEQ ID NO: 3706290 - DNA, 13 bp, Homo sapiens
attctgcctgccc

SEQ ID NO: 3706291 - DNA, 15 bp, Homo sapiens
attctgcctgcccag

SEQ ID NO: 3706292 - DNA, 16 bp, Homo sapiens
attctgcctgcccagg

SEQ ID NO: 3706293 - DNA, 17 bp, Homo sapiens
attctgcctgcccaggc

SEQ ID NO: 3706294 - DNA, 18 bp, Homo sapiens
attctgcctgcccaggcc

SEQ ID NO: 3706295 - DNA, 21 bp, Homo sapiens
attctgcctttgcagaaacag

SEQ ID NO: 3706296 - DNA, 20 bp, Homo sapiens
attctgctcacatatctgtc

SEQ ID NO: 3706297 - DNA, 15 bp, Homo sapiens
attctggtctctcta

SEQ ID NO: 3706298 - DNA, 20 bp, Homo sapiens
attctgtaaaatgtctgtta

SEQ ID NO: 3706299 - DNA, 14 bp, Homo sapiens
attctgttggccag

SEQ ID NO: 3706300 - DNA, 18 bp, Homo sapiens
attcttagcctgtggcag

SEQ ID NO: 3706301 - DNA, 13 bp, Homo sapiens
attcttatttaat

SEQ ID NO: 3706302 - DNA, 14 bp, Homo sapiens
attcttatttaatg

SEQ ID NO: 3706303 - DNA, 12 bp, Homo sapiens
attcttcctagt

SEQ ID NO: 3706304 - DNA, 22 bp, Homo sapiens
attcttcctccctccctctttc

SEQ ID NO: 3706305 - DNA, 19 bp, Homo sapiens
attcttctgcttcagcctc

SEQ ID NO: 3706306 - DNA, 13 bp, Homo sapiens
attcttgtgaata

SEQ ID NO: 3706307 - DNA, 17 bp, Homo sapiens
attcttgtgaatatgta

SEQ ID NO: 3706308 - DNA, 17 bp, Homo sapiens
attctttaaatttcatc

SEQ ID NO: 3706309 - DNA, 19 bp, Homo sapiens
attctttcaagtgaatcta

SEQ ID NO: 3706310 - DNA, 17 bp, Homo sapiens
attctttccattatgat

SEQ ID NO: 3706311 - DNA, 21 bp, Homo sapiens
attctttccattatgattctt

SEQ ID NO: 3706312 - DNA, 17 bp, Homo sapiens
attcttttttaaatttt

SEQ ID NO: 3706313 - DNA, 19 bp, Homo sapiens
attcttttttaaattttct

SEQ ID NO: 3706314 - DNA, 15 bp, Homo sapiens
attgaaaaggaagat

SEQ ID NO: 3706315 - DNA, 13 bp, Homo sapiens
attgaaaaggaca

SEQ ID NO: 3706316 - DNA, 22 bp, Homo sapiens
attgaaaataggagagagatca

SEQ ID NO: 3706317 - DNA, 20 bp, Homo sapiens
attgaaaatgtaagtaaatg

SEQ ID NO: 3706318 - DNA, 13 bp, Homo sapiens
attgaaggaaaga

SEQ ID NO: 3706319 - DNA, 20 bp, Homo sapiens
attgaattttcaagcatctc

SEQ ID NO: 3706320 - DNA, 18 bp, Homo sapiens
attgacaataatttcagg

SEQ ID NO: 3706321 - DNA, 18 bp, Homo sapiens
attgacaggattattgga

SEQ ID NO: 3706322 - DNA, 15 bp, Homo sapiens
attgacagtaacttg

SEQ ID NO: 3706323 - DNA, 18 bp, Homo sapiens
attgaccaagaactgcat

SEQ ID NO: 3706324 - DNA, 17 bp, Homo sapiens
attgagaattttaaatt

SEQ ID NO: 3706325 - DNA, 21 bp, Homo sapiens
attgagaattttaaattataa

SEQ ID NO: 3706326 - DNA, 14 bp, Homo sapiens
attgagacaaaaat

SEQ ID NO: 3706327 - DNA, 20 bp, Homo sapiens
attgagacaaaaattatcta

SEQ ID NO: 3706328 - DNA, 17 bp, Homo sapiens
attgagtaagatttacc

SEQ ID NO: 3706329 - DNA, 12 bp, Homo sapiens
attgataataaa

SEQ ID NO: 3706330 - DNA, 19 bp, Homo sapiens
attgatataaataaaacat

SEQ ID NO: 3706331 - DNA, 19 bp, Homo sapiens
attgatcattttcccccca

SEQ ID NO: 3706332 - DNA, 20 bp, Homo sapiens
cacaggtgtccccagcccac

SEQ ID NO: 3706333 - DNA, 19 bp, Homo sapiens
cacagtattacttctgcta

SEQ ID NO: 3706334 - DNA, 21 bp, Homo sapiens
cacagtattacttctgctaca

SEQ ID NO: 3706335 - DNA, 17 bp, Homo sapiens
cacagtgaaggctgtcc

SEQ ID NO: 3706336 - DNA, 21 bp, Homo sapiens
cacagtgagtcgaggacaggg

SEQ ID NO: 3706337 - DNA, 14 bp, Homo sapiens
cacagtgcatctca

SEQ ID NO: 3706338 - DNA, 14 bp, Homo sapiens
cacagtgggagcca

SEQ ID NO: 3706339 - DNA, 18 bp, Homo sapiens
cacagtgggagccagggc

SEQ ID NO: 3706340 - DNA, 18 bp, Homo sapiens
cacagtgtctgtatcgga

SEQ ID NO: 3706341 - DNA, 16 bp, Homo sapiens
cacagtgtgtttgtga

SEQ ID NO: 3706342 - DNA, 16 bp, Homo sapiens
cacagttcctcgccct

SEQ ID NO: 3706343 - DNA, 22 bp, Homo sapiens
cacagttcctcgccctgggtct

SEQ ID NO: 3706344 - DNA, 14 bp, Homo sapiens
cacatagattcacc

SEQ ID NO: 3706345 - DNA, 21 bp, Homo sapiens
cacatataaacatcacacaca

SEQ ID NO: 3706346 - DNA, 14 bp, Homo sapiens
cacatatctgtcat

SEQ ID NO: 3706347 - DNA, 24 bp, Homo sapiens
cacatcagctccactttcagtgaa

SEQ ID NO: 3706348 - DNA, 17 bp, Homo sapiens
cacatcctgtgtttcta

SEQ ID NO: 3706349 - DNA, 12 bp, Homo sapiens
cacatcttccct

SEQ ID NO: 3706350 - DNA, 14 bp, Homo sapiens
cacatcttgctctg

SEQ ID NO: 3706351 - DNA, 15 bp, Homo sapiens
cacatcttgctctgc

SEQ ID NO: 3706352 - DNA, 19 bp, Homo sapiens
cacatcttgctctgctgac

SEQ ID NO: 3706353 - DNA, 21 bp, Homo sapiens
cacatctttcacacttccacc

SEQ ID NO: 3706354 - DNA, 21 bp, Homo sapiens
cacatgagatctaggtgagga

SEQ ID NO: 3706355 - DNA, 15 bp, Homo sapiens
cacatgctggacagg

SEQ ID NO: 3706356 - DNA, 18 bp, Homo sapiens
cacatgcttttcttccta

SEQ ID NO: 3706357 - DNA, 18 bp, Homo sapiens
cacatgggtgaacactca

SEQ ID NO: 3706358 - DNA, 15 bp, Homo sapiens
cacatgtgcacatgc

SEQ ID NO: 3706359 - DNA, 20 bp, Homo sapiens
cacaagagcccagcagggcc

SEQ ID NO: 3706360 - DNA, 17 bp, Homo sapiens
cacaagattcccagaga

SEQ ID NO: 3706361 - DNA, 17 bp, Homo sapiens
cacaagctgcaccctca

SEQ ID NO: 3706362 - DNA, 23 bp, Homo sapiens
cacaagctgcaccctcaggcagg

SEQ ID NO: 3706363 - DNA, 12 bp, Homo sapiens
cacaagctgcct

SEQ ID NO: 3706364 - DNA, 14 bp, Homo sapiens
cacaagctgcctcc

SEQ ID NO: 3706365 - DNA, 12 bp, Homo sapiens
cacaagtgaaaa

SEQ ID NO: 3706366 - DNA, 22 bp, Homo sapiens
cacaagtgccactgcccgagct

SEQ ID NO: 3706367 - DNA, 20 bp, Homo sapiens
cacaataaatgtattcaaat

SEQ ID NO: 3706368 - DNA, 12 bp, Homo sapiens
cacaatatgaat

SEQ ID NO: 3706369 - DNA, 11 bp, Homo sapiens
cacaatatttt

SEQ ID NO: 3706370 - DNA, 22 bp, Homo sapiens
cacaatgaaatgctctcctttc

SEQ ID NO: 3706371 - DNA, 11 bp, Homo sapiens
cacaatgtctt

SEQ ID NO: 3706372 - DNA, 13 bp, Homo sapiens
cacacaaagagag

SEQ ID NO: 3706373 - DNA, 13 bp, Homo sapiens
cacacaaaggtat

SEQ ID NO: 3706374 - DNA, 18 bp, Homo sapiens
cacacaatgtgtctgaga

SEQ ID NO: 3706375 - DNA, 13 bp, Homo sapiens
cacacacaaagag

SEQ ID NO: 3706376 - DNA, 12 bp, Homo sapiens
cacacacacagg

SEQ ID NO: 3706377 - DNA, 12 bp, Homo sapiens
cacacacagctt

SEQ ID NO: 3706378 - DNA, 12 bp, Homo sapiens
cacacacaggag

SEQ ID NO: 3706379 - DNA, 12 bp, Homo sapiens
cacacagaggaa

SEQ ID NO: 3706380 - DNA, 21 bp, Homo sapiens
cacacagaggctgcctctccc

SEQ ID NO: 3706381 - DNA, 20 bp, Homo sapiens
cacacaggcaactgaggcag

SEQ ID NO: 3706382 - DNA, 23 bp, Homo sapiens
cacacagggtctgcaaggtcttt

SEQ ID NO: 3706383 - DNA, 15 bp, Homo sapiens
cacacatacacacac

SEQ ID NO: 3706384 - DNA, 23 bp, Homo sapiens
cacacatataaacatcacacaca

SEQ ID NO: 3706385 - DNA, 13 bp, Homo sapiens
cacaccagagccc

SEQ ID NO: 3706386 - DNA, 21 bp, Homo sapiens
cacaccagagcccaccttggc

SEQ ID NO: 3706387 - DNA, 14 bp, Homo sapiens
cacaccaggctgtg

SEQ ID NO: 3706388 - DNA, 21 bp, Homo sapiens
cacaccaggctgtgggcctca

SEQ ID NO: 3706389 - DNA, 14 bp, Homo sapiens
cacacccagcccac

SEQ ID NO: 3706390 - DNA, 16 bp, Homo sapiens
cacacccatcatctga

SEQ ID NO: 3706391 - DNA, 22 bp, Homo sapiens
caagtgtggtagggacttaaaa

SEQ ID NO: 3706392 - DNA, 23 bp, Homo sapiens
caagtgtggtagggacttaaaaa

SEQ ID NO: 3706393 - DNA, 23 bp, Homo sapiens
caagtgtgtatgtgcgtgtgtgc

SEQ ID NO: 3706394 - DNA, 16 bp, Homo sapiens
caagtgtgtgcatgtg

SEQ ID NO: 3706395 - DNA, 17 bp, Homo sapiens
caagtgtgtgtgcgtgt

SEQ ID NO: 3706396 - DNA, 15 bp, Homo sapiens
caagttaacaaggaa

SEQ ID NO: 3706397 - DNA, 16 bp, Homo sapiens
caagttaacaaggaat

SEQ ID NO: 3706398 - DNA, 14 bp, Homo sapiens
caagttagctcagg

SEQ ID NO: 3706399 - DNA, 20 bp, Homo sapiens
caagttataaatcaatgtca

SEQ ID NO: 3706400 - DNA, 13 bp, Homo sapiens
caagttattaatt

SEQ ID NO: 3706401 - DNA, 21 bp, Homo sapiens
caagttcctctagtgccctcc

SEQ ID NO: 3706402 - DNA, 15 bp, Homo sapiens
caagttgcgacggag

SEQ ID NO: 3706403 - DNA, 20 bp, Homo sapiens
caagttgcgacggagagaaa

SEQ ID NO: 3706404 - DNA, 16 bp, Homo sapiens
caagttgtttcattga

SEQ ID NO: 3706405 - DNA, 16 bp, Homo sapiens
caagtttcagacaggg

SEQ ID NO: 3706406 - DNA, 18 bp, Homo sapiens
caagtttccaagcaaatg

SEQ ID NO: 3706407 - DNA, 20 bp, Homo sapiens
caagttttcataagcacact

SEQ ID NO: 3706408 - DNA, 13 bp, Homo sapiens
caataaaataaca

SEQ ID NO: 3706409 - DNA, 14 bp, Homo sapiens
caataaaatcatgt

SEQ ID NO: 3706410 - DNA, 20 bp, Homo sapiens
caataaaatcttgaaaatgc

SEQ ID NO: 3706411 - DNA, 15 bp, Homo sapiens
caataaaatgtgatt

SEQ ID NO: 3706412 - DNA, 17 bp, Homo sapiens
caataaacctcttttct

SEQ ID NO: 3706413 - DNA, 11 bp, Homo sapiens
caataaactat

SEQ ID NO: 3706414 - DNA, 17 bp, Homo sapiens
caataactactgtgttc

SEQ ID NO: 3706415 - DNA, 18 bp, Homo sapiens
caataactactgtgttcc

SEQ ID NO: 3706416 - DNA, 18 bp, Homo sapiens
caataagcatcaaactct

SEQ ID NO: 3706417 - DNA, 19 bp, Homo sapiens
caataagcatcaaactctt

SEQ ID NO: 3706418 - DNA, 18 bp, Homo sapiens
caatacagtacaggcagc

SEQ ID NO: 3706419 - DNA, 14 bp, Homo sapiens
caatagagactgta

SEQ ID NO: 3706420 - DNA, 22 bp, Homo sapiens
caatagagactgtagattgctt

SEQ ID NO: 3706421 - DNA, 17 bp, Homo sapiens
caatagcactttcattg

SEQ ID NO: 3706422 - DNA, 21 bp, Homo sapiens
caatagcactttcattgccag

SEQ ID NO: 3706423 - DNA, 23 bp, Homo sapiens
caatagcactttcattgccagtg

SEQ ID NO: 3706424 - DNA, 18 bp, Homo sapiens
caatagctttaccctcag

SEQ ID NO: 3706425 - DNA, 21 bp, Homo sapiens
caatagctttaccctcaggca

SEQ ID NO: 3706426 - DNA, 23 bp, Homo sapiens
caatagctttaccctcaggcata

SEQ ID NO: 3706427 - DNA, 16 bp, Homo sapiens
caagattgcttaaaat

SEQ ID NO: 3706428 - DNA, 18 bp, Homo sapiens
caagattgcttaaaatag

SEQ ID NO: 3706429 - DNA, 17 bp, Homo sapiens
caagattttccacaaga

SEQ ID NO: 3706430 - DNA, 19 bp, Homo sapiens
caagcaaaggtgaagagac

SEQ ID NO: 3706431 - DNA, 17 bp, Homo sapiens
caagcacagtgcctgca

SEQ ID NO: 3706432 - DNA, 17 bp, Homo sapiens
caagcacatctgcattt

SEQ ID NO: 3706433 - DNA, 20 bp, Homo sapiens
caagcacatctgcattttca

SEQ ID NO: 3706434 - DNA, 18 bp, Homo sapiens
caagcacctagcctcgct

SEQ ID NO: 3706435 - DNA, 14 bp, Homo sapiens
caagcacctcctgc

SEQ ID NO: 3706436 - DNA, 14 bp, Homo sapiens
caagcagccaagct

SEQ ID NO: 3706437 - DNA, 16 bp, Homo sapiens
caagcaggaagctcag

SEQ ID NO: 3706438 - DNA, 14 bp, Homo sapiens
caagccaagcagcc

SEQ ID NO: 3706439 - DNA, 24 bp, Homo sapiens
caagccagggatggggccacagcc

SEQ ID NO: 3706440 - DNA, 12 bp, Homo sapiens
caagcccaggag

SEQ ID NO: 3706441 - DNA, 13 bp, Homo sapiens
caagccccaggca

SEQ ID NO: 3706442 - DNA, 17 bp, Homo sapiens
caagccccaggcaggct

SEQ ID NO: 3706443 - DNA, 18 bp, Homo sapiens
caagccgtggcttcccgc

SEQ ID NO: 3706444 - DNA, 14 bp, Homo sapiens
caagcctgcctagg

SEQ ID NO: 3706445 - DNA, 19 bp, Homo sapiens
caagcgattcttctgcttc

SEQ ID NO: 3706446 - DNA, 16 bp, Homo sapiens
caagcgtgagccactg

SEQ ID NO: 3706447 - DNA, 23 bp, Homo sapiens
caagctaataaaatatcattcag

SEQ ID NO: 3706448 - DNA, 21 bp, Homo sapiens
caagctcacagttcctcgccc

SEQ ID NO: 3706449 - DNA, 18 bp, Homo sapiens
caagctgcaccctcaggc

SEQ ID NO: 3706450 - DNA, 14 bp, Homo sapiens
caagctgcctccct

SEQ ID NO: 3706451 - DNA, 20 bp, Homo sapiens
caagctgcctccctgtccac

SEQ ID NO: 3706452 - DNA, 17 bp, Homo sapiens
caagctggtcccactca

SEQ ID NO: 3706453 - DNA, 21 bp, Homo sapiens
caagctggtcccactcagtcc

SEQ ID NO: 3706454 - DNA, 16 bp, Homo sapiens
caagctgttttcttct

SEQ ID NO: 3706455 - DNA, 20 bp, Homo sapiens
caagctttgatttagattga

SEQ ID NO: 3706456 - DNA, 20 bp, Homo sapiens
caaggaaagccccagcacta

SEQ ID NO: 3706457 - DNA, 17 bp, Homo sapiens
caaggacaaagtctcca

SEQ ID NO: 3706458 - DNA, 18 bp, Homo sapiens
caaggaccaacaagggca

SEQ ID NO: 3706459 - DNA, 20 bp, Homo sapiens
caaggaccaacaagggcagt

SEQ ID NO: 3706460 - DNA, 16 bp, Homo sapiens
caaggaccaggactcc

SEQ ID NO: 3706461 - DNA, 21 bp, Homo sapiens
caaggaccaggactccctcct

SEQ ID NO: 3706462 - DNA, 13 bp, Homo sapiens
caaggacccctca

SEQ ID NO: 3706463 - DNA, 14 bp, Homo sapiens
caaggacccctcac

SEQ ID NO: 3706464 - DNA, 15 bp, Homo sapiens
caaggacccctcacc

SEQ ID NO: 3706465 - DNA, 22 bp, Homo sapiens
caaggactgcagggactgccag

SEQ ID NO: 3706466 - DNA, 14 bp, Homo sapiens
caaggagaaacaga

SEQ ID NO: 3706467 - DNA, 18 bp, Homo sapiens
attttaagtgctttgtaa

SEQ ID NO: 3706468 - DNA, 18 bp, Homo sapiens
attttaattaggttaact

SEQ ID NO: 3706469 - DNA, 13 bp, Homo sapiens
attttaattatta

SEQ ID NO: 3706470 - DNA, 19 bp, Homo sapiens
attttaccaagttatataa

SEQ ID NO: 3706471 - DNA, 20 bp, Homo sapiens
attttaccaagttatataaa

SEQ ID NO: 3706472 - DNA, 22 bp, Homo sapiens
attttaccaagttatataaaga

SEQ ID NO: 3706473 - DNA, 14 bp, Homo sapiens
attttactgtctta

SEQ ID NO: 3706474 - DNA, 20 bp, Homo sapiens
attttactgtcttaattaag

SEQ ID NO: 3706475 - DNA, 21 bp, Homo sapiens
attttactttaaaaggagcca

SEQ ID NO: 3706476 - DNA, 12 bp, Homo sapiens
attttagacaaa

SEQ ID NO: 3706477 - DNA, 20 bp, Homo sapiens
attttagcagttctgcaaat

SEQ ID NO: 3706478 - DNA, 21 bp, Homo sapiens
attttagcagttctgcaaata

SEQ ID NO: 3706479 - DNA, 23 bp, Homo sapiens
attttagtatatttatataatta

SEQ ID NO: 3706480 - DNA, 13 bp, Homo sapiens
attttataaaatt

SEQ ID NO: 3706481 - DNA, 22 bp, Homo sapiens
attttatagctcagtttatcca

SEQ ID NO: 3706482 - DNA, 17 bp, Homo sapiens
attttatataataaagt

SEQ ID NO: 3706483 - DNA, 22 bp, Homo sapiens
attttatataataaagtattcc

SEQ ID NO: 3706484 - DNA, 15 bp, Homo sapiens
attttatctcttatt

SEQ ID NO: 3706485 - DNA, 21 bp, Homo sapiens
attttatgaaaggtttacatt

SEQ ID NO: 3706486 - DNA, 16 bp, Homo sapiens
attttatgtatgttta

SEQ ID NO: 3706487 - DNA, 20 bp, Homo sapiens
attttatttttttctctctg

SEQ ID NO: 3706488 - DNA, 17 bp, Homo sapiens
attttcaaagtacataa

SEQ ID NO: 3706489 - DNA, 18 bp, Homo sapiens
attttcaacgcagccctg

SEQ ID NO: 3706490 - DNA, 20 bp, Homo sapiens
attttcaacgcagccctgct

SEQ ID NO: 3706491 - DNA, 16 bp, Homo sapiens
attttcaagaaactga

SEQ ID NO: 3706492 - DNA, 16 bp, Homo sapiens
attttcaagtaattgt

SEQ ID NO: 3706493 - DNA, 20 bp, Homo sapiens
attttcacacaatacaataa

SEQ ID NO: 3706494 - DNA, 12 bp, Homo sapiens
attttcagaatc

SEQ ID NO: 3706495 - DNA, 21 bp, Homo sapiens
attttcagaatctgaatgtaa

SEQ ID NO: 3706496 - DNA, 22 bp, Homo sapiens
attttcagaatctgaatgtaat

SEQ ID NO: 3706497 - DNA, 12 bp, Homo sapiens
attttcagaccc

SEQ ID NO: 3706498 - DNA, 21 bp, Homo sapiens
attttcagtagggctacaaaa

SEQ ID NO: 3706499 - DNA, 19 bp, Homo sapiens
attttcagtataatttaac

SEQ ID NO: 3706500 - DNA, 21 bp, Homo sapiens
attttccacaagattcccaga

SEQ ID NO: 3706501 - DNA, 15 bp, Homo sapiens
attttccatgaaaat

SEQ ID NO: 3706502 - DNA, 15 bp, Homo sapiens
attttcctccccagc

SEQ ID NO: 3706503 - DNA, 16 bp, Homo sapiens
attttcctgccaggca

SEQ ID NO: 3706504 - DNA, 14 bp, Homo sapiens
attttctacaagta

SEQ ID NO: 3706505 - DNA, 19 bp, Homo sapiens
attttctgaaactaatgaa

SEQ ID NO: 3706506 - DNA, 20 bp, Homo sapiens
attttctgaaactaatgaaa

SEQ ID NO: 3706507 - DNA, 22 bp, Homo sapiens
attttctggaatacatgaaata

SEQ ID NO: 3706508 - DNA, 18 bp, Homo sapiens
attttctggtagatagaa

SEQ ID NO: 3706509 - DNA, 21 bp, Homo sapiens
attttctggtagatagaaata

SEQ ID NO: 3706510 - DNA, 14 bp, Homo sapiens
attttcttcatgca

SEQ ID NO: 3706511 - DNA, 21 bp, Homo sapiens
attttcttccaagcaaaggtg

SEQ ID NO: 3706512 - DNA, 19 bp, Homo sapiens
attttcttgatgactggaa

SEQ ID NO: 3706513 - DNA, 20 bp, Homo sapiens
attttctttttaataaaaag

SEQ ID NO: 3706514 - DNA, 16 bp, Homo sapiens
attttgaaaactacat

SEQ ID NO: 3706515 - DNA, 18 bp, Homo sapiens
attttgaaaactacattt

SEQ ID NO: 3706516 - DNA, 12 bp, Homo sapiens
attttgaagcta

SEQ ID NO: 3706517 - DNA, 13 bp, Homo sapiens
attttgaagctaa

SEQ ID NO: 3706518 - DNA, 23 bp, Homo sapiens
attttgaagctaattattttaat

SEQ ID NO: 3706519 - DNA, 18 bp, Homo sapiens
attttgacctactctcat

SEQ ID NO: 3706520 - DNA, 14 bp, Homo sapiens
attttgcagcagtg

SEQ ID NO: 3706521 - DNA, 21 bp, Homo sapiens
atttataactcatcataaaat

SEQ ID NO: 3706522 - DNA, 22 bp, Homo sapiens
atttataactcatcataaaata

SEQ ID NO: 3706523 - DNA, 22 bp, Homo sapiens
atttataagcagatttaacaat

SEQ ID NO: 3706524 - DNA, 14 bp, Homo sapiens
atttataatgttag

SEQ ID NO: 3706525 - DNA, 20 bp, Homo sapiens
atttataatgttagtagaaa

SEQ ID NO: 3706526 - DNA, 18 bp, Homo sapiens
atttatagtttatacagt

SEQ ID NO: 3706527 - DNA, 18 bp, Homo sapiens
atttatataattatgtta

SEQ ID NO: 3706528 - DNA, 20 bp, Homo sapiens
atttatataattatgttatt

SEQ ID NO: 3706529 - DNA, 16 bp, Homo sapiens
atttatatatgtatct

SEQ ID NO: 3706530 - DNA, 16 bp, Homo sapiens
atttatatatttataa

SEQ ID NO: 3706531 - DNA, 17 bp, Homo sapiens
atttatatatttataac

SEQ ID NO: 3706532 - DNA, 18 bp, Homo sapiens
atttatatttttatttta

SEQ ID NO: 3706533 - DNA, 17 bp, Homo sapiens
atttatcacacaaagca

SEQ ID NO: 3706534 - DNA, 18 bp, Homo sapiens
atttatcagtgacagagt

SEQ ID NO: 3706535 - DNA, 21 bp, Homo sapiens
atttatcctgaaatttcagat

SEQ ID NO: 3706536 - DNA, 20 bp, Homo sapiens
atttatctattgtaagataa

SEQ ID NO: 3706537 - DNA, 22 bp, Homo sapiens
atttatctttacttttaaacag

SEQ ID NO: 3706538 - DNA, 18 bp, Homo sapiens
atttatgagtttttgata

SEQ ID NO: 3706539 - DNA, 18 bp, Homo sapiens
atttatgtagatgtgcat

SEQ ID NO: 3706540 - DNA, 14 bp, Homo sapiens
atttattattttca

SEQ ID NO: 3706541 - DNA, 21 bp, Homo sapiens
atttattattttcacctgttt

SEQ ID NO: 3706542 - DNA, 12 bp, Homo sapiens
atttattcaaga

SEQ ID NO: 3706543 - DNA, 18 bp, Homo sapiens
atttattcaattcctctg

SEQ ID NO: 3706544 - DNA, 14 bp, Homo sapiens
atttattgcttgat

SEQ ID NO: 3706545 - DNA, 18 bp, Homo sapiens
atttattgtattttagta

SEQ ID NO: 3706546 - DNA, 21 bp, Homo sapiens
atttattgtttatttatcagt

SEQ ID NO: 3706547 - DNA, 15 bp, Homo sapiens
atttatttaatgtta

SEQ ID NO: 3706548 - DNA, 13 bp, Homo sapiens
atttattttcctc

SEQ ID NO: 3706549 - DNA, 17 bp, Homo sapiens
atttattttcctcccca

SEQ ID NO: 3706550 - DNA, 20 bp, Homo sapiens
atttattttcctccccagca

SEQ ID NO: 3706551 - DNA, 19 bp, Homo sapiens
atttattttttacattatt

SEQ ID NO: 3706552 - DNA, 22 bp, Homo sapiens
atttcaaaaatttggaattctg

SEQ ID NO: 3706553 - DNA, 14 bp, Homo sapiens
atttcaaaactcat

SEQ ID NO: 3706554 - DNA, 21 bp, Homo sapiens
atttcaatttccaagagctga

SEQ ID NO: 3706555 - DNA, 23 bp, Homo sapiens
atttcacagtgtgtttgtgattg

SEQ ID NO: 3706556 - DNA, 22 bp, Homo sapiens
atttcacattaatatttgctga

SEQ ID NO: 3706557 - DNA, 20 bp, Homo sapiens
atttcacgtcgtcttctgta

SEQ ID NO: 3706558 - DNA, 19 bp, Homo sapiens
atttcaggatactctgtca

SEQ ID NO: 3706559 - DNA, 15 bp, Homo sapiens
atttcatctatttct

SEQ ID NO: 3706560 - DNA, 20 bp, Homo sapiens
atttcatctatttctgagaa

SEQ ID NO: 3706561 - DNA, 15 bp, Homo sapiens
atttcatgatttcat

SEQ ID NO: 3706562 - DNA, 18 bp, Homo sapiens
atttcatgctatctctgt

SEQ ID NO: 3706563 - DNA, 15 bp, Homo sapiens
atttccaagagctga

SEQ ID NO: 3706564 - DNA, 17 bp, Homo sapiens
atttccagccaaagcct

SEQ ID NO: 3706565 - DNA, 17 bp, Homo sapiens
atttccattatttatat

SEQ ID NO: 3706566 - DNA, 23 bp, Homo sapiens
atttccccagacctgagctcccc

SEQ ID NO: 3706567 - DNA, 15 bp, Homo sapiens
atttcccttcttctg

SEQ ID NO: 3706568 - DNA, 18 bp, Homo sapiens
atttcccttcttctgtca

SEQ ID NO: 3706569 - DNA, 21 bp, Homo sapiens
atttcgccgttgaagaggaag

SEQ ID NO: 3706570 - DNA, 14 bp, Homo sapiens
atttctaaaaaaca

SEQ ID NO: 3706571 - DNA, 20 bp, Homo sapiens
atttctaaaaaacagaggcc

SEQ ID NO: 3706572 - DNA, 23 bp, Homo sapiens
atttctaactctgatgtaaatga

SEQ ID NO: 3706573 - DNA, 18 bp, Homo sapiens
atttctaccatttcagag

SEQ ID NO: 3706574 - DNA, 21 bp, Homo sapiens
atttctagaacatccctgcca

SEQ ID NO: 3706575 - DNA, 12 bp, Homo sapiens
atttctattttt

SEQ ID NO: 3706576 - DNA, 11 bp, Homo sapiens
atttctcccag

SEQ ID NO: 3706577 - DNA, 22 bp, Homo sapiens
atttctctctccagtcttccac

SEQ ID NO: 3706578 - DNA, 17 bp, Homo sapiens
atttctgagaaggtcct

SEQ ID NO: 3706579 - DNA, 16 bp, Homo sapiens
caacatcaatgttcat

SEQ ID NO: 3706580 - DNA, 22 bp, Homo sapiens
caacatcaatgttcattgtaat

SEQ ID NO: 3706581 - DNA, 13 bp, Homo sapiens
caacatctagcaa

SEQ ID NO: 3706582 - DNA, 22 bp, Homo sapiens
caacatcttggtcagatttgaa

SEQ ID NO: 3706583 - DNA, 23 bp, Homo sapiens
caacatgcctgccccaaacaaat

SEQ ID NO: 3706584 - DNA, 17 bp, Homo sapiens
caacatgttactgacca

SEQ ID NO: 3706585 - DNA, 15 bp, Homo sapiens
caacattaaacacaa

SEQ ID NO: 3706586 - DNA, 16 bp, Homo sapiens
caaccaatgtagaaag

SEQ ID NO: 3706587 - DNA, 17 bp, Homo sapiens
caaccaccgctccccag

SEQ ID NO: 3706588 - DNA, 19 bp, Homo sapiens
caaccactgtaaaatgaaa

SEQ ID NO: 3706589 - DNA, 21 bp, Homo sapiens
caaccactgtaaaatgaaatt

SEQ ID NO: 3706590 - DNA, 21 bp, Homo sapiens
caaccagaccattgtctcaga

SEQ ID NO: 3706591 - DNA, 13 bp, Homo sapiens
caaccagagcact

SEQ ID NO: 3706592 - DNA, 15 bp, Homo sapiens
caaccagagcactgt

SEQ ID NO: 3706593 - DNA, 14 bp, Homo sapiens
caaccattccagac

SEQ ID NO: 3706594 - DNA, 17 bp, Homo sapiens
caacccaaacctggaga

SEQ ID NO: 3706595 - DNA, 15 bp, Homo sapiens
caacccccagcctgc

SEQ ID NO: 3706596 - DNA, 14 bp, Homo sapiens
caacccctgtggag

SEQ ID NO: 3706597 - DNA, 16 bp, Homo sapiens
caacccctgtggagcc

SEQ ID NO: 3706598 - DNA, 21 bp, Homo sapiens
caacccctgtggagcccgcac

SEQ ID NO: 3706599 - DNA, 14 bp, Homo sapiens
caaccccttcgctc

SEQ ID NO: 3706600 - DNA, 16 bp, Homo sapiens
caaccccttcgctcct

SEQ ID NO: 3706601 - DNA, 18 bp, Homo sapiens
caaccccttcgctcctgt

SEQ ID NO: 3706602 - DNA, 21 bp, Homo sapiens
caaccccttcgctcctgtgtc

SEQ ID NO: 3706603 - DNA, 16 bp, Homo sapiens
caacccgaggcccgca

SEQ ID NO: 3706604 - DNA, 18 bp, Homo sapiens
caaccctcagagccaccc

SEQ ID NO: 3706605 - DNA, 20 bp, Homo sapiens
caaccctccctcagcccctc

SEQ ID NO: 3706606 - DNA, 15 bp, Homo sapiens
caaccctcctatcac

SEQ ID NO: 3706607 - DNA, 22 bp, Homo sapiens
caaccctcctatcacctcccct

SEQ ID NO: 3706608 - DNA, 11 bp, Homo sapiens
caaccctgccc

SEQ ID NO: 3706609 - DNA, 13 bp, Homo sapiens
caaccctgcccct

SEQ ID NO: 3706610 - DNA, 14 bp, Homo sapiens
caaccctgcccctg

SEQ ID NO: 3706611 - DNA, 17 bp, Homo sapiens
caaccctgttttatact

SEQ ID NO: 3706612 - DNA, 15 bp, Homo sapiens
caacccttacccctt

SEQ ID NO: 3706613 - DNA, 14 bp, Homo sapiens
caaccgatgctcca

SEQ ID NO: 3706614 - DNA, 18 bp, Homo sapiens
caaccgatgctccagcca

SEQ ID NO: 3706615 - DNA, 22 bp, Homo sapiens
caaccgatgctccagccaaccc

SEQ ID NO: 3706616 - DNA, 15 bp, Homo sapiens
caacctccccggctc

SEQ ID NO: 3706617 - DNA, 15 bp, Homo sapiens
caacctcctgggcta

SEQ ID NO: 3706618 - DNA, 17 bp, Homo sapiens
caacctcggctcctgga

SEQ ID NO: 3706619 - DNA, 16 bp, Homo sapiens
caacctctctgatctt

SEQ ID NO: 3706620 - DNA, 23 bp, Homo sapiens
caacctctctgatcttgtgctca

SEQ ID NO: 3706621 - DNA, 21 bp, Homo sapiens
caacctgaccaacatggagaa

SEQ ID NO: 3706622 - DNA, 16 bp, Homo sapiens
caacctgtaaattatt

SEQ ID NO: 3706623 - DNA, 21 bp, Homo sapiens
caaaacctgatgttaaaattc

SEQ ID NO: 3706624 - DNA, 19 bp, Homo sapiens
caaaacgcatggagtgtgt

SEQ ID NO: 3706625 - DNA, 13 bp, Homo sapiens
caaaacggggcag

SEQ ID NO: 3706626 - DNA, 17 bp, Homo sapiens
caaaagaagtaacaaga

SEQ ID NO: 3706627 - DNA, 22 bp, Homo sapiens
caaaagaagtaacaagagtgat

SEQ ID NO: 3706628 - DNA, 11 bp, Homo sapiens
caaaagcctct

SEQ ID NO: 3706629 - DNA, 12 bp, Homo sapiens
caaaaggaaacc

SEQ ID NO: 3706630 - DNA, 13 bp, Homo sapiens
caaaaggaagtct

SEQ ID NO: 3706631 - DNA, 23 bp, Homo sapiens
caaaaggtgcctgtgaggcaggg

SEQ ID NO: 3706632 - DNA, 20 bp, Homo sapiens
caaaaggttcactaaagcag

SEQ ID NO: 3706633 - DNA, 17 bp, Homo sapiens
caaaagtatcgggggct

SEQ ID NO: 3706634 - DNA, 13 bp, Homo sapiens
caaaagtgctttg

SEQ ID NO: 3706635 - DNA, 17 bp, Homo sapiens
caaaataaaaatgaggt

SEQ ID NO: 3706636 - DNA, 23 bp, Homo sapiens
caaaataaagttacattgctggt

SEQ ID NO: 3706637 - DNA, 11 bp, Homo sapiens
caaaataaatt

SEQ ID NO: 3706638 - DNA, 17 bp, Homo sapiens
caaaataatgtcttgtt

SEQ ID NO: 3706639 - DNA, 18 bp, Homo sapiens
caaaataatgtcttgtta

SEQ ID NO: 3706640 - DNA, 13 bp, Homo sapiens
caaaatataaagc

SEQ ID NO: 3706641 - DNA, 20 bp, Homo sapiens
caaaatccttgcttatgaca

SEQ ID NO: 3706642 - DNA, 21 bp, Homo sapiens
caaaatcgatgcagtgcttcc

SEQ ID NO: 3706643 - DNA, 15 bp, Homo sapiens
caaaatgacaatgat

SEQ ID NO: 3706644 - DNA, 21 bp, Homo sapiens
caaaattatagaagtttagat

SEQ ID NO: 3706645 - DNA, 14 bp, Homo sapiens
caaaatttccagta

SEQ ID NO: 3706646 - DNA, 20 bp, Homo sapiens
caaaatttccagtacctttg

SEQ ID NO: 3706647 - DNA, 12 bp, Homo sapiens
caaaatttgaaa

SEQ ID NO: 3706648 - DNA, 21 bp, Homo sapiens
caaaattttatagctcagttt

SEQ ID NO: 3706649 - DNA, 14 bp, Homo sapiens
caaaattttattcc

SEQ ID NO: 3706650 - DNA, 14 bp, Homo sapiens
caaacaaatatgca

SEQ ID NO: 3706651 - DNA, 14 bp, Homo sapiens
caaacacctgctga

SEQ ID NO: 3706652 - DNA, 21 bp, Homo sapiens
caaacatgaagtgtgtttcct

SEQ ID NO: 3706653 - DNA, 13 bp, Homo sapiens
caaaccagaagca

SEQ ID NO: 3706654 - DNA, 13 bp, Homo sapiens
caaacccagtgtt

SEQ ID NO: 3706655 - DNA, 18 bp, Homo sapiens
caaaccccgaccacctgc

SEQ ID NO: 3706656 - DNA, 23 bp, Homo sapiens
caaactcataacagtcttactgc

SEQ ID NO: 3706657 - DNA, 20 bp, Homo sapiens
caaactcttgacctcaggtg

SEQ ID NO: 3706658 - DNA, 14 bp, Homo sapiens
caaactgaagccag

SEQ ID NO: 3706659 - DNA, 13 bp, Homo sapiens
caaactgcaatag

SEQ ID NO: 3706660 - DNA, 20 bp, Homo sapiens
caaactgtgtaactgcccaa

SEQ ID NO: 3706661 - DNA, 13 bp, Homo sapiens
caaactgttgatt

SEQ ID NO: 3706662 - DNA, 15 bp, Homo sapiens
caaacttcagactga

SEQ ID NO: 3706663 - DNA, 19 bp, Homo sapiens
caaagacttagtatatttt

SEQ ID NO: 3706664 - DNA, 19 bp, Homo sapiens
caaagagagttaatcaact

SEQ ID NO: 3706665 - DNA, 13 bp, Homo sapiens
caaagagctgcct

SEQ ID NO: 3706666 - DNA, 13 bp, Homo sapiens
caaagaggcaaga

SEQ ID NO: 3706667 - DNA, 20 bp, Homo sapiens
caaagaggcaagaggctgga

SEQ ID NO: 3706668 - DNA, 16 bp, Homo sapiens
caaagaggtatttatc

SEQ ID NO: 3706669 - DNA, 16 bp, Homo sapiens
caaagagttaatatat

SEQ ID NO: 3706670 - DNA, 20 bp, Homo sapiens
caaagataatctctcagctt

SEQ ID NO: 3706671 - DNA, 16 bp, Homo sapiens
caaagatgtttgtcag

SEQ ID NO: 3706672 - DNA, 18 bp, Homo sapiens
caaagatgtttgtcagat

SEQ ID NO: 3706673 - DNA, 17 bp, Homo sapiens
ccagctcagtcttccct

SEQ ID NO: 3706674 - DNA, 13 bp, Homo sapiens
ccagctccagggc

SEQ ID NO: 3706675 - DNA, 18 bp, Homo sapiens
ccagctccagggccagat

SEQ ID NO: 3706676 - DNA, 17 bp, Homo sapiens
ccagctctagacaaccc

SEQ ID NO: 3706677 - DNA, 21 bp, Homo sapiens
ccagctctagacaaccctgca

SEQ ID NO: 3706678 - DNA, 12 bp, Homo sapiens
ccagctctcagc

SEQ ID NO: 3706679 - DNA, 14 bp, Homo sapiens
ccagctctcagcca

SEQ ID NO: 3706680 - DNA, 15 bp, Homo sapiens
ccagctctcagccaa

SEQ ID NO: 3706681 - DNA, 21 bp, Homo sapiens
ccagctctgaggactgcacca

SEQ ID NO: 3706682 - DNA, 19 bp, Homo sapiens
ccagctgccgaccagagcc

SEQ ID NO: 3706683 - DNA, 20 bp, Homo sapiens
ccagctgccgaccagagccc

SEQ ID NO: 3706684 - DNA, 17 bp, Homo sapiens
ccagctgctcccctccc

SEQ ID NO: 3706685 - DNA, 14 bp, Homo sapiens
ccagctgctctgcc

SEQ ID NO: 3706686 - DNA, 15 bp, Homo sapiens
ccagctgctctgccc

SEQ ID NO: 3706687 - DNA, 17 bp, Homo sapiens
ccagctgctctgcccag

SEQ ID NO: 3706688 - DNA, 20 bp, Homo sapiens
ccagctgctctgcccagagc

SEQ ID NO: 3706689 - DNA, 21 bp, Homo sapiens
ccagctgctctgcccagagct

SEQ ID NO: 3706690 - DNA, 22 bp, Homo sapiens
ccagctgctctgcccagagctg

SEQ ID NO: 3706691 - DNA, 14 bp, Homo sapiens
ccagctggcagcag

SEQ ID NO: 3706692 - DNA, 15 bp, Homo sapiens
ccagctggcagcaga

SEQ ID NO: 3706693 - DNA, 20 bp, Homo sapiens
ccagctggcagcagagtgtg

SEQ ID NO: 3706694 - DNA, 21 bp, Homo sapiens
ccagctgtgctctggacaggc

SEQ ID NO: 3706695 - DNA, 22 bp, Homo sapiens
ccagctgtgctctggacaggca

SEQ ID NO: 3706696 - DNA, 23 bp, Homo sapiens
ccagctgtgctctggacaggcat

SEQ ID NO: 3706697 - DNA, 13 bp, Homo sapiens
ccagctgtggttt

SEQ ID NO: 3706698 - DNA, 15 bp, Homo sapiens
ccagctgtggttttc

SEQ ID NO: 3706699 - DNA, 17 bp, Homo sapiens
ccagctgttcagctggt

SEQ ID NO: 3706700 - DNA, 19 bp, Homo sapiens
ccagcttaaaggggctaga

SEQ ID NO: 3706701 - DNA, 15 bp, Homo sapiens
ccagcttgttattta

SEQ ID NO: 3706702 - DNA, 17 bp, Homo sapiens
ccagcttttactgtttt

SEQ ID NO: 3706703 - DNA, 13 bp, Homo sapiens
ccaggaaaaagga

SEQ ID NO: 3706704 - DNA, 11 bp, Homo sapiens
ccaggaagccg

SEQ ID NO: 3706705 - DNA, 15 bp, Homo sapiens
ccaggaagccgtgcc

SEQ ID NO: 3706706 - DNA, 14 bp, Homo sapiens
ccaggaagggtcaa

SEQ ID NO: 3706707 - DNA, 14 bp, Homo sapiens
ccaggacaggcccg

SEQ ID NO: 3706708 - DNA, 17 bp, Homo sapiens
ccaggactccctcctca

SEQ ID NO: 3706709 - DNA, 21 bp, Homo sapiens
ccaggagaaccactacatgca

SEQ ID NO: 3706710 - DNA, 23 bp, Homo sapiens
ccaggagaaccactacatgcagc

SEQ ID NO: 3706711 - DNA, 13 bp, Homo sapiens
ccaggagagccag

SEQ ID NO: 3706712 - DNA, 19 bp, Homo sapiens
ccaggagagccagccctcc

SEQ ID NO: 3706713 - DNA, 20 bp, Homo sapiens
ccaggagagccagccctccc

SEQ ID NO: 3706714 - DNA, 15 bp, Homo sapiens
ccaggagccccgagg

SEQ ID NO: 3706715 - DNA, 17 bp, Homo sapiens
ccaggagcctgtgcctc

SEQ ID NO: 3706716 - DNA, 13 bp, Homo sapiens
ccaggagctcttc

SEQ ID NO: 3706717 - DNA, 18 bp, Homo sapiens
ccaggagctcttcaggcc

SEQ ID NO: 3706718 - DNA, 23 bp, Homo sapiens
ccaggagctcttcaggcctccct

SEQ ID NO: 3706719 - DNA, 14 bp, Homo sapiens
ccaggaggactgcc

SEQ ID NO: 3706720 - DNA, 18 bp, Homo sapiens
ccaggaggtcgaccccaa

SEQ ID NO: 3706721 - DNA, 21 bp, Homo sapiens
ccaggagtttgaggctgcagc

SEQ ID NO: 3706722 - DNA, 20 bp, Homo sapiens
ccaggcacgaacccacctgc

SEQ ID NO: 3706723 - DNA, 12 bp, Homo sapiens
ccaggcaggtct

SEQ ID NO: 3706724 - DNA, 14 bp, Homo sapiens
ccaggccatcagag

SEQ ID NO: 3706725 - DNA, 15 bp, Homo sapiens
ccaggccccaggaag

SEQ ID NO: 3706726 - DNA, 19 bp, Homo sapiens
ccaggcccccaagcctgca

SEQ ID NO: 3706727 - DNA, 15 bp, Homo sapiens
ccaggcccctgccac

SEQ ID NO: 3706728 - DNA, 15 bp, Homo sapiens
ccaggccgccccagc

SEQ ID NO: 3706729 - DNA, 18 bp, Homo sapiens
ccaggccgccccagcctc

SEQ ID NO: 3706730 - DNA, 18 bp, Homo sapiens
ccaggccgtggctgccca

SEQ ID NO: 3706731 - DNA, 14 bp, Homo sapiens
ccatgaactttgtc

SEQ ID NO: 3706732 - DNA, 13 bp, Homo sapiens
ccatgaagacagg

SEQ ID NO: 3706733 - DNA, 17 bp, Homo sapiens
ccatgaagacaggacag

SEQ ID NO: 3706734 - DNA, 16 bp, Homo sapiens
ccatgaagccacagcc

SEQ ID NO: 3706735 - DNA, 23 bp, Homo sapiens
ccatgagcctcagcatcctggca

SEQ ID NO: 3706736 - DNA, 17 bp, Homo sapiens
ccatgagctccagaccc

SEQ ID NO: 3706737 - DNA, 18 bp, Homo sapiens
ccatgaggagttgctgtt

SEQ ID NO: 3706738 - DNA, 15 bp, Homo sapiens
ccatgcccacctgcc

SEQ ID NO: 3706739 - DNA, 17 bp, Homo sapiens
ccatgcccacctgccca

SEQ ID NO: 3706740 - DNA, 18 bp, Homo sapiens
ccatgcccacctgcccat

SEQ ID NO: 3706741 - DNA, 17 bp, Homo sapiens
ccatgcctgtccagcct

SEQ ID NO: 3706742 - DNA, 15 bp, Homo sapiens
ccatgctcctggccc

SEQ ID NO: 3706743 - DNA, 18 bp, Homo sapiens
ccatgctcctggcccact

SEQ ID NO: 3706744 - DNA, 22 bp, Homo sapiens
ccatggactctacactgtgaac

SEQ ID NO: 3706745 - DNA, 13 bp, Homo sapiens
ccatggaggcaca

SEQ ID NO: 3706746 - DNA, 17 bp, Homo sapiens
ccatggaggcacacagc

SEQ ID NO: 3706747 - DNA, 19 bp, Homo sapiens
ccatggcgtgtccctctcg

SEQ ID NO: 3706748 - DNA, 14 bp, Homo sapiens
ccatgggcctcctg

SEQ ID NO: 3706749 - DNA, 15 bp, Homo sapiens
ccatggtcacagaga

SEQ ID NO: 3706750 - DNA, 14 bp, Homo sapiens
ccatggttgagaaa

SEQ ID NO: 3706751 - DNA, 17 bp, Homo sapiens
ccatgtaaaacaaaaaa

SEQ ID NO: 3706752 - DNA, 14 bp, Homo sapiens
ccatgtactgtagt

SEQ ID NO: 3706753 - DNA, 15 bp, Homo sapiens
ccatgtactgtagtt

SEQ ID NO: 3706754 - DNA, 16 bp, Homo sapiens
ccatgtcgcctctgca

SEQ ID NO: 3706755 - DNA, 17 bp, Homo sapiens
ccatgtctgccccatca

SEQ ID NO: 3706756 - DNA, 17 bp, Homo sapiens
ccatgtgtgagtgtgtg

SEQ ID NO: 3706757 - DNA, 15 bp, Homo sapiens
ccatgtgtggactca

SEQ ID NO: 3706758 - DNA, 12 bp, Homo sapiens
ccatgtgtgtgc

SEQ ID NO: 3706759 - DNA, 19 bp, Homo sapiens
ccatgtgtgtgcaagtgtg

SEQ ID NO: 3706760 - DNA, 18 bp, Homo sapiens
ccatgttagtttttactt

SEQ ID NO: 3706761 - DNA, 19 bp, Homo sapiens
ccatgttggccaggctggt

SEQ ID NO: 3706762 - DNA, 21 bp, Homo sapiens
ccatgttggccaggctggtct

SEQ ID NO: 3706763 - DNA, 16 bp, Homo sapiens
ccatgtttaagattta

SEQ ID NO: 3706764 - DNA, 16 bp, Homo sapiens
ccatgtttgagctcag

SEQ ID NO: 3706765 - DNA, 17 bp, Homo sapiens
ccatgtttgagctcaga

SEQ ID NO: 3706766 - DNA, 17 bp, Homo sapiens
ccattcaggaacctgga

SEQ ID NO: 3706767 - DNA, 24 bp, Homo sapiens
ccattcctggagcccgaggcacca

SEQ ID NO: 3706768 - DNA, 16 bp, Homo sapiens
ccattctctctcctgt

SEQ ID NO: 3706769 - DNA, 19 bp, Homo sapiens
ccattctctctcctgtcca

SEQ ID NO: 3706770 - DNA, 20 bp, Homo sapiens
ccattctctctcctgtccaa

SEQ ID NO: 3706771 - DNA, 16 bp, Homo sapiens
ccattctgaccatttc

SEQ ID NO: 3706772 - DNA, 20 bp, Homo sapiens
ccattctgcctccattctga

SEQ ID NO: 3706773 - DNA, 20 bp, Homo sapiens
ccattctgcctgcccaggcc

SEQ ID NO: 3706774 - DNA, 15 bp, Homo sapiens
ccattctttgcttga

SEQ ID NO: 3706775 - DNA, 20 bp, Homo sapiens
ccattctttgcttgaacaca

SEQ ID NO: 3706776 - DNA, 18 bp, Homo sapiens
ccattgcactccagcctg

SEQ ID NO: 3706777 - DNA, 14 bp, Homo sapiens
ccattgctgctcct

SEQ ID NO: 3706778 - DNA, 14 bp, Homo sapiens
ccattgcttcacta

SEQ ID NO: 3706779 - DNA, 12 bp, Homo sapiens
ccattgtcttta

SEQ ID NO: 3706780 - DNA, 22 bp, Homo sapiens
ccattgtctttatatgaacata

SEQ ID NO: 3706781 - DNA, 23 bp, Homo sapiens
ccattgtctttatatgaacatag

SEQ ID NO: 3706782 - DNA, 18 bp, Homo sapiens
ccatttacacttttgaga

SEQ ID NO: 3706783 - DNA, 22 bp, Homo sapiens
ccatttcacacctgaaaatgtt

SEQ ID NO: 3706784 - DNA, 19 bp, Homo sapiens
ccatttctaaaggcctctt

SEQ ID NO: 3706785 - DNA, 13 bp, Homo sapiens
ccatttctattta

SEQ ID NO: 3706786 - DNA, 14 bp, Homo sapiens
ccatttctatttat

SEQ ID NO: 3706787 - DNA, 13 bp, Homo sapiens
ccatttgtaataa

SEQ ID NO: 3706788 - DNA, 19 bp, Homo sapiens
ccattttgcccttccatag

SEQ ID NO: 3706789 - DNA, 21 bp, Homo sapiens
cccaaaaccacagccctgtca

SEQ ID NO: 3706790 - DNA, 15 bp, Homo sapiens
cccaaaatgaagatt

SEQ ID NO: 3706791 - DNA, 13 bp, Homo sapiens
cccaaacctggag

SEQ ID NO: 3706792 - DNA, 15 bp, Homo sapiens
cccaaagagctgcct

SEQ ID NO: 3706793 - DNA, 14 bp, Homo sapiens
ccagacccccagca

SEQ ID NO: 3706794 - DNA, 19 bp, Homo sapiens
ccagacccccagcaaccct

SEQ ID NO: 3706795 - DNA, 22 bp, Homo sapiens
ccagacccccagcaaccctcct

SEQ ID NO: 3706796 - DNA, 18 bp, Homo sapiens
ccagacccctctggccag

SEQ ID NO: 3706797 - DNA, 14 bp, Homo sapiens
ccagacccggctgc

SEQ ID NO: 3706798 - DNA, 16 bp, Homo sapiens
ccagacccggctgcgt

SEQ ID NO: 3706799 - DNA, 17 bp, Homo sapiens
ccagacccggctgcgtg

SEQ ID NO: 3706800 - DNA, 14 bp, Homo sapiens
ccagaccttttatc

SEQ ID NO: 3706801 - DNA, 23 bp, Homo sapiens
ccagacgcacgtgggtcttcagg

SEQ ID NO: 3706802 - DNA, 20 bp, Homo sapiens
ccagacggttcaccagcctc

SEQ ID NO: 3706803 - DNA, 22 bp, Homo sapiens
ccagactgcttccaattttctg

SEQ ID NO: 3706804 - DNA, 12 bp, Homo sapiens
ccagagacagga

SEQ ID NO: 3706805 - DNA, 19 bp, Homo sapiens
ccagagagagaagtgcccc

SEQ ID NO: 3706806 - DNA, 21 bp, Homo sapiens
ccagagagagaagtgcccctg

SEQ ID NO: 3706807 - DNA, 23 bp, Homo sapiens
ccagagagagaagtgcccctgct

SEQ ID NO: 3706808 - DNA, 22 bp, Homo sapiens
ccagagagcctggtgctgctgc

SEQ ID NO: 3706809 - DNA, 14 bp, Homo sapiens
ccagagagggtggt

SEQ ID NO: 3706810 - DNA, 21 bp, Homo sapiens
ccagagagggtggtgacctct

SEQ ID NO: 3706811 - DNA, 22 bp, Homo sapiens
ccagagagtggctcctcccggt

SEQ ID NO: 3706812 - DNA, 15 bp, Homo sapiens
ccagagatgcctcca

SEQ ID NO: 3706813 - DNA, 17 bp, Homo sapiens
ccagagatgcctccacc

SEQ ID NO: 3706814 - DNA, 18 bp, Homo sapiens
ccagagatgcctccaccg

SEQ ID NO: 3706815 - DNA, 20 bp, Homo sapiens
ccagagatgcctccaccgct

SEQ ID NO: 3706816 - DNA, 20 bp, Homo sapiens
ccagagcaagcttttttatt

SEQ ID NO: 3706817 - DNA, 11 bp, Homo sapiens
ccagagcactg

SEQ ID NO: 3706818 - DNA, 12 bp, Homo sapiens
ccagagcactgt

SEQ ID NO: 3706819 - DNA, 15 bp, Homo sapiens
ccagagccatggact

SEQ ID NO: 3706820 - DNA, 19 bp, Homo sapiens
ccagagccccacacggagg

SEQ ID NO: 3706821 - DNA, 15 bp, Homo sapiens
ccagagctcctcctt

SEQ ID NO: 3706822 - DNA, 16 bp, Homo sapiens
ccagagctctggagcc

SEQ ID NO: 3706823 - DNA, 21 bp, Homo sapiens
ccagagctgggtgagtgggga

SEQ ID NO: 3706824 - DNA, 19 bp, Homo sapiens
ccagagctgtttatggcct

SEQ ID NO: 3706825 - DNA, 20 bp, Homo sapiens
ccagagctgtttatggcctc

SEQ ID NO: 3706826 - DNA, 13 bp, Homo sapiens
ccagaggcacagc

SEQ ID NO: 3706827 - DNA, 14 bp, Homo sapiens
ccagaggcacagcc

SEQ ID NO: 3706828 - DNA, 17 bp, Homo sapiens
ccagaggcacagccggg

SEQ ID NO: 3706829 - DNA, 17 bp, Homo sapiens
ccagaggcagaaccctg

SEQ ID NO: 3706830 - DNA, 17 bp, Homo sapiens
ccagagggagtgacaga

SEQ ID NO: 3706831 - DNA, 18 bp, Homo sapiens
ccagagggagtgacagag

SEQ ID NO: 3706832 - DNA, 20 bp, Homo sapiens
ccagagggagtgacagaggc

SEQ ID NO: 3706833 - DNA, 18 bp, Homo sapiens
ccagagggcccaggcagg

SEQ ID NO: 3706834 - DNA, 23 bp, Homo sapiens
ccagaggggtgggttcctcttcc

SEQ ID NO: 3706835 - DNA, 15 bp, Homo sapiens
ccagagtggcctggc

SEQ ID NO: 3706836 - DNA, 19 bp, Homo sapiens
ccagagtggcctggccagg

SEQ ID NO: 3706837 - DNA, 22 bp, Homo sapiens
ccagagtggcctggccaggagc

SEQ ID NO: 3706838 - DNA, 18 bp, Homo sapiens
ccagagtgtgggaaggga

SEQ ID NO: 3706839 - DNA, 14 bp, Homo sapiens
ccagataagaatgc

SEQ ID NO: 3706840 - DNA, 19 bp, Homo sapiens
ccagatattcaagtcacct

SEQ ID NO: 3706841 - DNA, 13 bp, Homo sapiens
ccagatcccagaa

SEQ ID NO: 3706842 - DNA, 18 bp, Homo sapiens
ccagatcccagaaggacc

SEQ ID NO: 3706843 - DNA, 14 bp, Homo sapiens
ccagatctgcaccg

SEQ ID NO: 3706844 - DNA, 15 bp, Homo sapiens
ccagatgcaccagcc

SEQ ID NO: 3706845 - DNA, 14 bp, Homo sapiens
ccagattgcaacag

SEQ ID NO: 3706846 - DNA, 24 bp, Homo sapiens
ccagattttttacagctgcctgca

SEQ ID NO: 3706847 - DNA, 18 bp, Homo sapiens
ccagcaacttgtcttttt

SEQ ID NO: 3706848 - DNA, 16 bp, Homo sapiens
ccagcaaggtggagtg

SEQ ID NO: 3706849 - DNA, 18 bp, Homo sapiens
ccagcaaggtggagtgga

SEQ ID NO: 3706850 - DNA, 15 bp, Homo sapiens
ccagcaagtgagagc

SEQ ID NO: 3706851 - DNA, 21 bp, Homo sapiens
ccagcaagtgagagctgggtg

SEQ ID NO: 3706852 - DNA, 22 bp, Homo sapiens
ccagcaagtgagagctgggtgt

SEQ ID NO: 3706853 - DNA, 16 bp, Homo sapiens
ccagcacccccacgcc

SEQ ID NO: 3706854 - DNA, 16 bp, Homo sapiens
ccagcactttgggagg

SEQ ID NO: 3706855 - DNA, 17 bp, Homo sapiens
ccagcactttgggaggc

SEQ ID NO: 3706856 - DNA, 16 bp, Homo sapiens
cattactcttgtaaga

SEQ ID NO: 3706857 - DNA, 17 bp, Homo sapiens
cattagaaatagacagt

SEQ ID NO: 3706858 - DNA, 18 bp, Homo sapiens
cattagcagtttgctttg

SEQ ID NO: 3706859 - DNA, 13 bp, Homo sapiens
cattatattgcaa

SEQ ID NO: 3706860 - DNA, 17 bp, Homo sapiens
cattatcgggagcagtg

SEQ ID NO: 3706861 - DNA, 22 bp, Homo sapiens
cattatgagaggcaatgattgt

SEQ ID NO: 3706862 - DNA, 21 bp, Homo sapiens
cattatgatgtgggtcaagga

SEQ ID NO: 3706863 - DNA, 13 bp, Homo sapiens
cattatgattctt

SEQ ID NO: 3706864 - DNA, 17 bp, Homo sapiens
cattcaaaagttgaaat

SEQ ID NO: 3706865 - DNA, 20 bp, Homo sapiens
cattcaatttattcaagaaa

SEQ ID NO: 3706866 - DNA, 21 bp, Homo sapiens
cattcaatttattcaagaaaa

SEQ ID NO: 3706867 - DNA, 13 bp, Homo sapiens
cattcacccagac

SEQ ID NO: 3706868 - DNA, 15 bp, Homo sapiens
cattcacttgcattt

SEQ ID NO: 3706869 - DNA, 19 bp, Homo sapiens
cattcaggaacctggacca

SEQ ID NO: 3706870 - DNA, 14 bp, Homo sapiens
cattccaagcctga

SEQ ID NO: 3706871 - DNA, 17 bp, Homo sapiens
cattccaccttcccatg

SEQ ID NO: 3706872 - DNA, 13 bp, Homo sapiens
cattccaggctcc

SEQ ID NO: 3706873 - DNA, 16 bp, Homo sapiens
cattccatgtgcccag

SEQ ID NO: 3706874 - DNA, 17 bp, Homo sapiens
cattccatgtgcccagt

SEQ ID NO: 3706875 - DNA, 21 bp, Homo sapiens
cattccatgtgcccagttaat

SEQ ID NO: 3706876 - DNA, 15 bp, Homo sapiens
cattccccagcctct

SEQ ID NO: 3706877 - DNA, 13 bp, Homo sapiens
cattccccaggtg

SEQ ID NO: 3706878 - DNA, 20 bp, Homo sapiens
cattccctgagtcaccagga

SEQ ID NO: 3706879 - DNA, 20 bp, Homo sapiens
cattcctaacacagcatgtg

SEQ ID NO: 3706880 - DNA, 23 bp, Homo sapiens
cattcctcagggacagagacacc

SEQ ID NO: 3706881 - DNA, 16 bp, Homo sapiens
cattcctgcctgtctc

SEQ ID NO: 3706882 - DNA, 16 bp, Homo sapiens
cattcctggagcccga

SEQ ID NO: 3706883 - DNA, 16 bp, Homo sapiens
cattcgatctcattca

SEQ ID NO: 3706884 - DNA, 23 bp, Homo sapiens
cattctaggtaggggcccacttc

SEQ ID NO: 3706885 - DNA, 12 bp, Homo sapiens
cattctctctcc

SEQ ID NO: 3706886 - DNA, 12 bp, Homo sapiens
cattctgcctgc

SEQ ID NO: 3706887 - DNA, 17 bp, Homo sapiens
cattcttgaaagctgtg

SEQ ID NO: 3706888 - DNA, 21 bp, Homo sapiens
cattctttgcttgaacacagt

SEQ ID NO: 3706889 - DNA, 16 bp, Homo sapiens
cattgaaaatgtaagt

SEQ ID NO: 3706890 - DNA, 17 bp, Homo sapiens
ccaccaggtctcccggg

SEQ ID NO: 3706891 - DNA, 18 bp, Homo sapiens
ccaccaggtctcccggga

SEQ ID NO: 3706892 - DNA, 18 bp, Homo sapiens
ccaccatcaccagacagg

SEQ ID NO: 3706893 - DNA, 15 bp, Homo sapiens
ccaccatgcccagct

SEQ ID NO: 3706894 - DNA, 21 bp, Homo sapiens
ccaccatggccagccaacttt

SEQ ID NO: 3706895 - DNA, 23 bp, Homo sapiens
ccaccatggctaaggcaccagcc

SEQ ID NO: 3706896 - DNA, 14 bp, Homo sapiens
ccaccatgtctgcc

SEQ ID NO: 3706897 - DNA, 13 bp, Homo sapiens
ccacccacctcag

SEQ ID NO: 3706898 - DNA, 15 bp, Homo sapiens
ccacccacctcagcc

SEQ ID NO: 3706899 - DNA, 16 bp, Homo sapiens
ccacccacctcagcct

SEQ ID NO: 3706900 - DNA, 12 bp, Homo sapiens
ccacccagccca

SEQ ID NO: 3706901 - DNA, 17 bp, Homo sapiens
ccacccaggagggaggg

SEQ ID NO: 3706902 - DNA, 23 bp, Homo sapiens
ccacccaggggaatgatctctga

SEQ ID NO: 3706903 - DNA, 19 bp, Homo sapiens
ccaccccagaaatggtgaa

SEQ ID NO: 3706904 - DNA, 13 bp, Homo sapiens
ccaccccagctgc

SEQ ID NO: 3706905 - DNA, 22 bp, Homo sapiens
ccaccccagtgcacccactctg

SEQ ID NO: 3706906 - DNA, 16 bp, Homo sapiens
ccaccccctccccagg

SEQ ID NO: 3706907 - DNA, 22 bp, Homo sapiens
ccaccccctccctggcctgttc

SEQ ID NO: 3706908 - DNA, 17 bp, Homo sapiens
ccacccccttcagtgcc

SEQ ID NO: 3706909 - DNA, 20 bp, Homo sapiens
ccacccccttcagtgcccac

SEQ ID NO: 3706910 - DNA, 19 bp, Homo sapiens
ccacccccttctctgctcc

SEQ ID NO: 3706911 - DNA, 17 bp, Homo sapiens
ccaccccgggctctctg

SEQ ID NO: 3706912 - DNA, 18 bp, Homo sapiens
ccaccctgaaagccctga

SEQ ID NO: 3706913 - DNA, 17 bp, Homo sapiens
ccacccttggcctgtct

SEQ ID NO: 3706914 - DNA, 19 bp, Homo sapiens
ccacccttggcctgtctca

SEQ ID NO: 3706915 - DNA, 14 bp, Homo sapiens
ccaccgctccccag

SEQ ID NO: 3706916 - DNA, 15 bp, Homo sapiens
ccaccgctccccagc

SEQ ID NO: 3706917 - DNA, 17 bp, Homo sapiens
ccaccgctccccagccc

SEQ ID NO: 3706918 - DNA, 21 bp, Homo sapiens
ccaccgctccccagcccaggg

SEQ ID NO: 3706919 - DNA, 14 bp, Homo sapiens
ccaccgctgccagc

SEQ ID NO: 3706920 - DNA, 13 bp, Homo sapiens
ccaccgctgccta

SEQ ID NO: 3706921 - DNA, 16 bp, Homo sapiens
ccacctaggccactcc

SEQ ID NO: 3706922 - DNA, 12 bp, Homo sapiens
ccacctcagcct

SEQ ID NO: 3706923 - DNA, 14 bp, Homo sapiens
ccacctcagccttg

SEQ ID NO: 3706924 - DNA, 15 bp, Homo sapiens
ccacctcagccttgg

SEQ ID NO: 3706925 - DNA, 16 bp, Homo sapiens
ccacctccccaggccg

SEQ ID NO: 3706926 - DNA, 14 bp, Homo sapiens
ccacctgcccaacc

SEQ ID NO: 3706927 - DNA, 23 bp, Homo sapiens
ccacctgctgagagacccaagga

SEQ ID NO: 3706928 - DNA, 12 bp, Homo sapiens
ccacctggcccc

SEQ ID NO: 3706929 - DNA, 16 bp, Homo sapiens
ccacctggggcagtca

SEQ ID NO: 3706930 - DNA, 22 bp, Homo sapiens
ccacctgtcaaacaaagccaga

SEQ ID NO: 3706931 - DNA, 11 bp, Homo sapiens
ccacctgtctc

SEQ ID NO: 3706932 - DNA, 12 bp, Homo sapiens
ccacctgtctca

SEQ ID NO: 3706933 - DNA, 15 bp, Homo sapiens
ccacctgtctcagcc

SEQ ID NO: 3706934 - DNA, 15 bp, Homo sapiens
ccaccttaaattaaa

SEQ ID NO: 3706935 - DNA, 22 bp, Homo sapiens
ccaccttaaattaaacaattta

SEQ ID NO: 3706936 - DNA, 17 bp, Homo sapiens
ccaccttcaattcctgg

SEQ ID NO: 3706937 - DNA, 11 bp, Homo sapiens
ccaccttccca

SEQ ID NO: 3706938 - DNA, 16 bp, Homo sapiens
ccaccttggctcaagt

SEQ ID NO: 3706939 - DNA, 15 bp, Homo sapiens
ccaccttggctgcag

SEQ ID NO: 3706940 - DNA, 17 bp, Homo sapiens
ccacctttattaaaatc

SEQ ID NO: 3706941 - DNA, 18 bp, Homo sapiens
ccacgatgtggccctggc

SEQ ID NO: 3706942 - DNA, 17 bp, Homo sapiens
ccacgcctgtaatccca

SEQ ID NO: 3706943 - DNA, 16 bp, Homo sapiens
ccacgctggagtgcag

SEQ ID NO: 3706944 - DNA, 18 bp, Homo sapiens
ccacgctgtctccagacc

SEQ ID NO: 3706945 - DNA, 16 bp, Homo sapiens
ccacggccaggccaga

SEQ ID NO: 3706946 - DNA, 16 bp, Homo sapiens
ccacgtactgcagcct

SEQ ID NO: 3706947 - DNA, 20 bp, Homo sapiens
ccacgtctgctaacttggag

SEQ ID NO: 3706948 - DNA, 16 bp, Homo sapiens
ccacgtgccaggcccg

SEQ ID NO: 3706949 - DNA, 14 bp, Homo sapiens
ccacgttcacccct

SEQ ID NO: 3706950 - DNA, 20 bp, Homo sapiens
ccacgttccttactgcagaa

SEQ ID NO: 3706951 - DNA, 18 bp, Homo sapiens
ccactaggactctgaggc

SEQ ID NO: 3706952 - DNA, 21 bp, Homo sapiens
ccactatggtcatctttttct

SEQ ID NO: 3706953 - DNA, 12 bp, Homo sapiens
ccactcaagcca

SEQ ID NO: 3706954 - DNA, 16 bp, Homo sapiens
ccactcaagccaagca

SEQ ID NO: 3706955 - DNA, 21 bp, Homo sapiens
ccactccagacccctggcttt

SEQ ID NO: 3706956 - DNA, 22 bp, Homo sapiens
ccactccagacccctggctttt

SEQ ID NO: 3706957 - DNA, 12 bp, Homo sapiens
ccactccttcct

SEQ ID NO: 3706958 - DNA, 17 bp, Homo sapiens
ccaacatcccattgccc

SEQ ID NO: 3706959 - DNA, 17 bp, Homo sapiens
ccaacccaaacctggag

SEQ ID NO: 3706960 - DNA, 19 bp, Homo sapiens
ccaacccaaacctggagat

SEQ ID NO: 3706961 - DNA, 18 bp, Homo sapiens
ccaaccccccacctgcca

SEQ ID NO: 3706962 - DNA, 15 bp, Homo sapiens
ccaacccctgtggag

SEQ ID NO: 3706963 - DNA, 16 bp, Homo sapiens
ccaaccctgcccctgc

SEQ ID NO: 3706964 - DNA, 13 bp, Homo sapiens
ccaacctgaccaa

SEQ ID NO: 3706965 - DNA, 13 bp, Homo sapiens
ccaacctggacaa

SEQ ID NO: 3706966 - DNA, 19 bp, Homo sapiens
ccaaccttacttacagcat

SEQ ID NO: 3706967 - DNA, 15 bp, Homo sapiens
ccaacgaaaagcaca

SEQ ID NO: 3706968 - DNA, 15 bp, Homo sapiens
ccaacgtggggcagc

SEQ ID NO: 3706969 - DNA, 20 bp, Homo sapiens
ccaactccagtactggagct

SEQ ID NO: 3706970 - DNA, 19 bp, Homo sapiens
ccaactcctggaagctgtg

SEQ ID NO: 3706971 - DNA, 22 bp, Homo sapiens
ccaactcctggaagctgtgtcc

SEQ ID NO: 3706972 - DNA, 14 bp, Homo sapiens
ccaactgctgcccc

SEQ ID NO: 3706973 - DNA, 15 bp, Homo sapiens
ccaactggaagcaca

SEQ ID NO: 3706974 - DNA, 16 bp, Homo sapiens
ccaactggaagcacag

SEQ ID NO: 3706975 - DNA, 21 bp, Homo sapiens
ccaacttcatttgatgctaaa

SEQ ID NO: 3706976 - DNA, 13 bp, Homo sapiens
ccaacttcccagt

SEQ ID NO: 3706977 - DNA, 16 bp, Homo sapiens
ccaagaactgaaaaca

SEQ ID NO: 3706978 - DNA, 17 bp, Homo sapiens
ccaagaactgaaaacat

SEQ ID NO: 3706979 - DNA, 15 bp, Homo sapiens
ccaagaactgcatgg

SEQ ID NO: 3706980 - DNA, 19 bp, Homo sapiens
ccaagacagatgccccaga

SEQ ID NO: 3706981 - DNA, 21 bp, Homo sapiens
ccaagacagatgccccagagc

SEQ ID NO: 3706982 - DNA, 12 bp, Homo sapiens
ccaagacattgt

SEQ ID NO: 3706983 - DNA, 21 bp, Homo sapiens
ccaagacttggtgtcctttcc

SEQ ID NO: 3706984 - DNA, 22 bp, Homo sapiens
ccaagagctgaggcaattctaa

SEQ ID NO: 3706985 - DNA, 21 bp, Homo sapiens
ccaagattgcgccattgcact

SEQ ID NO: 3706986 - DNA, 14 bp, Homo sapiens
ccaagcaaatgtta

SEQ ID NO: 3706987 - DNA, 22 bp, Homo sapiens
ccaagcaagtagctttccacat

SEQ ID NO: 3706988 - DNA, 16 bp, Homo sapiens
ccaagcagccaagctc

SEQ ID NO: 3706989 - DNA, 12 bp, Homo sapiens
ccaagcaggaag

SEQ ID NO: 3706990 - DNA, 18 bp, Homo sapiens
ccaagcaggaagctcaga

SEQ ID NO: 3706991 - DNA, 20 bp, Homo sapiens
ccaagcaggaagctcagact

SEQ ID NO: 3706992 - DNA, 23 bp, Homo sapiens
ccaagccagggatggggccacag

SEQ ID NO: 3706993 - DNA, 15 bp, Homo sapiens
ccaagccgtggcttc

SEQ ID NO: 3706994 - DNA, 16 bp, Homo sapiens
ccaagccgtggcttcc

SEQ ID NO: 3706995 - DNA, 17 bp, Homo sapiens
ccaagctcacagttcct

SEQ ID NO: 3706996 - DNA, 15 bp, Homo sapiens
ccaagctctgctcct

SEQ ID NO: 3706997 - DNA, 16 bp, Homo sapiens
ccaagctctgctcctc

SEQ ID NO: 3706998 - DNA, 18 bp, Homo sapiens
ccaagctctgctcctctc

SEQ ID NO: 3706999 - DNA, 14 bp, Homo sapiens
ccaaggacccctca

SEQ ID NO: 3707000 - DNA, 18 bp, Homo sapiens
ccaaggacccctcacctt

SEQ ID NO: 3707001 - DNA, 11 bp, Homo sapiens
ccaaggactgc

SEQ ID NO: 3707002 - DNA, 13 bp, Homo sapiens
ccaaggactgccg

SEQ ID NO: 3707003 - DNA, 15 bp, Homo sapiens
ccaaggactgccgac

SEQ ID NO: 3707004 - DNA, 14 bp, Homo sapiens
ccaaggagaaacag

SEQ ID NO: 3707005 - DNA, 13 bp, Homo sapiens
ccaaggagaccaa

SEQ ID NO: 3707006 - DNA, 14 bp, Homo sapiens
ccaaggagatgaag

SEQ ID NO: 3707007 - DNA, 16 bp, Homo sapiens
ccaaggctctgagcaa

SEQ ID NO: 3707008 - DNA, 15 bp, Homo sapiens
ccaaggggcagtctg

SEQ ID NO: 3707009 - DNA, 19 bp, Homo sapiens
ccaagtgcaggctggcacc

SEQ ID NO: 3707010 - DNA, 16 bp, Homo sapiens
ccaagtgccagtcttg

SEQ ID NO: 3707011 - DNA, 16 bp, Homo sapiens
ccaagtggctcccaca

SEQ ID NO: 3707012 - DNA, 17 bp, Homo sapiens
ccaagtgtgtgtgcgtg

SEQ ID NO: 3707013 - DNA, 14 bp, Homo sapiens
ccaagttatataaa

SEQ ID NO: 3707014 - DNA, 22 bp, Homo sapiens
ccaagttatataaagagaaaat

SEQ ID NO: 3707015 - DNA, 22 bp, Homo sapiens
ccaataaatgtgaaattctgtc

SEQ ID NO: 3707016 - DNA, 19 bp, Homo sapiens
ccaatagcactttcattgc

SEQ ID NO: 3707017 - DNA, 17 bp, Homo sapiens
ccaatcaagataaagga

SEQ ID NO: 3707018 - DNA, 12 bp, Homo sapiens
ccaatcatttta

SEQ ID NO: 3707019 - DNA, 19 bp, Homo sapiens
ccaatgaggtctgaaatgg

SEQ ID NO: 3707020 - DNA, 18 bp, Homo sapiens
ccaatgccccactggcag

SEQ ID NO: 3707021 - DNA, 20 bp, Homo sapiens
ccaatggagtagacccctgg

SEQ ID NO: 3707022 - DNA, 14 bp, Homo sapiens
ccaatgtttaaaaa

SEQ ID NO: 3707023 - DNA, 15 bp, Homo sapiens
ccaattaaccagaaa

SEQ ID NO: 3707024 - DNA, 20 bp, Homo sapiens
ccaatttgtaaaaacagcat

SEQ ID NO: 3707025 - DNA, 22 bp, Homo sapiens
ccacaaatgggaaaaccagact

SEQ ID NO: 3707026 - DNA, 16 bp, Homo sapiens
ccacaagattcccaga

SEQ ID NO: 3707027 - DNA, 20 bp, Homo sapiens
ccacaagattcccagagaca

SEQ ID NO: 3707028 - DNA, 15 bp, Homo sapiens
ccacaagttaaataa

SEQ ID NO: 3707029 - DNA, 20 bp, Homo sapiens
ccacaagttaaataaatcat

SEQ ID NO: 3707030 - DNA, 16 bp, Homo sapiens
ccacacacagaggaag

SEQ ID NO: 3707031 - DNA, 18 bp, Homo sapiens
ccacacacagaggaagag

SEQ ID NO: 3707032 - DNA, 22 bp, Homo sapiens
ccacacacagaggaagagcagg

SEQ ID NO: 3707033 - DNA, 15 bp, Homo sapiens
ccacaccctctccca

SEQ ID NO: 3707034 - DNA, 18 bp, Homo sapiens
ccacaccctctcccagga

SEQ ID NO: 3707035 - DNA, 14 bp, Homo sapiens
ccacaccgcagaag

SEQ ID NO: 3707036 - DNA, 18 bp, Homo sapiens
ccacacctggccctgggg

SEQ ID NO: 3707037 - DNA, 16 bp, Homo sapiens
ccacactaacctgggt

SEQ ID NO: 3707038 - DNA, 16 bp, Homo sapiens
ccacacttcaggctct

SEQ ID NO: 3707039 - DNA, 12 bp, Homo sapiens
ccacacttcctg

SEQ ID NO: 3707040 - DNA, 18 bp, Homo sapiens
ccacacttcctgtccaga

SEQ ID NO: 3707041 - DNA, 20 bp, Homo sapiens
ccacacttgttccagctctt

SEQ ID NO: 3707042 - DNA, 13 bp, Homo sapiens
ccacagaaagaga

SEQ ID NO: 3707043 - DNA, 20 bp, Homo sapiens
ccacagaagacttcccagct

SEQ ID NO: 3707044 - DNA, 21 bp, Homo sapiens
ccacagcccaggcctccagct

SEQ ID NO: 3707045 - DNA, 21 bp, Homo sapiens
ccacagccctgtcagtgcagc

SEQ ID NO: 3707046 - DNA, 13 bp, Homo sapiens
ccacagctcccac

SEQ ID NO: 3707047 - DNA, 19 bp, Homo sapiens
ccacagctcccaccccacc

SEQ ID NO: 3707048 - DNA, 17 bp, Homo sapiens
ccacagcttcccctctc

SEQ ID NO: 3707049 - DNA, 16 bp, Homo sapiens
ccacaggatcagtctg

SEQ ID NO: 3707050 - DNA, 16 bp, Homo sapiens
ccacaggcccttcctc

SEQ ID NO: 3707051 - DNA, 19 bp, Homo sapiens
ccacaggcccttcctctcc

SEQ ID NO: 3707052 - DNA, 20 bp, Homo sapiens
ccacagggctaagagctagc

SEQ ID NO: 3707053 - DNA, 18 bp, Homo sapiens
ccacagggttcaaaatgt

SEQ ID NO: 3707054 - DNA, 21 bp, Homo sapiens
ccacaggtgtccccagcccac

SEQ ID NO: 3707055 - DNA, 23 bp, Homo sapiens
ccacatagactttatgcaataaa

SEQ ID NO: 3707056 - DNA, 19 bp, Homo sapiens
ccacatagtgatggttccc

SEQ ID NO: 3707057 - DNA, 23 bp, Homo sapiens
ccacatagtgatggttcccctgt

SEQ ID NO: 3707058 - DNA, 23 bp, Homo sapiens
ccacatccccgctggctgggggc

SEQ ID NO: 3707059 - DNA, 20 bp, Homo sapiens
ccacatcctccgtccagccg

SEQ ID NO: 3707060 - DNA, 17 bp, Homo sapiens
ccacatcttgctctgct

SEQ ID NO: 3707061 - DNA, 19 bp, Homo sapiens
ccacatcttgctctgctga

SEQ ID NO: 3707062 - DNA, 22 bp, Homo sapiens
ccacatcttgctctgctgacag

SEQ ID NO: 3707063 - DNA, 12 bp, Homo sapiens
ccaccaacccat

SEQ ID NO: 3707064 - DNA, 21 bp, Homo sapiens
ccaccaacccatcagaaggag

SEQ ID NO: 3707065 - DNA, 16 bp, Homo sapiens
ccaccacacccagccc

SEQ ID NO: 3707066 - DNA, 14 bp, Homo sapiens
ccaccaccccagct

SEQ ID NO: 3707067 - DNA, 20 bp, Homo sapiens
ccaccacctaggccactcct

SEQ ID NO: 3707068 - DNA, 19 bp, Homo sapiens
ccaccacgatgtggccctg

SEQ ID NO: 3707069 - DNA, 21 bp, Homo sapiens
ccaccacgatgtggccctggc

SEQ ID NO: 3707070 - DNA, 11 bp, Homo sapiens
ccaccagcctg

SEQ ID NO: 3707071 - DNA, 20 bp, Homo sapiens
ccaccaggctgctcagggct

SEQ ID NO: 3707072 - DNA, 13 bp, Homo sapiens
ccaccaggtctcc

SEQ ID NO: 3707073 - DNA, 15 bp, Homo sapiens
ccccactctcattcc

SEQ ID NO: 3707074 - DNA, 21 bp, Homo sapiens
ccccactgacagcctcccacc

SEQ ID NO: 3707075 - DNA, 12 bp, Homo sapiens
ccccactgcagg

SEQ ID NO: 3707076 - DNA, 16 bp, Homo sapiens
ccccactgcaggcccc

SEQ ID NO: 3707077 - DNA, 18 bp, Homo sapiens
ccccactgcaggccccgc

SEQ ID NO: 3707078 - DNA, 12 bp, Homo sapiens
ccccactgcctg

SEQ ID NO: 3707079 - DNA, 15 bp, Homo sapiens
ccccactgcctgccc

SEQ ID NO: 3707080 - DNA, 17 bp, Homo sapiens
ccccactgcctgcccac

SEQ ID NO: 3707081 - DNA, 21 bp, Homo sapiens
ccccactggctgtgggctccc

SEQ ID NO: 3707082 - DNA, 15 bp, Homo sapiens
ccccagacctgagct

SEQ ID NO: 3707083 - DNA, 11 bp, Homo sapiens
ccccagagctg

SEQ ID NO: 3707084 - DNA, 22 bp, Homo sapiens
ccccagattgcaacaggctggg

SEQ ID NO: 3707085 - DNA, 23 bp, Homo sapiens
ccccagattgcaacaggctgggc

SEQ ID NO: 3707086 - DNA, 19 bp, Homo sapiens
ccccagcaagtgagagctg

SEQ ID NO: 3707087 - DNA, 20 bp, Homo sapiens
ccccagcaagtgagagctgg

SEQ ID NO: 3707088 - DNA, 11 bp, Homo sapiens
ccccagcacta

SEQ ID NO: 3707089 - DNA, 11 bp, Homo sapiens
ccccagcccac

SEQ ID NO: 3707090 - DNA, 12 bp, Homo sapiens
ccccagccctgt

SEQ ID NO: 3707091 - DNA, 21 bp, Homo sapiens
ccccagcctaagatgaagagg

SEQ ID NO: 3707092 - DNA, 13 bp, Homo sapiens
ccccagcctctct

SEQ ID NO: 3707093 - DNA, 22 bp, Homo sapiens
ccccaggggtcccagccacccc

SEQ ID NO: 3707094 - DNA, 16 bp, Homo sapiens
ccccagggtcttccct

SEQ ID NO: 3707095 - DNA, 19 bp, Homo sapiens
ccccagggtcttccctacc

SEQ ID NO: 3707096 - DNA, 18 bp, Homo sapiens
ccccagtaagccactgcc

SEQ ID NO: 3707097 - DNA, 14 bp, Homo sapiens
ccccagtacctcca

SEQ ID NO: 3707098 - DNA, 18 bp, Homo sapiens
ccccagtacctccaagca

SEQ ID NO: 3707099 - DNA, 23 bp, Homo sapiens
ccccagtttgcagaaaagcacct

SEQ ID NO: 3707100 - DNA, 15 bp, Homo sapiens
ccccatactctgtct

SEQ ID NO: 3707101 - DNA, 14 bp, Homo sapiens
ccccatagccaccc

SEQ ID NO: 3707102 - DNA, 18 bp, Homo sapiens
ccccatcctccccttccc

SEQ ID NO: 3707103 - DNA, 19 bp, Homo sapiens
ccccatcctccccttccct

SEQ ID NO: 3707104 - DNA, 22 bp, Homo sapiens
ccccatgccaaagctagggtgg

SEQ ID NO: 3707105 - DNA, 13 bp, Homo sapiens
ccccatgcctgtc

SEQ ID NO: 3707106 - DNA, 17 bp, Homo sapiens
ccccatgcctgtccagc

SEQ ID NO: 3707107 - DNA, 19 bp, Homo sapiens
ccccatgcctgtccagcct

SEQ ID NO: 3707108 - DNA, 22 bp, Homo sapiens
ccccatgcctgtccagcctggg

SEQ ID NO: 3707109 - DNA, 24 bp, Homo sapiens
ccccatgcctgtccagcctgggca

SEQ ID NO: 3707110 - DNA, 21 bp, Homo sapiens
ccccattctttgcttgaacac

SEQ ID NO: 3707111 - DNA, 19 bp, Homo sapiens
cccccaagctgttttcttc

SEQ ID NO: 3707112 - DNA, 17 bp, Homo sapiens
cccccacacctcagttc

SEQ ID NO: 3707113 - DNA, 17 bp, Homo sapiens
cccccaccccttcccca

SEQ ID NO: 3707114 - DNA, 14 bp, Homo sapiens
cccccactgcaggc

SEQ ID NO: 3707115 - DNA, 14 bp, Homo sapiens
cccccactggctgt

SEQ ID NO: 3707116 - DNA, 22 bp, Homo sapiens
cccccagaacctgtccttgcac

SEQ ID NO: 3707117 - DNA, 11 bp, Homo sapiens
cccccagctgt

SEQ ID NO: 3707118 - DNA, 11 bp, Homo sapiens
cccccagtgtg

SEQ ID NO: 3707119 - DNA, 18 bp, Homo sapiens
ccccccagaacctgtcct

SEQ ID NO: 3707120 - DNA, 24 bp, Homo sapiens
cccccgggtttggcgggccaagga

SEQ ID NO: 3707121 - DNA, 13 bp, Homo sapiens
ccccctccccagg

SEQ ID NO: 3707122 - DNA, 14 bp, Homo sapiens
ccccctccctggcc

SEQ ID NO: 3707123 - DNA, 18 bp, Homo sapiens
ccccctgtagactagtgc

SEQ ID NO: 3707124 - DNA, 14 bp, Homo sapiens
cccccttcagtgcc

SEQ ID NO: 3707125 - DNA, 15 bp, Homo sapiens
cccccttctcccaca

SEQ ID NO: 3707126 - DNA, 13 bp, Homo sapiens
ccccgagctgggg

SEQ ID NO: 3707127 - DNA, 13 bp, Homo sapiens
ccccgccccacat

SEQ ID NO: 3707128 - DNA, 13 bp, Homo sapiens
ccccgccccgccc

SEQ ID NO: 3707129 - DNA, 16 bp, Homo sapiens
ccccgctcatgggccc

SEQ ID NO: 3707130 - DNA, 19 bp, Homo sapiens
ccccgggtttggcgggcca

SEQ ID NO: 3707131 - DNA, 21 bp, Homo sapiens
ccccgtcaccatctcaggcca

SEQ ID NO: 3707132 - DNA, 17 bp, Homo sapiens
ccccgtgggccatggca

SEQ ID NO: 3707133 - DNA, 14 bp, Homo sapiens
cccctatccaccca

SEQ ID NO: 3707134 - DNA, 18 bp, Homo sapiens
cccctcaggaccctcgct

SEQ ID NO: 3707135 - DNA, 19 bp, Homo sapiens
cccctcaggaccctcgctg

SEQ ID NO: 3707136 - DNA, 14 bp, Homo sapiens
cccctccctacctc

SEQ ID NO: 3707137 - DNA, 15 bp, Homo sapiens
cccctccctggcctg

SEQ ID NO: 3707138 - DNA, 15 bp, Homo sapiens
cccctccttccttga

SEQ ID NO: 3707139 - DNA, 17 bp, Homo sapiens
cccctccttccttgacc

SEQ ID NO: 3707140 - DNA, 20 bp, Homo sapiens
cccctccttccttgaccagc

SEQ ID NO: 3707141 - DNA, 13 bp, Homo sapiens
cccctctgctggc

SEQ ID NO: 3707142 - DNA, 14 bp, Homo sapiens
cccctctgctggcc

SEQ ID NO: 3707143 - DNA, 12 bp, Homo sapiens
cccctcttgccc

SEQ ID NO: 3707144 - DNA, 16 bp, Homo sapiens
cccctgccaccctggg

SEQ ID NO: 3707145 - DNA, 14 bp, Homo sapiens
cccctgccagtgcc

SEQ ID NO: 3707146 - DNA, 17 bp, Homo sapiens
cccctgccagtgcctta

SEQ ID NO: 3707147 - DNA, 19 bp, Homo sapiens
cccctgcccggctgcggaa

SEQ ID NO: 3707148 - DNA, 17 bp, Homo sapiens
cccctgccctggtccag

SEQ ID NO: 3707149 - DNA, 12 bp, Homo sapiens
cccctgctgcct

SEQ ID NO: 3707150 - DNA, 11 bp, Homo sapiens
cccctgctggt

SEQ ID NO: 3707151 - DNA, 20 bp, Homo sapiens
cccctgctggttcagggttg

SEQ ID NO: 3707152 - DNA, 23 bp, Homo sapiens
cccctgggctctgccccagctct

SEQ ID NO: 3707153 - DNA, 15 bp, Homo sapiens
cccctggtggacagt

SEQ ID NO: 3707154 - DNA, 21 bp, Homo sapiens
cccctggtggacagtcctggg

SEQ ID NO: 3707155 - DNA, 20 bp, Homo sapiens
ccccttagccagttgtatat

SEQ ID NO: 3707156 - DNA, 17 bp, Homo sapiens
ccccttcacttctgacc

SEQ ID NO: 3707157 - DNA, 19 bp, Homo sapiens
ccccttcacttctgaccac

SEQ ID NO: 3707158 - DNA, 23 bp, Homo sapiens
ccccttcacttctgaccacactt

SEQ ID NO: 3707159 - DNA, 16 bp, Homo sapiens
ccccttcatcctctga

SEQ ID NO: 3707160 - DNA, 23 bp, Homo sapiens
ccccttccccactgcctgcccac

SEQ ID NO: 3707161 - DNA, 13 bp, Homo sapiens
ccccttccctgca

SEQ ID NO: 3707162 - DNA, 17 bp, Homo sapiens
ccccttcgctcctgtgt

SEQ ID NO: 3707163 - DNA, 19 bp, Homo sapiens
ccccttcgctcctgtgtct

SEQ ID NO: 3707164 - DNA, 16 bp, Homo sapiens
ccccttctcccacact

SEQ ID NO: 3707165 - DNA, 16 bp, Homo sapiens
ccccttctctgctcca

SEQ ID NO: 3707166 - DNA, 20 bp, Homo sapiens
ccccttgcccagggctcagc

SEQ ID NO: 3707167 - DNA, 21 bp, Homo sapiens
ccccttgcccagggctcagcc

SEQ ID NO: 3707168 - DNA, 17 bp, Homo sapiens
cccctttttcttcctca

SEQ ID NO: 3707169 - DNA, 18 bp, Homo sapiens
cccgaatagctgggacta

SEQ ID NO: 3707170 - DNA, 12 bp, Homo sapiens
cccgacagaggg

SEQ ID NO: 3707171 - DNA, 14 bp, Homo sapiens
cccgacagcctggc

SEQ ID NO: 3707172 - DNA, 15 bp, Homo sapiens
cccgacagcctggca

SEQ ID NO: 3707173 - DNA, 18 bp, Homo sapiens
cccgacagcctggcacag

SEQ ID NO: 3707174 - DNA, 20 bp, Homo sapiens
cccgacatggacccggagct

SEQ ID NO: 3707175 - DNA, 23 bp, Homo sapiens
cccgacatggacccggagctaac

SEQ ID NO: 3707176 - DNA, 12 bp, Homo sapiens
cccgactcctca

SEQ ID NO: 3707177 - DNA, 14 bp, Homo sapiens
cccgactcctcaaa

SEQ ID NO: 3707178 - DNA, 20 bp, Homo sapiens
cccgagctgggggccatgag

SEQ ID NO: 3707179 - DNA, 13 bp, Homo sapiens
cccgaggcccgca

SEQ ID NO: 3707180 - DNA, 15 bp, Homo sapiens
cccgaggcccgcatg

SEQ ID NO: 3707181 - DNA, 15 bp, Homo sapiens
cccgaggccttctct

SEQ ID NO: 3707182 - DNA, 21 bp, Homo sapiens
cccgaggccttctctgaagga

SEQ ID NO: 3707183 - DNA, 15 bp, Homo sapiens
cccgagtagctggga

SEQ ID NO: 3707184 - DNA, 17 bp, Homo sapiens
cccgagtagctgggact

SEQ ID NO: 3707185 - DNA, 18 bp, Homo sapiens
cccgagtagctgggacta

SEQ ID NO: 3707186 - DNA, 22 bp, Homo sapiens
cccgagtagctgggactacagg

SEQ ID NO: 3707187 - DNA, 13 bp, Homo sapiens
cccgcacccccac

SEQ ID NO: 3707188 - DNA, 15 bp, Homo sapiens
cccgccccacattcc

SEQ ID NO: 3707189 - DNA, 20 bp, Homo sapiens
cccagcctccaagctccatc

SEQ ID NO: 3707190 - DNA, 12 bp, Homo sapiens
cccagcctctct

SEQ ID NO: 3707191 - DNA, 14 bp, Homo sapiens
cccagcgagccctg

SEQ ID NO: 3707192 - DNA, 15 bp, Homo sapiens
cccagctactcagga

SEQ ID NO: 3707193 - DNA, 20 bp, Homo sapiens
cccagctactcaggaggctg

SEQ ID NO: 3707194 - DNA, 14 bp, Homo sapiens
cccagctcagaggg

SEQ ID NO: 3707195 - DNA, 18 bp, Homo sapiens
cccagctccagggccaga

SEQ ID NO: 3707196 - DNA, 12 bp, Homo sapiens
cccagctctccc

SEQ ID NO: 3707197 - DNA, 16 bp, Homo sapiens
cccagctctccctctg

SEQ ID NO: 3707198 - DNA, 18 bp, Homo sapiens
cccagctctccctctggc

SEQ ID NO: 3707199 - DNA, 19 bp, Homo sapiens
cccagctctccctctggcc

SEQ ID NO: 3707200 - DNA, 23 bp, Homo sapiens
cccagctctccctctggccctgc

SEQ ID NO: 3707201 - DNA, 18 bp, Homo sapiens
cccagctctgaggactgc

SEQ ID NO: 3707202 - DNA, 22 bp, Homo sapiens
cccagctctgaggactgcacca

SEQ ID NO: 3707203 - DNA, 23 bp, Homo sapiens
cccagctgcacctgccagcctgg

SEQ ID NO: 3707204 - DNA, 14 bp, Homo sapiens
cccagctgctcccc

SEQ ID NO: 3707205 - DNA, 13 bp, Homo sapiens
cccagctgctctg

SEQ ID NO: 3707206 - DNA, 23 bp, Homo sapiens
cccagctgctctgcccagagctg

SEQ ID NO: 3707207 - DNA, 22 bp, Homo sapiens
cccagcttaaaggggctagagt

SEQ ID NO: 3707208 - DNA, 15 bp, Homo sapiens
cccaggagacagttc

SEQ ID NO: 3707209 - DNA, 15 bp, Homo sapiens
cccaggagagccagc

SEQ ID NO: 3707210 - DNA, 18 bp, Homo sapiens
cccaggagagccagccct

SEQ ID NO: 3707211 - DNA, 19 bp, Homo sapiens
cccaggagagccagccctc

SEQ ID NO: 3707212 - DNA, 21 bp, Homo sapiens
cccaggagagccagccctccc

SEQ ID NO: 3707213 - DNA, 21 bp, Homo sapiens
cccaggagccccgaggccttc

SEQ ID NO: 3707214 - DNA, 14 bp, Homo sapiens
cccaggagggaggg

SEQ ID NO: 3707215 - DNA, 23 bp, Homo sapiens
cccaggagtttgaggctgcagcg

SEQ ID NO: 3707216 - DNA, 13 bp, Homo sapiens
cccaggcaggtct

SEQ ID NO: 3707217 - DNA, 18 bp, Homo sapiens
cccaggccaggctccttc

SEQ ID NO: 3707218 - DNA, 19 bp, Homo sapiens
cccaggccaggctccttcc

SEQ ID NO: 3707219 - DNA, 21 bp, Homo sapiens
cccaggccaggctccttcctg

SEQ ID NO: 3707220 - DNA, 23 bp, Homo sapiens
cccaggccaggctccttcctgtc

SEQ ID NO: 3707221 - DNA, 15 bp, Homo sapiens
cccaggccccctgca

SEQ ID NO: 3707222 - DNA, 21 bp, Homo sapiens
cccaggcccctgccaccctgg

SEQ ID NO: 3707223 - DNA, 15 bp, Homo sapiens
cccaggccgtggctg

SEQ ID NO: 3707224 - DNA, 13 bp, Homo sapiens
cccaggcctccag

SEQ ID NO: 3707225 - DNA, 20 bp, Homo sapiens
cccaggcctccagctcagca

SEQ ID NO: 3707226 - DNA, 15 bp, Homo sapiens
cccaggcctgcctgt

SEQ ID NO: 3707227 - DNA, 16 bp, Homo sapiens
cccaggcctgcctgtt

SEQ ID NO: 3707228 - DNA, 13 bp, Homo sapiens
cccaggctggcgt

SEQ ID NO: 3707229 - DNA, 15 bp, Homo sapiens
cccagggaagttttg

SEQ ID NO: 3707230 - DNA, 18 bp, Homo sapiens
cccagggagaggccatga

SEQ ID NO: 3707231 - DNA, 21 bp, Homo sapiens
cccagggagcggaaagcagct

SEQ ID NO: 3707232 - DNA, 17 bp, Homo sapiens
ccgcttgtccagcgcct

SEQ ID NO: 3707233 - DNA, 18 bp, Homo sapiens
ccgcttgtccagcgccta

SEQ ID NO: 3707234 - DNA, 23 bp, Homo sapiens
ccgctttctacccagcgagccct

SEQ ID NO: 3707235 - DNA, 20 bp, Homo sapiens
ccggaatcctgtcctcagct

SEQ ID NO: 3707236 - DNA, 18 bp, Homo sapiens
ccggagatgtagcaaaac

SEQ ID NO: 3707237 - DNA, 17 bp, Homo sapiens
ccggagctaacactggc

SEQ ID NO: 3707238 - DNA, 21 bp, Homo sapiens
ccggagctttcaaagaaggaa

SEQ ID NO: 3707239 - DNA, 21 bp, Homo sapiens
ccggaggggcctggcagccgt

SEQ ID NO: 3707240 - DNA, 17 bp, Homo sapiens
ccggaggtagaggttgt

SEQ ID NO: 3707241 - DNA, 13 bp, Homo sapiens
ccggcagaaggga

SEQ ID NO: 3707242 - DNA, 18 bp, Homo sapiens
ccggcagggtcctagaaa

SEQ ID NO: 3707243 - DNA, 15 bp, Homo sapiens
ccggcccctgctggt

SEQ ID NO: 3707244 - DNA, 13 bp, Homo sapiens
ccggctccaggct

SEQ ID NO: 3707245 - DNA, 23 bp, Homo sapiens
ccggctcgagcagtcctgcctca

SEQ ID NO: 3707246 - DNA, 17 bp, Homo sapiens
ccggctctggctctccc

SEQ ID NO: 3707247 - DNA, 22 bp, Homo sapiens
ccggctgcttttccctaagcca

SEQ ID NO: 3707248 - DNA, 15 bp, Homo sapiens
ccgggaagccaccct

SEQ ID NO: 3707249 - DNA, 20 bp, Homo sapiens
ccgggactcactggcagccc

SEQ ID NO: 3707250 - DNA, 22 bp, Homo sapiens
ccgggactcactggcagcccca

SEQ ID NO: 3707251 - DNA, 12 bp, Homo sapiens
ccgggagagggg

SEQ ID NO: 3707252 - DNA, 19 bp, Homo sapiens
ccgggcctggagaactaga

SEQ ID NO: 3707253 - DNA, 22 bp, Homo sapiens
ccgggctcccctttcgcccaca

SEQ ID NO: 3707254 - DNA, 13 bp, Homo sapiens
ccgggctctctgc

SEQ ID NO: 3707255 - DNA, 18 bp, Homo sapiens
ccgggctgggagctctgc

SEQ ID NO: 3707256 - DNA, 19 bp, Homo sapiens
ccgggctgggagctctgca

SEQ ID NO: 3707257 - DNA, 15 bp, Homo sapiens
ccggtgtgcctgcag

SEQ ID NO: 3707258 - DNA, 24 bp, Homo sapiens
ccgtagacgtgcacgcacactgtc

SEQ ID NO: 3707259 - DNA, 14 bp, Homo sapiens
ccgtagttccctga

SEQ ID NO: 3707260 - DNA, 15 bp, Homo sapiens
ccgtagttccctgaa

SEQ ID NO: 3707261 - DNA, 22 bp, Homo sapiens
ccgtagttccctgaaaacccag

SEQ ID NO: 3707262 - DNA, 22 bp, Homo sapiens
ccgtccagccgccattgccacc

SEQ ID NO: 3707263 - DNA, 16 bp, Homo sapiens
ccgtccaggagcctgg

SEQ ID NO: 3707264 - DNA, 18 bp, Homo sapiens
ccgtccaggagcctgtgc

SEQ ID NO: 3707265 - DNA, 22 bp, Homo sapiens
ccgtctggggttcagcccctcc

SEQ ID NO: 3707266 - DNA, 22 bp, Homo sapiens
ccgtcttagaagtggaccagga

SEQ ID NO: 3707267 - DNA, 14 bp, Homo sapiens
ccgtcttcagccta

SEQ ID NO: 3707268 - DNA, 23 bp, Homo sapiens
ccgtgatgtagggtaaggtgcct

SEQ ID NO: 3707269 - DNA, 17 bp, Homo sapiens
ccgtgccttcagctcta

SEQ ID NO: 3707270 - DNA, 23 bp, Homo sapiens
ccgtggagatgggatgcttgcct

SEQ ID NO: 3707271 - DNA, 21 bp, Homo sapiens
ccgtggcttcccgctcagccc

SEQ ID NO: 3707272 - DNA, 15 bp, Homo sapiens
ccgtggctttggttt

SEQ ID NO: 3707273 - DNA, 13 bp, Homo sapiens
ccgtgtgccctcg

SEQ ID NO: 3707274 - DNA, 14 bp, Homo sapiens
ccgtgtggcccctt

SEQ ID NO: 3707275 - DNA, 13 bp, Homo sapiens
ccgttactctcca

SEQ ID NO: 3707276 - DNA, 23 bp, Homo sapiens
ccgttggaaacataaccattaca

SEQ ID NO: 3707277 - DNA, 14 bp, Homo sapiens
cctaaaaacacaga

SEQ ID NO: 3707278 - DNA, 12 bp, Homo sapiens
cctaaaacaaat

SEQ ID NO: 3707279 - DNA, 22 bp, Homo sapiens
cctaaaagttcataacagtgcc

SEQ ID NO: 3707280 - DNA, 15 bp, Homo sapiens
cctaaaattcagtgg

SEQ ID NO: 3707281 - DNA, 12 bp, Homo sapiens
cctaaagagata

SEQ ID NO: 3707282 - DNA, 21 bp, Homo sapiens
cctaagatttattttgttaaa

SEQ ID NO: 3707283 - DNA, 13 bp, Homo sapiens
cctaagtctctgt

SEQ ID NO: 3707284 - DNA, 16 bp, Homo sapiens
cctaagtggctgctga

SEQ ID NO: 3707285 - DNA, 17 bp, Homo sapiens
cctaagttacctttcta

SEQ ID NO: 3707286 - DNA, 17 bp, Homo sapiens
cctaagttcttagatat

SEQ ID NO: 3707287 - DNA, 18 bp, Homo sapiens
cctaatgtggcagctgtc

SEQ ID NO: 3707288 - DNA, 13 bp, Homo sapiens
cctaccaacctct

SEQ ID NO: 3707289 - DNA, 14 bp, Homo sapiens
cctaccaacctctg

SEQ ID NO: 3707290 - DNA, 13 bp, Homo sapiens
cctaccacagtgt

SEQ ID NO: 3707291 - DNA, 19 bp, Homo sapiens
cctaccgagtctcttctcc

SEQ ID NO: 3707292 - DNA, 22 bp, Homo sapiens
cctaccgagtctcttctccact

SEQ ID NO: 3707293 - DNA, 20 bp, Homo sapiens
cctaccggcaatttccggcc

SEQ ID NO: 3707294 - DNA, 12 bp, Homo sapiens
cctacctcagcc

SEQ ID NO: 3707295 - DNA, 14 bp, Homo sapiens
cctacctgtgcctg

SEQ ID NO: 3707296 - DNA, 15 bp, Homo sapiens
cctacctgtgcctga

SEQ ID NO: 3707297 - DNA, 20 bp, Homo sapiens
cctactacatcgccctccac

SEQ ID NO: 3707298 - DNA, 17 bp, Homo sapiens
cctactagggacctggg

SEQ ID NO: 3707299 - DNA, 20 bp, Homo sapiens
cctactagggacctggggaa

SEQ ID NO: 3707300 - DNA, 13 bp, Homo sapiens
cctactgaatgct

SEQ ID NO: 3707301 - DNA, 15 bp, Homo sapiens
cctacttcctgtgac

SEQ ID NO: 3707302 - DNA, 17 bp, Homo sapiens
cctagatccacacacag

SEQ ID NO: 3707303 - DNA, 17 bp, Homo sapiens
cctagccgacctcagcc

SEQ ID NO: 3707304 - DNA, 18 bp, Homo sapiens
cctagccgacctcagcct

SEQ ID NO: 3707305 - DNA, 22 bp, Homo sapiens
cctagccttagaagtcacacag

SEQ ID NO: 3707306 - DNA, 12 bp, Homo sapiens
cctaggagacca

SEQ ID NO: 3707307 - DNA, 17 bp, Homo sapiens
cctaggccactcctcca

SEQ ID NO: 3707308 - DNA, 15 bp, Homo sapiens
cctaggctccacccc

SEQ ID NO: 3707309 - DNA, 17 bp, Homo sapiens
cctaggctccaccccat

SEQ ID NO: 3707310 - DNA, 14 bp, Homo sapiens
cctagggcctggtc

SEQ ID NO: 3707311 - DNA, 13 bp, Homo sapiens
cctagggctgggt

SEQ ID NO: 3707312 - DNA, 15 bp, Homo sapiens
cctaggtgacagagt

SEQ ID NO: 3707313 - DNA, 18 bp, Homo sapiens
cctaggtgacagagtgag

SEQ ID NO: 3707314 - DNA, 14 bp, Homo sapiens
cctagtagtcattt

SEQ ID NO: 3707315 - DNA, 16 bp, Homo sapiens
cctagtcagccacatg

SEQ ID NO: 3707316 - DNA, 21 bp, Homo sapiens
cctagtggggtctccctctcc

SEQ ID NO: 3707317 - DNA, 18 bp, Homo sapiens
cctagttttctcctccca

SEQ ID NO: 3707318 - DNA, 12 bp, Homo sapiens
cctataaaacag

SEQ ID NO: 3707319 - DNA, 17 bp, Homo sapiens
cctatcacctcccctcc

SEQ ID NO: 3707320 - DNA, 12 bp, Homo sapiens
cctatccaccca

SEQ ID NO: 3707321 - DNA, 13 bp, Homo sapiens
cctatccacccag

SEQ ID NO: 3707322 - DNA, 15 bp, Homo sapiens
cctatcccatcccat

SEQ ID NO: 3707323 - DNA, 17 bp, Homo sapiens
cctatggggatggtcca

SEQ ID NO: 3707324 - DNA, 16 bp, Homo sapiens
cctattagagaagaga

SEQ ID NO: 3707325 - DNA, 16 bp, Homo sapiens
cctcaaaagcaccctt

SEQ ID NO: 3707326 - DNA, 19 bp, Homo sapiens
cctcaaccctccctcagcc

SEQ ID NO: 3707327 - DNA, 16 bp, Homo sapiens
cctcaacctcctgggc

SEQ ID NO: 3707328 - DNA, 17 bp, Homo sapiens
cctcaagatgaaggcaa

SEQ ID NO: 3707329 - DNA, 22 bp, Homo sapiens
cctcaaggacaaagtctccagc

SEQ ID NO: 3707330 - DNA, 13 bp, Homo sapiens
cctcaaggacttg

SEQ ID NO: 3707331 - DNA, 20 bp, Homo sapiens
cctcaaggacttgaaagcat

SEQ ID NO: 3707332 - DNA, 20 bp, Homo sapiens
cctcaatgtgaatcagaccc

SEQ ID NO: 3707333 - DNA, 15 bp, Homo sapiens
cctcaccccactgtg

SEQ ID NO: 3707334 - DNA, 19 bp, Homo sapiens
cctcacccccagctttgct

SEQ ID NO: 3707335 - DNA, 19 bp, Homo sapiens
cctcacccgaggctgccca

SEQ ID NO: 3707336 - DNA, 21 bp, Homo sapiens
cctcacccgaggctgcccact

SEQ ID NO: 3707337 - DNA, 20 bp, Homo sapiens
cctcacctctggactggcta

SEQ ID NO: 3707338 - DNA, 17 bp, Homo sapiens
cctcaccttgcaacaca

SEQ ID NO: 3707339 - DNA, 18 bp, Homo sapiens
cctcaccttgcaacacac

SEQ ID NO: 3707340 - DNA, 17 bp, Homo sapiens
cctcacctttcccatct

SEQ ID NO: 3707341 - DNA, 14 bp, Homo sapiens
cctcacgcacctcc

SEQ ID NO: 3707342 - DNA, 20 bp, Homo sapiens
cctcactcccttcccataag

SEQ ID NO: 3707343 - DNA, 19 bp, Homo sapiens
cctcactggggtcctgggg

SEQ ID NO: 3707344 - DNA, 14 bp, Homo sapiens
cctcactgggtggg

SEQ ID NO: 3707345 - DNA, 21 bp, Homo sapiens
cctcactgggtggggtgagga

SEQ ID NO: 3707346 - DNA, 16 bp, Homo sapiens
cctcactgttgaattt

SEQ ID NO: 3707347 - DNA, 18 bp, Homo sapiens
ccctgtggaagggactag

SEQ ID NO: 3707348 - DNA, 13 bp, Homo sapiens
ccctgttcactct

SEQ ID NO: 3707349 - DNA, 13 bp, Homo sapiens
cccttaaaattta

SEQ ID NO: 3707350 - DNA, 22 bp, Homo sapiens
cccttaccccttagcctccctg

SEQ ID NO: 3707351 - DNA, 14 bp, Homo sapiens
cccttacttagcat

SEQ ID NO: 3707352 - DNA, 17 bp, Homo sapiens
cccttcacttctgacca

SEQ ID NO: 3707353 - DNA, 17 bp, Homo sapiens
cccttccaggccatcag

SEQ ID NO: 3707354 - DNA, 23 bp, Homo sapiens
cccttccaggccatcagaggcct

SEQ ID NO: 3707355 - DNA, 12 bp, Homo sapiens
cccttccccact

SEQ ID NO: 3707356 - DNA, 15 bp, Homo sapiens
cccttcccctccctg

SEQ ID NO: 3707357 - DNA, 16 bp, Homo sapiens
cccttcccctccctgg

SEQ ID NO: 3707358 - DNA, 17 bp, Homo sapiens
cccttcctctccactgc

SEQ ID NO: 3707359 - DNA, 15 bp, Homo sapiens
cccttcctctttcca

SEQ ID NO: 3707360 - DNA, 17 bp, Homo sapiens
cccttcctgtccgccct

SEQ ID NO: 3707361 - DNA, 17 bp, Homo sapiens
cccttcgcgtatttcag

SEQ ID NO: 3707362 - DNA, 15 bp, Homo sapiens
cccttcgctcctgtg

SEQ ID NO: 3707363 - DNA, 17 bp, Homo sapiens
cccttctacactctcct

SEQ ID NO: 3707364 - DNA, 18 bp, Homo sapiens
cccttctacactctcctg

SEQ ID NO: 3707365 - DNA, 23 bp, Homo sapiens
cccttctacactctcctgggccc

SEQ ID NO: 3707366 - DNA, 18 bp, Homo sapiens
cccttctactgcttctac

SEQ ID NO: 3707367 - DNA, 19 bp, Homo sapiens
cccttctctgcccattccc

SEQ ID NO: 3707368 - DNA, 20 bp, Homo sapiens
cccttctctgctccaccaca

SEQ ID NO: 3707369 - DNA, 22 bp, Homo sapiens
cccttgagaaaccttattgtac

SEQ ID NO: 3707370 - DNA, 13 bp, Homo sapiens
cccttgagacctc

SEQ ID NO: 3707371 - DNA, 18 bp, Homo sapiens
cccttgagacctcagcca

SEQ ID NO: 3707372 - DNA, 14 bp, Homo sapiens
cccttgcccagggc

SEQ ID NO: 3707373 - DNA, 20 bp, Homo sapiens
cccttgcccagggctcagcc

SEQ ID NO: 3707374 - DNA, 15 bp, Homo sapiens
cccttggaggccagc

SEQ ID NO: 3707375 - DNA, 18 bp, Homo sapiens
cccttggaggccagccag

SEQ ID NO: 3707376 - DNA, 16 bp, Homo sapiens
cccttggcctgtctca

SEQ ID NO: 3707377 - DNA, 17 bp, Homo sapiens
cccttgtgcgtgggtga

SEQ ID NO: 3707378 - DNA, 23 bp, Homo sapiens
ccctttagcacgtttaaagttct

SEQ ID NO: 3707379 - DNA, 13 bp, Homo sapiens
ccctttcctgcgg

SEQ ID NO: 3707380 - DNA, 15 bp, Homo sapiens
ccctttccttccatc

SEQ ID NO: 3707381 - DNA, 14 bp, Homo sapiens
ccctttcttggcca

SEQ ID NO: 3707382 - DNA, 16 bp, Homo sapiens
ccctttcttggccagt

SEQ ID NO: 3707383 - DNA, 16 bp, Homo sapiens
cccttttctacagtta

SEQ ID NO: 3707384 - DNA, 20 bp, Homo sapiens
cccttttggcccccgagctg

SEQ ID NO: 3707385 - DNA, 16 bp, Homo sapiens
cccttttgggtttctg

SEQ ID NO: 3707386 - DNA, 15 bp, Homo sapiens
ccgaaaatcatataa

SEQ ID NO: 3707387 - DNA, 18 bp, Homo sapiens
ccgaagaagggtccttcc

SEQ ID NO: 3707388 - DNA, 18 bp, Homo sapiens
ccgacaaccgatgctcca

SEQ ID NO: 3707389 - DNA, 13 bp, Homo sapiens
ccgacagcctggc

SEQ ID NO: 3707390 - DNA, 15 bp, Homo sapiens
ccgacagcctggcac

SEQ ID NO: 3707391 - DNA, 13 bp, Homo sapiens
ccgaccagagccc

SEQ ID NO: 3707392 - DNA, 14 bp, Homo sapiens
ccgacctcagcctt

SEQ ID NO: 3707393 - DNA, 13 bp, Homo sapiens
ccgacctcgtcct

SEQ ID NO: 3707394 - DNA, 19 bp, Homo sapiens
ccgacctcgtcctccccct

SEQ ID NO: 3707395 - DNA, 23 bp, Homo sapiens
ccgacggtgggcatttgtgaggc

SEQ ID NO: 3707396 - DNA, 13 bp, Homo sapiens
ccgagaagcaaga

SEQ ID NO: 3707397 - DNA, 19 bp, Homo sapiens
ccgagaagcaagaaagaaa

SEQ ID NO: 3707398 - DNA, 15 bp, Homo sapiens
ccgagagcctgctcc

SEQ ID NO: 3707399 - DNA, 20 bp, Homo sapiens
ccgagagcctgctcccccac

SEQ ID NO: 3707400 - DNA, 21 bp, Homo sapiens
ccgagagtagccgagagcctg

SEQ ID NO: 3707401 - DNA, 22 bp, Homo sapiens
ccgagagtagccgagagcctgc

SEQ ID NO: 3707402 - DNA, 21 bp, Homo sapiens
ccgagatcacgccactgcact

SEQ ID NO: 3707403 - DNA, 15 bp, Homo sapiens
ccgagattgcaccac

SEQ ID NO: 3707404 - DNA, 19 bp, Homo sapiens
ccgagattgcaccactgca

SEQ ID NO: 3707405 - DNA, 18 bp, Homo sapiens
ccgagctgggggccatga

SEQ ID NO: 3707406 - DNA, 21 bp, Homo sapiens
ccgagctgggggccatgagct

SEQ ID NO: 3707407 - DNA, 21 bp, Homo sapiens
ccgagggtcctggctcctgag

SEQ ID NO: 3707408 - DNA, 23 bp, Homo sapiens
ccgagggtcctggctcctgaggg

SEQ ID NO: 3707409 - DNA, 16 bp, Homo sapiens
ccgaggtggctgcctg

SEQ ID NO: 3707410 - DNA, 20 bp, Homo sapiens
ccgagtagctgggactacag

SEQ ID NO: 3707411 - DNA, 16 bp, Homo sapiens
ccgagtctcttctcca

SEQ ID NO: 3707412 - DNA, 18 bp, Homo sapiens
ccgagtctcttctccact

SEQ ID NO: 3707413 - DNA, 19 bp, Homo sapiens
ccgagtctcttctccactg

SEQ ID NO: 3707414 - DNA, 16 bp, Homo sapiens
ccgcatcttctccatc

SEQ ID NO: 3707415 - DNA, 22 bp, Homo sapiens
ccgcatcttctccatctggcag

SEQ ID NO: 3707416 - DNA, 20 bp, Homo sapiens
ccgcatgcagcagcttgctg

SEQ ID NO: 3707417 - DNA, 15 bp, Homo sapiens
ccgcattccaggctc

SEQ ID NO: 3707418 - DNA, 23 bp, Homo sapiens
ccgcattccctgagtcaccagga

SEQ ID NO: 3707419 - DNA, 17 bp, Homo sapiens
ccgccaaggctggggga

SEQ ID NO: 3707420 - DNA, 16 bp, Homo sapiens
ccgccatgctcctggc

SEQ ID NO: 3707421 - DNA, 19 bp, Homo sapiens
ccgccattgccaccaggag

SEQ ID NO: 3707422 - DNA, 14 bp, Homo sapiens
ccgccccagcctct

SEQ ID NO: 3707423 - DNA, 23 bp, Homo sapiens
ccgcctcaatgtggttgcaaggc

SEQ ID NO: 3707424 - DNA, 16 bp, Homo sapiens
ccgcctggcagaactg

SEQ ID NO: 3707425 - DNA, 20 bp, Homo sapiens
ccgctcaggctgaccacttt

SEQ ID NO: 3707426 - DNA, 12 bp, Homo sapiens
ccgctccccagc

SEQ ID NO: 3707427 - DNA, 14 bp, Homo sapiens
ccgctccccagccc

SEQ ID NO: 3707428 - DNA, 15 bp, Homo sapiens
ccgctggctgggggc

SEQ ID NO: 3707429 - DNA, 14 bp, Homo sapiens
ccgctgttcaccca

SEQ ID NO: 3707430 - DNA, 16 bp, Homo sapiens
ccgctgttcacccaca

SEQ ID NO: 3707431 - DNA, 20 bp, Homo sapiens
cctcaggtcagggtgaggat

SEQ ID NO: 3707432 - DNA, 17 bp, Homo sapiens
cctcaggtgagaagcag

SEQ ID NO: 3707433 - DNA, 11 bp, Homo sapiens
cctcagtgtca

SEQ ID NO: 3707434 - DNA, 23 bp, Homo sapiens
cctcagtgtcatttatgaaaaga

SEQ ID NO: 3707435 - DNA, 15 bp, Homo sapiens
cctcagttcccttgg

SEQ ID NO: 3707436 - DNA, 21 bp, Homo sapiens
cctcagttcccttggcctcag

SEQ ID NO: 3707437 - DNA, 15 bp, Homo sapiens
cctcagtttccctat

SEQ ID NO: 3707438 - DNA, 17 bp, Homo sapiens
cctcatccgaggcaggg

SEQ ID NO: 3707439 - DNA, 19 bp, Homo sapiens
cctcatggtgggttcaggg

SEQ ID NO: 3707440 - DNA, 19 bp, Homo sapiens
cctcatttatccctcaacc

SEQ ID NO: 3707441 - DNA, 17 bp, Homo sapiens
cctcatttggggtagct

SEQ ID NO: 3707442 - DNA, 22 bp, Homo sapiens
cctccaagctccatctccactc

SEQ ID NO: 3707443 - DNA, 22 bp, Homo sapiens
cctccaatcccaccaaccctca

SEQ ID NO: 3707444 - DNA, 12 bp, Homo sapiens
cctccacagctt

SEQ ID NO: 3707445 - DNA, 11 bp, Homo sapiens
cctccactcct

SEQ ID NO: 3707446 - DNA, 11 bp, Homo sapiens
cctccagctgt

SEQ ID NO: 3707447 - DNA, 12 bp, Homo sapiens
cctccagggcca

SEQ ID NO: 3707448 - DNA, 17 bp, Homo sapiens
cctccagggccacgtgc

SEQ ID NO: 3707449 - DNA, 14 bp, Homo sapiens
cctccatcccgaca

SEQ ID NO: 3707450 - DNA, 15 bp, Homo sapiens
cctccatcccgacat

SEQ ID NO: 3707451 - DNA, 15 bp, Homo sapiens
cctccatgtgggcta

SEQ ID NO: 3707452 - DNA, 20 bp, Homo sapiens
cctccattcctggagcccga

SEQ ID NO: 3707453 - DNA, 15 bp, Homo sapiens
cctcccacctcagcc

SEQ ID NO: 3707454 - DNA, 17 bp, Homo sapiens
cctcccagaacacactc

SEQ ID NO: 3707455 - DNA, 14 bp, Homo sapiens
cctcccaggcgccc

SEQ ID NO: 3707456 - DNA, 16 bp, Homo sapiens
cctccccaaccctgcc

SEQ ID NO: 3707457 - DNA, 16 bp, Homo sapiens
cctccccagcaggtgg

SEQ ID NO: 3707458 - DNA, 20 bp, Homo sapiens
cctccccagcaggtggggag

SEQ ID NO: 3707459 - DNA, 18 bp, Homo sapiens
cctcccccaacccccacc

SEQ ID NO: 3707460 - DNA, 15 bp, Homo sapiens
cctccccccactgca

SEQ ID NO: 3707461 - DNA, 16 bp, Homo sapiens
cctccccccactgcag

SEQ ID NO: 3707462 - DNA, 20 bp, Homo sapiens
cctccccccactgcaggccc

SEQ ID NO: 3707463 - DNA, 12 bp, Homo sapiens
cctccccctcct

SEQ ID NO: 3707464 - DNA, 15 bp, Homo sapiens
cctccccctccttcc

SEQ ID NO: 3707465 - DNA, 14 bp, Homo sapiens
cctccccctgccag

SEQ ID NO: 3707466 - DNA, 20 bp, Homo sapiens
cctccccctgccagtgcctt

SEQ ID NO: 3707467 - DNA, 21 bp, Homo sapiens
cctccccgcaccccccaagct

SEQ ID NO: 3707468 - DNA, 13 bp, Homo sapiens
cctcccctatcca

SEQ ID NO: 3707469 - DNA, 15 bp, Homo sapiens
cctcccctatccacc

SEQ ID NO: 3707470 - DNA, 15 bp, Homo sapiens
cctcccctgccctgg

SEQ ID NO: 3707471 - DNA, 20 bp, Homo sapiens
cctcccgaatagctgggact

SEQ ID NO: 3707472 - DNA, 19 bp, Homo sapiens
cctcccgagtagctgggac

SEQ ID NO: 3707473 - DNA, 22 bp, Homo sapiens
cctccctacctcaacctgtaaa

SEQ ID NO: 3707474 - DNA, 16 bp, Homo sapiens
cctccctccctctttc

SEQ ID NO: 3707475 - DNA, 14 bp, Homo sapiens
cctccctccttcct

SEQ ID NO: 3707476 - DNA, 13 bp, Homo sapiens
cctccctctaatt

SEQ ID NO: 3707477 - DNA, 19 bp, Homo sapiens
cctccctctgacctgcagg

SEQ ID NO: 3707478 - DNA, 20 bp, Homo sapiens
cctccctgaaccatccctga

SEQ ID NO: 3707479 - DNA, 14 bp, Homo sapiens
cctccctgatgtac

SEQ ID NO: 3707480 - DNA, 13 bp, Homo sapiens
cctccctgcccct

SEQ ID NO: 3707481 - DNA, 24 bp, Homo sapiens
cctccctgcccctcccttcaacca

SEQ ID NO: 3707482 - DNA, 15 bp, Homo sapiens
cctccctggcctgtt

SEQ ID NO: 3707483 - DNA, 15 bp, Homo sapiens
cctccctgtccaccc

SEQ ID NO: 3707484 - DNA, 21 bp, Homo sapiens
cctcccttctactgcttctac

SEQ ID NO: 3707485 - DNA, 19 bp, Homo sapiens
cctccgccttcactccggt

SEQ ID NO: 3707486 - DNA, 20 bp, Homo sapiens
cctcctagggaaaagttcat

SEQ ID NO: 3707487 - DNA, 13 bp, Homo sapiens
cctcctcaccccc

SEQ ID NO: 3707488 - DNA, 15 bp, Homo sapiens
cctcctcaccccgtc

SEQ ID NO: 3707489 - DNA, 14 bp, Homo sapiens
cctcctcacctctg

SEQ ID NO: 3707490 - DNA, 21 bp, Homo sapiens
cctcctctaacaggggctggt

SEQ ID NO: 3707491 - DNA, 13 bp, Homo sapiens
cctcctctgccac

SEQ ID NO: 3707492 - DNA, 21 bp, Homo sapiens
cctcctctgccacctccccta

SEQ ID NO: 3707493 - DNA, 17 bp, Homo sapiens
cctcctgcccacctgtc

SEQ ID NO: 3707494 - DNA, 14 bp, Homo sapiens
cctcctgcccagga

SEQ ID NO: 3707495 - DNA, 13 bp, Homo sapiens
cctcctgcctcga

SEQ ID NO: 3707496 - DNA, 15 bp, Homo sapiens
cctcctgctactctg

SEQ ID NO: 3707497 - DNA, 14 bp, Homo sapiens
cctccttcccagct

SEQ ID NO: 3707498 - DNA, 20 bp, Homo sapiens
cctccttccttgaccagcag

SEQ ID NO: 3707499 - DNA, 20 bp, Homo sapiens
cctccttccttgctgtccta

SEQ ID NO: 3707500 - DNA, 17 bp, Homo sapiens
cctccttgcctcctgtg

SEQ ID NO: 3707501 - DNA, 18 bp, Homo sapiens
cctccttgcctcctgtgt

SEQ ID NO: 3707502 - DNA, 23 bp, Homo sapiens
cctcgaacccacactgcaacagg

SEQ ID NO: 3707503 - DNA, 22 bp, Homo sapiens
cctcgaactcctgggctcaagc

SEQ ID NO: 3707504 - DNA, 16 bp, Homo sapiens
cctcgaactggctgca

SEQ ID NO: 3707505 - DNA, 18 bp, Homo sapiens
cctcgaagcgcgccactc

SEQ ID NO: 3707506 - DNA, 15 bp, Homo sapiens
cctcgctggccccca

SEQ ID NO: 3707507 - DNA, 17 bp, Homo sapiens
cctcgctggcccccact

SEQ ID NO: 3707508 - DNA, 15 bp, Homo sapiens
cctcggctcctggac

SEQ ID NO: 3707509 - DNA, 18 bp, Homo sapiens
cctcggtgtggagaagcg

SEQ ID NO: 3707510 - DNA, 17 bp, Homo sapiens
cctcgtcctccccctgc

SEQ ID NO: 3707511 - DNA, 19 bp, Homo sapiens
cctcgtcctccccctgcca

SEQ ID NO: 3707512 - DNA, 20 bp, Homo sapiens
cctcgtcctccccctgccag

SEQ ID NO: 3707513 - DNA, 13 bp, Homo sapiens
cctcgtgctttaa

SEQ ID NO: 3707514 - DNA, 18 bp, Homo sapiens
cctcgtggccttccccag

SEQ ID NO: 3707515 - DNA, 19 bp, Homo sapiens
cctcgtggccttccccagc

SEQ ID NO: 3707516 - DNA, 22 bp, Homo sapiens
cctcgtggccttccccagcctc

SEQ ID NO: 3707517 - DNA, 23 bp, Homo sapiens
cctcgttagggaagagaaacagg

SEQ ID NO: 3707518 - DNA, 18 bp, Homo sapiens
cctctaatgctcacgctc

SEQ ID NO: 3707519 - DNA, 20 bp, Homo sapiens
cctctacttaatgagatagt

SEQ ID NO: 3707520 - DNA, 14 bp, Homo sapiens
cctctagtgccctc

SEQ ID NO: 3707521 - DNA, 14 bp, Homo sapiens
cctctcactgtgtc

SEQ ID NO: 3707522 - DNA, 14 bp, Homo sapiens
cctctcaggcatgc

SEQ ID NO: 3707523 - DNA, 21 bp, Homo sapiens
cctctcaggcatgcctgtgtg

SEQ ID NO: 3707524 - DNA, 14 bp, Homo sapiens
cctgggtctgtgtc

SEQ ID NO: 3707525 - DNA, 17 bp, Homo sapiens
cctgggtctgtgtctct

SEQ ID NO: 3707526 - DNA, 15 bp, Homo sapiens
cctgggtggggctgc

SEQ ID NO: 3707527 - DNA, 21 bp, Homo sapiens
cctgggtggtctgcaggcagg

SEQ ID NO: 3707528 - DNA, 18 bp, Homo sapiens
cctgggttccaatcctgg

SEQ ID NO: 3707529 - DNA, 21 bp, Homo sapiens
cctggtccagggaagctggcc

SEQ ID NO: 3707530 - DNA, 19 bp, Homo sapiens
cctggtccttccaggcccc

SEQ ID NO: 3707531 - DNA, 18 bp, Homo sapiens
cctggtgctgccacactt

SEQ ID NO: 3707532 - DNA, 21 bp, Homo sapiens
cctggtgctgccacacttcag

SEQ ID NO: 3707533 - DNA, 19 bp, Homo sapiens
cctgccttgaagccactga

SEQ ID NO: 3707534 - DNA, 22 bp, Homo sapiens
cctgccttgaagccactgaagc

SEQ ID NO: 3707535 - DNA, 22 bp, Homo sapiens
cctgccttggggaaggtctccc

SEQ ID NO: 3707536 - DNA, 17 bp, Homo sapiens
cctgcgaaggggccctg

SEQ ID NO: 3707537 - DNA, 17 bp, Homo sapiens
cctgcggcctgctggag

SEQ ID NO: 3707538 - DNA, 22 bp, Homo sapiens
cctgcgggctgccccgctttgc

SEQ ID NO: 3707539 - DNA, 21 bp, Homo sapiens
cctgcgggcttttccccggtc

SEQ ID NO: 3707540 - DNA, 17 bp, Homo sapiens
cctgcgtggctgacccc

SEQ ID NO: 3707541 - DNA, 17 bp, Homo sapiens
cctgctaattccccaga

SEQ ID NO: 3707542 - DNA, 13 bp, Homo sapiens
cctgctactctgt

SEQ ID NO: 3707543 - DNA, 16 bp, Homo sapiens
cctgctactctgttcc

SEQ ID NO: 3707544 - DNA, 18 bp, Homo sapiens
cctgctatttcccaagct

SEQ ID NO: 3707545 - DNA, 21 bp, Homo sapiens
cctgctatttcccaagctgga

SEQ ID NO: 3707546 - DNA, 14 bp, Homo sapiens
cctgctccagctgt

SEQ ID NO: 3707547 - DNA, 14 bp, Homo sapiens
cctgctcccccacc

SEQ ID NO: 3707548 - DNA, 22 bp, Homo sapiens
cctgctctccgaccagacacct

SEQ ID NO: 3707549 - DNA, 17 bp, Homo sapiens
cctgctctctacccagc

SEQ ID NO: 3707550 - DNA, 20 bp, Homo sapiens
cctgctctctacccagccca

SEQ ID NO: 3707551 - DNA, 20 bp, Homo sapiens
cctgctgagagacccaagga

SEQ ID NO: 3707552 - DNA, 21 bp, Homo sapiens
cctgctgagagacccaaggag

SEQ ID NO: 3707553 - DNA, 19 bp, Homo sapiens
cctgctgagggaccagcca

SEQ ID NO: 3707554 - DNA, 21 bp, Homo sapiens
cctgctgagggaccagccaag

SEQ ID NO: 3707555 - DNA, 21 bp, Homo sapiens
cctgctgatgtggcaactgct

SEQ ID NO: 3707556 - DNA, 22 bp, Homo sapiens
cctgctgccgcctcccagcctg

SEQ ID NO: 3707557 - DNA, 23 bp, Homo sapiens
cctgctgccgcctcccagcctgg

SEQ ID NO: 3707558 - DNA, 16 bp, Homo sapiens
cctgctgcctccccaa

SEQ ID NO: 3707559 - DNA, 21 bp, Homo sapiens
cctgctgcctccccaaccctg

SEQ ID NO: 3707560 - DNA, 23 bp, Homo sapiens
cctgctgcctccccaaccctgcc

SEQ ID NO: 3707561 - DNA, 19 bp, Homo sapiens
cctgctgggctctccacct

SEQ ID NO: 3707562 - DNA, 22 bp, Homo sapiens
cctgctgggctctccacctcag

SEQ ID NO: 3707563 - DNA, 23 bp, Homo sapiens
cctgctgggctctccacctcagc

SEQ ID NO: 3707564 - DNA, 18 bp, Homo sapiens
cctgcttgtccctgccca

SEQ ID NO: 3707565 - DNA, 21 bp, Homo sapiens
cctgctttagaatgttttcct

SEQ ID NO: 3707566 - DNA, 23 bp, Homo sapiens
cctgctttagaatgttttccttc

SEQ ID NO: 3707567 - DNA, 23 bp, Homo sapiens
cctggaaaggctcagtctcagga

SEQ ID NO: 3707568 - DNA, 16 bp, Homo sapiens
cctggaagagcagccc

SEQ ID NO: 3707569 - DNA, 23 bp, Homo sapiens
cctggaagctgtgtccttgcacc

SEQ ID NO: 3707570 - DNA, 22 bp, Homo sapiens
cctggaaggacatccatgttcc

SEQ ID NO: 3707571 - DNA, 13 bp, Homo sapiens
cctggacaaaccc

SEQ ID NO: 3707572 - DNA, 15 bp, Homo sapiens
cctggaccaaagctg

SEQ ID NO: 3707573 - DNA, 16 bp, Homo sapiens
cctggaccaaagctga

SEQ ID NO: 3707574 - DNA, 15 bp, Homo sapiens
cctggactcattgct

SEQ ID NO: 3707575 - DNA, 16 bp, Homo sapiens
cctggactcattgctt

SEQ ID NO: 3707576 - DNA, 12 bp, Homo sapiens
cctggagaacta

SEQ ID NO: 3707577 - DNA, 16 bp, Homo sapiens
cctggagaactagaga

SEQ ID NO: 3707578 - DNA, 13 bp, Homo sapiens
cctggagccccac

SEQ ID NO: 3707579 - DNA, 12 bp, Homo sapiens
cctggagcccga

SEQ ID NO: 3707580 - DNA, 16 bp, Homo sapiens
cctggagctcctggga

SEQ ID NO: 3707581 - DNA, 21 bp, Homo sapiens
cctggatccatcaggccactt

SEQ ID NO: 3707582 - DNA, 21 bp, Homo sapiens
cctggcaatagtgtgttctga

SEQ ID NO: 3707583 - DNA, 17 bp, Homo sapiens
cctggcacagggcagtg

SEQ ID NO: 3707584 - DNA, 20 bp, Homo sapiens
cctggcacccggcccctgct

SEQ ID NO: 3707585 - DNA, 23 bp, Homo sapiens
cctggcacccggcccctgctggt

SEQ ID NO: 3707586 - DNA, 20 bp, Homo sapiens
cctggcagaactgagctcct

SEQ ID NO: 3707587 - DNA, 20 bp, Homo sapiens
cctggccagatgcaccagcc

SEQ ID NO: 3707588 - DNA, 23 bp, Homo sapiens
cctggccagatgcaccagccctt

SEQ ID NO: 3707589 - DNA, 14 bp, Homo sapiens
cctggcccactgca

SEQ ID NO: 3707590 - DNA, 12 bp, Homo sapiens
cctggccccatg

SEQ ID NO: 3707591 - DNA, 12 bp, Homo sapiens
cctggcccccag

SEQ ID NO: 3707592 - DNA, 14 bp, Homo sapiens
cctggccctggggc

SEQ ID NO: 3707593 - DNA, 15 bp, Homo sapiens
cctggccctggggcc

SEQ ID NO: 3707594 - DNA, 17 bp, Homo sapiens
cctggccctggggcctg

SEQ ID NO: 3707595 - DNA, 13 bp, Homo sapiens
cctggcctgctgg

SEQ ID NO: 3707596 - DNA, 23 bp, Homo sapiens
cctggctacagggcgagactctg

SEQ ID NO: 3707597 - DNA, 23 bp, Homo sapiens
cctggctacatcccagcctgtgg

SEQ ID NO: 3707598 - DNA, 17 bp, Homo sapiens
cctggctcccacaggcc

SEQ ID NO: 3707599 - DNA, 16 bp, Homo sapiens
cctggctctcagaagg

SEQ ID NO: 3707600 - DNA, 11 bp, Homo sapiens
cctggctctga

SEQ ID NO: 3707601 - DNA, 22 bp, Homo sapiens
cctggctggtaagggccaagtc

SEQ ID NO: 3707602 - DNA, 15 bp, Homo sapiens
cctggcttctggagc

SEQ ID NO: 3707603 - DNA, 22 bp, Homo sapiens
cctggcttgtaactccaccaac

SEQ ID NO: 3707604 - DNA, 16 bp, Homo sapiens
cctggctttgcccaac

SEQ ID NO: 3707605 - DNA, 18 bp, Homo sapiens
cctggctttgcccaacct

SEQ ID NO: 3707606 - DNA, 24 bp, Homo sapiens
cctggcttttcactgctggctgcc

SEQ ID NO: 3707607 - DNA, 22 bp, Homo sapiens
cctgggaaggctactcaccttg

SEQ ID NO: 3707608 - DNA, 19 bp, Homo sapiens
cctgggagaacctcaggct

SEQ ID NO: 3707609 - DNA, 23 bp, Homo sapiens
cctgggaggtggaggttgcagtg

SEQ ID NO: 3707610 - DNA, 18 bp, Homo sapiens
cctgggagtgagctggtt

SEQ ID NO: 3707611 - DNA, 20 bp, Homo sapiens
cctgggatgtccacagatgc

SEQ ID NO: 3707612 - DNA, 19 bp, Homo sapiens
cctgggcagcatactgaga

SEQ ID NO: 3707613 - DNA, 15 bp, Homo sapiens
cctgggcattgcttt

SEQ ID NO: 3707614 - DNA, 16 bp, Homo sapiens
cctgggcattgctttc

SEQ ID NO: 3707615 - DNA, 22 bp, Homo sapiens
cctgggcccctccctacctcaa

SEQ ID NO: 3707616 - DNA, 22 bp, Homo sapiens
cctgggctcaagcaatcctcct

SEQ ID NO: 3707617 - DNA, 23 bp, Homo sapiens
cctgggctcaagcaatcctcctg

SEQ ID NO: 3707618 - DNA, 22 bp, Homo sapiens
cctgggctctgccccagctctg

SEQ ID NO: 3707619 - DNA, 19 bp, Homo sapiens
cctggggagtgggacagag

SEQ ID NO: 3707620 - DNA, 22 bp, Homo sapiens
cctggggagtgggacagagtct

SEQ ID NO: 3707621 - DNA, 13 bp, Homo sapiens
cctggggcctctt

SEQ ID NO: 3707622 - DNA, 15 bp, Homo sapiens
cctggggctctgtgc

SEQ ID NO: 3707623 - DNA, 15 bp, Homo sapiens
cctggggctgatctc

SEQ ID NO: 3707624 - DNA, 18 bp, Homo sapiens
cctggggctgatctcagg

SEQ ID NO: 3707625 - DNA, 19 bp, Homo sapiens
cctgggggaagccctggat

SEQ ID NO: 3707626 - DNA, 16 bp, Homo sapiens
cctgggggcctgacct

SEQ ID NO: 3707627 - DNA, 18 bp, Homo sapiens
cctgggggttctttcttc

SEQ ID NO: 3707628 - DNA, 15 bp, Homo sapiens
cctggggtgccctcc

SEQ ID NO: 3707629 - DNA, 22 bp, Homo sapiens
cctggggtgccctccactgccc

SEQ ID NO: 3707630 - DNA, 20 bp, Homo sapiens
cctggggtgtgggaggcccg

SEQ ID NO: 3707631 - DNA, 18 bp, Homo sapiens
cctgggtctaaggggttg

SEQ ID NO: 3707632 - DNA, 16 bp, Homo sapiens
cctctgcctgtccctc

SEQ ID NO: 3707633 - DNA, 19 bp, Homo sapiens
cctctgcctgtccctctca

SEQ ID NO: 3707634 - DNA, 20 bp, Homo sapiens
cctctgcctgtgcacggcca

SEQ ID NO: 3707635 - DNA, 22 bp, Homo sapiens
cctctgctggccgggcacagct

SEQ ID NO: 3707636 - DNA, 16 bp, Homo sapiens
cctctggaattgctca

SEQ ID NO: 3707637 - DNA, 16 bp, Homo sapiens
cctctggactggctag

SEQ ID NO: 3707638 - DNA, 20 bp, Homo sapiens
cctctggaggcctctgggcc

SEQ ID NO: 3707639 - DNA, 15 bp, Homo sapiens
cctctggccaggatg

SEQ ID NO: 3707640 - DNA, 15 bp, Homo sapiens
cctctggccctgcct

SEQ ID NO: 3707641 - DNA, 16 bp, Homo sapiens
cctctgtcatatcttc

SEQ ID NO: 3707642 - DNA, 15 bp, Homo sapiens
cctctgtccagggcc

SEQ ID NO: 3707643 - DNA, 19 bp, Homo sapiens
cctcttaaaaaataaaaac

SEQ ID NO: 3707644 - DNA, 14 bp, Homo sapiens
cctcttagaaaaac

SEQ ID NO: 3707645 - DNA, 13 bp, Homo sapiens
cctcttccccaga

SEQ ID NO: 3707646 - DNA, 14 bp, Homo sapiens
cctcttccccagaa

SEQ ID NO: 3707647 - DNA, 18 bp, Homo sapiens
cctcttccgtgacgtcac

SEQ ID NO: 3707648 - DNA, 18 bp, Homo sapiens
cctcttctattttgtaaa

SEQ ID NO: 3707649 - DNA, 12 bp, Homo sapiens
cctcttcttact

SEQ ID NO: 3707650 - DNA, 17 bp, Homo sapiens
cctcttcttcttcagaa

SEQ ID NO: 3707651 - DNA, 18 bp, Homo sapiens
cctcttgcggtcccttct

SEQ ID NO: 3707652 - DNA, 13 bp, Homo sapiens
cctcttgggttca

SEQ ID NO: 3707653 - DNA, 11 bp, Homo sapiens
cctctttccct

SEQ ID NO: 3707654 - DNA, 13 bp, Homo sapiens
cctctttccctcc

SEQ ID NO: 3707655 - DNA, 16 bp, Homo sapiens
cctctttccctccctt

SEQ ID NO: 3707656 - DNA, 15 bp, Homo sapiens
cctctttgttttgtt

SEQ ID NO: 3707657 - DNA, 13 bp, Homo sapiens
cctgaaaacccag

SEQ ID NO: 3707658 - DNA, 23 bp, Homo sapiens
cctgaaaatgtttttctgccagg

SEQ ID NO: 3707659 - DNA, 13 bp, Homo sapiens
cctgaaagccctg

SEQ ID NO: 3707660 - DNA, 16 bp, Homo sapiens
cctgaacaagaattgg

SEQ ID NO: 3707661 - DNA, 21 bp, Homo sapiens
cctgaacaagaattggaagct

SEQ ID NO: 3707662 - DNA, 16 bp, Homo sapiens
cctgaagtcacacagt

SEQ ID NO: 3707663 - DNA, 19 bp, Homo sapiens
cctgaccaacatggagaaa

SEQ ID NO: 3707664 - DNA, 16 bp, Homo sapiens
cctgacctcactgtga

SEQ ID NO: 3707665 - DNA, 14 bp, Homo sapiens
cctgacctccccct

SEQ ID NO: 3707666 - DNA, 16 bp, Homo sapiens
cctgacctccccctcc

SEQ ID NO: 3707667 - DNA, 17 bp, Homo sapiens
cctgacctccccctcct

SEQ ID NO: 3707668 - DNA, 19 bp, Homo sapiens
cctgacctccccctccttc

SEQ ID NO: 3707669 - DNA, 19 bp, Homo sapiens
cctgacggcgcccccagtg

SEQ ID NO: 3707670 - DNA, 10 bp, Homo sapiens
cctgactcaa

SEQ ID NO: 3707671 - DNA, 21 bp, Homo sapiens
cctgagacaaatggaggcctg

SEQ ID NO: 3707672 - DNA, 20 bp, Homo sapiens
cctgagatggccctctggta

SEQ ID NO: 3707673 - DNA, 21 bp, Homo sapiens
cctgagcacctcccagcccct

SEQ ID NO: 3707674 - DNA, 15 bp, Homo sapiens
cctgagctccccacc

SEQ ID NO: 3707675 - DNA, 16 bp, Homo sapiens
cctgagcttggccaga

SEQ ID NO: 3707676 - DNA, 18 bp, Homo sapiens
cctgagcttggccagaag

SEQ ID NO: 3707677 - DNA, 14 bp, Homo sapiens
cctgagctttctgc

SEQ ID NO: 3707678 - DNA, 16 bp, Homo sapiens
cctgagctttggacac

SEQ ID NO: 3707679 - DNA, 18 bp, Homo sapiens
cctgaggatcagaaagta

SEQ ID NO: 3707680 - DNA, 18 bp, Homo sapiens
cctgaggctggactccag

SEQ ID NO: 3707681 - DNA, 19 bp, Homo sapiens
cctgaggggcatctgcccc

SEQ ID NO: 3707682 - DNA, 18 bp, Homo sapiens
cctgagtcacccatgaag

SEQ ID NO: 3707683 - DNA, 23 bp, Homo sapiens
cctgagtcaccctacctgtgcct

SEQ ID NO: 3707684 - DNA, 21 bp, Homo sapiens
cctgatatagatcacataaca

SEQ ID NO: 3707685 - DNA, 20 bp, Homo sapiens
cctgatcaagtcaccggagc

SEQ ID NO: 3707686 - DNA, 14 bp, Homo sapiens
cctgatgacccagg

SEQ ID NO: 3707687 - DNA, 20 bp, Homo sapiens
cctgatgctccctcccctgc

SEQ ID NO: 3707688 - DNA, 20 bp, Homo sapiens
cctgcacaaagcccttccat

SEQ ID NO: 3707689 - DNA, 19 bp, Homo sapiens
cctgcacctccccccactg

SEQ ID NO: 3707690 - DNA, 17 bp, Homo sapiens
cctgcactggagtccag

SEQ ID NO: 3707691 - DNA, 16 bp, Homo sapiens
cctgcacttgcagact

SEQ ID NO: 3707692 - DNA, 19 bp, Homo sapiens
cctgcacttgcagactcta

SEQ ID NO: 3707693 - DNA, 12 bp, Homo sapiens
cctgcagagatg

SEQ ID NO: 3707694 - DNA, 12 bp, Homo sapiens
cctgcagcctgg

SEQ ID NO: 3707695 - DNA, 16 bp, Homo sapiens
cctgcaggccaagagc

SEQ ID NO: 3707696 - DNA, 15 bp, Homo sapiens
cctgcagggccaagc

SEQ ID NO: 3707697 - DNA, 15 bp, Homo sapiens
cctgcagtcatcttg

SEQ ID NO: 3707698 - DNA, 22 bp, Homo sapiens
cctgcatccgtagttccctgaa

SEQ ID NO: 3707699 - DNA, 12 bp, Homo sapiens
cctgcatgcaga

SEQ ID NO: 3707700 - DNA, 17 bp, Homo sapiens
cctgcattcacccagac

SEQ ID NO: 3707701 - DNA, 23 bp, Homo sapiens
cctgcatttgtgaaatgatggtg

SEQ ID NO: 3707702 - DNA, 20 bp, Homo sapiens
cctgccactaggctgggtgc

SEQ ID NO: 3707703 - DNA, 19 bp, Homo sapiens
cctgccagacggcacccac

SEQ ID NO: 3707704 - DNA, 15 bp, Homo sapiens
cctgccagcctggct

SEQ ID NO: 3707705 - DNA, 15 bp, Homo sapiens
cctgccaggcatggt

SEQ ID NO: 3707706 - DNA, 16 bp, Homo sapiens
cctgccaggcatggtg

SEQ ID NO: 3707707 - DNA, 14 bp, Homo sapiens
cctgccagtgcctt

SEQ ID NO: 3707708 - DNA, 17 bp, Homo sapiens
cctgccagtgccttacc

SEQ ID NO: 3707709 - DNA, 18 bp, Homo sapiens
cctgccagtgccttacct

SEQ ID NO: 3707710 - DNA, 20 bp, Homo sapiens
cctgccagtgccttacctcc

SEQ ID NO: 3707711 - DNA, 21 bp, Homo sapiens
cctgccagtgccttacctcct

SEQ ID NO: 3707712 - DNA, 12 bp, Homo sapiens
cctgcccacccg

SEQ ID NO: 3707713 - DNA, 22 bp, Homo sapiens
cctgcccacccgtggagatggg

SEQ ID NO: 3707714 - DNA, 23 bp, Homo sapiens
cctgcccaggagagccagccctc

SEQ ID NO: 3707715 - DNA, 15 bp, Homo sapiens
cctgcccaggcccct

SEQ ID NO: 3707716 - DNA, 17 bp, Homo sapiens
cctgccccagggctccc

SEQ ID NO: 3707717 - DNA, 12 bp, Homo sapiens
cctgccccctgg

SEQ ID NO: 3707718 - DNA, 13 bp, Homo sapiens
cctgccccctggt

SEQ ID NO: 3707719 - DNA, 16 bp, Homo sapiens
cctgcccccttctccc

SEQ ID NO: 3707720 - DNA, 19 bp, Homo sapiens
cctgcccccttctcccaca

SEQ ID NO: 3707721 - DNA, 20 bp, Homo sapiens
cctgcccccttctcccacac

SEQ ID NO: 3707722 - DNA, 16 bp, Homo sapiens
cctgccccgcccagct

SEQ ID NO: 3707723 - DNA, 15 bp, Homo sapiens
cctgcccctcccaga

SEQ ID NO: 3707724 - DNA, 16 bp, Homo sapiens
cctgcccctcccttca

SEQ ID NO: 3707725 - DNA, 20 bp, Homo sapiens
cctgccccttctacactctc

SEQ ID NO: 3707726 - DNA, 23 bp, Homo sapiens
cctgccccttctacactctcctg

SEQ ID NO: 3707727 - DNA, 14 bp, Homo sapiens
cctgcccggctgcg

SEQ ID NO: 3707728 - DNA, 24 bp, Homo sapiens
cctgccctagagcacactgtagca

SEQ ID NO: 3707729 - DNA, 22 bp, Homo sapiens
cgtgatccatccatctccaggg

SEQ ID NO: 3707730 - DNA, 17 bp, Homo sapiens
cgtgatgcctccctgtt

SEQ ID NO: 3707731 - DNA, 23 bp, Homo sapiens
cgtgatgtagggtaaggtgcctt

SEQ ID NO: 3707732 - DNA, 16 bp, Homo sapiens
cgtgcacacaccagag

SEQ ID NO: 3707733 - DNA, 20 bp, Homo sapiens
cgtgcacacaccagagccca

SEQ ID NO: 3707734 - DNA, 21 bp, Homo sapiens
cgtgcacgtggagagctggtg

SEQ ID NO: 3707735 - DNA, 18 bp, Homo sapiens
cgtgcactctgctaatca

SEQ ID NO: 3707736 - DNA, 16 bp, Homo sapiens
cgtgcagactggaggg

SEQ ID NO: 3707737 - DNA, 22 bp, Homo sapiens
cgtgcagtggtgcgatctgggt

SEQ ID NO: 3707738 - DNA, 19 bp, Homo sapiens
cgtgccaggcccggggctg

SEQ ID NO: 3707739 - DNA, 15 bp, Homo sapiens
cgtgccagtcctggg

SEQ ID NO: 3707740 - DNA, 17 bp, Homo sapiens
cgtgccgttactctcca

SEQ ID NO: 3707741 - DNA, 18 bp, Homo sapiens
cgtgccttcagctctaca

SEQ ID NO: 3707742 - DNA, 15 bp, Homo sapiens
cgtggaaagggtgct

SEQ ID NO: 3707743 - DNA, 21 bp, Homo sapiens
cgtggagagggatgaggtgct

SEQ ID NO: 3707744 - DNA, 22 bp, Homo sapiens
cgtggaggaatgctcccccatc

SEQ ID NO: 3707745 - DNA, 22 bp, Homo sapiens
cgtggctaagagtgtcctagga

SEQ ID NO: 3707746 - DNA, 18 bp, Homo sapiens
cgtggctgacccccctca

SEQ ID NO: 3707747 - DNA, 19 bp, Homo sapiens
cgtggctgacccccctcag

SEQ ID NO: 3707748 - DNA, 18 bp, Homo sapiens
cgtggcttcccgctcagc

SEQ ID NO: 3707749 - DNA, 20 bp, Homo sapiens
cgtggcttcccgctcagccc

SEQ ID NO: 3707750 - DNA, 17 bp, Homo sapiens
cgtgggcggcagagagg

SEQ ID NO: 3707751 - DNA, 12 bp, Homo sapiens
cgtggggcagca

SEQ ID NO: 3707752 - DNA, 22 bp, Homo sapiens
cgtggtgatttagcaggaagct

SEQ ID NO: 3707753 - DNA, 15 bp, Homo sapiens
cgtgtcgtgggtgtg

SEQ ID NO: 3707754 - DNA, 14 bp, Homo sapiens
cgtgtctgtattta

SEQ ID NO: 3707755 - DNA, 22 bp, Homo sapiens
cgtgtctgtatttatgtgtgag

SEQ ID NO: 3707756 - DNA, 16 bp, Homo sapiens
cgtgtgcgtgcatgtg

SEQ ID NO: 3707757 - DNA, 16 bp, Homo sapiens
cgttagggaagagaaa

SEQ ID NO: 3707758 - DNA, 15 bp, Homo sapiens
cgttcacccctccac

SEQ ID NO: 3707759 - DNA, 20 bp, Homo sapiens
cgttcacccctccacccttg

SEQ ID NO: 3707760 - DNA, 11 bp, Homo sapiens
cgttcatttgt

SEQ ID NO: 3707761 - DNA, 20 bp, Homo sapiens
cgttggaattaaaacaatgt

SEQ ID NO: 3707762 - DNA, 18 bp, Homo sapiens
cgttggacttttcgttaa

SEQ ID NO: 3707763 - DNA, 19 bp, Homo sapiens
cgtttaaagtgtattataa

SEQ ID NO: 3707764 - DNA, 15 bp, Homo sapiens
cgtttaaagttctgt

SEQ ID NO: 3707765 - DNA, 17 bp, Homo sapiens
cgtttaaagttctgtgt

SEQ ID NO: 3707766 - DNA, 20 bp, Homo sapiens
cgtttcctgagaagtgtcta

SEQ ID NO: 3707767 - DNA, 20 bp, Homo sapiens
cgtttgcccaaatctgccta

SEQ ID NO: 3707768 - DNA, 16 bp, Homo sapiens
cgtttgtttgttttgt

SEQ ID NO: 3707769 - DNA, 11 bp, Homo sapiens
ctaaaaataaa

SEQ ID NO: 3707770 - DNA, 23 bp, Homo sapiens
ctaaaagttcataacagtgccat

SEQ ID NO: 3707771 - DNA, 14 bp, Homo sapiens
ctaaaatatttatt

SEQ ID NO: 3707772 - DNA, 15 bp, Homo sapiens
ctaaaatatttattt

SEQ ID NO: 3707773 - DNA, 11 bp, Homo sapiens
ctaaagcagtg

SEQ ID NO: 3707774 - DNA, 17 bp, Homo sapiens
ctaaagcccaacctcct

SEQ ID NO: 3707775 - DNA, 17 bp, Homo sapiens
ctaaagtagacttcatt

SEQ ID NO: 3707776 - DNA, 20 bp, Homo sapiens
ctaaataaaatataattgtt

SEQ ID NO: 3707777 - DNA, 14 bp, Homo sapiens
ctaaatatttcctt

SEQ ID NO: 3707778 - DNA, 22 bp, Homo sapiens
ctaaatatttccttaaactgtg

SEQ ID NO: 3707779 - DNA, 15 bp, Homo sapiens
ctaaatgaatgttta

SEQ ID NO: 3707780 - DNA, 14 bp, Homo sapiens
ctaaatgccctgct

SEQ ID NO: 3707781 - DNA, 21 bp, Homo sapiens
ctaaatggtcgcccaggagac

SEQ ID NO: 3707782 - DNA, 22 bp, Homo sapiens
ctaaatgtaagaatcattgtaa

SEQ ID NO: 3707783 - DNA, 16 bp, Homo sapiens
ctaaatgttgaaagat

SEQ ID NO: 3707784 - DNA, 17 bp, Homo sapiens
ctaacacattatcggga

SEQ ID NO: 3707785 - DNA, 14 bp, Homo sapiens
ctaacacattttta

SEQ ID NO: 3707786 - DNA, 13 bp, Homo sapiens
ctaacactggccc

SEQ ID NO: 3707787 - DNA, 17 bp, Homo sapiens
ctaacactggcccctag

SEQ ID NO: 3707788 - DNA, 18 bp, Homo sapiens
ctaacagataagcaagag

SEQ ID NO: 3707789 - DNA, 22 bp, Homo sapiens
ctaacatataatgttgttattt

SEQ ID NO: 3707790 - DNA, 12 bp, Homo sapiens
ctaacattatat

SEQ ID NO: 3707791 - DNA, 22 bp, Homo sapiens
ctaacattatattgcaatgaag

SEQ ID NO: 3707792 - DNA, 13 bp, Homo sapiens
ctaaccaaatgca

SEQ ID NO: 3707793 - DNA, 18 bp, Homo sapiens
ctaaccagagcaagcttt

SEQ ID NO: 3707794 - DNA, 13 bp, Homo sapiens
ctaacccctttcc

SEQ ID NO: 3707795 - DNA, 14 bp, Homo sapiens
ctaacccctttcct

SEQ ID NO: 3707796 - DNA, 13 bp, Homo sapiens
ctaacctccttta

SEQ ID NO: 3707797 - DNA, 19 bp, Homo sapiens
ctaacctcttttctgcatc

SEQ ID NO: 3707798 - DNA, 16 bp, Homo sapiens
ctaactctgatgtaaa

SEQ ID NO: 3707799 - DNA, 13 bp, Homo sapiens
ctaactggaagca

SEQ ID NO: 3707800 - DNA, 20 bp, Homo sapiens
ctaacttggagccccagtgc

SEQ ID NO: 3707801 - DNA, 13 bp, Homo sapiens
ctaacttttgtgt

SEQ ID NO: 3707802 - DNA, 17 bp, Homo sapiens
ctaacttttgtgtgaaa

SEQ ID NO: 3707803 - DNA, 22 bp, Homo sapiens
ctaagaaaagatacgactttat

SEQ ID NO: 3707804 - DNA, 22 bp, Homo sapiens
ctaagagaatgataggcttttg

SEQ ID NO: 3707805 - DNA, 18 bp, Homo sapiens
ctaagagctagcgctgcc

SEQ ID NO: 3707806 - DNA, 20 bp, Homo sapiens
ctaagagctagcgctgccgc

SEQ ID NO: 3707807 - DNA, 20 bp, Homo sapiens
ctaagatttattttgttaaa

SEQ ID NO: 3707808 - DNA, 20 bp, Homo sapiens
ctaagcacgggccatatgaa

SEQ ID NO: 3707809 - DNA, 23 bp, Homo sapiens
ctaagcgctagaggaagcagcca

SEQ ID NO: 3707810 - DNA, 17 bp, Homo sapiens
ctaagctaggaatgaaa

SEQ ID NO: 3707811 - DNA, 22 bp, Homo sapiens
ctaagctattcagtaataactc

SEQ ID NO: 3707812 - DNA, 19 bp, Homo sapiens
ctaaggacatttcccaggg

SEQ ID NO: 3707813 - DNA, 15 bp, Homo sapiens
ctaagtccctgcccc

SEQ ID NO: 3707814 - DNA, 12 bp, Homo sapiens
ctaagtctctgt

SEQ ID NO: 3707815 - DNA, 13 bp, Homo sapiens
ctaagtctctgtg

SEQ ID NO: 3707816 - DNA, 17 bp, Homo sapiens
ctaagtgtttcataaat

SEQ ID NO: 3707817 - DNA, 15 bp, Homo sapiens
ctaagttcttagata

SEQ ID NO: 3707818 - DNA, 19 bp, Homo sapiens
ctaagtttcagttgatttt

SEQ ID NO: 3707819 - DNA, 20 bp, Homo sapiens
ctaataatcttgtttctgaa

SEQ ID NO: 3707820 - DNA, 12 bp, Homo sapiens
ctaatacaccag

SEQ ID NO: 3707821 - DNA, 17 bp, Homo sapiens
ctaatacattaaagcag

SEQ ID NO: 3707822 - DNA, 18 bp, Homo sapiens
ctaatacattaaagcagt

SEQ ID NO: 3707823 - DNA, 20 bp, Homo sapiens
ctaatagaactcagttttaa

SEQ ID NO: 3707824 - DNA, 14 bp, Homo sapiens
ctaatattttatgt

SEQ ID NO: 3707825 - DNA, 13 bp, Homo sapiens
ctaatccaaccca

SEQ ID NO: 3707826 - DNA, 18 bp, Homo sapiens
ctaatcccgattcaccct

SEQ ID NO: 3707827 - DNA, 22 bp, Homo sapiens
ctaatccctgggcattgctttc

SEQ ID NO: 3707828 - DNA, 23 bp, Homo sapiens
ctaatccctgggcattgctttcc

SEQ ID NO: 3707829 - DNA, 16 bp, Homo sapiens
ctaatcctctttttct

SEQ ID NO: 3707830 - DNA, 18 bp, Homo sapiens
ctaatctaacaatggaag

SEQ ID NO: 3707831 - DNA, 21 bp, Homo sapiens
ctaatctattgggttcattat

SEQ ID NO: 3707832 - DNA, 22 bp, Homo sapiens
ctaatctgctatgcttgaatgc

SEQ ID NO: 3707833 - DNA, 15 bp, Homo sapiens
ctaatcttcagggca

SEQ ID NO: 3707834 - DNA, 20 bp, Homo sapiens
ccttccccctgtagactagt

SEQ ID NO: 3707835 - DNA, 18 bp, Homo sapiens
ccttcccctccctggctc

SEQ ID NO: 3707836 - DNA, 22 bp, Homo sapiens
ccttcccctccctggctcccat

SEQ ID NO: 3707837 - DNA, 18 bp, Homo sapiens
ccttccccttgcccaggg

SEQ ID NO: 3707838 - DNA, 20 bp, Homo sapiens
ccttccccttgcccagggct

SEQ ID NO: 3707839 - DNA, 16 bp, Homo sapiens
cgaactcctgggctca

SEQ ID NO: 3707840 - DNA, 18 bp, Homo sapiens
cgaagaaaaaaaataaca

SEQ ID NO: 3707841 - DNA, 13 bp, Homo sapiens
cgaagacacagac

SEQ ID NO: 3707842 - DNA, 16 bp, Homo sapiens
cgaagcgcgccactcg

SEQ ID NO: 3707843 - DNA, 23 bp, Homo sapiens
cgaagcgcgccactcgcttcccc

SEQ ID NO: 3707844 - DNA, 18 bp, Homo sapiens
cgaagctcagcccacccc

SEQ ID NO: 3707845 - DNA, 13 bp, Homo sapiens
cgaatagctggga

SEQ ID NO: 3707846 - DNA, 16 bp, Homo sapiens
cgaatggtagtctaac

SEQ ID NO: 3707847 - DNA, 22 bp, Homo sapiens
cgaatggtagtctaaccaaatg

SEQ ID NO: 3707848 - DNA, 13 bp, Homo sapiens
cgacaaagctgct

SEQ ID NO: 3707849 - DNA, 15 bp, Homo sapiens
cgacaaccgatgctc

SEQ ID NO: 3707850 - DNA, 18 bp, Homo sapiens
cgacaaccgatgctccag

SEQ ID NO: 3707851 - DNA, 21 bp, Homo sapiens
cgacaaccgatgctccagcca

SEQ ID NO: 3707852 - DNA, 19 bp, Homo sapiens
cgaccgaggctggagctgg

SEQ ID NO: 3707853 - DNA, 15 bp, Homo sapiens
cgacctcagccttcc

SEQ ID NO: 3707854 - DNA, 12 bp, Homo sapiens
cgacctcggtgg

SEQ ID NO: 3707855 - DNA, 14 bp, Homo sapiens
cgacctcgtcctcc

SEQ ID NO: 3707856 - DNA, 19 bp, Homo sapiens
cgacctcgtcctccccctg

SEQ ID NO: 3707857 - DNA, 22 bp, Homo sapiens
cgacctcgtcctccccctgcca

SEQ ID NO: 3707858 - DNA, 17 bp, Homo sapiens
cgactgcccggcagggt

SEQ ID NO: 3707859 - DNA, 15 bp, Homo sapiens
cgagaagcaagaaag

SEQ ID NO: 3707860 - DNA, 17 bp, Homo sapiens
cgagaccaacctgacca

SEQ ID NO: 3707861 - DNA, 21 bp, Homo sapiens
cgagagacttgtggcctggga

SEQ ID NO: 3707862 - DNA, 13 bp, Homo sapiens
cgagagcctgctc

SEQ ID NO: 3707863 - DNA, 20 bp, Homo sapiens
cgagagcctgctcccccacc

SEQ ID NO: 3707864 - DNA, 19 bp, Homo sapiens
cgagagtagccgagagcct

SEQ ID NO: 3707865 - DNA, 20 bp, Homo sapiens
cgagagtagccgagagcctg

SEQ ID NO: 3707866 - DNA, 16 bp, Homo sapiens
cgagccctacttccag

SEQ ID NO: 3707867 - DNA, 16 bp, Homo sapiens
cgagccctggtggcag

SEQ ID NO: 3707868 - DNA, 19 bp, Homo sapiens
cgagccctggtggcagtgg

SEQ ID NO: 3707869 - DNA, 15 bp, Homo sapiens
cgagctgggggccat

SEQ ID NO: 3707870 - DNA, 20 bp, Homo sapiens
cgagctgggggccatgagct

SEQ ID NO: 3707871 - DNA, 13 bp, Homo sapiens
cgagctggtgcat

SEQ ID NO: 3707872 - DNA, 14 bp, Homo sapiens
cgagctggtgcatt

SEQ ID NO: 3707873 - DNA, 23 bp, Homo sapiens
cgagctggtgcattacagagagg

SEQ ID NO: 3707874 - DNA, 14 bp, Homo sapiens
cgaggaaactcaga

SEQ ID NO: 3707875 - DNA, 16 bp, Homo sapiens
cgaggacagggaggtg

SEQ ID NO: 3707876 - DNA, 15 bp, Homo sapiens
cgaggctggagctgg

SEQ ID NO: 3707877 - DNA, 16 bp, Homo sapiens
cgaggtcaacagagaa

SEQ ID NO: 3707878 - DNA, 21 bp, Homo sapiens
cgaggtcaacagagaaggcag

SEQ ID NO: 3707879 - DNA, 13 bp, Homo sapiens
cgagtagctggga

SEQ ID NO: 3707880 - DNA, 15 bp, Homo sapiens
cgagtagctgggact

SEQ ID NO: 3707881 - DNA, 14 bp, Homo sapiens
cgagtcactgcctc

SEQ ID NO: 3707882 - DNA, 18 bp, Homo sapiens
cgagtcactgcctctccc

SEQ ID NO: 3707883 - DNA, 20 bp, Homo sapiens
cgagtctcttctccactgga

SEQ ID NO: 3707884 - DNA, 21 bp, Homo sapiens
cgagtctcttctccactggat

SEQ ID NO: 3707885 - DNA, 23 bp, Homo sapiens
cgagtggatagatgccctgctag

SEQ ID NO: 3707886 - DNA, 11 bp, Homo sapiens
cgagtgtgtgc

SEQ ID NO: 3707887 - DNA, 21 bp, Homo sapiens
cgatcatggctcactgcagcc

SEQ ID NO: 3707888 - DNA, 15 bp, Homo sapiens
cgatccacctgtctc

SEQ ID NO: 3707889 - DNA, 20 bp, Homo sapiens
cgatccacctgtctcagcct

SEQ ID NO: 3707890 - DNA, 17 bp, Homo sapiens
cgatctcttattttaca

SEQ ID NO: 3707891 - DNA, 19 bp, Homo sapiens
cgatctgggttcactgcaa

SEQ ID NO: 3707892 - DNA, 23 bp, Homo sapiens
cgatgctccagccaacccctgtg

SEQ ID NO: 3707893 - DNA, 19 bp, Homo sapiens
cgatgggggatgcttcatg

SEQ ID NO: 3707894 - DNA, 13 bp, Homo sapiens
cgatgtggccctg

SEQ ID NO: 3707895 - DNA, 19 bp, Homo sapiens
cgattcttctgcttcagcc

SEQ ID NO: 3707896 - DNA, 21 bp, Homo sapiens
cgattcttctgcttcagcctc

SEQ ID NO: 3707897 - DNA, 12 bp, Homo sapiens
cgattgtaactc

SEQ ID NO: 3707898 - DNA, 20 bp, Homo sapiens
cgcaagcctgtaatcccagc

SEQ ID NO: 3707899 - DNA, 21 bp, Homo sapiens
cgcacaaggctgaccaagaga

SEQ ID NO: 3707900 - DNA, 12 bp, Homo sapiens
cgcacacagctt

SEQ ID NO: 3707901 - DNA, 14 bp, Homo sapiens
cgcaccccagagtg

SEQ ID NO: 3707902 - DNA, 15 bp, Homo sapiens
cgcacccccaccctt

SEQ ID NO: 3707903 - DNA, 16 bp, Homo sapiens
cgcacctcccatccta

SEQ ID NO: 3707904 - DNA, 16 bp, Homo sapiens
cgcacctgccccctgg

SEQ ID NO: 3707905 - DNA, 18 bp, Homo sapiens
cgcacgtgggtcttcagg

SEQ ID NO: 3707906 - DNA, 23 bp, Homo sapiens
cgcacttcgggaggtcgaggcag

SEQ ID NO: 3707907 - DNA, 15 bp, Homo sapiens
cgcagccctgctttg

SEQ ID NO: 3707908 - DNA, 12 bp, Homo sapiens
cgcaggaagctg

SEQ ID NO: 3707909 - DNA, 22 bp, Homo sapiens
cgcaggattcttcctccctccc

SEQ ID NO: 3707910 - DNA, 15 bp, Homo sapiens
cgcatgccctcaatc

SEQ ID NO: 3707911 - DNA, 14 bp, Homo sapiens
cgcatgcggcccag

SEQ ID NO: 3707912 - DNA, 16 bp, Homo sapiens
cgcatgcggcccagga

SEQ ID NO: 3707913 - DNA, 18 bp, Homo sapiens
cgcatggagtgtgtattg

SEQ ID NO: 3707914 - DNA, 15 bp, Homo sapiens
cgcattccaggctcc

SEQ ID NO: 3707915 - DNA, 12 bp, Homo sapiens
cgcattccctga

SEQ ID NO: 3707916 - DNA, 13 bp, Homo sapiens
cgcattccctgag

SEQ ID NO: 3707917 - DNA, 23 bp, Homo sapiens
cgccaaggctgggggaagaagct

SEQ ID NO: 3707918 - DNA, 23 bp, Homo sapiens
cgccacatccccgctggctgggg

SEQ ID NO: 3707919 - DNA, 23 bp, Homo sapiens
cgccactcgcttcccccatagcc

SEQ ID NO: 3707920 - DNA, 18 bp, Homo sapiens
cgccaggaccgccaaaga

SEQ ID NO: 3707921 - DNA, 18 bp, Homo sapiens
cgccattctcaagccctg

SEQ ID NO: 3707922 - DNA, 15 bp, Homo sapiens
cgccattgcactcca

SEQ ID NO: 3707923 - DNA, 15 bp, Homo sapiens
cgcccagctgcacct

SEQ ID NO: 3707924 - DNA, 13 bp, Homo sapiens
cgcccagtctgga

SEQ ID NO: 3707925 - DNA, 13 bp, Homo sapiens
cgcccccagtgtg

SEQ ID NO: 3707926 - DNA, 14 bp, Homo sapiens
cgccccgccccaca

SEQ ID NO: 3707927 - DNA, 17 bp, Homo sapiens
cgccccgccccacattc

SEQ ID NO: 3707928 - DNA, 13 bp, Homo sapiens
cgccccttccccc

SEQ ID NO: 3707929 - DNA, 19 bp, Homo sapiens
cgccctcattacggctcct

SEQ ID NO: 3707930 - DNA, 19 bp, Homo sapiens
cgccctcttcccctctaat

SEQ ID NO: 3707931 - DNA, 21 bp, Homo sapiens
cgcctagtggggtctccctct

SEQ ID NO: 3707932 - DNA, 22 bp, Homo sapiens
cgcctcaatgtggttgcaaggc

SEQ ID NO: 3707933 - DNA, 19 bp, Homo sapiens
cgcctcttcttcttcagaa

SEQ ID NO: 3707934 - DNA, 15 bp, Homo sapiens
cgcctgcccctccca

SEQ ID NO: 3707935 - DNA, 16 bp, Homo sapiens
cgcctgcccctcccag

SEQ ID NO: 3707936 - DNA, 17 bp, Homo sapiens
cgcctgtagtcctagcc

SEQ ID NO: 3707937 - DNA, 15 bp, Homo sapiens
cgcgccactcgcttc

SEQ ID NO: 3707938 - DNA, 18 bp, Homo sapiens
cgcgccactcgcttcccc

SEQ ID NO: 3707939 - DNA, 20 bp, Homo sapiens
cgcgccactcgcttccccca

SEQ ID NO: 3707940 - DNA, 19 bp, Homo sapiens
cgcgtgcacgtggagagct

SEQ ID NO: 3707941 - DNA, 19 bp, Homo sapiens
cgctcccaacacaaggtgg

SEQ ID NO: 3707942 - DNA, 14 bp, Homo sapiens
cgctcctgtctgcc

SEQ ID NO: 3707943 - DNA, 13 bp, Homo sapiens
cgctcttttccta

SEQ ID NO: 3707944 - DNA, 18 bp, Homo sapiens
cgctgccgcaccccagag

SEQ ID NO: 3707945 - DNA, 17 bp, Homo sapiens
cgctggagtgcagtgag

SEQ ID NO: 3707946 - DNA, 10 bp, Homo sapiens
cgctggcccc

SEQ ID NO: 3707947 - DNA, 17 bp, Homo sapiens
cgctggcccccactggc

SEQ ID NO: 3707948 - DNA, 18 bp, Homo sapiens
cgctggcccccactggct

SEQ ID NO: 3707949 - DNA, 19 bp, Homo sapiens
cgctggcccccactggctg

SEQ ID NO: 3707950 - DNA, 14 bp, Homo sapiens
cgctggctgggggc

SEQ ID NO: 3707951 - DNA, 15 bp, Homo sapiens
cgctggtagagatgg

SEQ ID NO: 3707952 - DNA, 22 bp, Homo sapiens
cgctgtctccagacccccaccc

SEQ ID NO: 3707953 - DNA, 15 bp, Homo sapiens
ctcccacaggccctt

SEQ ID NO: 3707954 - DNA, 20 bp, Homo sapiens
ctcccacaggcccttcctct

SEQ ID NO: 3707955 - DNA, 21 bp, Homo sapiens
ctcccacaggcccttcctctc

SEQ ID NO: 3707956 - DNA, 13 bp, Homo sapiens
ctcccaccccacc

SEQ ID NO: 3707957 - DNA, 22 bp, Homo sapiens
ctcccaccccacccccttcagt

SEQ ID NO: 3707958 - DNA, 23 bp, Homo sapiens
ctcccacccccttctctgctcca

SEQ ID NO: 3707959 - DNA, 19 bp, Homo sapiens
ctcccagcccctgcccctc

SEQ ID NO: 3707960 - DNA, 16 bp, Homo sapiens
ctcccaggagacagtt

SEQ ID NO: 3707961 - DNA, 19 bp, Homo sapiens
ctcccaggagacagttcaa

SEQ ID NO: 3707962 - DNA, 21 bp, Homo sapiens
ctcccaggccaggctccttcc

SEQ ID NO: 3707963 - DNA, 16 bp, Homo sapiens
ctcccagggccagggc

SEQ ID NO: 3707964 - DNA, 19 bp, Homo sapiens
ctcccagggccagggccct

SEQ ID NO: 3707965 - DNA, 20 bp, Homo sapiens
ctcccagggccatgaacttt

SEQ ID NO: 3707966 - DNA, 21 bp, Homo sapiens
ctcccagggccatgaactttg

SEQ ID NO: 3707967 - DNA, 14 bp, Homo sapiens
ctccccaaccctgc

SEQ ID NO: 3707968 - DNA, 21 bp, Homo sapiens
ctccccacactaacctgggtt

SEQ ID NO: 3707969 - DNA, 20 bp, Homo sapiens
ctccccaccaccccagctgc

SEQ ID NO: 3707970 - DNA, 13 bp, Homo sapiens
ctccccagcccag

SEQ ID NO: 3707971 - DNA, 22 bp, Homo sapiens
ctccccagcccagggttccccc

SEQ ID NO: 3707972 - DNA, 21 bp, Homo sapiens
ctccccatgtgcctgcaccag

SEQ ID NO: 3707973 - DNA, 21 bp, Homo sapiens
ctccccattagagtcagcctt

SEQ ID NO: 3707974 - DNA, 16 bp, Homo sapiens
ctccccccactgcagg

SEQ ID NO: 3707975 - DNA, 14 bp, Homo sapiens
ctccccctccttcc

SEQ ID NO: 3707976 - DNA, 15 bp, Homo sapiens
ctccccctccttccc

SEQ ID NO: 3707977 - DNA, 20 bp, Homo sapiens
ctccccctccttcccagctg

SEQ ID NO: 3707978 - DNA, 16 bp, Homo sapiens
ctccccctgccagtgc

SEQ ID NO: 3707979 - DNA, 19 bp, Homo sapiens
ctccccggctcaagtgatc

SEQ ID NO: 3707980 - DNA, 15 bp, Homo sapiens
ctcccctaatgcctg

SEQ ID NO: 3707981 - DNA, 14 bp, Homo sapiens
ctcccctccctcct

SEQ ID NO: 3707982 - DNA, 10 bp, Homo sapiens
ctcccctcta

SEQ ID NO: 3707983 - DNA, 13 bp, Homo sapiens
ctcccctctgctg

SEQ ID NO: 3707984 - DNA, 14 bp, Homo sapiens
ctcccctctgctgg

SEQ ID NO: 3707985 - DNA, 14 bp, Homo sapiens
ctcccctgccattt

SEQ ID NO: 3707986 - DNA, 15 bp, Homo sapiens
ctcccctgccctgct

SEQ ID NO: 3707987 - DNA, 20 bp, Homo sapiens
ctcccgaatagctgggacta

SEQ ID NO: 3707988 - DNA, 17 bp, Homo sapiens
ctcccgagtagctggga

SEQ ID NO: 3707989 - DNA, 21 bp, Homo sapiens
ctcccgggactcactggcagc

SEQ ID NO: 3707990 - DNA, 21 bp, Homo sapiens
ctcccggtgcccaagaataga

SEQ ID NO: 3707991 - DNA, 20 bp, Homo sapiens
ctccctacctcaacctgtaa

SEQ ID NO: 3707992 - DNA, 17 bp, Homo sapiens
ctccctagttccttcat

SEQ ID NO: 3707993 - DNA, 20 bp, Homo sapiens
ctccctataatgctggagcg

SEQ ID NO: 3707994 - DNA, 19 bp, Homo sapiens
ctccctatgttgcccaggt

SEQ ID NO: 3707995 - DNA, 15 bp, Homo sapiens
ctccctcaaagcaca

SEQ ID NO: 3707996 - DNA, 13 bp, Homo sapiens
ctccctcagcccc

SEQ ID NO: 3707997 - DNA, 14 bp, Homo sapiens
ctccctcagcccct

SEQ ID NO: 3707998 - DNA, 13 bp, Homo sapiens
ctccctcccctgc

SEQ ID NO: 3707999 - DNA, 15 bp, Homo sapiens
ctccctcccctgccc

SEQ ID NO: 3708000 - DNA, 16 bp, Homo sapiens
ctccctcccctgccct

SEQ ID NO: 3708001 - DNA, 16 bp, Homo sapiens
ctccctccctctttcc

SEQ ID NO: 3708002 - DNA, 18 bp, Homo sapiens
ctccctcctcacctctgg

SEQ ID NO: 3708003 - DNA, 19 bp, Homo sapiens
ctccctcctcacctctgga

SEQ ID NO: 3708004 - DNA, 21 bp, Homo sapiens
ctccctcctcacctctggact

SEQ ID NO: 3708005 - DNA, 12 bp, Homo sapiens
ctccctcctctg

SEQ ID NO: 3708006 - DNA, 20 bp, Homo sapiens
ctccctccttccttcttgct

SEQ ID NO: 3708007 - DNA, 12 bp, Homo sapiens
ctccctctcctg

SEQ ID NO: 3708008 - DNA, 14 bp, Homo sapiens
ctccctctcctgcc

SEQ ID NO: 3708009 - DNA, 17 bp, Homo sapiens
ctccctctcctgcctac

SEQ ID NO: 3708010 - DNA, 17 bp, Homo sapiens
ctccctctctcttctgc

SEQ ID NO: 3708011 - DNA, 17 bp, Homo sapiens
ctccctctgccggctct

SEQ ID NO: 3708012 - DNA, 20 bp, Homo sapiens
ctccctctttccctcccttc

SEQ ID NO: 3708013 - DNA, 23 bp, Homo sapiens
ctccctgaaaatgtttttctgcc

SEQ ID NO: 3708014 - DNA, 20 bp, Homo sapiens
ctccctgaagtaagcaaaga

SEQ ID NO: 3708015 - DNA, 16 bp, Homo sapiens
ctccctgccagcaccc

SEQ ID NO: 3708016 - DNA, 13 bp, Homo sapiens
ctccctgcccctc

SEQ ID NO: 3708017 - DNA, 21 bp, Homo sapiens
ctccctgcccctcccttcaac

SEQ ID NO: 3708018 - DNA, 18 bp, Homo sapiens
ctccctgccgcctcaatg

SEQ ID NO: 3708019 - DNA, 16 bp, Homo sapiens
ctccctggcctgttct

SEQ ID NO: 3708020 - DNA, 16 bp, Homo sapiens
ctccctggctctcaga

SEQ ID NO: 3708021 - DNA, 14 bp, Homo sapiens
ctccctgtcctcct

SEQ ID NO: 3708022 - DNA, 18 bp, Homo sapiens
ctccctgtcctcctcgga

SEQ ID NO: 3708023 - DNA, 12 bp, Homo sapiens
ctcccttcaacc

SEQ ID NO: 3708024 - DNA, 19 bp, Homo sapiens
ctcccttcaaccattcccc

SEQ ID NO: 3708025 - DNA, 21 bp, Homo sapiens
ctcccttcaaccattccccat

SEQ ID NO: 3708026 - DNA, 22 bp, Homo sapiens
ctcccttcaaccattccccatg

SEQ ID NO: 3708027 - DNA, 10 bp, Homo sapiens
ctcccttcct

SEQ ID NO: 3708028 - DNA, 13 bp, Homo sapiens
ctcccttcctccc

SEQ ID NO: 3708029 - DNA, 13 bp, Homo sapiens
ctcccttcctctt

SEQ ID NO: 3708030 - DNA, 17 bp, Homo sapiens
ctcccttctactgcttc

SEQ ID NO: 3708031 - DNA, 14 bp, Homo sapiens
ctccctttgaaatg

SEQ ID NO: 3708032 - DNA, 14 bp, Homo sapiens
ctccctttttatat

SEQ ID NO: 3708033 - DNA, 21 bp, Homo sapiens
ctccctttttatatcccattt

SEQ ID NO: 3708034 - DNA, 13 bp, Homo sapiens
ctccgccaggcga

SEQ ID NO: 3708035 - DNA, 19 bp, Homo sapiens
ctccggtgtgcctgcagcc

SEQ ID NO: 3708036 - DNA, 13 bp, Homo sapiens
ctccgtatttcag

SEQ ID NO: 3708037 - DNA, 14 bp, Homo sapiens
ctccgtatttcaga

SEQ ID NO: 3708038 - DNA, 20 bp, Homo sapiens
ctccgtccaggagcctgtgc

SEQ ID NO: 3708039 - DNA, 15 bp, Homo sapiens
ctccgtgatccatcc

SEQ ID NO: 3708040 - DNA, 17 bp, Homo sapiens
ctcctaaagtagacttc

SEQ ID NO: 3708041 - DNA, 12 bp, Homo sapiens
ctcctacctcag

SEQ ID NO: 3708042 - DNA, 21 bp, Homo sapiens
ctcctagactgaccctgatca

SEQ ID NO: 3708043 - DNA, 22 bp, Homo sapiens
ctcctaggacatgttcccttct

SEQ ID NO: 3708044 - DNA, 22 bp, Homo sapiens
ctcctatcagaagtttctcagc

SEQ ID NO: 3708045 - DNA, 17 bp, Homo sapiens
ctcctatcttcatatct

SEQ ID NO: 3708046 - DNA, 17 bp, Homo sapiens
ctcctcacccccagctt

SEQ ID NO: 3708047 - DNA, 21 bp, Homo sapiens
ctcctcacccccagctttgct

SEQ ID NO: 3708048 - DNA, 15 bp, Homo sapiens
ctcctcaccccgtct

SEQ ID NO: 3708049 - DNA, 14 bp, Homo sapiens
ctcctcacctctgg

SEQ ID NO: 3708050 - DNA, 15 bp, Homo sapiens
ctcctcacctctgga

SEQ ID NO: 3708051 - DNA, 16 bp, Homo sapiens
ctcctcacctctggac

SEQ ID NO: 3708052 - DNA, 21 bp, Homo sapiens
ctcctcactcccttcccataa

SEQ ID NO: 3708053 - DNA, 14 bp, Homo sapiens
ctcctcccggtgcc

SEQ ID NO: 3708054 - DNA, 21 bp, Homo sapiens
ctcctccctccctctgccggc

SEQ ID NO: 3708055 - DNA, 16 bp, Homo sapiens
ctcctccctgatgtac

SEQ ID NO: 3708056 - DNA, 19 bp, Homo sapiens
ctcctccctgatgtacagt

SEQ ID NO: 3708057 - DNA, 15 bp, Homo sapiens
ctcctcgcaagctgg

SEQ ID NO: 3708058 - DNA, 17 bp, Homo sapiens
ctcctctaacaggggct

SEQ ID NO: 3708059 - DNA, 18 bp, Homo sapiens
ctcctctctaacctcctt

SEQ ID NO: 3708060 - DNA, 12 bp, Homo sapiens
ctcctctgccac

SEQ ID NO: 3708061 - DNA, 14 bp, Homo sapiens
ctcctctgccacct

SEQ ID NO: 3708062 - DNA, 12 bp, Homo sapiens
ctcctctgggca

SEQ ID NO: 3708063 - DNA, 13 bp, Homo sapiens
ctcctctgggcag

SEQ ID NO: 3708064 - DNA, 17 bp, Homo sapiens
ctcctctgtccagggcc

SEQ ID NO: 3708065 - DNA, 19 bp, Homo sapiens
ctcctcttaaaaaataaaa

SEQ ID NO: 3708066 - DNA, 21 bp, Homo sapiens
ctcctcttaaaaaataaaaac

SEQ ID NO: 3708067 - DNA, 19 bp, Homo sapiens
ctcaggtgtccctgcactt

SEQ ID NO: 3708068 - DNA, 22 bp, Homo sapiens
ctcaggttgtctgaagtcactg

SEQ ID NO: 3708069 - DNA, 14 bp, Homo sapiens
ctcagtaaaatgaa

SEQ ID NO: 3708070 - DNA, 13 bp, Homo sapiens
ctcagtctcagga

SEQ ID NO: 3708071 - DNA, 20 bp, Homo sapiens
ctcagtctggcccttccttt

SEQ ID NO: 3708072 - DNA, 22 bp, Homo sapiens
ctcagtcttccctagggctggg

SEQ ID NO: 3708073 - DNA, 13 bp, Homo sapiens
ctcagtgccacta

SEQ ID NO: 3708074 - DNA, 14 bp, Homo sapiens
ctcagttcccttgg

SEQ ID NO: 3708075 - DNA, 15 bp, Homo sapiens
ctcagttcccttggc

SEQ ID NO: 3708076 - DNA, 20 bp, Homo sapiens
ctcagttcccttggcctcag

SEQ ID NO: 3708077 - DNA, 13 bp, Homo sapiens
ctcagtttcccta

SEQ ID NO: 3708078 - DNA, 18 bp, Homo sapiens
ctcatagcattaactaat

SEQ ID NO: 3708079 - DNA, 19 bp, Homo sapiens
ctcatagtatggtggctgg

SEQ ID NO: 3708080 - DNA, 23 bp, Homo sapiens
ctcatagtatggtggctgggttg

SEQ ID NO: 3708081 - DNA, 15 bp, Homo sapiens
ctcatatcagtttgc

SEQ ID NO: 3708082 - DNA, 15 bp, Homo sapiens
ctcatattcctgcag

SEQ ID NO: 3708083 - DNA, 12 bp, Homo sapiens
ctcatcataaaa

SEQ ID NO: 3708084 - DNA, 14 bp, Homo sapiens
ctcatcataaaata

SEQ ID NO: 3708085 - DNA, 13 bp, Homo sapiens
ctcatccccaggg

SEQ ID NO: 3708086 - DNA, 14 bp, Homo sapiens
ctcatccgaggcag

SEQ ID NO: 3708087 - DNA, 15 bp, Homo sapiens
ctcatccttttctcc

SEQ ID NO: 3708088 - DNA, 13 bp, Homo sapiens
ctcatctgtctgg

SEQ ID NO: 3708089 - DNA, 18 bp, Homo sapiens
ctcatgcatagtcccagc

SEQ ID NO: 3708090 - DNA, 19 bp, Homo sapiens
ctcatgcatagtcccagct

SEQ ID NO: 3708091 - DNA, 20 bp, Homo sapiens
ctcatgcatagtcccagcta

SEQ ID NO: 3708092 - DNA, 21 bp, Homo sapiens
ctcatgccaaccccgccctag

SEQ ID NO: 3708093 - DNA, 15 bp, Homo sapiens
ctcatgggcccctct

SEQ ID NO: 3708094 - DNA, 16 bp, Homo sapiens
ctcatgggcccctctg

SEQ ID NO: 3708095 - DNA, 17 bp, Homo sapiens
ctcatggtccccatggc

SEQ ID NO: 3708096 - DNA, 18 bp, Homo sapiens
ctcattacggctcctctc

SEQ ID NO: 3708097 - DNA, 19 bp, Homo sapiens
ctcattcaaaagttgaaat

SEQ ID NO: 3708098 - DNA, 22 bp, Homo sapiens
ctcattgcttcacaacccatct

SEQ ID NO: 3708099 - DNA, 20 bp, Homo sapiens
ctattagactttagaaataa

SEQ ID NO: 3708100 - DNA, 22 bp, Homo sapiens
ctattagactttagaaataaat

SEQ ID NO: 3708101 - DNA, 16 bp, Homo sapiens
ctattataatttaatg

SEQ ID NO: 3708102 - DNA, 11 bp, Homo sapiens
ctattcacaac

SEQ ID NO: 3708103 - DNA, 18 bp, Homo sapiens
ctattctctcctcagact

SEQ ID NO: 3708104 - DNA, 19 bp, Homo sapiens
ctattctctcctcagactg

SEQ ID NO: 3708105 - DNA, 17 bp, Homo sapiens
ctattgacaagtcattt

SEQ ID NO: 3708106 - DNA, 15 bp, Homo sapiens
ctattgggttcatta

SEQ ID NO: 3708107 - DNA, 16 bp, Homo sapiens
ctattgggttcattat

SEQ ID NO: 3708108 - DNA, 15 bp, Homo sapiens
ctattgtaagataaa

SEQ ID NO: 3708109 - DNA, 18 bp, Homo sapiens
ctattgtaagataaaaaa

SEQ ID NO: 3708110 - DNA, 22 bp, Homo sapiens
ctattgtcccctagcaaggcat

SEQ ID NO: 3708111 - DNA, 15 bp, Homo sapiens
ctatttaaattcttt

SEQ ID NO: 3708112 - DNA, 22 bp, Homo sapiens
ctatttaactggcttcagcctc

SEQ ID NO: 3708113 - DNA, 15 bp, Homo sapiens
ctatttatttactga

SEQ ID NO: 3708114 - DNA, 15 bp, Homo sapiens
ctatttcccaagctg

SEQ ID NO: 3708115 - DNA, 17 bp, Homo sapiens
ctatttcccaagctgga

SEQ ID NO: 3708116 - DNA, 19 bp, Homo sapiens
ctatttgcttatttaataa

SEQ ID NO: 3708117 - DNA, 22 bp, Homo sapiens
ctatttgtatatatacataaca

SEQ ID NO: 3708118 - DNA, 18 bp, Homo sapiens
ctattttactgtcttaat

SEQ ID NO: 3708119 - DNA, 12 bp, Homo sapiens
ctattttgtaaa

SEQ ID NO: 3708120 - DNA, 15 bp, Homo sapiens
ctatttttatttata

SEQ ID NO: 3708121 - DNA, 16 bp, Homo sapiens
ctatttttatttatat

SEQ ID NO: 3708122 - DNA, 18 bp, Homo sapiens
ctatttttatttatattt

SEQ ID NO: 3708123 - DNA, 14 bp, Homo sapiens
ctatttttgtagaa

SEQ ID NO: 3708124 - DNA, 15 bp, Homo sapiens
ctatttttgtagaag

SEQ ID NO: 3708125 - DNA, 21 bp, Homo sapiens
ctatttttttaaaatcactaa

SEQ ID NO: 3708126 - DNA, 18 bp, Homo sapiens
ctcaaaaaaagaaaaaga

SEQ ID NO: 3708127 - DNA, 19 bp, Homo sapiens
ctcaaaaaacattgttttg

SEQ ID NO: 3708128 - DNA, 18 bp, Homo sapiens
ctcaaaagctgggcaggt

SEQ ID NO: 3708129 - DNA, 18 bp, Homo sapiens
ctcaaaaggaaaccaagt

SEQ ID NO: 3708130 - DNA, 14 bp, Homo sapiens
ctcaaacacagaga

SEQ ID NO: 3708131 - DNA, 18 bp, Homo sapiens
ctcaaacctccaaaagcc

SEQ ID NO: 3708132 - DNA, 11 bp, Homo sapiens
ctcaaaggcac

SEQ ID NO: 3708133 - DNA, 12 bp, Homo sapiens
ctcaaataacta

SEQ ID NO: 3708134 - DNA, 21 bp, Homo sapiens
ctcaacacctctgcacaagct

SEQ ID NO: 3708135 - DNA, 19 bp, Homo sapiens
ctcaaccctccctcagccc

SEQ ID NO: 3708136 - DNA, 21 bp, Homo sapiens
ctcaaccctccctcagcccct

SEQ ID NO: 3708137 - DNA, 13 bp, Homo sapiens
ctcaacctcctgg

SEQ ID NO: 3708138 - DNA, 19 bp, Homo sapiens
ctcaacctgtaaattattt

SEQ ID NO: 3708139 - DNA, 20 bp, Homo sapiens
ctcaacctgtaaattatttt

SEQ ID NO: 3708140 - DNA, 13 bp, Homo sapiens
ctcaacctgtgat

SEQ ID NO: 3708141 - DNA, 17 bp, Homo sapiens
ctcaagagggcactggt

SEQ ID NO: 3708142 - DNA, 19 bp, Homo sapiens
ctcaagagggcactggtgg

SEQ ID NO: 3708143 - DNA, 18 bp, Homo sapiens
ctcaagcaatcctcctga

SEQ ID NO: 3708144 - DNA, 21 bp, Homo sapiens
ctcaagcaatcctcctgagtg

SEQ ID NO: 3708145 - DNA, 22 bp, Homo sapiens
ctcaagcaatcctcctgagtga

SEQ ID NO: 3708146 - DNA, 14 bp, Homo sapiens
ctcaagcagtctac

SEQ ID NO: 3708147 - DNA, 22 bp, Homo sapiens
ctcaagccctgcagtcacagct

SEQ ID NO: 3708148 - DNA, 20 bp, Homo sapiens
ctcaaggacaaagtctccag

SEQ ID NO: 3708149 - DNA, 21 bp, Homo sapiens
ctcaaggacaaagtctccagc

SEQ ID NO: 3708150 - DNA, 15 bp, Homo sapiens
ctcaaggcgtgagga

SEQ ID NO: 3708151 - DNA, 18 bp, Homo sapiens
ctcaagtgattctcctgc

SEQ ID NO: 3708152 - DNA, 19 bp, Homo sapiens
ctcaagtgattctcctgcc

SEQ ID NO: 3708153 - DNA, 21 bp, Homo sapiens
ctcaagtgattctcctgcctc

SEQ ID NO: 3708154 - DNA, 22 bp, Homo sapiens
ctcaagtgtctcagtccacctg

SEQ ID NO: 3708155 - DNA, 14 bp, Homo sapiens
ctcaagttcaagga

SEQ ID NO: 3708156 - DNA, 14 bp, Homo sapiens
ctcaagttgaaaga

SEQ ID NO: 3708157 - DNA, 20 bp, Homo sapiens
ctcaagtttcttcaatctga

SEQ ID NO: 3708158 - DNA, 22 bp, Homo sapiens
ctcaatattttccatgaaaatg

SEQ ID NO: 3708159 - DNA, 14 bp, Homo sapiens
ctcaatcctctaag

SEQ ID NO: 3708160 - DNA, 13 bp, Homo sapiens
ctcaatgcactga

SEQ ID NO: 3708161 - DNA, 19 bp, Homo sapiens
ctcaattcatatttatgaa

SEQ ID NO: 3708162 - DNA, 13 bp, Homo sapiens
ctcacagaagaat

SEQ ID NO: 3708163 - DNA, 18 bp, Homo sapiens
ctcacagtgggagccagg

SEQ ID NO: 3708164 - DNA, 19 bp, Homo sapiens
ctcacagttcctcgccctg

SEQ ID NO: 3708165 - DNA, 21 bp, Homo sapiens
ctcacagttcctcgccctggg

SEQ ID NO: 3708166 - DNA, 22 bp, Homo sapiens
ctcacagttcctcgccctgggt

SEQ ID NO: 3708167 - DNA, 23 bp, Homo sapiens
ctcacagttcctcgccctgggtc

SEQ ID NO: 3708168 - DNA, 15 bp, Homo sapiens
ctcacatttattctg

SEQ ID NO: 3708169 - DNA, 14 bp, Homo sapiens
ctcaccagccccag

SEQ ID NO: 3708170 - DNA, 15 bp, Homo sapiens
ctcaccagccccagt

SEQ ID NO: 3708171 - DNA, 17 bp, Homo sapiens
ctcaccagccccagtgc

SEQ ID NO: 3708172 - DNA, 21 bp, Homo sapiens
ctcaccagccccagtgcccac

SEQ ID NO: 3708173 - DNA, 14 bp, Homo sapiens
ctcaccatgtaaaa

SEQ ID NO: 3708174 - DNA, 22 bp, Homo sapiens
ctcacccccaaggggcagtctg

SEQ ID NO: 3708175 - DNA, 16 bp, Homo sapiens
ctcacctctaaaacag

SEQ ID NO: 3708176 - DNA, 15 bp, Homo sapiens
ctcacctctgcctca

SEQ ID NO: 3708177 - DNA, 14 bp, Homo sapiens
ctcacctctggact

SEQ ID NO: 3708178 - DNA, 15 bp, Homo sapiens
ctcacctctggactg

SEQ ID NO: 3708179 - DNA, 21 bp, Homo sapiens
ctcacctctggactggctaga

SEQ ID NO: 3708180 - DNA, 19 bp, Homo sapiens
ctcacctgagtcaccctac

SEQ ID NO: 3708181 - DNA, 21 bp, Homo sapiens
ctcacctgctggcccctcacc

SEQ ID NO: 3708182 - DNA, 19 bp, Homo sapiens
ctcacctgggcacctgggg

SEQ ID NO: 3708183 - DNA, 12 bp, Homo sapiens
ctcacctggggt

SEQ ID NO: 3708184 - DNA, 22 bp, Homo sapiens
ctcaccttgcaacacacagaca

SEQ ID NO: 3708185 - DNA, 17 bp, Homo sapiens
ctcacctttcccatctt

SEQ ID NO: 3708186 - DNA, 15 bp, Homo sapiens
ctcacgcacctccca

SEQ ID NO: 3708187 - DNA, 16 bp, Homo sapiens
ctcacgcacctcccat

SEQ ID NO: 3708188 - DNA, 19 bp, Homo sapiens
ctcacgcacctcccatcct

SEQ ID NO: 3708189 - DNA, 20 bp, Homo sapiens
ctcacgcctatgatcccagc

SEQ ID NO: 3708190 - DNA, 23 bp, Homo sapiens
ctcacgcctgtaatcccagcact

SEQ ID NO: 3708191 - DNA, 23 bp, Homo sapiens
ctcacgcctgtaatcccagcagt

SEQ ID NO: 3708192 - DNA, 17 bp, Homo sapiens
ctcactatcctacccca

SEQ ID NO: 3708193 - DNA, 16 bp, Homo sapiens
ctcactatgttgccca

SEQ ID NO: 3708194 - DNA, 18 bp, Homo sapiens
ctcactatgttgcccagg

SEQ ID NO: 3708195 - DNA, 19 bp, Homo sapiens
ctcactatgttgcccaggc

SEQ ID NO: 3708196 - DNA, 20 bp, Homo sapiens
ctcactatgttgcccaggca

SEQ ID NO: 3708197 - DNA, 22 bp, Homo sapiens
ctcactatgttgcccaggcagg

SEQ ID NO: 3708198 - DNA, 19 bp, Homo sapiens
ctcactcaagttcaaggac

SEQ ID NO: 3708199 - DNA, 21 bp, Homo sapiens
ctcactcaagttcaaggacca

SEQ ID NO: 3708200 - DNA, 16 bp, Homo sapiens
ctcactccaccaccca

SEQ ID NO: 3708201 - DNA, 15 bp, Homo sapiens
ctcactcccagtcca

SEQ ID NO: 3708202 - DNA, 15 bp, Homo sapiens
ctcactcccttccca

SEQ ID NO: 3708203 - DNA, 17 bp, Homo sapiens
ctcactcctacctggta

SEQ ID NO: 3708204 - DNA, 19 bp, Homo sapiens
ctcactcctacctggtaat

SEQ ID NO: 3708205 - DNA, 11 bp, Homo sapiens
ctcactctgtc

SEQ ID NO: 3708206 - DNA, 21 bp, Homo sapiens
ctcactctgtcgcccagtctg

SEQ ID NO: 3708207 - DNA, 12 bp, Homo sapiens
ctcactgcagcc

SEQ ID NO: 3708208 - DNA, 15 bp, Homo sapiens
ctcactgcagcctca

SEQ ID NO: 3708209 - DNA, 20 bp, Homo sapiens
ctcactggcagccccagcac

SEQ ID NO: 3708210 - DNA, 20 bp, Homo sapiens
ctcactggggtcctggggcc

SEQ ID NO: 3708211 - DNA, 22 bp, Homo sapiens
ctcactggggtcctggggcctc

SEQ ID NO: 3708212 - DNA, 14 bp, Homo sapiens
ctcactgttgccca

SEQ ID NO: 3708213 - DNA, 14 bp, Homo sapiens
cgctgtgggcaggt

SEQ ID NO: 3708214 - DNA, 13 bp, Homo sapiens
cgcttcccccata

SEQ ID NO: 3708215 - DNA, 20 bp, Homo sapiens
cgcttcccccatagccaccc

SEQ ID NO: 3708216 - DNA, 17 bp, Homo sapiens
cgcttgtccagcgccta

SEQ ID NO: 3708217 - DNA, 14 bp, Homo sapiens
cgctttctacccag

SEQ ID NO: 3708218 - DNA, 16 bp, Homo sapiens
cgctttctacccagcg

SEQ ID NO: 3708219 - DNA, 16 bp, Homo sapiens
cgctttctagctgttg

SEQ ID NO: 3708220 - DNA, 20 bp, Homo sapiens
cggaaagcagctcaaaggca

SEQ ID NO: 3708221 - DNA, 20 bp, Homo sapiens
cggaagcagtgccttccata

SEQ ID NO: 3708222 - DNA, 22 bp, Homo sapiens
cggaagcagtgccttccataat

SEQ ID NO: 3708223 - DNA, 23 bp, Homo sapiens
cggaagcagtgccttccataatt

SEQ ID NO: 3708224 - DNA, 14 bp, Homo sapiens
cggaatagttggct

SEQ ID NO: 3708225 - DNA, 16 bp, Homo sapiens
cggaatagttggctag

SEQ ID NO: 3708226 - DNA, 15 bp, Homo sapiens
cggaatcctgtcctc

SEQ ID NO: 3708227 - DNA, 18 bp, Homo sapiens
cggaatcctgtcctcagc

SEQ ID NO: 3708228 - DNA, 21 bp, Homo sapiens
cggaatcctgtcctcagcttc

SEQ ID NO: 3708229 - DNA, 16 bp, Homo sapiens
cggacagccacggcca

SEQ ID NO: 3708230 - DNA, 20 bp, Homo sapiens
cggacagccacggccaggcc

SEQ ID NO: 3708231 - DNA, 15 bp, Homo sapiens
cggagacggagtccc

SEQ ID NO: 3708232 - DNA, 20 bp, Homo sapiens
cggagacggagtcccacctt

SEQ ID NO: 3708233 - DNA, 21 bp, Homo sapiens
cggagacgtgatgaagggagg

SEQ ID NO: 3708234 - DNA, 14 bp, Homo sapiens
cggagagaaaaaag

SEQ ID NO: 3708235 - DNA, 17 bp, Homo sapiens
cggagctaacactggcc

SEQ ID NO: 3708236 - DNA, 18 bp, Homo sapiens
cggagctaacactggccc

SEQ ID NO: 3708237 - DNA, 21 bp, Homo sapiens
cggagctaacactggccccta

SEQ ID NO: 3708238 - DNA, 21 bp, Homo sapiens
cggaggcaaaaggcagtgggg

SEQ ID NO: 3708239 - DNA, 19 bp, Homo sapiens
cggaggcttgtcagagctg

SEQ ID NO: 3708240 - DNA, 21 bp, Homo sapiens
cggaggcttgtcagagctggg

SEQ ID NO: 3708241 - DNA, 18 bp, Homo sapiens
cggagtatctgggaactg

SEQ ID NO: 3708242 - DNA, 16 bp, Homo sapiens
cggagtcccaccttgg

SEQ ID NO: 3708243 - DNA, 22 bp, Homo sapiens
cggagtcccaccttggctgcag

SEQ ID NO: 3708244 - DNA, 15 bp, Homo sapiens
cggagtgacagagta

SEQ ID NO: 3708245 - DNA, 17 bp, Homo sapiens
cggagttcctaacagga

SEQ ID NO: 3708246 - DNA, 20 bp, Homo sapiens
cggagttcctaacaggatga

SEQ ID NO: 3708247 - DNA, 23 bp, Homo sapiens
cggatcaccgagagtagccgaga

SEQ ID NO: 3708248 - DNA, 16 bp, Homo sapiens
cggcaatttccggcca

SEQ ID NO: 3708249 - DNA, 20 bp, Homo sapiens
cggcacccacaagtgccact

SEQ ID NO: 3708250 - DNA, 15 bp, Homo sapiens
cggcacccacccagc

SEQ ID NO: 3708251 - DNA, 13 bp, Homo sapiens
cggcagagaggac

SEQ ID NO: 3708252 - DNA, 14 bp, Homo sapiens
cggcattcctgctt

SEQ ID NO: 3708253 - DNA, 21 bp, Homo sapiens
cggccagctgggatctgactg

SEQ ID NO: 3708254 - DNA, 24 bp, Homo sapiens
cggccaggccagagggagtgacag

SEQ ID NO: 3708255 - DNA, 19 bp, Homo sapiens
cggcccacagctcccaccc

SEQ ID NO: 3708256 - DNA, 13 bp, Homo sapiens
cggccgcattccc

SEQ ID NO: 3708257 - DNA, 15 bp, Homo sapiens
cggcctgatgctccc

SEQ ID NO: 3708258 - DNA, 19 bp, Homo sapiens
cggcctgatgctccctccc

SEQ ID NO: 3708259 - DNA, 23 bp, Homo sapiens
cggcctgatgctccctcccctgc

SEQ ID NO: 3708260 - DNA, 15 bp, Homo sapiens
cggcgcccccagtgt

SEQ ID NO: 3708261 - DNA, 13 bp, Homo sapiens
cggctactcagca

SEQ ID NO: 3708262 - DNA, 16 bp, Homo sapiens
cggctactcagcagcc

SEQ ID NO: 3708263 - DNA, 20 bp, Homo sapiens
cggctactcagcagccctcc

SEQ ID NO: 3708264 - DNA, 21 bp, Homo sapiens
cggctactcagcagccctcct

SEQ ID NO: 3708265 - DNA, 12 bp, Homo sapiens
cggctccaggct

SEQ ID NO: 3708266 - DNA, 15 bp, Homo sapiens
cgggaacagacaaca

SEQ ID NO: 3708267 - DNA, 21 bp, Homo sapiens
cgggactcactggcagcccca

SEQ ID NO: 3708268 - DNA, 23 bp, Homo sapiens
cgggactcactggcagccccagc

SEQ ID NO: 3708269 - DNA, 22 bp, Homo sapiens
cgggagcatctcttgaggccag

SEQ ID NO: 3708270 - DNA, 18 bp, Homo sapiens
cgggaggtcgaggcagga

SEQ ID NO: 3708271 - DNA, 16 bp, Homo sapiens
cgggatggtcctgggg

SEQ ID NO: 3708272 - DNA, 18 bp, Homo sapiens
cgggcacagctgtggtga

SEQ ID NO: 3708273 - DNA, 19 bp, Homo sapiens
cgggcacctatagtcccag

SEQ ID NO: 3708274 - DNA, 21 bp, Homo sapiens
cgggcacctatagtcccagct

SEQ ID NO: 3708275 - DNA, 14 bp, Homo sapiens
cgggccacagagaa

SEQ ID NO: 3708276 - DNA, 17 bp, Homo sapiens
cgggcgagtcactgcct

SEQ ID NO: 3708277 - DNA, 15 bp, Homo sapiens
cgggctcagcaaaag

SEQ ID NO: 3708278 - DNA, 14 bp, Homo sapiens
cgggctctctgctg

SEQ ID NO: 3708279 - DNA, 15 bp, Homo sapiens
cgggctgggcagctg

SEQ ID NO: 3708280 - DNA, 16 bp, Homo sapiens
cggggaactcctggaa

SEQ ID NO: 3708281 - DNA, 16 bp, Homo sapiens
cggggagcccccgccc

SEQ ID NO: 3708282 - DNA, 14 bp, Homo sapiens
cggggaggccaagt

SEQ ID NO: 3708283 - DNA, 19 bp, Homo sapiens
cggggcagctgccagagaa

SEQ ID NO: 3708284 - DNA, 14 bp, Homo sapiens
cgggggctggggca

SEQ ID NO: 3708285 - DNA, 13 bp, Homo sapiens
cggggggagggtt

SEQ ID NO: 3708286 - DNA, 15 bp, Homo sapiens
cgggtgctcagggct

SEQ ID NO: 3708287 - DNA, 18 bp, Homo sapiens
cgggtggctagtcagaga

SEQ ID NO: 3708288 - DNA, 17 bp, Homo sapiens
cgggttgtgtgtctgtt

SEQ ID NO: 3708289 - DNA, 23 bp, Homo sapiens
cgggtttggcgggccaaggactg

SEQ ID NO: 3708290 - DNA, 22 bp, Homo sapiens
cggtcccttgagacctcagcca

SEQ ID NO: 3708291 - DNA, 23 bp, Homo sapiens
cggtcccttgagacctcagccat

SEQ ID NO: 3708292 - DNA, 11 bp, Homo sapiens
cggtcctgtct

SEQ ID NO: 3708293 - DNA, 20 bp, Homo sapiens
cggtgagaggggaacagact

SEQ ID NO: 3708294 - DNA, 22 bp, Homo sapiens
cggtggctaaaggtcccaaggc

SEQ ID NO: 3708295 - DNA, 21 bp, Homo sapiens
cggtgtccatttatagaataa

SEQ ID NO: 3708296 - DNA, 15 bp, Homo sapiens
cggtgtgcctgcagc

SEQ ID NO: 3708297 - DNA, 18 bp, Homo sapiens
cggtgtggagaagcggct

SEQ ID NO: 3708298 - DNA, 16 bp, Homo sapiens
cggttttactgcagct

SEQ ID NO: 3708299 - DNA, 15 bp, Homo sapiens
cgtaaccacggaaaa

SEQ ID NO: 3708300 - DNA, 22 bp, Homo sapiens
cgtacttagcagctatctctca

SEQ ID NO: 3708301 - DNA, 16 bp, Homo sapiens
cgtagagggtgctgcc

SEQ ID NO: 3708302 - DNA, 17 bp, Homo sapiens
cgtagagggtgctgccc

SEQ ID NO: 3708303 - DNA, 20 bp, Homo sapiens
cgtagggagtacctgctgcc

SEQ ID NO: 3708304 - DNA, 20 bp, Homo sapiens
cgtagtgtagatttgttttg

SEQ ID NO: 3708305 - DNA, 14 bp, Homo sapiens
cgtagttccctgaa

SEQ ID NO: 3708306 - DNA, 22 bp, Homo sapiens
cgtatatgtctcaggtccctgc

SEQ ID NO: 3708307 - DNA, 20 bp, Homo sapiens
cgtccggcagttctgggtgc

SEQ ID NO: 3708308 - DNA, 15 bp, Homo sapiens
cgtcctccccctgcc

SEQ ID NO: 3708309 - DNA, 13 bp, Homo sapiens
cgtcctgccacct

SEQ ID NO: 3708310 - DNA, 18 bp, Homo sapiens
cgtcggggggacagctcc

SEQ ID NO: 3708311 - DNA, 17 bp, Homo sapiens
cgtctcaacccctcaca

SEQ ID NO: 3708312 - DNA, 17 bp, Homo sapiens
cgtctcccatcttaact

SEQ ID NO: 3708313 - DNA, 15 bp, Homo sapiens
cgtctgaccctctcc

SEQ ID NO: 3708314 - DNA, 17 bp, Homo sapiens
cgtctggggttcagccc

SEQ ID NO: 3708315 - DNA, 21 bp, Homo sapiens
cgtcttagcagtgatttttat

SEQ ID NO: 3708316 - DNA, 15 bp, Homo sapiens
cgtcttcagcctagc

SEQ ID NO: 3708317 - DNA, 19 bp, Homo sapiens
cgtcttctgtatactgtgg

SEQ ID NO: 3708318 - DNA, 20 bp, Homo sapiens
cgtgaaacacaccaggctgt

SEQ ID NO: 3708319 - DNA, 22 bp, Homo sapiens
cgtgaaacacaccaggctgtgg

SEQ ID NO: 3708320 - DNA, 15 bp, Homo sapiens
cgtgacaacacttgt

SEQ ID NO: 3708321 - DNA, 17 bp, Homo sapiens
cgtgacagtgcctggga

SEQ ID NO: 3708322 - DNA, 22 bp, Homo sapiens
cgtgactgccccaactcctgga

SEQ ID NO: 3708323 - DNA, 19 bp, Homo sapiens
cgtgagcagtgtgtctcct

SEQ ID NO: 3708324 - DNA, 15 bp, Homo sapiens
cgtgagccactgcac

SEQ ID NO: 3708325 - DNA, 19 bp, Homo sapiens
cgtgagtgaaccatcatta

SEQ ID NO: 3708326 - DNA, 21 bp, Homo sapiens
cgtgatccatccatctccagg

SEQ ID NO: 3708327 - DNA, 18 bp, Homo sapiens
ctaattctaaccagagca

SEQ ID NO: 3708328 - DNA, 16 bp, Homo sapiens
ctaatttgatgtttac

SEQ ID NO: 3708329 - DNA, 12 bp, Homo sapiens
ctaatttttaag

SEQ ID NO: 3708330 - DNA, 17 bp, Homo sapiens
ctaatttttaagcaaaa

SEQ ID NO: 3708331 - DNA, 19 bp, Homo sapiens
ctacaagagcagcctgtgg

SEQ ID NO: 3708332 - DNA, 20 bp, Homo sapiens
ctacaagagcagcctgtggc

SEQ ID NO: 3708333 - DNA, 22 bp, Homo sapiens
ctacaagagcagcctgtggcat

SEQ ID NO: 3708334 - DNA, 13 bp, Homo sapiens
ctacacccagcta

SEQ ID NO: 3708335 - DNA, 14 bp, Homo sapiens
ctacactccagcct

SEQ ID NO: 3708336 - DNA, 15 bp, Homo sapiens
ctacactctcctggg

SEQ ID NO: 3708337 - DNA, 23 bp, Homo sapiens
ctacactctcctgggcccctccc

SEQ ID NO: 3708338 - DNA, 22 bp, Homo sapiens
ctacactgtattacataaataa

SEQ ID NO: 3708339 - DNA, 20 bp, Homo sapiens
ctacactgtgaacttgggga

SEQ ID NO: 3708340 - DNA, 15 bp, Homo sapiens
ctacagcaaatttat

SEQ ID NO: 3708341 - DNA, 19 bp, Homo sapiens
ctacagctaatcagcattc

SEQ ID NO: 3708342 - DNA, 21 bp, Homo sapiens
ctacaggagagggaagagtgc

SEQ ID NO: 3708343 - DNA, 15 bp, Homo sapiens
ctacaggagtgagca

SEQ ID NO: 3708344 - DNA, 16 bp, Homo sapiens
ctacaggagtgagcac

SEQ ID NO: 3708345 - DNA, 15 bp, Homo sapiens
ctacaggcacccacc

SEQ ID NO: 3708346 - DNA, 16 bp, Homo sapiens
ctacaggcctcacaca

SEQ ID NO: 3708347 - DNA, 23 bp, Homo sapiens
ctacagttagggttgagttactt

SEQ ID NO: 3708348 - DNA, 13 bp, Homo sapiens
ctacagttgaaaa

SEQ ID NO: 3708349 - DNA, 18 bp, Homo sapiens
ctacatacaattccaaac

SEQ ID NO: 3708350 - DNA, 14 bp, Homo sapiens
ctacatcccagcct

SEQ ID NO: 3708351 - DNA, 13 bp, Homo sapiens
ctacatgaaacag

SEQ ID NO: 3708352 - DNA, 14 bp, Homo sapiens
ctacatgaaacaga

SEQ ID NO: 3708353 - DNA, 21 bp, Homo sapiens
ctacatgacgacaaagctgct

SEQ ID NO: 3708354 - DNA, 17 bp, Homo sapiens
ctacatgcagcccatgc

SEQ ID NO: 3708355 - DNA, 21 bp, Homo sapiens
ctacatgcagcccatgcccac

SEQ ID NO: 3708356 - DNA, 18 bp, Homo sapiens
ctacatggagtatatgtc

SEQ ID NO: 3708357 - DNA, 20 bp, Homo sapiens
ctacatggagtatatgtcaa

SEQ ID NO: 3708358 - DNA, 22 bp, Homo sapiens
ctacattataaatgtctcttta

SEQ ID NO: 3708359 - DNA, 23 bp, Homo sapiens
ctacatttcacctactttgtaag

SEQ ID NO: 3708360 - DNA, 12 bp, Homo sapiens
ctacattttaac

SEQ ID NO: 3708361 - DNA, 13 bp, Homo sapiens
ctacattttaaca

SEQ ID NO: 3708362 - DNA, 12 bp, Homo sapiens
ctaccaactgga

SEQ ID NO: 3708363 - DNA, 15 bp, Homo sapiens
ctaccaactggaagc

SEQ ID NO: 3708364 - DNA, 16 bp, Homo sapiens
ctaccaactggaagca

SEQ ID NO: 3708365 - DNA, 18 bp, Homo sapiens
ctaccaactggaagcaca

SEQ ID NO: 3708366 - DNA, 13 bp, Homo sapiens
ctaccacagtgtc

SEQ ID NO: 3708367 - DNA, 17 bp, Homo sapiens
ctacccaccctcctttc

SEQ ID NO: 3708368 - DNA, 22 bp, Homo sapiens
ctacccaccctcctttcaccac

SEQ ID NO: 3708369 - DNA, 22 bp, Homo sapiens
ctacccacttctaaatagcaat

SEQ ID NO: 3708370 - DNA, 13 bp, Homo sapiens
ctacccagcccat

SEQ ID NO: 3708371 - DNA, 18 bp, Homo sapiens
ctacccagcgagccctgg

SEQ ID NO: 3708372 - DNA, 19 bp, Homo sapiens
ctacccagcgagccctggt

SEQ ID NO: 3708373 - DNA, 13 bp, Homo sapiens
ctaccctcccacc

SEQ ID NO: 3708374 - DNA, 14 bp, Homo sapiens
ctaccctcccaccc

SEQ ID NO: 3708375 - DNA, 19 bp, Homo sapiens
ctaccgagtctcttctcca

SEQ ID NO: 3708376 - DNA, 21 bp, Homo sapiens
ctaccgagtctcttctccact

SEQ ID NO: 3708377 - DNA, 22 bp, Homo sapiens
ctaccgagtctcttctccactg

SEQ ID NO: 3708378 - DNA, 14 bp, Homo sapiens
ctacctcagcctag

SEQ ID NO: 3708379 - DNA, 15 bp, Homo sapiens
ctacctcagcctaga

SEQ ID NO: 3708380 - DNA, 22 bp, Homo sapiens
ctacctgaacacttattgcttt

SEQ ID NO: 3708381 - DNA, 23 bp, Homo sapiens
ctacctgaacacttattgctttg

SEQ ID NO: 3708382 - DNA, 16 bp, Homo sapiens
ctacctgatcccactc

SEQ ID NO: 3708383 - DNA, 17 bp, Homo sapiens
ctacctgatcccactcc

SEQ ID NO: 3708384 - DNA, 12 bp, Homo sapiens
ctacctgtgcct

SEQ ID NO: 3708385 - DNA, 16 bp, Homo sapiens
ctaccttcaaagctga

SEQ ID NO: 3708386 - DNA, 14 bp, Homo sapiens
ctaccttttctctt

SEQ ID NO: 3708387 - DNA, 21 bp, Homo sapiens
ctacgctctcctttctttcta

SEQ ID NO: 3708388 - DNA, 21 bp, Homo sapiens
ctactacatcgccctccacat

SEQ ID NO: 3708389 - DNA, 16 bp, Homo sapiens
ctactaccacaaggaa

SEQ ID NO: 3708390 - DNA, 17 bp, Homo sapiens
ctactaccacaaggaaa

SEQ ID NO: 3708391 - DNA, 19 bp, Homo sapiens
ctactaccacaaggaaaat

SEQ ID NO: 3708392 - DNA, 23 bp, Homo sapiens
ctactcaccttgaacaccacgct

SEQ ID NO: 3708393 - DNA, 15 bp, Homo sapiens
ctactcactcaagtt

SEQ ID NO: 3708394 - DNA, 13 bp, Homo sapiens
ctactcagaagcc

SEQ ID NO: 3708395 - DNA, 16 bp, Homo sapiens
ctactcagcagccctc

SEQ ID NO: 3708396 - DNA, 20 bp, Homo sapiens
ctactcagcagccctcctca

SEQ ID NO: 3708397 - DNA, 22 bp, Homo sapiens
ctactcagcagccctcctcacc

SEQ ID NO: 3708398 - DNA, 20 bp, Homo sapiens
ctactcaggaggctgaggca

SEQ ID NO: 3708399 - DNA, 18 bp, Homo sapiens
ctactcctacctcagcct

SEQ ID NO: 3708400 - DNA, 19 bp, Homo sapiens
ctactctgttccttcacat

SEQ ID NO: 3708401 - DNA, 17 bp, Homo sapiens
ctactgactttctcagc

SEQ ID NO: 3708402 - DNA, 14 bp, Homo sapiens
ctactgaggtgcta

SEQ ID NO: 3708403 - DNA, 16 bp, Homo sapiens
ctactgattgtttcat

SEQ ID NO: 3708404 - DNA, 19 bp, Homo sapiens
ctactgtcctacccaccct

SEQ ID NO: 3708405 - DNA, 17 bp, Homo sapiens
ctactgtggaaaaatat

SEQ ID NO: 3708406 - DNA, 20 bp, Homo sapiens
ctactgtggaaaaatattta

SEQ ID NO: 3708407 - DNA, 14 bp, Homo sapiens
ctactgtgttcctg

SEQ ID NO: 3708408 - DNA, 20 bp, Homo sapiens
ctactgtgttcctggcaata

SEQ ID NO: 3708409 - DNA, 22 bp, Homo sapiens
ctacttcttttgctcttagctg

SEQ ID NO: 3708410 - DNA, 21 bp, Homo sapiens
ctacttttccttccctcaaag

SEQ ID NO: 3708411 - DNA, 23 bp, Homo sapiens
ctagaaagtgaataaaaattaag

SEQ ID NO: 3708412 - DNA, 19 bp, Homo sapiens
ctagaaattccccaccctg

SEQ ID NO: 3708413 - DNA, 23 bp, Homo sapiens
ctagaaatttttcagatgcttct

SEQ ID NO: 3708414 - DNA, 22 bp, Homo sapiens
ctagaacacaggcaaaatcctt

SEQ ID NO: 3708415 - DNA, 14 bp, Homo sapiens
ctagaagaaatgaa

SEQ ID NO: 3708416 - DNA, 17 bp, Homo sapiens
ctagaagaaatgaaatt

SEQ ID NO: 3708417 - DNA, 22 bp, Homo sapiens
ctagaagaaatgaaattttacc

SEQ ID NO: 3708418 - DNA, 22 bp, Homo sapiens
ctagaagattttgaaattttta

SEQ ID NO: 3708419 - DNA, 13 bp, Homo sapiens
ctagaagggaagg

SEQ ID NO: 3708420 - DNA, 22 bp, Homo sapiens
ctagaatcagcctaggggtcag

SEQ ID NO: 3708421 - DNA, 23 bp, Homo sapiens
ctagaatttattcaattcctctg

SEQ ID NO: 3708422 - DNA, 16 bp, Homo sapiens
ctagacctccagctgt

SEQ ID NO: 3708423 - DNA, 20 bp, Homo sapiens
ctagacgttcatttgtgtgc

SEQ ID NO: 3708424 - DNA, 17 bp, Homo sapiens
ctagagatatggcagcg

SEQ ID NO: 3708425 - DNA, 19 bp, Homo sapiens
ctagaggaaccaaccccca

SEQ ID NO: 3708426 - DNA, 21 bp, Homo sapiens
ctagaggccagccccacccag

SEQ ID NO: 3708427 - DNA, 22 bp, Homo sapiens
ctctgaaggacattgcggacag

SEQ ID NO: 3708428 - DNA, 22 bp, Homo sapiens
ctctgaagggcatcatgcatct

SEQ ID NO: 3708429 - DNA, 13 bp, Homo sapiens
ctctgaagtcaca

SEQ ID NO: 3708430 - DNA, 18 bp, Homo sapiens
ctctgacacacagctctg

SEQ ID NO: 3708431 - DNA, 19 bp, Homo sapiens
ctctgacacacagctctgt

SEQ ID NO: 3708432 - DNA, 23 bp, Homo sapiens
ctctgaccgaaacagcgctgggt

SEQ ID NO: 3708433 - DNA, 13 bp, Homo sapiens
ctctgacctgcag

SEQ ID NO: 3708434 - DNA, 13 bp, Homo sapiens
ctctgactcccaa

SEQ ID NO: 3708435 - DNA, 23 bp, Homo sapiens
ctctgactcccaaagagctgcct

SEQ ID NO: 3708436 - DNA, 13 bp, Homo sapiens
ctctgagcccctg

SEQ ID NO: 3708437 - DNA, 16 bp, Homo sapiens
ctctgaggacactaac

SEQ ID NO: 3708438 - DNA, 20 bp, Homo sapiens
ctctgaggctctttctgggc

SEQ ID NO: 3708439 - DNA, 16 bp, Homo sapiens
ctctgagtttaccatt

SEQ ID NO: 3708440 - DNA, 17 bp, Homo sapiens
ctctgagtttaccattt

SEQ ID NO: 3708441 - DNA, 20 bp, Homo sapiens
ctctgatattccatgaatgt

SEQ ID NO: 3708442 - DNA, 16 bp, Homo sapiens
ctctgatcttgtgctc

SEQ ID NO: 3708443 - DNA, 18 bp, Homo sapiens
ctctgatgtaaatgaagt

SEQ ID NO: 3708444 - DNA, 18 bp, Homo sapiens
ctctgattttcaaagctt

SEQ ID NO: 3708445 - DNA, 22 bp, Homo sapiens
ctctgattttcaaagctttttc

SEQ ID NO: 3708446 - DNA, 13 bp, Homo sapiens
ctctgcacaagct

SEQ ID NO: 3708447 - DNA, 17 bp, Homo sapiens
ctctgcacaagctgcac

SEQ ID NO: 3708448 - DNA, 10 bp, Homo sapiens
ctctgcacag

SEQ ID NO: 3708449 - DNA, 14 bp, Homo sapiens
ctctgcacagatgg

SEQ ID NO: 3708450 - DNA, 15 bp, Homo sapiens
ctctgcacagatgga

SEQ ID NO: 3708451 - DNA, 13 bp, Homo sapiens
ctctgcagccagc

SEQ ID NO: 3708452 - DNA, 14 bp, Homo sapiens
ctctgcagccagcc

SEQ ID NO: 3708453 - DNA, 13 bp, Homo sapiens
ctctgccacctcc

SEQ ID NO: 3708454 - DNA, 20 bp, Homo sapiens
ctctgccatgaactggaggc

SEQ ID NO: 3708455 - DNA, 14 bp, Homo sapiens
ctctgcccagagct

SEQ ID NO: 3708456 - DNA, 16 bp, Homo sapiens
ctctgcccagagctgg

SEQ ID NO: 3708457 - DNA, 17 bp, Homo sapiens
ctctgcccagagctggg

SEQ ID NO: 3708458 - DNA, 20 bp, Homo sapiens
ctctgcccagagctgggtga

SEQ ID NO: 3708459 - DNA, 15 bp, Homo sapiens
ctctgcccattcccc

SEQ ID NO: 3708460 - DNA, 13 bp, Homo sapiens
ctctgccccagct

SEQ ID NO: 3708461 - DNA, 20 bp, Homo sapiens
ctctgccctgccctagctcc

SEQ ID NO: 3708462 - DNA, 16 bp, Homo sapiens
ctctgcctcctcttca

SEQ ID NO: 3708463 - DNA, 14 bp, Homo sapiens
ctctgcctctgaca

SEQ ID NO: 3708464 - DNA, 16 bp, Homo sapiens
ctctgcctctgacaca

SEQ ID NO: 3708465 - DNA, 19 bp, Homo sapiens
ctctgcctctgacacacag

SEQ ID NO: 3708466 - DNA, 20 bp, Homo sapiens
ctctgcctctgacacacagc

SEQ ID NO: 3708467 - DNA, 16 bp, Homo sapiens
ctctgcctgtccctct

SEQ ID NO: 3708468 - DNA, 21 bp, Homo sapiens
ctctgcctgtccctctcaggc

SEQ ID NO: 3708469 - DNA, 16 bp, Homo sapiens
ctctgcctgtgagcca

SEQ ID NO: 3708470 - DNA, 17 bp, Homo sapiens
ctctgcctgtgagccag

SEQ ID NO: 3708471 - DNA, 19 bp, Homo sapiens
ctctgcctgtgagccagtc

SEQ ID NO: 3708472 - DNA, 18 bp, Homo sapiens
ctctgctgacagacacag

SEQ ID NO: 3708473 - DNA, 19 bp, Homo sapiens
ctctgctgacagacacagg

SEQ ID NO: 3708474 - DNA, 21 bp, Homo sapiens
ctctgctgacagacacaggcc

SEQ ID NO: 3708475 - DNA, 13 bp, Homo sapiens
ctctgctgccatg

SEQ ID NO: 3708476 - DNA, 18 bp, Homo sapiens
ctctgctggtcttcaatt

SEQ ID NO: 3708477 - DNA, 23 bp, Homo sapiens
ctctgctgtacatatttgagact

SEQ ID NO: 3708478 - DNA, 23 bp, Homo sapiens
ctctgcttgccgaaactggaagt

SEQ ID NO: 3708479 - DNA, 23 bp, Homo sapiens
ctctggaaaggaggaaggagcct

SEQ ID NO: 3708480 - DNA, 22 bp, Homo sapiens
ctctggacaggcatgttctctg

SEQ ID NO: 3708481 - DNA, 14 bp, Homo sapiens
ctctggactggcta

SEQ ID NO: 3708482 - DNA, 14 bp, Homo sapiens
ctctggagccacct

SEQ ID NO: 3708483 - DNA, 20 bp, Homo sapiens
ctctggagccacctgtccca

SEQ ID NO: 3708484 - DNA, 15 bp, Homo sapiens
ctctggaggcctctg

SEQ ID NO: 3708485 - DNA, 22 bp, Homo sapiens
ctctggaggcctctgggcctcc

SEQ ID NO: 3708486 - DNA, 15 bp, Homo sapiens
ctctggcctctgtca

SEQ ID NO: 3708487 - DNA, 16 bp, Homo sapiens
ctctggcgacagtttt

SEQ ID NO: 3708488 - DNA, 19 bp, Homo sapiens
ctctggctagaggccagcc

SEQ ID NO: 3708489 - DNA, 18 bp, Homo sapiens
ctctggctcacagactgg

SEQ ID NO: 3708490 - DNA, 22 bp, Homo sapiens
ctctggctcacagactggagac

SEQ ID NO: 3708491 - DNA, 13 bp, Homo sapiens
ctctggctggcta

SEQ ID NO: 3708492 - DNA, 23 bp, Homo sapiens
ctctggctggctaactggaagca

SEQ ID NO: 3708493 - DNA, 15 bp, Homo sapiens
ctctgggcaggacct

SEQ ID NO: 3708494 - DNA, 17 bp, Homo sapiens
ctctgggctgccatgtg

SEQ ID NO: 3708495 - DNA, 22 bp, Homo sapiens
ctctgggctttgattccatctc

SEQ ID NO: 3708496 - DNA, 23 bp, Homo sapiens
ctctgggctttgattccatctcc

SEQ ID NO: 3708497 - DNA, 16 bp, Homo sapiens
ctctggtgacaccagc

SEQ ID NO: 3708498 - DNA, 18 bp, Homo sapiens
ctctggtgacaccagcct

SEQ ID NO: 3708499 - DNA, 21 bp, Homo sapiens
aaactttattttatataataa

SEQ ID NO: 3708500 - DNA, 15 bp, Homo sapiens
aaacttttagaaact

SEQ ID NO: 3708501 - DNA, 19 bp, Homo sapiens
aaacttttataaattaaat

SEQ ID NO: 3708502 - DNA, 21 bp, Homo sapiens
aaacttttataaattaaatat

SEQ ID NO: 3708503 - DNA, 17 bp, Homo sapiens
aaagaaaatatgcatct

SEQ ID NO: 3708504 - DNA, 18 bp, Homo sapiens
aaagaaaattcttggaat

SEQ ID NO: 3708505 - DNA, 20 bp, Homo sapiens
aaagaaaccccaaactcagg

SEQ ID NO: 3708506 - DNA, 16 bp, Homo sapiens
aaagaaatcatgttat

SEQ ID NO: 3708507 - DNA, 15 bp, Homo sapiens
aaagaaatgcacaat

SEQ ID NO: 3708508 - DNA, 15 bp, Homo sapiens
aaagaatcattattt

SEQ ID NO: 3708509 - DNA, 21 bp, Homo sapiens
aaagaatttcaatttgttcag

SEQ ID NO: 3708510 - DNA, 22 bp, Homo sapiens
aaagacaaattctgtttcttga

SEQ ID NO: 3708511 - DNA, 14 bp, Homo sapiens
aaagacatcaagca

SEQ ID NO: 3708512 - DNA, 17 bp, Homo sapiens
aaagactatctaaatgt

SEQ ID NO: 3708513 - DNA, 12 bp, Homo sapiens
aaagagaaactt

SEQ ID NO: 3708514 - DNA, 13 bp, Homo sapiens
aaagagaaacttt

SEQ ID NO: 3708515 - DNA, 20 bp, Homo sapiens
aaagagaatgccattctctt

SEQ ID NO: 3708516 - DNA, 15 bp, Homo sapiens
aaagatacatttgta

SEQ ID NO: 3708517 - DNA, 16 bp, Homo sapiens
aaagatacatttgtat

SEQ ID NO: 3708518 - DNA, 20 bp, Homo sapiens
aaagatacgactttattttc

SEQ ID NO: 3708519 - DNA, 22 bp, Homo sapiens
aaagatacgactttattttctg

SEQ ID NO: 3708520 - DNA, 23 bp, Homo sapiens
aaagatggcttttgtttcttccc

SEQ ID NO: 3708521 - DNA, 21 bp, Homo sapiens
aaagatgtttgtcagatatga

SEQ ID NO: 3708522 - DNA, 14 bp, Homo sapiens
aaagatttcttgag

SEQ ID NO: 3708523 - DNA, 21 bp, Homo sapiens
aaagcaaacttaagaaacact

SEQ ID NO: 3708524 - DNA, 13 bp, Homo sapiens
aaagcaaatgaga

SEQ ID NO: 3708525 - DNA, 14 bp, Homo sapiens
aaagcaaggatctt

SEQ ID NO: 3708526 - DNA, 12 bp, Homo sapiens
aaagcacatcca

SEQ ID NO: 3708527 - DNA, 13 bp, Homo sapiens
aaagcacctgccg

SEQ ID NO: 3708528 - DNA, 23 bp, Homo sapiens
aaagcagaggctggcctcagact

SEQ ID NO: 3708529 - DNA, 19 bp, Homo sapiens
aaagcagctcaaaggcaca

SEQ ID NO: 3708530 - DNA, 22 bp, Homo sapiens
aaagcattcaatttattcaaga

SEQ ID NO: 3708531 - DNA, 17 bp, Homo sapiens
aaagccaaactctgcca

SEQ ID NO: 3708532 - DNA, 15 bp, Homo sapiens
aaagccaaagctagg

SEQ ID NO: 3708533 - DNA, 14 bp, Homo sapiens
aaagccagaagctg

SEQ ID NO: 3708534 - DNA, 14 bp, Homo sapiens
aaagccagtcttaa

SEQ ID NO: 3708535 - DNA, 17 bp, Homo sapiens
aaagccatcatgtaaat

SEQ ID NO: 3708536 - DNA, 16 bp, Homo sapiens
aaagctaggcctggcc

SEQ ID NO: 3708537 - DNA, 15 bp, Homo sapiens
aaagctgaaaactgc

SEQ ID NO: 3708538 - DNA, 22 bp, Homo sapiens
aaagctgattactgtcaataaa

SEQ ID NO: 3708539 - DNA, 19 bp, Homo sapiens
aaagctggtgggtgaaaga

SEQ ID NO: 3708540 - DNA, 23 bp, Homo sapiens
aaagctggtgggtgaaagaaatc

SEQ ID NO: 3708541 - DNA, 11 bp, Homo sapiens
aaagcttcccc

SEQ ID NO: 3708542 - DNA, 20 bp, Homo sapiens
aaagcttgaagatcgttagt

SEQ ID NO: 3708543 - DNA, 14 bp, Homo sapiens
aaagctttcctgga

SEQ ID NO: 3708544 - DNA, 21 bp, Homo sapiens
aaaggaaaaagtatcatggaa

SEQ ID NO: 3708545 - DNA, 23 bp, Homo sapiens
aaaggaaatctcaccccatccca

SEQ ID NO: 3708546 - DNA, 15 bp, Homo sapiens
aaaggaatggaggct

SEQ ID NO: 3708547 - DNA, 19 bp, Homo sapiens
aaaggacaggcagaaagag

SEQ ID NO: 3708548 - DNA, 22 bp, Homo sapiens
aaaggactgttttttcctgagc

SEQ ID NO: 3708549 - DNA, 17 bp, Homo sapiens
aaaggagagctagcagc

SEQ ID NO: 3708550 - DNA, 21 bp, Homo sapiens
aaaggagagtcttgcagtgat

SEQ ID NO: 3708551 - DNA, 21 bp, Homo sapiens
aaaggagcttacctcccacct

SEQ ID NO: 3708552 - DNA, 20 bp, Homo sapiens
aaaggataaacttttagaaa

SEQ ID NO: 3708553 - DNA, 16 bp, Homo sapiens
aaaggatatttaagaa

SEQ ID NO: 3708554 - DNA, 23 bp, Homo sapiens
aaaggatatttaagaaaatacaa

SEQ ID NO: 3708555 - DNA, 15 bp, Homo sapiens
aaaggatattttctt

SEQ ID NO: 3708556 - DNA, 20 bp, Homo sapiens
aaaggcacctataaaacagg

SEQ ID NO: 3708557 - DNA, 18 bp, Homo sapiens
aaaggcattctctgaaga

SEQ ID NO: 3708558 - DNA, 14 bp, Homo sapiens
aaaggccagctggc

SEQ ID NO: 3708559 - DNA, 18 bp, Homo sapiens
aaaggccagctggcagca

SEQ ID NO: 3708560 - DNA, 19 bp, Homo sapiens
aaaggctcagtctcaggag

SEQ ID NO: 3708561 - DNA, 12 bp, Homo sapiens
aaagggacatga

SEQ ID NO: 3708562 - DNA, 22 bp, Homo sapiens
aaagggacttggaagctccgct

SEQ ID NO: 3708563 - DNA, 17 bp, Homo sapiens
aaagggagagagagagg

SEQ ID NO: 3708564 - DNA, 18 bp, Homo sapiens
aaaggggcagaaaaactc

SEQ ID NO: 3708565 - DNA, 13 bp, Homo sapiens
aaaggggggaggg

SEQ ID NO: 3708566 - DNA, 18 bp, Homo sapiens
aaaggggggagggggagg

SEQ ID NO: 3708567 - DNA, 18 bp, Homo sapiens
aaaggggtcccatagagg

SEQ ID NO: 3708568 - DNA, 19 bp, Homo sapiens
aaagggtgaagctatttat

SEQ ID NO: 3708569 - DNA, 14 bp, Homo sapiens
aaaggttttcctct

SEQ ID NO: 3708570 - DNA, 19 bp, Homo sapiens
aaagtaagcccttgaagat

SEQ ID NO: 3708571 - DNA, 22 bp, Homo sapiens
aaagtaatttcttctcaaaggg

SEQ ID NO: 3708572 - DNA, 14 bp, Homo sapiens
aaagtagattaaga

SEQ ID NO: 3708573 - DNA, 19 bp, Homo sapiens
aaagtatcatggaaatatt

SEQ ID NO: 3708574 - DNA, 19 bp, Homo sapiens
aaagtatcgggggctgggg

SEQ ID NO: 3708575 - DNA, 14 bp, Homo sapiens
aaagtattccacct

SEQ ID NO: 3708576 - DNA, 12 bp, Homo sapiens
aaagtctccagc

SEQ ID NO: 3708577 - DNA, 14 bp, Homo sapiens
aaagtctccagccc

SEQ ID NO: 3708578 - DNA, 23 bp, Homo sapiens
aaagtctctatttaaattctttt

SEQ ID NO: 3708579 - DNA, 17 bp, Homo sapiens
aaagtcttcaagggctg

SEQ ID NO: 3708580 - DNA, 20 bp, Homo sapiens
aaagtcttgctgtggtctct

SEQ ID NO: 3708581 - DNA, 23 bp, Homo sapiens
aaagtcttgctgtggtctctttg

SEQ ID NO: 3708582 - DNA, 21 bp, Homo sapiens
aaagtcttgtgactagtgctg

SEQ ID NO: 3708583 - DNA, 21 bp, Homo sapiens
aaagtgaatttgaatgaaaaa

SEQ ID NO: 3708584 - DNA, 23 bp, Homo sapiens
aaagtgatcaataaaatgtgatt

SEQ ID NO: 3708585 - DNA, 23 bp, Homo sapiens
aaagtgcagctccgtttggcagt

SEQ ID NO: 3708586 - DNA, 16 bp, Homo sapiens
aaagtggaaggaaaga

SEQ ID NO: 3708587 - DNA, 17 bp, Homo sapiens
aaagtgtaacatatgca

SEQ ID NO: 3708588 - DNA, 14 bp, Homo sapiens
aaagtgtattataa

SEQ ID NO: 3708589 - DNA, 16 bp, Homo sapiens
aaagtgttttcagagc

SEQ ID NO: 3708590 - DNA, 15 bp, Homo sapiens
aaagttaaaaaaaat

SEQ ID NO: 3708591 - DNA, 20 bp, Homo sapiens
aaagttaacctacctgtaac

SEQ ID NO: 3708592 - DNA, 21 bp, Homo sapiens
aaagttattaatattttaatt

SEQ ID NO: 3708593 - DNA, 19 bp, Homo sapiens
aaagttcataacagtgcca

SEQ ID NO: 3708594 - DNA, 12 bp, Homo sapiens
aaagttctgtgt

SEQ ID NO: 3708595 - DNA, 12 bp, Homo sapiens
aaagtttaaaat

SEQ ID NO: 3708596 - DNA, 23 bp, Homo sapiens
aaagtttctcttttcaaaacatt

SEQ ID NO: 3708597 - DNA, 14 bp, Homo sapiens
aaataaaaataaat

SEQ ID NO: 3708598 - DNA, 23 bp, Homo sapiens
aaataaaaattattattgatttt

SEQ ID NO: 3708599 - DNA, 14 bp, Homo sapiens
aaataaaaccagct

SEQ ID NO: 3708600 - DNA, 15 bp, Homo sapiens
aaataaaacctttca

SEQ ID NO: 3708601 - DNA, 20 bp, Homo sapiens
aaataaaagaaatgcacaat

SEQ ID NO: 3708602 - DNA, 19 bp, Homo sapiens
aaataaaagcagcatctgc

SEQ ID NO: 3708603 - DNA, 13 bp, Homo sapiens
aaataaaataacc

SEQ ID NO: 3708604 - DNA, 21 bp, Homo sapiens
aaataaacacatagattcacc

SEQ ID NO: 3708605 - DNA, 20 bp, Homo sapiens
aaataaagcttgcaacaaaa

SEQ ID NO: 3708606 - DNA, 20 bp, Homo sapiens
aaataaagtatatatagaat

SEQ ID NO: 3708607 - DNA, 18 bp, Homo sapiens
aaataaagttggtgacag

SEQ ID NO: 3708608 - DNA, 13 bp, Homo sapiens
aaataaatgcaat

SEQ ID NO: 3708609 - DNA, 21 bp, Homo sapiens
aaataaatgtatcatagaaat

SEQ ID NO: 3708610 - DNA, 12 bp, Homo sapiens
aaataagagaga

SEQ ID NO: 3708611 - DNA, 17 bp, Homo sapiens
aacgccagtctcccagg

SEQ ID NO: 3708612 - DNA, 23 bp, Homo sapiens
aacgccagtctcccaggccccct

SEQ ID NO: 3708613 - DNA, 12 bp, Homo sapiens
aacggggagaaa

SEQ ID NO: 3708614 - DNA, 12 bp, Homo sapiens
aacgtgaaaatg

SEQ ID NO: 3708615 - DNA, 20 bp, Homo sapiens
aacgtgatgatcagctgttt

SEQ ID NO: 3708616 - DNA, 18 bp, Homo sapiens
aacgtgggagttcagctg

SEQ ID NO: 3708617 - DNA, 18 bp, Homo sapiens
aacgtttcagtaataaaa

SEQ ID NO: 3708618 - DNA, 18 bp, Homo sapiens
aacgttttgtttgaaaaa

SEQ ID NO: 3708619 - DNA, 14 bp, Homo sapiens
aactaataaaagca

SEQ ID NO: 3708620 - DNA, 22 bp, Homo sapiens
aactaatctattgggttcatta

SEQ ID NO: 3708621 - DNA, 22 bp, Homo sapiens
aactagaatttattcaattcct

SEQ ID NO: 3708622 - DNA, 23 bp, Homo sapiens
aactagactcccaagctggacta

SEQ ID NO: 3708623 - DNA, 20 bp, Homo sapiens
aactagaggttttatgatat

SEQ ID NO: 3708624 - DNA, 15 bp, Homo sapiens
aactaggaaaattgg

SEQ ID NO: 3708625 - DNA, 17 bp, Homo sapiens
aactagggaagataata

SEQ ID NO: 3708626 - DNA, 15 bp, Homo sapiens
aactagtcctttact

SEQ ID NO: 3708627 - DNA, 20 bp, Homo sapiens
aactatgtacaatattttaa

SEQ ID NO: 3708628 - DNA, 23 bp, Homo sapiens
aactatttatctgtgtttttgaa

SEQ ID NO: 3708629 - DNA, 15 bp, Homo sapiens
aactcaaaatatttg

SEQ ID NO: 3708630 - DNA, 14 bp, Homo sapiens
aactcaaacacaga

SEQ ID NO: 3708631 - DNA, 17 bp, Homo sapiens
aactcaaactcttaaaa

SEQ ID NO: 3708632 - DNA, 12 bp, Homo sapiens
aactcaatattt

SEQ ID NO: 3708633 - DNA, 21 bp, Homo sapiens
aactcaccatgtaaaagagtc

SEQ ID NO: 3708634 - DNA, 22 bp, Homo sapiens
aactcacccccaaggggcagtc

SEQ ID NO: 3708635 - DNA, 21 bp, Homo sapiens
aactcacctaatgtttatgag

SEQ ID NO: 3708636 - DNA, 16 bp, Homo sapiens
aactcacctgctggcc

SEQ ID NO: 3708637 - DNA, 21 bp, Homo sapiens
aactcacctgctggcccctca

SEQ ID NO: 3708638 - DNA, 18 bp, Homo sapiens
aactcaggactccagccc

SEQ ID NO: 3708639 - DNA, 18 bp, Homo sapiens
aactcagttttaactaga

SEQ ID NO: 3708640 - DNA, 15 bp, Homo sapiens
aactcatcataaaat

SEQ ID NO: 3708641 - DNA, 18 bp, Homo sapiens
aactcatcataaaataaa

SEQ ID NO: 3708642 - DNA, 19 bp, Homo sapiens
aactcattcctgcctgtct

SEQ ID NO: 3708643 - DNA, 22 bp, Homo sapiens
aactcattcctgcctgtctcct

SEQ ID NO: 3708644 - DNA, 23 bp, Homo sapiens
aactcattcctgcctgtctcctt

SEQ ID NO: 3708645 - DNA, 12 bp, Homo sapiens
aactcctggcct

SEQ ID NO: 3708646 - DNA, 15 bp, Homo sapiens
aactcctgggctcaa

SEQ ID NO: 3708647 - DNA, 12 bp, Homo sapiens
aactctctccac

SEQ ID NO: 3708648 - DNA, 21 bp, Homo sapiens
aactctgggctgctacccaga

SEQ ID NO: 3708649 - DNA, 18 bp, Homo sapiens
aactgaaaacataaaaag

SEQ ID NO: 3708650 - DNA, 19 bp, Homo sapiens
aactgaaaacataaaaagt

SEQ ID NO: 3708651 - DNA, 20 bp, Homo sapiens
aactgaaaagactcagtgtt

SEQ ID NO: 3708652 - DNA, 16 bp, Homo sapiens
aactgaacaaaaaaat

SEQ ID NO: 3708653 - DNA, 13 bp, Homo sapiens
aactgaaggagaa

SEQ ID NO: 3708654 - DNA, 15 bp, Homo sapiens
aactgaaggagaagg

SEQ ID NO: 3708655 - DNA, 14 bp, Homo sapiens
aactgagctcctct

SEQ ID NO: 3708656 - DNA, 18 bp, Homo sapiens
aactgagctcctctgggc

SEQ ID NO: 3708657 - DNA, 22 bp, Homo sapiens
aactgagctcctctgggcagga

SEQ ID NO: 3708658 - DNA, 13 bp, Homo sapiens
aactgattcataa

SEQ ID NO: 3708659 - DNA, 18 bp, Homo sapiens
aactgcaatagagactgt

SEQ ID NO: 3708660 - DNA, 22 bp, Homo sapiens
aactgcaatagagactgtagat

SEQ ID NO: 3708661 - DNA, 14 bp, Homo sapiens
aactgcattgagaa

SEQ ID NO: 3708662 - DNA, 17 bp, Homo sapiens
aactgccttaaaacttt

SEQ ID NO: 3708663 - DNA, 16 bp, Homo sapiens
aactgccttggcttca

SEQ ID NO: 3708664 - DNA, 15 bp, Homo sapiens
aactgctgactgttt

SEQ ID NO: 3708665 - DNA, 21 bp, Homo sapiens
aactgctgactgttttctctt

SEQ ID NO: 3708666 - DNA, 23 bp, Homo sapiens
aactgctgactgttttctcttga

SEQ ID NO: 3708667 - DNA, 18 bp, Homo sapiens
aactgctgatgctcatgg

SEQ ID NO: 3708668 - DNA, 22 bp, Homo sapiens
aactggactcaggatgcccagg

SEQ ID NO: 3708669 - DNA, 17 bp, Homo sapiens
aactggcagttttccat

SEQ ID NO: 3708670 - DNA, 14 bp, Homo sapiens
aactggccctcttc

SEQ ID NO: 3708671 - DNA, 16 bp, Homo sapiens
aactggccctcttctt

SEQ ID NO: 3708672 - DNA, 11 bp, Homo sapiens
aactggctgca

SEQ ID NO: 3708673 - DNA, 18 bp, Homo sapiens
aactgtacttttaaggca

SEQ ID NO: 3708674 - DNA, 17 bp, Homo sapiens
aactgtgtatgtacata

SEQ ID NO: 3708675 - DNA, 18 bp, Homo sapiens
aactgtgtggactgtgat

SEQ ID NO: 3708676 - DNA, 18 bp, Homo sapiens
aactgttgccagagatgg

SEQ ID NO: 3708677 - DNA, 16 bp, Homo sapiens
aacttaaattttaatt

SEQ ID NO: 3708678 - DNA, 23 bp, Homo sapiens
aacttacattgtgaaacttctgt

SEQ ID NO: 3708679 - DNA, 19 bp, Homo sapiens
aacttagcatgtgttgaaa

SEQ ID NO: 3708680 - DNA, 23 bp, Homo sapiens
aacttagtgcggacaagttttaa

SEQ ID NO: 3708681 - DNA, 22 bp, Homo sapiens
aacttcagagggaaagtaaata

SEQ ID NO: 3708682 - DNA, 20 bp, Homo sapiens
aacttcatatatgaggactt

SEQ ID NO: 3708683 - DNA, 20 bp, Homo sapiens
aacttcgaaagcatcattat

SEQ ID NO: 3708684 - DNA, 24 bp, Homo sapiens
aacttctttgtaatcgttatgtgt

SEQ ID NO: 3708685 - DNA, 23 bp, Homo sapiens
aacttggaaaaatccagaaagaa

SEQ ID NO: 3708686 - DNA, 12 bp, Homo sapiens
aacttgggaact

SEQ ID NO: 3708687 - DNA, 19 bp, Homo sapiens
aacttggggaacaagggtg

SEQ ID NO: 3708688 - DNA, 18 bp, Homo sapiens
aacttgtaaatgctgtca

SEQ ID NO: 3708689 - DNA, 17 bp, Homo sapiens
aacttgtattaaagaca

SEQ ID NO: 3708690 - DNA, 17 bp, Homo sapiens
aactttcaatatcttta

SEQ ID NO: 3708691 - DNA, 20 bp, Homo sapiens
aacttttataaattaaatat

SEQ ID NO: 3708692 - DNA, 14 bp, Homo sapiens
aacttttgtaaata

SEQ ID NO: 3708693 - DNA, 20 bp, Homo sapiens
aagaaaaaaataattttatg

SEQ ID NO: 3708694 - DNA, 18 bp, Homo sapiens
aagaaaaagaaaaagaaa

SEQ ID NO: 3708695 - DNA, 12 bp, Homo sapiens
aagaaaaatcag

SEQ ID NO: 3708696 - DNA, 17 bp, Homo sapiens
aagaaaaatgagcctgg

SEQ ID NO: 3708697 - DNA, 16 bp, Homo sapiens
aagaaaatacaataaa

SEQ ID NO: 3708698 - DNA, 16 bp, Homo sapiens
aagaaactcaccccca

SEQ ID NO: 3708699 - DNA, 16 bp, Homo sapiens
aagaaagccagtctta

SEQ ID NO: 3708700 - DNA, 18 bp, Homo sapiens
aagaaaggggcaggagct

SEQ ID NO: 3708701 - DNA, 14 bp, Homo sapiens
aagaaatcatgtta

SEQ ID NO: 3708702 - DNA, 18 bp, Homo sapiens
aagaaatgaaattttacc

SEQ ID NO: 3708703 - DNA, 14 bp, Homo sapiens
aagaacaacggcaa

SEQ ID NO: 3708704 - DNA, 14 bp, Homo sapiens
aagaacaagaattt

SEQ ID NO: 3708705 - DNA, 21 bp, Homo sapiens
aagaactagaggttttatgat

SEQ ID NO: 3708706 - DNA, 11 bp, Homo sapiens
aagaactgcat

SEQ ID NO: 3708707 - DNA, 23 bp, Homo sapiens
aagaactgcatggacctaacatt

SEQ ID NO: 3708708 - DNA, 16 bp, Homo sapiens
aagaagacatgaacca

SEQ ID NO: 3708709 - DNA, 17 bp, Homo sapiens
aagaagccgggaacaga

SEQ ID NO: 3708710 - DNA, 20 bp, Homo sapiens
aagaaggaaatgaatttctc

SEQ ID NO: 3708711 - DNA, 17 bp, Homo sapiens
aagaagggtccttccct

SEQ ID NO: 3708712 - DNA, 15 bp, Homo sapiens
aagaagtaggcatga

SEQ ID NO: 3708713 - DNA, 20 bp, Homo sapiens
aagaagtgaccaaggaggag

SEQ ID NO: 3708714 - DNA, 18 bp, Homo sapiens
aagaatacaaacatattt

SEQ ID NO: 3708715 - DNA, 22 bp, Homo sapiens
aagaatacaaacatatttgtta

SEQ ID NO: 3708716 - DNA, 15 bp, Homo sapiens
aagaatccctgttca

SEQ ID NO: 3708717 - DNA, 21 bp, Homo sapiens
aagaatccctgttcattgtaa

SEQ ID NO: 3708718 - DNA, 19 bp, Homo sapiens
aagaatgctggttttccta

SEQ ID NO: 3708719 - DNA, 22 bp, Homo sapiens
aagaatgctggttttcctaaat

SEQ ID NO: 3708720 - DNA, 17 bp, Homo sapiens
aagaatgtcgattaaaa

SEQ ID NO: 3708721 - DNA, 17 bp, Homo sapiens
aagaattcctacaatat

SEQ ID NO: 3708722 - DNA, 23 bp, Homo sapiens
aagaattctgtgagaaaaaattt

SEQ ID NO: 3708723 - DNA, 18 bp, Homo sapiens
aatacaacttaaataata

SEQ ID NO: 3708724 - DNA, 16 bp, Homo sapiens
aatacaagttctattt

SEQ ID NO: 3708725 - DNA, 20 bp, Homo sapiens
aatacaagttctatttaagt

SEQ ID NO: 3708726 - DNA, 23 bp, Homo sapiens
aatacaagttctatttaagtgta

SEQ ID NO: 3708727 - DNA, 19 bp, Homo sapiens
aatacagccaaagataatc

SEQ ID NO: 3708728 - DNA, 23 bp, Homo sapiens
aatacagggcatgcattttgcag

SEQ ID NO: 3708729 - DNA, 16 bp, Homo sapiens
aatacagtacaggcag

SEQ ID NO: 3708730 - DNA, 18 bp, Homo sapiens
aatacagtacaggcagca

SEQ ID NO: 3708731 - DNA, 21 bp, Homo sapiens
aatacagtacaggcagcacag

SEQ ID NO: 3708732 - DNA, 13 bp, Homo sapiens
aatacattaaagc

SEQ ID NO: 3708733 - DNA, 17 bp, Homo sapiens
aatacattaaagcagtc

SEQ ID NO: 3708734 - DNA, 15 bp, Homo sapiens
aatacctctttgaaa

SEQ ID NO: 3708735 - DNA, 16 bp, Homo sapiens
aatactctaattctaa

SEQ ID NO: 3708736 - DNA, 20 bp, Homo sapiens
aatactctaccctcttagaa

SEQ ID NO: 3708737 - DNA, 22 bp, Homo sapiens
aatactctaccctcttagaaaa

SEQ ID NO: 3708738 - DNA, 13 bp, Homo sapiens
aatagaaactcac

SEQ ID NO: 3708739 - DNA, 17 bp, Homo sapiens
aatagaaatggggaact

SEQ ID NO: 3708740 - DNA, 15 bp, Homo sapiens
aatagaagaacatcc

SEQ ID NO: 3708741 - DNA, 14 bp, Homo sapiens
aatagaaggaaact

SEQ ID NO: 3708742 - DNA, 19 bp, Homo sapiens
aatagaaggatgtacattt

SEQ ID NO: 3708743 - DNA, 22 bp, Homo sapiens
aatagaaggatgtacatttcca

SEQ ID NO: 3708744 - DNA, 20 bp, Homo sapiens
aatagacagtatatttatag

SEQ ID NO: 3708745 - DNA, 14 bp, Homo sapiens
aatagagactgtag

SEQ ID NO: 3708746 - DNA, 18 bp, Homo sapiens
aatagagtatatgcactt

SEQ ID NO: 3708747 - DNA, 23 bp, Homo sapiens
aatagccactgcataccaacctg

SEQ ID NO: 3708748 - DNA, 17 bp, Homo sapiens
aatagctatatccatgt

SEQ ID NO: 3708749 - DNA, 18 bp, Homo sapiens
aatagctatatccatgta

SEQ ID NO: 3708750 - DNA, 22 bp, Homo sapiens
aatagtaaaagataacaagatc

SEQ ID NO: 3708751 - DNA, 13 bp, Homo sapiens
aatagtaatgttt

SEQ ID NO: 3708752 - DNA, 14 bp, Homo sapiens
aatagtctgtgtga

SEQ ID NO: 3708753 - DNA, 15 bp, Homo sapiens
aatagtctgtgtgaa

SEQ ID NO: 3708754 - DNA, 20 bp, Homo sapiens
aatagtgcttaaaaatcatt

SEQ ID NO: 3708755 - DNA, 21 bp, Homo sapiens
aatagtgtgttctgattagaa

SEQ ID NO: 3708756 - DNA, 23 bp, Homo sapiens
aatagtgtgttctgattagaaat

SEQ ID NO: 3708757 - DNA, 22 bp, Homo sapiens
aatagttcaaagccaagtttat

SEQ ID NO: 3708758 - DNA, 13 bp, Homo sapiens
aatagttggctag

SEQ ID NO: 3708759 - DNA, 17 bp, Homo sapiens
aatataaagcatctaaa

SEQ ID NO: 3708760 - DNA, 21 bp, Homo sapiens
aatataaagcatctaaacttt

SEQ ID NO: 3708761 - DNA, 22 bp, Homo sapiens
aatataactgccttaaaacttt

SEQ ID NO: 3708762 - DNA, 18 bp, Homo sapiens
aatataaggaaagcaata

SEQ ID NO: 3708763 - DNA, 21 bp, Homo sapiens
aatataaggaaagcaataaat

SEQ ID NO: 3708764 - DNA, 14 bp, Homo sapiens
aatataattatcgg

SEQ ID NO: 3708765 - DNA, 19 bp, Homo sapiens
aatataccccttagtgttt

SEQ ID NO: 3708766 - DNA, 17 bp, Homo sapiens
aatatactatatttatg

SEQ ID NO: 3708767 - DNA, 13 bp, Homo sapiens
aatatatgtatgt

SEQ ID NO: 3708768 - DNA, 19 bp, Homo sapiens
aatatatgtatgtaaaaat

SEQ ID NO: 3708769 - DNA, 16 bp, Homo sapiens
aatatattctctttgg

SEQ ID NO: 3708770 - DNA, 13 bp, Homo sapiens
aatatcatttatt

SEQ ID NO: 3708771 - DNA, 16 bp, Homo sapiens
aatatctgaaaatgta

SEQ ID NO: 3708772 - DNA, 20 bp, Homo sapiens
aatatctgaaaatgtatgtg

SEQ ID NO: 3708773 - DNA, 13 bp, Homo sapiens
aatatctgctgta

SEQ ID NO: 3708774 - DNA, 14 bp, Homo sapiens
aatatctgctgtat

SEQ ID NO: 3708775 - DNA, 16 bp, Homo sapiens
aatatgacagctgtcc

SEQ ID NO: 3708776 - DNA, 19 bp, Homo sapiens
aatatgacggaagaacata

SEQ ID NO: 3708777 - DNA, 16 bp, Homo sapiens
aatatgagaatcagat

SEQ ID NO: 3708778 - DNA, 20 bp, Homo sapiens
aatatgattagtaaagaaat

SEQ ID NO: 3708779 - DNA, 20 bp, Homo sapiens
aatatgcatctaataaaaaa

SEQ ID NO: 3708780 - DNA, 14 bp, Homo sapiens
aatatgctgccaaa

SEQ ID NO: 3708781 - DNA, 18 bp, Homo sapiens
aatatgtattttatgtat

SEQ ID NO: 3708782 - DNA, 17 bp, Homo sapiens
aatatgtccatatctaa

SEQ ID NO: 3708783 - DNA, 21 bp, Homo sapiens
aatatgttaacctcagtgtca

SEQ ID NO: 3708784 - DNA, 22 bp, Homo sapiens
aatatgttgatgaaaaatagca

SEQ ID NO: 3708785 - DNA, 18 bp, Homo sapiens
aatattagctttactgtt

SEQ ID NO: 3708786 - DNA, 21 bp, Homo sapiens
aatattagctttactgtttgt

SEQ ID NO: 3708787 - DNA, 15 bp, Homo sapiens
aatattatctttgta

SEQ ID NO: 3708788 - DNA, 20 bp, Homo sapiens
aatattatctttgtaattat

SEQ ID NO: 3708789 - DNA, 12 bp, Homo sapiens
aatattccagag

SEQ ID NO: 3708790 - DNA, 20 bp, Homo sapiens
aatattcccctatctctaga

SEQ ID NO: 3708791 - DNA, 14 bp, Homo sapiens
aatattctttcaat

SEQ ID NO: 3708792 - DNA, 20 bp, Homo sapiens
aatattgagaaagaaactaa

SEQ ID NO: 3708793 - DNA, 22 bp, Homo sapiens
aatatttaaggagatgtaagag

SEQ ID NO: 3708794 - DNA, 12 bp, Homo sapiens
aatatttataac

SEQ ID NO: 3708795 - DNA, 14 bp, Homo sapiens
aatatttatatttc

SEQ ID NO: 3708796 - DNA, 13 bp, Homo sapiens
aatatttattacc

SEQ ID NO: 3708797 - DNA, 18 bp, Homo sapiens
aatatttattacctctga

SEQ ID NO: 3708798 - DNA, 19 bp, Homo sapiens
aatatttattattttcacc

SEQ ID NO: 3708799 - DNA, 20 bp, Homo sapiens
aatatttattattttcacct

SEQ ID NO: 3708800 - DNA, 19 bp, Homo sapiens
aatatttccttaaactgtg

SEQ ID NO: 3708801 - DNA, 21 bp, Homo sapiens
aatatttccttaaactgtgtg

SEQ ID NO: 3708802 - DNA, 15 bp, Homo sapiens
aatattttaagcatt

SEQ ID NO: 3708803 - DNA, 19 bp, Homo sapiens
aatattttaccactgctgt

SEQ ID NO: 3708804 - DNA, 21 bp, Homo sapiens
aatattttaccactgctgtga

SEQ ID NO: 3708805 - DNA, 20 bp, Homo sapiens
aatcaaatttgtagggtttc

SEQ ID NO: 3708806 - DNA, 15 bp, Homo sapiens
aatcaacagggcagc

SEQ ID NO: 3708807 - DNA, 18 bp, Homo sapiens
aatcaactgaaagtgttt

SEQ ID NO: 3708808 - DNA, 11 bp, Homo sapiens
aatcaagataa

SEQ ID NO: 3708809 - DNA, 23 bp, Homo sapiens
aatcaagttggcttctaatcaaa

SEQ ID NO: 3708810 - DNA, 15 bp, Homo sapiens
aatcagatcatttca

SEQ ID NO: 3708811 - DNA, 23 bp, Homo sapiens
aatcagcctaggggtcagggacc

SEQ ID NO: 3708812 - DNA, 12 bp, Homo sapiens
aatcagcctctt

SEQ ID NO: 3708813 - DNA, 11 bp, Homo sapiens
aatcagcctgc

SEQ ID NO: 3708814 - DNA, 13 bp, Homo sapiens
aatcagcctgctc

SEQ ID NO: 3708815 - DNA, 17 bp, Homo sapiens
aatcagtgtagccccaa

SEQ ID NO: 3708816 - DNA, 21 bp, Homo sapiens
aatcagtgtagccccaagaag

SEQ ID NO: 3708817 - DNA, 21 bp, Homo sapiens
aatcagttgcgcgttctgaaa

SEQ ID NO: 3708818 - DNA, 18 bp, Homo sapiens
aatcataaactgtgtgca

SEQ ID NO: 3708819 - DNA, 19 bp, Homo sapiens
aatcatagtactctttgta

SEQ ID NO: 3708820 - DNA, 17 bp, Homo sapiens
aatcatgaaatatgcat

SEQ ID NO: 3708821 - DNA, 16 bp, Homo sapiens
aatcatgtacatttct

SEQ ID NO: 3708822 - DNA, 23 bp, Homo sapiens
aatcatgtgggtgagccagtgga

SEQ ID NO: 3708823 - DNA, 13 bp, Homo sapiens
aatcatgttatga

SEQ ID NO: 3708824 - DNA, 22 bp, Homo sapiens
aatcatgttatgataaaaaatt

SEQ ID NO: 3708825 - DNA, 20 bp, Homo sapiens
aatcattgtaaacattagtt

SEQ ID NO: 3708826 - DNA, 20 bp, Homo sapiens
aatcattttaattattattc

SEQ ID NO: 3708827 - DNA, 16 bp, Homo sapiens
aatcattttccttttt

SEQ ID NO: 3708828 - DNA, 13 bp, Homo sapiens
aatccagaaagaa

SEQ ID NO: 3708829 - DNA, 16 bp, Homo sapiens
aatccagcggttctca

SEQ ID NO: 3708830 - DNA, 15 bp, Homo sapiens
aatccatgcttgggt

SEQ ID NO: 3708831 - DNA, 14 bp, Homo sapiens
aatcccctcattca

SEQ ID NO: 3708832 - DNA, 16 bp, Homo sapiens
aatcccgattcaccct

SEQ ID NO: 3708833 - DNA, 21 bp, Homo sapiens
aatccctgggcattgctttcc

SEQ ID NO: 3708834 - DNA, 14 bp, Homo sapiens
aatccctgttcatt

SEQ ID NO: 3708835 - DNA, 17 bp, Homo sapiens
aatccctgttcattgta

SEQ ID NO: 3708836 - DNA, 16 bp, Homo sapiens
acaacctctctgatct

SEQ ID NO: 3708837 - DNA, 20 bp, Homo sapiens
acaacctctctgatcttgtg

SEQ ID NO: 3708838 - DNA, 18 bp, Homo sapiens
acaaccttctgtggctca

SEQ ID NO: 3708839 - DNA, 14 bp, Homo sapiens
acaacgaggaagcc

SEQ ID NO: 3708840 - DNA, 19 bp, Homo sapiens
acaactaggcttcagcata

SEQ ID NO: 3708841 - DNA, 14 bp, Homo sapiens
acaacttaaaaagt

SEQ ID NO: 3708842 - DNA, 15 bp, Homo sapiens
acaacttaaaaagtc

SEQ ID NO: 3708843 - DNA, 17 bp, Homo sapiens
acaacttctaattgcca

SEQ ID NO: 3708844 - DNA, 12 bp, Homo sapiens
acaagaaaacat

SEQ ID NO: 3708845 - DNA, 12 bp, Homo sapiens
acaagaaaggag

SEQ ID NO: 3708846 - DNA, 13 bp, Homo sapiens
acaagaaaggaga

SEQ ID NO: 3708847 - DNA, 15 bp, Homo sapiens
acaagaaagtttccc

SEQ ID NO: 3708848 - DNA, 21 bp, Homo sapiens
acaagaaagtttccccaccag

SEQ ID NO: 3708849 - DNA, 16 bp, Homo sapiens
acaagagcagcctgtg

SEQ ID NO: 3708850 - DNA, 13 bp, Homo sapiens
acaagagcccagc

SEQ ID NO: 3708851 - DNA, 16 bp, Homo sapiens
acaagccccaggcagg

SEQ ID NO: 3708852 - DNA, 21 bp, Homo sapiens
acaagcgtgagccactgcacc

SEQ ID NO: 3708853 - DNA, 17 bp, Homo sapiens
acaagctaggtgctaat

SEQ ID NO: 3708854 - DNA, 23 bp, Homo sapiens
acaagctgcaccctcaggcaggt

SEQ ID NO: 3708855 - DNA, 16 bp, Homo sapiens
acaagctgcctccctg

SEQ ID NO: 3708856 - DNA, 20 bp, Homo sapiens
acaagcttttttacacaaat

SEQ ID NO: 3708857 - DNA, 11 bp, Homo sapiens
acaaggaatgc

SEQ ID NO: 3708858 - DNA, 16 bp, Homo sapiens
acaaggaatgcctgtg

SEQ ID NO: 3708859 - DNA, 16 bp, Homo sapiens
acaaggattgctactg

SEQ ID NO: 3708860 - DNA, 23 bp, Homo sapiens
acaaggcattcaagtgtacagtg

SEQ ID NO: 3708861 - DNA, 13 bp, Homo sapiens
acaaggctgacca

SEQ ID NO: 3708862 - DNA, 18 bp, Homo sapiens
acaagggaagatttatgt

SEQ ID NO: 3708863 - DNA, 21 bp, Homo sapiens
acaagggcagtggaggtgctg

SEQ ID NO: 3708864 - DNA, 17 bp, Homo sapiens
acaagggtctagggaga

SEQ ID NO: 3708865 - DNA, 18 bp, Homo sapiens
acaagggtggcatcccag

SEQ ID NO: 3708866 - DNA, 14 bp, Homo sapiens
acaaggtagttttt

SEQ ID NO: 3708867 - DNA, 15 bp, Homo sapiens
acaaggtgggcaggg

SEQ ID NO: 3708868 - DNA, 15 bp, Homo sapiens
acaagtaaaactgtg

SEQ ID NO: 3708869 - DNA, 23 bp, Homo sapiens
acaagtcattttaactttatcac

SEQ ID NO: 3708870 - DNA, 18 bp, Homo sapiens
acaagtgactgtatctgt

SEQ ID NO: 3708871 - DNA, 20 bp, Homo sapiens
acaagtgactgtatctgtgt

SEQ ID NO: 3708872 - DNA, 17 bp, Homo sapiens
acaagtgagacaaaaag

SEQ ID NO: 3708873 - DNA, 19 bp, Homo sapiens
acaagtgagacaaaaagca

SEQ ID NO: 3708874 - DNA, 15 bp, Homo sapiens
acaagttaaataaat

SEQ ID NO: 3708875 - DNA, 14 bp, Homo sapiens
acaagttgtgtttg

SEQ ID NO: 3708876 - DNA, 21 bp, Homo sapiens
acaagttttcataagcacact

SEQ ID NO: 3708877 - DNA, 19 bp, Homo sapiens
acaataaatgtattcaaat

SEQ ID NO: 3708878 - DNA, 20 bp, Homo sapiens
acaataaatgtattcaaata

SEQ ID NO: 3708879 - DNA, 21 bp, Homo sapiens
acaataagttaactattttat

SEQ ID NO: 3708880 - DNA, 15 bp, Homo sapiens
acaatatgaatacag

SEQ ID NO: 3708881 - DNA, 14 bp, Homo sapiens
acaatattgtttct

SEQ ID NO: 3708882 - DNA, 10 bp, Homo sapiens
acaatattta

SEQ ID NO: 3708883 - DNA, 13 bp, Homo sapiens
acaatatttaaaa

SEQ ID NO: 3708884 - DNA, 17 bp, Homo sapiens
acaatattttaagcatt

SEQ ID NO: 3708885 - DNA, 17 bp, Homo sapiens
acaatattttgtggctt

SEQ ID NO: 3708886 - DNA, 23 bp, Homo sapiens
acaatcaactctaatagtgctta

SEQ ID NO: 3708887 - DNA, 19 bp, Homo sapiens
acaatcagccacattctag

SEQ ID NO: 3708888 - DNA, 18 bp, Homo sapiens
acaatcatgaaatatgca

SEQ ID NO: 3708889 - DNA, 16 bp, Homo sapiens
acaatgatgatgataa

SEQ ID NO: 3708890 - DNA, 21 bp, Homo sapiens
acaatgatgatgataatgatg

SEQ ID NO: 3708891 - DNA, 15 bp, Homo sapiens
acaatgcagatgcca

SEQ ID NO: 3708892 - DNA, 22 bp, Homo sapiens
acaatgtcaaggtgctgttgtc

SEQ ID NO: 3708893 - DNA, 11 bp, Homo sapiens
acaatgtcttg

SEQ ID NO: 3708894 - DNA, 19 bp, Homo sapiens
acaatgtgaaaagaaaaat

SEQ ID NO: 3708895 - DNA, 21 bp, Homo sapiens
acaattatttttacagttctc

SEQ ID NO: 3708896 - DNA, 22 bp, Homo sapiens
acaattcctagataaaaagatg

SEQ ID NO: 3708897 - DNA, 19 bp, Homo sapiens
acaattgaacttaaataaa

SEQ ID NO: 3708898 - DNA, 21 bp, Homo sapiens
acaattgcttactcattaaaa

SEQ ID NO: 3708899 - DNA, 14 bp, Homo sapiens
acaatttattttat

SEQ ID NO: 3708900 - DNA, 20 bp, Homo sapiens
acaatttattttattttagc

SEQ ID NO: 3708901 - DNA, 12 bp, Homo sapiens
acaattttgtac

SEQ ID NO: 3708902 - DNA, 22 bp, Homo sapiens
acacaaagagagttaatcaact

SEQ ID NO: 3708903 - DNA, 12 bp, Homo sapiens
acacaacaaaaa

SEQ ID NO: 3708904 - DNA, 13 bp, Homo sapiens
acacaacacacac

SEQ ID NO: 3708905 - DNA, 14 bp, Homo sapiens
acacaagtaaaact

SEQ ID NO: 3708906 - DNA, 13 bp, Homo sapiens
acacaatgttatt

SEQ ID NO: 3708907 - DNA, 22 bp, Homo sapiens
acacacaaaatgtacccagtat

SEQ ID NO: 3708908 - DNA, 14 bp, Homo sapiens
acacacacaaagag

SEQ ID NO: 3708909 - DNA, 16 bp, Homo sapiens
acacacacaaagagag

SEQ ID NO: 3708910 - DNA, 13 bp, Homo sapiens
acacacacacaca

SEQ ID NO: 3708911 - DNA, 11 bp, Homo sapiens
acacacacagc

SEQ ID NO: 3708912 - DNA, 13 bp, Homo sapiens
acacacagctctg

SEQ ID NO: 3708913 - DNA, 14 bp, Homo sapiens
acacacagctctgt

SEQ ID NO: 3708914 - DNA, 18 bp, Homo sapiens
acacaccaggctgtgggc

SEQ ID NO: 3708915 - DNA, 23 bp, Homo sapiens
acacacgcacacacacacacagg

SEQ ID NO: 3708916 - DNA, 16 bp, Homo sapiens
acacactgaggcaggg

SEQ ID NO: 3708917 - DNA, 16 bp, Homo sapiens
acacagactattgaca

SEQ ID NO: 3708918 - DNA, 17 bp, Homo sapiens
acacagaggaagagcag

SEQ ID NO: 3708919 - DNA, 14 bp, Homo sapiens
acacagcagcagtt

SEQ ID NO: 3708920 - DNA, 14 bp, Homo sapiens
acacagcatgtgta

SEQ ID NO: 3708921 - DNA, 14 bp, Homo sapiens
acacagctctgtcc

SEQ ID NO: 3708922 - DNA, 18 bp, Homo sapiens
acacagctcttctccagg

SEQ ID NO: 3708923 - DNA, 20 bp, Homo sapiens
acacagctcttctccaggct

SEQ ID NO: 3708924 - DNA, 23 bp, Homo sapiens
acacagcttttagtacccacctg

SEQ ID NO: 3708925 - DNA, 16 bp, Homo sapiens
acacaggatagataac

SEQ ID NO: 3708926 - DNA, 23 bp, Homo sapiens
acacaggatagataactctttgg

SEQ ID NO: 3708927 - DNA, 16 bp, Homo sapiens
acacaggcaactgagg

SEQ ID NO: 3708928 - DNA, 17 bp, Homo sapiens
acacaggcccggctcca

SEQ ID NO: 3708929 - DNA, 19 bp, Homo sapiens
acacaggcccggctccagg

SEQ ID NO: 3708930 - DNA, 24 bp, Homo sapiens
acacaggcccggctccaggctcct

SEQ ID NO: 3708931 - DNA, 19 bp, Homo sapiens
acacagtattacttctgct

SEQ ID NO: 3708932 - DNA, 22 bp, Homo sapiens
acacagtattacttctgctaca

SEQ ID NO: 3708933 - DNA, 13 bp, Homo sapiens
acacagtattttc

SEQ ID NO: 3708934 - DNA, 23 bp, Homo sapiens
acacagtctcacccagactccag

SEQ ID NO: 3708935 - DNA, 13 bp, Homo sapiens
acacagtgagtcg

SEQ ID NO: 3708936 - DNA, 22 bp, Homo sapiens
acacagttgctgtcataagaat

SEQ ID NO: 3708937 - DNA, 14 bp, Homo sapiens
acacataaaggata

SEQ ID NO: 3708938 - DNA, 19 bp, Homo sapiens
acacatagattcacctgta

SEQ ID NO: 3708939 - DNA, 12 bp, Homo sapiens
acacatctcctc

SEQ ID NO: 3708940 - DNA, 13 bp, Homo sapiens
acacatcttccct

SEQ ID NO: 3708941 - DNA, 15 bp, Homo sapiens
acacatcttccctag

SEQ ID NO: 3708942 - DNA, 23 bp, Homo sapiens
acacattatcgggagcagtgtct

SEQ ID NO: 3708943 - DNA, 17 bp, Homo sapiens
acacattcaataagcat

SEQ ID NO: 3708944 - DNA, 19 bp, Homo sapiens
acacccaaagaggtattta

SEQ ID NO: 3708945 - DNA, 12 bp, Homo sapiens
acacccagccca

SEQ ID NO: 3708946 - DNA, 16 bp, Homo sapiens
acacccctcccctgcc

SEQ ID NO: 3708947 - DNA, 14 bp, Homo sapiens
acacctagatcaga

SEQ ID NO: 3708948 - DNA, 18 bp, Homo sapiens
acacctcagttcccttgg

SEQ ID NO: 3708949 - DNA, 21 bp, Homo sapiens
acacctcagttcccttggcct

SEQ ID NO: 3708950 - DNA, 12 bp, Homo sapiens
acatactgctgt

SEQ ID NO: 3708951 - DNA, 12 bp, Homo sapiens
acatacttcagc

SEQ ID NO: 3708952 - DNA, 16 bp, Homo sapiens
acatagactagagaaa

SEQ ID NO: 3708953 - DNA, 20 bp, Homo sapiens
acatagactttatgcaataa

SEQ ID NO: 3708954 - DNA, 19 bp, Homo sapiens
acatagattcacctgtaaa

SEQ ID NO: 3708955 - DNA, 19 bp, Homo sapiens
acatagtgtaggctttact

SEQ ID NO: 3708956 - DNA, 23 bp, Homo sapiens
acatataatgttgttatttaaag

SEQ ID NO: 3708957 - DNA, 15 bp, Homo sapiens
acatatgaaaataca

SEQ ID NO: 3708958 - DNA, 14 bp, Homo sapiens
acatatgtaaaata

SEQ ID NO: 3708959 - DNA, 13 bp, Homo sapiens
acatatgtgaata

SEQ ID NO: 3708960 - DNA, 18 bp, Homo sapiens
acatattaggaaaatatg

SEQ ID NO: 3708961 - DNA, 20 bp, Homo sapiens
acatattcatttggaaataa

SEQ ID NO: 3708962 - DNA, 14 bp, Homo sapiens
acatatttgttaaa

SEQ ID NO: 3708963 - DNA, 17 bp, Homo sapiens
acatcaatgttcattgt

SEQ ID NO: 3708964 - DNA, 15 bp, Homo sapiens
acatcagttactctg

SEQ ID NO: 3708965 - DNA, 18 bp, Homo sapiens
acatcagttactctgaag

SEQ ID NO: 3708966 - DNA, 23 bp, Homo sapiens
acatccaaggagaaacagagaca

SEQ ID NO: 3708967 - DNA, 20 bp, Homo sapiens
acatccatttcatctatttc

SEQ ID NO: 3708968 - DNA, 20 bp, Homo sapiens
acatcccactcacaacagct

SEQ ID NO: 3708969 - DNA, 17 bp, Homo sapiens
acatcccattgccctgg

SEQ ID NO: 3708970 - DNA, 17 bp, Homo sapiens
acatcctccgtccagcc

SEQ ID NO: 3708971 - DNA, 12 bp, Homo sapiens
acatccttgtgg

SEQ ID NO: 3708972 - DNA, 18 bp, Homo sapiens
acatccttgtggcacatt

SEQ ID NO: 3708973 - DNA, 20 bp, Homo sapiens
acatctcaataaagtgcttt

SEQ ID NO: 3708974 - DNA, 20 bp, Homo sapiens
acatctctttgatgtcatat

SEQ ID NO: 3708975 - DNA, 18 bp, Homo sapiens
acatcttagtatttgcat

SEQ ID NO: 3708976 - DNA, 15 bp, Homo sapiens
acatcttccacaggt

SEQ ID NO: 3708977 - DNA, 17 bp, Homo sapiens
acatcttgctctgctga

SEQ ID NO: 3708978 - DNA, 21 bp, Homo sapiens
acatcttgctctgctgacaga

SEQ ID NO: 3708979 - DNA, 13 bp, Homo sapiens
acatgaaacagaa

SEQ ID NO: 3708980 - DNA, 15 bp, Homo sapiens
acatgaaacagaaac

SEQ ID NO: 3708981 - DNA, 21 bp, Homo sapiens
acatgaagtgtgtttccttca

SEQ ID NO: 3708982 - DNA, 19 bp, Homo sapiens
acatgacactgaaatgcct

SEQ ID NO: 3708983 - DNA, 18 bp, Homo sapiens
acatgacgacaaagctgc

SEQ ID NO: 3708984 - DNA, 21 bp, Homo sapiens
acatgaggacatgatggagcg

SEQ ID NO: 3708985 - DNA, 19 bp, Homo sapiens
acatgatcttctttataat

SEQ ID NO: 3708986 - DNA, 15 bp, Homo sapiens
acatgcagcccatgc

SEQ ID NO: 3708987 - DNA, 20 bp, Homo sapiens
acatgcagcccatgcccacc

SEQ ID NO: 3708988 - DNA, 12 bp, Homo sapiens
acatgcatttga

SEQ ID NO: 3708989 - DNA, 21 bp, Homo sapiens
acatgcctgccccaaacaaat

SEQ ID NO: 3708990 - DNA, 18 bp, Homo sapiens
acatgctggacaggtctg

SEQ ID NO: 3708991 - DNA, 21 bp, Homo sapiens
acatgcttcatgaaaatccta

SEQ ID NO: 3708992 - DNA, 20 bp, Homo sapiens
acatggaataacatgtaatt

SEQ ID NO: 3708993 - DNA, 22 bp, Homo sapiens
acatggacccggagctaacact

SEQ ID NO: 3708994 - DNA, 19 bp, Homo sapiens
acatggcttagttttcata

SEQ ID NO: 3708995 - DNA, 20 bp, Homo sapiens
acatggcttgccacagctct

SEQ ID NO: 3708996 - DNA, 22 bp, Homo sapiens
acatgggaaacttccaagacct

SEQ ID NO: 3708997 - DNA, 16 bp, Homo sapiens
acatggggaggaagga

SEQ ID NO: 3708998 - DNA, 18 bp, Homo sapiens
acatggggttttcaattt

SEQ ID NO: 3708999 - DNA, 22 bp, Homo sapiens
acatggggttttcaattttgca

SEQ ID NO: 3709000 - DNA, 18 bp, Homo sapiens
acatggttgtgacctgag

SEQ ID NO: 3709001 - DNA, 20 bp, Homo sapiens
acatgtataatatttttaat

SEQ ID NO: 3709002 - DNA, 18 bp, Homo sapiens
acatgtggaaagtgaatt

SEQ ID NO: 3709003 - DNA, 19 bp, Homo sapiens
acatgttactgaccagcaa

SEQ ID NO: 3709004 - DNA, 18 bp, Homo sapiens
acatgttggtatttatct

SEQ ID NO: 3709005 - DNA, 19 bp, Homo sapiens
acatgtttttcttctccct

SEQ ID NO: 3709006 - DNA, 12 bp, Homo sapiens
acattaaacaca

SEQ ID NO: 3709007 - DNA, 12 bp, Homo sapiens
acattaaagcag

SEQ ID NO: 3709008 - DNA, 13 bp, Homo sapiens
acattaaagcagt

SEQ ID NO: 3709009 - DNA, 14 bp, Homo sapiens
acattaaagcagtc

SEQ ID NO: 3709010 - DNA, 12 bp, Homo sapiens
acattaacagtt

SEQ ID NO: 3709011 - DNA, 17 bp, Homo sapiens
acattaacagttttcca

SEQ ID NO: 3709012 - DNA, 18 bp, Homo sapiens
acattaacagttttccat

SEQ ID NO: 3709013 - DNA, 19 bp, Homo sapiens
acattaggcattgagactt

SEQ ID NO: 3709014 - DNA, 15 bp, Homo sapiens
acattatattgcaat

SEQ ID NO: 3709015 - DNA, 22 bp, Homo sapiens
acattatcgggagcagtgtctt

SEQ ID NO: 3709016 - DNA, 13 bp, Homo sapiens
acattatttgcat

SEQ ID NO: 3709017 - DNA, 15 bp, Homo sapiens
acattcaataagcat

SEQ ID NO: 3709018 - DNA, 23 bp, Homo sapiens
acattcaataagcatcaaactct

SEQ ID NO: 3709019 - DNA, 16 bp, Homo sapiens
acattctgccaggccc

SEQ ID NO: 3709020 - DNA, 14 bp, Homo sapiens
acattctgtaaaat

SEQ ID NO: 3709021 - DNA, 12 bp, Homo sapiens
acattgtcaata

SEQ ID NO: 3709022 - DNA, 15 bp, Homo sapiens
acatttataatgttt

SEQ ID NO: 3709023 - DNA, 18 bp, Homo sapiens
acatttataatgtttgct

SEQ ID NO: 3709024 - DNA, 20 bp, Homo sapiens
acatttcacctactttgtaa

SEQ ID NO: 3709025 - DNA, 12 bp, Homo sapiens
acatttctaact

SEQ ID NO: 3709026 - DNA, 14 bp, Homo sapiens
acatttctaactct

SEQ ID NO: 3709027 - DNA, 16 bp, Homo sapiens
acatttgagtcccttc

SEQ ID NO: 3709028 - DNA, 19 bp, Homo sapiens
acatttgagtcccttccag

SEQ ID NO: 3709029 - DNA, 17 bp, Homo sapiens
acatttgggtaaatcat

SEQ ID NO: 3709030 - DNA, 13 bp, Homo sapiens
acattttaacatg

SEQ ID NO: 3709031 - DNA, 20 bp, Homo sapiens
acattttcacacaatacaat

SEQ ID NO: 3709032 - DNA, 21 bp, Homo sapiens
acatttttttttttaattttg

SEQ ID NO: 3709033 - DNA, 12 bp, Homo sapiens
accaaaatgaca

SEQ ID NO: 3709034 - DNA, 14 bp, Homo sapiens
accaaagccaccag

SEQ ID NO: 3709035 - DNA, 19 bp, Homo sapiens
accaaatcagctgctacta

SEQ ID NO: 3709036 - DNA, 12 bp, Homo sapiens
accaaatgcatc

SEQ ID NO: 3709037 - DNA, 16 bp, Homo sapiens
accaaatgcatcaatc

SEQ ID NO: 3709038 - DNA, 14 bp, Homo sapiens
accaaattccttgg

SEQ ID NO: 3709039 - DNA, 13 bp, Homo sapiens
accaacctgacca

SEQ ID NO: 3709040 - DNA, 19 bp, Homo sapiens
accaactggccctcttctt

SEQ ID NO: 3709041 - DNA, 21 bp, Homo sapiens
accaacttttctattaaaagt

SEQ ID NO: 3709042 - DNA, 15 bp, Homo sapiens
accaagaactgcatg

SEQ ID NO: 3709043 - DNA, 21 bp, Homo sapiens
accaagaattctccaaaacaa

SEQ ID NO: 3709044 - DNA, 16 bp, Homo sapiens
accaagcaggaagctc

SEQ ID NO: 3709045 - DNA, 12 bp, Homo sapiens
accaagcccagt

SEQ ID NO: 3709046 - DNA, 15 bp, Homo sapiens
accaagccgtggctt

SEQ ID NO: 3709047 - DNA, 16 bp, Homo sapiens
accaagccgtggcttc

SEQ ID NO: 3709048 - DNA, 17 bp, Homo sapiens
accaagctcacagttcc

SEQ ID NO: 3709049 - DNA, 19 bp, Homo sapiens
accaagctcacagttcctc

SEQ ID NO: 3709050 - DNA, 16 bp, Homo sapiens
accaaggacccctcac

SEQ ID NO: 3709051 - DNA, 18 bp, Homo sapiens
accaaggacccctcacct

SEQ ID NO: 3709052 - DNA, 20 bp, Homo sapiens
accaatattatactaagaaa

SEQ ID NO: 3709053 - DNA, 19 bp, Homo sapiens
accaatcaagataaaggac

SEQ ID NO: 3709054 - DNA, 15 bp, Homo sapiens
accaatgttctctct

SEQ ID NO: 3709055 - DNA, 16 bp, Homo sapiens
accaatgtttaaaaaa

SEQ ID NO: 3709056 - DNA, 15 bp, Homo sapiens
accacacagcctaca

SEQ ID NO: 3709057 - DNA, 21 bp, Homo sapiens
accacacccagcccacttctg

SEQ ID NO: 3709058 - DNA, 16 bp, Homo sapiens
accacacctccctgaa

SEQ ID NO: 3709059 - DNA, 17 bp, Homo sapiens
accacacttcctgtcca

SEQ ID NO: 3709060 - DNA, 15 bp, Homo sapiens
accacagccctgtca

SEQ ID NO: 3709061 - DNA, 16 bp, Homo sapiens
accacagccctgtcag

SEQ ID NO: 3709062 - DNA, 17 bp, Homo sapiens
accacagggttcaaaat

SEQ ID NO: 3709063 - DNA, 12 bp, Homo sapiens
acctcagcctgt

SEQ ID NO: 3709064 - DNA, 15 bp, Homo sapiens
acctcaggcaggaag

SEQ ID NO: 3709065 - DNA, 20 bp, Homo sapiens
acctcaggtgatccacccac

SEQ ID NO: 3709066 - DNA, 11 bp, Homo sapiens
acctccacagc

SEQ ID NO: 3709067 - DNA, 14 bp, Homo sapiens
acctccacagcttc

SEQ ID NO: 3709068 - DNA, 13 bp, Homo sapiens
acctccagctgtt

SEQ ID NO: 3709069 - DNA, 12 bp, Homo sapiens
acctcccacctt

SEQ ID NO: 3709070 - DNA, 15 bp, Homo sapiens
acctcccacctttgg

SEQ ID NO: 3709071 - DNA, 20 bp, Homo sapiens
acctccccaggccgtggctg

SEQ ID NO: 3709072 - DNA, 15 bp, Homo sapiens
acctccccccactgc

SEQ ID NO: 3709073 - DNA, 18 bp, Homo sapiens
acctccccccactgcagg

SEQ ID NO: 3709074 - DNA, 12 bp, Homo sapiens
acctccccctcc

SEQ ID NO: 3709075 - DNA, 21 bp, Homo sapiens
acctccccctccttcccagct

SEQ ID NO: 3709076 - DNA, 14 bp, Homo sapiens
acctcccctatcca

SEQ ID NO: 3709077 - DNA, 17 bp, Homo sapiens
acctcccctatccaccc

SEQ ID NO: 3709078 - DNA, 18 bp, Homo sapiens
acctcccctatccaccca

SEQ ID NO: 3709079 - DNA, 19 bp, Homo sapiens
acctcccctatccacccag

SEQ ID NO: 3709080 - DNA, 23 bp, Homo sapiens
acctcccctatccacccagccca

SEQ ID NO: 3709081 - DNA, 13 bp, Homo sapiens
acctcccctcctt

SEQ ID NO: 3709082 - DNA, 23 bp, Homo sapiens
acctcctacgtcaaacatgaagt

SEQ ID NO: 3709083 - DNA, 16 bp, Homo sapiens
acctcctgcaataaaa

SEQ ID NO: 3709084 - DNA, 13 bp, Homo sapiens
acctcctgcccag

SEQ ID NO: 3709085 - DNA, 14 bp, Homo sapiens
acctcctgcccagg

SEQ ID NO: 3709086 - DNA, 16 bp, Homo sapiens
acctcctgcccaggag

SEQ ID NO: 3709087 - DNA, 18 bp, Homo sapiens
acctcctgcccaggagag

SEQ ID NO: 3709088 - DNA, 12 bp, Homo sapiens
acctcctgcctc

SEQ ID NO: 3709089 - DNA, 13 bp, Homo sapiens
acctcctgcctcg

SEQ ID NO: 3709090 - DNA, 23 bp, Homo sapiens
acctcctgcctcgaactggctgc

SEQ ID NO: 3709091 - DNA, 13 bp, Homo sapiens
acctcctgggcta

SEQ ID NO: 3709092 - DNA, 18 bp, Homo sapiens
acctcctttaccctcatc

SEQ ID NO: 3709093 - DNA, 15 bp, Homo sapiens
acctcggctcctgga

SEQ ID NO: 3709094 - DNA, 18 bp, Homo sapiens
acctcgtcctccccctgc

SEQ ID NO: 3709095 - DNA, 14 bp, Homo sapiens
acctcgtgctttaa

SEQ ID NO: 3709096 - DNA, 18 bp, Homo sapiens
acctctataattgccact

SEQ ID NO: 3709097 - DNA, 20 bp, Homo sapiens
acctctataattgccactga

SEQ ID NO: 3709098 - DNA, 20 bp, Homo sapiens
acctctcctttggccattcc

SEQ ID NO: 3709099 - DNA, 21 bp, Homo sapiens
acctctgcacaagctgcaccc

SEQ ID NO: 3709100 - DNA, 20 bp, Homo sapiens
acctctgcctgaagtcacac

SEQ ID NO: 3709101 - DNA, 19 bp, Homo sapiens
acctcttccggagatgtag

SEQ ID NO: 3709102 - DNA, 17 bp, Homo sapiens
acctcttttagtcattt

SEQ ID NO: 3709103 - DNA, 12 bp, Homo sapiens
acctgaaaagat

SEQ ID NO: 3709104 - DNA, 18 bp, Homo sapiens
acctgaacacttattgct

SEQ ID NO: 3709105 - DNA, 18 bp, Homo sapiens
acctgaatagctcccaga

SEQ ID NO: 3709106 - DNA, 20 bp, Homo sapiens
acctgactattgaagttgca

SEQ ID NO: 3709107 - DNA, 16 bp, Homo sapiens
acctgagatggccctc

SEQ ID NO: 3709108 - DNA, 21 bp, Homo sapiens
acctgagatggccctctggta

SEQ ID NO: 3709109 - DNA, 22 bp, Homo sapiens
acctgagtcaccctacctgtgc

SEQ ID NO: 3709110 - DNA, 22 bp, Homo sapiens
acctgccactaggctgggtgcc

SEQ ID NO: 3709111 - DNA, 18 bp, Homo sapiens
acctgccatttgcaccct

SEQ ID NO: 3709112 - DNA, 22 bp, Homo sapiens
acctgcccagatcccagaagga

SEQ ID NO: 3709113 - DNA, 15 bp, Homo sapiens
acctgccccctggtg

SEQ ID NO: 3709114 - DNA, 16 bp, Homo sapiens
acctgcccccttctcc

SEQ ID NO: 3709115 - DNA, 23 bp, Homo sapiens
acctgccccgcccagctgcacct

SEQ ID NO: 3709116 - DNA, 17 bp, Homo sapiens
acctgccgacctcgtcc

SEQ ID NO: 3709117 - DNA, 18 bp, Homo sapiens
acctgctctcctcttgcc

SEQ ID NO: 3709118 - DNA, 20 bp, Homo sapiens
acctgctgagggaccagcca

SEQ ID NO: 3709119 - DNA, 13 bp, Homo sapiens
acctgctggcccc

SEQ ID NO: 3709120 - DNA, 18 bp, Homo sapiens
acctggaagccctctctg

SEQ ID NO: 3709121 - DNA, 19 bp, Homo sapiens
acctggccctggggcctgt

SEQ ID NO: 3709122 - DNA, 21 bp, Homo sapiens
acctggccctggggcctgtac

SEQ ID NO: 3709123 - DNA, 13 bp, Homo sapiens
acctgggcacctg

SEQ ID NO: 3709124 - DNA, 18 bp, Homo sapiens
acctgggcacctggggag

SEQ ID NO: 3709125 - DNA, 19 bp, Homo sapiens
acctggggcagtcacctgc

SEQ ID NO: 3709126 - DNA, 14 bp, Homo sapiens
acctggtgctggat

SEQ ID NO: 3709127 - DNA, 15 bp, Homo sapiens
acctggtggcctctg

SEQ ID NO: 3709128 - DNA, 15 bp, Homo sapiens
acctgtaaaacttta

SEQ ID NO: 3709129 - DNA, 16 bp, Homo sapiens
acctgtaaaactttat

SEQ ID NO: 3709130 - DNA, 17 bp, Homo sapiens
acctgtaaaactttatt

SEQ ID NO: 3709131 - DNA, 12 bp, Homo sapiens
acctgtaaatta

SEQ ID NO: 3709132 - DNA, 18 bp, Homo sapiens
acctgtaaattattttaa

SEQ ID NO: 3709133 - DNA, 11 bp, Homo sapiens
acctgtaatca

SEQ ID NO: 3709134 - DNA, 15 bp, Homo sapiens
acctgtaatcccagc

SEQ ID NO: 3709135 - DNA, 16 bp, Homo sapiens
acctgtaatcccagca

SEQ ID NO: 3709136 - DNA, 12 bp, Homo sapiens
acctgtactcag

SEQ ID NO: 3709137 - DNA, 17 bp, Homo sapiens
acctgtatgtctccagt

SEQ ID NO: 3709138 - DNA, 16 bp, Homo sapiens
acctgtcgcccagtgc

SEQ ID NO: 3709139 - DNA, 13 bp, Homo sapiens
acctgtctcacca

SEQ ID NO: 3709140 - DNA, 19 bp, Homo sapiens
acctgtcttccaaggagac

SEQ ID NO: 3709141 - DNA, 13 bp, Homo sapiens
acctgtgaccagc

SEQ ID NO: 3709142 - DNA, 23 bp, Homo sapiens
acctgtgaccagcactgtctcag

SEQ ID NO: 3709143 - DNA, 19 bp, Homo sapiens
acctgtgatgaggggagga

SEQ ID NO: 3709144 - DNA, 13 bp, Homo sapiens
acctgtgtcacta

SEQ ID NO: 3709145 - DNA, 13 bp, Homo sapiens
accttaaattaaa

SEQ ID NO: 3709146 - DNA, 19 bp, Homo sapiens
accttaaattaaacaattt

SEQ ID NO: 3709147 - DNA, 21 bp, Homo sapiens
accttagctggcattacagct

SEQ ID NO: 3709148 - DNA, 13 bp, Homo sapiens
accttatctgtgc

SEQ ID NO: 3709149 - DNA, 23 bp, Homo sapiens
accttatctgtgcgtgaaacaca

SEQ ID NO: 3709150 - DNA, 15 bp, Homo sapiens
accttcagatcctac

SEQ ID NO: 3709151 - DNA, 16 bp, Homo sapiens
accttcagatcctacc

SEQ ID NO: 3709152 - DNA, 15 bp, Homo sapiens
accttctgtggctca

SEQ ID NO: 3709153 - DNA, 19 bp, Homo sapiens
accttcttcagccacctct

SEQ ID NO: 3709154 - DNA, 20 bp, Homo sapiens
accttcttcagccacctctc

SEQ ID NO: 3709155 - DNA, 18 bp, Homo sapiens
accttgaactcctgggct

SEQ ID NO: 3709156 - DNA, 20 bp, Homo sapiens
accttgaactgggtacttgt

SEQ ID NO: 3709157 - DNA, 14 bp, Homo sapiens
accttgacagggca

SEQ ID NO: 3709158 - DNA, 22 bp, Homo sapiens
accttgaggtcttttgacatgt

SEQ ID NO: 3709159 - DNA, 15 bp, Homo sapiens
accttgcaacacaca

SEQ ID NO: 3709160 - DNA, 19 bp, Homo sapiens
accttgcaacacacagaca

SEQ ID NO: 3709161 - DNA, 12 bp, Homo sapiens
accttggctcaa

SEQ ID NO: 3709162 - DNA, 18 bp, Homo sapiens
acctttattaaaatctta

SEQ ID NO: 3709163 - DNA, 20 bp, Homo sapiens
acctttattaaaatcttaaa

SEQ ID NO: 3709164 - DNA, 17 bp, Homo sapiens
acctttcaaatttcaca

SEQ ID NO: 3709165 - DNA, 13 bp, Homo sapiens
acctttcccatct

SEQ ID NO: 3709166 - DNA, 14 bp, Homo sapiens
acctttttatctcc

SEQ ID NO: 3709167 - DNA, 16 bp, Homo sapiens
acgaacccacctgctg

SEQ ID NO: 3709168 - DNA, 11 bp, Homo sapiens
acgaagaaaaa

SEQ ID NO: 3709169 - DNA, 22 bp, Homo sapiens
acgacaaagccaaactctgcca

SEQ ID NO: 3709170 - DNA, 21 bp, Homo sapiens
acgacaaagctgctaaatctc

SEQ ID NO: 3709171 - DNA, 20 bp, Homo sapiens
acgacaatagctttaccctc

SEQ ID NO: 3709172 - DNA, 20 bp, Homo sapiens
acgagaccctacaggagagg

SEQ ID NO: 3709173 - DNA, 12 bp, Homo sapiens
acgaggaagccc

SEQ ID NO: 3709174 - DNA, 20 bp, Homo sapiens
acgaggtcaagagatcgaga

SEQ ID NO: 3709175 - DNA, 17 bp, Homo sapiens
acgagtcaatcccctca

SEQ ID NO: 3709176 - DNA, 14 bp, Homo sapiens
acgatgaaaaactt

SEQ ID NO: 3709177 - DNA, 15 bp, Homo sapiens
actcttgtaagattt

SEQ ID NO: 3709178 - DNA, 16 bp, Homo sapiens
actcttgtaagatttt

SEQ ID NO: 3709179 - DNA, 19 bp, Homo sapiens
actctttgagatagaagaa

SEQ ID NO: 3709180 - DNA, 22 bp, Homo sapiens
actctttgagatagaagaactg

SEQ ID NO: 3709181 - DNA, 18 bp, Homo sapiens
actctttttgttttttgt

SEQ ID NO: 3709182 - DNA, 19 bp, Homo sapiens
actgaaaacataaaaagtt

SEQ ID NO: 3709183 - DNA, 16 bp, Homo sapiens
actgaaatatacacac

SEQ ID NO: 3709184 - DNA, 17 bp, Homo sapiens
actgaaatatacacaca

SEQ ID NO: 3709185 - DNA, 18 bp, Homo sapiens
actgaaatgccttacttt

SEQ ID NO: 3709186 - DNA, 12 bp, Homo sapiens
actgaacaaaaa

SEQ ID NO: 3709187 - DNA, 13 bp, Homo sapiens
actgaacaaaaaa

SEQ ID NO: 3709188 - DNA, 14 bp, Homo sapiens
actgaagatagaag

SEQ ID NO: 3709189 - DNA, 16 bp, Homo sapiens
actgaagatagaagaa

SEQ ID NO: 3709190 - DNA, 17 bp, Homo sapiens
actgaagatagaagaaa

SEQ ID NO: 3709191 - DNA, 19 bp, Homo sapiens
actgaagatagaagaaaaa

SEQ ID NO: 3709192 - DNA, 15 bp, Homo sapiens
actgaagcctgcagg

SEQ ID NO: 3709193 - DNA, 16 bp, Homo sapiens
actgaagcctgcagga

SEQ ID NO: 3709194 - DNA, 21 bp, Homo sapiens
actgaatatttatatttcact

SEQ ID NO: 3709195 - DNA, 22 bp, Homo sapiens
actgaatatttatatttcacta

SEQ ID NO: 3709196 - DNA, 17 bp, Homo sapiens
actgaatgaacaacctc

SEQ ID NO: 3709197 - DNA, 22 bp, Homo sapiens
actgaattaatgacagagccag

SEQ ID NO: 3709198 - DNA, 13 bp, Homo sapiens
actgacacacacg

SEQ ID NO: 3709199 - DNA, 14 bp, Homo sapiens
actgacagaggggg

SEQ ID NO: 3709200 - DNA, 18 bp, Homo sapiens
actgacagcctcccaccc

SEQ ID NO: 3709201 - DNA, 13 bp, Homo sapiens
actgaccagcctc

SEQ ID NO: 3709202 - DNA, 16 bp, Homo sapiens
actgaccatccactct

SEQ ID NO: 3709203 - DNA, 20 bp, Homo sapiens
actgacccacagcctctgcc

SEQ ID NO: 3709204 - DNA, 14 bp, Homo sapiens
actgagcagactgg

SEQ ID NO: 3709205 - DNA, 23 bp, Homo sapiens
actgagcagactggtgagcagac

SEQ ID NO: 3709206 - DNA, 14 bp, Homo sapiens
actgagctcctctg

SEQ ID NO: 3709207 - DNA, 19 bp, Homo sapiens
actgagctcctctgggcag

SEQ ID NO: 3709208 - DNA, 18 bp, Homo sapiens
actgagcttctctgtgaa

SEQ ID NO: 3709209 - DNA, 18 bp, Homo sapiens
actgaggaatgatgaagc

SEQ ID NO: 3709210 - DNA, 15 bp, Homo sapiens
actgaggcagacagc

SEQ ID NO: 3709211 - DNA, 19 bp, Homo sapiens
actgaggcagacagcagct

SEQ ID NO: 3709212 - DNA, 22 bp, Homo sapiens
actgaggcagacagcagctcag

SEQ ID NO: 3709213 - DNA, 14 bp, Homo sapiens
actgaggcagggaa

SEQ ID NO: 3709214 - DNA, 15 bp, Homo sapiens
actgaggcagggaag

SEQ ID NO: 3709215 - DNA, 21 bp, Homo sapiens
actgagggaccaactgggccc

SEQ ID NO: 3709216 - DNA, 22 bp, Homo sapiens
actgagggaccaactgggccca

SEQ ID NO: 3709217 - DNA, 18 bp, Homo sapiens
actgaggggtctccagga

SEQ ID NO: 3709218 - DNA, 14 bp, Homo sapiens
actgatggaaacaa

SEQ ID NO: 3709219 - DNA, 12 bp, Homo sapiens
actgatgggcaa

SEQ ID NO: 3709220 - DNA, 23 bp, Homo sapiens
actgatgggcaacccccagcctg

SEQ ID NO: 3709221 - DNA, 18 bp, Homo sapiens
actgatggtgcattttat

SEQ ID NO: 3709222 - DNA, 18 bp, Homo sapiens
actgatgttaggctgggc

SEQ ID NO: 3709223 - DNA, 23 bp, Homo sapiens
actgatgttaggctgggcccaga

SEQ ID NO: 3709224 - DNA, 13 bp, Homo sapiens
actgattgtttca

SEQ ID NO: 3709225 - DNA, 16 bp, Homo sapiens
actgatttggagatat

SEQ ID NO: 3709226 - DNA, 15 bp, Homo sapiens
actgcaaaggcgcag

SEQ ID NO: 3709227 - DNA, 14 bp, Homo sapiens
actgcaacctccgc

SEQ ID NO: 3709228 - DNA, 16 bp, Homo sapiens
actgcaacctccgcct

SEQ ID NO: 3709229 - DNA, 17 bp, Homo sapiens
actgcaagagccttggt

SEQ ID NO: 3709230 - DNA, 19 bp, Homo sapiens
actgcaagtcacaaaggaa

SEQ ID NO: 3709231 - DNA, 20 bp, Homo sapiens
actgcaagtgagcaaacctg

SEQ ID NO: 3709232 - DNA, 16 bp, Homo sapiens
actgcaatagagactg

SEQ ID NO: 3709233 - DNA, 19 bp, Homo sapiens
actgcaatagagactgtag

SEQ ID NO: 3709234 - DNA, 16 bp, Homo sapiens
actgcacagtgcatct

SEQ ID NO: 3709235 - DNA, 23 bp, Homo sapiens
actgcacagtgcatctcagccca

SEQ ID NO: 3709236 - DNA, 19 bp, Homo sapiens
actgcacgtggcttctgat

SEQ ID NO: 3709237 - DNA, 21 bp, Homo sapiens
actgcactatagcctaggtga

SEQ ID NO: 3709238 - DNA, 16 bp, Homo sapiens
actgcactccagcctg

SEQ ID NO: 3709239 - DNA, 18 bp, Homo sapiens
actgcactccagcctggg

SEQ ID NO: 3709240 - DNA, 19 bp, Homo sapiens
actgcactccagcctgggc

SEQ ID NO: 3709241 - DNA, 20 bp, Homo sapiens
actgcactccagcctgggcg

SEQ ID NO: 3709242 - DNA, 21 bp, Homo sapiens
actgcactccagcctgggcga

SEQ ID NO: 3709243 - DNA, 20 bp, Homo sapiens
actgcactccagcctgggtg

SEQ ID NO: 3709244 - DNA, 18 bp, Homo sapiens
actgcactctagccggag

SEQ ID NO: 3709245 - DNA, 19 bp, Homo sapiens
actgcagcctcaacctcct

SEQ ID NO: 3709246 - DNA, 23 bp, Homo sapiens
actgcagcctcaacctcctgggc

SEQ ID NO: 3709247 - DNA, 12 bp, Homo sapiens
actgcaggcccc

SEQ ID NO: 3709248 - DNA, 23 bp, Homo sapiens
actgcaggccccgcttgtccagc

SEQ ID NO: 3709249 - DNA, 17 bp, Homo sapiens
actgcagggactgccag

SEQ ID NO: 3709250 - DNA, 14 bp, Homo sapiens
actgcatggaccta

SEQ ID NO: 3709251 - DNA, 20 bp, Homo sapiens
actgcatggacctaacattc

SEQ ID NO: 3709252 - DNA, 20 bp, Homo sapiens
actgcatgtataaatgaagt

SEQ ID NO: 3709253 - DNA, 16 bp, Homo sapiens
actgcattagaaatta

SEQ ID NO: 3709254 - DNA, 15 bp, Homo sapiens
actgcattgagaact

SEQ ID NO: 3709255 - DNA, 21 bp, Homo sapiens
actgccaaagggaaatatcat

SEQ ID NO: 3709256 - DNA, 23 bp, Homo sapiens
actgccccgtgcagactggaggg

SEQ ID NO: 3709257 - DNA, 20 bp, Homo sapiens
actgcccgagctggtgcatt

SEQ ID NO: 3709258 - DNA, 22 bp, Homo sapiens
actgcccgagctggtgcattac

SEQ ID NO: 3709259 - DNA, 17 bp, Homo sapiens
actgcccggggcagctg

SEQ ID NO: 3709260 - DNA, 18 bp, Homo sapiens
actgccgaccgaggctgg

SEQ ID NO: 3709261 - DNA, 19 bp, Homo sapiens
actgccgaccgaggctgga

SEQ ID NO: 3709262 - DNA, 17 bp, Homo sapiens
actgcctctccctggcc

SEQ ID NO: 3709263 - DNA, 15 bp, Homo sapiens
actgcctcttcctcc

SEQ ID NO: 3709264 - DNA, 9 bp, Homo sapiens
actgcctgc

SEQ ID NO: 3709265 - DNA, 13 bp, Homo sapiens
actgcctgcccac

SEQ ID NO: 3709266 - DNA, 16 bp, Homo sapiens
actgcctgcccacccg

SEQ ID NO: 3709267 - DNA, 15 bp, Homo sapiens
actgccttaaaactt

SEQ ID NO: 3709268 - DNA, 18 bp, Homo sapiens
actgccttggcttcaggg

SEQ ID NO: 3709269 - DNA, 20 bp, Homo sapiens
actgcgggatggtcctgggg

SEQ ID NO: 3709270 - DNA, 19 bp, Homo sapiens
actgctcatcattccttga

SEQ ID NO: 3709271 - DNA, 22 bp, Homo sapiens
actgctgccccaaaggaagctt

SEQ ID NO: 3709272 - DNA, 12 bp, Homo sapiens
actgctggctgc

SEQ ID NO: 3709273 - DNA, 13 bp, Homo sapiens
actgctggctgcc

SEQ ID NO: 3709274 - DNA, 14 bp, Homo sapiens
actgcttttggtct

SEQ ID NO: 3709275 - DNA, 20 bp, Homo sapiens
actgcttttggtctgtgtga

SEQ ID NO: 3709276 - DNA, 15 bp, Homo sapiens
actggaagcacagct

SEQ ID NO: 3709277 - DNA, 16 bp, Homo sapiens
actggaagcacagctt

SEQ ID NO: 3709278 - DNA, 16 bp, Homo sapiens
actggaagttttgcat

SEQ ID NO: 3709279 - DNA, 17 bp, Homo sapiens
actggaagttttgcatt

SEQ ID NO: 3709280 - DNA, 21 bp, Homo sapiens
actggaccactgggcaatgat

SEQ ID NO: 3709281 - DNA, 23 bp, Homo sapiens
actggactcaggatgcccagggc

SEQ ID NO: 3709282 - DNA, 22 bp, Homo sapiens
actggacttgagcttggcagct

SEQ ID NO: 3709283 - DNA, 14 bp, Homo sapiens
actggagagcaaca

SEQ ID NO: 3709284 - DNA, 16 bp, Homo sapiens
actggagcaccaggca

SEQ ID NO: 3709285 - DNA, 12 bp, Homo sapiens
actggagcccag

SEQ ID NO: 3709286 - DNA, 11 bp, Homo sapiens
actggagcccc

SEQ ID NO: 3709287 - DNA, 22 bp, Homo sapiens
actggaggggacgctggtagag

SEQ ID NO: 3709288 - DNA, 14 bp, Homo sapiens
actggattggccaa

SEQ ID NO: 3709289 - DNA, 16 bp, Homo sapiens
actggcagttttccat

SEQ ID NO: 3709290 - DNA, 20 bp, Homo sapiens
actggcatctgacacaaaaa

SEQ ID NO: 3709291 - DNA, 14 bp, Homo sapiens
actggccctcttct

SEQ ID NO: 3709292 - DNA, 15 bp, Homo sapiens
actggccctcttctt

SEQ ID NO: 3709293 - DNA, 16 bp, Homo sapiens
actggccctcttctta

SEQ ID NO: 3709294 - DNA, 17 bp, Homo sapiens
actggccctcttcttac

SEQ ID NO: 3709295 - DNA, 14 bp, Homo sapiens
actggcctgaggag

SEQ ID NO: 3709296 - DNA, 16 bp, Homo sapiens
actggcctgaggagca

SEQ ID NO: 3709297 - DNA, 16 bp, Homo sapiens
actggctggctgcagt

SEQ ID NO: 3709298 - DNA, 16 bp, Homo sapiens
actggctgtcctttcc

SEQ ID NO: 3709299 - DNA, 19 bp, Homo sapiens
actgggaagataggctctg

SEQ ID NO: 3709300 - DNA, 18 bp, Homo sapiens
actgggtggggtgaggac

SEQ ID NO: 3709301 - DNA, 20 bp, Homo sapiens
actgggtttctctgtatagt

SEQ ID NO: 3709302 - DNA, 20 bp, Homo sapiens
actggtggcccgacagcctg

SEQ ID NO: 3709303 - DNA, 20 bp, Homo sapiens
actggtgggatctgtgccca

SEQ ID NO: 3709304 - DNA, 14 bp, Homo sapiens
actggtgtccagct

SEQ ID NO: 3709305 - DNA, 16 bp, Homo sapiens
actgtacaaagtagaa

SEQ ID NO: 3709306 - DNA, 17 bp, Homo sapiens
actgtactagtctgtgt

SEQ ID NO: 3709307 - DNA, 13 bp, Homo sapiens
actgtactcctcc

SEQ ID NO: 3709308 - DNA, 14 bp, Homo sapiens
actgtactcctccc

SEQ ID NO: 3709309 - DNA, 19 bp, Homo sapiens
actgtagaatgatttcatg

SEQ ID NO: 3709310 - DNA, 17 bp, Homo sapiens
actgtagattgcttctg

SEQ ID NO: 3709311 - DNA, 21 bp, Homo sapiens
actgtagattgcttctgtagt

SEQ ID NO: 3709312 - DNA, 21 bp, Homo sapiens
actgtataccccgtgaagcat

SEQ ID NO: 3709313 - DNA, 15 bp, Homo sapiens
actgtatctgtgtag

SEQ ID NO: 3709314 - DNA, 20 bp, Homo sapiens
actgtattacataaataaat

SEQ ID NO: 3709315 - DNA, 20 bp, Homo sapiens
actgtatttttacctttttc

SEQ ID NO: 3709316 - DNA, 20 bp, Homo sapiens
actgtcaaagaatcaatcca

SEQ ID NO: 3709317 - DNA, 15 bp, Homo sapiens
actgtcaataaacag

SEQ ID NO: 3709318 - DNA, 17 bp, Homo sapiens
actgtcaataaacagct

SEQ ID NO: 3709319 - DNA, 19 bp, Homo sapiens
actgtcctctttcagaaaa

SEQ ID NO: 3709320 - DNA, 18 bp, Homo sapiens
actgtctcagtttcactt

SEQ ID NO: 3709321 - DNA, 14 bp, Homo sapiens
actgtcttaattaa

SEQ ID NO: 3709322 - DNA, 16 bp, Homo sapiens
actgtgaagagaacca

SEQ ID NO: 3709323 - DNA, 23 bp, Homo sapiens
actgtgatcaggctatgtatgga

SEQ ID NO: 3709324 - DNA, 13 bp, Homo sapiens
actgtgatgccac

SEQ ID NO: 3709325 - DNA, 20 bp, Homo sapiens
actgtgatgccacacagagt

SEQ ID NO: 3709326 - DNA, 17 bp, Homo sapiens
actgtgccatgtgccag

SEQ ID NO: 3709327 - DNA, 14 bp, Homo sapiens
actgtggaaaaata

SEQ ID NO: 3709328 - DNA, 15 bp, Homo sapiens
actgtggaaaaatat

SEQ ID NO: 3709329 - DNA, 17 bp, Homo sapiens
actgtggaaaaatattt

SEQ ID NO: 3709330 - DNA, 14 bp, Homo sapiens
actgtgtaactgcc

SEQ ID NO: 3709331 - DNA, 15 bp, Homo sapiens
actgtgtaactgccc

SEQ ID NO: 3709332 - DNA, 18 bp, Homo sapiens
actgtgtatgtacatata

SEQ ID NO: 3709333 - DNA, 18 bp, Homo sapiens
actgtgtggactgtgatg

SEQ ID NO: 3709334 - DNA, 17 bp, Homo sapiens
actgttaatagttcagg

SEQ ID NO: 3709335 - DNA, 18 bp, Homo sapiens
actgttagaacactattt

SEQ ID NO: 3709336 - DNA, 18 bp, Homo sapiens
actgttgcccaggctggc

SEQ ID NO: 3709337 - DNA, 12 bp, Homo sapiens
actgtttctctg

SEQ ID NO: 3709338 - DNA, 13 bp, Homo sapiens
actgtttctctgc

SEQ ID NO: 3709339 - DNA, 22 bp, Homo sapiens
actgtttgccttctacttttaa

SEQ ID NO: 3709340 - DNA, 23 bp, Homo sapiens
actgtttttgaaaaattacagct

SEQ ID NO: 3709341 - DNA, 19 bp, Homo sapiens
actgttttttcctgagctt

SEQ ID NO: 3709342 - DNA, 22 bp, Homo sapiens
acttaaaaaaatgacagatgtt

SEQ ID NO: 3709343 - DNA, 13 bp, Homo sapiens
acttaaaatattt

SEQ ID NO: 3709344 - DNA, 14 bp, Homo sapiens
acttaacagatgca

SEQ ID NO: 3709345 - DNA, 16 bp, Homo sapiens
acttaagaaacactga

SEQ ID NO: 3709346 - DNA, 15 bp, Homo sapiens
acttaccttcaataa

SEQ ID NO: 3709347 - DNA, 19 bp, Homo sapiens
acttaccttcaataaagta

SEQ ID NO: 3709348 - DNA, 16 bp, Homo sapiens
acttagcttatcaatt

SEQ ID NO: 3709349 - DNA, 19 bp, Homo sapiens
acttagcttatcaatttgt

SEQ ID NO: 3709350 - DNA, 22 bp, Homo sapiens
acttagcttatcaatttgtcat

SEQ ID NO: 3709351 - DNA, 21 bp, Homo sapiens
acttagcttgaaggatctgtt

SEQ ID NO: 3709352 - DNA, 20 bp, Homo sapiens
acttagtgcggacaagtttt

SEQ ID NO: 3709353 - DNA, 17 bp, Homo sapiens
acttatcttacaaagtg

SEQ ID NO: 3709354 - DNA, 18 bp, Homo sapiens
acttatcttacaaagtgt

SEQ ID NO: 3709355 - DNA, 20 bp, Homo sapiens
acttatcttacaaagtgtat

SEQ ID NO: 3709356 - DNA, 22 bp, Homo sapiens
acttatcttacaaagtgtattt

SEQ ID NO: 3709357 - DNA, 16 bp, Homo sapiens
acttattatcttcagg

SEQ ID NO: 3709358 - DNA, 16 bp, Homo sapiens
acttatttttgacagt

SEQ ID NO: 3709359 - DNA, 21 bp, Homo sapiens
acttcaaaaactgtcaaagaa

SEQ ID NO: 3709360 - DNA, 13 bp, Homo sapiens
acttcaaggccca

SEQ ID NO: 3709361 - DNA, 19 bp, Homo sapiens
acttcacacacaggcaact

SEQ ID NO: 3709362 - DNA, 14 bp, Homo sapiens
acttcacactgcaa

SEQ ID NO: 3709363 - DNA, 15 bp, Homo sapiens
acttcacactgcaag

SEQ ID NO: 3709364 - DNA, 16 bp, Homo sapiens
acttcacactgcaaga

SEQ ID NO: 3709365 - DNA, 13 bp, Homo sapiens
acttcagactgaa

SEQ ID NO: 3709366 - DNA, 17 bp, Homo sapiens
acttcagagagctggta

SEQ ID NO: 3709367 - DNA, 20 bp, Homo sapiens
acttcagagagctggtagtt

SEQ ID NO: 3709368 - DNA, 14 bp, Homo sapiens
acttcagctctgtt

SEQ ID NO: 3709369 - DNA, 11 bp, Homo sapiens
acttcagctga

SEQ ID NO: 3709370 - DNA, 14 bp, Homo sapiens
acttcaggctcttc

SEQ ID NO: 3709371 - DNA, 18 bp, Homo sapiens
acttcaggctcttctcct

SEQ ID NO: 3709372 - DNA, 20 bp, Homo sapiens
acttcaggctcttctccttt

SEQ ID NO: 3709373 - DNA, 21 bp, Homo sapiens
acttcagggttctcctctccc

SEQ ID NO: 3709374 - DNA, 20 bp, Homo sapiens
acttcatcttccccaagtgc

SEQ ID NO: 3709375 - DNA, 14 bp, Homo sapiens
acttcattcttgaa

SEQ ID NO: 3709376 - DNA, 15 bp, Homo sapiens
acttcattcttgaaa

SEQ ID NO: 3709377 - DNA, 21 bp, Homo sapiens
acttcattcttgaaagctgtg

SEQ ID NO: 3709378 - DNA, 22 bp, Homo sapiens
acttccaagacctgactcaggc

SEQ ID NO: 3709379 - DNA, 17 bp, Homo sapiens
acttccataatctggac

SEQ ID NO: 3709380 - DNA, 17 bp, Homo sapiens
acttccatgaggccaaa

SEQ ID NO: 3709381 - DNA, 14 bp, Homo sapiens
acttcgactgtgac

SEQ ID NO: 3709382 - DNA, 19 bp, Homo sapiens
acttcgggaaggtgtctgg

SEQ ID NO: 3709383 - DNA, 22 bp, Homo sapiens
acttcgggaggtcgaggcagga

SEQ ID NO: 3709384 - DNA, 20 bp, Homo sapiens
acttcgttttggttaagttg

SEQ ID NO: 3709385 - DNA, 15 bp, Homo sapiens
acttctaaatgaagt

SEQ ID NO: 3709386 - DNA, 14 bp, Homo sapiens
acttctaattgcca

SEQ ID NO: 3709387 - DNA, 17 bp, Homo sapiens
acttctaattgccatgt

SEQ ID NO: 3709388 - DNA, 14 bp, Homo sapiens
acttctccaccctg

SEQ ID NO: 3709389 - DNA, 18 bp, Homo sapiens
acttctccaccctgctct

SEQ ID NO: 3709390 - DNA, 15 bp, Homo sapiens
acttctgaccacact

SEQ ID NO: 3709391 - DNA, 16 bp, Homo sapiens
acttctgaccacactt

SEQ ID NO: 3709392 - DNA, 18 bp, Homo sapiens
acttctgccatattctgt

SEQ ID NO: 3709393 - DNA, 15 bp, Homo sapiens
acttcttttataact

SEQ ID NO: 3709394 - DNA, 19 bp, Homo sapiens
acttcttttgctcttagct

SEQ ID NO: 3709395 - DNA, 20 bp, Homo sapiens
acttgaattcatagaaaaag

SEQ ID NO: 3709396 - DNA, 20 bp, Homo sapiens
acttgacagaacactgtctt

SEQ ID NO: 3709397 - DNA, 22 bp, Homo sapiens
acttgatgagtgtaacaagaaa

SEQ ID NO: 3709398 - DNA, 19 bp, Homo sapiens
acttgcacgcccatgtgtg

SEQ ID NO: 3709399 - DNA, 23 bp, Homo sapiens
acttgcagactctacagaggcca

SEQ ID NO: 3709400 - DNA, 19 bp, Homo sapiens
acttgcattgaatatatta

SEQ ID NO: 3709401 - DNA, 21 bp, Homo sapiens
acttgctgaatcggaatctct

SEQ ID NO: 3709402 - DNA, 14 bp, Homo sapiens
acttgctgctattt

SEQ ID NO: 3709403 - DNA, 16 bp, Homo sapiens
agaatagatgctgact

SEQ ID NO: 3709404 - DNA, 23 bp, Homo sapiens
agaatattagctttactgtttgt

SEQ ID NO: 3709405 - DNA, 22 bp, Homo sapiens
agaatattgttcctaagttctt

SEQ ID NO: 3709406 - DNA, 11 bp, Homo sapiens
agaatatttat

SEQ ID NO: 3709407 - DNA, 14 bp, Homo sapiens
agaatcattattta

SEQ ID NO: 3709408 - DNA, 20 bp, Homo sapiens
agaatcattatttattaaat

SEQ ID NO: 3709409 - DNA, 21 bp, Homo sapiens
agaatcattatttattaaatt

SEQ ID NO: 3709410 - DNA, 13 bp, Homo sapiens
agaatcattgtaa

SEQ ID NO: 3709411 - DNA, 22 bp, Homo sapiens
agaatcgatgggggatgcttca

SEQ ID NO: 3709412 - DNA, 18 bp, Homo sapiens
agaatctatatttaacaa

SEQ ID NO: 3709413 - DNA, 18 bp, Homo sapiens
agaatgaaagggcccaga

SEQ ID NO: 3709414 - DNA, 16 bp, Homo sapiens
agaatgccattctctt

SEQ ID NO: 3709415 - DNA, 18 bp, Homo sapiens
agaatgctctttacttca

SEQ ID NO: 3709416 - DNA, 14 bp, Homo sapiens
agaatgtcagaaaa

SEQ ID NO: 3709417 - DNA, 15 bp, Homo sapiens
agaatgtcagattcc

SEQ ID NO: 3709418 - DNA, 18 bp, Homo sapiens
agaatgtcagattccttt

SEQ ID NO: 3709419 - DNA, 21 bp, Homo sapiens
agaatgtgtttaaacttggtt

SEQ ID NO: 3709420 - DNA, 14 bp, Homo sapiens
agaatgttctcaat

SEQ ID NO: 3709421 - DNA, 19 bp, Homo sapiens
agaatgttgtattcagtga

SEQ ID NO: 3709422 - DNA, 14 bp, Homo sapiens
agaatgttttcctt

SEQ ID NO: 3709423 - DNA, 20 bp, Homo sapiens
agaattctcagaatctcaaa

SEQ ID NO: 3709424 - DNA, 19 bp, Homo sapiens
agaattctccaaaacaatt

SEQ ID NO: 3709425 - DNA, 22 bp, Homo sapiens
agaattctgctacctcactggg

SEQ ID NO: 3709426 - DNA, 16 bp, Homo sapiens
agaattcttacatgtt

SEQ ID NO: 3709427 - DNA, 13 bp, Homo sapiens
agaattctttcaa

SEQ ID NO: 3709428 - DNA, 14 bp, Homo sapiens
agaattctttcaag

SEQ ID NO: 3709429 - DNA, 19 bp, Homo sapiens
agaattgaacccaggaggt

SEQ ID NO: 3709430 - DNA, 22 bp, Homo sapiens
agaattgatcattttcccccca

SEQ ID NO: 3709431 - DNA, 13 bp, Homo sapiens
agaatttattcaa

SEQ ID NO: 3709432 - DNA, 14 bp, Homo sapiens
agaatttattcaat

SEQ ID NO: 3709433 - DNA, 20 bp, Homo sapiens
agaatttcaatttgttcagt

SEQ ID NO: 3709434 - DNA, 21 bp, Homo sapiens
agaatttcttggtaagaagcc

SEQ ID NO: 3709435 - DNA, 17 bp, Homo sapiens
agaattttaaatatttt

SEQ ID NO: 3709436 - DNA, 13 bp, Homo sapiens
agaattttaaatt

SEQ ID NO: 3709437 - DNA, 18 bp, Homo sapiens
agaattttaaattataac

SEQ ID NO: 3709438 - DNA, 20 bp, Homo sapiens
agaattttcagaccccagcg

SEQ ID NO: 3709439 - DNA, 22 bp, Homo sapiens
agacaaaaacagcctcacagaa

SEQ ID NO: 3709440 - DNA, 23 bp, Homo sapiens
agacaaaaatactctaattctaa

SEQ ID NO: 3709441 - DNA, 19 bp, Homo sapiens
agacaaacacctcccagga

SEQ ID NO: 3709442 - DNA, 17 bp, Homo sapiens
agacaaaccagaagcaa

SEQ ID NO: 3709443 - DNA, 19 bp, Homo sapiens
agacaaattctgtttcttg

SEQ ID NO: 3709444 - DNA, 14 bp, Homo sapiens
agacaacagaagtc

SEQ ID NO: 3709445 - DNA, 22 bp, Homo sapiens
agacaatgcagatgccagagca

SEQ ID NO: 3709446 - DNA, 20 bp, Homo sapiens
agacaatgtgaaaagaaaaa

SEQ ID NO: 3709447 - DNA, 13 bp, Homo sapiens
agacacacttgtc

SEQ ID NO: 3709448 - DNA, 12 bp, Homo sapiens
agacacaggccc

SEQ ID NO: 3709449 - DNA, 20 bp, Homo sapiens
agacacaggcccggctccag

SEQ ID NO: 3709450 - DNA, 22 bp, Homo sapiens
agacacaggcccggctccaggc

SEQ ID NO: 3709451 - DNA, 12 bp, Homo sapiens
agacacctcaga

SEQ ID NO: 3709452 - DNA, 14 bp, Homo sapiens
agacacctcagagc

SEQ ID NO: 3709453 - DNA, 17 bp, Homo sapiens
agacacctgcacctccc

SEQ ID NO: 3709454 - DNA, 18 bp, Homo sapiens
agacaccttgacagggca

SEQ ID NO: 3709455 - DNA, 19 bp, Homo sapiens
agacaccttgacagggcac

SEQ ID NO: 3709456 - DNA, 18 bp, Homo sapiens
agacactgtttacaagaa

SEQ ID NO: 3709457 - DNA, 19 bp, Homo sapiens
agacactgtttacaagaaa

SEQ ID NO: 3709458 - DNA, 15 bp, Homo sapiens
agacacttgatactt

SEQ ID NO: 3709459 - DNA, 15 bp, Homo sapiens
agacagacttgagaa

SEQ ID NO: 3709460 - DNA, 16 bp, Homo sapiens
agacagagacgcagga

SEQ ID NO: 3709461 - DNA, 19 bp, Homo sapiens
agacagagtctcactgttg

SEQ ID NO: 3709462 - DNA, 21 bp, Homo sapiens
agacagagtctcactgttgcc

SEQ ID NO: 3709463 - DNA, 15 bp, Homo sapiens
agacagatgccccag

SEQ ID NO: 3709464 - DNA, 14 bp, Homo sapiens
agacagcagctcag

SEQ ID NO: 3709465 - DNA, 19 bp, Homo sapiens
agacagctccctctgcctg

SEQ ID NO: 3709466 - DNA, 18 bp, Homo sapiens
agacaggaaaatcctctg

SEQ ID NO: 3709467 - DNA, 20 bp, Homo sapiens
agacaggaaaatcctctggc

SEQ ID NO: 3709468 - DNA, 22 bp, Homo sapiens
agacaggcaagcacctcctgcc

SEQ ID NO: 3709469 - DNA, 16 bp, Homo sapiens
agacaggcccaagaga

SEQ ID NO: 3709470 - DNA, 18 bp, Homo sapiens
agacaggcccaagagatg

SEQ ID NO: 3709471 - DNA, 13 bp, Homo sapiens
agacagtaagtat

SEQ ID NO: 3709472 - DNA, 17 bp, Homo sapiens
agacagtatatttatag

SEQ ID NO: 3709473 - DNA, 15 bp, Homo sapiens
agacagtgatctcca

SEQ ID NO: 3709474 - DNA, 18 bp, Homo sapiens
agacagtgatctccatat

SEQ ID NO: 3709475 - DNA, 14 bp, Homo sapiens
agacagttcaagaa

SEQ ID NO: 3709476 - DNA, 14 bp, Homo sapiens
agacatgaatatga

SEQ ID NO: 3709477 - DNA, 18 bp, Homo sapiens
agacatggggaggaagga

SEQ ID NO: 3709478 - DNA, 17 bp, Homo sapiens
agacattccaaaacgaa

SEQ ID NO: 3709479 - DNA, 19 bp, Homo sapiens
agacattctgccaggcccc

SEQ ID NO: 3709480 - DNA, 16 bp, Homo sapiens
agacatttttttccct

SEQ ID NO: 3709481 - DNA, 18 bp, Homo sapiens
agaccaaaatgacaatga

SEQ ID NO: 3709482 - DNA, 17 bp, Homo sapiens
agaccaagactctgaaa

SEQ ID NO: 3709483 - DNA, 13 bp, Homo sapiens
agaccaagcttgt

SEQ ID NO: 3709484 - DNA, 21 bp, Homo sapiens
agaccacagggttcaaaatgt

SEQ ID NO: 3709485 - DNA, 12 bp, Homo sapiens
agaccagagctc

SEQ ID NO: 3709486 - DNA, 15 bp, Homo sapiens
agaccagagctctgg

SEQ ID NO: 3709487 - DNA, 14 bp, Homo sapiens
agacccaaggagga

SEQ ID NO: 3709488 - DNA, 16 bp, Homo sapiens
agacccattcctattt

SEQ ID NO: 3709489 - DNA, 11 bp, Homo sapiens
agacccccacc

SEQ ID NO: 3709490 - DNA, 17 bp, Homo sapiens
agacccctctggccagg

SEQ ID NO: 3709491 - DNA, 15 bp, Homo sapiens
agacccctggctttt

SEQ ID NO: 3709492 - DNA, 13 bp, Homo sapiens
agacccctgtctc

SEQ ID NO: 3709493 - DNA, 13 bp, Homo sapiens
agaccctgtctct

SEQ ID NO: 3709494 - DNA, 19 bp, Homo sapiens
agacccttttgggtttctg

SEQ ID NO: 3709495 - DNA, 16 bp, Homo sapiens
agaccggaagctcctg

SEQ ID NO: 3709496 - DNA, 12 bp, Homo sapiens
agacctcagcca

SEQ ID NO: 3709497 - DNA, 12 bp, Homo sapiens
agacctcagcct

SEQ ID NO: 3709498 - DNA, 20 bp, Homo sapiens
agacctcagcctgtgctgcc

SEQ ID NO: 3709499 - DNA, 18 bp, Homo sapiens
agacctctgtgcacttat

SEQ ID NO: 3709500 - DNA, 16 bp, Homo sapiens
agacctgagctcccca

SEQ ID NO: 3709501 - DNA, 13 bp, Homo sapiens
agacctgtaatca

SEQ ID NO: 3709502 - DNA, 19 bp, Homo sapiens
agaccttctccaaatgaga

SEQ ID NO: 3709503 - DNA, 17 bp, Homo sapiens
agacgatttgtcagtta

SEQ ID NO: 3709504 - DNA, 19 bp, Homo sapiens
agacggagtcccaccttgg

SEQ ID NO: 3709505 - DNA, 12 bp, Homo sapiens
agactagagaaa

SEQ ID NO: 3709506 - DNA, 15 bp, Homo sapiens
agactagagaaaccg

SEQ ID NO: 3709507 - DNA, 17 bp, Homo sapiens
agactatattgtacaca

SEQ ID NO: 3709508 - DNA, 15 bp, Homo sapiens
agactatctaaatgt

SEQ ID NO: 3709509 - DNA, 19 bp, Homo sapiens
agactatctaaatgttgaa

SEQ ID NO: 3709510 - DNA, 14 bp, Homo sapiens
agactatttgctta

SEQ ID NO: 3709511 - DNA, 12 bp, Homo sapiens
agactcacctct

SEQ ID NO: 3709512 - DNA, 16 bp, Homo sapiens
agactcagtttgtcag

SEQ ID NO: 3709513 - DNA, 18 bp, Homo sapiens
agactcattcttctgtac

SEQ ID NO: 3709514 - DNA, 18 bp, Homo sapiens
agactccgtctcaaggaa

SEQ ID NO: 3709515 - DNA, 18 bp, Homo sapiens
agactctgtctcaaaaaa

SEQ ID NO: 3709516 - DNA, 20 bp, Homo sapiens
agactgcgggatggtcctgg

SEQ ID NO: 3709517 - DNA, 12 bp, Homo sapiens
agcaggaagctc

SEQ ID NO: 3709518 - DNA, 20 bp, Homo sapiens
agcaggaagctgtgagagca

SEQ ID NO: 3709519 - DNA, 23 bp, Homo sapiens
agcaggactgaattgtccccagt

SEQ ID NO: 3709520 - DNA, 19 bp, Homo sapiens
agcaggcacatggaggagc

SEQ ID NO: 3709521 - DNA, 13 bp, Homo sapiens
agcaggcccacct

SEQ ID NO: 3709522 - DNA, 14 bp, Homo sapiens
agcaggcccaccta

SEQ ID NO: 3709523 - DNA, 17 bp, Homo sapiens
agcaggcccacctacct

SEQ ID NO: 3709524 - DNA, 13 bp, Homo sapiens
agcagggctcagc

SEQ ID NO: 3709525 - DNA, 14 bp, Homo sapiens
agcagggctcagcg

SEQ ID NO: 3709526 - DNA, 15 bp, Homo sapiens
agcagggctcagcgg

SEQ ID NO: 3709527 - DNA, 20 bp, Homo sapiens
agcaggttgaggggctcctg

SEQ ID NO: 3709528 - DNA, 17 bp, Homo sapiens
agcagtaactgacaact

SEQ ID NO: 3709529 - DNA, 19 bp, Homo sapiens
agcagtcctgcctcagcct

SEQ ID NO: 3709530 - DNA, 22 bp, Homo sapiens
agcagtgagccgcatcttctcc

SEQ ID NO: 3709531 - DNA, 16 bp, Homo sapiens
agcagtgccttccata

SEQ ID NO: 3709532 - DNA, 19 bp, Homo sapiens
agcagtgccttccataatt

SEQ ID NO: 3709533 - DNA, 19 bp, Homo sapiens
agcagtggacaccaggagt

SEQ ID NO: 3709534 - DNA, 15 bp, Homo sapiens
agcagtgtcttccat

SEQ ID NO: 3709535 - DNA, 16 bp, Homo sapiens
agcagtgtcttccata

SEQ ID NO: 3709536 - DNA, 21 bp, Homo sapiens
agcagttacaaaaaccttccc

SEQ ID NO: 3709537 - DNA, 20 bp, Homo sapiens
agcagtttggtttctagcat

SEQ ID NO: 3709538 - DNA, 22 bp, Homo sapiens
agcagtttggtttctagcatga

SEQ ID NO: 3709539 - DNA, 14 bp, Homo sapiens
agcataaatgcaaa

SEQ ID NO: 3709540 - DNA, 17 bp, Homo sapiens
agcataagtttctggga

SEQ ID NO: 3709541 - DNA, 14 bp, Homo sapiens
agcatacatttata

SEQ ID NO: 3709542 - DNA, 20 bp, Homo sapiens
agcatacatttataatgttt

SEQ ID NO: 3709543 - DNA, 13 bp, Homo sapiens
agcatcaaactct

SEQ ID NO: 3709544 - DNA, 14 bp, Homo sapiens
agcatcaaactctt

SEQ ID NO: 3709545 - DNA, 18 bp, Homo sapiens
agcatcacctagaaactt

SEQ ID NO: 3709546 - DNA, 13 bp, Homo sapiens
agcatcacctcag

SEQ ID NO: 3709547 - DNA, 15 bp, Homo sapiens
agcatcacctcaggc

SEQ ID NO: 3709548 - DNA, 24 bp, Homo sapiens
agcatccatgtgtggactcaagtc

SEQ ID NO: 3709549 - DNA, 16 bp, Homo sapiens
agcatcctcagttcct

SEQ ID NO: 3709550 - DNA, 18 bp, Homo sapiens
agcatcctggcacccggc

SEQ ID NO: 3709551 - DNA, 22 bp, Homo sapiens
agcatcctggcacccggcccct

SEQ ID NO: 3709552 - DNA, 23 bp, Homo sapiens
agcatcctggcacccggcccctg

SEQ ID NO: 3709553 - DNA, 13 bp, Homo sapiens
agcatcggaggga

SEQ ID NO: 3709554 - DNA, 14 bp, Homo sapiens
agcatctaaacttt

SEQ ID NO: 3709555 - DNA, 16 bp, Homo sapiens
agcatctaaactttaa

SEQ ID NO: 3709556 - DNA, 14 bp, Homo sapiens
agcatctcatgagt

SEQ ID NO: 3709557 - DNA, 19 bp, Homo sapiens
agcatcttctcactccctt

SEQ ID NO: 3709558 - DNA, 13 bp, Homo sapiens
agcatgaaaaagc

SEQ ID NO: 3709559 - DNA, 22 bp, Homo sapiens
agcatgacaagccccaggcagg

SEQ ID NO: 3709560 - DNA, 18 bp, Homo sapiens
agcatgacctgtgaccag

SEQ ID NO: 3709561 - DNA, 19 bp, Homo sapiens
agcatgattctttaataga

SEQ ID NO: 3709562 - DNA, 13 bp, Homo sapiens
agcatgcacaaag

SEQ ID NO: 3709563 - DNA, 18 bp, Homo sapiens
agcatgcacaaagtgtat

SEQ ID NO: 3709564 - DNA, 21 bp, Homo sapiens
agcatgcacaaagtgtattca

SEQ ID NO: 3709565 - DNA, 16 bp, Homo sapiens
agcatggtgcatgccg

SEQ ID NO: 3709566 - DNA, 17 bp, Homo sapiens
agcatggtgcatgccgc

SEQ ID NO: 3709567 - DNA, 13 bp, Homo sapiens
agcatgtaatggt

SEQ ID NO: 3709568 - DNA, 12 bp, Homo sapiens
agcatgttactg

SEQ ID NO: 3709569 - DNA, 14 bp, Homo sapiens
agcattaactaatc

SEQ ID NO: 3709570 - DNA, 19 bp, Homo sapiens
agcattactcttgtaagat

SEQ ID NO: 3709571 - DNA, 20 bp, Homo sapiens
agcattactcttgtaagatt

SEQ ID NO: 3709572 - DNA, 21 bp, Homo sapiens
agcattactcttgtaagattt

SEQ ID NO: 3709573 - DNA, 20 bp, Homo sapiens
agcattctcactcctacctg

SEQ ID NO: 3709574 - DNA, 11 bp, Homo sapiens
agcattgcttt

SEQ ID NO: 3709575 - DNA, 13 bp, Homo sapiens
agcattgctttct

SEQ ID NO: 3709576 - DNA, 17 bp, Homo sapiens
agcattgctttctgaaa

SEQ ID NO: 3709577 - DNA, 20 bp, Homo sapiens
agcatttagtccaatgtctt

SEQ ID NO: 3709578 - DNA, 21 bp, Homo sapiens
agcatttagtccaatgtcttt

SEQ ID NO: 3709579 - DNA, 15 bp, Homo sapiens
agccaaaccctgtct

SEQ ID NO: 3709580 - DNA, 16 bp, Homo sapiens
agccaaaccctgtctg

SEQ ID NO: 3709581 - DNA, 15 bp, Homo sapiens
agccaaactctgcca

SEQ ID NO: 3709582 - DNA, 15 bp, Homo sapiens
agccaaagagaatgc

SEQ ID NO: 3709583 - DNA, 23 bp, Homo sapiens
agccaaagctaggcctggccaga

SEQ ID NO: 3709584 - DNA, 16 bp, Homo sapiens
agccaacccctgtgga

SEQ ID NO: 3709585 - DNA, 19 bp, Homo sapiens
agccaagattgcgccattg

SEQ ID NO: 3709586 - DNA, 21 bp, Homo sapiens
agccaagtcagctttgccttc

SEQ ID NO: 3709587 - DNA, 12 bp, Homo sapiens
agccacagccca

SEQ ID NO: 3709588 - DNA, 18 bp, Homo sapiens
agccacagcccaggcctc

SEQ ID NO: 3709589 - DNA, 14 bp, Homo sapiens
agccaccctcccag

SEQ ID NO: 3709590 - DNA, 17 bp, Homo sapiens
agccaccctcccagctc

SEQ ID NO: 3709591 - DNA, 19 bp, Homo sapiens
agccaccctcccagctctg

SEQ ID NO: 3709592 - DNA, 19 bp, Homo sapiens
agccacctgtcccacctca

SEQ ID NO: 3709593 - DNA, 17 bp, Homo sapiens
agccacggccaggccag

SEQ ID NO: 3709594 - DNA, 18 bp, Homo sapiens
agccacgttccttactgc

SEQ ID NO: 3709595 - DNA, 23 bp, Homo sapiens
agccacgttccttactgcagaat

SEQ ID NO: 3709596 - DNA, 12 bp, Homo sapiens
agccactgaagc

SEQ ID NO: 3709597 - DNA, 16 bp, Homo sapiens
agccactgaagctggg

SEQ ID NO: 3709598 - DNA, 20 bp, Homo sapiens
agccactgcaccgggccaca

SEQ ID NO: 3709599 - DNA, 18 bp, Homo sapiens
agccacttaccttcaata

SEQ ID NO: 3709600 - DNA, 23 bp, Homo sapiens
agccagaaataaagttggtgaca

SEQ ID NO: 3709601 - DNA, 16 bp, Homo sapiens
agccagaaccccgagc

SEQ ID NO: 3709602 - DNA, 15 bp, Homo sapiens
agccagaagctgagc

SEQ ID NO: 3709603 - DNA, 20 bp, Homo sapiens
agccagaagctgagcaccag

SEQ ID NO: 3709604 - DNA, 13 bp, Homo sapiens
agccagcagccag

SEQ ID NO: 3709605 - DNA, 20 bp, Homo sapiens
agccagcagccagctctcag

SEQ ID NO: 3709606 - DNA, 12 bp, Homo sapiens
agccagcccagc

SEQ ID NO: 3709607 - DNA, 15 bp, Homo sapiens
agccagcccagccca

SEQ ID NO: 3709608 - DNA, 15 bp, Homo sapiens
agccaggctcaggcc

SEQ ID NO: 3709609 - DNA, 21 bp, Homo sapiens
agccaggctgccaaggccaga

SEQ ID NO: 3709610 - DNA, 15 bp, Homo sapiens
agccagtcttaacat

SEQ ID NO: 3709611 - DNA, 17 bp, Homo sapiens
agccagtgacctgagga

SEQ ID NO: 3709612 - DNA, 17 bp, Homo sapiens
agccatgtttaagattt

SEQ ID NO: 3709613 - DNA, 18 bp, Homo sapiens
agccatgtttaagattta

SEQ ID NO: 3709614 - DNA, 20 bp, Homo sapiens
agccattaccatggagacaa

SEQ ID NO: 3709615 - DNA, 16 bp, Homo sapiens
agcccaataaacctct

SEQ ID NO: 3709616 - DNA, 20 bp, Homo sapiens
agcccaatattataattttt

SEQ ID NO: 3709617 - DNA, 19 bp, Homo sapiens
agcccacaggtgtccccag

SEQ ID NO: 3709618 - DNA, 14 bp, Homo sapiens
agcccacccccctc

SEQ ID NO: 3709619 - DNA, 23 bp, Homo sapiens
agcccacccctcaacacctctgc

SEQ ID NO: 3709620 - DNA, 12 bp, Homo sapiens
agcccactggat

SEQ ID NO: 3709621 - DNA, 20 bp, Homo sapiens
agcccactggatcagaaaga

SEQ ID NO: 3709622 - DNA, 15 bp, Homo sapiens
agcccacttctgcca

SEQ ID NO: 3709623 - DNA, 12 bp, Homo sapiens
agcccagacaaa

SEQ ID NO: 3709624 - DNA, 21 bp, Homo sapiens
agcccagccattaccatggag

SEQ ID NO: 3709625 - DNA, 14 bp, Homo sapiens
agcccagcccagct

SEQ ID NO: 3709626 - DNA, 15 bp, Homo sapiens
agcccagcccagctg

SEQ ID NO: 3709627 - DNA, 14 bp, Homo sapiens
agcccagctccagg

SEQ ID NO: 3709628 - DNA, 16 bp, Homo sapiens
agcccagctgctctgc

SEQ ID NO: 3709629 - DNA, 19 bp, Homo sapiens
agcccagctgctctgccca

SEQ ID NO: 3709630 - DNA, 20 bp, Homo sapiens
agcccagctgctctgcccag

SEQ ID NO: 3709631 - DNA, 12 bp, Homo sapiens
agcccaggagga

SEQ ID NO: 3709632 - DNA, 16 bp, Homo sapiens
agcccagggttccccc

SEQ ID NO: 3709633 - DNA, 18 bp, Homo sapiens
agcccagggttcccccag

SEQ ID NO: 3709634 - DNA, 19 bp, Homo sapiens
agcccagggttcccccagc

SEQ ID NO: 3709635 - DNA, 23 bp, Homo sapiens
agcccagggttcccccagccctg

SEQ ID NO: 3709636 - DNA, 15 bp, Homo sapiens
agcccattctctctc

SEQ ID NO: 3709637 - DNA, 16 bp, Homo sapiens
agccccaagaaggctg

SEQ ID NO: 3709638 - DNA, 17 bp, Homo sapiens
agccccaagaaggctgg

SEQ ID NO: 3709639 - DNA, 15 bp, Homo sapiens
agccccacacggagg

SEQ ID NO: 3709640 - DNA, 20 bp, Homo sapiens
agccccacccaggagggagg

SEQ ID NO: 3709641 - DNA, 15 bp, Homo sapiens
agccccactgccctt

SEQ ID NO: 3709642 - DNA, 13 bp, Homo sapiens
agccccagcacca

SEQ ID NO: 3709643 - DNA, 17 bp, Homo sapiens
agccccagcccagccca

SEQ ID NO: 3709644 - DNA, 23 bp, Homo sapiens
agccccagcccagcccagctgct

SEQ ID NO: 3709645 - DNA, 20 bp, Homo sapiens
agccccagggtcttccctac

SEQ ID NO: 3709646 - DNA, 23 bp, Homo sapiens
agccccagggtcttccctacctc

SEQ ID NO: 3709647 - DNA, 13 bp, Homo sapiens
agccccagtgccc

SEQ ID NO: 3709648 - DNA, 14 bp, Homo sapiens
agccccagtgccca

SEQ ID NO: 3709649 - DNA, 16 bp, Homo sapiens
agccccagtgcccaca

SEQ ID NO: 3709650 - DNA, 23 bp, Homo sapiens
agccccataattttttttttcct

SEQ ID NO: 3709651 - DNA, 15 bp, Homo sapiens
agccccatcctgccg

SEQ ID NO: 3709652 - DNA, 17 bp, Homo sapiens
agccccattctgcctgc

SEQ ID NO: 3709653 - DNA, 22 bp, Homo sapiens
agccccattctgcctgcccagg

SEQ ID NO: 3709654 - DNA, 17 bp, Homo sapiens
agcccccaggctgctgg

SEQ ID NO: 3709655 - DNA, 23 bp, Homo sapiens
agcccccgccccgccccacattc

SEQ ID NO: 3709656 - DNA, 17 bp, Homo sapiens
agccccgaggccttctc

SEQ ID NO: 3709657 - DNA, 20 bp, Homo sapiens
agccccgcaaaacccactga

SEQ ID NO: 3709658 - DNA, 13 bp, Homo sapiens
agcccctcccacc

SEQ ID NO: 3709659 - DNA, 23 bp, Homo sapiens
agcccctcccaccacagcaggtg

SEQ ID NO: 3709660 - DNA, 13 bp, Homo sapiens
agcccctcctctg

SEQ ID NO: 3709661 - DNA, 14 bp, Homo sapiens
agcccctcctctgc

SEQ ID NO: 3709662 - DNA, 16 bp, Homo sapiens
agcccctcctctgcca

SEQ ID NO: 3709663 - DNA, 22 bp, Homo sapiens
agcccctcctctgccacctccc

SEQ ID NO: 3709664 - DNA, 21 bp, Homo sapiens
agcccctcttgccccccaccc

SEQ ID NO: 3709665 - DNA, 23 bp, Homo sapiens
agcccctcttgccccccacccca

SEQ ID NO: 3709666 - DNA, 13 bp, Homo sapiens
agcccctgcccct

SEQ ID NO: 3709667 - DNA, 15 bp, Homo sapiens
agcccgcacccccac

SEQ ID NO: 3709668 - DNA, 16 bp, Homo sapiens
agcccgcacccccacc

SEQ ID NO: 3709669 - DNA, 17 bp, Homo sapiens
agcccgcacccccaccc

SEQ ID NO: 3709670 - DNA, 21 bp, Homo sapiens
agcccgcacccccaccctttg

SEQ ID NO: 3709671 - DNA, 18 bp, Homo sapiens
agcccgcatgcagcagct

SEQ ID NO: 3709672 - DNA, 20 bp, Homo sapiens
agcccgcatgcagcagcttg

SEQ ID NO: 3709673 - DNA, 17 bp, Homo sapiens
agccctccctgcccctc

SEQ ID NO: 3709674 - DNA, 15 bp, Homo sapiens
agccctccctgtcct

SEQ ID NO: 3709675 - DNA, 19 bp, Homo sapiens
agccctccctgtcctcctc

SEQ ID NO: 3709676 - DNA, 23 bp, Homo sapiens
agccctccgccattctcaagccc

SEQ ID NO: 3709677 - DNA, 24 bp, Homo sapiens
agccctccgccattctcaagccct

SEQ ID NO: 3709678 - DNA, 13 bp, Homo sapiens
agccctccttcca

SEQ ID NO: 3709679 - DNA, 17 bp, Homo sapiens
agccctccttccacgga

SEQ ID NO: 3709680 - DNA, 17 bp, Homo sapiens
agccctctcactgtgtc

SEQ ID NO: 3709681 - DNA, 23 bp, Homo sapiens
agccctctctggctaaggacagg

SEQ ID NO: 3709682 - DNA, 14 bp, Homo sapiens
agccctggccagag

SEQ ID NO: 3709683 - DNA, 15 bp, Homo sapiens
agccctggccagagg

SEQ ID NO: 3709684 - DNA, 17 bp, Homo sapiens
agccctggccagaggct

SEQ ID NO: 3709685 - DNA, 16 bp, Homo sapiens
agccctgggccccacc

SEQ ID NO: 3709686 - DNA, 23 bp, Homo sapiens
agccctgggccccaccacctagg

SEQ ID NO: 3709687 - DNA, 16 bp, Homo sapiens
agccctggtggcagtg

SEQ ID NO: 3709688 - DNA, 23 bp, Homo sapiens
agccctggtggcagtgggagctg

SEQ ID NO: 3709689 - DNA, 20 bp, Homo sapiens
agccctgtcagtgcagcccg

SEQ ID NO: 3709690 - DNA, 12 bp, Homo sapiens
agccctgtggaa

SEQ ID NO: 3709691 - DNA, 17 bp, Homo sapiens
agcccttgagctcccca

SEQ ID NO: 3709692 - DNA, 23 bp, Homo sapiens
agccctttggagaacgccagtct

SEQ ID NO: 3709693 - DNA, 15 bp, Homo sapiens
agccgagagcctgct

SEQ ID NO: 3709694 - DNA, 20 bp, Homo sapiens
agccgagatcacgccactgc

SEQ ID NO: 3709695 - DNA, 16 bp, Homo sapiens
agccgcatcccagact

SEQ ID NO: 3709696 - DNA, 14 bp, Homo sapiens
agccgccaggaccg

SEQ ID NO: 3709697 - DNA, 22 bp, Homo sapiens
agccgccattgccaccaggaga

SEQ ID NO: 3709698 - DNA, 17 bp, Homo sapiens
agccgctcctgtctgcc

SEQ ID NO: 3709699 - DNA, 14 bp, Homo sapiens
agccgtggcttccc

SEQ ID NO: 3709700 - DNA, 15 bp, Homo sapiens
agcctaatccctggg

SEQ ID NO: 3709701 - DNA, 22 bp, Homo sapiens
agcctaatccctgggcattgct

SEQ ID NO: 3709702 - DNA, 22 bp, Homo sapiens
agcctactagggacctggggaa

SEQ ID NO: 3709703 - DNA, 19 bp, Homo sapiens
agcctagaagagcttctga

SEQ ID NO: 3709704 - DNA, 21 bp, Homo sapiens
agcctagccgacctcagcctt

SEQ ID NO: 3709705 - DNA, 23 bp, Homo sapiens
agcctaggggtcagggaccaagg

SEQ ID NO: 3709706 - DNA, 15 bp, Homo sapiens
agcctaggtgacaga

SEQ ID NO: 3709707 - DNA, 17 bp, Homo sapiens
agcctaggtgacagagt

SEQ ID NO: 3709708 - DNA, 14 bp, Homo sapiens
agcctagttcatcc

SEQ ID NO: 3709709 - DNA, 15 bp, Homo sapiens
agcctagttcatcca

SEQ ID NO: 3709710 - DNA, 14 bp, Homo sapiens
agcctcaaatgcag

SEQ ID NO: 3709711 - DNA, 17 bp, Homo sapiens
agcctcaacctcctggg

SEQ ID NO: 3709712 - DNA, 16 bp, Homo sapiens
agcctcacttgaatgt

SEQ ID NO: 3709713 - DNA, 16 bp, Homo sapiens
agcctcagcatcctgg

SEQ ID NO: 3709714 - DNA, 14 bp, Homo sapiens
agcctcatccgagg

SEQ ID NO: 3709715 - DNA, 18 bp, Homo sapiens
agcctcatccgaggcagg

SEQ ID NO: 3709716 - DNA, 20 bp, Homo sapiens
agcctcatccgaggcagggt

SEQ ID NO: 3709717 - DNA, 15 bp, Homo sapiens
agcctccatttagtt

SEQ ID NO: 3709718 - DNA, 17 bp, Homo sapiens
agcctcccaaagtgctg

SEQ ID NO: 3709719 - DNA, 19 bp, Homo sapiens
agcctcccaaagtgctggg

SEQ ID NO: 3709720 - DNA, 20 bp, Homo sapiens
agcctcccaaagtgctggga

SEQ ID NO: 3709721 - DNA, 20 bp, Homo sapiens
agcctcccgaatagctggga

SEQ ID NO: 3709722 - DNA, 22 bp, Homo sapiens
agcctcccgaatagctgggact

SEQ ID NO: 3709723 - DNA, 20 bp, Homo sapiens
agcctcccgagtagctggga

SEQ ID NO: 3709724 - DNA, 22 bp, Homo sapiens
agcctcccgagtagctgggact

SEQ ID NO: 3709725 - DNA, 16 bp, Homo sapiens
agcctcgaactcctgg

SEQ ID NO: 3709726 - DNA, 19 bp, Homo sapiens
agcctcgaactcctgggct

SEQ ID NO: 3709727 - DNA, 21 bp, Homo sapiens
agcctcgaactcctgggctca

SEQ ID NO: 3709728 - DNA, 20 bp, Homo sapiens
agcctcgccgtctgtgaatt

SEQ ID NO: 3709729 - DNA, 14 bp, Homo sapiens
agcctctcatcccc

SEQ ID NO: 3709730 - DNA, 14 bp, Homo sapiens
agcctctggctaga

SEQ ID NO: 3709731 - DNA, 15 bp, Homo sapiens
agcctctggctagag

SEQ ID NO: 3709732 - DNA, 20 bp, Homo sapiens
agcctctggctagaggccag

SEQ ID NO: 3709733 - DNA, 23 bp, Homo sapiens
agcctcttaaagctgcctgtagt

SEQ ID NO: 3709734 - DNA, 22 bp, Homo sapiens
agcctgaaatagtggttcttgg

SEQ ID NO: 3709735 - DNA, 23 bp, Homo sapiens
agcctgcagttattaacactaac

SEQ ID NO: 3709736 - DNA, 11 bp, Homo sapiens
agcctgcctgg

SEQ ID NO: 3709737 - DNA, 17 bp, Homo sapiens
agcctgcgtggctgacc

SEQ ID NO: 3709738 - DNA, 23 bp, Homo sapiens
agcctgcgtggctgacccccctc

SEQ ID NO: 3709739 - DNA, 16 bp, Homo sapiens
agcctgctccagctgt

SEQ ID NO: 3709740 - DNA, 19 bp, Homo sapiens
agcctgctccagctgttca

SEQ ID NO: 3709741 - DNA, 22 bp, Homo sapiens
agcctgctccagctgttcagct

SEQ ID NO: 3709742 - DNA, 23 bp, Homo sapiens
agcttccattccaagcctgacca

SEQ ID NO: 3709743 - DNA, 23 bp, Homo sapiens
agcttcctttgtttttttttcct

SEQ ID NO: 3709744 - DNA, 19 bp, Homo sapiens
agcttctcatcctgcaggc

SEQ ID NO: 3709745 - DNA, 12 bp, Homo sapiens
agcttctccaac

SEQ ID NO: 3709746 - DNA, 16 bp, Homo sapiens
agcttctctttaactc

SEQ ID NO: 3709747 - DNA, 19 bp, Homo sapiens
agcttctctttaactcagg

SEQ ID NO: 3709748 - DNA, 16 bp, Homo sapiens
agcttctgacctcagc

SEQ ID NO: 3709749 - DNA, 18 bp, Homo sapiens
agcttctgaggcgctgct

SEQ ID NO: 3709750 - DNA, 18 bp, Homo sapiens
agcttcttaaatgagaag

SEQ ID NO: 3709751 - DNA, 20 bp, Homo sapiens
agcttcttaatataactgcc

SEQ ID NO: 3709752 - DNA, 23 bp, Homo sapiens
agcttcttaatataactgcctta

SEQ ID NO: 3709753 - DNA, 18 bp, Homo sapiens
agcttgagggttgggctg

SEQ ID NO: 3709754 - DNA, 22 bp, Homo sapiens
agcttgagggttgggctggtgt

SEQ ID NO: 3709755 - DNA, 18 bp, Homo sapiens
agcttgataaagggccaa

SEQ ID NO: 3709756 - DNA, 14 bp, Homo sapiens
agcttggccagaag

SEQ ID NO: 3709757 - DNA, 14 bp, Homo sapiens
agcttgggaatgga

SEQ ID NO: 3709758 - DNA, 16 bp, Homo sapiens
agcttgttatttataa

SEQ ID NO: 3709759 - DNA, 20 bp, Homo sapiens
agctttaccctcaggcatag

SEQ ID NO: 3709760 - DNA, 15 bp, Homo sapiens
agctttactgtttgt

SEQ ID NO: 3709761 - DNA, 14 bp, Homo sapiens
agctttatgtaata

SEQ ID NO: 3709762 - DNA, 19 bp, Homo sapiens
agctttattttttaagtat

SEQ ID NO: 3709763 - DNA, 22 bp, Homo sapiens
agctttcctttttcccaataaa

SEQ ID NO: 3709764 - DNA, 15 bp, Homo sapiens
agctttctctgcttc

SEQ ID NO: 3709765 - DNA, 21 bp, Homo sapiens
agctttctctgcttcagcttg

SEQ ID NO: 3709766 - DNA, 16 bp, Homo sapiens
agctttgctaccaaag

SEQ ID NO: 3709767 - DNA, 18 bp, Homo sapiens
agctttgctctttggtag

SEQ ID NO: 3709768 - DNA, 21 bp, Homo sapiens
agctttgctctttggtagaaa

SEQ ID NO: 3709769 - DNA, 20 bp, Homo sapiens
agctttgcttctctctctaa

SEQ ID NO: 3709770 - DNA, 19 bp, Homo sapiens
agctttggacacacacagc

SEQ ID NO: 3709771 - DNA, 21 bp, Homo sapiens
agctttggacacacacagctt

SEQ ID NO: 3709772 - DNA, 23 bp, Homo sapiens
agctttggacacacacagcttct

SEQ ID NO: 3709773 - DNA, 14 bp, Homo sapiens
agctttggacgcac

SEQ ID NO: 3709774 - DNA, 21 bp, Homo sapiens
agctttggacgcacacagctt

SEQ ID NO: 3709775 - DNA, 19 bp, Homo sapiens
agctttgtttcaaccaagt

SEQ ID NO: 3709776 - DNA, 23 bp, Homo sapiens
agctttgtttgttgtcagctgaa

SEQ ID NO: 3709777 - DNA, 23 bp, Homo sapiens
agcttttagtacccacctgagct

SEQ ID NO: 3709778 - DNA, 16 bp, Homo sapiens
agcttttcccttcttt

SEQ ID NO: 3709779 - DNA, 17 bp, Homo sapiens
agctttttgtcttttct

SEQ ID NO: 3709780 - DNA, 15 bp, Homo sapiens
aggaaaaaaactttt

SEQ ID NO: 3709781 - DNA, 15 bp, Homo sapiens
aggaaaaaaatgact

SEQ ID NO: 3709782 - DNA, 20 bp, Homo sapiens
aggaaaaaggacaggcagaa

SEQ ID NO: 3709783 - DNA, 22 bp, Homo sapiens
aggaaaaccaagccgtggcttc

SEQ ID NO: 3709784 - DNA, 14 bp, Homo sapiens
aggaaaagctgctg

SEQ ID NO: 3709785 - DNA, 16 bp, Homo sapiens
aggaaaatagtttagg

SEQ ID NO: 3709786 - DNA, 12 bp, Homo sapiens
aggaaaattgga

SEQ ID NO: 3709787 - DNA, 11 bp, Homo sapiens
aggaaaccaag

SEQ ID NO: 3709788 - DNA, 17 bp, Homo sapiens
aggaaagaaagaaggaa

SEQ ID NO: 3709789 - DNA, 22 bp, Homo sapiens
aggaaagcaataaatgaatggg

SEQ ID NO: 3709790 - DNA, 16 bp, Homo sapiens
aggaaaggccagctgg

SEQ ID NO: 3709791 - DNA, 17 bp, Homo sapiens
aggaaaggccagctggc

SEQ ID NO: 3709792 - DNA, 18 bp, Homo sapiens
aggaaaggccagctggca

SEQ ID NO: 3709793 - DNA, 20 bp, Homo sapiens
aggaaataaaacctttcaaa

SEQ ID NO: 3709794 - DNA, 22 bp, Homo sapiens
aggaaataaaacctttcaaatt

SEQ ID NO: 3709795 - DNA, 15 bp, Homo sapiens
aggaacactctgaat

SEQ ID NO: 3709796 - DNA, 16 bp, Homo sapiens
aggaacatatgaaaat

SEQ ID NO: 3709797 - DNA, 19 bp, Homo sapiens
aggaacctggaccaaagct

SEQ ID NO: 3709798 - DNA, 16 bp, Homo sapiens
aggaagaaaaatcagt

SEQ ID NO: 3709799 - DNA, 12 bp, Homo sapiens
aggaagagcagg

SEQ ID NO: 3709800 - DNA, 18 bp, Homo sapiens
aggaagatcactttgctc

SEQ ID NO: 3709801 - DNA, 13 bp, Homo sapiens
aggaagcaacgaa

SEQ ID NO: 3709802 - DNA, 19 bp, Homo sapiens
aggaagcaacgaagggaaa

SEQ ID NO: 3709803 - DNA, 16 bp, Homo sapiens
aggaagccacagctgg

SEQ ID NO: 3709804 - DNA, 20 bp, Homo sapiens
aggaagccgtgccctgcccc

SEQ ID NO: 3709805 - DNA, 14 bp, Homo sapiens
aggaagctcagact

SEQ ID NO: 3709806 - DNA, 22 bp, Homo sapiens
aggaagctccagtcctgctctc

SEQ ID NO: 3709807 - DNA, 18 bp, Homo sapiens
aggaagctgtgagagcag

SEQ ID NO: 3709808 - DNA, 15 bp, Homo sapiens
aggaaggagagcctg

SEQ ID NO: 3709809 - DNA, 17 bp, Homo sapiens
aggaagggcaggaagga

SEQ ID NO: 3709810 - DNA, 14 bp, Homo sapiens
aggaaggtagaaat

SEQ ID NO: 3709811 - DNA, 18 bp, Homo sapiens
aggaagtctaggagctgg

SEQ ID NO: 3709812 - DNA, 17 bp, Homo sapiens
aggaagtgaaaataggt

SEQ ID NO: 3709813 - DNA, 16 bp, Homo sapiens
aggaagtgtaacagct

SEQ ID NO: 3709814 - DNA, 20 bp, Homo sapiens
aggaataaattgctccttga

SEQ ID NO: 3709815 - DNA, 19 bp, Homo sapiens
aggaatgaagataccatca

SEQ ID NO: 3709816 - DNA, 16 bp, Homo sapiens
aggaatgcctgtgtga

SEQ ID NO: 3709817 - DNA, 13 bp, Homo sapiens
aggaatgctaaca

SEQ ID NO: 3709818 - DNA, 22 bp, Homo sapiens
aggaatgctaacagttcacttg

SEQ ID NO: 3709819 - DNA, 16 bp, Homo sapiens
aggaatgcttggaata

SEQ ID NO: 3709820 - DNA, 24 bp, Homo sapiens
aggaatgcttggaatatctgctgt

SEQ ID NO: 3709821 - DNA, 20 bp, Homo sapiens
aggaatggaggctctaattg

SEQ ID NO: 3709822 - DNA, 22 bp, Homo sapiens
aggaattctaggcatcccaggg

SEQ ID NO: 3709823 - DNA, 17 bp, Homo sapiens
aggacaaagtctccagc

SEQ ID NO: 3709824 - DNA, 18 bp, Homo sapiens
aggacaaagtctccagcc

SEQ ID NO: 3709825 - DNA, 14 bp, Homo sapiens
aggacaggcaggtg

SEQ ID NO: 3709826 - DNA, 16 bp, Homo sapiens
aggacagtgcttcagc

SEQ ID NO: 3709827 - DNA, 19 bp, Homo sapiens
aggacagtgcttcagcctg

SEQ ID NO: 3709828 - DNA, 17 bp, Homo sapiens
aggaccaaaaaaataag

SEQ ID NO: 3709829 - DNA, 18 bp, Homo sapiens
aggaccaacaagggcagt

SEQ ID NO: 3709830 - DNA, 19 bp, Homo sapiens
aggaccaacaagggcagtg

SEQ ID NO: 3709831 - DNA, 16 bp, Homo sapiens
aggaccaggactccct

SEQ ID NO: 3709832 - DNA, 17 bp, Homo sapiens
aggaccaggactccctc

SEQ ID NO: 3709833 - DNA, 19 bp, Homo sapiens
aggaccaggactccctcct

SEQ ID NO: 3709834 - DNA, 23 bp, Homo sapiens
aggacccctcaccttgcaacaca

SEQ ID NO: 3709835 - DNA, 17 bp, Homo sapiens
aggacccggaggggcct

SEQ ID NO: 3709836 - DNA, 18 bp, Homo sapiens
aggacccggaggggcctg

SEQ ID NO: 3709837 - DNA, 22 bp, Homo sapiens
aggacccggaggggcctggcag

SEQ ID NO: 3709838 - DNA, 18 bp, Homo sapiens
aggaccctcgctggcccc

SEQ ID NO: 3709839 - DNA, 12 bp, Homo sapiens
aggacccttccc

SEQ ID NO: 3709840 - DNA, 22 bp, Homo sapiens
aggacctagggatgttctggcc

SEQ ID NO: 3709841 - DNA, 12 bp, Homo sapiens
aggacctctggg

SEQ ID NO: 3709842 - DNA, 15 bp, Homo sapiens
aggaccttatctgtg

SEQ ID NO: 3709843 - DNA, 16 bp, Homo sapiens
aggaccttatctgtgc

SEQ ID NO: 3709844 - DNA, 14 bp, Homo sapiens
aggacgtgggcggc

SEQ ID NO: 3709845 - DNA, 20 bp, Homo sapiens
aggacgtgggcggcagagag

SEQ ID NO: 3709846 - DNA, 12 bp, Homo sapiens
aggactccagcc

SEQ ID NO: 3709847 - DNA, 13 bp, Homo sapiens
aggactccctcct

SEQ ID NO: 3709848 - DNA, 17 bp, Homo sapiens
aggactccctcctcacc

SEQ ID NO: 3709849 - DNA, 15 bp, Homo sapiens
aggactctgcccaga

SEQ ID NO: 3709850 - DNA, 12 bp, Homo sapiens
aggactctgcct

SEQ ID NO: 3709851 - DNA, 17 bp, Homo sapiens
aggactctgcctcctct

SEQ ID NO: 3709852 - DNA, 18 bp, Homo sapiens
aggactctgcctcctctt

SEQ ID NO: 3709853 - DNA, 19 bp, Homo sapiens
aggactctgcctcctcttc

SEQ ID NO: 3709854 - DNA, 12 bp, Homo sapiens
aggactgcacca

SEQ ID NO: 3709855 - DNA, 14 bp, Homo sapiens
aggctgggcttcag

SEQ ID NO: 3709856 - DNA, 20 bp, Homo sapiens
aggctgggcttcagtggcag

SEQ ID NO: 3709857 - DNA, 21 bp, Homo sapiens
aggctgggcttcagtggcagc

SEQ ID NO: 3709858 - DNA, 23 bp, Homo sapiens
aggctgggcttcagtggcagctg

SEQ ID NO: 3709859 - DNA, 17 bp, Homo sapiens
aggctgggggaagaagc

SEQ ID NO: 3709860 - DNA, 11 bp, Homo sapiens
aggctgggtgc

SEQ ID NO: 3709861 - DNA, 15 bp, Homo sapiens
aggctgggtgcccac

SEQ ID NO: 3709862 - DNA, 21 bp, Homo sapiens
aggctgtatcccatgagcctc

SEQ ID NO: 3709863 - DNA, 19 bp, Homo sapiens
aggctgtccttacccatct

SEQ ID NO: 3709864 - DNA, 21 bp, Homo sapiens
aggctgtcttctcaggctctg

SEQ ID NO: 3709865 - DNA, 22 bp, Homo sapiens
aggctgtcttctcaggctctgc

SEQ ID NO: 3709866 - DNA, 18 bp, Homo sapiens
aggctgtgggcctcaagg

SEQ ID NO: 3709867 - DNA, 16 bp, Homo sapiens
aggctgtttttgggtg

SEQ ID NO: 3709868 - DNA, 18 bp, Homo sapiens
aggcttcaatttattgca

SEQ ID NO: 3709869 - DNA, 20 bp, Homo sapiens
aggcttcagcatatttatag

SEQ ID NO: 3709870 - DNA, 22 bp, Homo sapiens
aggcttcttcagatcagtgctt

SEQ ID NO: 3709871 - DNA, 16 bp, Homo sapiens
aggcttgcctgcaggc

SEQ ID NO: 3709872 - DNA, 17 bp, Homo sapiens
aggcttgcctgcaggca

SEQ ID NO: 3709873 - DNA, 19 bp, Homo sapiens
aggctttacttagcttatc

SEQ ID NO: 3709874 - DNA, 14 bp, Homo sapiens
aggctttcagggcc

SEQ ID NO: 3709875 - DNA, 16 bp, Homo sapiens
agggaaactattgtcc

SEQ ID NO: 3709876 - DNA, 13 bp, Homo sapiens
agggaacagacag

SEQ ID NO: 3709877 - DNA, 21 bp, Homo sapiens
agggaacagacaggagaaatg

SEQ ID NO: 3709878 - DNA, 14 bp, Homo sapiens
agggaagagaaaca

SEQ ID NO: 3709879 - DNA, 15 bp, Homo sapiens
agggaagagaaacag

SEQ ID NO: 3709880 - DNA, 14 bp, Homo sapiens
agggaagagtgcat

SEQ ID NO: 3709881 - DNA, 18 bp, Homo sapiens
agggaagcccagctccag

SEQ ID NO: 3709882 - DNA, 24 bp, Homo sapiens
agggaagcccagctccagggccag

SEQ ID NO: 3709883 - DNA, 16 bp, Homo sapiens
agggaagcctgaaaaa

SEQ ID NO: 3709884 - DNA, 13 bp, Homo sapiens
agggaagctggcc

SEQ ID NO: 3709885 - DNA, 13 bp, Homo sapiens
agggaagttttgt

SEQ ID NO: 3709886 - DNA, 14 bp, Homo sapiens
agggaattctcttg

SEQ ID NO: 3709887 - DNA, 21 bp, Homo sapiens
agggacagcccactgagaagt

SEQ ID NO: 3709888 - DNA, 13 bp, Homo sapiens
agggacatattca

SEQ ID NO: 3709889 - DNA, 15 bp, Homo sapiens
agggacatattcatt

SEQ ID NO: 3709890 - DNA, 16 bp, Homo sapiens
agggaccaactgggcc

SEQ ID NO: 3709891 - DNA, 19 bp, Homo sapiens
agggaccaactgggcccaa

SEQ ID NO: 3709892 - DNA, 18 bp, Homo sapiens
agggaccaaggacccctc

SEQ ID NO: 3709893 - DNA, 15 bp, Homo sapiens
agggaccagccaaga

SEQ ID NO: 3709894 - DNA, 15 bp, Homo sapiens
agggacccctgccct

SEQ ID NO: 3709895 - DNA, 15 bp, Homo sapiens
agggacttggaagct

SEQ ID NO: 3709896 - DNA, 18 bp, Homo sapiens
agggagaagggatggagg

SEQ ID NO: 3709897 - DNA, 15 bp, Homo sapiens
agggagcaagacaga

SEQ ID NO: 3709898 - DNA, 17 bp, Homo sapiens
agggagcgtagaatctg

SEQ ID NO: 3709899 - DNA, 13 bp, Homo sapiens
agggagctgggac

SEQ ID NO: 3709900 - DNA, 21 bp, Homo sapiens
agggaggaatcgaggaaccag

SEQ ID NO: 3709901 - DNA, 23 bp, Homo sapiens
agggaggcctttagcttaagagg

SEQ ID NO: 3709902 - DNA, 23 bp, Homo sapiens
agggagtccgaaagggacttgga

SEQ ID NO: 3709903 - DNA, 20 bp, Homo sapiens
agggagtgacagaggcagcc

SEQ ID NO: 3709904 - DNA, 16 bp, Homo sapiens
agggatacccagtgat

SEQ ID NO: 3709905 - DNA, 20 bp, Homo sapiens
agggatattttttagtttgt

SEQ ID NO: 3709906 - DNA, 22 bp, Homo sapiens
agggatcacagggccccagaag

SEQ ID NO: 3709907 - DNA, 15 bp, Homo sapiens
agggatggaaaagga

SEQ ID NO: 3709908 - DNA, 16 bp, Homo sapiens
agggattcaggctgct

SEQ ID NO: 3709909 - DNA, 18 bp, Homo sapiens
agggattcaggctgcttg

SEQ ID NO: 3709910 - DNA, 20 bp, Homo sapiens
agggcacaccgggcactcag

SEQ ID NO: 3709911 - DNA, 20 bp, Homo sapiens
agggcaccaagcccacaggt

SEQ ID NO: 3709912 - DNA, 15 bp, Homo sapiens
agggcagagccggga

SEQ ID NO: 3709913 - DNA, 14 bp, Homo sapiens
agggcagaggctgg

SEQ ID NO: 3709914 - DNA, 15 bp, Homo sapiens
agggcagaggctgga

SEQ ID NO: 3709915 - DNA, 17 bp, Homo sapiens
agggcagaggctggagg

SEQ ID NO: 3709916 - DNA, 22 bp, Homo sapiens
agggcagaggctggaggcaggg

SEQ ID NO: 3709917 - DNA, 15 bp, Homo sapiens
agggcagcctgcctg

SEQ ID NO: 3709918 - DNA, 18 bp, Homo sapiens
agggcaggaaggagagcc

SEQ ID NO: 3709919 - DNA, 15 bp, Homo sapiens
agggcagggctctga

SEQ ID NO: 3709920 - DNA, 16 bp, Homo sapiens
agggcagggctctgat

SEQ ID NO: 3709921 - DNA, 16 bp, Homo sapiens
agggcatctcctgtgc

SEQ ID NO: 3709922 - DNA, 16 bp, Homo sapiens
agggccaagtcccacc

SEQ ID NO: 3709923 - DNA, 16 bp, Homo sapiens
agggccacgtgccagg

SEQ ID NO: 3709924 - DNA, 18 bp, Homo sapiens
agggccacgtgccaggcc

SEQ ID NO: 3709925 - DNA, 14 bp, Homo sapiens
agggccactctgcc

SEQ ID NO: 3709926 - DNA, 18 bp, Homo sapiens
agggccactctgcctctg

SEQ ID NO: 3709927 - DNA, 16 bp, Homo sapiens
agggccagatctgtta

SEQ ID NO: 3709928 - DNA, 12 bp, Homo sapiens
agggccagggcc

SEQ ID NO: 3709929 - DNA, 15 bp, Homo sapiens
agggccagggccctg

SEQ ID NO: 3709930 - DNA, 22 bp, Homo sapiens
agggccagggccctgcagaggg

SEQ ID NO: 3709931 - DNA, 21 bp, Homo sapiens
agggccagtcctgcctggcca

SEQ ID NO: 3709932 - DNA, 22 bp, Homo sapiens
agggccagtcctgcctggccag

SEQ ID NO: 3709933 - DNA, 12 bp, Homo sapiens
agggcccagaga

SEQ ID NO: 3709934 - DNA, 18 bp, Homo sapiens
agggccccagaaggcagg

SEQ ID NO: 3709935 - DNA, 18 bp, Homo sapiens
agggccccagcactaaag

SEQ ID NO: 3709936 - DNA, 18 bp, Homo sapiens
agggccctaggtttgctc

SEQ ID NO: 3709937 - DNA, 14 bp, Homo sapiens
agggcctcactctg

SEQ ID NO: 3709938 - DNA, 23 bp, Homo sapiens
agggcctcactctgttgctcagg

SEQ ID NO: 3709939 - DNA, 17 bp, Homo sapiens
agggccttaaaagccat

SEQ ID NO: 3709940 - DNA, 17 bp, Homo sapiens
agggccttgcccagaga

SEQ ID NO: 3709941 - DNA, 19 bp, Homo sapiens
agggccttgcccagagatg

SEQ ID NO: 3709942 - DNA, 20 bp, Homo sapiens
agggcgaacgacaatagctt

SEQ ID NO: 3709943 - DNA, 19 bp, Homo sapiens
agggcgagactctgtctca

SEQ ID NO: 3709944 - DNA, 19 bp, Homo sapiens
agggcgggaggatgttctg

SEQ ID NO: 3709945 - DNA, 16 bp, Homo sapiens
agggcgtgactcaccc

SEQ ID NO: 3709946 - DNA, 19 bp, Homo sapiens
agggctaccctcccccagg

SEQ ID NO: 3709947 - DNA, 14 bp, Homo sapiens
agggctcagcctgg

SEQ ID NO: 3709948 - DNA, 17 bp, Homo sapiens
agggctctgatattcca

SEQ ID NO: 3709949 - DNA, 20 bp, Homo sapiens
agggctgacacgtccacccc

SEQ ID NO: 3709950 - DNA, 21 bp, Homo sapiens
agggctgacacgtccacccca

SEQ ID NO: 3709951 - DNA, 13 bp, Homo sapiens
agggctgccacca

SEQ ID NO: 3709952 - DNA, 11 bp, Homo sapiens
agggctgggtg

SEQ ID NO: 3709953 - DNA, 12 bp, Homo sapiens
agggctgggtgt

SEQ ID NO: 3709954 - DNA, 23 bp, Homo sapiens
agggcttctgccatttctgagat

SEQ ID NO: 3709955 - DNA, 21 bp, Homo sapiens
aggggaaaccagtgtagcctt

SEQ ID NO: 3709956 - DNA, 23 bp, Homo sapiens
aggggaaaccagtgtagccttgc

SEQ ID NO: 3709957 - DNA, 17 bp, Homo sapiens
aggggaagcactcgtgt

SEQ ID NO: 3709958 - DNA, 19 bp, Homo sapiens
aggggaatattttattcaa

SEQ ID NO: 3709959 - DNA, 23 bp, Homo sapiens
aggggaatattttattcaaggta

SEQ ID NO: 3709960 - DNA, 13 bp, Homo sapiens
aggggaatgtttg

SEQ ID NO: 3709961 - DNA, 14 bp, Homo sapiens
aggggacgctggta

SEQ ID NO: 3709962 - DNA, 23 bp, Homo sapiens
aggggacgctggtagagatggag

SEQ ID NO: 3709963 - DNA, 17 bp, Homo sapiens
aggggactcagccctga

SEQ ID NO: 3709964 - DNA, 23 bp, Homo sapiens
aggggagcaaaatcgatgcagtg

SEQ ID NO: 3709965 - DNA, 16 bp, Homo sapiens
aggggagctctgtctg

SEQ ID NO: 3709966 - DNA, 17 bp, Homo sapiens
aggggagctctgtctgt

SEQ ID NO: 3709967 - DNA, 19 bp, Homo sapiens
aggggagggtggcaggtga

SEQ ID NO: 3709968 - DNA, 13 bp, Homo sapiens
agtagctgggact

SEQ ID NO: 3709969 - DNA, 21 bp, Homo sapiens
agtagctgggactacaggcac

SEQ ID NO: 3709970 - DNA, 14 bp, Homo sapiens
agtagctttccaca

SEQ ID NO: 3709971 - DNA, 13 bp, Homo sapiens
agtagtcatttca

SEQ ID NO: 3709972 - DNA, 15 bp, Homo sapiens
agtagtgagaagaat

SEQ ID NO: 3709973 - DNA, 18 bp, Homo sapiens
agtagtgagaagaatatt

SEQ ID NO: 3709974 - DNA, 12 bp, Homo sapiens
agtatacaagat

SEQ ID NO: 3709975 - DNA, 14 bp, Homo sapiens
agtatacaagataa

SEQ ID NO: 3709976 - DNA, 18 bp, Homo sapiens
agtatacaagataagctt

SEQ ID NO: 3709977 - DNA, 14 bp, Homo sapiens
agtatattaaaaat

SEQ ID NO: 3709978 - DNA, 14 bp, Homo sapiens
agtatatttatagt

SEQ ID NO: 3709979 - DNA, 19 bp, Homo sapiens
agtatatttatataattat

SEQ ID NO: 3709980 - DNA, 14 bp, Homo sapiens
agtatccactttgc

SEQ ID NO: 3709981 - DNA, 23 bp, Homo sapiens
agtatctgagaccccaaactctc

SEQ ID NO: 3709982 - DNA, 16 bp, Homo sapiens
agtatgaataaagaca

SEQ ID NO: 3709983 - DNA, 19 bp, Homo sapiens
agtattccattgtgtgagt

SEQ ID NO: 3709984 - DNA, 22 bp, Homo sapiens
agtattctgcctttgcagaaac

SEQ ID NO: 3709985 - DNA, 16 bp, Homo sapiens
agtatttatatattta

SEQ ID NO: 3709986 - DNA, 17 bp, Homo sapiens
agtatttatatatttat

SEQ ID NO: 3709987 - DNA, 19 bp, Homo sapiens
agtatttatatatttataa

SEQ ID NO: 3709988 - DNA, 19 bp, Homo sapiens
agtcaaaacacttgtaatt

SEQ ID NO: 3709989 - DNA, 14 bp, Homo sapiens
agtcaaaacagaga

SEQ ID NO: 3709990 - DNA, 21 bp, Homo sapiens
agtcaaaacagagatgtgata

SEQ ID NO: 3709991 - DNA, 16 bp, Homo sapiens
agtcaaaaggtgcctg

SEQ ID NO: 3709992 - DNA, 21 bp, Homo sapiens
agtcaaaaggtgcctgtgagg

SEQ ID NO: 3709993 - DNA, 18 bp, Homo sapiens
agtcaaacatttcaaagt

SEQ ID NO: 3709994 - DNA, 16 bp, Homo sapiens
agtcaaggagtggctt

SEQ ID NO: 3709995 - DNA, 14 bp, Homo sapiens
agtcacaaaggaat

SEQ ID NO: 3709996 - DNA, 15 bp, Homo sapiens
agtcacaaaggaatg

SEQ ID NO: 3709997 - DNA, 16 bp, Homo sapiens
agtcacaagagcccag

SEQ ID NO: 3709998 - DNA, 13 bp, Homo sapiens
agtcaccaagccc

SEQ ID NO: 3709999 - DNA, 17 bp, Homo sapiens
agtcacccatgaagaca

SEQ ID NO: 3710000 - DNA, 20 bp, Homo sapiens
agtcacccatgaagacagga

SEQ ID NO: 3710001 - DNA, 13 bp, Homo sapiens
agtcaccttttaa

SEQ ID NO: 3710002 - DNA, 14 bp, Homo sapiens
agtcactgcctctc

SEQ ID NO: 3710003 - DNA, 20 bp, Homo sapiens
agtcactgcctctccctggc

SEQ ID NO: 3710004 - DNA, 14 bp, Homo sapiens
agtcagagagaatc

SEQ ID NO: 3710005 - DNA, 14 bp, Homo sapiens
agtcagatgcccag

SEQ ID NO: 3710006 - DNA, 14 bp, Homo sapiens
agtcagcagaactg

SEQ ID NO: 3710007 - DNA, 23 bp, Homo sapiens
agtcagccttccccctcccaggg

SEQ ID NO: 3710008 - DNA, 14 bp, Homo sapiens
agtcaggtccaatt

SEQ ID NO: 3710009 - DNA, 16 bp, Homo sapiens
agtcagttgaaattct

SEQ ID NO: 3710010 - DNA, 14 bp, Homo sapiens
agtcagtttgcagt

SEQ ID NO: 3710011 - DNA, 15 bp, Homo sapiens
agtcatctcaaccat

SEQ ID NO: 3710012 - DNA, 20 bp, Homo sapiens
agtcatcttgaccaagcagg

SEQ ID NO: 3710013 - DNA, 21 bp, Homo sapiens
agtcatcttgaccaagcagga

SEQ ID NO: 3710014 - DNA, 14 bp, Homo sapiens
agtcatgaagccca

SEQ ID NO: 3710015 - DNA, 21 bp, Homo sapiens
agtcatgaagcccaagtgaaa

SEQ ID NO: 3710016 - DNA, 16 bp, Homo sapiens
agtcatgatctccctg

SEQ ID NO: 3710017 - DNA, 23 bp, Homo sapiens
agtcatgatctccctgccgcctc

SEQ ID NO: 3710018 - DNA, 19 bp, Homo sapiens
agtccaaatgtcctccaga

SEQ ID NO: 3710019 - DNA, 23 bp, Homo sapiens
agtccaaatgtcctccagaagcc

SEQ ID NO: 3710020 - DNA, 12 bp, Homo sapiens
agtccaggcccc

SEQ ID NO: 3710021 - DNA, 23 bp, Homo sapiens
agtccaggccccaaaaccacagc

SEQ ID NO: 3710022 - DNA, 17 bp, Homo sapiens
agtccaggtcgggctca

SEQ ID NO: 3710023 - DNA, 15 bp, Homo sapiens
agtccagtctcttct

SEQ ID NO: 3710024 - DNA, 23 bp, Homo sapiens
agtccatatttcaatttccaaga

SEQ ID NO: 3710025 - DNA, 19 bp, Homo sapiens
agtcccaccttggctgcag

SEQ ID NO: 3710026 - DNA, 21 bp, Homo sapiens
agtcccaccttggctgcaggg

SEQ ID NO: 3710027 - DNA, 22 bp, Homo sapiens
agtcccagctactcagaagcct

SEQ ID NO: 3710028 - DNA, 21 bp, Homo sapiens
agtccctgactctctgtgacc

SEQ ID NO: 3710029 - DNA, 21 bp, Homo sapiens
agtccctgggggaagccctgg

SEQ ID NO: 3710030 - DNA, 14 bp, Homo sapiens
agtcccttcccctc

SEQ ID NO: 3710031 - DNA, 15 bp, Homo sapiens
agtcccttcccctcc

SEQ ID NO: 3710032 - DNA, 22 bp, Homo sapiens
agtcccttcccctccctggctc

SEQ ID NO: 3710033 - DNA, 17 bp, Homo sapiens
agtcctcactcccagtc

SEQ ID NO: 3710034 - DNA, 18 bp, Homo sapiens
agtcctcactcccagtcc

SEQ ID NO: 3710035 - DNA, 17 bp, Homo sapiens
agtcctcgtagccatct

SEQ ID NO: 3710036 - DNA, 21 bp, Homo sapiens
agtcctcgtagccatctctct

SEQ ID NO: 3710037 - DNA, 14 bp, Homo sapiens
agtcctcttttctg

SEQ ID NO: 3710038 - DNA, 16 bp, Homo sapiens
agtcctgcctcagcct

SEQ ID NO: 3710039 - DNA, 20 bp, Homo sapiens
agtcctgctctctacccagc

SEQ ID NO: 3710040 - DNA, 18 bp, Homo sapiens
agtcctggctacatccca

SEQ ID NO: 3710041 - DNA, 22 bp, Homo sapiens
agtcctggctacatcccagcct

SEQ ID NO: 3710042 - DNA, 22 bp, Homo sapiens
agtcctgggagaacctcaggct

SEQ ID NO: 3710043 - DNA, 19 bp, Homo sapiens
agtcgcatctcagtgcagg

SEQ ID NO: 3710044 - DNA, 16 bp, Homo sapiens
agtcgctgaggaaaaa

SEQ ID NO: 3710045 - DNA, 20 bp, Homo sapiens
agtcggaacggagaaaggtg

SEQ ID NO: 3710046 - DNA, 17 bp, Homo sapiens
agtctaaatatttcctt

SEQ ID NO: 3710047 - DNA, 14 bp, Homo sapiens
agtctaaccaaatg

SEQ ID NO: 3710048 - DNA, 17 bp, Homo sapiens
agtctaaccaaatgcat

SEQ ID NO: 3710049 - DNA, 17 bp, Homo sapiens
agtctacgctctccttt

SEQ ID NO: 3710050 - DNA, 20 bp, Homo sapiens
agtctacgctctcctttctt

SEQ ID NO: 3710051 - DNA, 20 bp, Homo sapiens
agtctaggagctgggaggaa

SEQ ID NO: 3710052 - DNA, 22 bp, Homo sapiens
agtctagttcctgatgacccag

SEQ ID NO: 3710053 - DNA, 23 bp, Homo sapiens
agtctcactgttgcccaggctgg

SEQ ID NO: 3710054 - DNA, 17 bp, Homo sapiens
agtctcaggagcatggg

SEQ ID NO: 3710055 - DNA, 13 bp, Homo sapiens
agtctcccaggcc

SEQ ID NO: 3710056 - DNA, 16 bp, Homo sapiens
agtctctaggttctga

SEQ ID NO: 3710057 - DNA, 21 bp, Homo sapiens
agtctctatttaaattctttt

SEQ ID NO: 3710058 - DNA, 14 bp, Homo sapiens
agtctcttctccac

SEQ ID NO: 3710059 - DNA, 16 bp, Homo sapiens
agtctcttctccactg

SEQ ID NO: 3710060 - DNA, 14 bp, Homo sapiens
agtctgaagcagat

SEQ ID NO: 3710061 - DNA, 21 bp, Homo sapiens
agtctgaagcagatgcaaaga

SEQ ID NO: 3710062 - DNA, 22 bp, Homo sapiens
agtctgattcccaagctctgct

SEQ ID NO: 3710063 - DNA, 16 bp, Homo sapiens
agtctgctgccctcca

SEQ ID NO: 3710064 - DNA, 17 bp, Homo sapiens
agtctggatctgggacc

SEQ ID NO: 3710065 - DNA, 18 bp, Homo sapiens
agtctggcccttcctttt

SEQ ID NO: 3710066 - DNA, 21 bp, Homo sapiens
agtctgtgcctggagctcctg

SEQ ID NO: 3710067 - DNA, 23 bp, Homo sapiens
agtctgtgcctggagctcctggg

SEQ ID NO: 3710068 - DNA, 11 bp, Homo sapiens
agtctgtgtgc

SEQ ID NO: 3710069 - DNA, 22 bp, Homo sapiens
agtctgtgtgggactgtacaca

SEQ ID NO: 3710070 - DNA, 17 bp, Homo sapiens
agtcttaacttctcccc

SEQ ID NO: 3710071 - DNA, 13 bp, Homo sapiens
agtcttagatgta

SEQ ID NO: 3710072 - DNA, 20 bp, Homo sapiens
agtcttcaagggctgcttca

SEQ ID NO: 3710073 - DNA, 15 bp, Homo sapiens
agtcttccacctgga

SEQ ID NO: 3710074 - DNA, 19 bp, Homo sapiens
agtcttccctagggctggg

SEQ ID NO: 3710075 - DNA, 20 bp, Homo sapiens
agtcttccctagggctgggt

SEQ ID NO: 3710076 - DNA, 22 bp, Homo sapiens
agtcttccctagggctgggtgt

SEQ ID NO: 3710077 - DNA, 13 bp, Homo sapiens
agtcttctcatag

SEQ ID NO: 3710078 - DNA, 21 bp, Homo sapiens
agtcttctcatagcattaact

SEQ ID NO: 3710079 - DNA, 20 bp, Homo sapiens
agtcttgctgtggtctcttt

SEQ ID NO: 3710080 - DNA, 22 bp, Homo sapiens
agtctttgtaagtaaactgccc

SEQ ID NO: 3710081 - DNA, 14 bp, Homo sapiens
agttgtatctcttt

SEQ ID NO: 3710082 - DNA, 19 bp, Homo sapiens
agttgtcccgattgtaact

SEQ ID NO: 3710083 - DNA, 19 bp, Homo sapiens
agttgtggaaagcctctgc

SEQ ID NO: 3710084 - DNA, 20 bp, Homo sapiens
agttgtggaaagcctctgct

SEQ ID NO: 3710085 - DNA, 20 bp, Homo sapiens
agttgtggagagtgcaacag

SEQ ID NO: 3710086 - DNA, 21 bp, Homo sapiens
agttgtgtactctggcctctg

SEQ ID NO: 3710087 - DNA, 13 bp, Homo sapiens
agttgttattaca

SEQ ID NO: 3710088 - DNA, 16 bp, Homo sapiens
agttgtttctgaccca

SEQ ID NO: 3710089 - DNA, 20 bp, Homo sapiens
agttgtttctgacccactga

SEQ ID NO: 3710090 - DNA, 13 bp, Homo sapiens
agtttaaaatgta

SEQ ID NO: 3710091 - DNA, 18 bp, Homo sapiens
agtttaccatttgtaata

SEQ ID NO: 3710092 - DNA, 22 bp, Homo sapiens
agtttaccatttgtaataaagt

SEQ ID NO: 3710093 - DNA, 14 bp, Homo sapiens
agtttactatttta

SEQ ID NO: 3710094 - DNA, 14 bp, Homo sapiens
agtttagaggaaaa

SEQ ID NO: 3710095 - DNA, 19 bp, Homo sapiens
agtttagaggaaaaaaatg

SEQ ID NO: 3710096 - DNA, 21 bp, Homo sapiens
agtttagaggaaaaaaatgac

SEQ ID NO: 3710097 - DNA, 15 bp, Homo sapiens
agtttatacagtaca

SEQ ID NO: 3710098 - DNA, 17 bp, Homo sapiens
agtttcaattcagtgct

SEQ ID NO: 3710099 - DNA, 12 bp, Homo sapiens
agtttcagagaa

SEQ ID NO: 3710100 - DNA, 18 bp, Homo sapiens
agtttcagagaagttctg

SEQ ID NO: 3710101 - DNA, 21 bp, Homo sapiens
agtttcatttatgatacaaaa

SEQ ID NO: 3710102 - DNA, 23 bp, Homo sapiens
agtttccccaccagtgaatgaaa

SEQ ID NO: 3710103 - DNA, 23 bp, Homo sapiens
agtttccgtttccaggtgtttat

SEQ ID NO: 3710104 - DNA, 13 bp, Homo sapiens
agtttcctcaggc

SEQ ID NO: 3710105 - DNA, 13 bp, Homo sapiens
agtttctcagctc

SEQ ID NO: 3710106 - DNA, 16 bp, Homo sapiens
agtttctcagctccca

SEQ ID NO: 3710107 - DNA, 17 bp, Homo sapiens
agtttctgggacctcag

SEQ ID NO: 3710108 - DNA, 13 bp, Homo sapiens
agtttctttggga

SEQ ID NO: 3710109 - DNA, 20 bp, Homo sapiens
agtttgcactgtatgctgga

SEQ ID NO: 3710110 - DNA, 20 bp, Homo sapiens
agtttgcagaaaagcacctg

SEQ ID NO: 3710111 - DNA, 23 bp, Homo sapiens
agtttgcagaaaagcacctgccg

SEQ ID NO: 3710112 - DNA, 16 bp, Homo sapiens
agtttggtttctagca

SEQ ID NO: 3710113 - DNA, 14 bp, Homo sapiens
agtttgtcagactt

SEQ ID NO: 3710114 - DNA, 16 bp, Homo sapiens
agttttaatccagaat

SEQ ID NO: 3710115 - DNA, 15 bp, Homo sapiens
agttttagttgcaga

SEQ ID NO: 3710116 - DNA, 21 bp, Homo sapiens
agttttagttgcagaaacatt

SEQ ID NO: 3710117 - DNA, 15 bp, Homo sapiens
agttttatcattttc

SEQ ID NO: 3710118 - DNA, 17 bp, Homo sapiens
agttttcagaacctctt

SEQ ID NO: 3710119 - DNA, 18 bp, Homo sapiens
agttttcagaacctcttc

SEQ ID NO: 3710120 - DNA, 21 bp, Homo sapiens
agttttccatggtcacagaga

SEQ ID NO: 3710121 - DNA, 16 bp, Homo sapiens
agttttcctaaatgta

SEQ ID NO: 3710122 - DNA, 19 bp, Homo sapiens
agtttttaatcgtacattt

SEQ ID NO: 3710123 - DNA, 17 bp, Homo sapiens
agtttttacctaccaca

SEQ ID NO: 3710124 - DNA, 23 bp, Homo sapiens
agtttttacctaccacagtgtct

SEQ ID NO: 3710125 - DNA, 15 bp, Homo sapiens
ataaaaaaaatgaaa

SEQ ID NO: 3710126 - DNA, 15 bp, Homo sapiens
ataaaaaagtctcta

SEQ ID NO: 3710127 - DNA, 17 bp, Homo sapiens
ataaaaaccaagaagat

SEQ ID NO: 3710128 - DNA, 11 bp, Homo sapiens
ataaaaaggca

SEQ ID NO: 3710129 - DNA, 12 bp, Homo sapiens
ataaaaaggcac

SEQ ID NO: 3710130 - DNA, 22 bp, Homo sapiens
ataaaaataaatttggttctaa

SEQ ID NO: 3710131 - DNA, 16 bp, Homo sapiens
ataaaacaggtcaata

SEQ ID NO: 3710132 - DNA, 18 bp, Homo sapiens
ataaaacaggtcaataca

SEQ ID NO: 3710133 - DNA, 18 bp, Homo sapiens
ataaaacattttcacaca

SEQ ID NO: 3710134 - DNA, 15 bp, Homo sapiens
ataaaagatacattt

SEQ ID NO: 3710135 - DNA, 16 bp, Homo sapiens
ataaaagcagcatctg

SEQ ID NO: 3710136 - DNA, 20 bp, Homo sapiens
ataaaagcagcatctgctaa

SEQ ID NO: 3710137 - DNA, 17 bp, Homo sapiens
ataaaagtgatcaataa

SEQ ID NO: 3710138 - DNA, 13 bp, Homo sapiens
ataaaataaagta

SEQ ID NO: 3710139 - DNA, 15 bp, Homo sapiens
ataaaatataattgt

SEQ ID NO: 3710140 - DNA, 18 bp, Homo sapiens
ataaaatatcattcagca

SEQ ID NO: 3710141 - DNA, 21 bp, Homo sapiens
ataaaatggtgttttcatgta

SEQ ID NO: 3710142 - DNA, 21 bp, Homo sapiens
ataaaattaaagaaaataaaa

SEQ ID NO: 3710143 - DNA, 14 bp, Homo sapiens
ataaacacatagat

SEQ ID NO: 3710144 - DNA, 22 bp, Homo sapiens
ataaacagcttcatgcctttgt

SEQ ID NO: 3710145 - DNA, 21 bp, Homo sapiens
ataaacatccttcaagaactc

SEQ ID NO: 3710146 - DNA, 20 bp, Homo sapiens
ataaacgtgatgatcagctg

SEQ ID NO: 3710147 - DNA, 17 bp, Homo sapiens
ataaactgtcctctttc

SEQ ID NO: 3710148 - DNA, 16 bp, Homo sapiens
ataaactgtgtttact

SEQ ID NO: 3710149 - DNA, 14 bp, Homo sapiens
ataaacttttagaa

SEQ ID NO: 3710150 - DNA, 15 bp, Homo sapiens
ataaacttttagaaa

SEQ ID NO: 3710151 - DNA, 18 bp, Homo sapiens
ataaacttttagaaactt

SEQ ID NO: 3710152 - DNA, 15 bp, Homo sapiens
ataaagaacaaggta

SEQ ID NO: 3710153 - DNA, 20 bp, Homo sapiens
ataaagagaaaattgaattt

SEQ ID NO: 3710154 - DNA, 20 bp, Homo sapiens
ataaagatttcttgagtttt

SEQ ID NO: 3710155 - DNA, 14 bp, Homo sapiens
ataaagcctgcttt

SEQ ID NO: 3710156 - DNA, 14 bp, Homo sapiens
ataaaggataaact

SEQ ID NO: 3710157 - DNA, 16 bp, Homo sapiens
ataaaggttattttct

SEQ ID NO: 3710158 - DNA, 19 bp, Homo sapiens
ataaaggttattttctcct

SEQ ID NO: 3710159 - DNA, 16 bp, Homo sapiens
ataaaggttgacaata

SEQ ID NO: 3710160 - DNA, 21 bp, Homo sapiens
ataaaggttgacaataaatgt

SEQ ID NO: 3710161 - DNA, 16 bp, Homo sapiens
ataaagtattccacct

SEQ ID NO: 3710162 - DNA, 23 bp, Homo sapiens
ataaagtattccaccttaaatta

SEQ ID NO: 3710163 - DNA, 21 bp, Homo sapiens
ataaagttctgagtgttttta

SEQ ID NO: 3710164 - DNA, 18 bp, Homo sapiens
ataaagttggtgacagat

SEQ ID NO: 3710165 - DNA, 17 bp, Homo sapiens
ataaataaaaatggata

SEQ ID NO: 3710166 - DNA, 13 bp, Homo sapiens
ataaataaaacat

SEQ ID NO: 3710167 - DNA, 20 bp, Homo sapiens
ataaatatttatgtagatgt

SEQ ID NO: 3710168 - DNA, 16 bp, Homo sapiens
ataaatgaagtttata

SEQ ID NO: 3710169 - DNA, 21 bp, Homo sapiens
ataaatgaagtttatacagta

SEQ ID NO: 3710170 - DNA, 18 bp, Homo sapiens
ataaatgcaatatgtatt

SEQ ID NO: 3710171 - DNA, 17 bp, Homo sapiens
ataaatgtatcatagaa

SEQ ID NO: 3710172 - DNA, 18 bp, Homo sapiens
ataaatgtatcttattca

SEQ ID NO: 3710173 - DNA, 11 bp, Homo sapiens
ataaattattt

SEQ ID NO: 3710174 - DNA, 13 bp, Homo sapiens
ataaattgaaata

SEQ ID NO: 3710175 - DNA, 14 bp, Homo sapiens
ataaattgaaatat

SEQ ID NO: 3710176 - DNA, 22 bp, Homo sapiens
ataaattgaaatataatgcaaa

SEQ ID NO: 3710177 - DNA, 21 bp, Homo sapiens
ataacaaaatcacttccatag

SEQ ID NO: 3710178 - DNA, 14 bp, Homo sapiens
ataacaagatcttt

SEQ ID NO: 3710179 - DNA, 14 bp, Homo sapiens
ataacacaatatga

SEQ ID NO: 3710180 - DNA, 23 bp, Homo sapiens
ataacactataaaggttgacaat

SEQ ID NO: 3710181 - DNA, 20 bp, Homo sapiens
ataacagctaccatgacaac

SEQ ID NO: 3710182 - DNA, 16 bp, Homo sapiens
ataacagggtaaatta

SEQ ID NO: 3710183 - DNA, 20 bp, Homo sapiens
ataacagggtaaattattca

SEQ ID NO: 3710184 - DNA, 22 bp, Homo sapiens
ataacagggtaaattattcagt

SEQ ID NO: 3710185 - DNA, 15 bp, Homo sapiens
ataaccaatgtttaa

SEQ ID NO: 3710186 - DNA, 13 bp, Homo sapiens
ataaccacttaaa

SEQ ID NO: 3710187 - DNA, 17 bp, Homo sapiens
ataacgaagttgggcaa

SEQ ID NO: 3710188 - DNA, 16 bp, Homo sapiens
ataactaaaaggtatg

SEQ ID NO: 3710189 - DNA, 21 bp, Homo sapiens
ataactaacaaccaaagacta

SEQ ID NO: 3710190 - DNA, 16 bp, Homo sapiens
ataactagtgttgctt

SEQ ID NO: 3710191 - DNA, 19 bp, Homo sapiens
ataactagtgttgcttgga

SEQ ID NO: 3710192 - DNA, 15 bp, Homo sapiens
ataactcctcattgt

SEQ ID NO: 3710193 - DNA, 18 bp, Homo sapiens
ataactgaaggagaaggt

SEQ ID NO: 3710194 - DNA, 19 bp, Homo sapiens
atagccacttaccttcaat

SEQ ID NO: 3710195 - DNA, 21 bp, Homo sapiens
atagccacttaccttcaataa

SEQ ID NO: 3710196 - DNA, 14 bp, Homo sapiens
atagccgggcatgg

SEQ ID NO: 3710197 - DNA, 13 bp, Homo sapiens
atagcgttggaat

SEQ ID NO: 3710198 - DNA, 16 bp, Homo sapiens
atagctatatccatgt

SEQ ID NO: 3710199 - DNA, 20 bp, Homo sapiens
atagctatttttatggaatt

SEQ ID NO: 3710200 - DNA, 22 bp, Homo sapiens
atagctcaggtgtccctgcact

SEQ ID NO: 3710201 - DNA, 23 bp, Homo sapiens
atagctccccgcttctgcctgca

SEQ ID NO: 3710202 - DNA, 17 bp, Homo sapiens
atagctgggactacagg

SEQ ID NO: 3710203 - DNA, 14 bp, Homo sapiens
atagcttgaaacat

SEQ ID NO: 3710204 - DNA, 22 bp, Homo sapiens
ataggccaaactggcaaacttc

SEQ ID NO: 3710205 - DNA, 15 bp, Homo sapiens
ataggccttcttgtg

SEQ ID NO: 3710206 - DNA, 17 bp, Homo sapiens
ataggccttcttgtgat

SEQ ID NO: 3710207 - DNA, 11 bp, Homo sapiens
ataggctctgc

SEQ ID NO: 3710208 - DNA, 21 bp, Homo sapiens
atagggtctcttcaggttctt

SEQ ID NO: 3710209 - DNA, 23 bp, Homo sapiens
ataggtcagtgaggcccagggag

SEQ ID NO: 3710210 - DNA, 13 bp, Homo sapiens
atagtaaaaataa

SEQ ID NO: 3710211 - DNA, 14 bp, Homo sapiens
atagtaaaaataaa

SEQ ID NO: 3710212 - DNA, 14 bp, Homo sapiens
atagtactggcatg

SEQ ID NO: 3710213 - DNA, 15 bp, Homo sapiens
atagtagcatacatt

SEQ ID NO: 3710214 - DNA, 16 bp, Homo sapiens
atagtagcatacattt

SEQ ID NO: 3710215 - DNA, 17 bp, Homo sapiens
atagtagcatacattta

SEQ ID NO: 3710216 - DNA, 17 bp, Homo sapiens
atagtatattaaaaatg

SEQ ID NO: 3710217 - DNA, 16 bp, Homo sapiens
atagtatggtggctgg

SEQ ID NO: 3710218 - DNA, 17 bp, Homo sapiens
atagtatggtggctggg

SEQ ID NO: 3710219 - DNA, 17 bp, Homo sapiens
atagtgcttaaaaatca

SEQ ID NO: 3710220 - DNA, 13 bp, Homo sapiens
atagtggccagac

SEQ ID NO: 3710221 - DNA, 17 bp, Homo sapiens
atagtggttcttggaaa

SEQ ID NO: 3710222 - DNA, 18 bp, Homo sapiens
atagtggttcttggaaaa

SEQ ID NO: 3710223 - DNA, 14 bp, Homo sapiens
atagtgtgttctga

SEQ ID NO: 3710224 - DNA, 19 bp, Homo sapiens
atagtgtgttctgattaga

SEQ ID NO: 3710225 - DNA, 21 bp, Homo sapiens
atagtgtgttctgattagaaa

SEQ ID NO: 3710226 - DNA, 23 bp, Homo sapiens
atagtgtgttctgattagaaatg

SEQ ID NO: 3710227 - DNA, 17 bp, Homo sapiens
atagttcccatgttaaa

SEQ ID NO: 3710228 - DNA, 19 bp, Homo sapiens
atagttgctccgcctctgc

SEQ ID NO: 3710229 - DNA, 15 bp, Homo sapiens
atagtttactatttt

SEQ ID NO: 3710230 - DNA, 22 bp, Homo sapiens
atagtttactattttacttcta

SEQ ID NO: 3710231 - DNA, 16 bp, Homo sapiens
atagtttaggagaaac

SEQ ID NO: 3710232 - DNA, 13 bp, Homo sapiens
atataaacactat

SEQ ID NO: 3710233 - DNA, 15 bp, Homo sapiens
atataaagagaaaat

SEQ ID NO: 3710234 - DNA, 17 bp, Homo sapiens
atataaagagaaaattg

SEQ ID NO: 3710235 - DNA, 11 bp, Homo sapiens
atataaccaat

SEQ ID NO: 3710236 - DNA, 13 bp, Homo sapiens
atataactaacaa

SEQ ID NO: 3710237 - DNA, 17 bp, Homo sapiens
atataataaagtattcc

SEQ ID NO: 3710238 - DNA, 15 bp, Homo sapiens
atataatatatgttt

SEQ ID NO: 3710239 - DNA, 23 bp, Homo sapiens
atataatatgcacacagtgcttt

SEQ ID NO: 3710240 - DNA, 21 bp, Homo sapiens
atataatgttgttatttaaag

SEQ ID NO: 3710241 - DNA, 14 bp, Homo sapiens
atataattatcgga

SEQ ID NO: 3710242 - DNA, 11 bp, Homo sapiens
atataattatg

SEQ ID NO: 3710243 - DNA, 22 bp, Homo sapiens
atataattgttttttatctttt

SEQ ID NO: 3710244 - DNA, 21 bp, Homo sapiens
atataatttttttatgttttg

SEQ ID NO: 3710245 - DNA, 16 bp, Homo sapiens
atatacaataacataa

SEQ ID NO: 3710246 - DNA, 18 bp, Homo sapiens
atatacattcaaacttaa

SEQ ID NO: 3710247 - DNA, 12 bp, Homo sapiens
atatagaattgc

SEQ ID NO: 3710248 - DNA, 23 bp, Homo sapiens
atatagatcagttataagtagca

SEQ ID NO: 3710249 - DNA, 17 bp, Homo sapiens
atatagtacctttgctc

SEQ ID NO: 3710250 - DNA, 16 bp, Homo sapiens
atatagtttactattt

SEQ ID NO: 3710251 - DNA, 18 bp, Homo sapiens
atatatatgttgatttct

SEQ ID NO: 3710252 - DNA, 16 bp, Homo sapiens
atatatgtatgtaaaa

SEQ ID NO: 3710253 - DNA, 13 bp, Homo sapiens
atatatgtgtttt

SEQ ID NO: 3710254 - DNA, 16 bp, Homo sapiens
atatattctctttggt

SEQ ID NO: 3710255 - DNA, 23 bp, Homo sapiens
atatattctctttggtgtacaaa

SEQ ID NO: 3710256 - DNA, 13 bp, Homo sapiens
atatatttataac

SEQ ID NO: 3710257 - DNA, 13 bp, Homo sapiens
atatattttaatt

SEQ ID NO: 3710258 - DNA, 17 bp, Homo sapiens
atatcaatcattttcct

SEQ ID NO: 3710259 - DNA, 19 bp, Homo sapiens
atatcagttactcagccct

SEQ ID NO: 3710260 - DNA, 14 bp, Homo sapiens
atatcattcagcaa

SEQ ID NO: 3710261 - DNA, 15 bp, Homo sapiens
atatcctgagccatc

SEQ ID NO: 3710262 - DNA, 20 bp, Homo sapiens
atatctaattattttgcagt

SEQ ID NO: 3710263 - DNA, 21 bp, Homo sapiens
atatctatcttatatagttta

SEQ ID NO: 3710264 - DNA, 16 bp, Homo sapiens
atatctgaaaatgtat

SEQ ID NO: 3710265 - DNA, 20 bp, Homo sapiens
atatctgttttactgctttt

SEQ ID NO: 3710266 - DNA, 21 bp, Homo sapiens
atatctttttattgatgtgca

SEQ ID NO: 3710267 - DNA, 22 bp, Homo sapiens
atatctttttattgatgtgcaa

SEQ ID NO: 3710268 - DNA, 18 bp, Homo sapiens
atatgaaaaatatgatat

SEQ ID NO: 3710269 - DNA, 23 bp, Homo sapiens
atatgaaaatacaacttaaataa

SEQ ID NO: 3710270 - DNA, 14 bp, Homo sapiens
atatgaaatttaat

SEQ ID NO: 3710271 - DNA, 12 bp, Homo sapiens
atatgaacatag

SEQ ID NO: 3710272 - DNA, 18 bp, Homo sapiens
atatgaaggaaatgaacc

SEQ ID NO: 3710273 - DNA, 16 bp, Homo sapiens
atatgacggaagaaca

SEQ ID NO: 3710274 - DNA, 18 bp, Homo sapiens
atatgacggaagaacata

SEQ ID NO: 3710275 - DNA, 23 bp, Homo sapiens
atatgacggaagaacatagaact

SEQ ID NO: 3710276 - DNA, 13 bp, Homo sapiens
atatgagactttc

SEQ ID NO: 3710277 - DNA, 21 bp, Homo sapiens
atatgcaaacataacaaaatc

SEQ ID NO: 3710278 - DNA, 22 bp, Homo sapiens
atatgcaaacataacaaaatca

SEQ ID NO: 3710279 - DNA, 19 bp, Homo sapiens
atatgcacacagtgctttc

SEQ ID NO: 3710280 - DNA, 16 bp, Homo sapiens
atatgctctgcatgtt

SEQ ID NO: 3710281 - DNA, 20 bp, Homo sapiens
atatgctctgcatgttacat

SEQ ID NO: 3710282 - DNA, 18 bp, Homo sapiens
atatgctgccaaattttg

SEQ ID NO: 3710283 - DNA, 23 bp, Homo sapiens
atatggggggccaacaccaggga

SEQ ID NO: 3710284 - DNA, 16 bp, Homo sapiens
atatgtaaaataaaat

SEQ ID NO: 3710285 - DNA, 16 bp, Homo sapiens
atatgtaacaagccac

SEQ ID NO: 3710286 - DNA, 16 bp, Homo sapiens
atatgtagaaggcaca

SEQ ID NO: 3710287 - DNA, 18 bp, Homo sapiens
atatgtagtataaagaaa

SEQ ID NO: 3710288 - DNA, 19 bp, Homo sapiens
atatgtatccagtacattt

SEQ ID NO: 3710289 - DNA, 22 bp, Homo sapiens
atatgtatccagtacatttaat

SEQ ID NO: 3710290 - DNA, 15 bp, Homo sapiens
atatgtatgtaaaaa

SEQ ID NO: 3710291 - DNA, 17 bp, Homo sapiens
atatgtattttatgtat

SEQ ID NO: 3710292 - DNA, 18 bp, Homo sapiens
atatgtattttatgtatg

SEQ ID NO: 3710293 - DNA, 22 bp, Homo sapiens
atatgtattttatgtatgttta

SEQ ID NO: 3710294 - DNA, 18 bp, Homo sapiens
atatgttctttaaaaata

SEQ ID NO: 3710295 - DNA, 14 bp, Homo sapiens
atatgttgatgaaa

SEQ ID NO: 3710296 - DNA, 22 bp, Homo sapiens
atatgttttaaatatagaattt

SEQ ID NO: 3710297 - DNA, 15 bp, Homo sapiens
atattaaaaatggta

SEQ ID NO: 3710298 - DNA, 16 bp, Homo sapiens
atattaaaaatggtaa

SEQ ID NO: 3710299 - DNA, 15 bp, Homo sapiens
atattaagaaagact

SEQ ID NO: 3710300 - DNA, 17 bp, Homo sapiens
atattaagaaagactat

SEQ ID NO: 3710301 - DNA, 22 bp, Homo sapiens
atattaaggaagacaatgtgaa

SEQ ID NO: 3710302 - DNA, 20 bp, Homo sapiens
atattacacaaatacttatt

SEQ ID NO: 3710303 - DNA, 21 bp, Homo sapiens
atattagctttactgtttgtt

SEQ ID NO: 3710304 - DNA, 22 bp, Homo sapiens
atattataatttttttcaatat

SEQ ID NO: 3710305 - DNA, 15 bp, Homo sapiens
atattatgcaaattc

SEQ ID NO: 3710306 - DNA, 16 bp, Homo sapiens
atattatggaagattt

SEQ ID NO: 3710307 - DNA, 22 bp, Homo sapiens
atcatgcatcttactgaaggta

SEQ ID NO: 3710308 - DNA, 12 bp, Homo sapiens
atcatgcattgt

SEQ ID NO: 3710309 - DNA, 13 bp, Homo sapiens
atcatgcattgtt

SEQ ID NO: 3710310 - DNA, 14 bp, Homo sapiens
atcatgcattgttg

SEQ ID NO: 3710311 - DNA, 21 bp, Homo sapiens
atcatgcattgttgaggtggt

SEQ ID NO: 3710312 - DNA, 22 bp, Homo sapiens
atcatgcattgttgaggtggtc

SEQ ID NO: 3710313 - DNA, 22 bp, Homo sapiens
atcatggctaagcttaaaaaaa

SEQ ID NO: 3710314 - DNA, 15 bp, Homo sapiens
atcatggctcactgc

SEQ ID NO: 3710315 - DNA, 20 bp, Homo sapiens
atcatggctcactgcagcct

SEQ ID NO: 3710316 - DNA, 14 bp, Homo sapiens
atcatgtaaattac

SEQ ID NO: 3710317 - DNA, 18 bp, Homo sapiens
atcatgtgggtgagccag

SEQ ID NO: 3710318 - DNA, 17 bp, Homo sapiens
atcatgttatgataaaa

SEQ ID NO: 3710319 - DNA, 17 bp, Homo sapiens
atcattaaatttttcct

SEQ ID NO: 3710320 - DNA, 16 bp, Homo sapiens
atcattataaacgtga

SEQ ID NO: 3710321 - DNA, 20 bp, Homo sapiens
atcattgtttggcattgaaa

SEQ ID NO: 3710322 - DNA, 15 bp, Homo sapiens
atcatttcttgggcc

SEQ ID NO: 3710323 - DNA, 14 bp, Homo sapiens
atcattttaattat

SEQ ID NO: 3710324 - DNA, 17 bp, Homo sapiens
atcattttccccccact

SEQ ID NO: 3710325 - DNA, 13 bp, Homo sapiens
atccaaggagaaa

SEQ ID NO: 3710326 - DNA, 22 bp, Homo sapiens
atccaaggagaaacagagacag

SEQ ID NO: 3710327 - DNA, 18 bp, Homo sapiens
atccaatcctcactgggt

SEQ ID NO: 3710328 - DNA, 13 bp, Homo sapiens
atccacccacctc

SEQ ID NO: 3710329 - DNA, 18 bp, Homo sapiens
atccacccacctcagcct

SEQ ID NO: 3710330 - DNA, 21 bp, Homo sapiens
atccactctaccctcccaccc

SEQ ID NO: 3710331 - DNA, 22 bp, Homo sapiens
atccactctaccctcccacccc

SEQ ID NO: 3710332 - DNA, 21 bp, Homo sapiens
atccaggcacccaaaccccgg

SEQ ID NO: 3710333 - DNA, 16 bp, Homo sapiens
atccaggttcagcttg

SEQ ID NO: 3710334 - DNA, 19 bp, Homo sapiens
atccagtacatttaattga

SEQ ID NO: 3710335 - DNA, 16 bp, Homo sapiens
atccagttcatgagaa

SEQ ID NO: 3710336 - DNA, 12 bp, Homo sapiens
atccatctccag

SEQ ID NO: 3710337 - DNA, 19 bp, Homo sapiens
atccatgagtttgccctgg

SEQ ID NO: 3710338 - DNA, 12 bp, Homo sapiens
atccatgtactg

SEQ ID NO: 3710339 - DNA, 18 bp, Homo sapiens
atccatgtactgtagttt

SEQ ID NO: 3710340 - DNA, 18 bp, Homo sapiens
atccatgttagtttttac

SEQ ID NO: 3710341 - DNA, 19 bp, Homo sapiens
atccatgttagtttttact

SEQ ID NO: 3710342 - DNA, 20 bp, Homo sapiens
atccatttcatctatttctg

SEQ ID NO: 3710343 - DNA, 21 bp, Homo sapiens
atccatttcatctatttctga

SEQ ID NO: 3710344 - DNA, 23 bp, Homo sapiens
atccatttcatctatttctgaga

SEQ ID NO: 3710345 - DNA, 20 bp, Homo sapiens
atcccacctctggataattt

SEQ ID NO: 3710346 - DNA, 20 bp, Homo sapiens
atcccacggaaaatgccaat

SEQ ID NO: 3710347 - DNA, 15 bp, Homo sapiens
atcccagcctgtggt

SEQ ID NO: 3710348 - DNA, 16 bp, Homo sapiens
atcccagcctgtggtt

SEQ ID NO: 3710349 - DNA, 19 bp, Homo sapiens
atcccaggggaccacacct

SEQ ID NO: 3710350 - DNA, 20 bp, Homo sapiens
atcccatcccgctcttttcc

SEQ ID NO: 3710351 - DNA, 19 bp, Homo sapiens
atcccatgagcctcagcat

SEQ ID NO: 3710352 - DNA, 16 bp, Homo sapiens
atcccattgccctggt

SEQ ID NO: 3710353 - DNA, 19 bp, Homo sapiens
atccccaggggtcccagcc

SEQ ID NO: 3710354 - DNA, 15 bp, Homo sapiens
atcccgattcaccct

SEQ ID NO: 3710355 - DNA, 22 bp, Homo sapiens
atcccgcctcttcttcttcaga

SEQ ID NO: 3710356 - DNA, 19 bp, Homo sapiens
atcccgtgcaaaacatgct

SEQ ID NO: 3710357 - DNA, 20 bp, Homo sapiens
atcccgtgcaaaacatgcta

SEQ ID NO: 3710358 - DNA, 22 bp, Homo sapiens
atccctaccccctaagagccat

SEQ ID NO: 3710359 - DNA, 21 bp, Homo sapiens
atccctagtcttcaagcagat

SEQ ID NO: 3710360 - DNA, 19 bp, Homo sapiens
atccctatgctgcctaggc

SEQ ID NO: 3710361 - DNA, 18 bp, Homo sapiens
atccctgaggctggactc

SEQ ID NO: 3710362 - DNA, 20 bp, Homo sapiens
atccctgaggctggactcca

SEQ ID NO: 3710363 - DNA, 16 bp, Homo sapiens
atccctgggcattgct

SEQ ID NO: 3710364 - DNA, 17 bp, Homo sapiens
atccctgttcattgtaa

SEQ ID NO: 3710365 - DNA, 19 bp, Homo sapiens
atcccttccttttagccta

SEQ ID NO: 3710366 - DNA, 14 bp, Homo sapiens
atcccttttcttga

SEQ ID NO: 3710367 - DNA, 22 bp, Homo sapiens
atccggaggagaagaaggaaat

SEQ ID NO: 3710368 - DNA, 16 bp, Homo sapiens
atccgtagttccctga

SEQ ID NO: 3710369 - DNA, 17 bp, Homo sapiens
atccgtagttccctgaa

SEQ ID NO: 3710370 - DNA, 19 bp, Homo sapiens
atcctaatgaatgcataaa

SEQ ID NO: 3710371 - DNA, 15 bp, Homo sapiens
atcctaccaacctct

SEQ ID NO: 3710372 - DNA, 19 bp, Homo sapiens
atcctagctgtgtgcagtc

SEQ ID NO: 3710373 - DNA, 21 bp, Homo sapiens
atcctatctctccaaccagat

SEQ ID NO: 3710374 - DNA, 21 bp, Homo sapiens
atcctatggtttctccatcca

SEQ ID NO: 3710375 - DNA, 22 bp, Homo sapiens
atcctcagttcctgcagcagag

SEQ ID NO: 3710376 - DNA, 15 bp, Homo sapiens
atcctcccacctcag

SEQ ID NO: 3710377 - DNA, 18 bp, Homo sapiens
atcctccccttccctgca

SEQ ID NO: 3710378 - DNA, 19 bp, Homo sapiens
atcctccccttccctgcaa

SEQ ID NO: 3710379 - DNA, 18 bp, Homo sapiens
atcctctgagtgtgacca

SEQ ID NO: 3710380 - DNA, 19 bp, Homo sapiens
atcctctggttcttcattt

SEQ ID NO: 3710381 - DNA, 15 bp, Homo sapiens
atcctgcccagtgtt

SEQ ID NO: 3710382 - DNA, 22 bp, Homo sapiens
atcctgcccagtgttgtttgta

SEQ ID NO: 3710383 - DNA, 13 bp, Homo sapiens
atcctgctaagtt

SEQ ID NO: 3710384 - DNA, 21 bp, Homo sapiens
atcctggcacccggcccctgc

SEQ ID NO: 3710385 - DNA, 22 bp, Homo sapiens
atcctggcacccggcccctgct

SEQ ID NO: 3710386 - DNA, 18 bp, Homo sapiens
atcctggctttgcccaac

SEQ ID NO: 3710387 - DNA, 23 bp, Homo sapiens
atcctgggtggtctgcaggcagg

SEQ ID NO: 3710388 - DNA, 22 bp, Homo sapiens
atcctggttggtgttgcagaag

SEQ ID NO: 3710389 - DNA, 17 bp, Homo sapiens
atcctgtctgttcatgg

SEQ ID NO: 3710390 - DNA, 15 bp, Homo sapiens
atcctgttgaaaagc

SEQ ID NO: 3710391 - DNA, 18 bp, Homo sapiens
atcctgttgaaaagccat

SEQ ID NO: 3710392 - DNA, 19 bp, Homo sapiens
atcctgttgaaaagccatg

SEQ ID NO: 3710393 - DNA, 18 bp, Homo sapiens
atccttaagtatcagaaa

SEQ ID NO: 3710394 - DNA, 17 bp, Homo sapiens
atccttcctcacaccag

SEQ ID NO: 3710395 - DNA, 12 bp, Homo sapiens
atccttctaatc

SEQ ID NO: 3710396 - DNA, 13 bp, Homo sapiens
atccttctaatct

SEQ ID NO: 3710397 - DNA, 17 bp, Homo sapiens
atcctttaaatccttcc

SEQ ID NO: 3710398 - DNA, 13 bp, Homo sapiens
atcgatgcagtgc

SEQ ID NO: 3710399 - DNA, 23 bp, Homo sapiens
atcgcgccactacactccagcct

SEQ ID NO: 3710400 - DNA, 21 bp, Homo sapiens
atcggaggcttgtcagagctg

SEQ ID NO: 3710401 - DNA, 22 bp, Homo sapiens
atcggaggcttgtcagagctgg

SEQ ID NO: 3710402 - DNA, 19 bp, Homo sapiens
atcggcccacagctcccac

SEQ ID NO: 3710403 - DNA, 20 bp, Homo sapiens
atcggcccacagctcccacc

SEQ ID NO: 3710404 - DNA, 23 bp, Homo sapiens
atcggcccacagctcccacccca

SEQ ID NO: 3710405 - DNA, 21 bp, Homo sapiens
atcgggaacagtgtttcccat

SEQ ID NO: 3710406 - DNA, 14 bp, Homo sapiens
atcggggccagagg

SEQ ID NO: 3710407 - DNA, 18 bp, Homo sapiens
atcggtgaaactaacaga

SEQ ID NO: 3710408 - DNA, 21 bp, Homo sapiens
atcggtgaaactaacagataa

SEQ ID NO: 3710409 - DNA, 14 bp, Homo sapiens
atcgtctaaacttt

SEQ ID NO: 3710410 - DNA, 19 bp, Homo sapiens
atcgtgccgttactctcca

SEQ ID NO: 3710411 - DNA, 12 bp, Homo sapiens
atcgtgctaaat

SEQ ID NO: 3710412 - DNA, 18 bp, Homo sapiens
atctaaactttaatatgt

SEQ ID NO: 3710413 - DNA, 16 bp, Homo sapiens
atctaagcctttccat

SEQ ID NO: 3710414 - DNA, 12 bp, Homo sapiens
atctagaagaaa

SEQ ID NO: 3710415 - DNA, 18 bp, Homo sapiens
atctagaagaaatgaaat

SEQ ID NO: 3710416 - DNA, 20 bp, Homo sapiens
atctagaagaaatgaaattt

SEQ ID NO: 3710417 - DNA, 20 bp, Homo sapiens
atctaggtgaggattgatta

SEQ ID NO: 3710418 - DNA, 18 bp, Homo sapiens
atctaggtggagttgaaa

SEQ ID NO: 3710419 - DNA, 13 bp, Homo sapiens
atgggactgggag

SEQ ID NO: 3710420 - DNA, 22 bp, Homo sapiens
atgggagctggttagaaatgca

SEQ ID NO: 3710421 - DNA, 21 bp, Homo sapiens
atgggcaacccccagcctgct

SEQ ID NO: 3710422 - DNA, 23 bp, Homo sapiens
atgggcttgttttcttgccaatg

SEQ ID NO: 3710423 - DNA, 16 bp, Homo sapiens
atggggaaggaggctg

SEQ ID NO: 3710424 - DNA, 12 bp, Homo sapiens
atggggccacag

SEQ ID NO: 3710425 - DNA, 22 bp, Homo sapiens
atggggctgaacggggagaaaa

SEQ ID NO: 3710426 - DNA, 19 bp, Homo sapiens
atgggggagtctgaagcag

SEQ ID NO: 3710427 - DNA, 20 bp, Homo sapiens
atgggggagtctgaagcaga

SEQ ID NO: 3710428 - DNA, 19 bp, Homo sapiens
atggggtggggtagggctg

SEQ ID NO: 3710429 - DNA, 14 bp, Homo sapiens
atgggtagcttctg

SEQ ID NO: 3710430 - DNA, 13 bp, Homo sapiens
atgggtgtgtgtt

SEQ ID NO: 3710431 - DNA, 19 bp, Homo sapiens
atgggttttgtaggtactt

SEQ ID NO: 3710432 - DNA, 13 bp, Homo sapiens
atggtaaaattgc

SEQ ID NO: 3710433 - DNA, 19 bp, Homo sapiens
atggtactagggggaagtg

SEQ ID NO: 3710434 - DNA, 19 bp, Homo sapiens
atggtcaccaaatcagctg

SEQ ID NO: 3710435 - DNA, 16 bp, Homo sapiens
atggtcagacacaaac

SEQ ID NO: 3710436 - DNA, 22 bp, Homo sapiens
atggtcatctttttctctaaaa

SEQ ID NO: 3710437 - DNA, 17 bp, Homo sapiens
atggtcctggggctctg

SEQ ID NO: 3710438 - DNA, 20 bp, Homo sapiens
atggtcctggggctctgtgc

SEQ ID NO: 3710439 - DNA, 16 bp, Homo sapiens
atggtcgcccaggaga

SEQ ID NO: 3710440 - DNA, 24 bp, Homo sapiens
atggtgaaaccccgtctctactaa

SEQ ID NO: 3710441 - DNA, 16 bp, Homo sapiens
atggtggcgcgcacct

SEQ ID NO: 3710442 - DNA, 15 bp, Homo sapiens
atggtggctgggttg

SEQ ID NO: 3710443 - DNA, 19 bp, Homo sapiens
atggtggttgtttcttcca

SEQ ID NO: 3710444 - DNA, 22 bp, Homo sapiens
atggtgtgaaagtcagatgccc

SEQ ID NO: 3710445 - DNA, 22 bp, Homo sapiens
atggtttgaatataaacactat

SEQ ID NO: 3710446 - DNA, 18 bp, Homo sapiens
atggtttgcaaggaagcc

SEQ ID NO: 3710447 - DNA, 15 bp, Homo sapiens
atggttttcaaaata

SEQ ID NO: 3710448 - DNA, 21 bp, Homo sapiens
atgtaaaagagtcatctggta

SEQ ID NO: 3710449 - DNA, 21 bp, Homo sapiens
atgtaaaaggtattaaattga

SEQ ID NO: 3710450 - DNA, 23 bp, Homo sapiens
atgtaaacataattcttgtatat

SEQ ID NO: 3710451 - DNA, 23 bp, Homo sapiens
atgtaaataaccccattctttgc

SEQ ID NO: 3710452 - DNA, 12 bp, Homo sapiens
atgtaaatgaag

SEQ ID NO: 3710453 - DNA, 13 bp, Homo sapiens
atgtaaatgaagt

SEQ ID NO: 3710454 - DNA, 16 bp, Homo sapiens
atgtaacttttgtaag

SEQ ID NO: 3710455 - DNA, 17 bp, Homo sapiens
atgtaacttttgtaaga

SEQ ID NO: 3710456 - DNA, 16 bp, Homo sapiens
atgtaagagctttaca

SEQ ID NO: 3710457 - DNA, 20 bp, Homo sapiens
atgtaagagctttacaaaaa

SEQ ID NO: 3710458 - DNA, 23 bp, Homo sapiens
atgtaagagctttacaaaaagac

SEQ ID NO: 3710459 - DNA, 17 bp, Homo sapiens
atgtaagctctactgag

SEQ ID NO: 3710460 - DNA, 20 bp, Homo sapiens
atgtaaggaatgcttggaat

SEQ ID NO: 3710461 - DNA, 14 bp, Homo sapiens
atgtaataatgtga

SEQ ID NO: 3710462 - DNA, 16 bp, Homo sapiens
atgtaatcaatgtttc

SEQ ID NO: 3710463 - DNA, 17 bp, Homo sapiens
atgtaattaagtactat

SEQ ID NO: 3710464 - DNA, 23 bp, Homo sapiens
atgtaattaagtactatgtatca

SEQ ID NO: 3710465 - DNA, 21 bp, Homo sapiens
atgtaatttgtgtaataaagt

SEQ ID NO: 3710466 - DNA, 19 bp, Homo sapiens
atgtacatttctgaaatga

SEQ ID NO: 3710467 - DNA, 21 bp, Homo sapiens
atgtaccatgtacatgaagaa

SEQ ID NO: 3710468 - DNA, 17 bp, Homo sapiens
atgtactcctctttaca

SEQ ID NO: 3710469 - DNA, 18 bp, Homo sapiens
atgtactgagccttgtaa

SEQ ID NO: 3710470 - DNA, 17 bp, Homo sapiens
atgtagcaaaacgcatg

SEQ ID NO: 3710471 - DNA, 18 bp, Homo sapiens
atgtagcaatcagatttt

SEQ ID NO: 3710472 - DNA, 19 bp, Homo sapiens
atgtagtataaagaaaagt

SEQ ID NO: 3710473 - DNA, 13 bp, Homo sapiens
atgtatgtaaaaa

SEQ ID NO: 3710474 - DNA, 12 bp, Homo sapiens
atgtatgtgtaa

SEQ ID NO: 3710475 - DNA, 14 bp, Homo sapiens
atgtatgtgtgtat

SEQ ID NO: 3710476 - DNA, 19 bp, Homo sapiens
atgtatgtttacactgtca

SEQ ID NO: 3710477 - DNA, 15 bp, Homo sapiens
atgtattataacttt

SEQ ID NO: 3710478 - DNA, 14 bp, Homo sapiens
atgtattattctgc

SEQ ID NO: 3710479 - DNA, 17 bp, Homo sapiens
atgtatttataaatata

SEQ ID NO: 3710480 - DNA, 17 bp, Homo sapiens
atgtattttatgtatgt

SEQ ID NO: 3710481 - DNA, 21 bp, Homo sapiens
atgtcaaggtgctgttgtcat

SEQ ID NO: 3710482 - DNA, 15 bp, Homo sapiens
atgtcacaggcaggt

SEQ ID NO: 3710483 - DNA, 17 bp, Homo sapiens
atgtcacaggcaggtcc

SEQ ID NO: 3710484 - DNA, 23 bp, Homo sapiens
atgtcaccaccttcccagctctc

SEQ ID NO: 3710485 - DNA, 19 bp, Homo sapiens
atgtcaccggatcctgggt

SEQ ID NO: 3710486 - DNA, 22 bp, Homo sapiens
atgtcactaaagcaggcctttt

SEQ ID NO: 3710487 - DNA, 19 bp, Homo sapiens
atgtcagaaaaacaataag

SEQ ID NO: 3710488 - DNA, 17 bp, Homo sapiens
atgtcaggaacagaagg

SEQ ID NO: 3710489 - DNA, 20 bp, Homo sapiens
atgtcaggaacagaaggatg

SEQ ID NO: 3710490 - DNA, 20 bp, Homo sapiens
atgtccacagatgcctccac

SEQ ID NO: 3710491 - DNA, 20 bp, Homo sapiens
atgtcccaacttgtaaaaat

SEQ ID NO: 3710492 - DNA, 18 bp, Homo sapiens
atgtcctccagaagcctc

SEQ ID NO: 3710493 - DNA, 22 bp, Homo sapiens
atgtcctccagaagcctctggc

SEQ ID NO: 3710494 - DNA, 14 bp, Homo sapiens
atgtcgattaaaat

SEQ ID NO: 3710495 - DNA, 20 bp, Homo sapiens
atgtctcaatagtaaaagat

SEQ ID NO: 3710496 - DNA, 22 bp, Homo sapiens
atgtctcaggtccctgcagggc

SEQ ID NO: 3710497 - DNA, 17 bp, Homo sapiens
atgtctctcagaattct

SEQ ID NO: 3710498 - DNA, 20 bp, Homo sapiens
atgtctgctgaataataaac

SEQ ID NO: 3710499 - DNA, 12 bp, Homo sapiens
atgtcttatttt

SEQ ID NO: 3710500 - DNA, 15 bp, Homo sapiens
atgtcttatttttag

SEQ ID NO: 3710501 - DNA, 13 bp, Homo sapiens
atgtcttgttaat

SEQ ID NO: 3710502 - DNA, 21 bp, Homo sapiens
atgtcttgttaatattctttc

SEQ ID NO: 3710503 - DNA, 12 bp, Homo sapiens
atgtgaatcaga

SEQ ID NO: 3710504 - DNA, 21 bp, Homo sapiens
atgtgacaattttgtacaaat

SEQ ID NO: 3710505 - DNA, 14 bp, Homo sapiens
atgtgagagaaagt

SEQ ID NO: 3710506 - DNA, 17 bp, Homo sapiens
atgtgagccaccgctgc

SEQ ID NO: 3710507 - DNA, 15 bp, Homo sapiens
atgtgatttttctga

SEQ ID NO: 3710508 - DNA, 23 bp, Homo sapiens
atgtgcaaaaatttttggattga

SEQ ID NO: 3710509 - DNA, 20 bp, Homo sapiens
atgtgcatttttgtgaaatg

SEQ ID NO: 3710510 - DNA, 21 bp, Homo sapiens
atgtgccaggtttttggtctg

SEQ ID NO: 3710511 - DNA, 17 bp, Homo sapiens
atgtgcctgcaccagga

SEQ ID NO: 3710512 - DNA, 14 bp, Homo sapiens
atgtgcgtgtgtgc

SEQ ID NO: 3710513 - DNA, 15 bp, Homo sapiens
atgtgcgtgtgtgca

SEQ ID NO: 3710514 - DNA, 14 bp, Homo sapiens
atgtgctactgatt

SEQ ID NO: 3710515 - DNA, 17 bp, Homo sapiens
atgtggaaagtgaattt

SEQ ID NO: 3710516 - DNA, 19 bp, Homo sapiens
atgtggaaagtgaatttga

SEQ ID NO: 3710517 - DNA, 13 bp, Homo sapiens
atgtggccctggc

SEQ ID NO: 3710518 - DNA, 20 bp, Homo sapiens
atgtggccctggcctgctgg

SEQ ID NO: 3710519 - DNA, 20 bp, Homo sapiens
atgtgggaagaaacaaaccc

SEQ ID NO: 3710520 - DNA, 21 bp, Homo sapiens
atgtggtgggacagggaccca

SEQ ID NO: 3710521 - DNA, 14 bp, Homo sapiens
atgtgtaagtattc

SEQ ID NO: 3710522 - DNA, 15 bp, Homo sapiens
atgtgtgaggagctg

SEQ ID NO: 3710523 - DNA, 22 bp, Homo sapiens
atgtgtgaggagctgctggctt

SEQ ID NO: 3710524 - DNA, 22 bp, Homo sapiens
atgtgtgtatatgtatgtgtgt

SEQ ID NO: 3710525 - DNA, 20 bp, Homo sapiens
atgtgtgtatgggtgtgtgt

SEQ ID NO: 3710526 - DNA, 19 bp, Homo sapiens
atgtgtgtgcaagtgtgtg

SEQ ID NO: 3710527 - DNA, 15 bp, Homo sapiens
atgtgtgtgctcagg

SEQ ID NO: 3710528 - DNA, 15 bp, Homo sapiens
atgtgtgtgtatgct

SEQ ID NO: 3710529 - DNA, 15 bp, Homo sapiens
atgtgtgtgtatgtt

SEQ ID NO: 3710530 - DNA, 21 bp, Homo sapiens
atgtgtgtgtatgtttgcaca

SEQ ID NO: 3710531 - DNA, 14 bp, Homo sapiens
attctgcctgccca

SEQ ID NO: 3710532 - DNA, 22 bp, Homo sapiens
attctgcctttgcagaaacaga

SEQ ID NO: 3710533 - DNA, 21 bp, Homo sapiens
attctgctcacatatctgtca

SEQ ID NO: 3710534 - DNA, 21 bp, Homo sapiens
attctgtgtgttttcataata

SEQ ID NO: 3710535 - DNA, 23 bp, Homo sapiens
attctgtgtgttttcataataaa

SEQ ID NO: 3710536 - DNA, 21 bp, Homo sapiens
attctgttggccagtgtgaca

SEQ ID NO: 3710537 - DNA, 12 bp, Homo sapiens
attctgtttctt

SEQ ID NO: 3710538 - DNA, 17 bp, Homo sapiens
attcttagcctgtggca

SEQ ID NO: 3710539 - DNA, 18 bp, Homo sapiens
attcttatttaatgaaag

SEQ ID NO: 3710540 - DNA, 17 bp, Homo sapiens
attcttcctagttttct

SEQ ID NO: 3710541 - DNA, 11 bp, Homo sapiens
attcttctgct

SEQ ID NO: 3710542 - DNA, 22 bp, Homo sapiens
attcttcttccaacgtggccca

SEQ ID NO: 3710543 - DNA, 17 bp, Homo sapiens
attcttgtcacaataaa

SEQ ID NO: 3710544 - DNA, 18 bp, Homo sapiens
attcttgtcacaataaat

SEQ ID NO: 3710545 - DNA, 12 bp, Homo sapiens
attcttgtgaat

SEQ ID NO: 3710546 - DNA, 23 bp, Homo sapiens
attctttgcttgaacacagtatt

SEQ ID NO: 3710547 - DNA, 13 bp, Homo sapiens
attcttttgctgt

SEQ ID NO: 3710548 - DNA, 16 bp, Homo sapiens
attgaaaaaaattggc

SEQ ID NO: 3710549 - DNA, 17 bp, Homo sapiens
attgaaaaggaagatca

SEQ ID NO: 3710550 - DNA, 20 bp, Homo sapiens
attgaaatataatgcaaacc

SEQ ID NO: 3710551 - DNA, 16 bp, Homo sapiens
attgaaatgactaaaa

SEQ ID NO: 3710552 - DNA, 18 bp, Homo sapiens
attgaagagagagctgag

SEQ ID NO: 3710553 - DNA, 12 bp, Homo sapiens
attgaaggaaag

SEQ ID NO: 3710554 - DNA, 16 bp, Homo sapiens
attgaagtaatgaatt

SEQ ID NO: 3710555 - DNA, 14 bp, Homo sapiens
attgaatttaacaa

SEQ ID NO: 3710556 - DNA, 15 bp, Homo sapiens
attgaatttaacaat

SEQ ID NO: 3710557 - DNA, 13 bp, Homo sapiens
attgacaaactct

SEQ ID NO: 3710558 - DNA, 15 bp, Homo sapiens
attgacaagtcattt

SEQ ID NO: 3710559 - DNA, 23 bp, Homo sapiens
attgacagtaacttggttataca

SEQ ID NO: 3710560 - DNA, 15 bp, Homo sapiens
attgaccaagaactg

SEQ ID NO: 3710561 - DNA, 16 bp, Homo sapiens
attgaccaagaactgc

SEQ ID NO: 3710562 - DNA, 20 bp, Homo sapiens
attgaccaagaactgcatgg

SEQ ID NO: 3710563 - DNA, 21 bp, Homo sapiens
attgactatcaaactgaagcc

SEQ ID NO: 3710564 - DNA, 16 bp, Homo sapiens
attgacttcgactgtg

SEQ ID NO: 3710565 - DNA, 16 bp, Homo sapiens
attgagaaagaaacta

SEQ ID NO: 3710566 - DNA, 22 bp, Homo sapiens
attgagaactgcatatgtttcg

SEQ ID NO: 3710567 - DNA, 16 bp, Homo sapiens
attgagacaaaaatta

SEQ ID NO: 3710568 - DNA, 19 bp, Homo sapiens
attgagacaaaaattatct

SEQ ID NO: 3710569 - DNA, 21 bp, Homo sapiens
attgagctggacctcaccaag

SEQ ID NO: 3710570 - DNA, 18 bp, Homo sapiens
attgatataaataaaaca

SEQ ID NO: 3710571 - DNA, 15 bp, Homo sapiens
attgatatgaaaaat

SEQ ID NO: 3710572 - DNA, 16 bp, Homo sapiens
attgatatgaaaaata

SEQ ID NO: 3710573 - DNA, 20 bp, Homo sapiens
attgatcattttccccccac

SEQ ID NO: 3710574 - DNA, 18 bp, Homo sapiens
attgatttcccttcttct

SEQ ID NO: 3710575 - DNA, 16 bp, Homo sapiens
attgcaacaggctggg

SEQ ID NO: 3710576 - DNA, 18 bp, Homo sapiens
attgcaacaggctgggct

SEQ ID NO: 3710577 - DNA, 15 bp, Homo sapiens
attgcactccagcct

SEQ ID NO: 3710578 - DNA, 18 bp, Homo sapiens
attgcactccagcctggg

SEQ ID NO: 3710579 - DNA, 19 bp, Homo sapiens
attgcactccagcctgggc

SEQ ID NO: 3710580 - DNA, 15 bp, Homo sapiens
attgccaccaggaga

SEQ ID NO: 3710581 - DNA, 15 bp, Homo sapiens
attgccagtgtcttt

SEQ ID NO: 3710582 - DNA, 16 bp, Homo sapiens
attgccagtgtctttc

SEQ ID NO: 3710583 - DNA, 21 bp, Homo sapiens
attgccagtgtctttctttgg

SEQ ID NO: 3710584 - DNA, 22 bp, Homo sapiens
attgcctgcggtcaaggccagc

SEQ ID NO: 3710585 - DNA, 19 bp, Homo sapiens
attgcgccattgcactcca

SEQ ID NO: 3710586 - DNA, 14 bp, Homo sapiens
attgctactgtcct

SEQ ID NO: 3710587 - DNA, 22 bp, Homo sapiens
attgctactgtcctacccaccc

SEQ ID NO: 3710588 - DNA, 19 bp, Homo sapiens
attgctacttcctgcctgg

SEQ ID NO: 3710589 - DNA, 20 bp, Homo sapiens
attgctgctccttagctgcc

SEQ ID NO: 3710590 - DNA, 19 bp, Homo sapiens
attgctggcaaagacagaa

SEQ ID NO: 3710591 - DNA, 19 bp, Homo sapiens
attgctgtgtccaactcca

SEQ ID NO: 3710592 - DNA, 20 bp, Homo sapiens
attgcttcacaacccatcta

SEQ ID NO: 3710593 - DNA, 18 bp, Homo sapiens
attgcttgagcccaggag

SEQ ID NO: 3710594 - DNA, 14 bp, Homo sapiens
attgctttccactg

SEQ ID NO: 3710595 - DNA, 11 bp, Homo sapiens
attgctttctg

SEQ ID NO: 3710596 - DNA, 13 bp, Homo sapiens
attgctttctgaa

SEQ ID NO: 3710597 - DNA, 16 bp, Homo sapiens
attgctttctgaaatt

SEQ ID NO: 3710598 - DNA, 22 bp, Homo sapiens
attggacattaagcatcacaaa

SEQ ID NO: 3710599 - DNA, 17 bp, Homo sapiens
attggagccaccatgcc

SEQ ID NO: 3710600 - DNA, 23 bp, Homo sapiens
attggagggtgggagagcccagc

SEQ ID NO: 3710601 - DNA, 16 bp, Homo sapiens
attggcattaaaactt

SEQ ID NO: 3710602 - DNA, 14 bp, Homo sapiens
attggtccagcttg

SEQ ID NO: 3710603 - DNA, 18 bp, Homo sapiens
attggttccctttgctcc

SEQ ID NO: 3710604 - DNA, 12 bp, Homo sapiens
attgtaaactgt

SEQ ID NO: 3710605 - DNA, 13 bp, Homo sapiens
attgtaagataaa

SEQ ID NO: 3710606 - DNA, 20 bp, Homo sapiens
attgtaagtgaagtaaaact

SEQ ID NO: 3710607 - DNA, 15 bp, Homo sapiens
attgtaatgttactg

SEQ ID NO: 3710608 - DNA, 21 bp, Homo sapiens
attgtacagaatcattgctta

SEQ ID NO: 3710609 - DNA, 12 bp, Homo sapiens
attgtacctctc

SEQ ID NO: 3710610 - DNA, 18 bp, Homo sapiens
attgtacctctcttatag

SEQ ID NO: 3710611 - DNA, 19 bp, Homo sapiens
attgtacgtttaaagtgta

SEQ ID NO: 3710612 - DNA, 17 bp, Homo sapiens
attgtataaaaatagaa

SEQ ID NO: 3710613 - DNA, 21 bp, Homo sapiens
attgtataaaaatagaagaat

SEQ ID NO: 3710614 - DNA, 14 bp, Homo sapiens
attgtatctagtgc

SEQ ID NO: 3710615 - DNA, 16 bp, Homo sapiens
attgtatctagtgcag

SEQ ID NO: 3710616 - DNA, 14 bp, Homo sapiens
attgtcagatattt

SEQ ID NO: 3710617 - DNA, 12 bp, Homo sapiens
attgtctcagag

SEQ ID NO: 3710618 - DNA, 17 bp, Homo sapiens
attgtctttatatgaac

SEQ ID NO: 3710619 - DNA, 20 bp, Homo sapiens
attgtctttatatgaacata

SEQ ID NO: 3710620 - DNA, 15 bp, Homo sapiens
attgtgaccaagtta

SEQ ID NO: 3710621 - DNA, 17 bp, Homo sapiens
attgtgaccaagttata

SEQ ID NO: 3710622 - DNA, 20 bp, Homo sapiens
attgtggttatttttataca

SEQ ID NO: 3710623 - DNA, 22 bp, Homo sapiens
attgtggttatttttatacagt

SEQ ID NO: 3710624 - DNA, 15 bp, Homo sapiens
attgtgtatattcat

SEQ ID NO: 3710625 - DNA, 21 bp, Homo sapiens
attgttaagtctaaatatttc

SEQ ID NO: 3710626 - DNA, 23 bp, Homo sapiens
attgttaagtctaaatatttcct

SEQ ID NO: 3710627 - DNA, 21 bp, Homo sapiens
attgttccaagacattgtcaa

SEQ ID NO: 3710628 - DNA, 22 bp, Homo sapiens
attgttccaagacattgtcaat

SEQ ID NO: 3710629 - DNA, 21 bp, Homo sapiens
attgttcccagtgacacttca

SEQ ID NO: 3710630 - DNA, 13 bp, Homo sapiens
attgttcctaagt

SEQ ID NO: 3710631 - DNA, 20 bp, Homo sapiens
attgttcctaagttcttaga

SEQ ID NO: 3710632 - DNA, 23 bp, Homo sapiens
attgttcctaagttcttagatat

SEQ ID NO: 3710633 - DNA, 19 bp, Homo sapiens
attgttcttagtttgcagt

SEQ ID NO: 3710634 - DNA, 17 bp, Homo sapiens
attgtttatttatcagt

SEQ ID NO: 3710635 - DNA, 18 bp, Homo sapiens
attgtttatttatcagtg

SEQ ID NO: 3710636 - DNA, 21 bp, Homo sapiens
attgtttatttatcagtgaca

SEQ ID NO: 3710637 - DNA, 19 bp, Homo sapiens
attgtttcaaaataaaaac

SEQ ID NO: 3710638 - DNA, 13 bp, Homo sapiens
attgtttgcttat

SEQ ID NO: 3710639 - DNA, 20 bp, Homo sapiens
attgtttgtctgtcttcata

SEQ ID NO: 3710640 - DNA, 19 bp, Homo sapiens
attgttttcagtgtacatg

SEQ ID NO: 3710641 - DNA, 23 bp, Homo sapiens
attgttttttatcttttctacag

SEQ ID NO: 3710642 - DNA, 19 bp, Homo sapiens
atttaaagaacaccctata

SEQ ID NO: 3710643 - DNA, 19 bp, Homo sapiens
atttaaaggctaccttatt

SEQ ID NO: 3710644 - DNA, 17 bp, Homo sapiens
attttaaattataagga

SEQ ID NO: 3710645 - DNA, 22 bp, Homo sapiens
attttaacaataactactgtgt

SEQ ID NO: 3710646 - DNA, 15 bp, Homo sapiens
attttaacacacata

SEQ ID NO: 3710647 - DNA, 22 bp, Homo sapiens
attttaacacacataaaggata

SEQ ID NO: 3710648 - DNA, 21 bp, Homo sapiens
attttaacatggaactctagg

SEQ ID NO: 3710649 - DNA, 17 bp, Homo sapiens
attttaacctgcataaa

SEQ ID NO: 3710650 - DNA, 15 bp, Homo sapiens
attttaactttatca

SEQ ID NO: 3710651 - DNA, 14 bp, Homo sapiens
attttaagattcct

SEQ ID NO: 3710652 - DNA, 22 bp, Homo sapiens
attttaagattccttttcttgt

SEQ ID NO: 3710653 - DNA, 14 bp, Homo sapiens
attttaagcattac

SEQ ID NO: 3710654 - DNA, 21 bp, Homo sapiens
attttaagcattactcttgta

SEQ ID NO: 3710655 - DNA, 24 bp, Homo sapiens
attttaagcattactcttgtaaga

SEQ ID NO: 3710656 - DNA, 20 bp, Homo sapiens
attttaagtgctttgtaatg

SEQ ID NO: 3710657 - DNA, 14 bp, Homo sapiens
attttaatcaaatt

SEQ ID NO: 3710658 - DNA, 21 bp, Homo sapiens
attttaatgcacctgaatgtt

SEQ ID NO: 3710659 - DNA, 15 bp, Homo sapiens
attttaattaggtta

SEQ ID NO: 3710660 - DNA, 23 bp, Homo sapiens
attttaattaggttaactatgta

SEQ ID NO: 3710661 - DNA, 12 bp, Homo sapiens
attttaatttat

SEQ ID NO: 3710662 - DNA, 16 bp, Homo sapiens
attttacaaaagatgt

SEQ ID NO: 3710663 - DNA, 17 bp, Homo sapiens
attttacaaaagatgta

SEQ ID NO: 3710664 - DNA, 13 bp, Homo sapiens
attttacaattga

SEQ ID NO: 3710665 - DNA, 17 bp, Homo sapiens
attttacaattgaaatg

SEQ ID NO: 3710666 - DNA, 21 bp, Homo sapiens
attttacaattgaaatgacta

SEQ ID NO: 3710667 - DNA, 14 bp, Homo sapiens
attttacatttatc

SEQ ID NO: 3710668 - DNA, 17 bp, Homo sapiens
attttaccaagttatat

SEQ ID NO: 3710669 - DNA, 17 bp, Homo sapiens
attttaccactgctgtg

SEQ ID NO: 3710670 - DNA, 22 bp, Homo sapiens
attttactactgtggaaaaata

SEQ ID NO: 3710671 - DNA, 15 bp, Homo sapiens
attttactgtcttaa

SEQ ID NO: 3710672 - DNA, 16 bp, Homo sapiens
attttactgtcttaat

SEQ ID NO: 3710673 - DNA, 23 bp, Homo sapiens
attttactgtcttaattaagtaa

SEQ ID NO: 3710674 - DNA, 18 bp, Homo sapiens
attttacttctagagata

SEQ ID NO: 3710675 - DNA, 16 bp, Homo sapiens
attttagacaaatcta

SEQ ID NO: 3710676 - DNA, 15 bp, Homo sapiens
attttagctgcagaa

SEQ ID NO: 3710677 - DNA, 16 bp, Homo sapiens
attttagctgcagaac

SEQ ID NO: 3710678 - DNA, 18 bp, Homo sapiens
attttataaaattaaaga

SEQ ID NO: 3710679 - DNA, 22 bp, Homo sapiens
attttataaaattaaagaaaat

SEQ ID NO: 3710680 - DNA, 16 bp, Homo sapiens
attttatgaatgtctt

SEQ ID NO: 3710681 - DNA, 18 bp, Homo sapiens
attttatgtaaaattttg

SEQ ID NO: 3710682 - DNA, 14 bp, Homo sapiens
attttatgtatgtt

SEQ ID NO: 3710683 - DNA, 20 bp, Homo sapiens
attttattacatctttcaca

SEQ ID NO: 3710684 - DNA, 12 bp, Homo sapiens
attttattcaag

SEQ ID NO: 3710685 - DNA, 14 bp, Homo sapiens
attttattcaaggt

SEQ ID NO: 3710686 - DNA, 16 bp, Homo sapiens
attttattcaaggtaa

SEQ ID NO: 3710687 - DNA, 20 bp, Homo sapiens
attttattctttaagttcac

SEQ ID NO: 3710688 - DNA, 15 bp, Homo sapiens
attttattttagcag

SEQ ID NO: 3710689 - DNA, 22 bp, Homo sapiens
attttcaaagctttttccagag

SEQ ID NO: 3710690 - DNA, 13 bp, Homo sapiens
attttcaagaaac

SEQ ID NO: 3710691 - DNA, 14 bp, Homo sapiens
attttcaagaaact

SEQ ID NO: 3710692 - DNA, 12 bp, Homo sapiens
attttcaagtaa

SEQ ID NO: 3710693 - DNA, 22 bp, Homo sapiens
attttcaattcaaaaatgtaca

SEQ ID NO: 3710694 - DNA, 15 bp, Homo sapiens
attttcagaatctga

SEQ ID NO: 3710695 - DNA, 22 bp, Homo sapiens
attttcagtagggctacaaaac

SEQ ID NO: 3710696 - DNA, 18 bp, Homo sapiens
attttcatgtatatgtgt

SEQ ID NO: 3710697 - DNA, 15 bp, Homo sapiens
attttccccccactc

SEQ ID NO: 3710698 - DNA, 20 bp, Homo sapiens
attttccccccactctcccc

SEQ ID NO: 3710699 - DNA, 21 bp, Homo sapiens
attttccccccactctcccca

SEQ ID NO: 3710700 - DNA, 22 bp, Homo sapiens
attttccccccactctccccac

SEQ ID NO: 3710701 - DNA, 13 bp, Homo sapiens
attttcctcccca

SEQ ID NO: 3710702 - DNA, 16 bp, Homo sapiens
attttcctccccagca

SEQ ID NO: 3710703 - DNA, 21 bp, Homo sapiens
attttctgaaactaatgaaag

SEQ ID NO: 3710704 - DNA, 20 bp, Homo sapiens
attttctgggttctgggtgg

SEQ ID NO: 3710705 - DNA, 17 bp, Homo sapiens
attttctggtagataga

SEQ ID NO: 3710706 - DNA, 14 bp, Homo sapiens
attttcttcagttg

SEQ ID NO: 3710707 - DNA, 22 bp, Homo sapiens
attttctttaaccagtctgaag

SEQ ID NO: 3710708 - DNA, 22 bp, Homo sapiens
attttctttttattttttaatt

SEQ ID NO: 3710709 - DNA, 22 bp, Homo sapiens
attttgaaaactacattttaac

SEQ ID NO: 3710710 - DNA, 21 bp, Homo sapiens
attttgaagctaattatttta

SEQ ID NO: 3710711 - DNA, 17 bp, Homo sapiens
attttgacctactctca

SEQ ID NO: 3710712 - DNA, 14 bp, Homo sapiens
attttgcaaaattt

SEQ ID NO: 3710713 - DNA, 15 bp, Homo sapiens
attttgcaaaatttc

SEQ ID NO: 3710714 - DNA, 12 bp, Homo sapiens
attttgcagcag

SEQ ID NO: 3710715 - DNA, 18 bp, Homo sapiens
attttgccagtgggaact

SEQ ID NO: 3710716 - DNA, 22 bp, Homo sapiens
attttgcccttccatagcctaa

SEQ ID NO: 3710717 - DNA, 22 bp, Homo sapiens
attttgcctaatacattaaagc

SEQ ID NO: 3710718 - DNA, 14 bp, Homo sapiens
attttggaaaataa

SEQ ID NO: 3710719 - DNA, 20 bp, Homo sapiens
attttggaaaataaattatt

SEQ ID NO: 3710720 - DNA, 21 bp, Homo sapiens
attttggggtacccactgctc

SEQ ID NO: 3710721 - DNA, 17 bp, Homo sapiens
attttgtaaactcaaaa

SEQ ID NO: 3710722 - DNA, 20 bp, Homo sapiens
attttgtacaaatttgttat

SEQ ID NO: 3710723 - DNA, 23 bp, Homo sapiens
attttgttgctgttttgatttgt

SEQ ID NO: 3710724 - DNA, 22 bp, Homo sapiens
attttgtttttgtcttaaaaag

SEQ ID NO: 3710725 - DNA, 19 bp, Homo sapiens
atttttaaatgtaaaacat

SEQ ID NO: 3710726 - DNA, 16 bp, Homo sapiens
atttttacagaattgc

SEQ ID NO: 3710727 - DNA, 23 bp, Homo sapiens
atttttagatggttacactgtta

SEQ ID NO: 3710728 - DNA, 12 bp, Homo sapiens
atttttatggaa

SEQ ID NO: 3710729 - DNA, 14 bp, Homo sapiens
atttttatggaatt

SEQ ID NO: 3710730 - DNA, 15 bp, Homo sapiens
atttttatggaattt

SEQ ID NO: 3710731 - DNA, 22 bp, Homo sapiens
atttttattatgcataactgac

SEQ ID NO: 3710732 - DNA, 22 bp, Homo sapiens
atttttcattgatatgaaaaat

SEQ ID NO: 3710733 - DNA, 17 bp, Homo sapiens
atttttggattgacagt

SEQ ID NO: 3710734 - DNA, 22 bp, Homo sapiens
atttttggattgacagtaactt

SEQ ID NO: 3710735 - DNA, 17 bp, Homo sapiens
atttttgtttcttccaa

SEQ ID NO: 3710736 - DNA, 20 bp, Homo sapiens
attttttaaagttactttgt

SEQ ID NO: 3710737 - DNA, 16 bp, Homo sapiens
attttttaagtattta

SEQ ID NO: 3710738 - DNA, 17 bp, Homo sapiens
attttttaagtatttat

SEQ ID NO: 3710739 - DNA, 16 bp, Homo sapiens
attttttaattattgt

SEQ ID NO: 3710740 - DNA, 21 bp, Homo sapiens
attttttaatttgatgaaagc

SEQ ID NO: 3710741 - DNA, 22 bp, Homo sapiens
attttttaatttgatgaaagct

SEQ ID NO: 3710742 - DNA, 18 bp, Homo sapiens
attttttagtttgtgatt

SEQ ID NO: 3710743 - DNA, 17 bp, Homo sapiens
attttttattcttgtga

SEQ ID NO: 3710744 - DNA, 21 bp, Homo sapiens
attttttcgtgcactctgcta

SEQ ID NO: 3710745 - DNA, 13 bp, Homo sapiens
atttttttctacc

SEQ ID NO: 3710746 - DNA, 19 bp, Homo sapiens
attttttttttaaattatt

SEQ ID NO: 3710747 - DNA, 15 bp, Homo sapiens
caaaaaaaatttaaa

SEQ ID NO: 3710748 - DNA, 17 bp, Homo sapiens
caaaaaaaatttaaaaa

SEQ ID NO: 3710749 - DNA, 16 bp, Homo sapiens
caaaaaattagccggg

SEQ ID NO: 3710750 - DNA, 16 bp, Homo sapiens
caaaaacagcctcaca

SEQ ID NO: 3710751 - DNA, 20 bp, Homo sapiens
caaaaagggaaactattgtc

SEQ ID NO: 3710752 - DNA, 19 bp, Homo sapiens
caaaaatactctaattcta

SEQ ID NO: 3710753 - DNA, 11 bp, Homo sapiens
caaaaattatc

SEQ ID NO: 3710754 - DNA, 23 bp, Homo sapiens
caaaaattatctatttgtatata

SEQ ID NO: 3710755 - DNA, 11 bp, Homo sapiens
caaaaattttt

SEQ ID NO: 3710756 - DNA, 15 bp, Homo sapiens
caagagcagaggcag

SEQ ID NO: 3710757 - DNA, 20 bp, Homo sapiens
caagagcagcctgtggcatc

SEQ ID NO: 3710758 - DNA, 13 bp, Homo sapiens
caagagccacagt

SEQ ID NO: 3710759 - DNA, 18 bp, Homo sapiens
caagagccttggtgtcca

SEQ ID NO: 3710760 - DNA, 14 bp, Homo sapiens
caagagggcactgg

SEQ ID NO: 3710761 - DNA, 18 bp, Homo sapiens
caagagggcactggtggc

SEQ ID NO: 3710762 - DNA, 20 bp, Homo sapiens
caagagggcactggtggccc

SEQ ID NO: 3710763 - DNA, 16 bp, Homo sapiens
caagagggtctgagga

SEQ ID NO: 3710764 - DNA, 17 bp, Homo sapiens
caagagggtctgaggaa

SEQ ID NO: 3710765 - DNA, 14 bp, Homo sapiens
caagagtgattctt

SEQ ID NO: 3710766 - DNA, 16 bp, Homo sapiens
caagagtgattcttgc

SEQ ID NO: 3710767 - DNA, 19 bp, Homo sapiens
caagagtgattcttgctgc

SEQ ID NO: 3710768 - DNA, 13 bp, Homo sapiens
caagatacttttt

SEQ ID NO: 3710769 - DNA, 19 bp, Homo sapiens
caagatcctgtctttaagg

SEQ ID NO: 3710770 - DNA, 13 bp, Homo sapiens
caagatctttcag

SEQ ID NO: 3710771 - DNA, 15 bp, Homo sapiens
caagatctttcagga

SEQ ID NO: 3710772 - DNA, 21 bp, Homo sapiens
caagatgtcctccttgttcta

SEQ ID NO: 3710773 - DNA, 14 bp, Homo sapiens
caagattaaatgta

SEQ ID NO: 3710774 - DNA, 13 bp, Homo sapiens
caagattcccaga

SEQ ID NO: 3710775 - DNA, 14 bp, Homo sapiens
caagattcccagag

SEQ ID NO: 3710776 - DNA, 16 bp, Homo sapiens
caagattcccagagac

SEQ ID NO: 3710777 - DNA, 16 bp, Homo sapiens
caagcaaaaggagaga

SEQ ID NO: 3710778 - DNA, 14 bp, Homo sapiens
caagcaaatgttac

SEQ ID NO: 3710779 - DNA, 15 bp, Homo sapiens
caagcaaatgttaca

SEQ ID NO: 3710780 - DNA, 13 bp, Homo sapiens
caagcaagaaaca

SEQ ID NO: 3710781 - DNA, 18 bp, Homo sapiens
caagcaagaaacactggg

SEQ ID NO: 3710782 - DNA, 16 bp, Homo sapiens
caagcaccagggaaga

SEQ ID NO: 3710783 - DNA, 12 bp, Homo sapiens
caagcaggaagc

SEQ ID NO: 3710784 - DNA, 14 bp, Homo sapiens
caagcaggaagctc

SEQ ID NO: 3710785 - DNA, 15 bp, Homo sapiens
caagcaggaagctca

SEQ ID NO: 3710786 - DNA, 21 bp, Homo sapiens
caagcaggaagctcagactgg

SEQ ID NO: 3710787 - DNA, 14 bp, Homo sapiens
caagcatctcctga

SEQ ID NO: 3710788 - DNA, 17 bp, Homo sapiens
caagcatctcctgagga

SEQ ID NO: 3710789 - DNA, 18 bp, Homo sapiens
caagccaacgacaaagcc

SEQ ID NO: 3710790 - DNA, 16 bp, Homo sapiens
caagccaagcagccaa

SEQ ID NO: 3710791 - DNA, 21 bp, Homo sapiens
caagccaagcagccaagctcc

SEQ ID NO: 3710792 - DNA, 13 bp, Homo sapiens
caagccccatcct

SEQ ID NO: 3710793 - DNA, 15 bp, Homo sapiens
caagccgtggcttcc

SEQ ID NO: 3710794 - DNA, 16 bp, Homo sapiens
caagccgtggcttccc

SEQ ID NO: 3710795 - DNA, 21 bp, Homo sapiens
caagcctgaccacgctttcta

SEQ ID NO: 3710796 - DNA, 20 bp, Homo sapiens
caagcgattcttctgcttca

SEQ ID NO: 3710797 - DNA, 18 bp, Homo sapiens
caagcgtgagccactgca

SEQ ID NO: 3710798 - DNA, 19 bp, Homo sapiens
caagctaataaaatatcat

SEQ ID NO: 3710799 - DNA, 17 bp, Homo sapiens
caagctaggtgctaatt

SEQ ID NO: 3710800 - DNA, 12 bp, Homo sapiens
caagctcacagt

SEQ ID NO: 3710801 - DNA, 16 bp, Homo sapiens
caagctcacagttcct

SEQ ID NO: 3710802 - DNA, 19 bp, Homo sapiens
caagctcacagttcctcgc

SEQ ID NO: 3710803 - DNA, 22 bp, Homo sapiens
caagctccttgggaggccccac

SEQ ID NO: 3710804 - DNA, 16 bp, Homo sapiens
caagctctgctcctct

SEQ ID NO: 3710805 - DNA, 21 bp, Homo sapiens
caagctgcaccctcaggcagg

SEQ ID NO: 3710806 - DNA, 12 bp, Homo sapiens
caagctgcctcc

SEQ ID NO: 3710807 - DNA, 19 bp, Homo sapiens
caagctgcctccctgtcca

SEQ ID NO: 3710808 - DNA, 19 bp, Homo sapiens
caagctggtcccactcagt

SEQ ID NO: 3710809 - DNA, 14 bp, Homo sapiens
caagctgttttctt

SEQ ID NO: 3710810 - DNA, 14 bp, Homo sapiens
caagcttttttatt

SEQ ID NO: 3710811 - DNA, 15 bp, Homo sapiens
caagcttttttattt

SEQ ID NO: 3710812 - DNA, 13 bp, Homo sapiens
caaggaaggaaag

SEQ ID NO: 3710813 - DNA, 18 bp, Homo sapiens
caaggaaggaaagaaaga

SEQ ID NO: 3710814 - DNA, 18 bp, Homo sapiens
caaggaatgcctgtgcca

SEQ ID NO: 3710815 - DNA, 19 bp, Homo sapiens
caaggaatgcctgtgccaa

SEQ ID NO: 3710816 - DNA, 23 bp, Homo sapiens
caaggacaaagtctccagcccac

SEQ ID NO: 3710817 - DNA, 13 bp, Homo sapiens
caaggaccaggac

SEQ ID NO: 3710818 - DNA, 19 bp, Homo sapiens
caaggagaaacagagacag

SEQ ID NO: 3710819 - DNA, 22 bp, Homo sapiens
caaggagaccaagtcctggcta

SEQ ID NO: 3710820 - DNA, 13 bp, Homo sapiens
caaggagctgaga

SEQ ID NO: 3710821 - DNA, 18 bp, Homo sapiens
caaggagctgagaataga

SEQ ID NO: 3710822 - DNA, 20 bp, Homo sapiens
caaggaggaaaaacagacaa

SEQ ID NO: 3710823 - DNA, 18 bp, Homo sapiens
caaggcaaggggtgcctg

SEQ ID NO: 3710824 - DNA, 22 bp, Homo sapiens
caaggccagcaaggtggagtgg

SEQ ID NO: 3710825 - DNA, 15 bp, Homo sapiens
caaggctctgagcaa

SEQ ID NO: 3710826 - DNA, 19 bp, Homo sapiens
caaggctgaccaagagaga

SEQ ID NO: 3710827 - DNA, 23 bp, Homo sapiens
caaggctgaccaagagagaaaga

SEQ ID NO: 3710828 - DNA, 15 bp, Homo sapiens
caaggctgcagtgag

SEQ ID NO: 3710829 - DNA, 22 bp, Homo sapiens
caaggctgcagtgagccgagat

SEQ ID NO: 3710830 - DNA, 16 bp, Homo sapiens
caagggcagtggaggt

SEQ ID NO: 3710831 - DNA, 22 bp, Homo sapiens
caagggcttacacgtggaggaa

SEQ ID NO: 3710832 - DNA, 23 bp, Homo sapiens
caaggggaatgtttgcctctgcc

SEQ ID NO: 3710833 - DNA, 21 bp, Homo sapiens
caaggggacccataggaaatc

SEQ ID NO: 3710834 - DNA, 17 bp, Homo sapiens
caaggggcccaaattct

SEQ ID NO: 3710835 - DNA, 15 bp, Homo sapiens
caaggggtgcctggg

SEQ ID NO: 3710836 - DNA, 17 bp, Homo sapiens
caaggggtttctgtttc

SEQ ID NO: 3710837 - DNA, 21 bp, Homo sapiens
caagggtggcatcccagtggc

SEQ ID NO: 3710838 - DNA, 19 bp, Homo sapiens
caagggttcagagactcag

SEQ ID NO: 3710839 - DNA, 23 bp, Homo sapiens
caaggtgaagatgggaacgcaga

SEQ ID NO: 3710840 - DNA, 15 bp, Homo sapiens
caaggtgcaaatcaa

SEQ ID NO: 3710841 - DNA, 13 bp, Homo sapiens
caaggtggagtgg

SEQ ID NO: 3710842 - DNA, 15 bp, Homo sapiens
caaggtggagtggat

SEQ ID NO: 3710843 - DNA, 12 bp, Homo sapiens
caaggtgggagg

SEQ ID NO: 3710844 - DNA, 23 bp, Homo sapiens
caaggtgggaggattgcttgagc

SEQ ID NO: 3710845 - DNA, 17 bp, Homo sapiens
caaggtgggctgagccc

SEQ ID NO: 3710846 - DNA, 20 bp, Homo sapiens
caaggtgggctgagccctgg

SEQ ID NO: 3710847 - DNA, 23 bp, Homo sapiens
caagtaaatagcaacatgcttca

SEQ ID NO: 3710848 - DNA, 16 bp, Homo sapiens
caagtaagaagacatg

SEQ ID NO: 3710849 - DNA, 13 bp, Homo sapiens
caagtactgctgt

SEQ ID NO: 3710850 - DNA, 14 bp, Homo sapiens
caagtactgctgta

SEQ ID NO: 3710851 - DNA, 17 bp, Homo sapiens
caagtagctttccacat

SEQ ID NO: 3710852 - DNA, 14 bp, Homo sapiens
caagtattctgcct

SEQ ID NO: 3710853 - DNA, 15 bp, Homo sapiens
caagtattctgcctt

SEQ ID NO: 3710854 - DNA, 23 bp, Homo sapiens
caagtattctgcctttgcagaaa

SEQ ID NO: 3710855 - DNA, 19 bp, Homo sapiens
caagtcaaccaatgtagaa

SEQ ID NO: 3710856 - DNA, 17 bp, Homo sapiens
caagtcaagtgaaaaag

SEQ ID NO: 3710857 - DNA, 19 bp, Homo sapiens
caagtcaggcccttatttt

SEQ ID NO: 3710858 - DNA, 16 bp, Homo sapiens
caagtcatgtgcattt

SEQ ID NO: 3710859 - DNA, 17 bp, Homo sapiens
caagtcatgtgcatttc

SEQ ID NO: 3710860 - DNA, 20 bp, Homo sapiens
caagtccaggtcgggctcag

SEQ ID NO: 3710861 - DNA, 21 bp, Homo sapiens
caagtccctgactctctgtga

SEQ ID NO: 3710862 - DNA, 23 bp, Homo sapiens
caagtccctgactctctgtgacc

SEQ ID NO: 3710863 - DNA, 18 bp, Homo sapiens
caagtcctgcctcttaaa

SEQ ID NO: 3710864 - DNA, 15 bp, Homo sapiens
caagtcctggctaca

SEQ ID NO: 3710865 - DNA, 18 bp, Homo sapiens
caagtctctgctggccca

SEQ ID NO: 3710866 - DNA, 23 bp, Homo sapiens
caagtctctgctggcccagccaa

SEQ ID NO: 3710867 - DNA, 19 bp, Homo sapiens
caagtctgtgcctggagct

SEQ ID NO: 3710868 - DNA, 14 bp, Homo sapiens
caagtcttccctga

SEQ ID NO: 3710869 - DNA, 19 bp, Homo sapiens
cacatcagctagcaaaaga

SEQ ID NO: 3710870 - DNA, 21 bp, Homo sapiens
cacatccaggcaatggcctaa

SEQ ID NO: 3710871 - DNA, 18 bp, Homo sapiens
cacatccccgctggctgg

SEQ ID NO: 3710872 - DNA, 22 bp, Homo sapiens
cacatctcctccatactcagga

SEQ ID NO: 3710873 - DNA, 13 bp, Homo sapiens
cacatctgcattt

SEQ ID NO: 3710874 - DNA, 20 bp, Homo sapiens
cacatcttgctctgctgaca

SEQ ID NO: 3710875 - DNA, 21 bp, Homo sapiens
cacatcttgctctgctgacag

SEQ ID NO: 3710876 - DNA, 22 bp, Homo sapiens
cacatcttgctctgctgacaga

SEQ ID NO: 3710877 - DNA, 18 bp, Homo sapiens
cacatctttcacacttcc

SEQ ID NO: 3710878 - DNA, 19 bp, Homo sapiens
cacatctttcacacttcca

SEQ ID NO: 3710879 - DNA, 14 bp, Homo sapiens
cacatgtgcacatg

SEQ ID NO: 3710880 - DNA, 18 bp, Homo sapiens
cacattaatatttgctga

SEQ ID NO: 3710881 - DNA, 17 bp, Homo sapiens
cacattatcgggagcag

SEQ ID NO: 3710882 - DNA, 14 bp, Homo sapiens
cacattatttgcat

SEQ ID NO: 3710883 - DNA, 15 bp, Homo sapiens
cacattatttgcatg

SEQ ID NO: 3710884 - DNA, 21 bp, Homo sapiens
cacattgccagtgacatgaga

SEQ ID NO: 3710885 - DNA, 17 bp, Homo sapiens
cacatttattctgctca

SEQ ID NO: 3710886 - DNA, 16 bp, Homo sapiens
cacatttttaaagctt

SEQ ID NO: 3710887 - DNA, 19 bp, Homo sapiens
cacatttttttttttaatt

SEQ ID NO: 3710888 - DNA, 19 bp, Homo sapiens
caccaacccatcagaagga

SEQ ID NO: 3710889 - DNA, 19 bp, Homo sapiens
caccaactggccctcttct

SEQ ID NO: 3710890 - DNA, 13 bp, Homo sapiens
caccaagctgctg

SEQ ID NO: 3710891 - DNA, 23 bp, Homo sapiens
caccaagttggaacatccttgga

SEQ ID NO: 3710892 - DNA, 18 bp, Homo sapiens
caccacatcctccgtcca

SEQ ID NO: 3710893 - DNA, 14 bp, Homo sapiens
caccaccaggtctc

SEQ ID NO: 3710894 - DNA, 14 bp, Homo sapiens
caccaccccagctg

SEQ ID NO: 3710895 - DNA, 16 bp, Homo sapiens
caccaccccagctgct

SEQ ID NO: 3710896 - DNA, 23 bp, Homo sapiens
caccacctaggccactcctccaa

SEQ ID NO: 3710897 - DNA, 12 bp, Homo sapiens
caccacctctcc

SEQ ID NO: 3710898 - DNA, 14 bp, Homo sapiens
caccaccttcccag

SEQ ID NO: 3710899 - DNA, 19 bp, Homo sapiens
caccaccttcccagctctc

SEQ ID NO: 3710900 - DNA, 13 bp, Homo sapiens
caccactgcactc

SEQ ID NO: 3710901 - DNA, 22 bp, Homo sapiens
caccagagcccaccttggctca

SEQ ID NO: 3710902 - DNA, 12 bp, Homo sapiens
caccagcagcct

SEQ ID NO: 3710903 - DNA, 16 bp, Homo sapiens
caccagccccagtgcc

SEQ ID NO: 3710904 - DNA, 22 bp, Homo sapiens
caccagccccagtgcccacagg

SEQ ID NO: 3710905 - DNA, 17 bp, Homo sapiens
caccaggaatgttaaag

SEQ ID NO: 3710906 - DNA, 21 bp, Homo sapiens
caccaggaatgttaaagtcag

SEQ ID NO: 3710907 - DNA, 17 bp, Homo sapiens
caccaggagtccctggt

SEQ ID NO: 3710908 - DNA, 18 bp, Homo sapiens
caccagttcctttcaatg

SEQ ID NO: 3710909 - DNA, 17 bp, Homo sapiens
caccatcatgtctggct

SEQ ID NO: 3710910 - DNA, 18 bp, Homo sapiens
caccatctcaggccacct

SEQ ID NO: 3710911 - DNA, 20 bp, Homo sapiens
caccatctcaggccacctgc

SEQ ID NO: 3710912 - DNA, 19 bp, Homo sapiens
caccatgtttgagctcaga

SEQ ID NO: 3710913 - DNA, 23 bp, Homo sapiens
caccatgtttgagctcagacccc

SEQ ID NO: 3710914 - DNA, 17 bp, Homo sapiens
caccattgctgctcctt

SEQ ID NO: 3710915 - DNA, 15 bp, Homo sapiens
cacccaccagggcga

SEQ ID NO: 3710916 - DNA, 22 bp, Homo sapiens
cacccaccatcatgtctggcta

SEQ ID NO: 3710917 - DNA, 16 bp, Homo sapiens
cacccacctcagcctc

SEQ ID NO: 3710918 - DNA, 16 bp, Homo sapiens
cacccagacagctccc

SEQ ID NO: 3710919 - DNA, 10 bp, Homo sapiens
cacccagccc

SEQ ID NO: 3710920 - DNA, 11 bp, Homo sapiens
cacccagccca

SEQ ID NO: 3710921 - DNA, 23 bp, Homo sapiens
cacccagcccattctctctcctg

SEQ ID NO: 3710922 - DNA, 20 bp, Homo sapiens
cacccaggagccccgaggcc

SEQ ID NO: 3710923 - DNA, 23 bp, Homo sapiens
cacccaggagccccgaggccttc

SEQ ID NO: 3710924 - DNA, 24 bp, Homo sapiens
cacccaggagccccgaggccttct

SEQ ID NO: 3710925 - DNA, 14 bp, Homo sapiens
cacccatcctagag

SEQ ID NO: 3710926 - DNA, 15 bp, Homo sapiens
cacccatgaagacag

SEQ ID NO: 3710927 - DNA, 12 bp, Homo sapiens
caccccacactt

SEQ ID NO: 3710928 - DNA, 22 bp, Homo sapiens
caccccacccccttcagtgccc

SEQ ID NO: 3710929 - DNA, 19 bp, Homo sapiens
caccccagcctaagatgaa

SEQ ID NO: 3710930 - DNA, 18 bp, Homo sapiens
caccccagctgctcccct

SEQ ID NO: 3710931 - DNA, 12 bp, Homo sapiens
caccccatgcca

SEQ ID NO: 3710932 - DNA, 19 bp, Homo sapiens
cacccccaaggggcagtct

SEQ ID NO: 3710933 - DNA, 17 bp, Homo sapiens
cacccccatctctccct

SEQ ID NO: 3710934 - DNA, 19 bp, Homo sapiens
caccccccagaacctgtcc

SEQ ID NO: 3710935 - DNA, 20 bp, Homo sapiens
caccccccagaacctgtcct

SEQ ID NO: 3710936 - DNA, 21 bp, Homo sapiens
caccccccagaacctgtcctt

SEQ ID NO: 3710937 - DNA, 12 bp, Homo sapiens
cacccccctcat

SEQ ID NO: 3710938 - DNA, 13 bp, Homo sapiens
cacccccctgggc

SEQ ID NO: 3710939 - DNA, 16 bp, Homo sapiens
cacccccgcctccctc

SEQ ID NO: 3710940 - DNA, 14 bp, Homo sapiens
caccccctccccag

SEQ ID NO: 3710941 - DNA, 15 bp, Homo sapiens
caccccctccccagg

SEQ ID NO: 3710942 - DNA, 17 bp, Homo sapiens
caccccctccccagggg

SEQ ID NO: 3710943 - DNA, 21 bp, Homo sapiens
cacccccttcagtgcccacca

SEQ ID NO: 3710944 - DNA, 13 bp, Homo sapiens
cacccccttctct

SEQ ID NO: 3710945 - DNA, 22 bp, Homo sapiens
cacccccttctctgcccattcc

SEQ ID NO: 3710946 - DNA, 16 bp, Homo sapiens
cacccccttctctgct

SEQ ID NO: 3710947 - DNA, 22 bp, Homo sapiens
caccccgtctggggttcagccc

SEQ ID NO: 3710948 - DNA, 22 bp, Homo sapiens
cacccctcccctgccctagagc

SEQ ID NO: 3710949 - DNA, 15 bp, Homo sapiens
cacccctgccctggg

SEQ ID NO: 3710950 - DNA, 11 bp, Homo sapiens
caccccttccc

SEQ ID NO: 3710951 - DNA, 13 bp, Homo sapiens
caccccttcccca

SEQ ID NO: 3710952 - DNA, 14 bp, Homo sapiens
cacccgactcctca

SEQ ID NO: 3710953 - DNA, 15 bp, Homo sapiens
cacccgactcctcaa

SEQ ID NO: 3710954 - DNA, 16 bp, Homo sapiens
cacccgactcctcaaa

SEQ ID NO: 3710955 - DNA, 12 bp, Homo sapiens
cacccgaggctg

SEQ ID NO: 3710956 - DNA, 17 bp, Homo sapiens
cacccgaggctgcccac

SEQ ID NO: 3710957 - DNA, 12 bp, Homo sapiens
cacccggcccct

SEQ ID NO: 3710958 - DNA, 16 bp, Homo sapiens
cacccggcccctgctg

SEQ ID NO: 3710959 - DNA, 18 bp, Homo sapiens
caccctagtcccttcccc

SEQ ID NO: 3710960 - DNA, 14 bp, Homo sapiens
caccctcaggcagg

SEQ ID NO: 3710961 - DNA, 24 bp, Homo sapiens
caccctcgaagcgcgccactcgct

SEQ ID NO: 3710962 - DNA, 17 bp, Homo sapiens
caccctgatttcttgct

SEQ ID NO: 3710963 - DNA, 13 bp, Homo sapiens
caccctgtcaagt

SEQ ID NO: 3710964 - DNA, 17 bp, Homo sapiens
caccctgtcaagttaac

SEQ ID NO: 3710965 - DNA, 13 bp, Homo sapiens
cacccttcccctc

SEQ ID NO: 3710966 - DNA, 14 bp, Homo sapiens
cacccttcccctcc

SEQ ID NO: 3710967 - DNA, 23 bp, Homo sapiens
cacccttcccctccttctccctt

SEQ ID NO: 3710968 - DNA, 19 bp, Homo sapiens
cacccttggaggctgtctt

SEQ ID NO: 3710969 - DNA, 22 bp, Homo sapiens
cacccttggaggctgtcttctc

SEQ ID NO: 3710970 - DNA, 21 bp, Homo sapiens
cacccttggcctgtctcatcc

SEQ ID NO: 3710971 - DNA, 21 bp, Homo sapiens
caccgctccccagcccagggt

SEQ ID NO: 3710972 - DNA, 22 bp, Homo sapiens
caccgctgcctaagtggctgct

SEQ ID NO: 3710973 - DNA, 22 bp, Homo sapiens
caccggagctttcaaagaagga

SEQ ID NO: 3710974 - DNA, 15 bp, Homo sapiens
caccggatcctgggt

SEQ ID NO: 3710975 - DNA, 21 bp, Homo sapiens
caccggatcctgggtggtctg

SEQ ID NO: 3710976 - DNA, 15 bp, Homo sapiens
caccgggccacagag

SEQ ID NO: 3710977 - DNA, 18 bp, Homo sapiens
caccggttgcttctggga

SEQ ID NO: 3710978 - DNA, 21 bp, Homo sapiens
caccggttgcttctgggaagg

SEQ ID NO: 3710979 - DNA, 19 bp, Homo sapiens
caccgtaaagtgagcatgc

SEQ ID NO: 3710980 - DNA, 21 bp, Homo sapiens
caccgttggggattggggaag

SEQ ID NO: 3710981 - DNA, 18 bp, Homo sapiens
cacctaccttcaaagctg

SEQ ID NO: 3710982 - DNA, 16 bp, Homo sapiens
cactagcctctccagg

SEQ ID NO: 3710983 - DNA, 13 bp, Homo sapiens
cactaggctgggt

SEQ ID NO: 3710984 - DNA, 18 bp, Homo sapiens
cactaggctgggtgccca

SEQ ID NO: 3710985 - DNA, 21 bp, Homo sapiens
cactaggctgggtgcccacag

SEQ ID NO: 3710986 - DNA, 20 bp, Homo sapiens
cactagtctgtgtgctgtgg

SEQ ID NO: 3710987 - DNA, 21 bp, Homo sapiens
cactagtctgtgtgctgtggt

SEQ ID NO: 3710988 - DNA, 19 bp, Homo sapiens
cactataaatggtgttttt

SEQ ID NO: 3710989 - DNA, 21 bp, Homo sapiens
cactatagcctaggtgacaga

SEQ ID NO: 3710990 - DNA, 15 bp, Homo sapiens
cactatgcattttaa

SEQ ID NO: 3710991 - DNA, 19 bp, Homo sapiens
cactatgttgcccaggcag

SEQ ID NO: 3710992 - DNA, 19 bp, Homo sapiens
cactatttatctgtgcaaa

SEQ ID NO: 3710993 - DNA, 20 bp, Homo sapiens
cactattttcagaatctgaa

SEQ ID NO: 3710994 - DNA, 17 bp, Homo sapiens
cactatttttatttata

SEQ ID NO: 3710995 - DNA, 15 bp, Homo sapiens
cactcaaaagctggg

SEQ ID NO: 3710996 - DNA, 17 bp, Homo sapiens
cactcaaaagctgggca

SEQ ID NO: 3710997 - DNA, 18 bp, Homo sapiens
cactcaaaagctgggcag

SEQ ID NO: 3710998 - DNA, 19 bp, Homo sapiens
cactcaaaagctgggcagg

SEQ ID NO: 3710999 - DNA, 15 bp, Homo sapiens
cactcaagccaagca

SEQ ID NO: 3711000 - DNA, 19 bp, Homo sapiens
cactcaagttcaaggacca

SEQ ID NO: 3711001 - DNA, 19 bp, Homo sapiens
cactcacatttattctgct

SEQ ID NO: 3711002 - DNA, 16 bp, Homo sapiens
cactcagaagacactg

SEQ ID NO: 3711003 - DNA, 18 bp, Homo sapiens
cactcagaagacactgat

SEQ ID NO: 3711004 - DNA, 22 bp, Homo sapiens
cactcagaagacactgatgggc

SEQ ID NO: 3711005 - DNA, 19 bp, Homo sapiens
cactcaggaggctgaggca

SEQ ID NO: 3711006 - DNA, 21 bp, Homo sapiens
cactcaggaggctgaggcagg

SEQ ID NO: 3711007 - DNA, 16 bp, Homo sapiens
cactccaatctgggtg

SEQ ID NO: 3711008 - DNA, 11 bp, Homo sapiens
cactccaccac

SEQ ID NO: 3711009 - DNA, 17 bp, Homo sapiens
cactccagacccctggc

SEQ ID NO: 3711010 - DNA, 16 bp, Homo sapiens
cactccagcctgggcg

SEQ ID NO: 3711011 - DNA, 13 bp, Homo sapiens
cactcccctgcac

SEQ ID NO: 3711012 - DNA, 14 bp, Homo sapiens
cactcccttctcct

SEQ ID NO: 3711013 - DNA, 17 bp, Homo sapiens
cactcctaggacatgtt

SEQ ID NO: 3711014 - DNA, 10 bp, Homo sapiens
cactcctggg

SEQ ID NO: 3711015 - DNA, 11 bp, Homo sapiens
cactccttcct

SEQ ID NO: 3711016 - DNA, 15 bp, Homo sapiens
cactccttcctgcca

SEQ ID NO: 3711017 - DNA, 20 bp, Homo sapiens
cactcgcttcccccatagcc

SEQ ID NO: 3711018 - DNA, 22 bp, Homo sapiens
cactcgtgtgcaacagacaagt

SEQ ID NO: 3711019 - DNA, 19 bp, Homo sapiens
cactctaccctcccacccc

SEQ ID NO: 3711020 - DNA, 13 bp, Homo sapiens
cactctcctgggc

SEQ ID NO: 3711021 - DNA, 14 bp, Homo sapiens
cactctcctgggcc

SEQ ID NO: 3711022 - DNA, 21 bp, Homo sapiens
cactctcctgggcccctccct

SEQ ID NO: 3711023 - DNA, 17 bp, Homo sapiens
cactctgcctctgcctg

SEQ ID NO: 3711024 - DNA, 20 bp, Homo sapiens
cactctgcctctgcctgcat

SEQ ID NO: 3711025 - DNA, 21 bp, Homo sapiens
cactctgctttgactgagcag

SEQ ID NO: 3711026 - DNA, 19 bp, Homo sapiens
cactcttattgcccacgct

SEQ ID NO: 3711027 - DNA, 21 bp, Homo sapiens
cactcttattgcccacgctgg

SEQ ID NO: 3711028 - DNA, 12 bp, Homo sapiens
cactctttgtaa

SEQ ID NO: 3711029 - DNA, 16 bp, Homo sapiens
cactgaaatatacaca

SEQ ID NO: 3711030 - DNA, 20 bp, Homo sapiens
cactgaaatatacacacagc

SEQ ID NO: 3711031 - DNA, 21 bp, Homo sapiens
cactgaaatgccttactttgt

SEQ ID NO: 3711032 - DNA, 22 bp, Homo sapiens
cactgaaatgccttactttgta

SEQ ID NO: 3711033 - DNA, 14 bp, Homo sapiens
cactgaagatagaa

SEQ ID NO: 3711034 - DNA, 20 bp, Homo sapiens
cactgaaggctttcagggcc

SEQ ID NO: 3711035 - DNA, 17 bp, Homo sapiens
cactgacagcctcccac

SEQ ID NO: 3711036 - DNA, 14 bp, Homo sapiens
cactgactcctgtg

SEQ ID NO: 3711037 - DNA, 19 bp, Homo sapiens
cactgaggcagggaagtcc

SEQ ID NO: 3711038 - DNA, 24 bp, Homo sapiens
cactgatctctactaccacaagga

SEQ ID NO: 3711039 - DNA, 14 bp, Homo sapiens
cactgatttggaga

SEQ ID NO: 3711040 - DNA, 14 bp, Homo sapiens
cactgcaacctccg

SEQ ID NO: 3711041 - DNA, 16 bp, Homo sapiens
cactgcaagagccttg

SEQ ID NO: 3711042 - DNA, 23 bp, Homo sapiens
cactgcacagtgcatctcagccc

SEQ ID NO: 3711043 - DNA, 18 bp, Homo sapiens
cactgcactatagcctag

SEQ ID NO: 3711044 - DNA, 12 bp, Homo sapiens
cactgcactcca

SEQ ID NO: 3711045 - DNA, 12 bp, Homo sapiens
cactgcagcctc

SEQ ID NO: 3711046 - DNA, 14 bp, Homo sapiens
cactgcagcctcaa

SEQ ID NO: 3711047 - DNA, 21 bp, Homo sapiens
cactgcagcctcaacctcctg

SEQ ID NO: 3711048 - DNA, 22 bp, Homo sapiens
cactgcagcctcaacctcctgg

SEQ ID NO: 3711049 - DNA, 16 bp, Homo sapiens
cactgcataccaacct

SEQ ID NO: 3711050 - DNA, 17 bp, Homo sapiens
cactgccatggaggcac

SEQ ID NO: 3711051 - DNA, 19 bp, Homo sapiens
cactgcccgagctggtgca

SEQ ID NO: 3711052 - DNA, 21 bp, Homo sapiens
cactgcccgagctggtgcatt

SEQ ID NO: 3711053 - DNA, 12 bp, Homo sapiens
cactgccctctg

SEQ ID NO: 3711054 - DNA, 16 bp, Homo sapiens
cactgcctctccctgg

SEQ ID NO: 3711055 - DNA, 19 bp, Homo sapiens
cactgcctctccctggccc

SEQ ID NO: 3711056 - DNA, 20 bp, Homo sapiens
cactgcctctccctggccct

SEQ ID NO: 3711057 - DNA, 15 bp, Homo sapiens
cactgcctgcccacc

SEQ ID NO: 3711058 - DNA, 23 bp, Homo sapiens
cactgctaggtgggccagcccct

SEQ ID NO: 3711059 - DNA, 13 bp, Homo sapiens
cactgctcacact

SEQ ID NO: 3711060 - DNA, 15 bp, Homo sapiens
cactgctgcccagcc

SEQ ID NO: 3711061 - DNA, 17 bp, Homo sapiens
cactgctgcccagcctc

SEQ ID NO: 3711062 - DNA, 12 bp, Homo sapiens
cactgctggctg

SEQ ID NO: 3711063 - DNA, 14 bp, Homo sapiens
cactgctggctgcc

SEQ ID NO: 3711064 - DNA, 15 bp, Homo sapiens
cactgctggctgcct

SEQ ID NO: 3711065 - DNA, 16 bp, Homo sapiens
cactgctggctgcctt

SEQ ID NO: 3711066 - DNA, 17 bp, Homo sapiens
cactgctgtgaacaagt

SEQ ID NO: 3711067 - DNA, 21 bp, Homo sapiens
cactgcttttggtctgtgtga

SEQ ID NO: 3711068 - DNA, 16 bp, Homo sapiens
cactggagcaccaggc

SEQ ID NO: 3711069 - DNA, 15 bp, Homo sapiens
cactggagcccagga

SEQ ID NO: 3711070 - DNA, 15 bp, Homo sapiens
cactggcagccccag

SEQ ID NO: 3711071 - DNA, 16 bp, Homo sapiens
cactggcatctttgct

SEQ ID NO: 3711072 - DNA, 14 bp, Homo sapiens
cactggctgtgggc

SEQ ID NO: 3711073 - DNA, 20 bp, Homo sapiens
cactggctgtgggctccctt

SEQ ID NO: 3711074 - DNA, 21 bp, Homo sapiens
cactggggaaataacagctgt

SEQ ID NO: 3711075 - DNA, 15 bp, Homo sapiens
cactgggggagggga

SEQ ID NO: 3711076 - DNA, 21 bp, Homo sapiens
cactgggggaggggacattga

SEQ ID NO: 3711077 - DNA, 18 bp, Homo sapiens
cactggggtcctggggcc

SEQ ID NO: 3711078 - DNA, 23 bp, Homo sapiens
cactgggtggggtgaggaccact

SEQ ID NO: 3711079 - DNA, 21 bp, Homo sapiens
cactggtggcccgacagcctg

SEQ ID NO: 3711080 - DNA, 23 bp, Homo sapiens
cactggtgtgagggcccctgcct

SEQ ID NO: 3711081 - DNA, 18 bp, Homo sapiens
cactgtattacataaata

SEQ ID NO: 3711082 - DNA, 19 bp, Homo sapiens
cactgtcactgtttctctg

SEQ ID NO: 3711083 - DNA, 22 bp, Homo sapiens
cactgtcactgtttctctgctg

SEQ ID NO: 3711084 - DNA, 12 bp, Homo sapiens
cactgtctcagt

SEQ ID NO: 3711085 - DNA, 16 bp, Homo sapiens
cactgtgccatgtgcc

SEQ ID NO: 3711086 - DNA, 16 bp, Homo sapiens
cactgtgggactcttc

SEQ ID NO: 3711087 - DNA, 13 bp, Homo sapiens
cactgttagaaca

SEQ ID NO: 3711088 - DNA, 16 bp, Homo sapiens
cactgttagaacacta

SEQ ID NO: 3711089 - DNA, 18 bp, Homo sapiens
cactgttagaacactatt

SEQ ID NO: 3711090 - DNA, 15 bp, Homo sapiens
cactgttatcaaaac

SEQ ID NO: 3711091 - DNA, 23 bp, Homo sapiens
cacttaaatatcaatcattttcc

SEQ ID NO: 3711092 - DNA, 13 bp, Homo sapiens
cacttaagactgt

SEQ ID NO: 3711093 - DNA, 13 bp, Homo sapiens
cacttaccttcaa

SEQ ID NO: 3711094 - DNA, 17 bp, Homo sapiens
cacttaccttcaataaa

SEQ ID NO: 3711095 - DNA, 17 bp, Homo sapiens
cagaccattgtctcaga

SEQ ID NO: 3711096 - DNA, 15 bp, Homo sapiens
cagaccccagcggct

SEQ ID NO: 3711097 - DNA, 13 bp, Homo sapiens
cagacccccaccc

SEQ ID NO: 3711098 - DNA, 19 bp, Homo sapiens
cagacccccaccccttccc

SEQ ID NO: 3711099 - DNA, 20 bp, Homo sapiens
cagacccccaccccttcccc

SEQ ID NO: 3711100 - DNA, 22 bp, Homo sapiens
cagacccccaccccttccccac

SEQ ID NO: 3711101 - DNA, 14 bp, Homo sapiens
cagacccccactct

SEQ ID NO: 3711102 - DNA, 17 bp, Homo sapiens
cagacccccagcaaccc

SEQ ID NO: 3711103 - DNA, 16 bp, Homo sapiens
cagacccctctggcca

SEQ ID NO: 3711104 - DNA, 15 bp, Homo sapiens
cagaccctaccccac

SEQ ID NO: 3711105 - DNA, 16 bp, Homo sapiens
cagaccctaccccacc

SEQ ID NO: 3711106 - DNA, 16 bp, Homo sapiens
cagacctgtcttccaa

SEQ ID NO: 3711107 - DNA, 15 bp, Homo sapiens
cagacgccttactgg

SEQ ID NO: 3711108 - DNA, 17 bp, Homo sapiens
cagacggcacccaccca

SEQ ID NO: 3711109 - DNA, 19 bp, Homo sapiens
cagactcatacagaaggtg

SEQ ID NO: 3711110 - DNA, 21 bp, Homo sapiens
cagactcatacagaaggtggg

SEQ ID NO: 3711111 - DNA, 21 bp, Homo sapiens
cagactcctgtgcaactttcc

SEQ ID NO: 3711112 - DNA, 17 bp, Homo sapiens
cagactctacagaggcc

SEQ ID NO: 3711113 - DNA, 20 bp, Homo sapiens
cagactctacagaggccatg

SEQ ID NO: 3711114 - DNA, 16 bp, Homo sapiens
cagactggcctgagga

SEQ ID NO: 3711115 - DNA, 15 bp, Homo sapiens
cagactggtgagcag

SEQ ID NO: 3711116 - DNA, 23 bp, Homo sapiens
cagactggttgagttcaggtagc

SEQ ID NO: 3711117 - DNA, 20 bp, Homo sapiens
cagacttctccagacccacc

SEQ ID NO: 3711118 - DNA, 13 bp, Homo sapiens
cagacttgagaac

SEQ ID NO: 3711119 - DNA, 20 bp, Homo sapiens
cagagaagccaaaagattgg

SEQ ID NO: 3711120 - DNA, 16 bp, Homo sapiens
cagagaaggcagcagg

SEQ ID NO: 3711121 - DNA, 11 bp, Homo sapiens
cagagaagttc

SEQ ID NO: 3711122 - DNA, 19 bp, Homo sapiens
cagagaatcatacttagca

SEQ ID NO: 3711123 - DNA, 21 bp, Homo sapiens
cagagaatgaaagggcccaga

SEQ ID NO: 3711124 - DNA, 16 bp, Homo sapiens
cagagaatttctacca

SEQ ID NO: 3711125 - DNA, 13 bp, Homo sapiens
cagagacacctgc

SEQ ID NO: 3711126 - DNA, 17 bp, Homo sapiens
cagagacacctgcacct

SEQ ID NO: 3711127 - DNA, 14 bp, Homo sapiens
cagagacagagagg

SEQ ID NO: 3711128 - DNA, 16 bp, Homo sapiens
cagagacagagaggac

SEQ ID NO: 3711129 - DNA, 13 bp, Homo sapiens
cagagacaggaaa

SEQ ID NO: 3711130 - DNA, 14 bp, Homo sapiens
cagagacaggaaaa

SEQ ID NO: 3711131 - DNA, 23 bp, Homo sapiens
cagagacaggcccaagagatgaa

SEQ ID NO: 3711132 - DNA, 17 bp, Homo sapiens
cagagacgcaggaatgg

SEQ ID NO: 3711133 - DNA, 11 bp, Homo sapiens
cagagagacag

SEQ ID NO: 3711134 - DNA, 21 bp, Homo sapiens
cagagagagaagtgcccctgc

SEQ ID NO: 3711135 - DNA, 22 bp, Homo sapiens
cagagaggagaaacacatcttc

SEQ ID NO: 3711136 - DNA, 22 bp, Homo sapiens
cagagagggggccacctcccca

SEQ ID NO: 3711137 - DNA, 12 bp, Homo sapiens
cagagagggtgg

SEQ ID NO: 3711138 - DNA, 23 bp, Homo sapiens
cagagagggtggtgacctctgcc

SEQ ID NO: 3711139 - DNA, 21 bp, Homo sapiens
cagagatggaggttctctcgg

SEQ ID NO: 3711140 - DNA, 23 bp, Homo sapiens
cagagatggaggttctctcggag

SEQ ID NO: 3711141 - DNA, 19 bp, Homo sapiens
cagagatgggactgggagg

SEQ ID NO: 3711142 - DNA, 16 bp, Homo sapiens
cagagcaaaataattt

SEQ ID NO: 3711143 - DNA, 19 bp, Homo sapiens
cagagcaagcttttttatt

SEQ ID NO: 3711144 - DNA, 20 bp, Homo sapiens
cagagcaagtgagaccctgt

SEQ ID NO: 3711145 - DNA, 13 bp, Homo sapiens
cagagcactgtat

SEQ ID NO: 3711146 - DNA, 16 bp, Homo sapiens
cagagcactgtatacc

SEQ ID NO: 3711147 - DNA, 13 bp, Homo sapiens
cagagccccacac

SEQ ID NO: 3711148 - DNA, 14 bp, Homo sapiens
cagagcctgcagtt

SEQ ID NO: 3711149 - DNA, 20 bp, Homo sapiens
cagagcgagagtctgtctca

SEQ ID NO: 3711150 - DNA, 17 bp, Homo sapiens
cagagcgtccttccccc

SEQ ID NO: 3711151 - DNA, 23 bp, Homo sapiens
cagagctcctccttgtcttggca

SEQ ID NO: 3711152 - DNA, 15 bp, Homo sapiens
cagagctctggagcc

SEQ ID NO: 3711153 - DNA, 23 bp, Homo sapiens
cagagctggaccagtggtgcctt

SEQ ID NO: 3711154 - DNA, 13 bp, Homo sapiens
cagagctgggagg

SEQ ID NO: 3711155 - DNA, 12 bp, Homo sapiens
cagagctgggtg

SEQ ID NO: 3711156 - DNA, 21 bp, Homo sapiens
cagagctgtttatggcctcag

SEQ ID NO: 3711157 - DNA, 22 bp, Homo sapiens
cagaggacacctgtactggaga

SEQ ID NO: 3711158 - DNA, 17 bp, Homo sapiens
cagaggcagaaccctgg

SEQ ID NO: 3711159 - DNA, 12 bp, Homo sapiens
cagaggcagccc

SEQ ID NO: 3711160 - DNA, 19 bp, Homo sapiens
cagaggcagccccattctg

SEQ ID NO: 3711161 - DNA, 16 bp, Homo sapiens
cagaggccatgggcct

SEQ ID NO: 3711162 - DNA, 23 bp, Homo sapiens
cagaggctgcctctcccatcact

SEQ ID NO: 3711163 - DNA, 13 bp, Homo sapiens
cagaggctggagg

SEQ ID NO: 3711164 - DNA, 16 bp, Homo sapiens
cagaggctggcctcag

SEQ ID NO: 3711165 - DNA, 17 bp, Homo sapiens
cagaggctggcctcaga

SEQ ID NO: 3711166 - DNA, 20 bp, Homo sapiens
cagaggcttcttcagatcag

SEQ ID NO: 3711167 - DNA, 23 bp, Homo sapiens
cagagggaggaatcgaggaacca

SEQ ID NO: 3711168 - DNA, 14 bp, Homo sapiens
cagagggagtgaca

SEQ ID NO: 3711169 - DNA, 16 bp, Homo sapiens
cagagggagtgacaga

SEQ ID NO: 3711170 - DNA, 19 bp, Homo sapiens
cagagggagtgacagaggc

SEQ ID NO: 3711171 - DNA, 17 bp, Homo sapiens
cagagggcagaggctgg

SEQ ID NO: 3711172 - DNA, 18 bp, Homo sapiens
cagaggttgcagtgagct

SEQ ID NO: 3711173 - DNA, 14 bp, Homo sapiens
cagagtccaggccc

SEQ ID NO: 3711174 - DNA, 15 bp, Homo sapiens
cagagtccaggcccc

SEQ ID NO: 3711175 - DNA, 17 bp, Homo sapiens
cagagtctcactgttgc

SEQ ID NO: 3711176 - DNA, 15 bp, Homo sapiens
cagagtgagaccctg

SEQ ID NO: 3711177 - DNA, 19 bp, Homo sapiens
cagagtgagactctgtctc

SEQ ID NO: 3711178 - DNA, 16 bp, Homo sapiens
cagagtgccccacctg

SEQ ID NO: 3711179 - DNA, 18 bp, Homo sapiens
cagagtgccccacctgcc

SEQ ID NO: 3711180 - DNA, 20 bp, Homo sapiens
cagagtgccccacctgccac

SEQ ID NO: 3711181 - DNA, 12 bp, Homo sapiens
cagagtggcctg

SEQ ID NO: 3711182 - DNA, 13 bp, Homo sapiens
cagagtggcctgg

SEQ ID NO: 3711183 - DNA, 16 bp, Homo sapiens
cagagtggcctggcca

SEQ ID NO: 3711184 - DNA, 18 bp, Homo sapiens
cagagtggcctggccagg

SEQ ID NO: 3711185 - DNA, 15 bp, Homo sapiens
cagagtggtctttct

SEQ ID NO: 3711186 - DNA, 12 bp, Homo sapiens
cagagttcacta

SEQ ID NO: 3711187 - DNA, 21 bp, Homo sapiens
cagataagaatgctggttttc

SEQ ID NO: 3711188 - DNA, 20 bp, Homo sapiens
cagatacaggaaaagctgct

SEQ ID NO: 3711189 - DNA, 17 bp, Homo sapiens
cagatacatggttgtga

SEQ ID NO: 3711190 - DNA, 19 bp, Homo sapiens
cagatacttggggggctga

SEQ ID NO: 3711191 - DNA, 18 bp, Homo sapiens
cagataggccttcttgtg

SEQ ID NO: 3711192 - DNA, 13 bp, Homo sapiens
cagatatattttt

SEQ ID NO: 3711193 - DNA, 18 bp, Homo sapiens
cagatatatttttcacag

SEQ ID NO: 3711194 - DNA, 15 bp, Homo sapiens
cagatatgatatgta

SEQ ID NO: 3711195 - DNA, 11 bp, Homo sapiens
cagatatttat

SEQ ID NO: 3711196 - DNA, 14 bp, Homo sapiens
cagatatttatatt

SEQ ID NO: 3711197 - DNA, 15 bp, Homo sapiens
cagatattttttcag

SEQ ID NO: 3711198 - DNA, 20 bp, Homo sapiens
cagatattttttcagaaata

SEQ ID NO: 3711199 - DNA, 12 bp, Homo sapiens
cagatcccagct

SEQ ID NO: 3711200 - DNA, 16 bp, Homo sapiens
cagatctccaaagctt

SEQ ID NO: 3711201 - DNA, 17 bp, Homo sapiens
cagatctggtcccttgc

SEQ ID NO: 3711202 - DNA, 14 bp, Homo sapiens
cagatctgtgcccc

SEQ ID NO: 3711203 - DNA, 20 bp, Homo sapiens
cagatctgtgccccatgcct

SEQ ID NO: 3711204 - DNA, 21 bp, Homo sapiens
cagatctgtgccccatgcctg

SEQ ID NO: 3711205 - DNA, 22 bp, Homo sapiens
cagatgaactctttctggcctg

SEQ ID NO: 3711206 - DNA, 23 bp, Homo sapiens
cagatgaactctttctggcctgc

SEQ ID NO: 3711207 - DNA, 14 bp, Homo sapiens
cagatgacccctcc

SEQ ID NO: 3711208 - DNA, 23 bp, Homo sapiens
cagctcttctgccggccctgggg

SEQ ID NO: 3711209 - DNA, 16 bp, Homo sapiens
cagctgacctttgtca

SEQ ID NO: 3711210 - DNA, 20 bp, Homo sapiens
cagctgactgtggccccctc

SEQ ID NO: 3711211 - DNA, 20 bp, Homo sapiens
cagctgaggtctcttgaggg

SEQ ID NO: 3711212 - DNA, 12 bp, Homo sapiens
cagctgatttta

SEQ ID NO: 3711213 - DNA, 17 bp, Homo sapiens
cagctgattttaacaat

SEQ ID NO: 3711214 - DNA, 16 bp, Homo sapiens
cagctgcagctgggct

SEQ ID NO: 3711215 - DNA, 16 bp, Homo sapiens
cagctgccagagaagc

SEQ ID NO: 3711216 - DNA, 19 bp, Homo sapiens
cagctgcccctccctgcca

SEQ ID NO: 3711217 - DNA, 17 bp, Homo sapiens
cagctgccgaccagagc

SEQ ID NO: 3711218 - DNA, 18 bp, Homo sapiens
cagctgccgaccagagcc

SEQ ID NO: 3711219 - DNA, 17 bp, Homo sapiens
cagctgcctcacttcct

SEQ ID NO: 3711220 - DNA, 12 bp, Homo sapiens
cagctgcctgca

SEQ ID NO: 3711221 - DNA, 19 bp, Homo sapiens
cagctgcggtccacccagg

SEQ ID NO: 3711222 - DNA, 13 bp, Homo sapiens
cagctgctcccct

SEQ ID NO: 3711223 - DNA, 18 bp, Homo sapiens
cagctgctcccctccctc

SEQ ID NO: 3711224 - DNA, 20 bp, Homo sapiens
cagctgctcccctccctcct

SEQ ID NO: 3711225 - DNA, 17 bp, Homo sapiens
cagctgctctgcccaga

SEQ ID NO: 3711226 - DNA, 19 bp, Homo sapiens
cagctgctctgcccagagc

SEQ ID NO: 3711227 - DNA, 23 bp, Homo sapiens
cagctgctctgcccagagctggg

SEQ ID NO: 3711228 - DNA, 14 bp, Homo sapiens
cagctggcagcaga

SEQ ID NO: 3711229 - DNA, 20 bp, Homo sapiens
cagctgtaagaagagactgg

SEQ ID NO: 3711230 - DNA, 14 bp, Homo sapiens
cagctgtccctgtc

SEQ ID NO: 3711231 - DNA, 20 bp, Homo sapiens
cagctgtctgtgtcagcctg

SEQ ID NO: 3711232 - DNA, 19 bp, Homo sapiens
cagctgtgctctggacagg

SEQ ID NO: 3711233 - DNA, 20 bp, Homo sapiens
cagctgtgctctggacaggc

SEQ ID NO: 3711234 - DNA, 24 bp, Homo sapiens
cagctgtgctctggacaggcatgt

SEQ ID NO: 3711235 - DNA, 23 bp, Homo sapiens
cagctgtggtgaggttgggcagc

SEQ ID NO: 3711236 - DNA, 17 bp, Homo sapiens
cagcttaggggctgctg

SEQ ID NO: 3711237 - DNA, 19 bp, Homo sapiens
cagcttcatgcctttgtaa

SEQ ID NO: 3711238 - DNA, 20 bp, Homo sapiens
cagcttcatgcctttgtaag

SEQ ID NO: 3711239 - DNA, 21 bp, Homo sapiens
cagcttcatgcctttgtaagt

SEQ ID NO: 3711240 - DNA, 19 bp, Homo sapiens
cagcttctgccacataaaa

SEQ ID NO: 3711241 - DNA, 22 bp, Homo sapiens
cagcttcttaatataactgcct

SEQ ID NO: 3711242 - DNA, 18 bp, Homo sapiens
cagcttgagggttgggct

SEQ ID NO: 3711243 - DNA, 14 bp, Homo sapiens
cagcttgctgcacc

SEQ ID NO: 3711244 - DNA, 22 bp, Homo sapiens
cagcttgtaaatagctcaggtg

SEQ ID NO: 3711245 - DNA, 16 bp, Homo sapiens
cagctttcatgattag

SEQ ID NO: 3711246 - DNA, 17 bp, Homo sapiens
cagctttcatgattagc

SEQ ID NO: 3711247 - DNA, 20 bp, Homo sapiens
cagctttcatgattagcaag

SEQ ID NO: 3711248 - DNA, 11 bp, Homo sapiens
cagctttgcta

SEQ ID NO: 3711249 - DNA, 23 bp, Homo sapiens
cagctttgtttgttgtcagctga

SEQ ID NO: 3711250 - DNA, 14 bp, Homo sapiens
cagcttttactgtt

SEQ ID NO: 3711251 - DNA, 20 bp, Homo sapiens
cagcttttagtacccacctg

SEQ ID NO: 3711252 - DNA, 21 bp, Homo sapiens
cagcttttagtacccacctga

SEQ ID NO: 3711253 - DNA, 13 bp, Homo sapiens
cagctttttgtct

SEQ ID NO: 3711254 - DNA, 22 bp, Homo sapiens
caggaaaaaggacaggcagaaa

SEQ ID NO: 3711255 - DNA, 19 bp, Homo sapiens
caggaaacatatttaagaa

SEQ ID NO: 3711256 - DNA, 20 bp, Homo sapiens
caggaacagctatgggagcc

SEQ ID NO: 3711257 - DNA, 22 bp, Homo sapiens
caggaacagctatgggagcccc

SEQ ID NO: 3711258 - DNA, 13 bp, Homo sapiens
caggaacctggac

SEQ ID NO: 3711259 - DNA, 16 bp, Homo sapiens
caggaagcaccccatg

SEQ ID NO: 3711260 - DNA, 21 bp, Homo sapiens
caggaagccgtgccctgcccc

SEQ ID NO: 3711261 - DNA, 12 bp, Homo sapiens
caggaaggagag

SEQ ID NO: 3711262 - DNA, 21 bp, Homo sapiens
caggaagggcaggaaggagag

SEQ ID NO: 3711263 - DNA, 23 bp, Homo sapiens
caggaataaggccttaatatgtt

SEQ ID NO: 3711264 - DNA, 17 bp, Homo sapiens
caggaatgtgtggcaga

SEQ ID NO: 3711265 - DNA, 15 bp, Homo sapiens
caggacaacgaggaa

SEQ ID NO: 3711266 - DNA, 19 bp, Homo sapiens
caggacagcatggtgcatg

SEQ ID NO: 3711267 - DNA, 12 bp, Homo sapiens
caggaccacaaa

SEQ ID NO: 3711268 - DNA, 21 bp, Homo sapiens
caggacccatcacgcctgtgc

SEQ ID NO: 3711269 - DNA, 15 bp, Homo sapiens
caggaccctcgctgg

SEQ ID NO: 3711270 - DNA, 18 bp, Homo sapiens
caggaccctcgctggccc

SEQ ID NO: 3711271 - DNA, 16 bp, Homo sapiens
caggacctcaggtgag

SEQ ID NO: 3711272 - DNA, 13 bp, Homo sapiens
caggacctgacta

SEQ ID NO: 3711273 - DNA, 13 bp, Homo sapiens
caggactccctcc

SEQ ID NO: 3711274 - DNA, 14 bp, Homo sapiens
caggactccctcct

SEQ ID NO: 3711275 - DNA, 15 bp, Homo sapiens
caggactccctcctc

SEQ ID NO: 3711276 - DNA, 20 bp, Homo sapiens
caggactccctcctcacctc

SEQ ID NO: 3711277 - DNA, 13 bp, Homo sapiens
caggactctgcct

SEQ ID NO: 3711278 - DNA, 18 bp, Homo sapiens
caggactgaattgtcccc

SEQ ID NO: 3711279 - DNA, 23 bp, Homo sapiens
caggagaaatgcatccattcctc

SEQ ID NO: 3711280 - DNA, 14 bp, Homo sapiens
caggagagaaaggg

SEQ ID NO: 3711281 - DNA, 13 bp, Homo sapiens
caggagagccagc

SEQ ID NO: 3711282 - DNA, 16 bp, Homo sapiens
caggagagccagccct

SEQ ID NO: 3711283 - DNA, 19 bp, Homo sapiens
caggagagccagccctccc

SEQ ID NO: 3711284 - DNA, 21 bp, Homo sapiens
caggagagccagccctccctg

SEQ ID NO: 3711285 - DNA, 12 bp, Homo sapiens
caggagagggaa

SEQ ID NO: 3711286 - DNA, 15 bp, Homo sapiens
caggagaggggcaga

SEQ ID NO: 3711287 - DNA, 18 bp, Homo sapiens
caggagccccgaggcctt

SEQ ID NO: 3711288 - DNA, 11 bp, Homo sapiens
caggagcctgg

SEQ ID NO: 3711289 - DNA, 12 bp, Homo sapiens
caggagcctggc

SEQ ID NO: 3711290 - DNA, 22 bp, Homo sapiens
caggagctgggatcctaagggc

SEQ ID NO: 3711291 - DNA, 23 bp, Homo sapiens
caggaggactgccccgtgcagac

SEQ ID NO: 3711292 - DNA, 23 bp, Homo sapiens
caggaggagactagatttatgaa

SEQ ID NO: 3711293 - DNA, 23 bp, Homo sapiens
caggaggattgcttgagcccagg

SEQ ID NO: 3711294 - DNA, 14 bp, Homo sapiens
caggaggcagggtt

SEQ ID NO: 3711295 - DNA, 16 bp, Homo sapiens
caggaggctgaggcag

SEQ ID NO: 3711296 - DNA, 20 bp, Homo sapiens
caggaggctgaggcagaaga

SEQ ID NO: 3711297 - DNA, 19 bp, Homo sapiens
caggaggctgaggcaggag

SEQ ID NO: 3711298 - DNA, 21 bp, Homo sapiens
caggaggctgaggcaggagga

SEQ ID NO: 3711299 - DNA, 14 bp, Homo sapiens
caggaggctgaggt

SEQ ID NO: 3711300 - DNA, 18 bp, Homo sapiens
caggaggctggaggaagg

SEQ ID NO: 3711301 - DNA, 12 bp, Homo sapiens
caggagggaggt

SEQ ID NO: 3711302 - DNA, 12 bp, Homo sapiens
caggagggccct

SEQ ID NO: 3711303 - DNA, 21 bp, Homo sapiens
caggagtcccaaggaaagccc

SEQ ID NO: 3711304 - DNA, 24 bp, Homo sapiens
caggagtcccaaggaaagccccag

SEQ ID NO: 3711305 - DNA, 15 bp, Homo sapiens
caggagtccctggta

SEQ ID NO: 3711306 - DNA, 12 bp, Homo sapiens
caggagtgagca

SEQ ID NO: 3711307 - DNA, 20 bp, Homo sapiens
caggagttagaggccagcct

SEQ ID NO: 3711308 - DNA, 23 bp, Homo sapiens
caggagttcaagaccagcctggc

SEQ ID NO: 3711309 - DNA, 21 bp, Homo sapiens
caggagttcgagaccagcctg

SEQ ID NO: 3711310 - DNA, 23 bp, Homo sapiens
caggagttcgagaccagcctggc

SEQ ID NO: 3711311 - DNA, 23 bp, Homo sapiens
caggagtttgagaccaacctggg

SEQ ID NO: 3711312 - DNA, 22 bp, Homo sapiens
caggagtttgaggctgcagcga

SEQ ID NO: 3711313 - DNA, 18 bp, Homo sapiens
caggatactctgtcagat

SEQ ID NO: 3711314 - DNA, 20 bp, Homo sapiens
caggatactctgtcagatgg

SEQ ID NO: 3711315 - DNA, 18 bp, Homo sapiens
caggatagataactcttt

SEQ ID NO: 3711316 - DNA, 17 bp, Homo sapiens
caggatgattgtacaga

SEQ ID NO: 3711317 - DNA, 22 bp, Homo sapiens
caggatggaggggtggtcctga

SEQ ID NO: 3711318 - DNA, 14 bp, Homo sapiens
caggattctccttt

SEQ ID NO: 3711319 - DNA, 17 bp, Homo sapiens
caggattcttcctccct

SEQ ID NO: 3711320 - DNA, 21 bp, Homo sapiens
cagtcaggtagttgcaattga

SEQ ID NO: 3711321 - DNA, 20 bp, Homo sapiens
cagtcatcgtaggtgatttg

SEQ ID NO: 3711322 - DNA, 24 bp, Homo sapiens
cagtcatcttgaccaagcaggaag

SEQ ID NO: 3711323 - DNA, 23 bp, Homo sapiens
cagtcattatgagaggcaatgat

SEQ ID NO: 3711324 - DNA, 17 bp, Homo sapiens
cagtccaaatgtcctcc

SEQ ID NO: 3711325 - DNA, 20 bp, Homo sapiens
cagtccctgggggaagccct

SEQ ID NO: 3711326 - DNA, 13 bp, Homo sapiens
cagtcctgctctc

SEQ ID NO: 3711327 - DNA, 17 bp, Homo sapiens
cagtcctgctctctacc

SEQ ID NO: 3711328 - DNA, 21 bp, Homo sapiens
cagtcctgggagaacctcagg

SEQ ID NO: 3711329 - DNA, 23 bp, Homo sapiens
cagtcctgggagaacctcaggct

SEQ ID NO: 3711330 - DNA, 14 bp, Homo sapiens
cagtctagttcctg

SEQ ID NO: 3711331 - DNA, 18 bp, Homo sapiens
cagtctcccaggccccct

SEQ ID NO: 3711332 - DNA, 20 bp, Homo sapiens
cagtctcccaggccccctgc

SEQ ID NO: 3711333 - DNA, 15 bp, Homo sapiens
cagtctcgggtggct

SEQ ID NO: 3711334 - DNA, 22 bp, Homo sapiens
cagtctctttaatcttcagttt

SEQ ID NO: 3711335 - DNA, 19 bp, Homo sapiens
cagtctgattcccaagctc

SEQ ID NO: 3711336 - DNA, 20 bp, Homo sapiens
cagtctgattcccaagctct

SEQ ID NO: 3711337 - DNA, 13 bp, Homo sapiens
cagtctgctgccc

SEQ ID NO: 3711338 - DNA, 14 bp, Homo sapiens
cagtctgctgccct

SEQ ID NO: 3711339 - DNA, 21 bp, Homo sapiens
cagtctgctgccctccatccc

SEQ ID NO: 3711340 - DNA, 23 bp, Homo sapiens
cagtctgcttatccttccacgga

SEQ ID NO: 3711341 - DNA, 15 bp, Homo sapiens
cagtctggaatgcag

SEQ ID NO: 3711342 - DNA, 17 bp, Homo sapiens
cagtctggaatgcagtg

SEQ ID NO: 3711343 - DNA, 17 bp, Homo sapiens
cagtcttccacctggaa

SEQ ID NO: 3711344 - DNA, 13 bp, Homo sapiens
cagtgaaagcatc

SEQ ID NO: 3711345 - DNA, 16 bp, Homo sapiens
cagtgacacttcagag

SEQ ID NO: 3711346 - DNA, 18 bp, Homo sapiens
cagtgacacttcagagag

SEQ ID NO: 3711347 - DNA, 22 bp, Homo sapiens
cagtgacacttcagagagctgg

SEQ ID NO: 3711348 - DNA, 18 bp, Homo sapiens
cagtgacctgaggaagcg

SEQ ID NO: 3711349 - DNA, 17 bp, Homo sapiens
cagtgacgtgcacctgt

SEQ ID NO: 3711350 - DNA, 22 bp, Homo sapiens
cagtgacgtgcacctgtactca

SEQ ID NO: 3711351 - DNA, 24 bp, Homo sapiens
cagtgagccgagattgcaccactg

SEQ ID NO: 3711352 - DNA, 21 bp, Homo sapiens
cagtgaggcccagggagaggc

SEQ ID NO: 3711353 - DNA, 15 bp, Homo sapiens
cagtgaggtcctggg

SEQ ID NO: 3711354 - DNA, 17 bp, Homo sapiens
cagtgaggtcctggggg

SEQ ID NO: 3711355 - DNA, 18 bp, Homo sapiens
cagtgaggtcctgggggc

SEQ ID NO: 3711356 - DNA, 20 bp, Homo sapiens
cagtgagtcgaggacaggga

SEQ ID NO: 3711357 - DNA, 15 bp, Homo sapiens
cagtgatctccatat

SEQ ID NO: 3711358 - DNA, 20 bp, Homo sapiens
cagtgatgctggatgctcct

SEQ ID NO: 3711359 - DNA, 14 bp, Homo sapiens
cagtgatttttatc

SEQ ID NO: 3711360 - DNA, 17 bp, Homo sapiens
cagtgatttttatccaa

SEQ ID NO: 3711361 - DNA, 22 bp, Homo sapiens
cagtgcaatggtataaatttca

SEQ ID NO: 3711362 - DNA, 15 bp, Homo sapiens
cagtgcacccactct

SEQ ID NO: 3711363 - DNA, 12 bp, Homo sapiens
cagtgcagacag

SEQ ID NO: 3711364 - DNA, 13 bp, Homo sapiens
cagtgcagacagg

SEQ ID NO: 3711365 - DNA, 16 bp, Homo sapiens
cagtgcagcccgtgtg

SEQ ID NO: 3711366 - DNA, 16 bp, Homo sapiens
cagtgcatctcagccc

SEQ ID NO: 3711367 - DNA, 17 bp, Homo sapiens
cagtgcatctcagccca

SEQ ID NO: 3711368 - DNA, 15 bp, Homo sapiens
cagtgccaagcacag

SEQ ID NO: 3711369 - DNA, 15 bp, Homo sapiens
cagtgccattgtctt

SEQ ID NO: 3711370 - DNA, 21 bp, Homo sapiens
cagtgccattgtctttatatg

SEQ ID NO: 3711371 - DNA, 15 bp, Homo sapiens
cagtgcccacaggat

SEQ ID NO: 3711372 - DNA, 17 bp, Homo sapiens
cagtgcccacaggatca

SEQ ID NO: 3711373 - DNA, 22 bp, Homo sapiens
cagtgcccacaggatcagtctg

SEQ ID NO: 3711374 - DNA, 24 bp, Homo sapiens
cagtgccctggggctgatctcagg

SEQ ID NO: 3711375 - DNA, 12 bp, Homo sapiens
cagtgcctgctg

SEQ ID NO: 3711376 - DNA, 20 bp, Homo sapiens
cagtgcctgggaatgtatta

SEQ ID NO: 3711377 - DNA, 17 bp, Homo sapiens
cagtgccttacctcctg

SEQ ID NO: 3711378 - DNA, 20 bp, Homo sapiens
cagtgccttacctcctgccc

SEQ ID NO: 3711379 - DNA, 22 bp, Homo sapiens
cagtgctgctgaactaatttct

SEQ ID NO: 3711380 - DNA, 19 bp, Homo sapiens
cagtgcttgattgcgtgga

SEQ ID NO: 3711381 - DNA, 22 bp, Homo sapiens
cagtggactttccaccccctcc

SEQ ID NO: 3711382 - DNA, 15 bp, Homo sapiens
cagtggaggtgctgc

SEQ ID NO: 3711383 - DNA, 13 bp, Homo sapiens
cagtggcagctgc

SEQ ID NO: 3711384 - DNA, 19 bp, Homo sapiens
cagtggcatggctccagtc

SEQ ID NO: 3711385 - DNA, 23 bp, Homo sapiens
cagtggcctcaaccctccctcag

SEQ ID NO: 3711386 - DNA, 13 bp, Homo sapiens
cagtggcctggct

SEQ ID NO: 3711387 - DNA, 15 bp, Homo sapiens
cagtggcctggctcc

SEQ ID NO: 3711388 - DNA, 16 bp, Homo sapiens
cagtgggacagggcat

SEQ ID NO: 3711389 - DNA, 13 bp, Homo sapiens
cagtgggagaaaa

SEQ ID NO: 3711390 - DNA, 11 bp, Homo sapiens
cagtgggagct

SEQ ID NO: 3711391 - DNA, 15 bp, Homo sapiens
cagtgggagctgcct

SEQ ID NO: 3711392 - DNA, 13 bp, Homo sapiens
cagtggggctggg

SEQ ID NO: 3711393 - DNA, 14 bp, Homo sapiens
cagtggggctgggg

SEQ ID NO: 3711394 - DNA, 13 bp, Homo sapiens
cagtgggtgcccc

SEQ ID NO: 3711395 - DNA, 21 bp, Homo sapiens
cagtggtatgatcacggctca

SEQ ID NO: 3711396 - DNA, 14 bp, Homo sapiens
cagtggttatttag

SEQ ID NO: 3711397 - DNA, 22 bp, Homo sapiens
cagtggttctacaatctattta

SEQ ID NO: 3711398 - DNA, 23 bp, Homo sapiens
cagtgtacatggaataacatgta

SEQ ID NO: 3711399 - DNA, 19 bp, Homo sapiens
cagtgtagccttgcccgga

SEQ ID NO: 3711400 - DNA, 20 bp, Homo sapiens
cagtgtcatttatgaaaaga

SEQ ID NO: 3711401 - DNA, 18 bp, Homo sapiens
cagtgtcctcccctcaag

SEQ ID NO: 3711402 - DNA, 19 bp, Homo sapiens
cagtgtcctcccctcaagg

SEQ ID NO: 3711403 - DNA, 22 bp, Homo sapiens
cagtgtctgtatcggagacagt

SEQ ID NO: 3711404 - DNA, 17 bp, Homo sapiens
cagtgtcttccataatg

SEQ ID NO: 3711405 - DNA, 20 bp, Homo sapiens
cagtgtcttccataatgtat

SEQ ID NO: 3711406 - DNA, 23 bp, Homo sapiens
cagtgtcttccataatgtataaa

SEQ ID NO: 3711407 - DNA, 18 bp, Homo sapiens
cagtgtctttctttggtg

SEQ ID NO: 3711408 - DNA, 22 bp, Homo sapiens
cagtgtctttctttggtgcctt

SEQ ID NO: 3711409 - DNA, 14 bp, Homo sapiens
cagtgtgacaagga

SEQ ID NO: 3711410 - DNA, 14 bp, Homo sapiens
cagtgtgtctcctg

SEQ ID NO: 3711411 - DNA, 16 bp, Homo sapiens
cagtgtgtctcctgca

SEQ ID NO: 3711412 - DNA, 21 bp, Homo sapiens
cagtgtgtggctttcagagcc

SEQ ID NO: 3711413 - DNA, 15 bp, Homo sapiens
cagtgttgtttgtaa

SEQ ID NO: 3711414 - DNA, 17 bp, Homo sapiens
cagtgttgtttgtaaat

SEQ ID NO: 3711415 - DNA, 15 bp, Homo sapiens
cagtgtttcccataa

SEQ ID NO: 3711416 - DNA, 16 bp, Homo sapiens
cagtgttttaggagca

SEQ ID NO: 3711417 - DNA, 20 bp, Homo sapiens
cagtgttttaggagcatgag

SEQ ID NO: 3711418 - DNA, 20 bp, Homo sapiens
cagttaactttcagaagaga

SEQ ID NO: 3711419 - DNA, 22 bp, Homo sapiens
cagttaactttcagaagagatg

SEQ ID NO: 3711420 - DNA, 14 bp, Homo sapiens
cagttaagaaaaaa

SEQ ID NO: 3711421 - DNA, 15 bp, Homo sapiens
cagttaagaaaaaaa

SEQ ID NO: 3711422 - DNA, 16 bp, Homo sapiens
cagttaagaaaaaaat

SEQ ID NO: 3711423 - DNA, 15 bp, Homo sapiens
cagttaatcttgctt

SEQ ID NO: 3711424 - DNA, 13 bp, Homo sapiens
cagttactcagcc

SEQ ID NO: 3711425 - DNA, 16 bp, Homo sapiens
cagttactcagccctg

SEQ ID NO: 3711426 - DNA, 17 bp, Homo sapiens
cagttactcagccctgg

SEQ ID NO: 3711427 - DNA, 16 bp, Homo sapiens
cagttactctgaaggg

SEQ ID NO: 3711428 - DNA, 20 bp, Homo sapiens
cagttatgtgaatgatctct

SEQ ID NO: 3711429 - DNA, 14 bp, Homo sapiens
cagttcacttgcag

SEQ ID NO: 3711430 - DNA, 16 bp, Homo sapiens
cagttcagcaccaccc

SEQ ID NO: 3711431 - DNA, 17 bp, Homo sapiens
cagttcagcaccaccct

SEQ ID NO: 3711432 - DNA, 23 bp, Homo sapiens
cagttcaggagtcccaaggaaag

SEQ ID NO: 3711433 - DNA, 14 bp, Homo sapiens
catgacctgtgacc

SEQ ID NO: 3711434 - DNA, 13 bp, Homo sapiens
catgactgcattt

SEQ ID NO: 3711435 - DNA, 12 bp, Homo sapiens
catgagaatcta

SEQ ID NO: 3711436 - DNA, 19 bp, Homo sapiens
catgagacacatctcctcc

SEQ ID NO: 3711437 - DNA, 19 bp, Homo sapiens
catgagaccactgttatca

SEQ ID NO: 3711438 - DNA, 21 bp, Homo sapiens
catgagcctcagcatcctggc

SEQ ID NO: 3711439 - DNA, 21 bp, Homo sapiens
catgagctccagacccccagc

SEQ ID NO: 3711440 - DNA, 22 bp, Homo sapiens
catgaggacatgatggagcgca

SEQ ID NO: 3711441 - DNA, 14 bp, Homo sapiens
catgaggaggcaga

SEQ ID NO: 3711442 - DNA, 22 bp, Homo sapiens
catgaggcaatgtcaggaacag

SEQ ID NO: 3711443 - DNA, 23 bp, Homo sapiens
catgaggcaatgtcaggaacaga

SEQ ID NO: 3711444 - DNA, 17 bp, Homo sapiens
catgagggatcacaggg

SEQ ID NO: 3711445 - DNA, 16 bp, Homo sapiens
catgaggggcccgagc

SEQ ID NO: 3711446 - DNA, 16 bp, Homo sapiens
catgatctccctgccg

SEQ ID NO: 3711447 - DNA, 19 bp, Homo sapiens
catgatgagctcctcttcc

SEQ ID NO: 3711448 - DNA, 18 bp, Homo sapiens
catgatggagcgcacctg

SEQ ID NO: 3711449 - DNA, 22 bp, Homo sapiens
catgattaaccacttcagctga

SEQ ID NO: 3711450 - DNA, 12 bp, Homo sapiens
catgattagcaa

SEQ ID NO: 3711451 - DNA, 16 bp, Homo sapiens
catgcaaatgctgtat

SEQ ID NO: 3711452 - DNA, 22 bp, Homo sapiens
catgcaaatgctgtattcttct

SEQ ID NO: 3711453 - DNA, 14 bp, Homo sapiens
catgcaaggggaaa

SEQ ID NO: 3711454 - DNA, 16 bp, Homo sapiens
catgcaatgacatctt

SEQ ID NO: 3711455 - DNA, 16 bp, Homo sapiens
catgcaccctcataca

SEQ ID NO: 3711456 - DNA, 16 bp, Homo sapiens
catgcagcagcttgct

SEQ ID NO: 3711457 - DNA, 19 bp, Homo sapiens
catgcagcccatgcccacc

SEQ ID NO: 3711458 - DNA, 22 bp, Homo sapiens
catgcagcccatgcccacctgc

SEQ ID NO: 3711459 - DNA, 23 bp, Homo sapiens
catgcagcccatgcccacctgcc

SEQ ID NO: 3711460 - DNA, 18 bp, Homo sapiens
catgcatagtcccagcta

SEQ ID NO: 3711461 - DNA, 17 bp, Homo sapiens
catgcattgttgaggtg

SEQ ID NO: 3711462 - DNA, 17 bp, Homo sapiens
catgcatttgaggtcaa

SEQ ID NO: 3711463 - DNA, 21 bp, Homo sapiens
catgccaccatggccagccaa

SEQ ID NO: 3711464 - DNA, 19 bp, Homo sapiens
catgccactacactccagc

SEQ ID NO: 3711465 - DNA, 16 bp, Homo sapiens
catgcccacctgccca

SEQ ID NO: 3711466 - DNA, 21 bp, Homo sapiens
catgccgctgcatccgtgagc

SEQ ID NO: 3711467 - DNA, 14 bp, Homo sapiens
catgccgggcgcag

SEQ ID NO: 3711468 - DNA, 19 bp, Homo sapiens
catgcctggacaaaccctt

SEQ ID NO: 3711469 - DNA, 16 bp, Homo sapiens
catgcctgtccagcct

SEQ ID NO: 3711470 - DNA, 17 bp, Homo sapiens
catgcctgtccagcctg

SEQ ID NO: 3711471 - DNA, 18 bp, Homo sapiens
catgcctgtccagcctgg

SEQ ID NO: 3711472 - DNA, 20 bp, Homo sapiens
catgcctgtccagcctgggc

SEQ ID NO: 3711473 - DNA, 21 bp, Homo sapiens
catgcctgtccagcctgggca

SEQ ID NO: 3711474 - DNA, 20 bp, Homo sapiens
catgccttccagcaccctgc

SEQ ID NO: 3711475 - DNA, 20 bp, Homo sapiens
catgcgggctgggcagctgt

SEQ ID NO: 3711476 - DNA, 20 bp, Homo sapiens
catgctacctgatcccactc

SEQ ID NO: 3711477 - DNA, 22 bp, Homo sapiens
catgctacctgatcccactcct

SEQ ID NO: 3711478 - DNA, 14 bp, Homo sapiens
catgctcctggccc

SEQ ID NO: 3711479 - DNA, 15 bp, Homo sapiens
catgctctctgcagc

SEQ ID NO: 3711480 - DNA, 20 bp, Homo sapiens
catgctctctgcagccagcc

SEQ ID NO: 3711481 - DNA, 13 bp, Homo sapiens
catgctgctttaa

SEQ ID NO: 3711482 - DNA, 14 bp, Homo sapiens
catgctgctttaat

SEQ ID NO: 3711483 - DNA, 20 bp, Homo sapiens
catgctggctcccagggcca

SEQ ID NO: 3711484 - DNA, 19 bp, Homo sapiens
catgctgtgattgtgccta

SEQ ID NO: 3711485 - DNA, 14 bp, Homo sapiens
catgcttgatggtt

SEQ ID NO: 3711486 - DNA, 17 bp, Homo sapiens
catgcttgatggtttat

SEQ ID NO: 3711487 - DNA, 16 bp, Homo sapiens
catggaaatattatgc

SEQ ID NO: 3711488 - DNA, 19 bp, Homo sapiens
catggaaatattatgcaaa

SEQ ID NO: 3711489 - DNA, 16 bp, Homo sapiens
catggaactcattcct

SEQ ID NO: 3711490 - DNA, 17 bp, Homo sapiens
catggaactcattcctg

SEQ ID NO: 3711491 - DNA, 19 bp, Homo sapiens
catggaactcattcctgcc

SEQ ID NO: 3711492 - DNA, 21 bp, Homo sapiens
catggaactcattcctgcctg

SEQ ID NO: 3711493 - DNA, 12 bp, Homo sapiens
catggacccgga

SEQ ID NO: 3711494 - DNA, 15 bp, Homo sapiens
catggacccggagct

SEQ ID NO: 3711495 - DNA, 19 bp, Homo sapiens
catggacgttcggggcatg

SEQ ID NO: 3711496 - DNA, 17 bp, Homo sapiens
catggagaaaccctgtc

SEQ ID NO: 3711497 - DNA, 13 bp, Homo sapiens
catggaggcacac

SEQ ID NO: 3711498 - DNA, 14 bp, Homo sapiens
catggagtgtgtat

SEQ ID NO: 3711499 - DNA, 18 bp, Homo sapiens
catggagtgtgtattgtt

SEQ ID NO: 3711500 - DNA, 20 bp, Homo sapiens
catggagtgtgtattgttcc

SEQ ID NO: 3711501 - DNA, 21 bp, Homo sapiens
catggagtgtgtattgttccc

SEQ ID NO: 3711502 - DNA, 22 bp, Homo sapiens
catggcagaataatctttgggt

SEQ ID NO: 3711503 - DNA, 21 bp, Homo sapiens
catggcatgggggcctcaggg

SEQ ID NO: 3711504 - DNA, 22 bp, Homo sapiens
catggcatgggggcctcagggc

SEQ ID NO: 3711505 - DNA, 14 bp, Homo sapiens
catggctaactggc

SEQ ID NO: 3711506 - DNA, 13 bp, Homo sapiens
catggctccagtc

SEQ ID NO: 3711507 - DNA, 20 bp, Homo sapiens
catggctccagtctgctgcc

SEQ ID NO: 3711508 - DNA, 18 bp, Homo sapiens
catggcttgccacagctc

SEQ ID NO: 3711509 - DNA, 20 bp, Homo sapiens
catgggaaatgtcaacaagt

SEQ ID NO: 3711510 - DNA, 14 bp, Homo sapiens
catgggcccctctg

SEQ ID NO: 3711511 - DNA, 16 bp, Homo sapiens
catgggcccctctgac

SEQ ID NO: 3711512 - DNA, 17 bp, Homo sapiens
catgggcctcctgtgtg

SEQ ID NO: 3711513 - DNA, 13 bp, Homo sapiens
catgggggcaggg

SEQ ID NO: 3711514 - DNA, 15 bp, Homo sapiens
catgggtagcttctg

SEQ ID NO: 3711515 - DNA, 16 bp, Homo sapiens
catgggtagcttctga

SEQ ID NO: 3711516 - DNA, 19 bp, Homo sapiens
catgggtagcttctgacct

SEQ ID NO: 3711517 - DNA, 15 bp, Homo sapiens
catgggttatgtgta

SEQ ID NO: 3711518 - DNA, 23 bp, Homo sapiens
catggtaatttatagtttataca

SEQ ID NO: 3711519 - DNA, 16 bp, Homo sapiens
catggtccccaagacc

SEQ ID NO: 3711520 - DNA, 17 bp, Homo sapiens
catggtccggtgtcctt

SEQ ID NO: 3711521 - DNA, 15 bp, Homo sapiens
catggtgcctctgga

SEQ ID NO: 3711522 - DNA, 17 bp, Homo sapiens
catggtggcgcaagcct

SEQ ID NO: 3711523 - DNA, 18 bp, Homo sapiens
catggtggcgcaagcctg

SEQ ID NO: 3711524 - DNA, 16 bp, Homo sapiens
catggttgagaaatga

SEQ ID NO: 3711525 - DNA, 13 bp, Homo sapiens
catgtaaaacaaa

SEQ ID NO: 3711526 - DNA, 22 bp, Homo sapiens
catgtaaaacaaaaaacaatat

SEQ ID NO: 3711527 - DNA, 16 bp, Homo sapiens
catgtaaattaccagt

SEQ ID NO: 3711528 - DNA, 12 bp, Homo sapiens
catgtaataaaa

SEQ ID NO: 3711529 - DNA, 13 bp, Homo sapiens
catgtactgtagt

SEQ ID NO: 3711530 - DNA, 13 bp, Homo sapiens
catgtataaatga

SEQ ID NO: 3711531 - DNA, 18 bp, Homo sapiens
catgtataaatgaagttt

SEQ ID NO: 3711532 - DNA, 18 bp, Homo sapiens
catgtataatatttttaa

SEQ ID NO: 3711533 - DNA, 21 bp, Homo sapiens
catgtatcccaactcctataa

SEQ ID NO: 3711534 - DNA, 16 bp, Homo sapiens
catgtccctaccgagt

SEQ ID NO: 3711535 - DNA, 15 bp, Homo sapiens
catgtcgcctctgca

SEQ ID NO: 3711536 - DNA, 18 bp, Homo sapiens
catgtctttctccaggga

SEQ ID NO: 3711537 - DNA, 13 bp, Homo sapiens
catgtgaagaggg

SEQ ID NO: 3711538 - DNA, 12 bp, Homo sapiens
catgtgagccac

SEQ ID NO: 3711539 - DNA, 22 bp, Homo sapiens
catgtgagccaccgctgccagc

SEQ ID NO: 3711540 - DNA, 15 bp, Homo sapiens
catgtgcacatgcac

SEQ ID NO: 3711541 - DNA, 22 bp, Homo sapiens
catgtgccaggtttttggtctg

SEQ ID NO: 3711542 - DNA, 22 bp, Homo sapiens
catgtgcctatagtcccagcta

SEQ ID NO: 3711543 - DNA, 19 bp, Homo sapiens
catgtgctgtgaccattta

SEQ ID NO: 3711544 - DNA, 17 bp, Homo sapiens
catgtggaaagtgaatt

SEQ ID NO: 3711545 - DNA, 23 bp, Homo sapiens
catgtggaaagtgaatttgaatg

SEQ ID NO: 3711546 - DNA, 22 bp, Homo sapiens
ccaaggagctgagaatagaagg

SEQ ID NO: 3711547 - DNA, 13 bp, Homo sapiens
ccaaggaggaaaa

SEQ ID NO: 3711548 - DNA, 21 bp, Homo sapiens
ccaaggaggaaaaacagacaa

SEQ ID NO: 3711549 - DNA, 22 bp, Homo sapiens
ccaaggcaaggggtgcctggga

SEQ ID NO: 3711550 - DNA, 14 bp, Homo sapiens
ccaaggctggggga

SEQ ID NO: 3711551 - DNA, 24 bp, Homo sapiens
ccaagggagttaggctattcacaa

SEQ ID NO: 3711552 - DNA, 22 bp, Homo sapiens
ccaaggggaatgtttgcctctg

SEQ ID NO: 3711553 - DNA, 16 bp, Homo sapiens
ccaaggtctaggtgga

SEQ ID NO: 3711554 - DNA, 23 bp, Homo sapiens
ccaaggtgggctgagccctggca

SEQ ID NO: 3711555 - DNA, 21 bp, Homo sapiens
ccaagtcagctttgccttcca

SEQ ID NO: 3711556 - DNA, 14 bp, Homo sapiens
ccaagtgcaggctg

SEQ ID NO: 3711557 - DNA, 16 bp, Homo sapiens
ccaagtgggggcagag

SEQ ID NO: 3711558 - DNA, 14 bp, Homo sapiens
ccaagtggtcagga

SEQ ID NO: 3711559 - DNA, 14 bp, Homo sapiens
ccaagtgtgtgtgc

SEQ ID NO: 3711560 - DNA, 20 bp, Homo sapiens
ccaagttataaatcaatgtc

SEQ ID NO: 3711561 - DNA, 14 bp, Homo sapiens
ccaagtttatatac

SEQ ID NO: 3711562 - DNA, 12 bp, Homo sapiens
ccaatattataa

SEQ ID NO: 3711563 - DNA, 13 bp, Homo sapiens
ccaatattataat

SEQ ID NO: 3711564 - DNA, 17 bp, Homo sapiens
ccaatatttaccagacc

SEQ ID NO: 3711565 - DNA, 21 bp, Homo sapiens
ccaatggagactgtctcaaga

SEQ ID NO: 3711566 - DNA, 16 bp, Homo sapiens
ccaatgtttaaaaaag

SEQ ID NO: 3711567 - DNA, 19 bp, Homo sapiens
ccaattcttacaaacatgt

SEQ ID NO: 3711568 - DNA, 18 bp, Homo sapiens
ccacaaaggagagctagc

SEQ ID NO: 3711569 - DNA, 18 bp, Homo sapiens
ccacaaccctgttttata

SEQ ID NO: 3711570 - DNA, 17 bp, Homo sapiens
ccacaagattcccagag

SEQ ID NO: 3711571 - DNA, 21 bp, Homo sapiens
ccacaagattcccagagacag

SEQ ID NO: 3711572 - DNA, 12 bp, Homo sapiens
ccacacacagag

SEQ ID NO: 3711573 - DNA, 17 bp, Homo sapiens
ccacacacagaggaaga

SEQ ID NO: 3711574 - DNA, 12 bp, Homo sapiens
ccacacacccca

SEQ ID NO: 3711575 - DNA, 19 bp, Homo sapiens
ccacacctcagttcccttg

SEQ ID NO: 3711576 - DNA, 16 bp, Homo sapiens
ccacacctccctgaac

SEQ ID NO: 3711577 - DNA, 22 bp, Homo sapiens
ccacactaacctgggttccctt

SEQ ID NO: 3711578 - DNA, 14 bp, Homo sapiens
ccacactgcaacag

SEQ ID NO: 3711579 - DNA, 16 bp, Homo sapiens
ccacacttcctgtcca

SEQ ID NO: 3711580 - DNA, 12 bp, Homo sapiens
ccacagaaagag

SEQ ID NO: 3711581 - DNA, 15 bp, Homo sapiens
ccacagacaaggtag

SEQ ID NO: 3711582 - DNA, 21 bp, Homo sapiens
ccacagacaaggtagccctgg

SEQ ID NO: 3711583 - DNA, 23 bp, Homo sapiens
ccacagaggtgctgtagatgctg

SEQ ID NO: 3711584 - DNA, 18 bp, Homo sapiens
ccacagatgcctccaccc

SEQ ID NO: 3711585 - DNA, 16 bp, Homo sapiens
ccacagcccaggcctc

SEQ ID NO: 3711586 - DNA, 13 bp, Homo sapiens
ccacagccctgtc

SEQ ID NO: 3711587 - DNA, 18 bp, Homo sapiens
ccacagccgcagcctccc

SEQ ID NO: 3711588 - DNA, 17 bp, Homo sapiens
ccacagcctctgcctgt

SEQ ID NO: 3711589 - DNA, 15 bp, Homo sapiens
ccacagctcccaccc

SEQ ID NO: 3711590 - DNA, 17 bp, Homo sapiens
ccacagctcccacccca

SEQ ID NO: 3711591 - DNA, 15 bp, Homo sapiens
ccacaggcccttcct

SEQ ID NO: 3711592 - DNA, 18 bp, Homo sapiens
ccacaggcccttcctctc

SEQ ID NO: 3711593 - DNA, 22 bp, Homo sapiens
ccacaggcccttcctctccact

SEQ ID NO: 3711594 - DNA, 15 bp, Homo sapiens
ccacaggtgtcccca

SEQ ID NO: 3711595 - DNA, 16 bp, Homo sapiens
ccacaggtgtccccag

SEQ ID NO: 3711596 - DNA, 19 bp, Homo sapiens
ccacaggtgtccccagccc

SEQ ID NO: 3711597 - DNA, 22 bp, Homo sapiens
ccacaggtgtccccagcccact

SEQ ID NO: 3711598 - DNA, 20 bp, Homo sapiens
ccacagtgcctaataatact

SEQ ID NO: 3711599 - DNA, 12 bp, Homo sapiens
ccacagtgtctg

SEQ ID NO: 3711600 - DNA, 22 bp, Homo sapiens
ccacatagactttatgcaataa

SEQ ID NO: 3711601 - DNA, 22 bp, Homo sapiens
ccacatagtgatggttcccctg

SEQ ID NO: 3711602 - DNA, 16 bp, Homo sapiens
ccacatcttgctctgc

SEQ ID NO: 3711603 - DNA, 18 bp, Homo sapiens
ccacatcttgctctgctg

SEQ ID NO: 3711604 - DNA, 16 bp, Homo sapiens
ccacatgtgcacatgc

SEQ ID NO: 3711605 - DNA, 19 bp, Homo sapiens
ccaccaactggccctcttc

SEQ ID NO: 3711606 - DNA, 17 bp, Homo sapiens
ccaccacaccgcagaag

SEQ ID NO: 3711607 - DNA, 22 bp, Homo sapiens
ccaccacctaggccactcctcc

SEQ ID NO: 3711608 - DNA, 20 bp, Homo sapiens
ccaccacgatgtggccctgg

SEQ ID NO: 3711609 - DNA, 20 bp, Homo sapiens
ccaccactaggactctgagg

SEQ ID NO: 3711610 - DNA, 13 bp, Homo sapiens
ccaccaggagaac

SEQ ID NO: 3711611 - DNA, 14 bp, Homo sapiens
ccaccaggagaacc

SEQ ID NO: 3711612 - DNA, 23 bp, Homo sapiens
ccaccatattcagtgctgtggcc

SEQ ID NO: 3711613 - DNA, 19 bp, Homo sapiens
ccaccatcatgtctggcta

SEQ ID NO: 3711614 - DNA, 22 bp, Homo sapiens
ccaccatgcccagctcagaggg

SEQ ID NO: 3711615 - DNA, 17 bp, Homo sapiens
ccaccatgtctgcccca

SEQ ID NO: 3711616 - DNA, 14 bp, Homo sapiens
ccacccacctcagc

SEQ ID NO: 3711617 - DNA, 13 bp, Homo sapiens
ccacccagcccat

SEQ ID NO: 3711618 - DNA, 22 bp, Homo sapiens
ccacccagcccattctctctcc

SEQ ID NO: 3711619 - DNA, 12 bp, Homo sapiens
ccacccaggagc

SEQ ID NO: 3711620 - DNA, 14 bp, Homo sapiens
ccacccaggagccc

SEQ ID NO: 3711621 - DNA, 21 bp, Homo sapiens
ccacccaggagccccgaggcc

SEQ ID NO: 3711622 - DNA, 13 bp, Homo sapiens
ccaccccacactt

SEQ ID NO: 3711623 - DNA, 14 bp, Homo sapiens
ccaccccagcctaa

SEQ ID NO: 3711624 - DNA, 17 bp, Homo sapiens
ccaccccagtgcaccca

SEQ ID NO: 3711625 - DNA, 19 bp, Homo sapiens
ccaccccagtgcacccact

SEQ ID NO: 3711626 - DNA, 18 bp, Homo sapiens
ccaccccatccagttcat

SEQ ID NO: 3711627 - DNA, 21 bp, Homo sapiens
ccaccccccagaacctgtcct

SEQ ID NO: 3711628 - DNA, 17 bp, Homo sapiens
ccaccccctccccaggg

SEQ ID NO: 3711629 - DNA, 18 bp, Homo sapiens
ccacccccttcagtgccc

SEQ ID NO: 3711630 - DNA, 14 bp, Homo sapiens
ccaccccgggctct

SEQ ID NO: 3711631 - DNA, 18 bp, Homo sapiens
ccaccccgggctctctgc

SEQ ID NO: 3711632 - DNA, 15 bp, Homo sapiens
ccacccctccttcct

SEQ ID NO: 3711633 - DNA, 13 bp, Homo sapiens
ccaccccttcccc

SEQ ID NO: 3711634 - DNA, 15 bp, Homo sapiens
ccaccccttccccac

SEQ ID NO: 3711635 - DNA, 15 bp, Homo sapiens
ccaccctcccagctc

SEQ ID NO: 3711636 - DNA, 16 bp, Homo sapiens
ccaccctgaaagccct

SEQ ID NO: 3711637 - DNA, 17 bp, Homo sapiens
ccaccctgaaagccctg

SEQ ID NO: 3711638 - DNA, 13 bp, Homo sapiens
ccaccctgctctc

SEQ ID NO: 3711639 - DNA, 12 bp, Homo sapiens
ccacccttggcc

SEQ ID NO: 3711640 - DNA, 15 bp, Homo sapiens
ccacccttggcctgt

SEQ ID NO: 3711641 - DNA, 15 bp, Homo sapiens
ccaccctttgggggg

SEQ ID NO: 3711642 - DNA, 23 bp, Homo sapiens
ccaccctttggggggggcccgcc

SEQ ID NO: 3711643 - DNA, 15 bp, Homo sapiens
ccaccgctgccagca

SEQ ID NO: 3711644 - DNA, 21 bp, Homo sapiens
ccaccgctgccagcacagagc

SEQ ID NO: 3711645 - DNA, 14 bp, Homo sapiens
ccaccgctgcctaa

SEQ ID NO: 3711646 - DNA, 15 bp, Homo sapiens
ccaccgctgcctaag

SEQ ID NO: 3711647 - DNA, 23 bp, Homo sapiens
ccaccgggctgggagctctgcag

SEQ ID NO: 3711648 - DNA, 17 bp, Homo sapiens
ccaccggttgcttctgg

SEQ ID NO: 3711649 - DNA, 18 bp, Homo sapiens
ccacctaggccactcctc

SEQ ID NO: 3711650 - DNA, 22 bp, Homo sapiens
ccacctaggccactcctccaaa

SEQ ID NO: 3711651 - DNA, 13 bp, Homo sapiens
ccacctcagcctc

SEQ ID NO: 3711652 - DNA, 17 bp, Homo sapiens
ccacctcccacaaagga

SEQ ID NO: 3711653 - DNA, 13 bp, Homo sapiens
ccacctccccagg

SEQ ID NO: 3711654 - DNA, 23 bp, Homo sapiens
ccacctccccaggccgtggctgc

SEQ ID NO: 3711655 - DNA, 17 bp, Homo sapiens
ccacctcccctatccac

SEQ ID NO: 3711656 - DNA, 15 bp, Homo sapiens
ccacctctctttttc

SEQ ID NO: 3711657 - DNA, 20 bp, Homo sapiens
ccacctgagctttggacaca

SEQ ID NO: 3711658 - DNA, 22 bp, Homo sapiens
ccacctgagctttggacgcaca

SEQ ID NO: 3711659 - DNA, 16 bp, Homo sapiens
ccagcttatctcaggg

SEQ ID NO: 3711660 - DNA, 16 bp, Homo sapiens
ccagcttgctcttcag

SEQ ID NO: 3711661 - DNA, 23 bp, Homo sapiens
ccagcttgctcttcagtgggaga

SEQ ID NO: 3711662 - DNA, 22 bp, Homo sapiens
ccaggaacacccgactcctcaa

SEQ ID NO: 3711663 - DNA, 23 bp, Homo sapiens
ccaggactccctcctcacctctg

SEQ ID NO: 3711664 - DNA, 19 bp, Homo sapiens
ccaggagaaccactacatg

SEQ ID NO: 3711665 - DNA, 16 bp, Homo sapiens
ccaggagccccgaggc

SEQ ID NO: 3711666 - DNA, 16 bp, Homo sapiens
ccaggagcctgtgcct

SEQ ID NO: 3711667 - DNA, 16 bp, Homo sapiens
ccaggaggctgaggtg

SEQ ID NO: 3711668 - DNA, 21 bp, Homo sapiens
ccaggagtgtggccacgtggg

SEQ ID NO: 3711669 - DNA, 20 bp, Homo sapiens
ccaggagttcgaggctgcag

SEQ ID NO: 3711670 - DNA, 21 bp, Homo sapiens
ccaggagtttaagaccagcct

SEQ ID NO: 3711671 - DNA, 22 bp, Homo sapiens
ccaggagtttgaggctgcagcg

SEQ ID NO: 3711672 - DNA, 13 bp, Homo sapiens
ccaggcaatggcc

SEQ ID NO: 3711673 - DNA, 19 bp, Homo sapiens
ccaggcaatggcctaaact

SEQ ID NO: 3711674 - DNA, 21 bp, Homo sapiens
ccaggcacgaacccacctgct

SEQ ID NO: 3711675 - DNA, 23 bp, Homo sapiens
ccaggcacgaacccacctgctga

SEQ ID NO: 3711676 - DNA, 20 bp, Homo sapiens
ccaggcagatctgtgcccca

SEQ ID NO: 3711677 - DNA, 14 bp, Homo sapiens
ccaggcaggctgtg

SEQ ID NO: 3711678 - DNA, 23 bp, Homo sapiens
ccaggcaggtcttgaactcctgg

SEQ ID NO: 3711679 - DNA, 13 bp, Homo sapiens
ccaggcatggtgg

SEQ ID NO: 3711680 - DNA, 12 bp, Homo sapiens
ccaggccagagg

SEQ ID NO: 3711681 - DNA, 20 bp, Homo sapiens
ccaggccccaaaaccacagc

SEQ ID NO: 3711682 - DNA, 17 bp, Homo sapiens
ccaggccccaggaagcc

SEQ ID NO: 3711683 - DNA, 20 bp, Homo sapiens
ccaggcccccaagcctgcag

SEQ ID NO: 3711684 - DNA, 16 bp, Homo sapiens
ccaggcccctgccacc

SEQ ID NO: 3711685 - DNA, 20 bp, Homo sapiens
ccaggcccggggctggcggc

SEQ ID NO: 3711686 - DNA, 14 bp, Homo sapiens
ccaggccgtggctg

SEQ ID NO: 3711687 - DNA, 15 bp, Homo sapiens
ccaggcctccagctc

SEQ ID NO: 3711688 - DNA, 17 bp, Homo sapiens
ccaggcctccagctcag

SEQ ID NO: 3711689 - DNA, 19 bp, Homo sapiens
ccaggcctccagctcagca

SEQ ID NO: 3711690 - DNA, 22 bp, Homo sapiens
ccaggcgagagacttgtggcct

SEQ ID NO: 3711691 - DNA, 18 bp, Homo sapiens
ccaggcgccccttccccc

SEQ ID NO: 3711692 - DNA, 15 bp, Homo sapiens
ccaggctccttcctg

SEQ ID NO: 3711693 - DNA, 21 bp, Homo sapiens
ccaggctgcatagaaggagga

SEQ ID NO: 3711694 - DNA, 19 bp, Homo sapiens
ccaggctgccaaggccaga

SEQ ID NO: 3711695 - DNA, 17 bp, Homo sapiens
ccaggctgcctgagcac

SEQ ID NO: 3711696 - DNA, 14 bp, Homo sapiens
ccaggctgctggac

SEQ ID NO: 3711697 - DNA, 16 bp, Homo sapiens
ccaggctggcgtgcag

SEQ ID NO: 3711698 - DNA, 19 bp, Homo sapiens
ccaggctggtctcaaactc

SEQ ID NO: 3711699 - DNA, 24 bp, Homo sapiens
ccaggctgtatcccatgagcctca

SEQ ID NO: 3711700 - DNA, 17 bp, Homo sapiens
ccaggctgtgggcctca

SEQ ID NO: 3711701 - DNA, 21 bp, Homo sapiens
ccaggctgtgggcctcaagga

SEQ ID NO: 3711702 - DNA, 22 bp, Homo sapiens
ccaggctgtgggcctcaaggac

SEQ ID NO: 3711703 - DNA, 18 bp, Homo sapiens
ccaggcttgcctgcaggc

SEQ ID NO: 3711704 - DNA, 16 bp, Homo sapiens
ccagggagcaagacag

SEQ ID NO: 3711705 - DNA, 18 bp, Homo sapiens
ccagggagcggaaagcag

SEQ ID NO: 3711706 - DNA, 23 bp, Homo sapiens
ccagggagcggaaagcagctcaa

SEQ ID NO: 3711707 - DNA, 22 bp, Homo sapiens
ccagggagcttgaaagttttca

SEQ ID NO: 3711708 - DNA, 17 bp, Homo sapiens
ccagggatggggccaca

SEQ ID NO: 3711709 - DNA, 17 bp, Homo sapiens
ccagggccactctgcct

SEQ ID NO: 3711710 - DNA, 21 bp, Homo sapiens
ccagggccactctgcctctgc

SEQ ID NO: 3711711 - DNA, 17 bp, Homo sapiens
ccagggccagggccctg

SEQ ID NO: 3711712 - DNA, 18 bp, Homo sapiens
ccagggccatgaactttg

SEQ ID NO: 3711713 - DNA, 18 bp, Homo sapiens
ccagggccctgagctcgg

SEQ ID NO: 3711714 - DNA, 14 bp, Homo sapiens
ccagggccctgcag

SEQ ID NO: 3711715 - DNA, 15 bp, Homo sapiens
ccagggccctgcaga

SEQ ID NO: 3711716 - DNA, 13 bp, Homo sapiens
ccaggggaccaca

SEQ ID NO: 3711717 - DNA, 21 bp, Homo sapiens
ccaggggagagggtctggaga

SEQ ID NO: 3711718 - DNA, 15 bp, Homo sapiens
ccagggttcccccag

SEQ ID NO: 3711719 - DNA, 20 bp, Homo sapiens
ccagggttcccccagccctg

SEQ ID NO: 3711720 - DNA, 21 bp, Homo sapiens
ccagggttcccccagccctgt

SEQ ID NO: 3711721 - DNA, 22 bp, Homo sapiens
ccagggttcccccagccctgtg

SEQ ID NO: 3711722 - DNA, 14 bp, Homo sapiens
ccaggtcgggctca

SEQ ID NO: 3711723 - DNA, 17 bp, Homo sapiens
ccaggtcgggctcagct

SEQ ID NO: 3711724 - DNA, 18 bp, Homo sapiens
ccaggtcgggctcagctc

SEQ ID NO: 3711725 - DNA, 14 bp, Homo sapiens
ccaggtgcagtggc

SEQ ID NO: 3711726 - DNA, 19 bp, Homo sapiens
ccaggtggctgacccagtc

SEQ ID NO: 3711727 - DNA, 20 bp, Homo sapiens
ccaggtggctgacccagtcc

SEQ ID NO: 3711728 - DNA, 21 bp, Homo sapiens
ccaggtggctgacccagtccc

SEQ ID NO: 3711729 - DNA, 22 bp, Homo sapiens
ccaggtggctgacccagtccct

SEQ ID NO: 3711730 - DNA, 23 bp, Homo sapiens
ccaggttctggttagctcagccc

SEQ ID NO: 3711731 - DNA, 13 bp, Homo sapiens
ccaggttgaaaga

SEQ ID NO: 3711732 - DNA, 15 bp, Homo sapiens
ccagtacctccaagc

SEQ ID NO: 3711733 - DNA, 16 bp, Homo sapiens
ccagtacctccaagca

SEQ ID NO: 3711734 - DNA, 22 bp, Homo sapiens
ccagtattctaggtagtgccct

SEQ ID NO: 3711735 - DNA, 19 bp, Homo sapiens
ccagtcataccaactttag

SEQ ID NO: 3711736 - DNA, 12 bp, Homo sapiens
ccagtccctggg

SEQ ID NO: 3711737 - DNA, 15 bp, Homo sapiens
ccagtccctggggga

SEQ ID NO: 3711738 - DNA, 23 bp, Homo sapiens
ccagtccctgggggaagccctgg

SEQ ID NO: 3711739 - DNA, 14 bp, Homo sapiens
ccagtcctgcctgg

SEQ ID NO: 3711740 - DNA, 19 bp, Homo sapiens
ccagtcctgcctggccagg

SEQ ID NO: 3711741 - DNA, 12 bp, Homo sapiens
ccagtctcccag

SEQ ID NO: 3711742 - DNA, 13 bp, Homo sapiens
ccagtctcccagg

SEQ ID NO: 3711743 - DNA, 12 bp, Homo sapiens
ccagtctgaagt

SEQ ID NO: 3711744 - DNA, 14 bp, Homo sapiens
ccagtctgaagttt

SEQ ID NO: 3711745 - DNA, 17 bp, Homo sapiens
ccagtctgctgccctcc

SEQ ID NO: 3711746 - DNA, 23 bp, Homo sapiens
ccagtctgctgccctccatcccg

SEQ ID NO: 3711747 - DNA, 18 bp, Homo sapiens
ccagtctggaatgcagtg

SEQ ID NO: 3711748 - DNA, 20 bp, Homo sapiens
ccagtctggaatgcagtggt

SEQ ID NO: 3711749 - DNA, 11 bp, Homo sapiens
ccagtgacact

SEQ ID NO: 3711750 - DNA, 20 bp, Homo sapiens
ccagtgacacttcagagagc

SEQ ID NO: 3711751 - DNA, 16 bp, Homo sapiens
ccagtgaccaaccttt

SEQ ID NO: 3711752 - DNA, 23 bp, Homo sapiens
ccagtgagttcagcctttaagat

SEQ ID NO: 3711753 - DNA, 14 bp, Homo sapiens
ccagtgcacccact

SEQ ID NO: 3711754 - DNA, 15 bp, Homo sapiens
ccagtgccctggggc

SEQ ID NO: 3711755 - DNA, 20 bp, Homo sapiens
ccagtgccgagaaggaagcc

SEQ ID NO: 3711756 - DNA, 17 bp, Homo sapiens
ccagtgccttacctcct

SEQ ID NO: 3711757 - DNA, 18 bp, Homo sapiens
ccagtgccttacctcctg

SEQ ID NO: 3711758 - DNA, 19 bp, Homo sapiens
ccagtgccttacctcctgc

SEQ ID NO: 3711759 - DNA, 22 bp, Homo sapiens
ccagtgccttacctcctgccca

SEQ ID NO: 3711760 - DNA, 23 bp, Homo sapiens
ccagtgccttacctcctgcccag

SEQ ID NO: 3711761 - DNA, 14 bp, Homo sapiens
ccagtggcctggct

SEQ ID NO: 3711762 - DNA, 15 bp, Homo sapiens
ccagtgtgatcccaa

SEQ ID NO: 3711763 - DNA, 21 bp, Homo sapiens
ccagtgtgtggctttcagagc

SEQ ID NO: 3711764 - DNA, 22 bp, Homo sapiens
ccagtgtgtggctttcagagcc

SEQ ID NO: 3711765 - DNA, 18 bp, Homo sapiens
ccagttcaggagtcccaa

SEQ ID NO: 3711766 - DNA, 14 bp, Homo sapiens
ccagttgcacttgg

SEQ ID NO: 3711767 - DNA, 20 bp, Homo sapiens
ccagttgcacttggcctctg

SEQ ID NO: 3711768 - DNA, 20 bp, Homo sapiens
ccagttgggtggatgcctgg

SEQ ID NO: 3711769 - DNA, 22 bp, Homo sapiens
ccagttgtcccgattgtaactc

SEQ ID NO: 3711770 - DNA, 19 bp, Homo sapiens
ccataatgtataaagaaca

SEQ ID NO: 3711771 - DNA, 23 bp, Homo sapiens
cccagctgtgctctggacaggca

SEQ ID NO: 3711772 - DNA, 14 bp, Homo sapiens
cccaggagagccag

SEQ ID NO: 3711773 - DNA, 23 bp, Homo sapiens
cccaggaggtggaggttgcagtg

SEQ ID NO: 3711774 - DNA, 24 bp, Homo sapiens
cccaggagttcgaggctgcagtca

SEQ ID NO: 3711775 - DNA, 14 bp, Homo sapiens
cccaggcaggccac

SEQ ID NO: 3711776 - DNA, 13 bp, Homo sapiens
cccaggcaggctg

SEQ ID NO: 3711777 - DNA, 17 bp, Homo sapiens
cccaggccccaggaagc

SEQ ID NO: 3711778 - DNA, 12 bp, Homo sapiens
cccaggccccct

SEQ ID NO: 3711779 - DNA, 11 bp, Homo sapiens
cccaggcccct

SEQ ID NO: 3711780 - DNA, 17 bp, Homo sapiens
cccaggcctccagctca

SEQ ID NO: 3711781 - DNA, 18 bp, Homo sapiens
cccaggcctccagctcag

SEQ ID NO: 3711782 - DNA, 18 bp, Homo sapiens
cccaggcgccccttcccc

SEQ ID NO: 3711783 - DNA, 20 bp, Homo sapiens
cccaggctgcctgagcacct

SEQ ID NO: 3711784 - DNA, 21 bp, Homo sapiens
cccaggctggcgtgcagtggt

SEQ ID NO: 3711785 - DNA, 20 bp, Homo sapiens
cccagggagcggaaagcagc

SEQ ID NO: 3711786 - DNA, 23 bp, Homo sapiens
cccagggccactctgcctctgcc

SEQ ID NO: 3711787 - DNA, 21 bp, Homo sapiens
cccagggccagggccctgcag

SEQ ID NO: 3711788 - DNA, 17 bp, Homo sapiens
cccaggggaccacacct

SEQ ID NO: 3711789 - DNA, 23 bp, Homo sapiens
cccaggggagagggtctggagaa

SEQ ID NO: 3711790 - DNA, 15 bp, Homo sapiens
cccaggggtcccagc

SEQ ID NO: 3711791 - DNA, 20 bp, Homo sapiens
cccaggggtcccagccaccc

SEQ ID NO: 3711792 - DNA, 15 bp, Homo sapiens
cccagggtcttccct

SEQ ID NO: 3711793 - DNA, 16 bp, Homo sapiens
cccagggtcttcccta

SEQ ID NO: 3711794 - DNA, 13 bp, Homo sapiens
cccaggtcctcac

SEQ ID NO: 3711795 - DNA, 18 bp, Homo sapiens
cccaggtggctgacccag

SEQ ID NO: 3711796 - DNA, 13 bp, Homo sapiens
cccaggtttctat

SEQ ID NO: 3711797 - DNA, 22 bp, Homo sapiens
cccagtaattattttcttcctt

SEQ ID NO: 3711798 - DNA, 18 bp, Homo sapiens
cccagtacctccaagcaa

SEQ ID NO: 3711799 - DNA, 23 bp, Homo sapiens
cccagtattctaggtagtgccct

SEQ ID NO: 3711800 - DNA, 22 bp, Homo sapiens
cccagtgacacttcagagagct

SEQ ID NO: 3711801 - DNA, 20 bp, Homo sapiens
cccagtgcccacaggatcag

SEQ ID NO: 3711802 - DNA, 15 bp, Homo sapiens
cccagtgccgagaag

SEQ ID NO: 3711803 - DNA, 18 bp, Homo sapiens
cccagtgccgagaaggaa

SEQ ID NO: 3711804 - DNA, 16 bp, Homo sapiens
cccagtgttgtttgta

SEQ ID NO: 3711805 - DNA, 17 bp, Homo sapiens
cccagtgttgtttgtaa

SEQ ID NO: 3711806 - DNA, 22 bp, Homo sapiens
cccagtttgcagaaaagcacct

SEQ ID NO: 3711807 - DNA, 16 bp, Homo sapiens
cccatagcttccatga

SEQ ID NO: 3711808 - DNA, 19 bp, Homo sapiens
cccatagtgaccggctgct

SEQ ID NO: 3711809 - DNA, 16 bp, Homo sapiens
cccatcacgcctgtgc

SEQ ID NO: 3711810 - DNA, 13 bp, Homo sapiens
cccatcactggag

SEQ ID NO: 3711811 - DNA, 14 bp, Homo sapiens
cccatccagttcat

SEQ ID NO: 3711812 - DNA, 14 bp, Homo sapiens
cccatcccatccca

SEQ ID NO: 3711813 - DNA, 16 bp, Homo sapiens
cccatcccatcccatc

SEQ ID NO: 3711814 - DNA, 14 bp, Homo sapiens
cccatcctcccctt

SEQ ID NO: 3711815 - DNA, 18 bp, Homo sapiens
cccatcctccccttccct

SEQ ID NO: 3711816 - DNA, 22 bp, Homo sapiens
cccatcctccccttccctgcaa

SEQ ID NO: 3711817 - DNA, 13 bp, Homo sapiens
cccatctctccct

SEQ ID NO: 3711818 - DNA, 21 bp, Homo sapiens
cccatctctccctcccctgcc

SEQ ID NO: 3711819 - DNA, 15 bp, Homo sapiens
cccatcttgcctcca

SEQ ID NO: 3711820 - DNA, 19 bp, Homo sapiens
cccatgaagacaggacagt

SEQ ID NO: 3711821 - DNA, 14 bp, Homo sapiens
cccatgagcctcag

SEQ ID NO: 3711822 - DNA, 16 bp, Homo sapiens
cccatgagcctcagca

SEQ ID NO: 3711823 - DNA, 15 bp, Homo sapiens
cccatgcccacctgc

SEQ ID NO: 3711824 - DNA, 13 bp, Homo sapiens
cccatgcctgtcc

SEQ ID NO: 3711825 - DNA, 16 bp, Homo sapiens
cccatgcctgtccagc

SEQ ID NO: 3711826 - DNA, 20 bp, Homo sapiens
cccatgtgtgagtgtgtgca

SEQ ID NO: 3711827 - DNA, 19 bp, Homo sapiens
cccattctctctcctgtcc

SEQ ID NO: 3711828 - DNA, 20 bp, Homo sapiens
cccattctctctcctgtcca

SEQ ID NO: 3711829 - DNA, 22 bp, Homo sapiens
cccattctgcctgcccaggccc

SEQ ID NO: 3711830 - DNA, 23 bp, Homo sapiens
cccattctgcctgcccaggcccc

SEQ ID NO: 3711831 - DNA, 11 bp, Homo sapiens
cccattctttg

SEQ ID NO: 3711832 - DNA, 16 bp, Homo sapiens
cccatttctatttatt

SEQ ID NO: 3711833 - DNA, 22 bp, Homo sapiens
cccattttggaagttttcagga

SEQ ID NO: 3711834 - DNA, 15 bp, Homo sapiens
ccccaaaaccacagc

SEQ ID NO: 3711835 - DNA, 16 bp, Homo sapiens
ccccaaaaccacagcc

SEQ ID NO: 3711836 - DNA, 19 bp, Homo sapiens
ccccaaacgggctgccctg

SEQ ID NO: 3711837 - DNA, 12 bp, Homo sapiens
ccccaaagcccc

SEQ ID NO: 3711838 - DNA, 13 bp, Homo sapiens
ccccaaccctgcc

SEQ ID NO: 3711839 - DNA, 17 bp, Homo sapiens
ccccaaccctgcccctg

SEQ ID NO: 3711840 - DNA, 14 bp, Homo sapiens
ccccaaggggcagt

SEQ ID NO: 3711841 - DNA, 22 bp, Homo sapiens
ccccaaggggcagtctggaggg

SEQ ID NO: 3711842 - DNA, 14 bp, Homo sapiens
ccccacacctcagt

SEQ ID NO: 3711843 - DNA, 16 bp, Homo sapiens
ccccacacctggccct

SEQ ID NO: 3711844 - DNA, 22 bp, Homo sapiens
ccccacacttgttccagctctt

SEQ ID NO: 3711845 - DNA, 12 bp, Homo sapiens
ccccaccaccta

SEQ ID NO: 3711846 - DNA, 17 bp, Homo sapiens
ccccaccacttctttta

SEQ ID NO: 3711847 - DNA, 13 bp, Homo sapiens
ccccacccaggag

SEQ ID NO: 3711848 - DNA, 13 bp, Homo sapiens
ccccaccccagcc

SEQ ID NO: 3711849 - DNA, 17 bp, Homo sapiens
ccccaccccctccccag

SEQ ID NO: 3711850 - DNA, 12 bp, Homo sapiens
ccccaccccctt

SEQ ID NO: 3711851 - DNA, 17 bp, Homo sapiens
ccccacccccttcagtg

SEQ ID NO: 3711852 - DNA, 21 bp, Homo sapiens
ccccacccccttcagtgccca

SEQ ID NO: 3711853 - DNA, 13 bp, Homo sapiens
ccccaccccttcc

SEQ ID NO: 3711854 - DNA, 17 bp, Homo sapiens
ccccaccccttccccac

SEQ ID NO: 3711855 - DNA, 13 bp, Homo sapiens
ccccacctcctgc

SEQ ID NO: 3711856 - DNA, 11 bp, Homo sapiens
ccccacctgcc

SEQ ID NO: 3711857 - DNA, 17 bp, Homo sapiens
ccccacctgccactagg

SEQ ID NO: 3711858 - DNA, 20 bp, Homo sapiens
ccccactctcattccccagg

SEQ ID NO: 3711859 - DNA, 18 bp, Homo sapiens
ccccactctccccacact

SEQ ID NO: 3711860 - DNA, 14 bp, Homo sapiens
ccccactggctgtg

SEQ ID NO: 3711861 - DNA, 23 bp, Homo sapiens
ccccactggctgtgggctccctt

SEQ ID NO: 3711862 - DNA, 14 bp, Homo sapiens
ccccactggggaaa

SEQ ID NO: 3711863 - DNA, 20 bp, Homo sapiens
ccccagaacctgtccttgca

SEQ ID NO: 3711864 - DNA, 16 bp, Homo sapiens
ccccagaaggcaggga

SEQ ID NO: 3711865 - DNA, 23 bp, Homo sapiens
ccccagagctgtttatggcctca

SEQ ID NO: 3711866 - DNA, 15 bp, Homo sapiens
ccccagattgcaaca

SEQ ID NO: 3711867 - DNA, 21 bp, Homo sapiens
ccccagcaagtgagagctggg

SEQ ID NO: 3711868 - DNA, 22 bp, Homo sapiens
ccccagcaagtgagagctgggt

SEQ ID NO: 3711869 - DNA, 19 bp, Homo sapiens
ccccagcactaaagcagtg

SEQ ID NO: 3711870 - DNA, 13 bp, Homo sapiens
ccccagccctgtg

SEQ ID NO: 3711871 - DNA, 16 bp, Homo sapiens
ccccagctctgcttgc

SEQ ID NO: 3711872 - DNA, 17 bp, Homo sapiens
ccccagctctggcttcc

SEQ ID NO: 3711873 - DNA, 15 bp, Homo sapiens
ccccagctgactgtg

SEQ ID NO: 3711874 - DNA, 18 bp, Homo sapiens
ccccagctgactgtggcc

SEQ ID NO: 3711875 - DNA, 12 bp, Homo sapiens
ccccaggaagcc

SEQ ID NO: 3711876 - DNA, 18 bp, Homo sapiens
ccccaggcaggctgtgcg

SEQ ID NO: 3711877 - DNA, 12 bp, Homo sapiens
ccccaggcccca

SEQ ID NO: 3711878 - DNA, 19 bp, Homo sapiens
ccccaggggtcccagccac

SEQ ID NO: 3711879 - DNA, 13 bp, Homo sapiens
ccccaggtggctg

SEQ ID NO: 3711880 - DNA, 23 bp, Homo sapiens
ccccaggtggctgacccagtccc

SEQ ID NO: 3711881 - DNA, 12 bp, Homo sapiens
ccccatagccac

SEQ ID NO: 3711882 - DNA, 18 bp, Homo sapiens
ccccatcagttcccccag

SEQ ID NO: 3711883 - DNA, 12 bp, Homo sapiens
ccccatctctcc

SEQ ID NO: 3711884 - DNA, 16 bp, Homo sapiens
ccccatctctccctcc

SEQ ID NO: 3711885 - DNA, 17 bp, Homo sapiens
ccctgtggagcccgcac

SEQ ID NO: 3711886 - DNA, 14 bp, Homo sapiens
ccctgttcactcta

SEQ ID NO: 3711887 - DNA, 22 bp, Homo sapiens
ccctgttcactctacttagcat

SEQ ID NO: 3711888 - DNA, 23 bp, Homo sapiens
cccttagcagggaaacagctaat

SEQ ID NO: 3711889 - DNA, 17 bp, Homo sapiens
cccttagcctccctgaa

SEQ ID NO: 3711890 - DNA, 18 bp, Homo sapiens
cccttcaaccattcccca

SEQ ID NO: 3711891 - DNA, 19 bp, Homo sapiens
cccttcacaccataactag

SEQ ID NO: 3711892 - DNA, 16 bp, Homo sapiens
cccttcacagtgtttc

SEQ ID NO: 3711893 - DNA, 14 bp, Homo sapiens
cccttccaggccat

SEQ ID NO: 3711894 - DNA, 20 bp, Homo sapiens
cccttccatgtcgcctctgc

SEQ ID NO: 3711895 - DNA, 21 bp, Homo sapiens
cccttccccactgcctgccca

SEQ ID NO: 3711896 - DNA, 17 bp, Homo sapiens
cccttcccctccctggc

SEQ ID NO: 3711897 - DNA, 13 bp, Homo sapiens
cccttccctgcaa

SEQ ID NO: 3711898 - DNA, 20 bp, Homo sapiens
cccttcctctccactgcctt

SEQ ID NO: 3711899 - DNA, 21 bp, Homo sapiens
cccttcctctccactgccttc

SEQ ID NO: 3711900 - DNA, 14 bp, Homo sapiens
cccttcgctcctgt

SEQ ID NO: 3711901 - DNA, 18 bp, Homo sapiens
cccttcgctcctgtgtct

SEQ ID NO: 3711902 - DNA, 14 bp, Homo sapiens
cccttctacactct

SEQ ID NO: 3711903 - DNA, 15 bp, Homo sapiens
cccttctcccacact

SEQ ID NO: 3711904 - DNA, 15 bp, Homo sapiens
cccttctccttccaa

SEQ ID NO: 3711905 - DNA, 15 bp, Homo sapiens
cccttctctgctcca

SEQ ID NO: 3711906 - DNA, 17 bp, Homo sapiens
cccttctctgctccacc

SEQ ID NO: 3711907 - DNA, 23 bp, Homo sapiens
cccttctctgctccaccacatcc

SEQ ID NO: 3711908 - DNA, 13 bp, Homo sapiens
cccttctctgtat

SEQ ID NO: 3711909 - DNA, 14 bp, Homo sapiens
cccttctgtgccca

SEQ ID NO: 3711910 - DNA, 17 bp, Homo sapiens
cccttctgtgcccagct

SEQ ID NO: 3711911 - DNA, 16 bp, Homo sapiens
cccttgagacctcagc

SEQ ID NO: 3711912 - DNA, 20 bp, Homo sapiens
cccttgagctccccaaaaac

SEQ ID NO: 3711913 - DNA, 16 bp, Homo sapiens
cccttgcagctagttt

SEQ ID NO: 3711914 - DNA, 15 bp, Homo sapiens
cccttgccagacatg

SEQ ID NO: 3711915 - DNA, 23 bp, Homo sapiens
cccttgcccagggctcagcctgg

SEQ ID NO: 3711916 - DNA, 14 bp, Homo sapiens
cccttggcctcaga

SEQ ID NO: 3711917 - DNA, 12 bp, Homo sapiens
cccttggcctgt

SEQ ID NO: 3711918 - DNA, 19 bp, Homo sapiens
cccttggcctgtctcatcc

SEQ ID NO: 3711919 - DNA, 12 bp, Homo sapiens
cccttgtgtgtg

SEQ ID NO: 3711920 - DNA, 18 bp, Homo sapiens
ccctttccttccttccct

SEQ ID NO: 3711921 - DNA, 17 bp, Homo sapiens
ccctttcttggccagtt

SEQ ID NO: 3711922 - DNA, 14 bp, Homo sapiens
cccttttggccccc

SEQ ID NO: 3711923 - DNA, 23 bp, Homo sapiens
ccctttttactccccttgagctg

SEQ ID NO: 3711924 - DNA, 20 bp, Homo sapiens
ccgaagaagggtccttccct

SEQ ID NO: 3711925 - DNA, 19 bp, Homo sapiens
ccgaaggaaaagggctttc

SEQ ID NO: 3711926 - DNA, 20 bp, Homo sapiens
ccgaatagctgggactacag

SEQ ID NO: 3711927 - DNA, 20 bp, Homo sapiens
ccgacaaccgatgctccagc

SEQ ID NO: 3711928 - DNA, 17 bp, Homo sapiens
ccgacacgctccctccc

SEQ ID NO: 3711929 - DNA, 13 bp, Homo sapiens
ccgacagagggaa

SEQ ID NO: 3711930 - DNA, 14 bp, Homo sapiens
ccgacagcctggca

SEQ ID NO: 3711931 - DNA, 13 bp, Homo sapiens
ccgaccagacacc

SEQ ID NO: 3711932 - DNA, 15 bp, Homo sapiens
ccgacctcagccttc

SEQ ID NO: 3711933 - DNA, 22 bp, Homo sapiens
ccgacctcgtcctccccctgcc

SEQ ID NO: 3711934 - DNA, 23 bp, Homo sapiens
ccgacctcgtcctccccctgcca

SEQ ID NO: 3711935 - DNA, 21 bp, Homo sapiens
ccgagattgcaccactgcact

SEQ ID NO: 3711936 - DNA, 17 bp, Homo sapiens
ccgagccctacttccag

SEQ ID NO: 3711937 - DNA, 16 bp, Homo sapiens
ccgagctgggggccat

SEQ ID NO: 3711938 - DNA, 19 bp, Homo sapiens
ccgagctgggggccatgag

SEQ ID NO: 3711939 - DNA, 17 bp, Homo sapiens
ccgagctggtgcattac

SEQ ID NO: 3711940 - DNA, 19 bp, Homo sapiens
ccgagctttgaaaattcag

SEQ ID NO: 3711941 - DNA, 14 bp, Homo sapiens
ccgaggccttctct

SEQ ID NO: 3711942 - DNA, 14 bp, Homo sapiens
ccgaggctggagct

SEQ ID NO: 3711943 - DNA, 16 bp, Homo sapiens
ccgagggtcctggctc

SEQ ID NO: 3711944 - DNA, 19 bp, Homo sapiens
ccgagggtcctggctcctg

SEQ ID NO: 3711945 - DNA, 21 bp, Homo sapiens
ccgaggtggctgcctggagcc

SEQ ID NO: 3711946 - DNA, 16 bp, Homo sapiens
ccgagtagctgggact

SEQ ID NO: 3711947 - DNA, 21 bp, Homo sapiens
ccgagtctcttctccactgga

SEQ ID NO: 3711948 - DNA, 21 bp, Homo sapiens
ccgagtggatagatgccctgc

SEQ ID NO: 3711949 - DNA, 19 bp, Homo sapiens
ccgatgctccagccaaccc

SEQ ID NO: 3711950 - DNA, 16 bp, Homo sapiens
ccgattgtaactcaaa

SEQ ID NO: 3711951 - DNA, 11 bp, Homo sapiens
ccgcaccccag

SEQ ID NO: 3711952 - DNA, 17 bp, Homo sapiens
ccgcaccccagagtgtg

SEQ ID NO: 3711953 - DNA, 16 bp, Homo sapiens
ccgcacccccaccctt

SEQ ID NO: 3711954 - DNA, 13 bp, Homo sapiens
ccgcaccccccaa

SEQ ID NO: 3711955 - DNA, 14 bp, Homo sapiens
ccgcagcctccctc

SEQ ID NO: 3711956 - DNA, 15 bp, Homo sapiens
ccgcaggaagctgct

SEQ ID NO: 3711957 - DNA, 19 bp, Homo sapiens
ccgcaggaagctgctccgt

SEQ ID NO: 3711958 - DNA, 23 bp, Homo sapiens
ccgcaggatttgggctcttggaa

SEQ ID NO: 3711959 - DNA, 15 bp, Homo sapiens
ccgcatcttctccat

SEQ ID NO: 3711960 - DNA, 16 bp, Homo sapiens
ccgcattccaggctcc

SEQ ID NO: 3711961 - DNA, 20 bp, Homo sapiens
ccgccattctcaagccctgc

SEQ ID NO: 3711962 - DNA, 21 bp, Homo sapiens
ccgccattctcaagccctgca

SEQ ID NO: 3711963 - DNA, 15 bp, Homo sapiens
ccgccccagcctctg

SEQ ID NO: 3711964 - DNA, 11 bp, Homo sapiens
ccgcctctgct

SEQ ID NO: 3711965 - DNA, 21 bp, Homo sapiens
ccgcctggcagaactgagctc

SEQ ID NO: 3711966 - DNA, 17 bp, Homo sapiens
ccgcgtctggtgacaac

SEQ ID NO: 3711967 - DNA, 11 bp, Homo sapiens
ccgctcagccc

SEQ ID NO: 3711968 - DNA, 12 bp, Homo sapiens
ccgctcagccct

SEQ ID NO: 3711969 - DNA, 13 bp, Homo sapiens
ccgctccccagcc

SEQ ID NO: 3711970 - DNA, 16 bp, Homo sapiens
ccgctccccagcccag

SEQ ID NO: 3711971 - DNA, 12 bp, Homo sapiens
ccgctgccagca

SEQ ID NO: 3711972 - DNA, 18 bp, Homo sapiens
ccgctgccagcacagagc

SEQ ID NO: 3711973 - DNA, 15 bp, Homo sapiens
ccggagctttcaaag

SEQ ID NO: 3711974 - DNA, 14 bp, Homo sapiens
ccggaggggcctgg

SEQ ID NO: 3711975 - DNA, 17 bp, Homo sapiens
ccggcagttctgggtgc

SEQ ID NO: 3711976 - DNA, 19 bp, Homo sapiens
ccggccagctgggatctga

SEQ ID NO: 3711977 - DNA, 17 bp, Homo sapiens
ccggctatgggggcact

SEQ ID NO: 3711978 - DNA, 15 bp, Homo sapiens
ccggctccaggctcc

SEQ ID NO: 3711979 - DNA, 21 bp, Homo sapiens
ccggctccaggctcctttagc

SEQ ID NO: 3711980 - DNA, 16 bp, Homo sapiens
ccggctctggctctcc

SEQ ID NO: 3711981 - DNA, 17 bp, Homo sapiens
ccgggaagccaccctcc

SEQ ID NO: 3711982 - DNA, 23 bp, Homo sapiens
ccgggactcactggcagccccag

SEQ ID NO: 3711983 - DNA, 17 bp, Homo sapiens
ccgggcacagctgtggt

SEQ ID NO: 3711984 - DNA, 15 bp, Homo sapiens
ccgggcactcagaag

SEQ ID NO: 3711985 - DNA, 20 bp, Homo sapiens
ccgggcactcagaagacact

SEQ ID NO: 3711986 - DNA, 22 bp, Homo sapiens
ccgggcactcagaagacactga

SEQ ID NO: 3711987 - DNA, 13 bp, Homo sapiens
ccgggctgggagc

SEQ ID NO: 3711988 - DNA, 20 bp, Homo sapiens
ccggggcagctgccagagaa

SEQ ID NO: 3711989 - DNA, 19 bp, Homo sapiens
ccgggtttggcgggccaag

SEQ ID NO: 3711990 - DNA, 20 bp, Homo sapiens
ccgggtttggcgggccaagg

SEQ ID NO: 3711991 - DNA, 16 bp, Homo sapiens
ccggtgtgcctgcagc

SEQ ID NO: 3711992 - DNA, 17 bp, Homo sapiens
ccggtgtgcctgcagcc

SEQ ID NO: 3711993 - DNA, 17 bp, Homo sapiens
ccggttgcttctgggaa

SEQ ID NO: 3711994 - DNA, 18 bp, Homo sapiens
ccgtagggagtacctgct

SEQ ID NO: 3711995 - DNA, 16 bp, Homo sapiens
ccgtagttccctgaaa

SEQ ID NO: 3711996 - DNA, 19 bp, Homo sapiens
ccgtctggggttcagcccc

SEQ ID NO: 3711997 - DNA, 21 bp, Homo sapiens
ccgtctggggttcagcccctc

SEQ ID NO: 3711998 - DNA, 19 bp, Homo sapiens
cctcaggtcagggtgagga

SEQ ID NO: 3711999 - DNA, 16 bp, Homo sapiens
cctcaggtgagaagca

SEQ ID NO: 3712000 - DNA, 22 bp, Homo sapiens
cctcaggtgagaagcagaggaa

SEQ ID NO: 3712001 - DNA, 17 bp, Homo sapiens
cctcaggtgatccaccc

SEQ ID NO: 3712002 - DNA, 20 bp, Homo sapiens
cctcagtctggcccttcctt

SEQ ID NO: 3712003 - DNA, 21 bp, Homo sapiens
cctcagtggactttccacccc

SEQ ID NO: 3712004 - DNA, 12 bp, Homo sapiens
cctcagtgtcat

SEQ ID NO: 3712005 - DNA, 16 bp, Homo sapiens
cctcagttcccttggc

SEQ ID NO: 3712006 - DNA, 20 bp, Homo sapiens
cctcagttcccttggcctca

SEQ ID NO: 3712007 - DNA, 19 bp, Homo sapiens
cctcagttttatcattttc

SEQ ID NO: 3712008 - DNA, 20 bp, Homo sapiens
cctcatagtatggtggctgg

SEQ ID NO: 3712009 - DNA, 14 bp, Homo sapiens
cctcatccgaggca

SEQ ID NO: 3712010 - DNA, 15 bp, Homo sapiens
cctcatccgaggcag

SEQ ID NO: 3712011 - DNA, 20 bp, Homo sapiens
cctcatccgaggcagggtca

SEQ ID NO: 3712012 - DNA, 14 bp, Homo sapiens
cctcatgccaaccc

SEQ ID NO: 3712013 - DNA, 15 bp, Homo sapiens
cctcattcaggaaaa

SEQ ID NO: 3712014 - DNA, 17 bp, Homo sapiens
cctcattcaggaaaact

SEQ ID NO: 3712015 - DNA, 22 bp, Homo sapiens
cctcattcaggaaaactgacag

SEQ ID NO: 3712016 - DNA, 20 bp, Homo sapiens
cctcatttggggtagctaga

SEQ ID NO: 3712017 - DNA, 23 bp, Homo sapiens
cctcatttttgaatacaggcata

SEQ ID NO: 3712018 - DNA, 14 bp, Homo sapiens
cctccaagcaagta

SEQ ID NO: 3712019 - DNA, 23 bp, Homo sapiens
cctccaatcccaccaaccctcag

SEQ ID NO: 3712020 - DNA, 16 bp, Homo sapiens
cctccactgccctctg

SEQ ID NO: 3712021 - DNA, 17 bp, Homo sapiens
cctccagaagcctctgg

SEQ ID NO: 3712022 - DNA, 18 bp, Homo sapiens
cctccagaagcctctggc

SEQ ID NO: 3712023 - DNA, 20 bp, Homo sapiens
cctccagaagcctctggcta

SEQ ID NO: 3712024 - DNA, 22 bp, Homo sapiens
cctccagccctctcactgtgtc

SEQ ID NO: 3712025 - DNA, 11 bp, Homo sapiens
cctccagctca

SEQ ID NO: 3712026 - DNA, 15 bp, Homo sapiens
cctccagctcagcag

SEQ ID NO: 3712027 - DNA, 14 bp, Homo sapiens
cctccagggccacg

SEQ ID NO: 3712028 - DNA, 18 bp, Homo sapiens
cctccagggccacgtgcc

SEQ ID NO: 3712029 - DNA, 20 bp, Homo sapiens
cctccagggccacgtgccag

SEQ ID NO: 3712030 - DNA, 21 bp, Homo sapiens
cctccagggccacgtgccagg

SEQ ID NO: 3712031 - DNA, 22 bp, Homo sapiens
cctccagggccacgtgccaggc

SEQ ID NO: 3712032 - DNA, 15 bp, Homo sapiens
cctccatgctgcctc

SEQ ID NO: 3712033 - DNA, 16 bp, Homo sapiens
cctccatgctgcctcc

SEQ ID NO: 3712034 - DNA, 18 bp, Homo sapiens
cctccatggtgcctctgg

SEQ ID NO: 3712035 - DNA, 12 bp, Homo sapiens
cctccatgtggg

SEQ ID NO: 3712036 - DNA, 15 bp, Homo sapiens
cctcccaaagtgctg

SEQ ID NO: 3712037 - DNA, 17 bp, Homo sapiens
cctcccaaagtgctggg

SEQ ID NO: 3712038 - DNA, 12 bp, Homo sapiens
cctcccaccaca

SEQ ID NO: 3712039 - DNA, 12 bp, Homo sapiens
cctcccaccccc

SEQ ID NO: 3712040 - DNA, 18 bp, Homo sapiens
cctcccagaacacactcc

SEQ ID NO: 3712041 - DNA, 12 bp, Homo sapiens
cctcccagcctg

SEQ ID NO: 3712042 - DNA, 14 bp, Homo sapiens
cctcccagggccag

SEQ ID NO: 3712043 - DNA, 12 bp, Homo sapiens
cctccccagcag

SEQ ID NO: 3712044 - DNA, 17 bp, Homo sapiens
cctccccagcaggtggg

SEQ ID NO: 3712045 - DNA, 22 bp, Homo sapiens
cctccccaggggagagggtctg

SEQ ID NO: 3712046 - DNA, 22 bp, Homo sapiens
cctcccccaacccccaccccac

SEQ ID NO: 3712047 - DNA, 16 bp, Homo sapiens
cctccccctccttccc

SEQ ID NO: 3712048 - DNA, 13 bp, Homo sapiens
cctccccctgcca

SEQ ID NO: 3712049 - DNA, 14 bp, Homo sapiens
cctccccctgcccc

SEQ ID NO: 3712050 - DNA, 17 bp, Homo sapiens
cctcccctatccaccca

SEQ ID NO: 3712051 - DNA, 18 bp, Homo sapiens
cctcccctatccacccag

SEQ ID NO: 3712052 - DNA, 13 bp, Homo sapiens
cctcccctcaagg

SEQ ID NO: 3712053 - DNA, 16 bp, Homo sapiens
cctcccctgccctggt

SEQ ID NO: 3712054 - DNA, 17 bp, Homo sapiens
cctcccgagtagctggg

SEQ ID NO: 3712055 - DNA, 13 bp, Homo sapiens
cctcccggtgccc

SEQ ID NO: 3712056 - DNA, 15 bp, Homo sapiens
cctccctacctcaac

SEQ ID NO: 3712057 - DNA, 16 bp, Homo sapiens
cctccctacctcaacc

SEQ ID NO: 3712058 - DNA, 19 bp, Homo sapiens
cctccctacctcaacctgt

SEQ ID NO: 3712059 - DNA, 14 bp, Homo sapiens
cctccctcagcccc

SEQ ID NO: 3712060 - DNA, 10 bp, Homo sapiens
cctccctccc

SEQ ID NO: 3712061 - DNA, 14 bp, Homo sapiens
cctccctctgacct

SEQ ID NO: 3712062 - DNA, 20 bp, Homo sapiens
cctccctgaaaatgtttttc

SEQ ID NO: 3712063 - DNA, 13 bp, Homo sapiens
cctccctgaacca

SEQ ID NO: 3712064 - DNA, 17 bp, Homo sapiens
cctccctgaccctgcag

SEQ ID NO: 3712065 - DNA, 21 bp, Homo sapiens
cctccctgcccctcccttcaa

SEQ ID NO: 3712066 - DNA, 20 bp, Homo sapiens
cctccctggctcccatgacc

SEQ ID NO: 3712067 - DNA, 11 bp, Homo sapiens
cctccctgtcc

SEQ ID NO: 3712068 - DNA, 14 bp, Homo sapiens
cctccctgtccacc

SEQ ID NO: 3712069 - DNA, 17 bp, Homo sapiens
cctcccttctactgctt

SEQ ID NO: 3712070 - DNA, 14 bp, Homo sapiens
cctccgcctcttgg

SEQ ID NO: 3712071 - DNA, 18 bp, Homo sapiens
cctccgtccaggagcctg

SEQ ID NO: 3712072 - DNA, 16 bp, Homo sapiens
cctccgtgatccatcc

SEQ ID NO: 3712073 - DNA, 17 bp, Homo sapiens
cctccgtgatccatcca

SEQ ID NO: 3712074 - DNA, 18 bp, Homo sapiens
cctccgtgatccatccat

SEQ ID NO: 3712075 - DNA, 23 bp, Homo sapiens
cctccgtgatccatccatctcca

SEQ ID NO: 3712076 - DNA, 18 bp, Homo sapiens
cctcctatcacctcccct

SEQ ID NO: 3712077 - DNA, 19 bp, Homo sapiens
cctcctatcacctcccctc

SEQ ID NO: 3712078 - DNA, 16 bp, Homo sapiens
cctcctcacccccagc

SEQ ID NO: 3712079 - DNA, 12 bp, Homo sapiens
cctcctcacctc

SEQ ID NO: 3712080 - DNA, 16 bp, Homo sapiens
cctcctcacctctgga

SEQ ID NO: 3712081 - DNA, 21 bp, Homo sapiens
cctcctcacctctggactggc

SEQ ID NO: 3712082 - DNA, 22 bp, Homo sapiens
cctcctcacctctggactggct

SEQ ID NO: 3712083 - DNA, 14 bp, Homo sapiens
cctcctcactccct

SEQ ID NO: 3712084 - DNA, 12 bp, Homo sapiens
cctcctccagcc

SEQ ID NO: 3712085 - DNA, 21 bp, Homo sapiens
cctcctccagccgccatgctc

SEQ ID NO: 3712086 - DNA, 12 bp, Homo sapiens
cctcctctgcca

SEQ ID NO: 3712087 - DNA, 14 bp, Homo sapiens
cctcctctgccacc

SEQ ID NO: 3712088 - DNA, 18 bp, Homo sapiens
cctcctctgccacctccc

SEQ ID NO: 3712089 - DNA, 20 bp, Homo sapiens
cctcctctgccacctcccct

SEQ ID NO: 3712090 - DNA, 21 bp, Homo sapiens
cctcctgaaacttacacacaa

SEQ ID NO: 3712091 - DNA, 15 bp, Homo sapiens
cctcctgacctgtca

SEQ ID NO: 3712092 - DNA, 12 bp, Homo sapiens
cctcctgcccac

SEQ ID NO: 3712093 - DNA, 23 bp, Homo sapiens
cctcctgcctcgaactggctgca

SEQ ID NO: 3712094 - DNA, 16 bp, Homo sapiens
cctccttcccagctgc

SEQ ID NO: 3712095 - DNA, 14 bp, Homo sapiens
cctccttccttgac

SEQ ID NO: 3712096 - DNA, 14 bp, Homo sapiens
cctccttgcctcct

SEQ ID NO: 3712097 - DNA, 19 bp, Homo sapiens
cctccttgcctcctgtgta

SEQ ID NO: 3712098 - DNA, 15 bp, Homo sapiens
cctcgaactcctggg

SEQ ID NO: 3712099 - DNA, 15 bp, Homo sapiens
cctcgaactggctgc

SEQ ID NO: 3712100 - DNA, 13 bp, Homo sapiens
cctcgccctgggt

SEQ ID NO: 3712101 - DNA, 14 bp, Homo sapiens
cctcgccctgggtc

SEQ ID NO: 3712102 - DNA, 18 bp, Homo sapiens
cctcgctggcccccactg

SEQ ID NO: 3712103 - DNA, 20 bp, Homo sapiens
cctcgctggcccccactggc

SEQ ID NO: 3712104 - DNA, 22 bp, Homo sapiens
cctcgctggcccccactggctg

SEQ ID NO: 3712105 - DNA, 23 bp, Homo sapiens
cctcgctggcccccactggctgt

SEQ ID NO: 3712106 - DNA, 13 bp, Homo sapiens
cctcggagcctca

SEQ ID NO: 3712107 - DNA, 14 bp, Homo sapiens
cctcggagcctcat

SEQ ID NO: 3712108 - DNA, 23 bp, Homo sapiens
cctcggagcctcatccgaggcag

SEQ ID NO: 3712109 - DNA, 15 bp, Homo sapiens
cctcggatcaccgag

SEQ ID NO: 3712110 - DNA, 22 bp, Homo sapiens
cctcgggcgagtcactgcctct

SEQ ID NO: 3712111 - DNA, 16 bp, Homo sapiens
cctcgtcctccccctg

SEQ ID NO: 3712112 - DNA, 23 bp, Homo sapiens
cctggggcagtcacctgcccaga

SEQ ID NO: 3712113 - DNA, 20 bp, Homo sapiens
cctggggctgatctcaggga

SEQ ID NO: 3712114 - DNA, 16 bp, Homo sapiens
cctgggggaagccctg

SEQ ID NO: 3712115 - DNA, 17 bp, Homo sapiens
cctgggggaagccctgg

SEQ ID NO: 3712116 - DNA, 15 bp, Homo sapiens
cctgggggcctgacc

SEQ ID NO: 3712117 - DNA, 19 bp, Homo sapiens
cctgggggcctgacctccc

SEQ ID NO: 3712118 - DNA, 23 bp, Homo sapiens
cctgggggcctgacctccccctc

SEQ ID NO: 3712119 - DNA, 23 bp, Homo sapiens
cctgggggttctttcttcctctg

SEQ ID NO: 3712120 - DNA, 16 bp, Homo sapiens
cctggggtgccctcca

SEQ ID NO: 3712121 - DNA, 16 bp, Homo sapiens
cctgggtgctggctgc

SEQ ID NO: 3712122 - DNA, 17 bp, Homo sapiens
cctgggtggggctgctc

SEQ ID NO: 3712123 - DNA, 20 bp, Homo sapiens
cctgggtggggctgctcctc

SEQ ID NO: 3712124 - DNA, 22 bp, Homo sapiens
cctgggtggggctgctcctcca

SEQ ID NO: 3712125 - DNA, 23 bp, Homo sapiens
cctgggtggggctgctcctccag

SEQ ID NO: 3712126 - DNA, 19 bp, Homo sapiens
cctgggtggtctgcaggca

SEQ ID NO: 3712127 - DNA, 13 bp, Homo sapiens
cctgggttccctt

SEQ ID NO: 3712128 - DNA, 21 bp, Homo sapiens
cctggtcacaggactctgcct

SEQ ID NO: 3712129 - DNA, 22 bp, Homo sapiens
cctggtcacaggactctgcctc

SEQ ID NO: 3712130 - DNA, 23 bp, Homo sapiens
cctggtcacaggactctgcctcc

SEQ ID NO: 3712131 - DNA, 22 bp, Homo sapiens
cctggtccagggaagctggccg

SEQ ID NO: 3712132 - DNA, 16 bp, Homo sapiens
cctggtccctgggagg

SEQ ID NO: 3712133 - DNA, 19 bp, Homo sapiens
cctggtctcctgcccccac

SEQ ID NO: 3712134 - DNA, 21 bp, Homo sapiens
cctggtgaggaagctccagtc

SEQ ID NO: 3712135 - DNA, 23 bp, Homo sapiens
cctggtgaggaagctccagtcct

SEQ ID NO: 3712136 - DNA, 15 bp, Homo sapiens
cctggtgctgccaca

SEQ ID NO: 3712137 - DNA, 12 bp, Homo sapiens
cctggtgctgct

SEQ ID NO: 3712138 - DNA, 13 bp, Homo sapiens
cctggtgctgctg

SEQ ID NO: 3712139 - DNA, 20 bp, Homo sapiens
cctggtggacagtcctggga

SEQ ID NO: 3712140 - DNA, 12 bp, Homo sapiens
cctggtggcagc

SEQ ID NO: 3712141 - DNA, 13 bp, Homo sapiens
cctggtggcagtg

SEQ ID NO: 3712142 - DNA, 15 bp, Homo sapiens
cctggtggcagtggg

SEQ ID NO: 3712143 - DNA, 18 bp, Homo sapiens
cctggtgggcctcctctg

SEQ ID NO: 3712144 - DNA, 20 bp, Homo sapiens
cctggttccggaatcctgtc

SEQ ID NO: 3712145 - DNA, 17 bp, Homo sapiens
cctggtttcactggccc

SEQ ID NO: 3712146 - DNA, 12 bp, Homo sapiens
cctgtaaattat

SEQ ID NO: 3712147 - DNA, 18 bp, Homo sapiens
cctgtaaattattttaaa

SEQ ID NO: 3712148 - DNA, 18 bp, Homo sapiens
cctgtaacttgagagtag

SEQ ID NO: 3712149 - DNA, 13 bp, Homo sapiens
cctgtaatcccag

SEQ ID NO: 3712150 - DNA, 14 bp, Homo sapiens
cctgtaatcccagc

SEQ ID NO: 3712151 - DNA, 18 bp, Homo sapiens
cctgtaatcccagcactt

SEQ ID NO: 3712152 - DNA, 15 bp, Homo sapiens
cctgtaatcccagct

SEQ ID NO: 3712153 - DNA, 16 bp, Homo sapiens
cctgtaatcccagcta

SEQ ID NO: 3712154 - DNA, 20 bp, Homo sapiens
cctgtaatcctagcactttg

SEQ ID NO: 3712155 - DNA, 21 bp, Homo sapiens
cctgtacaaaagggacatgaa

SEQ ID NO: 3712156 - DNA, 21 bp, Homo sapiens
cctgtacaatatttaaaattt

SEQ ID NO: 3712157 - DNA, 12 bp, Homo sapiens
cctgtacactga

SEQ ID NO: 3712158 - DNA, 21 bp, Homo sapiens
cctgtacactgaatatttata

SEQ ID NO: 3712159 - DNA, 14 bp, Homo sapiens
cctgtaccccagca

SEQ ID NO: 3712160 - DNA, 13 bp, Homo sapiens
cctgtactcagga

SEQ ID NO: 3712161 - DNA, 15 bp, Homo sapiens
cctgtactcaggagg

SEQ ID NO: 3712162 - DNA, 14 bp, Homo sapiens
cctgtactggagag

SEQ ID NO: 3712163 - DNA, 18 bp, Homo sapiens
cctgtagacctagggagg

SEQ ID NO: 3712164 - DNA, 23 bp, Homo sapiens
cctgtagacctagggaggacctt

SEQ ID NO: 3712165 - DNA, 13 bp, Homo sapiens
cctgtagtcccag

SEQ ID NO: 3712166 - DNA, 14 bp, Homo sapiens
cctgtagtcccagc

SEQ ID NO: 3712167 - DNA, 16 bp, Homo sapiens
cctgtagttaggaaat

SEQ ID NO: 3712168 - DNA, 17 bp, Homo sapiens
cctgtagttaggaaata

SEQ ID NO: 3712169 - DNA, 18 bp, Homo sapiens
cctgtagttaggaaataa

SEQ ID NO: 3712170 - DNA, 19 bp, Homo sapiens
cctgtagttaggaaataaa

SEQ ID NO: 3712171 - DNA, 16 bp, Homo sapiens
cctgtatgtctccagt

SEQ ID NO: 3712172 - DNA, 16 bp, Homo sapiens
cctgtcaagttaacaa

SEQ ID NO: 3712173 - DNA, 18 bp, Homo sapiens
cctgtcaagttaacaagg

SEQ ID NO: 3712174 - DNA, 14 bp, Homo sapiens
cctgtcagtgcagc

SEQ ID NO: 3712175 - DNA, 19 bp, Homo sapiens
cctgtccaacctaacccct

SEQ ID NO: 3712176 - DNA, 22 bp, Homo sapiens
cctgtccagcctgggcagccag

SEQ ID NO: 3712177 - DNA, 23 bp, Homo sapiens
cctgtccccctgagatcagagtc

SEQ ID NO: 3712178 - DNA, 16 bp, Homo sapiens
cctgtccctctcaggc

SEQ ID NO: 3712179 - DNA, 19 bp, Homo sapiens
cctgtccctggccatctct

SEQ ID NO: 3712180 - DNA, 23 bp, Homo sapiens
cctgtcccttctcttaatttaat

SEQ ID NO: 3712181 - DNA, 22 bp, Homo sapiens
cctgtccgccctcttcccctct

SEQ ID NO: 3712182 - DNA, 15 bp, Homo sapiens
cctgtcctcctcgga

SEQ ID NO: 3712183 - DNA, 17 bp, Homo sapiens
cctgtcggagccctgtc

SEQ ID NO: 3712184 - DNA, 23 bp, Homo sapiens
cctgtctaggtcagtacccacct

SEQ ID NO: 3712185 - DNA, 13 bp, Homo sapiens
cctgtctcagcct

SEQ ID NO: 3712186 - DNA, 20 bp, Homo sapiens
cctgtctgccagccagcagc

SEQ ID NO: 3712187 - DNA, 17 bp, Homo sapiens
cctgtgaccagcactgt

SEQ ID NO: 3712188 - DNA, 18 bp, Homo sapiens
cctgtgacttcagctctg

SEQ ID NO: 3712189 - DNA, 23 bp, Homo sapiens
cctgtgagccagtctagttcctg

SEQ ID NO: 3712190 - DNA, 13 bp, Homo sapiens
cctgtgaggcagg

SEQ ID NO: 3712191 - DNA, 23 bp, Homo sapiens
cctgtgaggtgcagagtgcccag

SEQ ID NO: 3712192 - DNA, 19 bp, Homo sapiens
cctgtgcctctgggactgg

SEQ ID NO: 3712193 - DNA, 19 bp, Homo sapiens
cctgtgctagttttacaga

SEQ ID NO: 3712194 - DNA, 21 bp, Homo sapiens
cctgtgctgcccgtcttcagc

SEQ ID NO: 3712195 - DNA, 22 bp, Homo sapiens
cctgtgctgcccgtcttcagcc

SEQ ID NO: 3712196 - DNA, 23 bp, Homo sapiens
cctgtgctgcccgtcttcagcct

SEQ ID NO: 3712197 - DNA, 20 bp, Homo sapiens
cctgtggaagggactaggag

SEQ ID NO: 3712198 - DNA, 24 bp, Homo sapiens
cctgtggaagggactaggagcact

SEQ ID NO: 3712199 - DNA, 15 bp, Homo sapiens
cctgtggagcccgca

SEQ ID NO: 3712200 - DNA, 20 bp, Homo sapiens
cctgtggatgataaaacaca

SEQ ID NO: 3712201 - DNA, 19 bp, Homo sapiens
cctgtggcggtgcctgggt

SEQ ID NO: 3712202 - DNA, 20 bp, Homo sapiens
cctgtggcggtgcctgggtg

SEQ ID NO: 3712203 - DNA, 15 bp, Homo sapiens
cctgtggttacagtg

SEQ ID NO: 3712204 - DNA, 21 bp, Homo sapiens
cctgtggttacagtgcagaca

SEQ ID NO: 3712205 - DNA, 13 bp, Homo sapiens
cctgtgtagctgg

SEQ ID NO: 3712206 - DNA, 20 bp, Homo sapiens
cctgtgtggtttagtgtaaa

SEQ ID NO: 3712207 - DNA, 21 bp, Homo sapiens
cctgtgtgtgcgcctacagga

SEQ ID NO: 3712208 - DNA, 21 bp, Homo sapiens
cctgttacctaattagagcag

SEQ ID NO: 3712209 - DNA, 12 bp, Homo sapiens
cctgttcagcat

SEQ ID NO: 3712210 - DNA, 13 bp, Homo sapiens
cctgttcagctcc

SEQ ID NO: 3712211 - DNA, 20 bp, Homo sapiens
cctgttcagctccagctcac

SEQ ID NO: 3712212 - DNA, 21 bp, Homo sapiens
cctgttcagctccagctcacc

SEQ ID NO: 3712213 - DNA, 19 bp, Homo sapiens
ccttaaaagccatcatgta

SEQ ID NO: 3712214 - DNA, 15 bp, Homo sapiens
ccttaaactgtgtgg

SEQ ID NO: 3712215 - DNA, 18 bp, Homo sapiens
ccttaaattaaacaattt

SEQ ID NO: 3712216 - DNA, 21 bp, Homo sapiens
ccttaaattaaacaatttatt

SEQ ID NO: 3712217 - DNA, 14 bp, Homo sapiens
ccttaactggagcc

SEQ ID NO: 3712218 - DNA, 23 bp, Homo sapiens
ccttaatcaggtcctcagagaat

SEQ ID NO: 3712219 - DNA, 14 bp, Homo sapiens
ccttacccatctgc

SEQ ID NO: 3712220 - DNA, 15 bp, Homo sapiens
ccttaccccttagcc

SEQ ID NO: 3712221 - DNA, 16 bp, Homo sapiens
ccttaccccttagcct

SEQ ID NO: 3712222 - DNA, 17 bp, Homo sapiens
ccttacctcctgcccag

SEQ ID NO: 3712223 - DNA, 20 bp, Homo sapiens
ccttacctcggtgccttcct

SEQ ID NO: 3712224 - DNA, 15 bp, Homo sapiens
ctaatccaacccatg

SEQ ID NO: 3712225 - DNA, 20 bp, Homo sapiens
ctaatccctgggcattgctt

SEQ ID NO: 3712226 - DNA, 21 bp, Homo sapiens
ctaatccctgggcattgcttt

SEQ ID NO: 3712227 - DNA, 14 bp, Homo sapiens
ctaatctattgggt

SEQ ID NO: 3712228 - DNA, 19 bp, Homo sapiens
ctaatctattgggttcatt

SEQ ID NO: 3712229 - DNA, 20 bp, Homo sapiens
ctaatctgctatgcttgaat

SEQ ID NO: 3712230 - DNA, 22 bp, Homo sapiens
ctaatcttcagggcactgctgc

SEQ ID NO: 3712231 - DNA, 22 bp, Homo sapiens
ctaatgaatgcataaaatgtta

SEQ ID NO: 3712232 - DNA, 22 bp, Homo sapiens
ctaatgagtttcttttataaaa

SEQ ID NO: 3712233 - DNA, 12 bp, Homo sapiens
ctaatgggacac

SEQ ID NO: 3712234 - DNA, 18 bp, Homo sapiens
ctaatgtttatgagccag

SEQ ID NO: 3712235 - DNA, 17 bp, Homo sapiens
ctaattaacatataata

SEQ ID NO: 3712236 - DNA, 13 bp, Homo sapiens
ctaattattttaa

SEQ ID NO: 3712237 - DNA, 17 bp, Homo sapiens
ctaattcccattttgca

SEQ ID NO: 3712238 - DNA, 17 bp, Homo sapiens
ctaatttaacccagctc

SEQ ID NO: 3712239 - DNA, 21 bp, Homo sapiens
ctaatttatcttgtctctggg

SEQ ID NO: 3712240 - DNA, 19 bp, Homo sapiens
ctacaaaaagcataaaaat

SEQ ID NO: 3712241 - DNA, 18 bp, Homo sapiens
ctacaagagcagcctgtg

SEQ ID NO: 3712242 - DNA, 21 bp, Homo sapiens
ctacaagagcagcctgtggca

SEQ ID NO: 3712243 - DNA, 12 bp, Homo sapiens
ctacaatatata

SEQ ID NO: 3712244 - DNA, 16 bp, Homo sapiens
ctacaatttaaagcaa

SEQ ID NO: 3712245 - DNA, 21 bp, Homo sapiens
ctacacatatgtattcctgat

SEQ ID NO: 3712246 - DNA, 22 bp, Homo sapiens
ctacacccctcccctgccctag

SEQ ID NO: 3712247 - DNA, 17 bp, Homo sapiens
ctacactctcctgggcc

SEQ ID NO: 3712248 - DNA, 19 bp, Homo sapiens
ctacactctcctgggcccc

SEQ ID NO: 3712249 - DNA, 22 bp, Homo sapiens
ctacagaatactagccagagct

SEQ ID NO: 3712250 - DNA, 14 bp, Homo sapiens
ctacagacattaaa

SEQ ID NO: 3712251 - DNA, 22 bp, Homo sapiens
ctacagaggccatgggcctcct

SEQ ID NO: 3712252 - DNA, 13 bp, Homo sapiens
ctacagatgtccc

SEQ ID NO: 3712253 - DNA, 13 bp, Homo sapiens
ctacagcaaattt

SEQ ID NO: 3712254 - DNA, 21 bp, Homo sapiens
ctacagctaatcagcattctc

SEQ ID NO: 3712255 - DNA, 22 bp, Homo sapiens
ctacaggaagcaccccatgcca

SEQ ID NO: 3712256 - DNA, 18 bp, Homo sapiens
ctacaggagagggaagag

SEQ ID NO: 3712257 - DNA, 20 bp, Homo sapiens
ctacagttgttttttgaaaa

SEQ ID NO: 3712258 - DNA, 19 bp, Homo sapiens
ctacatcccagcctgtggt

SEQ ID NO: 3712259 - DNA, 15 bp, Homo sapiens
ctacatcgccctcca

SEQ ID NO: 3712260 - DNA, 16 bp, Homo sapiens
ctacatgaaacagaaa

SEQ ID NO: 3712261 - DNA, 11 bp, Homo sapiens
ctacattttaa

SEQ ID NO: 3712262 - DNA, 14 bp, Homo sapiens
ctaccaactggaag

SEQ ID NO: 3712263 - DNA, 15 bp, Homo sapiens
ctaccacagtgtctg

SEQ ID NO: 3712264 - DNA, 14 bp, Homo sapiens
ctaccacctcccca

SEQ ID NO: 3712265 - DNA, 16 bp, Homo sapiens
ctaccacctccccagc

SEQ ID NO: 3712266 - DNA, 17 bp, Homo sapiens
ctaccacctccccagcc

SEQ ID NO: 3712267 - DNA, 11 bp, Homo sapiens
ctaccatctcc

SEQ ID NO: 3712268 - DNA, 14 bp, Homo sapiens
ctacccacttctaa

SEQ ID NO: 3712269 - DNA, 12 bp, Homo sapiens
ctacccagccca

SEQ ID NO: 3712270 - DNA, 15 bp, Homo sapiens
ctacccagcccatct

SEQ ID NO: 3712271 - DNA, 13 bp, Homo sapiens
ctaccccaccacg

SEQ ID NO: 3712272 - DNA, 17 bp, Homo sapiens
ctaccctcttagaaaaa

SEQ ID NO: 3712273 - DNA, 23 bp, Homo sapiens
ctaccgagtctcttctccactgg

SEQ ID NO: 3712274 - DNA, 21 bp, Homo sapiens
ctacctcaacctgtaaattat

SEQ ID NO: 3712275 - DNA, 17 bp, Homo sapiens
ctacctcactggggtcc

SEQ ID NO: 3712276 - DNA, 13 bp, Homo sapiens
ctacctcaggcag

SEQ ID NO: 3712277 - DNA, 20 bp, Homo sapiens
ctacctgattggtgcaaccc

SEQ ID NO: 3712278 - DNA, 14 bp, Homo sapiens
ctacctgtaacttt

SEQ ID NO: 3712279 - DNA, 16 bp, Homo sapiens
ctactacatcgccctc

SEQ ID NO: 3712280 - DNA, 18 bp, Homo sapiens
ctactagggacctgggga

SEQ ID NO: 3712281 - DNA, 20 bp, Homo sapiens
ctactagggacctggggaag

SEQ ID NO: 3712282 - DNA, 15 bp, Homo sapiens
ctactcacagtctct

SEQ ID NO: 3712283 - DNA, 17 bp, Homo sapiens
ctactcacagtctcttt

SEQ ID NO: 3712284 - DNA, 13 bp, Homo sapiens
ctactcactcaag

SEQ ID NO: 3712285 - DNA, 22 bp, Homo sapiens
ctactcactcaagttcaaggac

SEQ ID NO: 3712286 - DNA, 16 bp, Homo sapiens
ctactcagaagcctga

SEQ ID NO: 3712287 - DNA, 15 bp, Homo sapiens
ctactcagcagccct

SEQ ID NO: 3712288 - DNA, 21 bp, Homo sapiens
ctactcagcagccctcctcac

SEQ ID NO: 3712289 - DNA, 15 bp, Homo sapiens
ctactcaggaggctg

SEQ ID NO: 3712290 - DNA, 23 bp, Homo sapiens
ctactcaggaggctgaggcagaa

SEQ ID NO: 3712291 - DNA, 23 bp, Homo sapiens
ctactccggaggctgaggcagga

SEQ ID NO: 3712292 - DNA, 16 bp, Homo sapiens
ctactcctacctcagc

SEQ ID NO: 3712293 - DNA, 17 bp, Homo sapiens
ctactcctacctcagcc

SEQ ID NO: 3712294 - DNA, 21 bp, Homo sapiens
ctactcctacctcagcctaga

SEQ ID NO: 3712295 - DNA, 13 bp, Homo sapiens
ctactctgtgtca

SEQ ID NO: 3712296 - DNA, 15 bp, Homo sapiens
ctactctgttccttc

SEQ ID NO: 3712297 - DNA, 12 bp, Homo sapiens
ctactgcttcta

SEQ ID NO: 3712298 - DNA, 18 bp, Homo sapiens
ctactgtggaaaaatatt

SEQ ID NO: 3712299 - DNA, 21 bp, Homo sapiens
ctactgtggaaaaatatttaa

SEQ ID NO: 3712300 - DNA, 13 bp, Homo sapiens
ctacttacacatc

SEQ ID NO: 3712301 - DNA, 20 bp, Homo sapiens
ctactttgtcctttttgtta

SEQ ID NO: 3712302 - DNA, 22 bp, Homo sapiens
ctactttgtcctttttgttatt

SEQ ID NO: 3712303 - DNA, 16 bp, Homo sapiens
ctacttttccttccct

SEQ ID NO: 3712304 - DNA, 13 bp, Homo sapiens
ctagaaatttttc

SEQ ID NO: 3712305 - DNA, 19 bp, Homo sapiens
ctagaacacaggcaaaatc

SEQ ID NO: 3712306 - DNA, 18 bp, Homo sapiens
ctagaacatccctgccag

SEQ ID NO: 3712307 - DNA, 18 bp, Homo sapiens
ctagaactctccatctta

SEQ ID NO: 3712308 - DNA, 18 bp, Homo sapiens
ctagaagaaatgaaattt

SEQ ID NO: 3712309 - DNA, 20 bp, Homo sapiens
ctagaagaaatgaaatttta

SEQ ID NO: 3712310 - DNA, 20 bp, Homo sapiens
ctagaagtgggccaggacag

SEQ ID NO: 3712311 - DNA, 21 bp, Homo sapiens
ctagaatttatcacacttctg

SEQ ID NO: 3712312 - DNA, 12 bp, Homo sapiens
ctagaatttatt

SEQ ID NO: 3712313 - DNA, 17 bp, Homo sapiens
ctagaatttcatttatt

SEQ ID NO: 3712314 - DNA, 19 bp, Homo sapiens
ctagaattttaagtgcttt

SEQ ID NO: 3712315 - DNA, 13 bp, Homo sapiens
ctagacactgcca

SEQ ID NO: 3712316 - DNA, 18 bp, Homo sapiens
ctagactcccaagctgga

SEQ ID NO: 3712317 - DNA, 10 bp, Homo sapiens
ctagagaaac

SEQ ID NO: 3712318 - DNA, 19 bp, Homo sapiens
ctagagagggaattctctt

SEQ ID NO: 3712319 - DNA, 14 bp, Homo sapiens
ctagaggcagggag

SEQ ID NO: 3712320 - DNA, 15 bp, Homo sapiens
ctagaggcagggagg

SEQ ID NO: 3712321 - DNA, 18 bp, Homo sapiens
ctagaggcagggagggga

SEQ ID NO: 3712322 - DNA, 17 bp, Homo sapiens
ctagaggccagccccac

SEQ ID NO: 3712323 - DNA, 18 bp, Homo sapiens
ctagaggccagccccacc

SEQ ID NO: 3712324 - DNA, 19 bp, Homo sapiens
ctagaggccagccccaccc

SEQ ID NO: 3712325 - DNA, 22 bp, Homo sapiens
ctagaggccagccccacccagg

SEQ ID NO: 3712326 - DNA, 22 bp, Homo sapiens
ctagagggatacactgaagtta

SEQ ID NO: 3712327 - DNA, 19 bp, Homo sapiens
ctagagggttcctgtagac

SEQ ID NO: 3712328 - DNA, 17 bp, Homo sapiens
ctagagtgaacttgggc

SEQ ID NO: 3712329 - DNA, 13 bp, Homo sapiens
ctagatccacaca

SEQ ID NO: 3712330 - DNA, 21 bp, Homo sapiens
ctagatgagaattcagctgcc

SEQ ID NO: 3712331 - DNA, 22 bp, Homo sapiens
ctagatgagaattcagctgccc

SEQ ID NO: 3712332 - DNA, 13 bp, Homo sapiens
ctagatgtcttta

SEQ ID NO: 3712333 - DNA, 21 bp, Homo sapiens
ctagattaccccctcattgtt

SEQ ID NO: 3712334 - DNA, 15 bp, Homo sapiens
ctagcactcacatgc

SEQ ID NO: 3712335 - DNA, 23 bp, Homo sapiens
ctagcagagcaggggcagggtga

SEQ ID NO: 3712336 - DNA, 23 bp, Homo sapiens
ctagcagcagggagggcttctgc

SEQ ID NO: 3712337 - DNA, 18 bp, Homo sapiens
ctcctccaaaggaagtct

SEQ ID NO: 3712338 - DNA, 23 bp, Homo sapiens
ctcctccaaaggaagtctaggag

SEQ ID NO: 3712339 - DNA, 11 bp, Homo sapiens
ctcctccaggg

SEQ ID NO: 3712340 - DNA, 22 bp, Homo sapiens
ctcctccagggccacgtgccag

SEQ ID NO: 3712341 - DNA, 17 bp, Homo sapiens
ctcctcccggtgcccaa

SEQ ID NO: 3712342 - DNA, 14 bp, Homo sapiens
ctcctcctccccca

SEQ ID NO: 3712343 - DNA, 15 bp, Homo sapiens
ctcctcctcccccag

SEQ ID NO: 3712344 - DNA, 19 bp, Homo sapiens
ctcctcgcaagctgggtaa

SEQ ID NO: 3712345 - DNA, 13 bp, Homo sapiens
ctcctctccccag

SEQ ID NO: 3712346 - DNA, 15 bp, Homo sapiens
ctcctctcccctcta

SEQ ID NO: 3712347 - DNA, 16 bp, Homo sapiens
ctcctctgccacctcc

SEQ ID NO: 3712348 - DNA, 14 bp, Homo sapiens
ctcctctgtccagg

SEQ ID NO: 3712349 - DNA, 15 bp, Homo sapiens
ctcctctgtccaggc

SEQ ID NO: 3712350 - DNA, 13 bp, Homo sapiens
ctcctctgtccct

SEQ ID NO: 3712351 - DNA, 20 bp, Homo sapiens
ctcctcttaaaaaataaaaa

SEQ ID NO: 3712352 - DNA, 23 bp, Homo sapiens
ctcctcttcaactgaccagcctc

SEQ ID NO: 3712353 - DNA, 15 bp, Homo sapiens
ctcctcttgccactg

SEQ ID NO: 3712354 - DNA, 18 bp, Homo sapiens
ctcctcttgccactgcct

SEQ ID NO: 3712355 - DNA, 16 bp, Homo sapiens
ctcctgaggggcatct

SEQ ID NO: 3712356 - DNA, 19 bp, Homo sapiens
ctcctgaggggcatctgcc

SEQ ID NO: 3712357 - DNA, 20 bp, Homo sapiens
ctcctgaggggcatctgccc

SEQ ID NO: 3712358 - DNA, 12 bp, Homo sapiens
ctcctgcccagg

SEQ ID NO: 3712359 - DNA, 17 bp, Homo sapiens
ctcctgcccaggagagc

SEQ ID NO: 3712360 - DNA, 23 bp, Homo sapiens
ctcctgcccccacacctggccct

SEQ ID NO: 3712361 - DNA, 13 bp, Homo sapiens
ctcctgcctactc

SEQ ID NO: 3712362 - DNA, 13 bp, Homo sapiens
ctcctgcctcagc

SEQ ID NO: 3712363 - DNA, 15 bp, Homo sapiens
ctcctgcctcagcct

SEQ ID NO: 3712364 - DNA, 22 bp, Homo sapiens
ctcctgcctcgaactggctgca

SEQ ID NO: 3712365 - DNA, 18 bp, Homo sapiens
ctcctggaaaggctcagt

SEQ ID NO: 3712366 - DNA, 22 bp, Homo sapiens
ctcctggaaaggctcagtctca

SEQ ID NO: 3712367 - DNA, 11 bp, Homo sapiens
ctcctggaaat

SEQ ID NO: 3712368 - DNA, 17 bp, Homo sapiens
ctcctggaagctgtgtc

SEQ ID NO: 3712369 - DNA, 23 bp, Homo sapiens
ctcctggaagctgtgtccttgca

SEQ ID NO: 3712370 - DNA, 19 bp, Homo sapiens
ctcctggcctcaagtgatt

SEQ ID NO: 3712371 - DNA, 12 bp, Homo sapiens
ctcctgggaagg

SEQ ID NO: 3712372 - DNA, 13 bp, Homo sapiens
ctcctgggcccct

SEQ ID NO: 3712373 - DNA, 18 bp, Homo sapiens
ctcctgggggttctttct

SEQ ID NO: 3712374 - DNA, 22 bp, Homo sapiens
ctcctggtatgggtttctccca

SEQ ID NO: 3712375 - DNA, 16 bp, Homo sapiens
ctcctgtctgccagcc

SEQ ID NO: 3712376 - DNA, 22 bp, Homo sapiens
ctcctgtctgccagccagcagc

SEQ ID NO: 3712377 - DNA, 16 bp, Homo sapiens
ctcctgtgcatgggtg

SEQ ID NO: 3712378 - DNA, 17 bp, Homo sapiens
ctcctgtgcatgggtga

SEQ ID NO: 3712379 - DNA, 11 bp, Homo sapiens
ctcctgtgtaa

SEQ ID NO: 3712380 - DNA, 15 bp, Homo sapiens
ctcctgtgtcttgca

SEQ ID NO: 3712381 - DNA, 24 bp, Homo sapiens
ctcctgtgtgtgcgcctacaggag

SEQ ID NO: 3712382 - DNA, 22 bp, Homo sapiens
ctccttagctgccaagccccat

SEQ ID NO: 3712383 - DNA, 16 bp, Homo sapiens
ctccttagtcttctca

SEQ ID NO: 3712384 - DNA, 14 bp, Homo sapiens
ctccttcccagctg

SEQ ID NO: 3712385 - DNA, 19 bp, Homo sapiens
ctccttcccagctgcccct

SEQ ID NO: 3712386 - DNA, 20 bp, Homo sapiens
ctccttcccagctgcccctc

SEQ ID NO: 3712387 - DNA, 12 bp, Homo sapiens
ctccttcctgtc

SEQ ID NO: 3712388 - DNA, 13 bp, Homo sapiens
ctccttcctgtct

SEQ ID NO: 3712389 - DNA, 16 bp, Homo sapiens
ctccttcctgtcttcc

SEQ ID NO: 3712390 - DNA, 18 bp, Homo sapiens
ctccttccttgaccagca

SEQ ID NO: 3712391 - DNA, 20 bp, Homo sapiens
ctccttctgtcctactctgt

SEQ ID NO: 3712392 - DNA, 21 bp, Homo sapiens
ctccttgggaggccccactgg

SEQ ID NO: 3712393 - DNA, 16 bp, Homo sapiens
ctccttgtaaagactg

SEQ ID NO: 3712394 - DNA, 17 bp, Homo sapiens
ctcctttaccctcatct

SEQ ID NO: 3712395 - DNA, 22 bp, Homo sapiens
ctcctttagcgcccagttgggt

SEQ ID NO: 3712396 - DNA, 20 bp, Homo sapiens
ctcctttcacaaccttctgt

SEQ ID NO: 3712397 - DNA, 15 bp, Homo sapiens
ctcctttcaccacat

SEQ ID NO: 3712398 - DNA, 14 bp, Homo sapiens
ctcgaactggctgc

SEQ ID NO: 3712399 - DNA, 15 bp, Homo sapiens
ctcgaactggctgca

SEQ ID NO: 3712400 - DNA, 12 bp, Homo sapiens
ctcgaagcgcgc

SEQ ID NO: 3712401 - DNA, 13 bp, Homo sapiens
ctcgaagcgcgcc

SEQ ID NO: 3712402 - DNA, 20 bp, Homo sapiens
ctcgaagcgcgccactcgct

SEQ ID NO: 3712403 - DNA, 22 bp, Homo sapiens
ctcgcatttgtcaatgacagtt

SEQ ID NO: 3712404 - DNA, 19 bp, Homo sapiens
ctcgccacccctccttcct

SEQ ID NO: 3712405 - DNA, 12 bp, Homo sapiens
ctcgccctgggt

SEQ ID NO: 3712406 - DNA, 15 bp, Homo sapiens
ctcgctggcccccac

SEQ ID NO: 3712407 - DNA, 14 bp, Homo sapiens
ctcgcttcccccat

SEQ ID NO: 3712408 - DNA, 16 bp, Homo sapiens
ctcgcttcccccatag

SEQ ID NO: 3712409 - DNA, 13 bp, Homo sapiens
ctcggagcctcat

SEQ ID NO: 3712410 - DNA, 23 bp, Homo sapiens
ctcggagcctcatccgaggcagg

SEQ ID NO: 3712411 - DNA, 17 bp, Homo sapiens
ctcggagtatctgggaa

SEQ ID NO: 3712412 - DNA, 22 bp, Homo sapiens
ctcgggcgagtcactgcctctc

SEQ ID NO: 3712413 - DNA, 21 bp, Homo sapiens
ctcgggtggctagtcagagag

SEQ ID NO: 3712414 - DNA, 18 bp, Homo sapiens
ctcggtggacccagggat

SEQ ID NO: 3712415 - DNA, 16 bp, Homo sapiens
ctcggtgtggagaagc

SEQ ID NO: 3712416 - DNA, 12 bp, Homo sapiens
ctcgtcctcccc

SEQ ID NO: 3712417 - DNA, 18 bp, Homo sapiens
ctcgtcctccccctgcca

SEQ ID NO: 3712418 - DNA, 20 bp, Homo sapiens
ctcgtcctccccctgccagt

SEQ ID NO: 3712419 - DNA, 22 bp, Homo sapiens
ctcgtcctccccctgccagtgc

SEQ ID NO: 3712420 - DNA, 14 bp, Homo sapiens
ctcgtggccttccc

SEQ ID NO: 3712421 - DNA, 18 bp, Homo sapiens
ctcgtggccttccccagc

SEQ ID NO: 3712422 - DNA, 18 bp, Homo sapiens
ctcgttagggaagagaaa

SEQ ID NO: 3712423 - DNA, 22 bp, Homo sapiens
ctcgttagggaagagaaacagg

SEQ ID NO: 3712424 - DNA, 16 bp, Homo sapiens
ctctacaaactcccac

SEQ ID NO: 3712425 - DNA, 14 bp, Homo sapiens
ctctacccagccca

SEQ ID NO: 3712426 - DNA, 17 bp, Homo sapiens
ctctacccagcccatct

SEQ ID NO: 3712427 - DNA, 18 bp, Homo sapiens
ctctacccagcccatctt

SEQ ID NO: 3712428 - DNA, 19 bp, Homo sapiens
ctctacccagcccatcttg

SEQ ID NO: 3712429 - DNA, 15 bp, Homo sapiens
ctctaccctcccacc

SEQ ID NO: 3712430 - DNA, 19 bp, Homo sapiens
ctctactaaaaatacagaa

SEQ ID NO: 3712431 - DNA, 19 bp, Homo sapiens
ctctacttagcatgtccct

SEQ ID NO: 3712432 - DNA, 20 bp, Homo sapiens
ctctacttagcatgtcccta

SEQ ID NO: 3712433 - DNA, 20 bp, Homo sapiens
ctctagaattttaagtgctt

SEQ ID NO: 3712434 - DNA, 17 bp, Homo sapiens
ctctagacaaccctgca

SEQ ID NO: 3712435 - DNA, 14 bp, Homo sapiens
ctctagcctgggca

SEQ ID NO: 3712436 - DNA, 23 bp, Homo sapiens
ctctagggaaggccacctgcagg

SEQ ID NO: 3712437 - DNA, 14 bp, Homo sapiens
ctctatctcacagc

SEQ ID NO: 3712438 - DNA, 18 bp, Homo sapiens
ctctatctcacagcacac

SEQ ID NO: 3712439 - DNA, 17 bp, Homo sapiens
ctctatgccagctcagt

SEQ ID NO: 3712440 - DNA, 14 bp, Homo sapiens
ctctatttaaattc

SEQ ID NO: 3712441 - DNA, 17 bp, Homo sapiens
ctctcaaagcaaataat

SEQ ID NO: 3712442 - DNA, 12 bp, Homo sapiens
ctctcacctcct

SEQ ID NO: 3712443 - DNA, 17 bp, Homo sapiens
ctctcagaattcttcag

SEQ ID NO: 3712444 - DNA, 18 bp, Homo sapiens
ctctcaggcatgcctgtg

SEQ ID NO: 3712445 - DNA, 12 bp, Homo sapiens
ctctcagttttt

SEQ ID NO: 3712446 - DNA, 16 bp, Homo sapiens
ctctcattccccaggt

SEQ ID NO: 3712447 - DNA, 21 bp, Homo sapiens
ctctcattccccaggtggctg

SEQ ID NO: 3712448 - DNA, 13 bp, Homo sapiens
ctctccaacctgg

SEQ ID NO: 3712449 - DNA, 14 bp, Homo sapiens
ctctccaacctgga

SEQ ID NO: 3712450 - DNA, 16 bp, Homo sapiens
ctctccacctcagcct

SEQ ID NO: 3712451 - DNA, 18 bp, Homo sapiens
ctgcaagaattgaagcag

SEQ ID NO: 3712452 - DNA, 15 bp, Homo sapiens
ctgcaagagccttgg

SEQ ID NO: 3712453 - DNA, 20 bp, Homo sapiens
ctgcaagcacatctgcattt

SEQ ID NO: 3712454 - DNA, 12 bp, Homo sapiens
ctgcaatagaga

SEQ ID NO: 3712455 - DNA, 20 bp, Homo sapiens
ctgcaatagagactgtagat

SEQ ID NO: 3712456 - DNA, 20 bp, Homo sapiens
ctgcacaaagcccttccatg

SEQ ID NO: 3712457 - DNA, 13 bp, Homo sapiens
ctgcacaagctgc

SEQ ID NO: 3712458 - DNA, 14 bp, Homo sapiens
ctgcacaagctgca

SEQ ID NO: 3712459 - DNA, 18 bp, Homo sapiens
ctgcacagtgcatctcag

SEQ ID NO: 3712460 - DNA, 21 bp, Homo sapiens
ctgcacagtgcatctcagccc

SEQ ID NO: 3712461 - DNA, 22 bp, Homo sapiens
ctgcacagtgcatctcagccca

SEQ ID NO: 3712462 - DNA, 17 bp, Homo sapiens
ctgcaccaggagacaga

SEQ ID NO: 3712463 - DNA, 16 bp, Homo sapiens
ctgcaccattgctgct

SEQ ID NO: 3712464 - DNA, 14 bp, Homo sapiens
ctgcacccccctgg

SEQ ID NO: 3712465 - DNA, 15 bp, Homo sapiens
ctgcacccccctggg

SEQ ID NO: 3712466 - DNA, 16 bp, Homo sapiens
ctgcacccccctgggc

SEQ ID NO: 3712467 - DNA, 13 bp, Homo sapiens
ctgcaccctcagg

SEQ ID NO: 3712468 - DNA, 18 bp, Homo sapiens
ctgcaccgggccacagag

SEQ ID NO: 3712469 - DNA, 23 bp, Homo sapiens
ctgcaccgggccacagagaaagt

SEQ ID NO: 3712470 - DNA, 17 bp, Homo sapiens
ctgcacctgccagcctg

SEQ ID NO: 3712471 - DNA, 19 bp, Homo sapiens
ctgcacctgccagcctggc

SEQ ID NO: 3712472 - DNA, 20 bp, Homo sapiens
ctgcacctgccagcctggct

SEQ ID NO: 3712473 - DNA, 19 bp, Homo sapiens
ctgcacgtggcttctgatg

SEQ ID NO: 3712474 - DNA, 16 bp, Homo sapiens
ctgcactaatttgatg

SEQ ID NO: 3712475 - DNA, 18 bp, Homo sapiens
ctgcactatagcctaggt

SEQ ID NO: 3712476 - DNA, 22 bp, Homo sapiens
ctgcactatagcctaggtgaca

SEQ ID NO: 3712477 - DNA, 23 bp, Homo sapiens
ctgcactatagcctaggtgacag

SEQ ID NO: 3712478 - DNA, 13 bp, Homo sapiens
ctgcactccagcc

SEQ ID NO: 3712479 - DNA, 19 bp, Homo sapiens
ctgcactcttaagcttccg

SEQ ID NO: 3712480 - DNA, 16 bp, Homo sapiens
ctgcactggagtccag

SEQ ID NO: 3712481 - DNA, 17 bp, Homo sapiens
ctgcacttgcagactct

SEQ ID NO: 3712482 - DNA, 23 bp, Homo sapiens
ctgcagaacgtattggtccagct

SEQ ID NO: 3712483 - DNA, 21 bp, Homo sapiens
ctgcagaggggaaaccagtgt

SEQ ID NO: 3712484 - DNA, 13 bp, Homo sapiens
ctgcagcagagcc

SEQ ID NO: 3712485 - DNA, 15 bp, Homo sapiens
ctgcagccagcccag

SEQ ID NO: 3712486 - DNA, 23 bp, Homo sapiens
ctgcagccagcccagcccagctg

SEQ ID NO: 3712487 - DNA, 11 bp, Homo sapiens
ctgcagcctca

SEQ ID NO: 3712488 - DNA, 11 bp, Homo sapiens
ctgcagcctcc

SEQ ID NO: 3712489 - DNA, 20 bp, Homo sapiens
ctgcagcctcgaactcctgg

SEQ ID NO: 3712490 - DNA, 23 bp, Homo sapiens
ctgcagcctcgaactcctgggct

SEQ ID NO: 3712491 - DNA, 18 bp, Homo sapiens
ctgcagcctttgcctccc

SEQ ID NO: 3712492 - DNA, 20 bp, Homo sapiens
ctgcagcggccacactgtac

SEQ ID NO: 3712493 - DNA, 20 bp, Homo sapiens
ctgcaggatgattgtacaga

SEQ ID NO: 3712494 - DNA, 11 bp, Homo sapiens
ctgcaggcagg

SEQ ID NO: 3712495 - DNA, 12 bp, Homo sapiens
ctgcaggcaggg

SEQ ID NO: 3712496 - DNA, 15 bp, Homo sapiens
ctgcaggccaagagc

SEQ ID NO: 3712497 - DNA, 19 bp, Homo sapiens
ctgcaggccaagagcagag

SEQ ID NO: 3712498 - DNA, 24 bp, Homo sapiens
ctgcaggccaagagcagaggcagc

SEQ ID NO: 3712499 - DNA, 14 bp, Homo sapiens
ctgcaggccccgct

SEQ ID NO: 3712500 - DNA, 20 bp, Homo sapiens
ctgcaggccccgcttgtcca

SEQ ID NO: 3712501 - DNA, 23 bp, Homo sapiens
ctgcaggccccgcttgtccagcg

SEQ ID NO: 3712502 - DNA, 22 bp, Homo sapiens
ctgcagggagtccgaaagggac

SEQ ID NO: 3712503 - DNA, 23 bp, Homo sapiens
ctgcagggggtgtgtctgctcag

SEQ ID NO: 3712504 - DNA, 14 bp, Homo sapiens
ctgcagtcacagct

SEQ ID NO: 3712505 - DNA, 15 bp, Homo sapiens
ctgcataccaacctg

SEQ ID NO: 3712506 - DNA, 16 bp, Homo sapiens
ctgcatagaaggagga

SEQ ID NO: 3712507 - DNA, 20 bp, Homo sapiens
ctgcatccgtagttccctga

SEQ ID NO: 3712508 - DNA, 11 bp, Homo sapiens
ctgcatgcaga

SEQ ID NO: 3712509 - DNA, 16 bp, Homo sapiens
ctgcatggacctaaca

SEQ ID NO: 3712510 - DNA, 15 bp, Homo sapiens
ctgcatggtaattta

SEQ ID NO: 3712511 - DNA, 20 bp, Homo sapiens
ctgcattttctgaaactaat

SEQ ID NO: 3712512 - DNA, 15 bp, Homo sapiens
ctgcattttctgggt

SEQ ID NO: 3712513 - DNA, 17 bp, Homo sapiens
ctgcattttctgggttc

SEQ ID NO: 3712514 - DNA, 14 bp, Homo sapiens
ctgccaagccccat

SEQ ID NO: 3712515 - DNA, 21 bp, Homo sapiens
ctgccaaggccagagtggcct

SEQ ID NO: 3712516 - DNA, 23 bp, Homo sapiens
ctgccaaggccagagtggcctgg

SEQ ID NO: 3712517 - DNA, 23 bp, Homo sapiens
ctgccacacgtctgaccctctcc

SEQ ID NO: 3712518 - DNA, 22 bp, Homo sapiens
ctgccacacttcaggctcttct

SEQ ID NO: 3712519 - DNA, 21 bp, Homo sapiens
ctgccaccctggggagaaagt

SEQ ID NO: 3712520 - DNA, 22 bp, Homo sapiens
ctgccacctcccctatccaccc

SEQ ID NO: 3712521 - DNA, 18 bp, Homo sapiens
ctgccacctggggcagtc

SEQ ID NO: 3712522 - DNA, 16 bp, Homo sapiens
ctgccactaggctggg

SEQ ID NO: 3712523 - DNA, 19 bp, Homo sapiens
ctgccactaggctgggtgc

SEQ ID NO: 3712524 - DNA, 22 bp, Homo sapiens
ctgccactaggctgggtgccca

SEQ ID NO: 3712525 - DNA, 23 bp, Homo sapiens
ctgccactaggctgggtgcccac

SEQ ID NO: 3712526 - DNA, 19 bp, Homo sapiens
ctgccactttggtacatgg

SEQ ID NO: 3712527 - DNA, 15 bp, Homo sapiens
ctgccagcacagagc

SEQ ID NO: 3712528 - DNA, 12 bp, Homo sapiens
ctgccagccaca

SEQ ID NO: 3712529 - DNA, 14 bp, Homo sapiens
ctgccagccagcag

SEQ ID NO: 3712530 - DNA, 18 bp, Homo sapiens
ctgccagccagcagccag

SEQ ID NO: 3712531 - DNA, 12 bp, Homo sapiens
ctgccagcctgg

SEQ ID NO: 3712532 - DNA, 16 bp, Homo sapiens
ctgccagcctggcttc

SEQ ID NO: 3712533 - DNA, 19 bp, Homo sapiens
ctgccagcctggcttctgg

SEQ ID NO: 3712534 - DNA, 22 bp, Homo sapiens
ctgccagcctggcttctggagc

SEQ ID NO: 3712535 - DNA, 13 bp, Homo sapiens
ctgccaggccccc

SEQ ID NO: 3712536 - DNA, 22 bp, Homo sapiens
ctgccaggctctaaagccaaag

SEQ ID NO: 3712537 - DNA, 21 bp, Homo sapiens
ctgccagtccccctgccccag

SEQ ID NO: 3712538 - DNA, 22 bp, Homo sapiens
ctgccagtccccctgccccagg

SEQ ID NO: 3712539 - DNA, 20 bp, Homo sapiens
ctgccatattctgttggcca

SEQ ID NO: 3712540 - DNA, 22 bp, Homo sapiens
ctgccatattctgttggccagt

SEQ ID NO: 3712541 - DNA, 12 bp, Homo sapiens
ctgccatccagg

SEQ ID NO: 3712542 - DNA, 19 bp, Homo sapiens
ctgccatccaggttcagct

SEQ ID NO: 3712543 - DNA, 21 bp, Homo sapiens
ctgccatccaggttcagcttg

SEQ ID NO: 3712544 - DNA, 15 bp, Homo sapiens
ctgccatgaactgga

SEQ ID NO: 3712545 - DNA, 17 bp, Homo sapiens
ctgccatgccagcttat

SEQ ID NO: 3712546 - DNA, 20 bp, Homo sapiens
ctgccatggaggcacacagc

SEQ ID NO: 3712547 - DNA, 21 bp, Homo sapiens
ctgccatggaggcacacagct

SEQ ID NO: 3712548 - DNA, 23 bp, Homo sapiens
ctgccatggaggcacacagctgc

SEQ ID NO: 3712549 - DNA, 21 bp, Homo sapiens
ctgccatggcgtgtccctctc

SEQ ID NO: 3712550 - DNA, 21 bp, Homo sapiens
ctgccatttgcaccctccgcc

SEQ ID NO: 3712551 - DNA, 19 bp, Homo sapiens
ctgcccaacctgctctcct

SEQ ID NO: 3712552 - DNA, 12 bp, Homo sapiens
ctgcccacctgt

SEQ ID NO: 3712553 - DNA, 22 bp, Homo sapiens
ctgcccagaattcccagctgtc

SEQ ID NO: 3712554 - DNA, 14 bp, Homo sapiens
ctgcccagagctgg

SEQ ID NO: 3712555 - DNA, 15 bp, Homo sapiens
ctgcccagagctggg

SEQ ID NO: 3712556 - DNA, 18 bp, Homo sapiens
ctgcccagagctgggtga

SEQ ID NO: 3712557 - DNA, 23 bp, Homo sapiens
ctgcccaggagagccagccctcc

SEQ ID NO: 3712558 - DNA, 13 bp, Homo sapiens
ctgcccaggcccc

SEQ ID NO: 3712559 - DNA, 18 bp, Homo sapiens
ctgcccaggcctgcctgt

SEQ ID NO: 3712560 - DNA, 19 bp, Homo sapiens
ctgcccaggcctgcctgtt

SEQ ID NO: 3712561 - DNA, 17 bp, Homo sapiens
ctgccccaactcctgga

SEQ ID NO: 3712562 - DNA, 21 bp, Homo sapiens
ctgccccaactcctggaagct

SEQ ID NO: 3712563 - DNA, 14 bp, Homo sapiens
ctgggattcctccc

SEQ ID NO: 3712564 - DNA, 15 bp, Homo sapiens
ctgggcaacagagca

SEQ ID NO: 3712565 - DNA, 19 bp, Homo sapiens
ctgggcaatgatggcaatt

SEQ ID NO: 3712566 - DNA, 20 bp, Homo sapiens
ctgggcaatgtgataaaacc

SEQ ID NO: 3712567 - DNA, 19 bp, Homo sapiens
ctgggcacctggggagtgg

SEQ ID NO: 3712568 - DNA, 14 bp, Homo sapiens
ctgggcagaaggcc

SEQ ID NO: 3712569 - DNA, 18 bp, Homo sapiens
ctgggcagcatagcaaga

SEQ ID NO: 3712570 - DNA, 17 bp, Homo sapiens
ctgggcagccaggctgc

SEQ ID NO: 3712571 - DNA, 12 bp, Homo sapiens
ctgggcagctgt

SEQ ID NO: 3712572 - DNA, 12 bp, Homo sapiens
ctgggcattgct

SEQ ID NO: 3712573 - DNA, 13 bp, Homo sapiens
ctgggcattgctt

SEQ ID NO: 3712574 - DNA, 14 bp, Homo sapiens
ctgggcattgcttt

SEQ ID NO: 3712575 - DNA, 17 bp, Homo sapiens
ctgggcattgctttcca

SEQ ID NO: 3712576 - DNA, 15 bp, Homo sapiens
ctgggccaagttcct

SEQ ID NO: 3712577 - DNA, 18 bp, Homo sapiens
ctgggccaagttcctcta

SEQ ID NO: 3712578 - DNA, 23 bp, Homo sapiens
ctgggcccagaaggttgtgatga

SEQ ID NO: 3712579 - DNA, 12 bp, Homo sapiens
ctgggcccagag

SEQ ID NO: 3712580 - DNA, 18 bp, Homo sapiens
ctgggcccagaggcacag

SEQ ID NO: 3712581 - DNA, 21 bp, Homo sapiens
ctgggcccagaggcacagccg

SEQ ID NO: 3712582 - DNA, 17 bp, Homo sapiens
ctgggcctgttgccctt

SEQ ID NO: 3712583 - DNA, 13 bp, Homo sapiens
ctgggcgacagag

SEQ ID NO: 3712584 - DNA, 15 bp, Homo sapiens
ctgggctctccacct

SEQ ID NO: 3712585 - DNA, 16 bp, Homo sapiens
ctgggctctccacctc

SEQ ID NO: 3712586 - DNA, 13 bp, Homo sapiens
ctgggctctgccc

SEQ ID NO: 3712587 - DNA, 15 bp, Homo sapiens
ctgggctggccagtt

SEQ ID NO: 3712588 - DNA, 15 bp, Homo sapiens
ctgggcttcagtggc

SEQ ID NO: 3712589 - DNA, 17 bp, Homo sapiens
ctgggcttcagtggcag

SEQ ID NO: 3712590 - DNA, 18 bp, Homo sapiens
ctgggcttcagtggcagc

SEQ ID NO: 3712591 - DNA, 24 bp, Homo sapiens
ctgggcttcagtggcagctgcttt

SEQ ID NO: 3712592 - DNA, 20 bp, Homo sapiens
ctgggcttggggcttcctaa

SEQ ID NO: 3712593 - DNA, 13 bp, Homo sapiens
ctggggagaaagt

SEQ ID NO: 3712594 - DNA, 23 bp, Homo sapiens
ctggggcaggaggggagtgaggc

SEQ ID NO: 3712595 - DNA, 13 bp, Homo sapiens
ctggggccccacc

SEQ ID NO: 3712596 - DNA, 19 bp, Homo sapiens
ctggggcctcggagcctca

SEQ ID NO: 3712597 - DNA, 14 bp, Homo sapiens
ctggggctctggga

SEQ ID NO: 3712598 - DNA, 21 bp, Homo sapiens
ctggggctgatctcagggaag

SEQ ID NO: 3712599 - DNA, 14 bp, Homo sapiens
ctgggggcaggagg

SEQ ID NO: 3712600 - DNA, 18 bp, Homo sapiens
ctgggggccatgagctcc

SEQ ID NO: 3712601 - DNA, 20 bp, Homo sapiens
ctgggggccatgagctccag

SEQ ID NO: 3712602 - DNA, 16 bp, Homo sapiens
ctgggggcctcactcc

SEQ ID NO: 3712603 - DNA, 12 bp, Homo sapiens
ctgggggcctga

SEQ ID NO: 3712604 - DNA, 22 bp, Homo sapiens
ctgggggcctgacctccccctc

SEQ ID NO: 3712605 - DNA, 13 bp, Homo sapiens
ctggggttcagcc

SEQ ID NO: 3712606 - DNA, 17 bp, Homo sapiens
ctggggttcagcccctc

SEQ ID NO: 3712607 - DNA, 21 bp, Homo sapiens
ctggggttcagcccctcctct

SEQ ID NO: 3712608 - DNA, 23 bp, Homo sapiens
ctggggttcagcccctcctctgc

SEQ ID NO: 3712609 - DNA, 16 bp, Homo sapiens
ctgggtacgagggatg

SEQ ID NO: 3712610 - DNA, 19 bp, Homo sapiens
ctgggtacttgtggacaca

SEQ ID NO: 3712611 - DNA, 22 bp, Homo sapiens
ctgggtccaggggatgggaggt

SEQ ID NO: 3712612 - DNA, 22 bp, Homo sapiens
ctgggtctcgctttgttgccca

SEQ ID NO: 3712613 - DNA, 16 bp, Homo sapiens
ctgggtctgtgtctct

SEQ ID NO: 3712614 - DNA, 13 bp, Homo sapiens
ctgggtgacagag

SEQ ID NO: 3712615 - DNA, 14 bp, Homo sapiens
ctgggtgagtgggg

SEQ ID NO: 3712616 - DNA, 18 bp, Homo sapiens
ctgggtgagtggggagac

SEQ ID NO: 3712617 - DNA, 15 bp, Homo sapiens
ctgggtgcagctgag

SEQ ID NO: 3712618 - DNA, 14 bp, Homo sapiens
ctgggtgctcccta

SEQ ID NO: 3712619 - DNA, 22 bp, Homo sapiens
ctgggtggcaccagcagcctgg

SEQ ID NO: 3712620 - DNA, 23 bp, Homo sapiens
ctgggtggcaccagcagcctgga

SEQ ID NO: 3712621 - DNA, 22 bp, Homo sapiens
ctgggtggggctgctcctccag

SEQ ID NO: 3712622 - DNA, 14 bp, Homo sapiens
ctgggttcactgca

SEQ ID NO: 3712623 - DNA, 20 bp, Homo sapiens
ctgggttcactgcaacctcc

SEQ ID NO: 3712624 - DNA, 14 bp, Homo sapiens
ctgggttccctttc

SEQ ID NO: 3712625 - DNA, 15 bp, Homo sapiens
ctgggttctgggtgg

SEQ ID NO: 3712626 - DNA, 13 bp, Homo sapiens
ctgggttggaggg

SEQ ID NO: 3712627 - DNA, 18 bp, Homo sapiens
ctgggtttctctgtatag

SEQ ID NO: 3712628 - DNA, 15 bp, Homo sapiens
ctggtagatagaaat

SEQ ID NO: 3712629 - DNA, 20 bp, Homo sapiens
ctggtaggaatagcatgtca

SEQ ID NO: 3712630 - DNA, 23 bp, Homo sapiens
ctggtaggaatagcatgtcacta

SEQ ID NO: 3712631 - DNA, 23 bp, Homo sapiens
ctggtatgggtttctcccagttc

SEQ ID NO: 3712632 - DNA, 20 bp, Homo sapiens
ctggtcaacttgagcatgtt

SEQ ID NO: 3712633 - DNA, 22 bp, Homo sapiens
ctggtcactgccatggaggcac

SEQ ID NO: 3712634 - DNA, 15 bp, Homo sapiens
ctggtccagggaagc

SEQ ID NO: 3712635 - DNA, 17 bp, Homo sapiens
ctggtccatgatggagt

SEQ ID NO: 3712636 - DNA, 13 bp, Homo sapiens
ctggtcccactca

SEQ ID NO: 3712637 - DNA, 21 bp, Homo sapiens
ctggtcccttgcagctagttt

SEQ ID NO: 3712638 - DNA, 12 bp, Homo sapiens
ctggtctctcta

SEQ ID NO: 3712639 - DNA, 15 bp, Homo sapiens
ctggtcttgtaagag

SEQ ID NO: 3712640 - DNA, 14 bp, Homo sapiens
ctggtgacaccagc

SEQ ID NO: 3712641 - DNA, 14 bp, Homo sapiens
ctggtgagccaagc

SEQ ID NO: 3712642 - DNA, 16 bp, Homo sapiens
ctggtgcattacagag

SEQ ID NO: 3712643 - DNA, 17 bp, Homo sapiens
ctggtgcattacagaga

SEQ ID NO: 3712644 - DNA, 18 bp, Homo sapiens
ctggtgcattacagagag

SEQ ID NO: 3712645 - DNA, 12 bp, Homo sapiens
ctggtgctgctg

SEQ ID NO: 3712646 - DNA, 15 bp, Homo sapiens
ctggtggacagtcct

SEQ ID NO: 3712647 - DNA, 18 bp, Homo sapiens
ctggtggacagtcctggg

SEQ ID NO: 3712648 - DNA, 15 bp, Homo sapiens
ctggtggcagctgcg

SEQ ID NO: 3712649 - DNA, 23 bp, Homo sapiens
ctggtggcagtgggagctgcctg

SEQ ID NO: 3712650 - DNA, 15 bp, Homo sapiens
ctggtggcccctgcc

SEQ ID NO: 3712651 - DNA, 22 bp, Homo sapiens
ctggtggcccgacagcctggca

SEQ ID NO: 3712652 - DNA, 15 bp, Homo sapiens
ctggtggcctctgcc

SEQ ID NO: 3712653 - DNA, 24 bp, Homo sapiens
ctggtgggatctgtgcccagagat

SEQ ID NO: 3712654 - DNA, 21 bp, Homo sapiens
ctggtgggcaccaagagccaa

SEQ ID NO: 3712655 - DNA, 12 bp, Homo sapiens
ctggtgggcctc

SEQ ID NO: 3712656 - DNA, 17 bp, Homo sapiens
ctggtgggtgaaagaaa

SEQ ID NO: 3712657 - DNA, 19 bp, Homo sapiens
ctggtgggtgaaagaaatc

SEQ ID NO: 3712658 - DNA, 16 bp, Homo sapiens
ctggtgtccagctgag

SEQ ID NO: 3712659 - DNA, 22 bp, Homo sapiens
ctggttagctcagccccagccc

SEQ ID NO: 3712660 - DNA, 20 bp, Homo sapiens
ctggttcagggttggcccct

SEQ ID NO: 3712661 - DNA, 17 bp, Homo sapiens
ctggttccggaatcctg

SEQ ID NO: 3712662 - DNA, 18 bp, Homo sapiens
ctggttccggaatcctgt

SEQ ID NO: 3712663 - DNA, 20 bp, Homo sapiens
ctggttcctgctagaaatgg

SEQ ID NO: 3712664 - DNA, 22 bp, Homo sapiens
ctggttcttcatttattgagca

SEQ ID NO: 3712665 - DNA, 20 bp, Homo sapiens
ctggttggtgttgcagaagg

SEQ ID NO: 3712666 - DNA, 15 bp, Homo sapiens
ctggttgtcattttt

SEQ ID NO: 3712667 - DNA, 18 bp, Homo sapiens
ctggtttcactggcccaa

SEQ ID NO: 3712668 - DNA, 13 bp, Homo sapiens
ctgtaaaacttta

SEQ ID NO: 3712669 - DNA, 17 bp, Homo sapiens
ctgtaagaagagactgg

SEQ ID NO: 3712670 - DNA, 20 bp, Homo sapiens
ctgtaagaagagactgggaa

SEQ ID NO: 3712671 - DNA, 16 bp, Homo sapiens
ctgtaagactgataat

SEQ ID NO: 3712672 - DNA, 22 bp, Homo sapiens
ctgtaataaactcatttctagc

SEQ ID NO: 3712673 - DNA, 14 bp, Homo sapiens
ctgtaatcccagca

SEQ ID NO: 3712674 - DNA, 16 bp, Homo sapiens
ctgtaatcccagcact

SEQ ID NO: 3712675 - DNA, 17 bp, Homo sapiens
ctgtaatcccagcactt

SEQ ID NO: 3712676 - DNA, 15 bp, Homo sapiens
cttacattgtgaaac

SEQ ID NO: 3712677 - DNA, 18 bp, Homo sapiens
cttacccttctgtgccca

SEQ ID NO: 3712678 - DNA, 21 bp, Homo sapiens
cttacccttctgtgcccagct

SEQ ID NO: 3712679 - DNA, 20 bp, Homo sapiens
cttaccgtgggcactgaagg

SEQ ID NO: 3712680 - DNA, 13 bp, Homo sapiens
cttacctcctgcc

SEQ ID NO: 3712681 - DNA, 15 bp, Homo sapiens
cttacctcctgccca

SEQ ID NO: 3712682 - DNA, 15 bp, Homo sapiens
cttaccttcaataaa

SEQ ID NO: 3712683 - DNA, 16 bp, Homo sapiens
cttaccttcaataaag

SEQ ID NO: 3712684 - DNA, 18 bp, Homo sapiens
cttaccttcaataaagta

SEQ ID NO: 3712685 - DNA, 14 bp, Homo sapiens
cttactccaggaga

SEQ ID NO: 3712686 - DNA, 18 bp, Homo sapiens
cttacttattatcttcag

SEQ ID NO: 3712687 - DNA, 20 bp, Homo sapiens
cttagaaaaaccaccaccat

SEQ ID NO: 3712688 - DNA, 17 bp, Homo sapiens
cttagaaattgcatttc

SEQ ID NO: 3712689 - DNA, 15 bp, Homo sapiens
cttagaacctttctt

SEQ ID NO: 3712690 - DNA, 20 bp, Homo sapiens
cttagaagtcacacagtatt

SEQ ID NO: 3712691 - DNA, 23 bp, Homo sapiens
cttagaagtggaccaggacagga

SEQ ID NO: 3712692 - DNA, 17 bp, Homo sapiens
cttagacttgaaatact

SEQ ID NO: 3712693 - DNA, 13 bp, Homo sapiens
cttagatatcttt

SEQ ID NO: 3712694 - DNA, 14 bp, Homo sapiens
cttagatatctttt

SEQ ID NO: 3712695 - DNA, 13 bp, Homo sapiens
cttagatgtatat

SEQ ID NO: 3712696 - DNA, 16 bp, Homo sapiens
cttagcagctatctct

SEQ ID NO: 3712697 - DNA, 18 bp, Homo sapiens
cttagcatgtgttgaaaa

SEQ ID NO: 3712698 - DNA, 15 bp, Homo sapiens
cttagcctccctgaa

SEQ ID NO: 3712699 - DNA, 15 bp, Homo sapiens
cttagctgccaagcc

SEQ ID NO: 3712700 - DNA, 14 bp, Homo sapiens
cttagctgtctgct

SEQ ID NO: 3712701 - DNA, 16 bp, Homo sapiens
cttagcttagacctca

SEQ ID NO: 3712702 - DNA, 17 bp, Homo sapiens
cttagcttagacctcag

SEQ ID NO: 3712703 - DNA, 19 bp, Homo sapiens
cttagcttagacctcagcc

SEQ ID NO: 3712704 - DNA, 22 bp, Homo sapiens
cttagcttagacctcagcctgt

SEQ ID NO: 3712705 - DNA, 15 bp, Homo sapiens
cttaggaagaatttt

SEQ ID NO: 3712706 - DNA, 17 bp, Homo sapiens
cttaggaagagaaacca

SEQ ID NO: 3712707 - DNA, 16 bp, Homo sapiens
cttaggggctgctgac

SEQ ID NO: 3712708 - DNA, 23 bp, Homo sapiens
cttaggttggcaaaaaggcagga

SEQ ID NO: 3712709 - DNA, 15 bp, Homo sapiens
cttagtcttctcata

SEQ ID NO: 3712710 - DNA, 13 bp, Homo sapiens
cttatagaatatt

SEQ ID NO: 3712711 - DNA, 15 bp, Homo sapiens
cttatagaatattta

SEQ ID NO: 3712712 - DNA, 16 bp, Homo sapiens
cttatagaatatttat

SEQ ID NO: 3712713 - DNA, 18 bp, Homo sapiens
cttatatagtttactatt

SEQ ID NO: 3712714 - DNA, 15 bp, Homo sapiens
cttatcaatttgtca

SEQ ID NO: 3712715 - DNA, 22 bp, Homo sapiens
cttatgacatcacttgtacaaa

SEQ ID NO: 3712716 - DNA, 23 bp, Homo sapiens
cttatgacgcggctcaaaaggaa

SEQ ID NO: 3712717 - DNA, 15 bp, Homo sapiens
cttatgtacctcttt

SEQ ID NO: 3712718 - DNA, 15 bp, Homo sapiens
cttattctcaaagca

SEQ ID NO: 3712719 - DNA, 12 bp, Homo sapiens
cttattgcccac

SEQ ID NO: 3712720 - DNA, 14 bp, Homo sapiens
cttattgtacctct

SEQ ID NO: 3712721 - DNA, 15 bp, Homo sapiens
cttattgtacctctc

SEQ ID NO: 3712722 - DNA, 18 bp, Homo sapiens
cttattgtacctctctta

SEQ ID NO: 3712723 - DNA, 12 bp, Homo sapiens
cttattgttcca

SEQ ID NO: 3712724 - DNA, 15 bp, Homo sapiens
cttatttaatgaaag

SEQ ID NO: 3712725 - DNA, 17 bp, Homo sapiens
cttatttaatgaaagac

SEQ ID NO: 3712726 - DNA, 18 bp, Homo sapiens
cttatttaatgaaagact

SEQ ID NO: 3712727 - DNA, 15 bp, Homo sapiens
cttatttcctcattt

SEQ ID NO: 3712728 - DNA, 12 bp, Homo sapiens
cttattttcaag

SEQ ID NO: 3712729 - DNA, 14 bp, Homo sapiens
cttattttcaagaa

SEQ ID NO: 3712730 - DNA, 23 bp, Homo sapiens
cttcaacagaccccctctagaaa

SEQ ID NO: 3712731 - DNA, 18 bp, Homo sapiens
cttcaacatcaatgttca

SEQ ID NO: 3712732 - DNA, 20 bp, Homo sapiens
cttcaaccattccccatggg

SEQ ID NO: 3712733 - DNA, 17 bp, Homo sapiens
cttcaagggctgcttca

SEQ ID NO: 3712734 - DNA, 23 bp, Homo sapiens
cttcaagtctgtgcctggagctc

SEQ ID NO: 3712735 - DNA, 22 bp, Homo sapiens
cttcaagtgcatgctctctgca

SEQ ID NO: 3712736 - DNA, 18 bp, Homo sapiens
cttcaagttaaagtgaat

SEQ ID NO: 3712737 - DNA, 12 bp, Homo sapiens
cttcaataaagt

SEQ ID NO: 3712738 - DNA, 19 bp, Homo sapiens
cttcaatttattgcacaaa

SEQ ID NO: 3712739 - DNA, 12 bp, Homo sapiens
cttcacactgca

SEQ ID NO: 3712740 - DNA, 13 bp, Homo sapiens
cttcacactgcaa

SEQ ID NO: 3712741 - DNA, 15 bp, Homo sapiens
cttcacactgcaaga

SEQ ID NO: 3712742 - DNA, 18 bp, Homo sapiens
cttcacactgcaagagcc

SEQ ID NO: 3712743 - DNA, 20 bp, Homo sapiens
cttcacatcctgtgtttcta

SEQ ID NO: 3712744 - DNA, 21 bp, Homo sapiens
cttcacatcctgtgtttctag

SEQ ID NO: 3712745 - DNA, 13 bp, Homo sapiens
cttcaccctgtca

SEQ ID NO: 3712746 - DNA, 17 bp, Homo sapiens
cttcacggcaggacaac

SEQ ID NO: 3712747 - DNA, 14 bp, Homo sapiens
cttcactccggtgt

SEQ ID NO: 3712748 - DNA, 22 bp, Homo sapiens
cttcactccggtgtgcctgcag

SEQ ID NO: 3712749 - DNA, 23 bp, Homo sapiens
cttcactccggtgtgcctgcagc

SEQ ID NO: 3712750 - DNA, 16 bp, Homo sapiens
cttcacttctgaccac

SEQ ID NO: 3712751 - DNA, 19 bp, Homo sapiens
cttcacttctgaccacact

SEQ ID NO: 3712752 - DNA, 16 bp, Homo sapiens
cttcagagagctggta

SEQ ID NO: 3712753 - DNA, 22 bp, Homo sapiens
cttcagagagctggtagttagt

SEQ ID NO: 3712754 - DNA, 18 bp, Homo sapiens
cttcagagataggcctgt

SEQ ID NO: 3712755 - DNA, 10 bp, Homo sapiens
cttcagaggc

SEQ ID NO: 3712756 - DNA, 13 bp, Homo sapiens
cttcagaggctga

SEQ ID NO: 3712757 - DNA, 21 bp, Homo sapiens
cttcagaggtggctctggaat

SEQ ID NO: 3712758 - DNA, 15 bp, Homo sapiens
cttcagatcctaccc

SEQ ID NO: 3712759 - DNA, 18 bp, Homo sapiens
cttcagcatatttatagc

SEQ ID NO: 3712760 - DNA, 15 bp, Homo sapiens
cttcagccacctctc

SEQ ID NO: 3712761 - DNA, 15 bp, Homo sapiens
cttcagccaggagct

SEQ ID NO: 3712762 - DNA, 17 bp, Homo sapiens
cttcagccaggagctgg

SEQ ID NO: 3712763 - DNA, 18 bp, Homo sapiens
cttcagccaggagctggg

SEQ ID NO: 3712764 - DNA, 20 bp, Homo sapiens
cttcagcctagccgacctca

SEQ ID NO: 3712765 - DNA, 20 bp, Homo sapiens
cttcagcctccccaccttct

SEQ ID NO: 3712766 - DNA, 20 bp, Homo sapiens
cttcagcctcccgagtagct

SEQ ID NO: 3712767 - DNA, 16 bp, Homo sapiens
cttcagcctgaggctg

SEQ ID NO: 3712768 - DNA, 22 bp, Homo sapiens
cttcagcctgaggctgagactg

SEQ ID NO: 3712769 - DNA, 16 bp, Homo sapiens
cttcaggctcttctcc

SEQ ID NO: 3712770 - DNA, 17 bp, Homo sapiens
cttcaggctcttctcct

SEQ ID NO: 3712771 - DNA, 17 bp, Homo sapiens
cttcagggcagggctct

SEQ ID NO: 3712772 - DNA, 20 bp, Homo sapiens
cttcagggcagggctctgat

SEQ ID NO: 3712773 - DNA, 23 bp, Homo sapiens
cttcagggggccaggtgcacaga

SEQ ID NO: 3712774 - DNA, 21 bp, Homo sapiens
cttcagggttctcctctcccc

SEQ ID NO: 3712775 - DNA, 14 bp, Homo sapiens
cttcagtaagccgt

SEQ ID NO: 3712776 - DNA, 15 bp, Homo sapiens
cttcagtaagccgtg

SEQ ID NO: 3712777 - DNA, 19 bp, Homo sapiens
cttcagtgcatctgggaag

SEQ ID NO: 3712778 - DNA, 17 bp, Homo sapiens
cttcagtgcccaccaac

SEQ ID NO: 3712779 - DNA, 13 bp, Homo sapiens
cttcagtggcagc

SEQ ID NO: 3712780 - DNA, 17 bp, Homo sapiens
cttcagtgtatggaaat

SEQ ID NO: 3712781 - DNA, 12 bp, Homo sapiens
cttcatcttccc

SEQ ID NO: 3712782 - DNA, 17 bp, Homo sapiens
cttcatgaaaatcctac

SEQ ID NO: 3712783 - DNA, 13 bp, Homo sapiens
cttcatgcaatga

SEQ ID NO: 3712784 - DNA, 17 bp, Homo sapiens
cttcatgcaatgacatc

SEQ ID NO: 3712785 - DNA, 17 bp, Homo sapiens
cttcatgcctttgtaag

SEQ ID NO: 3712786 - DNA, 20 bp, Homo sapiens
cttcattcaacccacctgcg

SEQ ID NO: 3712787 - DNA, 20 bp, Homo sapiens
cttcattcttgaaagctgtg

SEQ ID NO: 3712788 - DNA, 18 bp, Homo sapiens
cttcatttcctgtgtctt

SEQ ID NO: 3712789 - DNA, 12 bp, Homo sapiens
cttcattttccc

SEQ ID NO: 3712790 - DNA, 23 bp, Homo sapiens
ctttgcttcattcaagtcagctc

SEQ ID NO: 3712791 - DNA, 14 bp, Homo sapiens
ctttgcttgaacac

SEQ ID NO: 3712792 - DNA, 17 bp, Homo sapiens
ctttggaagtttgtgtt

SEQ ID NO: 3712793 - DNA, 15 bp, Homo sapiens
ctttggactctcccc

SEQ ID NO: 3712794 - DNA, 23 bp, Homo sapiens
ctttgggaggccaaggtgggagg

SEQ ID NO: 3712795 - DNA, 17 bp, Homo sapiens
ctttgggaggctgaggc

SEQ ID NO: 3712796 - DNA, 17 bp, Homo sapiens
ctttgggaggctgaggt

SEQ ID NO: 3712797 - DNA, 20 bp, Homo sapiens
ctttggggcttttacaccag

SEQ ID NO: 3712798 - DNA, 22 bp, Homo sapiens
ctttggtacatggccagtgtga

SEQ ID NO: 3712799 - DNA, 14 bp, Homo sapiens
ctttggtccttcaa

SEQ ID NO: 3712800 - DNA, 17 bp, Homo sapiens
ctttggtctcttgcttg

SEQ ID NO: 3712801 - DNA, 14 bp, Homo sapiens
ctttggtgcctttc

SEQ ID NO: 3712802 - DNA, 20 bp, Homo sapiens
ctttggtgcctttcctgttc

SEQ ID NO: 3712803 - DNA, 14 bp, Homo sapiens
ctttggttcagcta

SEQ ID NO: 3712804 - DNA, 20 bp, Homo sapiens
ctttgtaattatttttaata

SEQ ID NO: 3712805 - DNA, 15 bp, Homo sapiens
ctttgttacaggcac

SEQ ID NO: 3712806 - DNA, 17 bp, Homo sapiens
ctttgtttcaaccaagt

SEQ ID NO: 3712807 - DNA, 21 bp, Homo sapiens
ctttgtttgttgtcagctgaa

SEQ ID NO: 3712808 - DNA, 23 bp, Homo sapiens
ctttgttttgatgtttgtggcct

SEQ ID NO: 3712809 - DNA, 11 bp, Homo sapiens
ctttgttttgt

SEQ ID NO: 3712810 - DNA, 16 bp, Homo sapiens
ctttgtttttaaatga

SEQ ID NO: 3712811 - DNA, 21 bp, Homo sapiens
ctttgtttttttttcctgtcc

SEQ ID NO: 3712812 - DNA, 23 bp, Homo sapiens
ctttgtttttttttcctgtcctt

SEQ ID NO: 3712813 - DNA, 18 bp, Homo sapiens
cttttaaaacacttccat

SEQ ID NO: 3712814 - DNA, 19 bp, Homo sapiens
cttttaagatgtgtcttca

SEQ ID NO: 3712815 - DNA, 19 bp, Homo sapiens
cttttagttgtatctcttt

SEQ ID NO: 3712816 - DNA, 21 bp, Homo sapiens
cttttagttttagttgcagaa

SEQ ID NO: 3712817 - DNA, 13 bp, Homo sapiens
cttttataaaaaa

SEQ ID NO: 3712818 - DNA, 22 bp, Homo sapiens
cttttataaaaaaaatgaaatg

SEQ ID NO: 3712819 - DNA, 23 bp, Homo sapiens
cttttataaaaaaaatgaaatgt

SEQ ID NO: 3712820 - DNA, 13 bp, Homo sapiens
cttttataaatta

SEQ ID NO: 3712821 - DNA, 22 bp, Homo sapiens
cttttataactagtcctttact

SEQ ID NO: 3712822 - DNA, 21 bp, Homo sapiens
cttttatgagctcatgtagca

SEQ ID NO: 3712823 - DNA, 20 bp, Homo sapiens
cttttcataacctagcctta

SEQ ID NO: 3712824 - DNA, 17 bp, Homo sapiens
cttttccttggggcagg

SEQ ID NO: 3712825 - DNA, 14 bp, Homo sapiens
cttttctacagcaa

SEQ ID NO: 3712826 - DNA, 18 bp, Homo sapiens
cttttctacagcaaattt

SEQ ID NO: 3712827 - DNA, 19 bp, Homo sapiens
cttttctacagcaaattta

SEQ ID NO: 3712828 - DNA, 15 bp, Homo sapiens
cttttctccatgagt

SEQ ID NO: 3712829 - DNA, 18 bp, Homo sapiens
cttttctcctatcttcat

SEQ ID NO: 3712830 - DNA, 14 bp, Homo sapiens
cttttctctttctc

SEQ ID NO: 3712831 - DNA, 15 bp, Homo sapiens
cttttctgcagaggg

SEQ ID NO: 3712832 - DNA, 18 bp, Homo sapiens
cttttgaacccaggagtt

SEQ ID NO: 3712833 - DNA, 20 bp, Homo sapiens
cttttgaatccatgcttggg

SEQ ID NO: 3712834 - DNA, 21 bp, Homo sapiens
cttttgaatccatgcttgggt

SEQ ID NO: 3712835 - DNA, 13 bp, Homo sapiens
cttttgacatgtg

SEQ ID NO: 3712836 - DNA, 20 bp, Homo sapiens
cttttgagactttttggtgg

SEQ ID NO: 3712837 - DNA, 13 bp, Homo sapiens
cttttgatattaa

SEQ ID NO: 3712838 - DNA, 21 bp, Homo sapiens
cttttgcccttcacagtgttt

SEQ ID NO: 3712839 - DNA, 11 bp, Homo sapiens
cttttgctaaa

SEQ ID NO: 3712840 - DNA, 22 bp, Homo sapiens
cttttgctcttagctgtctgct

SEQ ID NO: 3712841 - DNA, 20 bp, Homo sapiens
cttttggaatctagaagaaa

SEQ ID NO: 3712842 - DNA, 21 bp, Homo sapiens
cttttggaatctagaagaaat

SEQ ID NO: 3712843 - DNA, 17 bp, Homo sapiens
cttttgggtttctgccc

SEQ ID NO: 3712844 - DNA, 20 bp, Homo sapiens
cttttgggtttctgccctgc

SEQ ID NO: 3712845 - DNA, 21 bp, Homo sapiens
cttttggttgccttaaaagaa

SEQ ID NO: 3712846 - DNA, 10 bp, Homo sapiens
cttttgtaag

SEQ ID NO: 3712847 - DNA, 18 bp, Homo sapiens
cttttgtctatgggactc

SEQ ID NO: 3712848 - DNA, 14 bp, Homo sapiens
cttttgtgtacagt

SEQ ID NO: 3712849 - DNA, 23 bp, Homo sapiens
cttttgtgtacagtgtgtaaagt

SEQ ID NO: 3712850 - DNA, 12 bp, Homo sapiens
cttttgtttctt

SEQ ID NO: 3712851 - DNA, 20 bp, Homo sapiens
ctttttaataaaaaggcacc

SEQ ID NO: 3712852 - DNA, 21 bp, Homo sapiens
ctttttattttttaattattg

SEQ ID NO: 3712853 - DNA, 22 bp, Homo sapiens
ctttttctggactgaagcctgc

SEQ ID NO: 3712854 - DNA, 14 bp, Homo sapiens
ctttttcttcctca

SEQ ID NO: 3712855 - DNA, 16 bp, Homo sapiens
ctttttctttataaac

SEQ ID NO: 3712856 - DNA, 15 bp, Homo sapiens
cttttttaaattttc

SEQ ID NO: 3712857 - DNA, 20 bp, Homo sapiens
cttttttaaattttcttcag

SEQ ID NO: 3712858 - DNA, 23 bp, Homo sapiens
cttttttatgtgccgtgttattg

SEQ ID NO: 3712859 - DNA, 18 bp, Homo sapiens
cttttttattttttatac

SEQ ID NO: 3712860 - DNA, 17 bp, Homo sapiens
cttttttctttaaattt

SEQ ID NO: 3712861 - DNA, 21 bp, Homo sapiens
gaaaaaaaaagtcagactgct

SEQ ID NO: 3712862 - DNA, 14 bp, Homo sapiens
gaaaaaaaacacac

SEQ ID NO: 3712863 - DNA, 22 bp, Homo sapiens
gaaaaaaaagtttcagagaagt

SEQ ID NO: 3712864 - DNA, 17 bp, Homo sapiens
gaaaaaaacttttataa

SEQ ID NO: 3712865 - DNA, 16 bp, Homo sapiens
gaaaaaaatgactaaa

SEQ ID NO: 3712866 - DNA, 16 bp, Homo sapiens
gaaaaaaattggcatt

SEQ ID NO: 3712867 - DNA, 12 bp, Homo sapiens
gaaaaaagcttt

SEQ ID NO: 3712868 - DNA, 10 bp, Homo sapiens
gaaaaaatac

SEQ ID NO: 3712869 - DNA, 13 bp, Homo sapiens
gaaaaaatacatt

SEQ ID NO: 3712870 - DNA, 15 bp, Homo sapiens
gaaaaaatacatttt

SEQ ID NO: 3712871 - DNA, 20 bp, Homo sapiens
gaaaaacttccatgaggcca

SEQ ID NO: 3712872 - DNA, 18 bp, Homo sapiens
gaaaaaggacaggcagaa

SEQ ID NO: 3712873 - DNA, 15 bp, Homo sapiens
gaaaaaggaggaaga

SEQ ID NO: 3712874 - DNA, 22 bp, Homo sapiens
gaaaaagtatcatggaaatatt

SEQ ID NO: 3712875 - DNA, 19 bp, Homo sapiens
gaaaaataacttcaagcaa

SEQ ID NO: 3712876 - DNA, 11 bp, Homo sapiens
gaaaaatatga

SEQ ID NO: 3712877 - DNA, 16 bp, Homo sapiens
gaaaaatgagcctggc

SEQ ID NO: 3712878 - DNA, 22 bp, Homo sapiens
gaaaaatggatccccagtgaaa

SEQ ID NO: 3712879 - DNA, 16 bp, Homo sapiens
gaaaaattacagcttc

SEQ ID NO: 3712880 - DNA, 11 bp, Homo sapiens
gaaaacagaaa

SEQ ID NO: 3712881 - DNA, 14 bp, Homo sapiens
gaaaacagaaaaaa

SEQ ID NO: 3712882 - DNA, 19 bp, Homo sapiens
gaaaacaggaaaaaaactt

SEQ ID NO: 3712883 - DNA, 22 bp, Homo sapiens
gaaaacataaaaagttaaaaaa

SEQ ID NO: 3712884 - DNA, 13 bp, Homo sapiens
gaaaacccagaga

SEQ ID NO: 3712885 - DNA, 16 bp, Homo sapiens
gaaaacgttttattgt

SEQ ID NO: 3712886 - DNA, 20 bp, Homo sapiens
gaaaacgttttattgtgttt

SEQ ID NO: 3712887 - DNA, 14 bp, Homo sapiens
gaaaactacatttt

SEQ ID NO: 3712888 - DNA, 17 bp, Homo sapiens
gaaaactacattttaac

SEQ ID NO: 3712889 - DNA, 21 bp, Homo sapiens
gaaaactacattttaacatgg

SEQ ID NO: 3712890 - DNA, 20 bp, Homo sapiens
gaaaactagagctctaagcc

SEQ ID NO: 3712891 - DNA, 20 bp, Homo sapiens
gaaaacttgaattcatagaa

SEQ ID NO: 3712892 - DNA, 16 bp, Homo sapiens
gaaaagaatacagaaa

SEQ ID NO: 3712893 - DNA, 18 bp, Homo sapiens
gaaaagatgttgtgtctt

SEQ ID NO: 3712894 - DNA, 16 bp, Homo sapiens
gaaaagccatgtttaa

SEQ ID NO: 3712895 - DNA, 18 bp, Homo sapiens
gaaaagccatgtttaaga

SEQ ID NO: 3712896 - DNA, 20 bp, Homo sapiens
gaaaagccatgtttaagatt

SEQ ID NO: 3712897 - DNA, 17 bp, Homo sapiens
gaaaagctgctgacagt

SEQ ID NO: 3712898 - DNA, 15 bp, Homo sapiens
gaaaaggaagactag

SEQ ID NO: 3712899 - DNA, 18 bp, Homo sapiens
gaaaagggaacaggaaaa

SEQ ID NO: 3712900 - DNA, 12 bp, Homo sapiens
gaaaagttcata

SEQ ID NO: 3712901 - DNA, 15 bp, Homo sapiens
gaaaatacaataaac

SEQ ID NO: 3712902 - DNA, 15 bp, Homo sapiens
gaaaatatgcatcta

SEQ ID NO: 3712903 - DNA, 17 bp, Homo sapiens
gaatgaaggtgtcagaa

SEQ ID NO: 3712904 - DNA, 14 bp, Homo sapiens
gaatgagagtgtga

SEQ ID NO: 3712905 - DNA, 11 bp, Homo sapiens
gaatgagcctc

SEQ ID NO: 3712906 - DNA, 13 bp, Homo sapiens
gaatgagcctcgg

SEQ ID NO: 3712907 - DNA, 14 bp, Homo sapiens
gaatgaggaggaag

SEQ ID NO: 3712908 - DNA, 15 bp, Homo sapiens
gaatgaggtcccagg

SEQ ID NO: 3712909 - DNA, 22 bp, Homo sapiens
gaatgatttccaaagagaaaaa

SEQ ID NO: 3712910 - DNA, 22 bp, Homo sapiens
gaatgcccacaggcaaatgcat

SEQ ID NO: 3712911 - DNA, 21 bp, Homo sapiens
gaatgcggccgcattccctga

SEQ ID NO: 3712912 - DNA, 21 bp, Homo sapiens
gaatgctaacagttcacttgc

SEQ ID NO: 3712913 - DNA, 19 bp, Homo sapiens
gaatgctcccccatcctcc

SEQ ID NO: 3712914 - DNA, 18 bp, Homo sapiens
gaatgctggttttcctaa

SEQ ID NO: 3712915 - DNA, 22 bp, Homo sapiens
gaatgctggttttcctaaatgc

SEQ ID NO: 3712916 - DNA, 22 bp, Homo sapiens
gaatggttttcaaaataaaaat

SEQ ID NO: 3712917 - DNA, 13 bp, Homo sapiens
gaatgtaatttgt

SEQ ID NO: 3712918 - DNA, 14 bp, Homo sapiens
gaatgtactctgtt

SEQ ID NO: 3712919 - DNA, 20 bp, Homo sapiens
gaatgtagctggtttcctca

SEQ ID NO: 3712920 - DNA, 21 bp, Homo sapiens
gaatgtattattctgcagcat

SEQ ID NO: 3712921 - DNA, 14 bp, Homo sapiens
gaatgtcagattcc

SEQ ID NO: 3712922 - DNA, 22 bp, Homo sapiens
gaatgtggcccctgaacaagaa

SEQ ID NO: 3712923 - DNA, 15 bp, Homo sapiens
gaatgttctgacatt

SEQ ID NO: 3712924 - DNA, 16 bp, Homo sapiens
gaatgtttgcctctgc

SEQ ID NO: 3712925 - DNA, 19 bp, Homo sapiens
gaatgtttgcctctgcctc

SEQ ID NO: 3712926 - DNA, 13 bp, Homo sapiens
gaattaaaacaat

SEQ ID NO: 3712927 - DNA, 19 bp, Homo sapiens
gaattaacctggtgctgga

SEQ ID NO: 3712928 - DNA, 16 bp, Homo sapiens
gaattaagaggataca

SEQ ID NO: 3712929 - DNA, 22 bp, Homo sapiens
gaattcattctggtctctctat

SEQ ID NO: 3712930 - DNA, 23 bp, Homo sapiens
gaattctaggcatcccaggggac

SEQ ID NO: 3712931 - DNA, 15 bp, Homo sapiens
gaattgaggtctgct

SEQ ID NO: 3712932 - DNA, 14 bp, Homo sapiens
gaattgataataaa

SEQ ID NO: 3712933 - DNA, 15 bp, Homo sapiens
gaattgataataaac

SEQ ID NO: 3712934 - DNA, 20 bp, Homo sapiens
gaattgatcattttcccccc

SEQ ID NO: 3712935 - DNA, 21 bp, Homo sapiens
gaattgatcattttcccccca

SEQ ID NO: 3712936 - DNA, 14 bp, Homo sapiens
gaattgcagagtac

SEQ ID NO: 3712937 - DNA, 21 bp, Homo sapiens
gaattgcattttttaaaacaa

SEQ ID NO: 3712938 - DNA, 16 bp, Homo sapiens
gaattgggagcttggg

SEQ ID NO: 3712939 - DNA, 11 bp, Homo sapiens
gaatttaacaa

SEQ ID NO: 3712940 - DNA, 12 bp, Homo sapiens
gaatttaacaat

SEQ ID NO: 3712941 - DNA, 17 bp, Homo sapiens
gaatttaacaatgcgaa

SEQ ID NO: 3712942 - DNA, 20 bp, Homo sapiens
gaatttataaaaattaagtt

SEQ ID NO: 3712943 - DNA, 13 bp, Homo sapiens
gaatttctctaca

SEQ ID NO: 3712944 - DNA, 12 bp, Homo sapiens
gaatttcttggt

SEQ ID NO: 3712945 - DNA, 14 bp, Homo sapiens
gaatttgaatgaaa

SEQ ID NO: 3712946 - DNA, 20 bp, Homo sapiens
gaattttcaagcatctcctg

SEQ ID NO: 3712947 - DNA, 22 bp, Homo sapiens
gaattttctttttaataaaaag

SEQ ID NO: 3712948 - DNA, 21 bp, Homo sapiens
gaattttgtgcccccatgtaa

SEQ ID NO: 3712949 - DNA, 17 bp, Homo sapiens
gacaaaaatactctaat

SEQ ID NO: 3712950 - DNA, 15 bp, Homo sapiens
gacaaaccagaagca

SEQ ID NO: 3712951 - DNA, 12 bp, Homo sapiens
gacaaacccttc

SEQ ID NO: 3712952 - DNA, 12 bp, Homo sapiens
gacaaatcaagt

SEQ ID NO: 3712953 - DNA, 18 bp, Homo sapiens
gacaaatcaagtttccaa

SEQ ID NO: 3712954 - DNA, 19 bp, Homo sapiens
gacaaatcaagtttccaag

SEQ ID NO: 3712955 - DNA, 23 bp, Homo sapiens
gacaaatcaagtttccaagcaaa

SEQ ID NO: 3712956 - DNA, 12 bp, Homo sapiens
gacaaatctaag

SEQ ID NO: 3712957 - DNA, 22 bp, Homo sapiens
gacaaatgctgcgcccttcccc

SEQ ID NO: 3712958 - DNA, 15 bp, Homo sapiens
gacaaattctgtttc

SEQ ID NO: 3712959 - DNA, 16 bp, Homo sapiens
gacaaattctgtttct

SEQ ID NO: 3712960 - DNA, 15 bp, Homo sapiens
gacaaatttaaaaca

SEQ ID NO: 3712961 - DNA, 14 bp, Homo sapiens
gacaacagaagtca

SEQ ID NO: 3712962 - DNA, 17 bp, Homo sapiens
gacaaccaccgctcccc

SEQ ID NO: 3712963 - DNA, 19 bp, Homo sapiens
gacaaccaccgctccccag

SEQ ID NO: 3712964 - DNA, 13 bp, Homo sapiens
gacaaccctgcaa

SEQ ID NO: 3712965 - DNA, 18 bp, Homo sapiens
gacaaccgatgctccagc

SEQ ID NO: 3712966 - DNA, 21 bp, Homo sapiens
gacaacttctaattgccatgt

SEQ ID NO: 3712967 - DNA, 24 bp, Homo sapiens
gacaagacttcgggaaggtgtctg

SEQ ID NO: 3712968 - DNA, 18 bp, Homo sapiens
gacaaggattgctactgt

SEQ ID NO: 3712969 - DNA, 22 bp, Homo sapiens
gacaaggattgctactgtccta

SEQ ID NO: 3712970 - DNA, 17 bp, Homo sapiens
gacaaggccccagagac

SEQ ID NO: 3712971 - DNA, 23 bp, Homo sapiens
gacaaggtagccctggccagagg

SEQ ID NO: 3712972 - DNA, 19 bp, Homo sapiens
gacaataatttcaggtttt

SEQ ID NO: 3712973 - DNA, 14 bp, Homo sapiens
gacaatagaacatt

SEQ ID NO: 3712974 - DNA, 19 bp, Homo sapiens
gacaatcatgaaatatgca

SEQ ID NO: 3712975 - DNA, 20 bp, Homo sapiens
gacaatcatgaaatatgcat

SEQ ID NO: 3712976 - DNA, 21 bp, Homo sapiens
gacaatcatgaaatatgcatc

SEQ ID NO: 3712977 - DNA, 19 bp, Homo sapiens
gacaatgcagatgccagag

SEQ ID NO: 3712978 - DNA, 20 bp, Homo sapiens
gacaatgtgaaaagaaaaat

SEQ ID NO: 3712979 - DNA, 13 bp, Homo sapiens
gacacacacagct

SEQ ID NO: 3712980 - DNA, 14 bp, Homo sapiens
gacacacagctctg

SEQ ID NO: 3712981 - DNA, 17 bp, Homo sapiens
gacacacagctctgtcc

SEQ ID NO: 3712982 - DNA, 18 bp, Homo sapiens
gacacacagctctgtcct

SEQ ID NO: 3712983 - DNA, 19 bp, Homo sapiens
gacacacagctctgtcctg

SEQ ID NO: 3712984 - DNA, 15 bp, Homo sapiens
gacacagaacacaga

SEQ ID NO: 3712985 - DNA, 13 bp, Homo sapiens
gacacagctcttc

SEQ ID NO: 3712986 - DNA, 17 bp, Homo sapiens
gacacagctcttctcca

SEQ ID NO: 3712987 - DNA, 18 bp, Homo sapiens
gacacaggcccggctcca

SEQ ID NO: 3712988 - DNA, 20 bp, Homo sapiens
gacacaggcccggctccagg

SEQ ID NO: 3712989 - DNA, 22 bp, Homo sapiens
gacaccagcctttctcccaggc

SEQ ID NO: 3712990 - DNA, 14 bp, Homo sapiens
gacacccaaagggt

SEQ ID NO: 3712991 - DNA, 11 bp, Homo sapiens
gacacctcaga

SEQ ID NO: 3712992 - DNA, 13 bp, Homo sapiens
gacacctgcacct

SEQ ID NO: 3712993 - DNA, 18 bp, Homo sapiens
gacacctgtactggagag

SEQ ID NO: 3712994 - DNA, 17 bp, Homo sapiens
gacaccttgacagggca

SEQ ID NO: 3712995 - DNA, 23 bp, Homo sapiens
gacacgctccctccccctgcccc

SEQ ID NO: 3712996 - DNA, 15 bp, Homo sapiens
gacacggggcagtgg

SEQ ID NO: 3712997 - DNA, 14 bp, Homo sapiens
gacacgtccacccc

SEQ ID NO: 3712998 - DNA, 16 bp, Homo sapiens
gacactaaccacgctg

SEQ ID NO: 3712999 - DNA, 17 bp, Homo sapiens
gacactaaccacgctgg

SEQ ID NO: 3713000 - DNA, 21 bp, Homo sapiens
gacactaaccacgctggacct

SEQ ID NO: 3713001 - DNA, 15 bp, Homo sapiens
gacactaacgacttc

SEQ ID NO: 3713002 - DNA, 16 bp, Homo sapiens
gacactattcactaaa

SEQ ID NO: 3713003 - DNA, 23 bp, Homo sapiens
gacactggctcatattcctgcag

SEQ ID NO: 3713004 - DNA, 19 bp, Homo sapiens
gacacttcagagagctggt

SEQ ID NO: 3713005 - DNA, 17 bp, Homo sapiens
gacacttgatacttgtt

SEQ ID NO: 3713006 - DNA, 13 bp, Homo sapiens
gacagaacactgt

SEQ ID NO: 3713007 - DNA, 20 bp, Homo sapiens
gacagaacccctacatgaaa

SEQ ID NO: 3713008 - DNA, 15 bp, Homo sapiens
gacagacacacacac

SEQ ID NO: 3713009 - DNA, 17 bp, Homo sapiens
gacagacacaggcccgg

SEQ ID NO: 3713010 - DNA, 20 bp, Homo sapiens
gacagacacaggcccggctc

SEQ ID NO: 3713011 - DNA, 23 bp, Homo sapiens
gacagacacttctaaatgaagtg

SEQ ID NO: 3713012 - DNA, 18 bp, Homo sapiens
gacagacttgagaacttg

SEQ ID NO: 3713013 - DNA, 17 bp, Homo sapiens
gacagagaaggcagcag

SEQ ID NO: 3713014 - DNA, 16 bp, Homo sapiens
gacagagacacctgca

SEQ ID NO: 3713015 - DNA, 17 bp, Homo sapiens
gacagagacacctgcac

SEQ ID NO: 3713016 - DNA, 18 bp, Homo sapiens
gagatcacgccactgcac

SEQ ID NO: 3713017 - DNA, 19 bp, Homo sapiens
gagatcacgccactgcact

SEQ ID NO: 3713018 - DNA, 21 bp, Homo sapiens
gagatcacgccactgcactcc

SEQ ID NO: 3713019 - DNA, 12 bp, Homo sapiens
gagatcatgaga

SEQ ID NO: 3713020 - DNA, 14 bp, Homo sapiens
gagatcatgagaaa

SEQ ID NO: 3713021 - DNA, 20 bp, Homo sapiens
gagatcgcgccactgcactc

SEQ ID NO: 3713022 - DNA, 18 bp, Homo sapiens
gagatcggggccagaggc

SEQ ID NO: 3713023 - DNA, 19 bp, Homo sapiens
gagatctaagcctttccat

SEQ ID NO: 3713024 - DNA, 22 bp, Homo sapiens
gagatctccttgccctagatga

SEQ ID NO: 3713025 - DNA, 13 bp, Homo sapiens
gagatgactgagt

SEQ ID NO: 3713026 - DNA, 19 bp, Homo sapiens
gagatgcctccaccgctgc

SEQ ID NO: 3713027 - DNA, 19 bp, Homo sapiens
gagatgggactgggagggc

SEQ ID NO: 3713028 - DNA, 20 bp, Homo sapiens
gagatggggaaagaattcct

SEQ ID NO: 3713029 - DNA, 15 bp, Homo sapiens
gagatgtagcaaaac

SEQ ID NO: 3713030 - DNA, 21 bp, Homo sapiens
gagattgcaccactgcactcc

SEQ ID NO: 3713031 - DNA, 17 bp, Homo sapiens
gagattggacggcctga

SEQ ID NO: 3713032 - DNA, 21 bp, Homo sapiens
gagattgtgccacttcactcc

SEQ ID NO: 3713033 - DNA, 12 bp, Homo sapiens
gagcaaaataat

SEQ ID NO: 3713034 - DNA, 20 bp, Homo sapiens
gagcaacagagtgagaccct

SEQ ID NO: 3713035 - DNA, 18 bp, Homo sapiens
gagcacaaaagcctctca

SEQ ID NO: 3713036 - DNA, 15 bp, Homo sapiens
gagcacactgtagca

SEQ ID NO: 3713037 - DNA, 15 bp, Homo sapiens
gagcactaaggtgtg

SEQ ID NO: 3713038 - DNA, 21 bp, Homo sapiens
gagcactaaggtgtgctctga

SEQ ID NO: 3713039 - DNA, 23 bp, Homo sapiens
gagcagactggtgagcagactgg

SEQ ID NO: 3713040 - DNA, 12 bp, Homo sapiens
gagcagagaagg

SEQ ID NO: 3713041 - DNA, 17 bp, Homo sapiens
gagcagagaaggccagg

SEQ ID NO: 3713042 - DNA, 16 bp, Homo sapiens
gagcagagaattctct

SEQ ID NO: 3713043 - DNA, 16 bp, Homo sapiens
gagcagcctgtggcat

SEQ ID NO: 3713044 - DNA, 18 bp, Homo sapiens
gagcagcctgtggcatct

SEQ ID NO: 3713045 - DNA, 21 bp, Homo sapiens
gagcagggctcagcggggaca

SEQ ID NO: 3713046 - DNA, 19 bp, Homo sapiens
gagcagtgtcttccataat

SEQ ID NO: 3713047 - DNA, 23 bp, Homo sapiens
gagcagtgtgtctcctgcatgca

SEQ ID NO: 3713048 - DNA, 19 bp, Homo sapiens
gagcattgtggctgtcagc

SEQ ID NO: 3713049 - DNA, 19 bp, Homo sapiens
gagccaatttaaagaaaac

SEQ ID NO: 3713050 - DNA, 14 bp, Homo sapiens
gagccaccatgccc

SEQ ID NO: 3713051 - DNA, 19 bp, Homo sapiens
gagccaccatgcccagctc

SEQ ID NO: 3713052 - DNA, 19 bp, Homo sapiens
gagccacctgtcccacctc

SEQ ID NO: 3713053 - DNA, 12 bp, Homo sapiens
gagccactctgt

SEQ ID NO: 3713054 - DNA, 18 bp, Homo sapiens
gagccactgcaccgggcc

SEQ ID NO: 3713055 - DNA, 19 bp, Homo sapiens
gagccactgcaccgggcca

SEQ ID NO: 3713056 - DNA, 20 bp, Homo sapiens
gagccactgcaccgggccac

SEQ ID NO: 3713057 - DNA, 22 bp, Homo sapiens
gagccactgcaccgggccacag

SEQ ID NO: 3713058 - DNA, 16 bp, Homo sapiens
gagccagccctccctg

SEQ ID NO: 3713059 - DNA, 22 bp, Homo sapiens
gagccatcggtgaaactaacag

SEQ ID NO: 3713060 - DNA, 13 bp, Homo sapiens
gagcccaccttgg

SEQ ID NO: 3713061 - DNA, 16 bp, Homo sapiens
gagccccaccctcaga

SEQ ID NO: 3713062 - DNA, 17 bp, Homo sapiens
gagccccaccctcagat

SEQ ID NO: 3713063 - DNA, 13 bp, Homo sapiens
gagccccagggtc

SEQ ID NO: 3713064 - DNA, 14 bp, Homo sapiens
gagccccagggtct

SEQ ID NO: 3713065 - DNA, 17 bp, Homo sapiens
gagccccagtgccaagc

SEQ ID NO: 3713066 - DNA, 18 bp, Homo sapiens
gagccccatcagctccag

SEQ ID NO: 3713067 - DNA, 21 bp, Homo sapiens
gagcccccgccccgccccaca

SEQ ID NO: 3713068 - DNA, 14 bp, Homo sapiens
gagccccgaggcct

SEQ ID NO: 3713069 - DNA, 12 bp, Homo sapiens
gagcccctccta

SEQ ID NO: 3713070 - DNA, 19 bp, Homo sapiens
gagcccgcacccccaccct

SEQ ID NO: 3713071 - DNA, 17 bp, Homo sapiens
gagcccggatgcttctc

SEQ ID NO: 3713072 - DNA, 13 bp, Homo sapiens
gagccctggtggc

SEQ ID NO: 3713073 - DNA, 15 bp, Homo sapiens
gagccctggtggcag

SEQ ID NO: 3713074 - DNA, 12 bp, Homo sapiens
gagccctgtctc

SEQ ID NO: 3713075 - DNA, 21 bp, Homo sapiens
gagccgcatcttctccatctg

SEQ ID NO: 3713076 - DNA, 22 bp, Homo sapiens
gagccgcatcttctccatctgg

SEQ ID NO: 3713077 - DNA, 14 bp, Homo sapiens
gagccgtgatgcct

SEQ ID NO: 3713078 - DNA, 19 bp, Homo sapiens
gagcctcatccgaggcagg

SEQ ID NO: 3713079 - DNA, 18 bp, Homo sapiens
gagcctcctttctggctt

SEQ ID NO: 3713080 - DNA, 18 bp, Homo sapiens
gagcctgaaatagtggtt

SEQ ID NO: 3713081 - DNA, 17 bp, Homo sapiens
gagcctgctcccccacc

SEQ ID NO: 3713082 - DNA, 19 bp, Homo sapiens
gagcctgctcccccacccc

SEQ ID NO: 3713083 - DNA, 20 bp, Homo sapiens
gagccttggtgtccacctgg

SEQ ID NO: 3713084 - DNA, 18 bp, Homo sapiens
gagccttggttcatcagt

SEQ ID NO: 3713085 - DNA, 13 bp, Homo sapiens
gagcgcctgcccc

SEQ ID NO: 3713086 - DNA, 22 bp, Homo sapiens
gagcgcctgcccctcccagaac

SEQ ID NO: 3713087 - DNA, 15 bp, Homo sapiens
gagcgctacccactt

SEQ ID NO: 3713088 - DNA, 19 bp, Homo sapiens
gagctagcgctgccgcacc

SEQ ID NO: 3713089 - DNA, 19 bp, Homo sapiens
gagctatacagttttccta

SEQ ID NO: 3713090 - DNA, 20 bp, Homo sapiens
gagctatacagttttcctaa

SEQ ID NO: 3713091 - DNA, 14 bp, Homo sapiens
gagctcagaccccc

SEQ ID NO: 3713092 - DNA, 15 bp, Homo sapiens
gagctcatgtagcaa

SEQ ID NO: 3713093 - DNA, 22 bp, Homo sapiens
gagctccccaccaccccagctg

SEQ ID NO: 3713094 - DNA, 14 bp, Homo sapiens
gagctcctctgggc

SEQ ID NO: 3713095 - DNA, 15 bp, Homo sapiens
gagctctgtctgtcc

SEQ ID NO: 3713096 - DNA, 22 bp, Homo sapiens
gagctcttcaggcctccctctc

SEQ ID NO: 3713097 - DNA, 13 bp, Homo sapiens
gagctgacaaaat

SEQ ID NO: 3713098 - DNA, 17 bp, Homo sapiens
gagctgacaaaattttg

SEQ ID NO: 3713099 - DNA, 19 bp, Homo sapiens
gagctgagaatagaaggaa

SEQ ID NO: 3713100 - DNA, 13 bp, Homo sapiens
gagctgagatgga

SEQ ID NO: 3713101 - DNA, 17 bp, Homo sapiens
gagctgaggcaattcta

SEQ ID NO: 3713102 - DNA, 17 bp, Homo sapiens
gagctgcctaagaggca

SEQ ID NO: 3713103 - DNA, 16 bp, Homo sapiens
gagctgcctgttcagc

SEQ ID NO: 3713104 - DNA, 15 bp, Homo sapiens
gagctggaccagtgg

SEQ ID NO: 3713105 - DNA, 21 bp, Homo sapiens
gagctgggacacttaacagat

SEQ ID NO: 3713106 - DNA, 16 bp, Homo sapiens
gagctgggaggaaaag

SEQ ID NO: 3713107 - DNA, 19 bp, Homo sapiens
gagctgggggccatgagct

SEQ ID NO: 3713108 - DNA, 18 bp, Homo sapiens
gagctgggtgtcaagagg

SEQ ID NO: 3713109 - DNA, 16 bp, Homo sapiens
gagctggtgcattaca

SEQ ID NO: 3713110 - DNA, 18 bp, Homo sapiens
gagctggtgcattacaga

SEQ ID NO: 3713111 - DNA, 16 bp, Homo sapiens
gagctggtgcccggag

SEQ ID NO: 3713112 - DNA, 17 bp, Homo sapiens
gagctggtgcccggaga

SEQ ID NO: 3713113 - DNA, 14 bp, Homo sapiens
gagctggtgtctga

SEQ ID NO: 3713114 - DNA, 13 bp, Homo sapiens
gagcttacctccc

SEQ ID NO: 3713115 - DNA, 18 bp, Homo sapiens
gagcttagtgaaattact

SEQ ID NO: 3713116 - DNA, 22 bp, Homo sapiens
gagcttctctttaactcaggac

SEQ ID NO: 3713117 - DNA, 22 bp, Homo sapiens
gagcttctgggaagacaactag

SEQ ID NO: 3713118 - DNA, 20 bp, Homo sapiens
gagcttgggggatgactaga

SEQ ID NO: 3713119 - DNA, 22 bp, Homo sapiens
gagctttatgtaataatgtgaa

SEQ ID NO: 3713120 - DNA, 21 bp, Homo sapiens
gagctttctgtccttttggca

SEQ ID NO: 3713121 - DNA, 20 bp, Homo sapiens
gagctttgaaaattcagtgg

SEQ ID NO: 3713122 - DNA, 20 bp, Homo sapiens
gaggaaaaccaagccgtggc

SEQ ID NO: 3713123 - DNA, 23 bp, Homo sapiens
gaggaaactcacctgctggcccc

SEQ ID NO: 3713124 - DNA, 14 bp, Homo sapiens
gaggaaactcagag

SEQ ID NO: 3713125 - DNA, 19 bp, Homo sapiens
gaggaaaggccagctggca

SEQ ID NO: 3713126 - DNA, 22 bp, Homo sapiens
gaggaaccagagccatggactc

SEQ ID NO: 3713127 - DNA, 15 bp, Homo sapiens
gaggaaccgaaaggc

SEQ ID NO: 3713128 - DNA, 14 bp, Homo sapiens
gaggaactgggcct

SEQ ID NO: 3713129 - DNA, 14 bp, Homo sapiens
gcacccactctgct

SEQ ID NO: 3713130 - DNA, 16 bp, Homo sapiens
gcacccatcctagaga

SEQ ID NO: 3713131 - DNA, 14 bp, Homo sapiens
gcacccccaccctt

SEQ ID NO: 3713132 - DNA, 15 bp, Homo sapiens
gcaccctcaggcagg

SEQ ID NO: 3713133 - DNA, 17 bp, Homo sapiens
gcaccctcatacacaga

SEQ ID NO: 3713134 - DNA, 16 bp, Homo sapiens
gcaccctccgccttca

SEQ ID NO: 3713135 - DNA, 13 bp, Homo sapiens
gcaccgccttctc

SEQ ID NO: 3713136 - DNA, 23 bp, Homo sapiens
gcaccgggccacagagaaagtac

SEQ ID NO: 3713137 - DNA, 23 bp, Homo sapiens
gcacctactacatcgccctccac

SEQ ID NO: 3713138 - DNA, 14 bp, Homo sapiens
gcacctcccagccc

SEQ ID NO: 3713139 - DNA, 14 bp, Homo sapiens
gcacctcccatcct

SEQ ID NO: 3713140 - DNA, 18 bp, Homo sapiens
gcacctccccccactgca

SEQ ID NO: 3713141 - DNA, 12 bp, Homo sapiens
gcacctcctgcc

SEQ ID NO: 3713142 - DNA, 15 bp, Homo sapiens
gcacctcctgcctcg

SEQ ID NO: 3713143 - DNA, 23 bp, Homo sapiens
gcacctgcatccgtagttccctg

SEQ ID NO: 3713144 - DNA, 15 bp, Homo sapiens
gcacctgccagcctg

SEQ ID NO: 3713145 - DNA, 16 bp, Homo sapiens
gcacctgccagcctgg

SEQ ID NO: 3713146 - DNA, 17 bp, Homo sapiens
gcacctgccagcctggc

SEQ ID NO: 3713147 - DNA, 15 bp, Homo sapiens
gcacctgccccctgg

SEQ ID NO: 3713148 - DNA, 17 bp, Homo sapiens
gcacctgccccctggtg

SEQ ID NO: 3713149 - DNA, 19 bp, Homo sapiens
gcacctgccgacctcgtcc

SEQ ID NO: 3713150 - DNA, 17 bp, Homo sapiens
gcacctggggagtggga

SEQ ID NO: 3713151 - DNA, 17 bp, Homo sapiens
gcacgaacccacctgct

SEQ ID NO: 3713152 - DNA, 16 bp, Homo sapiens
gcacgcacactgtctg

SEQ ID NO: 3713153 - DNA, 17 bp, Homo sapiens
gcacgcccatgtgtgag

SEQ ID NO: 3713154 - DNA, 16 bp, Homo sapiens
gcacgctgtgggcagg

SEQ ID NO: 3713155 - DNA, 20 bp, Homo sapiens
gcacgctgtgggcaggtggg

SEQ ID NO: 3713156 - DNA, 21 bp, Homo sapiens
gcacgtagtagggtcaggcca

SEQ ID NO: 3713157 - DNA, 18 bp, Homo sapiens
gcacgtggagagctggtg

SEQ ID NO: 3713158 - DNA, 17 bp, Homo sapiens
gcacgtggcttctgatg

SEQ ID NO: 3713159 - DNA, 23 bp, Homo sapiens
gcacgtggcttctgatgaatctt

SEQ ID NO: 3713160 - DNA, 14 bp, Homo sapiens
gcactataatgtaa

SEQ ID NO: 3713161 - DNA, 20 bp, Homo sapiens
gcactataatgtaagctcta

SEQ ID NO: 3713162 - DNA, 14 bp, Homo sapiens
gcactcacatgctg

SEQ ID NO: 3713163 - DNA, 14 bp, Homo sapiens
gcactccagcctgg

SEQ ID NO: 3713164 - DNA, 17 bp, Homo sapiens
gcactccagcctgggca

SEQ ID NO: 3713165 - DNA, 17 bp, Homo sapiens
gcactccagcctgggtg

SEQ ID NO: 3713166 - DNA, 21 bp, Homo sapiens
gcactcgtgtgcaacagacaa

SEQ ID NO: 3713167 - DNA, 23 bp, Homo sapiens
gcactctgagtttaccatttgta

SEQ ID NO: 3713168 - DNA, 21 bp, Homo sapiens
gcactgaaggctttcagggcc

SEQ ID NO: 3713169 - DNA, 22 bp, Homo sapiens
gcactgaaggctttcagggcct

SEQ ID NO: 3713170 - DNA, 16 bp, Homo sapiens
gcactgactgggcata

SEQ ID NO: 3713171 - DNA, 15 bp, Homo sapiens
gcactgagatattta

SEQ ID NO: 3713172 - DNA, 20 bp, Homo sapiens
gcactgctgcccagcctcca

SEQ ID NO: 3713173 - DNA, 19 bp, Homo sapiens
gcactggtggcccgacagc

SEQ ID NO: 3713174 - DNA, 15 bp, Homo sapiens
gcactgtatgctgga

SEQ ID NO: 3713175 - DNA, 20 bp, Homo sapiens
gcactgtctcagtttcactt

SEQ ID NO: 3713176 - DNA, 14 bp, Homo sapiens
gcactgtggccttg

SEQ ID NO: 3713177 - DNA, 22 bp, Homo sapiens
gcacttaaatatcaatcatttt

SEQ ID NO: 3713178 - DNA, 14 bp, Homo sapiens
gcacttgcagactc

SEQ ID NO: 3713179 - DNA, 13 bp, Homo sapiens
gcacttggagcca

SEQ ID NO: 3713180 - DNA, 18 bp, Homo sapiens
gcactttaaatgaagcta

SEQ ID NO: 3713181 - DNA, 13 bp, Homo sapiens
gcactttcattgc

SEQ ID NO: 3713182 - DNA, 20 bp, Homo sapiens
gcactttgggaggctgaggc

SEQ ID NO: 3713183 - DNA, 23 bp, Homo sapiens
gcagaaagcaaatgtgacctgtg

SEQ ID NO: 3713184 - DNA, 13 bp, Homo sapiens
gcagaaagcagag

SEQ ID NO: 3713185 - DNA, 14 bp, Homo sapiens
gcagaaatctagaa

SEQ ID NO: 3713186 - DNA, 14 bp, Homo sapiens
gcagaaccctggtg

SEQ ID NO: 3713187 - DNA, 21 bp, Homo sapiens
gcagaacgtattggtccagct

SEQ ID NO: 3713188 - DNA, 14 bp, Homo sapiens
gcagaactgagctc

SEQ ID NO: 3713189 - DNA, 16 bp, Homo sapiens
gcagaactgagctcct

SEQ ID NO: 3713190 - DNA, 21 bp, Homo sapiens
gcagaagaattgaacccagga

SEQ ID NO: 3713191 - DNA, 14 bp, Homo sapiens
gcagacagcagctc

SEQ ID NO: 3713192 - DNA, 20 bp, Homo sapiens
gcagacagcagctcaggcac

SEQ ID NO: 3713193 - DNA, 12 bp, Homo sapiens
gcagacaggcaa

SEQ ID NO: 3713194 - DNA, 14 bp, Homo sapiens
gcagacaggcaagc

SEQ ID NO: 3713195 - DNA, 19 bp, Homo sapiens
gcagacaggcaagcacctc

SEQ ID NO: 3713196 - DNA, 22 bp, Homo sapiens
gcagacaggccatgtgagccac

SEQ ID NO: 3713197 - DNA, 15 bp, Homo sapiens
gcagactctacagag

SEQ ID NO: 3713198 - DNA, 17 bp, Homo sapiens
gcagactctacagaggc

SEQ ID NO: 3713199 - DNA, 12 bp, Homo sapiens
gcagactggagg

SEQ ID NO: 3713200 - DNA, 14 bp, Homo sapiens
gcagactggagggg

SEQ ID NO: 3713201 - DNA, 14 bp, Homo sapiens
gcagagaagccttg

SEQ ID NO: 3713202 - DNA, 20 bp, Homo sapiens
gcagagaatgaaagggccca

SEQ ID NO: 3713203 - DNA, 21 bp, Homo sapiens
gcagagaatgaaagggcccag

SEQ ID NO: 3713204 - DNA, 15 bp, Homo sapiens
gcagagacagagagg

SEQ ID NO: 3713205 - DNA, 17 bp, Homo sapiens
gcagagacaggacctga

SEQ ID NO: 3713206 - DNA, 11 bp, Homo sapiens
gcagaggctgg

SEQ ID NO: 3713207 - DNA, 17 bp, Homo sapiens
gcagaggctggcctcag

SEQ ID NO: 3713208 - DNA, 18 bp, Homo sapiens
gcagaggctggcctcaga

SEQ ID NO: 3713209 - DNA, 18 bp, Homo sapiens
gcagagggcagaggctgg

SEQ ID NO: 3713210 - DNA, 18 bp, Homo sapiens
gcagaggggctttctgga

SEQ ID NO: 3713211 - DNA, 12 bp, Homo sapiens
gcagagtcagca

SEQ ID NO: 3713212 - DNA, 19 bp, Homo sapiens
gcagataatcagcctctta

SEQ ID NO: 3713213 - DNA, 15 bp, Homo sapiens
gcagatcccagctca

SEQ ID NO: 3713214 - DNA, 20 bp, Homo sapiens
gcagatctgtgccccatgcc

SEQ ID NO: 3713215 - DNA, 15 bp, Homo sapiens
gcagatgacccctcc

SEQ ID NO: 3713216 - DNA, 14 bp, Homo sapiens
gcagatgatccatg

SEQ ID NO: 3713217 - DNA, 19 bp, Homo sapiens
gcagatgcaaagaggcaag

SEQ ID NO: 3713218 - DNA, 19 bp, Homo sapiens
gcagattcatttttctttc

SEQ ID NO: 3713219 - DNA, 20 bp, Homo sapiens
gcagattcatttttctttct

SEQ ID NO: 3713220 - DNA, 14 bp, Homo sapiens
gcagattggagaaa

SEQ ID NO: 3713221 - DNA, 19 bp, Homo sapiens
gcagcaaccagagcactgt

SEQ ID NO: 3713222 - DNA, 14 bp, Homo sapiens
gcagcacagagagg

SEQ ID NO: 3713223 - DNA, 18 bp, Homo sapiens
gcagcagagcctggaaga

SEQ ID NO: 3713224 - DNA, 23 bp, Homo sapiens
gcagcagcttttaatacagggta

SEQ ID NO: 3713225 - DNA, 18 bp, Homo sapiens
gcagcagggagggcttct

SEQ ID NO: 3713226 - DNA, 17 bp, Homo sapiens
gcagcatgacctgtgac

SEQ ID NO: 3713227 - DNA, 17 bp, Homo sapiens
gcagccagcccagccca

SEQ ID NO: 3713228 - DNA, 13 bp, Homo sapiens
gcagccaggctgc

SEQ ID NO: 3713229 - DNA, 18 bp, Homo sapiens
gcagcccacccctcaaca

SEQ ID NO: 3713230 - DNA, 22 bp, Homo sapiens
gcagccccagcaccaccaggtc

SEQ ID NO: 3713231 - DNA, 23 bp, Homo sapiens
gcagccccagcaccaccaggtct

SEQ ID NO: 3713232 - DNA, 21 bp, Homo sapiens
gcagccccattctgcctgccc

SEQ ID NO: 3713233 - DNA, 13 bp, Homo sapiens
gcagccctcctca

SEQ ID NO: 3713234 - DNA, 18 bp, Homo sapiens
gcagccgtgccttcagct

SEQ ID NO: 3713235 - DNA, 14 bp, Homo sapiens
gcagcctccctctg

SEQ ID NO: 3713236 - DNA, 21 bp, Homo sapiens
gcagcctcgaactcctgggct

SEQ ID NO: 3713237 - DNA, 16 bp, Homo sapiens
gcagcctgcctggagt

SEQ ID NO: 3713238 - DNA, 19 bp, Homo sapiens
gcagcctgcgtggctgacc

SEQ ID NO: 3713239 - DNA, 15 bp, Homo sapiens
gcagccttggcaaac

SEQ ID NO: 3713240 - DNA, 17 bp, Homo sapiens
gcagcctttgcctcccc

SEQ ID NO: 3713241 - DNA, 18 bp, Homo sapiens
gcagcctttgcctccccg

SEQ ID NO: 3713242 - DNA, 15 bp, Homo sapiens
gcccccactggctgt

SEQ ID NO: 3713243 - DNA, 18 bp, Homo sapiens
gcccccactggctgtggg

SEQ ID NO: 3713244 - DNA, 21 bp, Homo sapiens
gcccccactggctgtgggctc

SEQ ID NO: 3713245 - DNA, 16 bp, Homo sapiens
gcccccaggctgctgg

SEQ ID NO: 3713246 - DNA, 13 bp, Homo sapiens
gcccccgagctgg

SEQ ID NO: 3713247 - DNA, 22 bp, Homo sapiens
gcccccgagctgggggccatga

SEQ ID NO: 3713248 - DNA, 16 bp, Homo sapiens
gcccccgctcatgggc

SEQ ID NO: 3713249 - DNA, 21 bp, Homo sapiens
gccccctccgtgatccatcca

SEQ ID NO: 3713250 - DNA, 13 bp, Homo sapiens
gccccctgcatct

SEQ ID NO: 3713251 - DNA, 22 bp, Homo sapiens
gccccctggtggacagtcctgg

SEQ ID NO: 3713252 - DNA, 23 bp, Homo sapiens
gccccctggtggacagtcctggg

SEQ ID NO: 3713253 - DNA, 20 bp, Homo sapiens
gcccccttctcccacactgc

SEQ ID NO: 3713254 - DNA, 22 bp, Homo sapiens
gcccccttctcccacactgcta

SEQ ID NO: 3713255 - DNA, 15 bp, Homo sapiens
gccccgaggccttct

SEQ ID NO: 3713256 - DNA, 18 bp, Homo sapiens
gccccgaggccttctctg

SEQ ID NO: 3713257 - DNA, 22 bp, Homo sapiens
gccccgaggccttctctgaagg

SEQ ID NO: 3713258 - DNA, 14 bp, Homo sapiens
gccccgccccacat

SEQ ID NO: 3713259 - DNA, 22 bp, Homo sapiens
gccccgccccacattccgacaa

SEQ ID NO: 3713260 - DNA, 14 bp, Homo sapiens
gccccgcttgtcca

SEQ ID NO: 3713261 - DNA, 22 bp, Homo sapiens
gccccgtcaccatctcaggcca

SEQ ID NO: 3713262 - DNA, 23 bp, Homo sapiens
gccccgtcaccatctcaggccac

SEQ ID NO: 3713263 - DNA, 19 bp, Homo sapiens
gccccgtgcagactggagg

SEQ ID NO: 3713264 - DNA, 17 bp, Homo sapiens
gcccctagaagggaagg

SEQ ID NO: 3713265 - DNA, 17 bp, Homo sapiens
gcccctagaatcagcct

SEQ ID NO: 3713266 - DNA, 14 bp, Homo sapiens
gcccctcacctggg

SEQ ID NO: 3713267 - DNA, 20 bp, Homo sapiens
gcccctcacctgggcacctg

SEQ ID NO: 3713268 - DNA, 16 bp, Homo sapiens
gcccctcccaccacag

SEQ ID NO: 3713269 - DNA, 22 bp, Homo sapiens
gcccctcccccaacccccaccc

SEQ ID NO: 3713270 - DNA, 18 bp, Homo sapiens
gcccctccctacctcaac

SEQ ID NO: 3713271 - DNA, 14 bp, Homo sapiens
gcccctcctctgcc

SEQ ID NO: 3713272 - DNA, 15 bp, Homo sapiens
gcccctcctctgcca

SEQ ID NO: 3713273 - DNA, 16 bp, Homo sapiens
gcccctcctctgccac

SEQ ID NO: 3713274 - DNA, 23 bp, Homo sapiens
gcccctcctctgccacctcccct

SEQ ID NO: 3713275 - DNA, 14 bp, Homo sapiens
gcccctctctccat

SEQ ID NO: 3713276 - DNA, 16 bp, Homo sapiens
gcccctcttgcccccc

SEQ ID NO: 3713277 - DNA, 18 bp, Homo sapiens
gcccctcttgccccccac

SEQ ID NO: 3713278 - DNA, 21 bp, Homo sapiens
gcccctcttgccccccacccc

SEQ ID NO: 3713279 - DNA, 16 bp, Homo sapiens
gcccctgaacaagaat

SEQ ID NO: 3713280 - DNA, 13 bp, Homo sapiens
gcccctgccaccc

SEQ ID NO: 3713281 - DNA, 15 bp, Homo sapiens
gcccctgccccgtca

SEQ ID NO: 3713282 - DNA, 13 bp, Homo sapiens
gcccctgctgcct

SEQ ID NO: 3713283 - DNA, 17 bp, Homo sapiens
gcccctgctgcctcccc

SEQ ID NO: 3713284 - DNA, 21 bp, Homo sapiens
gcccctgctggttcagggttg

SEQ ID NO: 3713285 - DNA, 22 bp, Homo sapiens
gcccctgttacctaattagagc

SEQ ID NO: 3713286 - DNA, 21 bp, Homo sapiens
gccccttctacactctcctgg

SEQ ID NO: 3713287 - DNA, 20 bp, Homo sapiens
gcccctttttactccccttg

SEQ ID NO: 3713288 - DNA, 21 bp, Homo sapiens
gcccctttttactccccttga

SEQ ID NO: 3713289 - DNA, 19 bp, Homo sapiens
gcccgacagcctggcacag

SEQ ID NO: 3713290 - DNA, 13 bp, Homo sapiens
gcccgagctggtg

SEQ ID NO: 3713291 - DNA, 22 bp, Homo sapiens
gcccgagctggtgcattacaga

SEQ ID NO: 3713292 - DNA, 17 bp, Homo sapiens
gcccgaggtggctgcct

SEQ ID NO: 3713293 - DNA, 18 bp, Homo sapiens
gcccgaggtggctgcctg

SEQ ID NO: 3713294 - DNA, 22 bp, Homo sapiens
gcccgaggtggctgcctggagc

SEQ ID NO: 3713295 - DNA, 16 bp, Homo sapiens
gcccgcacccccaccc

SEQ ID NO: 3713296 - DNA, 19 bp, Homo sapiens
gcccgcatgcagcagcttg

SEQ ID NO: 3713297 - DNA, 13 bp, Homo sapiens
gcccgcctggcag

SEQ ID NO: 3713298 - DNA, 14 bp, Homo sapiens
gcccggatgcttct

SEQ ID NO: 3713299 - DNA, 21 bp, Homo sapiens
gcccggcgcggtggctcacgc

SEQ ID NO: 3713300 - DNA, 12 bp, Homo sapiens
gcccggctccag

SEQ ID NO: 3713301 - DNA, 14 bp, Homo sapiens
gcccggctccaggc

SEQ ID NO: 3713302 - DNA, 15 bp, Homo sapiens
gcccggctccaggct

SEQ ID NO: 3713303 - DNA, 16 bp, Homo sapiens
gcccggctccaggctc

SEQ ID NO: 3713304 - DNA, 17 bp, Homo sapiens
gcccggggcagctgcca

SEQ ID NO: 3713305 - DNA, 15 bp, Homo sapiens
gcccgtcttcagcct

SEQ ID NO: 3713306 - DNA, 15 bp, Homo sapiens
gcccgtgtggcccct

SEQ ID NO: 3713307 - DNA, 17 bp, Homo sapiens
gcccgtgtggccccttc

SEQ ID NO: 3713308 - DNA, 17 bp, Homo sapiens
gccctaggctccgtcag

SEQ ID NO: 3713309 - DNA, 19 bp, Homo sapiens
gccctcacccctgccctgg

SEQ ID NO: 3713310 - DNA, 18 bp, Homo sapiens
gccctcattacggctcct

SEQ ID NO: 3713311 - DNA, 20 bp, Homo sapiens
gccctccacagccgcagcct

SEQ ID NO: 3713312 - DNA, 16 bp, Homo sapiens
gccctccactgccctc

SEQ ID NO: 3713313 - DNA, 18 bp, Homo sapiens
gccctccactgccctctg

SEQ ID NO: 3713314 - DNA, 18 bp, Homo sapiens
gccctccctgtcctcctc

SEQ ID NO: 3713315 - DNA, 23 bp, Homo sapiens
gccctccgccattctcaagccct

SEQ ID NO: 3713316 - DNA, 13 bp, Homo sapiens
gccctcctcaccc

SEQ ID NO: 3713317 - DNA, 14 bp, Homo sapiens
gccctcctcacccc

SEQ ID NO: 3713318 - DNA, 16 bp, Homo sapiens
gccctgagctcggtgg

SEQ ID NO: 3713319 - DNA, 22 bp, Homo sapiens
gccctgagctcggtggacccag

SEQ ID NO: 3713320 - DNA, 19 bp, Homo sapiens
gccctgattgcgcaaaact

SEQ ID NO: 3713321 - DNA, 21 bp, Homo sapiens
gccctgctgccgcctcccagc

SEQ ID NO: 3713322 - DNA, 21 bp, Homo sapiens
gccctgctttgggctgccctg

SEQ ID NO: 3713323 - DNA, 15 bp, Homo sapiens
gccctggcctgctgg

SEQ ID NO: 3713324 - DNA, 16 bp, Homo sapiens
gccctggcctgctggg

SEQ ID NO: 3713325 - DNA, 15 bp, Homo sapiens
gccctggctcccaca

SEQ ID NO: 3713326 - DNA, 19 bp, Homo sapiens
gccctggctcccacaggcc

SEQ ID NO: 3713327 - DNA, 19 bp, Homo sapiens
gccctgggccccaccacct

SEQ ID NO: 3713328 - DNA, 20 bp, Homo sapiens
gccctgggccccaccaccta

SEQ ID NO: 3713329 - DNA, 22 bp, Homo sapiens
gccctgggccccaccacctagg

SEQ ID NO: 3713330 - DNA, 14 bp, Homo sapiens
gccctggggcctgt

SEQ ID NO: 3713331 - DNA, 17 bp, Homo sapiens
gccctggggcctgtaca

SEQ ID NO: 3713332 - DNA, 15 bp, Homo sapiens
gccctggggctgatc

SEQ ID NO: 3713333 - DNA, 21 bp, Homo sapiens
gccctggggctgatctcaggg

SEQ ID NO: 3713334 - DNA, 13 bp, Homo sapiens
gccctggtccagg

SEQ ID NO: 3713335 - DNA, 14 bp, Homo sapiens
gccctggtccaggg

SEQ ID NO: 3713336 - DNA, 18 bp, Homo sapiens
gccctggtccttccaggc

SEQ ID NO: 3713337 - DNA, 21 bp, Homo sapiens
gccctggtgctgccacacttc

SEQ ID NO: 3713338 - DNA, 14 bp, Homo sapiens
gccctggtggcagt

SEQ ID NO: 3713339 - DNA, 21 bp, Homo sapiens
gccctggtggcagtgggagct

SEQ ID NO: 3713340 - DNA, 23 bp, Homo sapiens
gccctggtggcagtgggagctgc

SEQ ID NO: 3713341 - DNA, 23 bp, Homo sapiens
gccctgtggaagggactaggagc

SEQ ID NO: 3713342 - DNA, 21 bp, Homo sapiens
gccctgttctgggtgcagctg

SEQ ID NO: 3713343 - DNA, 17 bp, Homo sapiens
gcccttattttcaagaa

SEQ ID NO: 3713344 - DNA, 12 bp, Homo sapiens
gcccttcctctc

SEQ ID NO: 3713345 - DNA, 16 bp, Homo sapiens
gcccttcctctccact

SEQ ID NO: 3713346 - DNA, 18 bp, Homo sapiens
gcccttcctctccactgc

SEQ ID NO: 3713347 - DNA, 16 bp, Homo sapiens
gcccttggaggccagc

SEQ ID NO: 3713348 - DNA, 22 bp, Homo sapiens
gccctttctgtaccatttattt

SEQ ID NO: 3713349 - DNA, 17 bp, Homo sapiens
gccctttgggaggctga

SEQ ID NO: 3713350 - DNA, 12 bp, Homo sapiens
gccgacctcagc

SEQ ID NO: 3713351 - DNA, 14 bp, Homo sapiens
gccgacctcagcct

SEQ ID NO: 3713352 - DNA, 17 bp, Homo sapiens
gccgacctcagccttcc

SEQ ID NO: 3713353 - DNA, 20 bp, Homo sapiens
gccgacctcgtcctccccct

SEQ ID NO: 3713354 - DNA, 20 bp, Homo sapiens
gctggcccccactggctgtg

SEQ ID NO: 3713355 - DNA, 11 bp, Homo sapiens
gctggcccctc

SEQ ID NO: 3713356 - DNA, 14 bp, Homo sapiens
gctggcccctcacc

SEQ ID NO: 3713357 - DNA, 17 bp, Homo sapiens
gctggccgggcacagct

SEQ ID NO: 3713358 - DNA, 18 bp, Homo sapiens
gctggccgggcacagctg

SEQ ID NO: 3713359 - DNA, 19 bp, Homo sapiens
gctggccgggcacagctgt

SEQ ID NO: 3713360 - DNA, 12 bp, Homo sapiens
gctggcctcaga

SEQ ID NO: 3713361 - DNA, 16 bp, Homo sapiens
gctggcggctactcag

SEQ ID NO: 3713362 - DNA, 15 bp, Homo sapiens
gctggcgtgcagtgg

SEQ ID NO: 3713363 - DNA, 20 bp, Homo sapiens
gctggcgtgcagtggtgcga

SEQ ID NO: 3713364 - DNA, 15 bp, Homo sapiens
gctggctgggcatgg

SEQ ID NO: 3713365 - DNA, 19 bp, Homo sapiens
gctggctgttggctggggg

SEQ ID NO: 3713366 - DNA, 19 bp, Homo sapiens
gctgggactacaggcaccc

SEQ ID NO: 3713367 - DNA, 19 bp, Homo sapiens
gctgggactacaggtgtga

SEQ ID NO: 3713368 - DNA, 15 bp, Homo sapiens
gctgggactggccag

SEQ ID NO: 3713369 - DNA, 16 bp, Homo sapiens
gctgggactggccagg

SEQ ID NO: 3713370 - DNA, 15 bp, Homo sapiens
gctgggagctctgca

SEQ ID NO: 3713371 - DNA, 18 bp, Homo sapiens
gctgggatctgactgcac

SEQ ID NO: 3713372 - DNA, 16 bp, Homo sapiens
gctgggattacaggtg

SEQ ID NO: 3713373 - DNA, 12 bp, Homo sapiens
gctgggcagctg

SEQ ID NO: 3713374 - DNA, 14 bp, Homo sapiens
gctgggcccagagg

SEQ ID NO: 3713375 - DNA, 16 bp, Homo sapiens
gctgggcccagaggca

SEQ ID NO: 3713376 - DNA, 13 bp, Homo sapiens
gctgggctctcca

SEQ ID NO: 3713377 - DNA, 22 bp, Homo sapiens
gctgggctctccacctcagcct

SEQ ID NO: 3713378 - DNA, 14 bp, Homo sapiens
gctgggctgggcgc

SEQ ID NO: 3713379 - DNA, 21 bp, Homo sapiens
gctgggcttcagtggcagctg

SEQ ID NO: 3713380 - DNA, 22 bp, Homo sapiens
gctgggggcagcctgcgtggct

SEQ ID NO: 3713381 - DNA, 23 bp, Homo sapiens
gctgggggcaggagggccctacc

SEQ ID NO: 3713382 - DNA, 14 bp, Homo sapiens
gctgggggcctcac

SEQ ID NO: 3713383 - DNA, 13 bp, Homo sapiens
gctgggtgcccac

SEQ ID NO: 3713384 - DNA, 15 bp, Homo sapiens
gctgggtgcccacag

SEQ ID NO: 3713385 - DNA, 16 bp, Homo sapiens
gctgggtgcccacagc

SEQ ID NO: 3713386 - DNA, 22 bp, Homo sapiens
gctgggtggcaccagcagcctg

SEQ ID NO: 3713387 - DNA, 23 bp, Homo sapiens
gctgggtggcaccagcagcctgg

SEQ ID NO: 3713388 - DNA, 20 bp, Homo sapiens
gctgggtgtattaggactgg

SEQ ID NO: 3713389 - DNA, 21 bp, Homo sapiens
gctgggttggagggtgtccca

SEQ ID NO: 3713390 - DNA, 19 bp, Homo sapiens
gctggtcccactcagtcca

SEQ ID NO: 3713391 - DNA, 20 bp, Homo sapiens
gctggtgcattacagagagg

SEQ ID NO: 3713392 - DNA, 21 bp, Homo sapiens
gctggtgggaagcgtctgtcc

SEQ ID NO: 3713393 - DNA, 21 bp, Homo sapiens
gctggtgggcaccaagagcca

SEQ ID NO: 3713394 - DNA, 14 bp, Homo sapiens
gctggtgtcacctg

SEQ ID NO: 3713395 - DNA, 18 bp, Homo sapiens
gctggtgtcacctgaaga

SEQ ID NO: 3713396 - DNA, 22 bp, Homo sapiens
gctggttcagggttggcccctg

SEQ ID NO: 3713397 - DNA, 23 bp, Homo sapiens
gctggttcagggttggcccctgc

SEQ ID NO: 3713398 - DNA, 15 bp, Homo sapiens
gctggtttcctcatt

SEQ ID NO: 3713399 - DNA, 24 bp, Homo sapiens
gctgtaagaagagactgggaagat

SEQ ID NO: 3713400 - DNA, 17 bp, Homo sapiens
gctgtatcccatgagcc

SEQ ID NO: 3713401 - DNA, 16 bp, Homo sapiens
gctgtatcttgttttt

SEQ ID NO: 3713402 - DNA, 13 bp, Homo sapiens
gctgtcatctcag

SEQ ID NO: 3713403 - DNA, 13 bp, Homo sapiens
gctgtctccagac

SEQ ID NO: 3713404 - DNA, 15 bp, Homo sapiens
gctgtctccagaccc

SEQ ID NO: 3713405 - DNA, 17 bp, Homo sapiens
gctgtctccatgtttga

SEQ ID NO: 3713406 - DNA, 22 bp, Homo sapiens
gctgtcttctcaggctctgccc

SEQ ID NO: 3713407 - DNA, 20 bp, Homo sapiens
gctgtgaacaagtgaacaca

SEQ ID NO: 3713408 - DNA, 21 bp, Homo sapiens
gctgtgcgctgacaaccaccg

SEQ ID NO: 3713409 - DNA, 14 bp, Homo sapiens
gctgtgctatgaat

SEQ ID NO: 3713410 - DNA, 18 bp, Homo sapiens
gctgtgctctggacaggc

SEQ ID NO: 3713411 - DNA, 14 bp, Homo sapiens
gctgtggcaggcca

SEQ ID NO: 3713412 - DNA, 14 bp, Homo sapiens
gctgtggcctgggc

SEQ ID NO: 3713413 - DNA, 17 bp, Homo sapiens
gctgtgggcaggtggga

SEQ ID NO: 3713414 - DNA, 16 bp, Homo sapiens
gctgtgggctcccttc

SEQ ID NO: 3713415 - DNA, 19 bp, Homo sapiens
gctgtgtccaactccagta

SEQ ID NO: 3713416 - DNA, 13 bp, Homo sapiens
gctgtgtgcagtc

SEQ ID NO: 3713417 - DNA, 12 bp, Homo sapiens
gctgttgagctg

SEQ ID NO: 3713418 - DNA, 20 bp, Homo sapiens
gctgttggctgggggcctca

SEQ ID NO: 3713419 - DNA, 21 bp, Homo sapiens
gctgttggctgggggcctcag

SEQ ID NO: 3713420 - DNA, 22 bp, Homo sapiens
gctgttgtcattgctttactgg

SEQ ID NO: 3713421 - DNA, 15 bp, Homo sapiens
gctgtttatggcctc

SEQ ID NO: 3713422 - DNA, 17 bp, Homo sapiens
gctgtttatggcctcag

SEQ ID NO: 3713423 - DNA, 22 bp, Homo sapiens
gctgtttatggcctcagctgcc

SEQ ID NO: 3713424 - DNA, 15 bp, Homo sapiens
gcttaaaaatcattg

SEQ ID NO: 3713425 - DNA, 12 bp, Homo sapiens
gcttaatgaaaa

SEQ ID NO: 3713426 - DNA, 18 bp, Homo sapiens
gcttacatgagaacagac

SEQ ID NO: 3713427 - DNA, 14 bp, Homo sapiens
gcttacctcccacc

SEQ ID NO: 3713428 - DNA, 21 bp, Homo sapiens
gcttactacatgtgggagctt

SEQ ID NO: 3713429 - DNA, 14 bp, Homo sapiens
gcttactcattaaa

SEQ ID NO: 3713430 - DNA, 14 bp, Homo sapiens
gcttagacctcagc

SEQ ID NO: 3713431 - DNA, 16 bp, Homo sapiens
gcttagacctcagcct

SEQ ID NO: 3713432 - DNA, 12 bp, Homo sapiens
gcttatacactt

SEQ ID NO: 3713433 - DNA, 13 bp, Homo sapiens
gcttatctcaggg

SEQ ID NO: 3713434 - DNA, 16 bp, Homo sapiens
gcttatgaatatttat

SEQ ID NO: 3713435 - DNA, 22 bp, Homo sapiens
gcttatgacatcacttgtacaa

SEQ ID NO: 3713436 - DNA, 16 bp, Homo sapiens
gcttattaatgctaag

SEQ ID NO: 3713437 - DNA, 14 bp, Homo sapiens
gcttattgttccaa

SEQ ID NO: 3713438 - DNA, 20 bp, Homo sapiens
gcttattgttccaagacatt

SEQ ID NO: 3713439 - DNA, 14 bp, Homo sapiens
gcttatttaataaa

SEQ ID NO: 3713440 - DNA, 16 bp, Homo sapiens
gcttatttaataaaga

SEQ ID NO: 3713441 - DNA, 18 bp, Homo sapiens
gcttatttaattaaaaaa

SEQ ID NO: 3713442 - DNA, 15 bp, Homo sapiens
gcttcacggaagagc

SEQ ID NO: 3713443 - DNA, 18 bp, Homo sapiens
gcttcacggaagagcctt

SEQ ID NO: 3713444 - DNA, 19 bp, Homo sapiens
gcttcacggaagagccttg

SEQ ID NO: 3713445 - DNA, 12 bp, Homo sapiens
gcttcagcctcc

SEQ ID NO: 3713446 - DNA, 21 bp, Homo sapiens
gcttcagcctgaggctgagac

SEQ ID NO: 3713447 - DNA, 16 bp, Homo sapiens
gcttcagtggcagctg

SEQ ID NO: 3713448 - DNA, 17 bp, Homo sapiens
gcttcagtggcagctgc

SEQ ID NO: 3713449 - DNA, 19 bp, Homo sapiens
gcttcagtggcagctgctt

SEQ ID NO: 3713450 - DNA, 13 bp, Homo sapiens
gcttcatgccttt

SEQ ID NO: 3713451 - DNA, 16 bp, Homo sapiens
gcttcatgcctttgta

SEQ ID NO: 3713452 - DNA, 16 bp, Homo sapiens
gcttcatttcctgtgt

SEQ ID NO: 3713453 - DNA, 17 bp, Homo sapiens
gcttcatttcctgtgtc

SEQ ID NO: 3713454 - DNA, 14 bp, Homo sapiens
gcttccaggaaaaa

SEQ ID NO: 3713455 - DNA, 17 bp, Homo sapiens
gcttccatgagaacagc

SEQ ID NO: 3713456 - DNA, 18 bp, Homo sapiens
gcttcccccatagccacc

SEQ ID NO: 3713457 - DNA, 18 bp, Homo sapiens
gcttcccctctctcctcc

SEQ ID NO: 3713458 - DNA, 15 bp, Homo sapiens
gcttcccgctcagcc

SEQ ID NO: 3713459 - DNA, 22 bp, Homo sapiens
gcttcctcatagtatggtggct

SEQ ID NO: 3713460 - DNA, 18 bp, Homo sapiens
gcttctaccaactggaag

SEQ ID NO: 3713461 - DNA, 22 bp, Homo sapiens
gcttctcactgccatgccagct

SEQ ID NO: 3713462 - DNA, 22 bp, Homo sapiens
gcttctcatcctgcaggcagct

SEQ ID NO: 3713463 - DNA, 19 bp, Homo sapiens
gcttctctgtgaacgattt

SEQ ID NO: 3713464 - DNA, 22 bp, Homo sapiens
gcttctctgtgaacgatttaga

SEQ ID NO: 3713465 - DNA, 19 bp, Homo sapiens
gcttctctttaactcagga

SEQ ID NO: 3713466 - DNA, 14 bp, Homo sapiens
gcttctgcacctta

SEQ ID NO: 3713467 - DNA, 20 bp, Homo sapiens
ggaggttgcagtgagctgag

SEQ ID NO: 3713468 - DNA, 15 bp, Homo sapiens
ggagtatctgggaac

SEQ ID NO: 3713469 - DNA, 23 bp, Homo sapiens
ggagtcatctcaaccatcccctc

SEQ ID NO: 3713470 - DNA, 20 bp, Homo sapiens
ggagtcccaccttggctgca

SEQ ID NO: 3713471 - DNA, 22 bp, Homo sapiens
ggagtcccaccttggctgcagg

SEQ ID NO: 3713472 - DNA, 15 bp, Homo sapiens
ggagtcccgtcagga

SEQ ID NO: 3713473 - DNA, 14 bp, Homo sapiens
ggagtctgaagcag

SEQ ID NO: 3713474 - DNA, 11 bp, Homo sapiens
ggagtgacaga

SEQ ID NO: 3713475 - DNA, 17 bp, Homo sapiens
ggagtgacagaggcagc

SEQ ID NO: 3713476 - DNA, 14 bp, Homo sapiens
ggagtgagctggtt

SEQ ID NO: 3713477 - DNA, 14 bp, Homo sapiens
ggagtgcagtgagc

SEQ ID NO: 3713478 - DNA, 15 bp, Homo sapiens
ggagtgcagtgagcc

SEQ ID NO: 3713479 - DNA, 16 bp, Homo sapiens
ggagtgtgtattgttc

SEQ ID NO: 3713480 - DNA, 16 bp, Homo sapiens
ggagttagaggccagc

SEQ ID NO: 3713481 - DNA, 18 bp, Homo sapiens
ggagttcgagaccagcct

SEQ ID NO: 3713482 - DNA, 20 bp, Homo sapiens
ggagttcgagaccagcctgg

SEQ ID NO: 3713483 - DNA, 19 bp, Homo sapiens
ggagttggcattgcattta

SEQ ID NO: 3713484 - DNA, 14 bp, Homo sapiens
ggataaaatgaggt

SEQ ID NO: 3713485 - DNA, 21 bp, Homo sapiens
ggatacgcatcagacagatgg

SEQ ID NO: 3713486 - DNA, 20 bp, Homo sapiens
ggatagataactctttggat

SEQ ID NO: 3713487 - DNA, 15 bp, Homo sapiens
ggatagatgccctgc

SEQ ID NO: 3713488 - DNA, 18 bp, Homo sapiens
ggatagttgctccgcctc

SEQ ID NO: 3713489 - DNA, 21 bp, Homo sapiens
ggatattagtcatagaagaac

SEQ ID NO: 3713490 - DNA, 13 bp, Homo sapiens
ggatcacagggcc

SEQ ID NO: 3713491 - DNA, 17 bp, Homo sapiens
ggatcacagggccccag

SEQ ID NO: 3713492 - DNA, 13 bp, Homo sapiens
ggatcactggagc

SEQ ID NO: 3713493 - DNA, 22 bp, Homo sapiens
ggatcagaaagagttcagtaag

SEQ ID NO: 3713494 - DNA, 23 bp, Homo sapiens
ggatcggaggcttgtcagagctg

SEQ ID NO: 3713495 - DNA, 23 bp, Homo sapiens
ggatctctctagtgatggtcaga

SEQ ID NO: 3713496 - DNA, 23 bp, Homo sapiens
ggatctgttgtgtacgtggagag

SEQ ID NO: 3713497 - DNA, 14 bp, Homo sapiens
ggatgaatgaggtc

SEQ ID NO: 3713498 - DNA, 16 bp, Homo sapiens
ggatgacatgtcccta

SEQ ID NO: 3713499 - DNA, 22 bp, Homo sapiens
ggatgagaaaggttgaagcacc

SEQ ID NO: 3713500 - DNA, 13 bp, Homo sapiens
ggatgagcattta

SEQ ID NO: 3713501 - DNA, 15 bp, Homo sapiens
ggatgattgtacaga

SEQ ID NO: 3713502 - DNA, 19 bp, Homo sapiens
ggatgccatctgtgggcac

SEQ ID NO: 3713503 - DNA, 22 bp, Homo sapiens
ggatgcccagggccactctgcc

SEQ ID NO: 3713504 - DNA, 21 bp, Homo sapiens
ggatgctcctcccttctctac

SEQ ID NO: 3713505 - DNA, 19 bp, Homo sapiens
ggatggaggggtggtcctg

SEQ ID NO: 3713506 - DNA, 18 bp, Homo sapiens
ggatggatttccagccaa

SEQ ID NO: 3713507 - DNA, 15 bp, Homo sapiens
ggatgggaaggaggg

SEQ ID NO: 3713508 - DNA, 15 bp, Homo sapiens
ggatggggccacagc

SEQ ID NO: 3713509 - DNA, 18 bp, Homo sapiens
ggatgtaaacagtgcctg

SEQ ID NO: 3713510 - DNA, 20 bp, Homo sapiens
ggatgtaaacagtgcctgct

SEQ ID NO: 3713511 - DNA, 13 bp, Homo sapiens
ggatgtcaccaat

SEQ ID NO: 3713512 - DNA, 18 bp, Homo sapiens
ggatgtccacagatgcct

SEQ ID NO: 3713513 - DNA, 13 bp, Homo sapiens
ggattcaggctgc

SEQ ID NO: 3713514 - DNA, 14 bp, Homo sapiens
ggattcaggctgct

SEQ ID NO: 3713515 - DNA, 18 bp, Homo sapiens
ggattctcctttttaccc

SEQ ID NO: 3713516 - DNA, 19 bp, Homo sapiens
ggattctgggaggaagcag

SEQ ID NO: 3713517 - DNA, 21 bp, Homo sapiens
ggattcttcctccctccctct

SEQ ID NO: 3713518 - DNA, 13 bp, Homo sapiens
ggattgacagtaa

SEQ ID NO: 3713519 - DNA, 16 bp, Homo sapiens
ggattgacagtaactt

SEQ ID NO: 3713520 - DNA, 22 bp, Homo sapiens
ggattggccaaacatcagacct

SEQ ID NO: 3713521 - DNA, 15 bp, Homo sapiens
ggcaaaaaaattaaa

SEQ ID NO: 3713522 - DNA, 23 bp, Homo sapiens
ggcaaacaggcagttggccagag

SEQ ID NO: 3713523 - DNA, 19 bp, Homo sapiens
ggcaacagagcaagatcct

SEQ ID NO: 3713524 - DNA, 17 bp, Homo sapiens
ggcaacccccagcctgc

SEQ ID NO: 3713525 - DNA, 18 bp, Homo sapiens
ggcaacccccagcctgct

SEQ ID NO: 3713526 - DNA, 15 bp, Homo sapiens
ggcaacgaagaaaaa

SEQ ID NO: 3713527 - DNA, 14 bp, Homo sapiens
ggcaactgaacaaa

SEQ ID NO: 3713528 - DNA, 16 bp, Homo sapiens
ggcaactgaacaaaaa

SEQ ID NO: 3713529 - DNA, 14 bp, Homo sapiens
ggcaactgaggcag

SEQ ID NO: 3713530 - DNA, 18 bp, Homo sapiens
ggcaactgcattggcttt

SEQ ID NO: 3713531 - DNA, 19 bp, Homo sapiens
ggcaactgcattggctttg

SEQ ID NO: 3713532 - DNA, 18 bp, Homo sapiens
ggcaacttgggaactaga

SEQ ID NO: 3713533 - DNA, 17 bp, Homo sapiens
ggcaagacttttctttg

SEQ ID NO: 3713534 - DNA, 17 bp, Homo sapiens
ggcaagcacctcctgcc

SEQ ID NO: 3713535 - DNA, 18 bp, Homo sapiens
ggcaagcacctcctgcct

SEQ ID NO: 3713536 - DNA, 22 bp, Homo sapiens
ggcaagtccctgactctctgtg

SEQ ID NO: 3713537 - DNA, 21 bp, Homo sapiens
ggcaatataaccaatgtttaa

SEQ ID NO: 3713538 - DNA, 14 bp, Homo sapiens
ggcaatgctggctg

SEQ ID NO: 3713539 - DNA, 14 bp, Homo sapiens
ggcaattttgtaac

SEQ ID NO: 3713540 - DNA, 20 bp, Homo sapiens
ggcacagccggggcctgcct

SEQ ID NO: 3713541 - DNA, 14 bp, Homo sapiens
ggcacatggaggag

SEQ ID NO: 3713542 - DNA, 21 bp, Homo sapiens
ggcacatttccccagacctga

SEQ ID NO: 3713543 - DNA, 12 bp, Homo sapiens
ggcacatttttt

SEQ ID NO: 3713544 - DNA, 16 bp, Homo sapiens
ggcaccagcagcctgg

SEQ ID NO: 3713545 - DNA, 17 bp, Homo sapiens
ggcaccagcagcctgga

SEQ ID NO: 3713546 - DNA, 18 bp, Homo sapiens
ggcaccagccggggaaga

SEQ ID NO: 3713547 - DNA, 21 bp, Homo sapiens
ggcaccagtgtcctcccctca

SEQ ID NO: 3713548 - DNA, 23 bp, Homo sapiens
ggcacccaccatcatgtctggct

SEQ ID NO: 3713549 - DNA, 17 bp, Homo sapiens
ggcacccggcccctgct

SEQ ID NO: 3713550 - DNA, 19 bp, Homo sapiens
ggcacctatagtcccagct

SEQ ID NO: 3713551 - DNA, 23 bp, Homo sapiens
ggcacctcctacgtcaaacatga

SEQ ID NO: 3713552 - DNA, 17 bp, Homo sapiens
ggcacgaacccacctgc

SEQ ID NO: 3713553 - DNA, 15 bp, Homo sapiens
ggcacgggcccgtga

SEQ ID NO: 3713554 - DNA, 20 bp, Homo sapiens
ggcactcagaagacactgat

SEQ ID NO: 3713555 - DNA, 24 bp, Homo sapiens
ggcactgtactaggcgtgagaagc

SEQ ID NO: 3713556 - DNA, 17 bp, Homo sapiens
ggcagaaagcagaggct

SEQ ID NO: 3713557 - DNA, 18 bp, Homo sapiens
ggcagaaagcagaggctg

SEQ ID NO: 3713558 - DNA, 13 bp, Homo sapiens
ggcagaactgagc

SEQ ID NO: 3713559 - DNA, 22 bp, Homo sapiens
ggcagaagaattgaacccagga

SEQ ID NO: 3713560 - DNA, 23 bp, Homo sapiens
ggcagaagaattgaacccaggag

SEQ ID NO: 3713561 - DNA, 16 bp, Homo sapiens
ggcagaaggccaagag

SEQ ID NO: 3713562 - DNA, 20 bp, Homo sapiens
ggcagacagcagctcaggca

SEQ ID NO: 3713563 - DNA, 14 bp, Homo sapiens
ggcagagaatcata

SEQ ID NO: 3713564 - DNA, 12 bp, Homo sapiens
ggcagaggctgg

SEQ ID NO: 3713565 - DNA, 23 bp, Homo sapiens
ggcagaggctggaggcagggcct

SEQ ID NO: 3713566 - DNA, 16 bp, Homo sapiens
ggcagagggcagaggc

SEQ ID NO: 3713567 - DNA, 18 bp, Homo sapiens
ggcagaggttcatttcaa

SEQ ID NO: 3713568 - DNA, 21 bp, Homo sapiens
ggcagaggttgcagtgagccg

SEQ ID NO: 3713569 - DNA, 18 bp, Homo sapiens
ggcagatctgtgccccat

SEQ ID NO: 3713570 - DNA, 16 bp, Homo sapiens
ggcagccaaacccatg

SEQ ID NO: 3713571 - DNA, 15 bp, Homo sapiens
ggcagccaggctgcc

SEQ ID NO: 3713572 - DNA, 13 bp, Homo sapiens
ggcagccccagca

SEQ ID NO: 3713573 - DNA, 19 bp, Homo sapiens
ggcagccgtgccttcagct

SEQ ID NO: 3713574 - DNA, 14 bp, Homo sapiens
ggcagcctgcctgg

SEQ ID NO: 3713575 - DNA, 19 bp, Homo sapiens
ggcagcctgcgtggctgac

SEQ ID NO: 3713576 - DNA, 11 bp, Homo sapiens
ggcagcctgga

SEQ ID NO: 3713577 - DNA, 11 bp, Homo sapiens
ggcagctgcca

SEQ ID NO: 3713578 - DNA, 14 bp, Homo sapiens
ggcagctgccagag

SEQ ID NO: 3713579 - DNA, 15 bp, Homo sapiens
ggcagctgccagaga

SEQ ID NO: 3713580 - DNA, 22 bp, Homo sapiens
gggcaacagagcaagatcctgt

SEQ ID NO: 3713581 - DNA, 16 bp, Homo sapiens
gggcaacccccagcct

SEQ ID NO: 3713582 - DNA, 17 bp, Homo sapiens
gggcaacgaagaaaaaa

SEQ ID NO: 3713583 - DNA, 23 bp, Homo sapiens
gggcaacgaagaaaaaaaataac

SEQ ID NO: 3713584 - DNA, 21 bp, Homo sapiens
gggcaatataaccaatgttta

SEQ ID NO: 3713585 - DNA, 23 bp, Homo sapiens
gggcacaccgggcactcagaaga

SEQ ID NO: 3713586 - DNA, 18 bp, Homo sapiens
gggcacgctgtgggcagg

SEQ ID NO: 3713587 - DNA, 21 bp, Homo sapiens
gggcagaggctggaggcaggg

SEQ ID NO: 3713588 - DNA, 20 bp, Homo sapiens
gggcagagggcagaggctgg

SEQ ID NO: 3713589 - DNA, 17 bp, Homo sapiens
gggcagccaaacccatg

SEQ ID NO: 3713590 - DNA, 13 bp, Homo sapiens
gggcagccaggct

SEQ ID NO: 3713591 - DNA, 14 bp, Homo sapiens
gggcagccaggctg

SEQ ID NO: 3713592 - DNA, 20 bp, Homo sapiens
gggcagggaaggggaggcag

SEQ ID NO: 3713593 - DNA, 13 bp, Homo sapiens
gggcaggtgggag

SEQ ID NO: 3713594 - DNA, 15 bp, Homo sapiens
gggcagtctggaggg

SEQ ID NO: 3713595 - DNA, 17 bp, Homo sapiens
gggcagtctggaggggc

SEQ ID NO: 3713596 - DNA, 14 bp, Homo sapiens
gggcatctgcccct

SEQ ID NO: 3713597 - DNA, 19 bp, Homo sapiens
gggcatctgcccctccccc

SEQ ID NO: 3713598 - DNA, 22 bp, Homo sapiens
gggcatggacgttcggggcatg

SEQ ID NO: 3713599 - DNA, 16 bp, Homo sapiens
gggcatggccagcagc

SEQ ID NO: 3713600 - DNA, 16 bp, Homo sapiens
gggccaacaccaggga

SEQ ID NO: 3713601 - DNA, 19 bp, Homo sapiens
gggccacctccccaggccg

SEQ ID NO: 3713602 - DNA, 22 bp, Homo sapiens
gggccacctccccaggccgtgg

SEQ ID NO: 3713603 - DNA, 15 bp, Homo sapiens
gggccactctgcctc

SEQ ID NO: 3713604 - DNA, 13 bp, Homo sapiens
gggccagcccctc

SEQ ID NO: 3713605 - DNA, 16 bp, Homo sapiens
gggccaggacaggccc

SEQ ID NO: 3713606 - DNA, 17 bp, Homo sapiens
gggccaggacaggcccg

SEQ ID NO: 3713607 - DNA, 18 bp, Homo sapiens
gggccagggccctgcaga

SEQ ID NO: 3713608 - DNA, 15 bp, Homo sapiens
gggccagtcctgcct

SEQ ID NO: 3713609 - DNA, 19 bp, Homo sapiens
gggccagtcctgcctggcc

SEQ ID NO: 3713610 - DNA, 22 bp, Homo sapiens
gggccagtcctgcctggccagg

SEQ ID NO: 3713611 - DNA, 15 bp, Homo sapiens
gggccatgaactttg

SEQ ID NO: 3713612 - DNA, 18 bp, Homo sapiens
gggccatgagctccagac

SEQ ID NO: 3713613 - DNA, 15 bp, Homo sapiens
gggccccaccaccta

SEQ ID NO: 3713614 - DNA, 18 bp, Homo sapiens
gggcccctccctacctca

SEQ ID NO: 3713615 - DNA, 18 bp, Homo sapiens
gggcccctttttactccc

SEQ ID NO: 3713616 - DNA, 23 bp, Homo sapiens
gggcccgcctggcagaactgagc

SEQ ID NO: 3713617 - DNA, 13 bp, Homo sapiens
gggccctgagctc

SEQ ID NO: 3713618 - DNA, 16 bp, Homo sapiens
gggcctcaaggacttg

SEQ ID NO: 3713619 - DNA, 14 bp, Homo sapiens
gggcctcactccag

SEQ ID NO: 3713620 - DNA, 23 bp, Homo sapiens
gggcctcctctaacaggggctgg

SEQ ID NO: 3713621 - DNA, 17 bp, Homo sapiens
gggcctcggagcctcat

SEQ ID NO: 3713622 - DNA, 19 bp, Homo sapiens
gggcctggtccctgggagg

SEQ ID NO: 3713623 - DNA, 12 bp, Homo sapiens
gggcctgttgcc

SEQ ID NO: 3713624 - DNA, 15 bp, Homo sapiens
gggccttgcccagag

SEQ ID NO: 3713625 - DNA, 17 bp, Homo sapiens
gggccttgcccagagat

SEQ ID NO: 3713626 - DNA, 15 bp, Homo sapiens
gggcggcaggaggga

SEQ ID NO: 3713627 - DNA, 16 bp, Homo sapiens
gggcgtgactcaccca

SEQ ID NO: 3713628 - DNA, 22 bp, Homo sapiens
gggctcagcaaaagatgcttct

SEQ ID NO: 3713629 - DNA, 12 bp, Homo sapiens
gggctcagcctg

SEQ ID NO: 3713630 - DNA, 16 bp, Homo sapiens
gggctcagcctggtgg

SEQ ID NO: 3713631 - DNA, 19 bp, Homo sapiens
gggctcagcggggacagct

SEQ ID NO: 3713632 - DNA, 11 bp, Homo sapiens
gggctcctgga

SEQ ID NO: 3713633 - DNA, 21 bp, Homo sapiens
gggctctgccctccctccttc

SEQ ID NO: 3713634 - DNA, 20 bp, Homo sapiens
gggctgactagaagggccag

SEQ ID NO: 3713635 - DNA, 10 bp, Homo sapiens
gggctgagac

SEQ ID NO: 3713636 - DNA, 17 bp, Homo sapiens
gggctgagccctggcag

SEQ ID NO: 3713637 - DNA, 12 bp, Homo sapiens
gggctgaggggc

SEQ ID NO: 3713638 - DNA, 18 bp, Homo sapiens
gggctgccatgtgaagag

SEQ ID NO: 3713639 - DNA, 21 bp, Homo sapiens
gggctgccctggtgctgccac

SEQ ID NO: 3713640 - DNA, 16 bp, Homo sapiens
gggctgctcctccagg

SEQ ID NO: 3713641 - DNA, 18 bp, Homo sapiens
gggctgctcctccagggc

SEQ ID NO: 3713642 - DNA, 19 bp, Homo sapiens
gggctgctcctccagggcc

SEQ ID NO: 3713643 - DNA, 16 bp, Homo sapiens
gggctggactggctgt

SEQ ID NO: 3713644 - DNA, 18 bp, Homo sapiens
gggctgggagctctgcag

SEQ ID NO: 3713645 - DNA, 14 bp, Homo sapiens
gggctgggcagctg

SEQ ID NO: 3713646 - DNA, 11 bp, Homo sapiens
gggctgggtgt

SEQ ID NO: 3713647 - DNA, 21 bp, Homo sapiens
gggctggtgacccagtcagag

SEQ ID NO: 3713648 - DNA, 12 bp, Homo sapiens
gggctgtgatcg

SEQ ID NO: 3713649 - DNA, 16 bp, Homo sapiens
gggcttcagtggcagc

SEQ ID NO: 3713650 - DNA, 17 bp, Homo sapiens
gggcttcagtggcagct

SEQ ID NO: 3713651 - DNA, 15 bp, Homo sapiens
gggctttctggagag

SEQ ID NO: 3713652 - DNA, 24 bp, Homo sapiens
ggggaaaatcagcctgctccagct

SEQ ID NO: 3713653 - DNA, 13 bp, Homo sapiens
ggggaactcctgg

SEQ ID NO: 3713654 - DNA, 22 bp, Homo sapiens
ggggaagcccattcctctgcca

SEQ ID NO: 3713655 - DNA, 22 bp, Homo sapiens
ggggaatgtttgcctctgcctc

SEQ ID NO: 3713656 - DNA, 14 bp, Homo sapiens
ggggacagctcctt

SEQ ID NO: 3713657 - DNA, 15 bp, Homo sapiens
ggggactcagccctg

SEQ ID NO: 3713658 - DNA, 16 bp, Homo sapiens
ggggactcagccctga

SEQ ID NO: 3713659 - DNA, 14 bp, Homo sapiens
ggggactgtctttc

SEQ ID NO: 3713660 - DNA, 16 bp, Homo sapiens
ggggaggacctctggg

SEQ ID NO: 3713661 - DNA, 20 bp, Homo sapiens
ggggagtgggacagagtctg

SEQ ID NO: 3713662 - DNA, 17 bp, Homo sapiens
ggggatcacagcctctg

SEQ ID NO: 3713663 - DNA, 13 bp, Homo sapiens
ggggatgcttcat

SEQ ID NO: 3713664 - DNA, 14 bp, Homo sapiens
ggggatttctccca

SEQ ID NO: 3713665 - DNA, 22 bp, Homo sapiens
ggggcagagggcagaggctgga

SEQ ID NO: 3713666 - DNA, 17 bp, Homo sapiens
ggggcagcctgcgtggc

SEQ ID NO: 3713667 - DNA, 16 bp, Homo sapiens
ggggcaggagctcaga

SEQ ID NO: 3713668 - DNA, 14 bp, Homo sapiens
ggggcagtcacctg

SEQ ID NO: 3713669 - DNA, 13 bp, Homo sapiens
ggggcagtggcaa

SEQ ID NO: 3713670 - DNA, 14 bp, Homo sapiens
ggggcatctgcccc

SEQ ID NO: 3713671 - DNA, 20 bp, Homo sapiens
ggggccacagccagaacccc

SEQ ID NO: 3713672 - DNA, 22 bp, Homo sapiens
ggggccatgagctccagacccc

SEQ ID NO: 3713673 - DNA, 10 bp, Homo sapiens
ggggcccctt

SEQ ID NO: 3713674 - DNA, 22 bp, Homo sapiens
ggggcccctttttactcccctt

SEQ ID NO: 3713675 - DNA, 23 bp, Homo sapiens
ggggcccgcctggcagaactgag

SEQ ID NO: 3713676 - DNA, 12 bp, Homo sapiens
ggggcctggcag

SEQ ID NO: 3713677 - DNA, 12 bp, Homo sapiens
ggggctcctgga

SEQ ID NO: 3713678 - DNA, 21 bp, Homo sapiens
ggggctcctggaaaggctcag

SEQ ID NO: 3713679 - DNA, 12 bp, Homo sapiens
ggggctctggga

SEQ ID NO: 3713680 - DNA, 17 bp, Homo sapiens
ggggctgaggtgggagg

SEQ ID NO: 3713681 - DNA, 19 bp, Homo sapiens
ggggctgaggtgggaggat

SEQ ID NO: 3713682 - DNA, 14 bp, Homo sapiens
ggggctgctcctcc

SEQ ID NO: 3713683 - DNA, 20 bp, Homo sapiens
ggggctgctcctccagggcc

SEQ ID NO: 3713684 - DNA, 15 bp, Homo sapiens
ggggctttctggaga

SEQ ID NO: 3713685 - DNA, 17 bp, Homo sapiens
gggggagtctgaagcag

SEQ ID NO: 3713686 - DNA, 22 bp, Homo sapiens
gggggagtctgaagcagatgca

SEQ ID NO: 3713687 - DNA, 17 bp, Homo sapiens
gggggatcacagcctct

SEQ ID NO: 3713688 - DNA, 13 bp, Homo sapiens
gggggcagagggc

SEQ ID NO: 3713689 - DNA, 15 bp, Homo sapiens
gggggccatgagctc

SEQ ID NO: 3713690 - DNA, 17 bp, Homo sapiens
gggggcctcagggcagc

SEQ ID NO: 3713691 - DNA, 18 bp, Homo sapiens
gggggcctgacctccccc

SEQ ID NO: 3713692 - DNA, 22 bp, Homo sapiens
ggggtccttcaagttagctcag

SEQ ID NO: 3713693 - DNA, 15 bp, Homo sapiens
ggggtgcagcagtga

SEQ ID NO: 3713694 - DNA, 22 bp, Homo sapiens
gtatcctcatttggggtagcta

SEQ ID NO: 3713695 - DNA, 14 bp, Homo sapiens
gtatcggagacagt

SEQ ID NO: 3713696 - DNA, 15 bp, Homo sapiens
gtatcggagacagtg

SEQ ID NO: 3713697 - DNA, 11 bp, Homo sapiens
gtatcgggggc

SEQ ID NO: 3713698 - DNA, 23 bp, Homo sapiens
gtatcttgtttttccactactgc

SEQ ID NO: 3713699 - DNA, 18 bp, Homo sapiens
gtatgaataaagacacct

SEQ ID NO: 3713700 - DNA, 14 bp, Homo sapiens
gtatgactaaagag

SEQ ID NO: 3713701 - DNA, 21 bp, Homo sapiens
gtatgatcacggctcactgca

SEQ ID NO: 3713702 - DNA, 17 bp, Homo sapiens
gtatggaatacagtgtt

SEQ ID NO: 3713703 - DNA, 13 bp, Homo sapiens
gtatggtggctgg

SEQ ID NO: 3713704 - DNA, 14 bp, Homo sapiens
gtatggtggctggg

SEQ ID NO: 3713705 - DNA, 15 bp, Homo sapiens
gtatggtggctgggt

SEQ ID NO: 3713706 - DNA, 16 bp, Homo sapiens
gtatggttttgtggat

SEQ ID NO: 3713707 - DNA, 11 bp, Homo sapiens
gtatgtgccat

SEQ ID NO: 3713708 - DNA, 14 bp, Homo sapiens
gtatgtgtgtatgg

SEQ ID NO: 3713709 - DNA, 17 bp, Homo sapiens
gtatgtttacactgtca

SEQ ID NO: 3713710 - DNA, 23 bp, Homo sapiens
gtatgtttttgtgtatttgttaa

SEQ ID NO: 3713711 - DNA, 22 bp, Homo sapiens
gtatgttttttattatgctgta

SEQ ID NO: 3713712 - DNA, 19 bp, Homo sapiens
gtattaaaggggggagggg

SEQ ID NO: 3713713 - DNA, 15 bp, Homo sapiens
gtattacataaataa

SEQ ID NO: 3713714 - DNA, 13 bp, Homo sapiens
gtattacttctgc

SEQ ID NO: 3713715 - DNA, 14 bp, Homo sapiens
gtattacttctgct

SEQ ID NO: 3713716 - DNA, 19 bp, Homo sapiens
gtattataggccaaactgg

SEQ ID NO: 3713717 - DNA, 17 bp, Homo sapiens
gtattcaagaaagccag

SEQ ID NO: 3713718 - DNA, 15 bp, Homo sapiens
gtattccaccttaaa

SEQ ID NO: 3713719 - DNA, 15 bp, Homo sapiens
gtattccagtttgtt

SEQ ID NO: 3713720 - DNA, 22 bp, Homo sapiens
gtattcgtgcagcatatgagga

SEQ ID NO: 3713721 - DNA, 21 bp, Homo sapiens
gtattctgcctttgcagaaac

SEQ ID NO: 3713722 - DNA, 15 bp, Homo sapiens
gtattcttatttaat

SEQ ID NO: 3713723 - DNA, 17 bp, Homo sapiens
gtatttaattgtaaact

SEQ ID NO: 3713724 - DNA, 21 bp, Homo sapiens
gtatttaattgtaaactgtac

SEQ ID NO: 3713725 - DNA, 13 bp, Homo sapiens
gtatttataaata

SEQ ID NO: 3713726 - DNA, 13 bp, Homo sapiens
gtatttatatatt

SEQ ID NO: 3713727 - DNA, 13 bp, Homo sapiens
gtatttatcttta

SEQ ID NO: 3713728 - DNA, 15 bp, Homo sapiens
gtatttgagacattc

SEQ ID NO: 3713729 - DNA, 15 bp, Homo sapiens
gtattttagtatatt

SEQ ID NO: 3713730 - DNA, 17 bp, Homo sapiens
gtcaaacaaagccagaa

SEQ ID NO: 3713731 - DNA, 20 bp, Homo sapiens
gtcaaactgtagaaatgatg

SEQ ID NO: 3713732 - DNA, 22 bp, Homo sapiens
gtcaacacttaagggttttaga

SEQ ID NO: 3713733 - DNA, 20 bp, Homo sapiens
gtcaacttgagcatgttact

SEQ ID NO: 3713734 - DNA, 13 bp, Homo sapiens
gtcaactttatgc

SEQ ID NO: 3713735 - DNA, 12 bp, Homo sapiens
gtcaaggcctgt

SEQ ID NO: 3713736 - DNA, 21 bp, Homo sapiens
gtcaaggcctgtccctggcca

SEQ ID NO: 3713737 - DNA, 13 bp, Homo sapiens
gtcaataaacagc

SEQ ID NO: 3713738 - DNA, 20 bp, Homo sapiens
gtcaataaacagcttcatgc

SEQ ID NO: 3713739 - DNA, 19 bp, Homo sapiens
gtcaatcctgtgggtgaag

SEQ ID NO: 3713740 - DNA, 15 bp, Homo sapiens
gtcacaacctctctg

SEQ ID NO: 3713741 - DNA, 17 bp, Homo sapiens
gtcacaagagcccagca

SEQ ID NO: 3713742 - DNA, 16 bp, Homo sapiens
gtcacacactttggct

SEQ ID NO: 3713743 - DNA, 17 bp, Homo sapiens
gtcacaggactctgcct

SEQ ID NO: 3713744 - DNA, 12 bp, Homo sapiens
gtcacaggcagg

SEQ ID NO: 3713745 - DNA, 15 bp, Homo sapiens
gtcacaggcaggtcc

SEQ ID NO: 3713746 - DNA, 16 bp, Homo sapiens
gtcacaggcaggtcca

SEQ ID NO: 3713747 - DNA, 15 bp, Homo sapiens
gtcacatcacaggac

SEQ ID NO: 3713748 - DNA, 13 bp, Homo sapiens
gtcaccacctctc

SEQ ID NO: 3713749 - DNA, 14 bp, Homo sapiens
gtcaccaccttccc

SEQ ID NO: 3713750 - DNA, 15 bp, Homo sapiens
gtcaccaccttccca

SEQ ID NO: 3713751 - DNA, 16 bp, Homo sapiens
gtcaccaccttcccag

SEQ ID NO: 3713752 - DNA, 16 bp, Homo sapiens
gtcaccatctcaggcc

SEQ ID NO: 3713753 - DNA, 17 bp, Homo sapiens
gtcaccatctcaggcca

SEQ ID NO: 3713754 - DNA, 17 bp, Homo sapiens
gtcaccggatcctgggt

SEQ ID NO: 3713755 - DNA, 20 bp, Homo sapiens
gtcacctgaagactcattct

SEQ ID NO: 3713756 - DNA, 16 bp, Homo sapiens
gtcacgcagccaccag

SEQ ID NO: 3713757 - DNA, 23 bp, Homo sapiens
gtcactcagatggaaccgcagga

SEQ ID NO: 3713758 - DNA, 13 bp, Homo sapiens
gtcactcctgggg

SEQ ID NO: 3713759 - DNA, 21 bp, Homo sapiens
gtcactcctggggcctcttgg

SEQ ID NO: 3713760 - DNA, 16 bp, Homo sapiens
gtcactgacacacacg

SEQ ID NO: 3713761 - DNA, 16 bp, Homo sapiens
gtcactgccatggagg

SEQ ID NO: 3713762 - DNA, 12 bp, Homo sapiens
gtcactgcctct

SEQ ID NO: 3713763 - DNA, 22 bp, Homo sapiens
gtcactgcctctccctggccct

SEQ ID NO: 3713764 - DNA, 19 bp, Homo sapiens
gtcactggaccactgggca

SEQ ID NO: 3713765 - DNA, 20 bp, Homo sapiens
gtcagacacaaacaaacaag

SEQ ID NO: 3713766 - DNA, 20 bp, Homo sapiens
gtcagactgctgggactggc

SEQ ID NO: 3713767 - DNA, 14 bp, Homo sapiens
gtcagactggctgg

SEQ ID NO: 3713768 - DNA, 16 bp, Homo sapiens
gtcagactttaaagaa

SEQ ID NO: 3713769 - DNA, 17 bp, Homo sapiens
gtcagagaggagtcaga

SEQ ID NO: 3713770 - DNA, 14 bp, Homo sapiens
gtcagagcctgcag

SEQ ID NO: 3713771 - DNA, 15 bp, Homo sapiens
gtcagagcctgcagt

SEQ ID NO: 3713772 - DNA, 12 bp, Homo sapiens
gtcagagctggg

SEQ ID NO: 3713773 - DNA, 12 bp, Homo sapiens
gtcagattcctt

SEQ ID NO: 3713774 - DNA, 13 bp, Homo sapiens
gtcagattccttt

SEQ ID NO: 3713775 - DNA, 14 bp, Homo sapiens
gtcagattcctttc

SEQ ID NO: 3713776 - DNA, 15 bp, Homo sapiens
gtcagccaaatgtaa

SEQ ID NO: 3713777 - DNA, 13 bp, Homo sapiens
gtcagccacatgg

SEQ ID NO: 3713778 - DNA, 16 bp, Homo sapiens
gtcagctttgccttcc

SEQ ID NO: 3713779 - DNA, 23 bp, Homo sapiens
gtcagctttgccttccacgctgt

SEQ ID NO: 3713780 - DNA, 18 bp, Homo sapiens
gtcaggaaggatgagcat

SEQ ID NO: 3713781 - DNA, 22 bp, Homo sapiens
gtcaggagttagaggccagcct

SEQ ID NO: 3713782 - DNA, 23 bp, Homo sapiens
gtcaggagttagaggccagcctg

SEQ ID NO: 3713783 - DNA, 21 bp, Homo sapiens
gtcaggagttgtttctgaccc

SEQ ID NO: 3713784 - DNA, 14 bp, Homo sapiens
gtcaggccacggca

SEQ ID NO: 3713785 - DNA, 15 bp, Homo sapiens
gtcaggccacggcag

SEQ ID NO: 3713786 - DNA, 18 bp, Homo sapiens
gtcaggccacggcagcct

SEQ ID NO: 3713787 - DNA, 22 bp, Homo sapiens
gtcaggcccttattttcaagaa

SEQ ID NO: 3713788 - DNA, 14 bp, Homo sapiens
gtcagggacccctg

SEQ ID NO: 3713789 - DNA, 18 bp, Homo sapiens
gtcagggacccctgccct

SEQ ID NO: 3713790 - DNA, 16 bp, Homo sapiens
gtcaggtggggcagct

SEQ ID NO: 3713791 - DNA, 19 bp, Homo sapiens
gtcaggttatactcctcct

SEQ ID NO: 3713792 - DNA, 19 bp, Homo sapiens
gtcagtacccacctgagct

SEQ ID NO: 3713793 - DNA, 23 bp, Homo sapiens
gtcagtatcaggcctgccagacg

SEQ ID NO: 3713794 - DNA, 20 bp, Homo sapiens
gtcagtctgcttatccttcc

SEQ ID NO: 3713795 - DNA, 23 bp, Homo sapiens
gtcagtgcagcccgtgtggcccc

SEQ ID NO: 3713796 - DNA, 15 bp, Homo sapiens
gtcagtggctctttt

SEQ ID NO: 3713797 - DNA, 22 bp, Homo sapiens
gtcagtgggaacgtgactgccc

SEQ ID NO: 3713798 - DNA, 16 bp, Homo sapiens
gtcataccaactttag

SEQ ID NO: 3713799 - DNA, 13 bp, Homo sapiens
gtcatagaagaac

SEQ ID NO: 3713800 - DNA, 16 bp, Homo sapiens
gtcatctcagctggat

SEQ ID NO: 3713801 - DNA, 17 bp, Homo sapiens
gtcatctccatcagctg

SEQ ID NO: 3713802 - DNA, 16 bp, Homo sapiens
gtcatctggtagattt

SEQ ID NO: 3713803 - DNA, 18 bp, Homo sapiens
gtcatcttgaccaagcag

SEQ ID NO: 3713804 - DNA, 18 bp, Homo sapiens
gtcatctttttctctaaa

SEQ ID NO: 3713805 - DNA, 22 bp, Homo sapiens
gtcatctttttctctaaaatag

SEQ ID NO: 3713806 - DNA, 16 bp, Homo sapiens
gtcatgagctgagcag

SEQ ID NO: 3713807 - DNA, 21 bp, Homo sapiens
gtcatttgagcagggctcagc

SEQ ID NO: 3713808 - DNA, 14 bp, Homo sapiens
gtggatagatgccc

SEQ ID NO: 3713809 - DNA, 16 bp, Homo sapiens
gtggatcacagaggct

SEQ ID NO: 3713810 - DNA, 15 bp, Homo sapiens
gtggatcacctgagg

SEQ ID NO: 3713811 - DNA, 16 bp, Homo sapiens
gtggatgcctggtggc

SEQ ID NO: 3713812 - DNA, 14 bp, Homo sapiens
gtggcaccagcagc

SEQ ID NO: 3713813 - DNA, 20 bp, Homo sapiens
gtggcagataatcagcctct

SEQ ID NO: 3713814 - DNA, 12 bp, Homo sapiens
gtggcagccctg

SEQ ID NO: 3713815 - DNA, 14 bp, Homo sapiens
gtggcagctgcggt

SEQ ID NO: 3713816 - DNA, 19 bp, Homo sapiens
gtggcagctgcggtccacc

SEQ ID NO: 3713817 - DNA, 21 bp, Homo sapiens
gtggcaggtgaccttctggga

SEQ ID NO: 3713818 - DNA, 17 bp, Homo sapiens
gtggcagtaaagagaaa

SEQ ID NO: 3713819 - DNA, 22 bp, Homo sapiens
gtggcagtgcagcaaccagagc

SEQ ID NO: 3713820 - DNA, 15 bp, Homo sapiens
gtggcagtgggagct

SEQ ID NO: 3713821 - DNA, 14 bp, Homo sapiens
gtggcatcacctta

SEQ ID NO: 3713822 - DNA, 22 bp, Homo sapiens
gtggcatcaccttaggcaggga

SEQ ID NO: 3713823 - DNA, 18 bp, Homo sapiens
gtggcatctttgccttgg

SEQ ID NO: 3713824 - DNA, 21 bp, Homo sapiens
gtggcatctttgccttgggct

SEQ ID NO: 3713825 - DNA, 18 bp, Homo sapiens
gtggccagaccagagctc

SEQ ID NO: 3713826 - DNA, 20 bp, Homo sapiens
gtggcctcaaccctccctca

SEQ ID NO: 3713827 - DNA, 20 bp, Homo sapiens
gtggcctggccaggagctct

SEQ ID NO: 3713828 - DNA, 15 bp, Homo sapiens
gtggccttccccagc

SEQ ID NO: 3713829 - DNA, 20 bp, Homo sapiens
gtggccttccccagcctctt

SEQ ID NO: 3713830 - DNA, 14 bp, Homo sapiens
gtggcggtgcctgg

SEQ ID NO: 3713831 - DNA, 21 bp, Homo sapiens
gtggctaaaggtcccaaggca

SEQ ID NO: 3713832 - DNA, 23 bp, Homo sapiens
gtggctaaaggtcccaaggcaag

SEQ ID NO: 3713833 - DNA, 17 bp, Homo sapiens
gtggctagtcagagaga

SEQ ID NO: 3713834 - DNA, 20 bp, Homo sapiens
gtggctcctcccggtgccca

SEQ ID NO: 3713835 - DNA, 17 bp, Homo sapiens
gtggctgacccagtccc

SEQ ID NO: 3713836 - DNA, 15 bp, Homo sapiens
gtggctgcctggagc

SEQ ID NO: 3713837 - DNA, 11 bp, Homo sapiens
gtggctggggg

SEQ ID NO: 3713838 - DNA, 22 bp, Homo sapiens
gtggctgggggcaggagggccc

SEQ ID NO: 3713839 - DNA, 18 bp, Homo sapiens
gtggcttcccgctcagcc

SEQ ID NO: 3713840 - DNA, 19 bp, Homo sapiens
gtggcttcccgctcagccc

SEQ ID NO: 3713841 - DNA, 15 bp, Homo sapiens
gtgggaaggacttgg

SEQ ID NO: 3713842 - DNA, 13 bp, Homo sapiens
gtgggaagggaga

SEQ ID NO: 3713843 - DNA, 12 bp, Homo sapiens
gtgggagctgag

SEQ ID NO: 3713844 - DNA, 15 bp, Homo sapiens
gtgggagctgcctgt

SEQ ID NO: 3713845 - DNA, 17 bp, Homo sapiens
gtgggatatccctatgc

SEQ ID NO: 3713846 - DNA, 14 bp, Homo sapiens
gtgggatggaggag

SEQ ID NO: 3713847 - DNA, 17 bp, Homo sapiens
gtgggcaccaagagcca

SEQ ID NO: 3713848 - DNA, 20 bp, Homo sapiens
gtgggcaggtgggagcttga

SEQ ID NO: 3713849 - DNA, 19 bp, Homo sapiens
gtgggccagcccctcccac

SEQ ID NO: 3713850 - DNA, 17 bp, Homo sapiens
gtgggcctgtcgtgcca

SEQ ID NO: 3713851 - DNA, 16 bp, Homo sapiens
gtgggcggcagagagg

SEQ ID NO: 3713852 - DNA, 15 bp, Homo sapiens
gtgggctagttgggc

SEQ ID NO: 3713853 - DNA, 16 bp, Homo sapiens
gtgggctgagccctgg

SEQ ID NO: 3713854 - DNA, 22 bp, Homo sapiens
gtgggctggtgacccagtcaga

SEQ ID NO: 3713855 - DNA, 14 bp, Homo sapiens
gtgggctgtgagtg

SEQ ID NO: 3713856 - DNA, 18 bp, Homo sapiens
gtggggagacacctcaga

SEQ ID NO: 3713857 - DNA, 19 bp, Homo sapiens
gtggggagacacctcagag

SEQ ID NO: 3713858 - DNA, 20 bp, Homo sapiens
gtggggagacacctcagagc

SEQ ID NO: 3713859 - DNA, 22 bp, Homo sapiens
gtggggagacacctcagagccc

SEQ ID NO: 3713860 - DNA, 16 bp, Homo sapiens
gtggggctgctcctcc

SEQ ID NO: 3713861 - DNA, 20 bp, Homo sapiens
gtgggggatcacagcctctg

SEQ ID NO: 3713862 - DNA, 18 bp, Homo sapiens
gtgggggcagagggcaga

SEQ ID NO: 3713863 - DNA, 14 bp, Homo sapiens
gtggggtctccctc

SEQ ID NO: 3713864 - DNA, 17 bp, Homo sapiens
gtggggtctccctctcc

SEQ ID NO: 3713865 - DNA, 19 bp, Homo sapiens
gtggggtctccctctcctg

SEQ ID NO: 3713866 - DNA, 22 bp, Homo sapiens
gtgggtaagactaaatctgtaa

SEQ ID NO: 3713867 - DNA, 14 bp, Homo sapiens
gtgggtcaaggaat

SEQ ID NO: 3713868 - DNA, 18 bp, Homo sapiens
gtgggtgaaagaaatcat

SEQ ID NO: 3713869 - DNA, 21 bp, Homo sapiens
gtgggtgaaagaaatcatgtt

SEQ ID NO: 3713870 - DNA, 24 bp, Homo sapiens
gtggtctgaatgttctgacattaa

SEQ ID NO: 3713871 - DNA, 16 bp, Homo sapiens
gtggtctgcaggcagg

SEQ ID NO: 3713872 - DNA, 17 bp, Homo sapiens
gtggtgacctctgcctg

SEQ ID NO: 3713873 - DNA, 19 bp, Homo sapiens
gtggtgcgatctgggttca

SEQ ID NO: 3713874 - DNA, 18 bp, Homo sapiens
gtggtgggacagggaccc

SEQ ID NO: 3713875 - DNA, 20 bp, Homo sapiens
gtggttacagtgcagacagg

SEQ ID NO: 3713876 - DNA, 21 bp, Homo sapiens
gtggttacagtgcagacaggc

SEQ ID NO: 3713877 - DNA, 19 bp, Homo sapiens
gtggttctacaatctattt

SEQ ID NO: 3713878 - DNA, 19 bp, Homo sapiens
gtggtttagtgtaaaaatg

SEQ ID NO: 3713879 - DNA, 20 bp, Homo sapiens
gtggtttagtgtaaaaatga

SEQ ID NO: 3713880 - DNA, 23 bp, Homo sapiens
gtggtttccaaggagctgagaat

SEQ ID NO: 3713881 - DNA, 19 bp, Homo sapiens
gtggttttcttttgccatg

SEQ ID NO: 3713882 - DNA, 15 bp, Homo sapiens
gtgtaaaaatgagaa

SEQ ID NO: 3713883 - DNA, 16 bp, Homo sapiens
gtgtaaaaatgagaac

SEQ ID NO: 3713884 - DNA, 12 bp, Homo sapiens
gtgtaacagctg

SEQ ID NO: 3713885 - DNA, 21 bp, Homo sapiens
gtgtaacagctgaggtctctt

SEQ ID NO: 3713886 - DNA, 15 bp, Homo sapiens
gtgtaacatatgcaa

SEQ ID NO: 3713887 - DNA, 21 bp, Homo sapiens
gtgtaacctgagatggccctc

SEQ ID NO: 3713888 - DNA, 13 bp, Homo sapiens
gtgtaataaagtg

SEQ ID NO: 3713889 - DNA, 19 bp, Homo sapiens
gtgtaatcatttcttgggc

SEQ ID NO: 3713890 - DNA, 23 bp, Homo sapiens
gtgtaatcatttcttgggccctc

SEQ ID NO: 3713891 - DNA, 16 bp, Homo sapiens
gtgtacgtggagaggg

SEQ ID NO: 3713892 - DNA, 18 bp, Homo sapiens
gtgtactctggcctctgt

SEQ ID NO: 3713893 - DNA, 17 bp, Homo sapiens
gtgtagatttgttttgt

SEQ ID NO: 3713894 - DNA, 20 bp, Homo sapiens
gtgtagccccaagaaggctg

SEQ ID NO: 3713895 - DNA, 16 bp, Homo sapiens
gtgtagccttgcccgg

SEQ ID NO: 3713896 - DNA, 16 bp, Homo sapiens
gtgtatgggtgtgtgt

SEQ ID NO: 3713897 - DNA, 17 bp, Homo sapiens
gtgtatgtacatatata

SEQ ID NO: 3713898 - DNA, 16 bp, Homo sapiens
gtgtatgtgcgtgtgt

SEQ ID NO: 3713899 - DNA, 18 bp, Homo sapiens
gtgtatgtttgcacactt

SEQ ID NO: 3713900 - DNA, 20 bp, Homo sapiens
gtgtatttaattgtaaactg

SEQ ID NO: 3713901 - DNA, 19 bp, Homo sapiens
gtgtatttccagtgcaatt

SEQ ID NO: 3713902 - DNA, 18 bp, Homo sapiens
gtgtattttataaaatta

SEQ ID NO: 3713903 - DNA, 20 bp, Homo sapiens
gtgtattttataaaattaaa

SEQ ID NO: 3713904 - DNA, 20 bp, Homo sapiens
gtgtcaagagggtctgagga

SEQ ID NO: 3713905 - DNA, 23 bp, Homo sapiens
gtgtcactactcacagtctcttt

SEQ ID NO: 3713906 - DNA, 16 bp, Homo sapiens
gtgtcagcatagaagt

SEQ ID NO: 3713907 - DNA, 18 bp, Homo sapiens
gtgtcaggtggggcagct

SEQ ID NO: 3713908 - DNA, 18 bp, Homo sapiens
gtgtcataccaggccgcc

SEQ ID NO: 3713909 - DNA, 17 bp, Homo sapiens
gtgtccaagtgtgtgtg

SEQ ID NO: 3713910 - DNA, 14 bp, Homo sapiens
gtgtccatgtgtgt

SEQ ID NO: 3713911 - DNA, 16 bp, Homo sapiens
gtgtccatgtgtgtgc

SEQ ID NO: 3713912 - DNA, 20 bp, Homo sapiens
gtgtcccaaaaagaaaggag

SEQ ID NO: 3713913 - DNA, 15 bp, Homo sapiens
gtgtccccagcccac

SEQ ID NO: 3713914 - DNA, 22 bp, Homo sapiens
gtgtccccagcccactggatca

SEQ ID NO: 3713915 - DNA, 16 bp, Homo sapiens
gtgtccctctctctgg

SEQ ID NO: 3713916 - DNA, 18 bp, Homo sapiens
gtgtccctctctctggaa

SEQ ID NO: 3713917 - DNA, 14 bp, Homo sapiens
gtgtctaaaaacac

SEQ ID NO: 3713918 - DNA, 17 bp, Homo sapiens
gtgtctaaaaacaccaa

SEQ ID NO: 3713919 - DNA, 21 bp, Homo sapiens
gtgtctcggagggattcccct

SEQ ID NO: 3713920 - DNA, 14 bp, Homo sapiens
gttgtgtaagagaa

SEQ ID NO: 3713921 - DNA, 20 bp, Homo sapiens
gttgtgtactctggcctctg

SEQ ID NO: 3713922 - DNA, 12 bp, Homo sapiens
gttgtttcttcc

SEQ ID NO: 3713923 - DNA, 20 bp, Homo sapiens
gtttaaaaaagtttaaaatg

SEQ ID NO: 3713924 - DNA, 22 bp, Homo sapiens
gtttaaaaaagtttaaaatgta

SEQ ID NO: 3713925 - DNA, 23 bp, Homo sapiens
gtttaaaaaagtttaaaatgtat

SEQ ID NO: 3713926 - DNA, 19 bp, Homo sapiens
gtttaaaagacacacttgt

SEQ ID NO: 3713927 - DNA, 13 bp, Homo sapiens
gtttaacataaag

SEQ ID NO: 3713928 - DNA, 15 bp, Homo sapiens
gtttaacataaaggt

SEQ ID NO: 3713929 - DNA, 17 bp, Homo sapiens
gtttaagaccagcctgg

SEQ ID NO: 3713930 - DNA, 12 bp, Homo sapiens
gtttaagattta

SEQ ID NO: 3713931 - DNA, 21 bp, Homo sapiens
gtttaagtgactgatggctaa

SEQ ID NO: 3713932 - DNA, 15 bp, Homo sapiens
gtttaatattgagaa

SEQ ID NO: 3713933 - DNA, 18 bp, Homo sapiens
gtttacactgtcaaacat

SEQ ID NO: 3713934 - DNA, 17 bp, Homo sapiens
gtttaccatttgtaata

SEQ ID NO: 3713935 - DNA, 15 bp, Homo sapiens
gtttatacagtacag

SEQ ID NO: 3713936 - DNA, 20 bp, Homo sapiens
gtttatacagttttaaagaa

SEQ ID NO: 3713937 - DNA, 23 bp, Homo sapiens
gtttatggcctcagctgcctcac

SEQ ID NO: 3713938 - DNA, 15 bp, Homo sapiens
gtttattacttattt

SEQ ID NO: 3713939 - DNA, 14 bp, Homo sapiens
gtttatttatcagt

SEQ ID NO: 3713940 - DNA, 18 bp, Homo sapiens
gtttatttttatatagct

SEQ ID NO: 3713941 - DNA, 19 bp, Homo sapiens
gtttcaaaataaaaaccaa

SEQ ID NO: 3713942 - DNA, 22 bp, Homo sapiens
gtttcaattccacctgcaatca

SEQ ID NO: 3713943 - DNA, 20 bp, Homo sapiens
gtttcactgacttagaacca

SEQ ID NO: 3713944 - DNA, 21 bp, Homo sapiens
gtttcactttcacatagatgt

SEQ ID NO: 3713945 - DNA, 22 bp, Homo sapiens
gtttcagtaataaaacatcttt

SEQ ID NO: 3713946 - DNA, 11 bp, Homo sapiens
gtttcattgac

SEQ ID NO: 3713947 - DNA, 14 bp, Homo sapiens
gtttccaagcaaat

SEQ ID NO: 3713948 - DNA, 18 bp, Homo sapiens
gtttcctcaggctgctgg

SEQ ID NO: 3713949 - DNA, 22 bp, Homo sapiens
gtttcctcaggctgctggagga

SEQ ID NO: 3713950 - DNA, 18 bp, Homo sapiens
gtttctagggaaatgaaa

SEQ ID NO: 3713951 - DNA, 23 bp, Homo sapiens
gtttctaggtaatttttacagaa

SEQ ID NO: 3713952 - DNA, 23 bp, Homo sapiens
gtttctccccctgggctctgccc

SEQ ID NO: 3713953 - DNA, 13 bp, Homo sapiens
gtttctctgctgt

SEQ ID NO: 3713954 - DNA, 20 bp, Homo sapiens
gtttctgaaaattaacactg

SEQ ID NO: 3713955 - DNA, 19 bp, Homo sapiens
gtttctgaaaattccagaa

SEQ ID NO: 3713956 - DNA, 13 bp, Homo sapiens
gtttctgccctgc

SEQ ID NO: 3713957 - DNA, 13 bp, Homo sapiens
gtttcttccaaag

SEQ ID NO: 3713958 - DNA, 17 bp, Homo sapiens
gtttgaatataaacact

SEQ ID NO: 3713959 - DNA, 14 bp, Homo sapiens
gtttgatccttgtt

SEQ ID NO: 3713960 - DNA, 14 bp, Homo sapiens
gtttgcaaggaagc

SEQ ID NO: 3713961 - DNA, 15 bp, Homo sapiens
gtttgcaaggaagcc

SEQ ID NO: 3713962 - DNA, 22 bp, Homo sapiens
gtttgcaaggaagccacagctg

SEQ ID NO: 3713963 - DNA, 19 bp, Homo sapiens
gtttgcactgtatgctgga

SEQ ID NO: 3713964 - DNA, 20 bp, Homo sapiens
gtttgcactgtatgctggac

SEQ ID NO: 3713965 - DNA, 22 bp, Homo sapiens
gtttgcactgtatgctggacgg

SEQ ID NO: 3713966 - DNA, 21 bp, Homo sapiens
gtttgcagaagggggtctctt

SEQ ID NO: 3713967 - DNA, 20 bp, Homo sapiens
gtttgcagagcttgaacaca

SEQ ID NO: 3713968 - DNA, 17 bp, Homo sapiens
gtttgctcacctggggt

SEQ ID NO: 3713969 - DNA, 16 bp, Homo sapiens
gtttggcgggccaagg

SEQ ID NO: 3713970 - DNA, 16 bp, Homo sapiens
gtttgggtatattcat

SEQ ID NO: 3713971 - DNA, 22 bp, Homo sapiens
gtttgggtatcctgcccagtgt

SEQ ID NO: 3713972 - DNA, 15 bp, Homo sapiens
gtttgtaaataagag

SEQ ID NO: 3713973 - DNA, 17 bp, Homo sapiens
gtttgtaaataagagat

SEQ ID NO: 3713974 - DNA, 18 bp, Homo sapiens
gtttgtaaataagagatt

SEQ ID NO: 3713975 - DNA, 13 bp, Homo sapiens
gtttgtggcctca

SEQ ID NO: 3713976 - DNA, 14 bp, Homo sapiens
gtttgtggcctcag

SEQ ID NO: 3713977 - DNA, 16 bp, Homo sapiens
gtttgtggcctcagaa

SEQ ID NO: 3713978 - DNA, 22 bp, Homo sapiens
gtttgtggctgggggcaggagg

SEQ ID NO: 3713979 - DNA, 14 bp, Homo sapiens
gtttgttaaaactg

SEQ ID NO: 3713980 - DNA, 19 bp, Homo sapiens
gtttgtttctccccctggg

SEQ ID NO: 3713981 - DNA, 21 bp, Homo sapiens
gtttgtttctccccctgggct

SEQ ID NO: 3713982 - DNA, 12 bp, Homo sapiens
gtttgtttgttt

SEQ ID NO: 3713983 - DNA, 14 bp, Homo sapiens
gttttaagaggcag

SEQ ID NO: 3713984 - DNA, 17 bp, Homo sapiens
gttttaattgaaggaaa

SEQ ID NO: 3713985 - DNA, 19 bp, Homo sapiens
gttttaattgaaggaaaga

SEQ ID NO: 3713986 - DNA, 20 bp, Homo sapiens
gttttaattgaaggaaagat

SEQ ID NO: 3713987 - DNA, 23 bp, Homo sapiens
gttttacaataaaatcttgaaaa

SEQ ID NO: 3713988 - DNA, 18 bp, Homo sapiens
gttttactgcagctttgt

SEQ ID NO: 3713989 - DNA, 14 bp, Homo sapiens
gttttactgctttt

SEQ ID NO: 3713990 - DNA, 18 bp, Homo sapiens
gttttatactgtacttaa

SEQ ID NO: 3713991 - DNA, 23 bp, Homo sapiens
gttttatactgtacttaataaat

SEQ ID NO: 3713992 - DNA, 17 bp, Homo sapiens
gttttcagactcagact

SEQ ID NO: 3713993 - DNA, 14 bp, Homo sapiens
gttttccatgaaaa

SEQ ID NO: 3713994 - DNA, 18 bp, Homo sapiens
gttttccatgaaaacgtt

SEQ ID NO: 3713995 - DNA, 17 bp, Homo sapiens
gttttcctaaatgcagt

SEQ ID NO: 3713996 - DNA, 12 bp, Homo sapiens
gttttcttccca

SEQ ID NO: 3713997 - DNA, 22 bp, Homo sapiens
gttttgaactaataaaagcata

SEQ ID NO: 3713998 - DNA, 21 bp, Homo sapiens
gttttgatgtttgtggcctca

SEQ ID NO: 3713999 - DNA, 22 bp, Homo sapiens
gttttgccatgttggccaggct

SEQ ID NO: 3714000 - DNA, 16 bp, Homo sapiens
gttttggggactcatt

SEQ ID NO: 3714001 - DNA, 14 bp, Homo sapiens
gttttggttaagtt

SEQ ID NO: 3714002 - DNA, 20 bp, Homo sapiens
gttttggttaagttggcttc

SEQ ID NO: 3714003 - DNA, 13 bp, Homo sapiens
gttttgtaagaaa

SEQ ID NO: 3714004 - DNA, 15 bp, Homo sapiens
gttttgtgttgtttg

SEQ ID NO: 3714005 - DNA, 15 bp, Homo sapiens
gttttgttctttaaa

SEQ ID NO: 3714006 - DNA, 13 bp, Homo sapiens
gtttttaagctgt

SEQ ID NO: 3714007 - DNA, 19 bp, Homo sapiens
gtttttaagctgtttccat

SEQ ID NO: 3714008 - DNA, 21 bp, Homo sapiens
gtttttaagggtttgtggaaa

SEQ ID NO: 3714009 - DNA, 18 bp, Homo sapiens
gtttttaatataaagcct

SEQ ID NO: 3714010 - DNA, 16 bp, Homo sapiens
gtttttatggggctga

SEQ ID NO: 3714011 - DNA, 18 bp, Homo sapiens
gtttttccactactgcta

SEQ ID NO: 3714012 - DNA, 23 bp, Homo sapiens
gtttttcttcaacatcaatgttc

SEQ ID NO: 3714013 - DNA, 17 bp, Homo sapiens
gtttttgggatgtctta

SEQ ID NO: 3714014 - DNA, 19 bp, Homo sapiens
gtttttgttaactttgggt

SEQ ID NO: 3714015 - DNA, 19 bp, Homo sapiens
gttttttatcttttctaca

SEQ ID NO: 3714016 - DNA, 12 bp, Homo sapiens
gttttttgaaaa

SEQ ID NO: 3714017 - DNA, 20 bp, Homo sapiens
taaaaaaaatccttctaatc

SEQ ID NO: 3714018 - DNA, 20 bp, Homo sapiens
taaaaaaataataataatgt

SEQ ID NO: 3714019 - DNA, 20 bp, Homo sapiens
taaaaaactgctgactgttt

SEQ ID NO: 3714020 - DNA, 23 bp, Homo sapiens
taaaaaactgctgactgttttct

SEQ ID NO: 3714021 - DNA, 15 bp, Homo sapiens
taaaaaacttgtaaa

SEQ ID NO: 3714022 - DNA, 13 bp, Homo sapiens
taaaaaagtctct

SEQ ID NO: 3714023 - DNA, 22 bp, Homo sapiens
taaaaaagtctctatttaaatt

SEQ ID NO: 3714024 - DNA, 17 bp, Homo sapiens
taaaaaagtttaaaatg

SEQ ID NO: 3714025 - DNA, 18 bp, Homo sapiens
taaaaaagtttaaaatgt

SEQ ID NO: 3714026 - DNA, 17 bp, Homo sapiens
taaaaaataataataca

SEQ ID NO: 3714027 - DNA, 19 bp, Homo sapiens
taaaaaataataatacaag

SEQ ID NO: 3714028 - DNA, 23 bp, Homo sapiens
taaaaagtctgcattacattcct

SEQ ID NO: 3714029 - DNA, 14 bp, Homo sapiens
taaaaatacaaaca

SEQ ID NO: 3714030 - DNA, 11 bp, Homo sapiens
taaaaatcata

SEQ ID NO: 3714031 - DNA, 14 bp, Homo sapiens
taaaaatgagaaca

SEQ ID NO: 3714032 - DNA, 18 bp, Homo sapiens
taaaaatgagaacatgtt

SEQ ID NO: 3714033 - DNA, 17 bp, Homo sapiens
taatgtaagctctactg

SEQ ID NO: 3714034 - DNA, 16 bp, Homo sapiens
taatgtcacaggcagg

SEQ ID NO: 3714035 - DNA, 18 bp, Homo sapiens
taatgtcacaggcaggtc

SEQ ID NO: 3714036 - DNA, 15 bp, Homo sapiens
taatgtcttgttaat

SEQ ID NO: 3714037 - DNA, 17 bp, Homo sapiens
taatgtgcctagttctt

SEQ ID NO: 3714038 - DNA, 18 bp, Homo sapiens
taatgtgggaagaaacaa

SEQ ID NO: 3714039 - DNA, 22 bp, Homo sapiens
taatgtgggaagaaacaaaccc

SEQ ID NO: 3714040 - DNA, 11 bp, Homo sapiens
taatgttactg

SEQ ID NO: 3714041 - DNA, 13 bp, Homo sapiens
taatgttactgat

SEQ ID NO: 3714042 - DNA, 21 bp, Homo sapiens
taatgttactgatcatgcatt

SEQ ID NO: 3714043 - DNA, 23 bp, Homo sapiens
taatgttactgatcatgcattgt

SEQ ID NO: 3714044 - DNA, 21 bp, Homo sapiens
taatgttgggtagaaagagat

SEQ ID NO: 3714045 - DNA, 16 bp, Homo sapiens
taatgtttttaaatat

SEQ ID NO: 3714046 - DNA, 20 bp, Homo sapiens
taattaacatataatatatg

SEQ ID NO: 3714047 - DNA, 21 bp, Homo sapiens
taattaagtaaactaatgagt

SEQ ID NO: 3714048 - DNA, 13 bp, Homo sapiens
taattagctgtgc

SEQ ID NO: 3714049 - DNA, 17 bp, Homo sapiens
taattaggggttgctaa

SEQ ID NO: 3714050 - DNA, 16 bp, Homo sapiens
taattaggttaactat

SEQ ID NO: 3714051 - DNA, 14 bp, Homo sapiens
taattatgttattg

SEQ ID NO: 3714052 - DNA, 22 bp, Homo sapiens
taattattatttatatatgtat

SEQ ID NO: 3714053 - DNA, 15 bp, Homo sapiens
taattcatgtttctt

SEQ ID NO: 3714054 - DNA, 17 bp, Homo sapiens
taattcccattttgcaa

SEQ ID NO: 3714055 - DNA, 22 bp, Homo sapiens
taattctaaccagagcaagctt

SEQ ID NO: 3714056 - DNA, 13 bp, Homo sapiens
taattctaaggaa

SEQ ID NO: 3714057 - DNA, 14 bp, Homo sapiens
taattctgcatctg

SEQ ID NO: 3714058 - DNA, 15 bp, Homo sapiens
taattgaaggaaaga

SEQ ID NO: 3714059 - DNA, 20 bp, Homo sapiens
taattgacaggattattgga

SEQ ID NO: 3714060 - DNA, 12 bp, Homo sapiens
taattgccatgt

SEQ ID NO: 3714061 - DNA, 13 bp, Homo sapiens
taattgtaaactg

SEQ ID NO: 3714062 - DNA, 18 bp, Homo sapiens
taatttatagtttataca

SEQ ID NO: 3714063 - DNA, 20 bp, Homo sapiens
taatttattgtttttccttg

SEQ ID NO: 3714064 - DNA, 14 bp, Homo sapiens
taatttatttatta

SEQ ID NO: 3714065 - DNA, 17 bp, Homo sapiens
taatttgatgaaagctg

SEQ ID NO: 3714066 - DNA, 19 bp, Homo sapiens
taatttgatgaaagctgat

SEQ ID NO: 3714067 - DNA, 17 bp, Homo sapiens
taatttgccaaaataat

SEQ ID NO: 3714068 - DNA, 20 bp, Homo sapiens
taatttgtgtaataaagtgt

SEQ ID NO: 3714069 - DNA, 21 bp, Homo sapiens
taatttgtgtaataaagtgtt

SEQ ID NO: 3714070 - DNA, 14 bp, Homo sapiens
taattttaaacaaa

SEQ ID NO: 3714071 - DNA, 16 bp, Homo sapiens
taatttttacagaatt

SEQ ID NO: 3714072 - DNA, 17 bp, Homo sapiens
taatttttacagaattg

SEQ ID NO: 3714073 - DNA, 21 bp, Homo sapiens
taatttttttatgttttgttt

SEQ ID NO: 3714074 - DNA, 22 bp, Homo sapiens
taatttttttcaatatttatta

SEQ ID NO: 3714075 - DNA, 22 bp, Homo sapiens
taattttttttttccttttaaa

SEQ ID NO: 3714076 - DNA, 15 bp, Homo sapiens
tacaaaaagcataaa

SEQ ID NO: 3714077 - DNA, 16 bp, Homo sapiens
tacaaaagattgtcat

SEQ ID NO: 3714078 - DNA, 11 bp, Homo sapiens
tacaaaataaa

SEQ ID NO: 3714079 - DNA, 20 bp, Homo sapiens
tacaaaataaacaaataaca

SEQ ID NO: 3714080 - DNA, 19 bp, Homo sapiens
tacaaaatttgaaatttag

SEQ ID NO: 3714081 - DNA, 15 bp, Homo sapiens
tacaaacatatttgt

SEQ ID NO: 3714082 - DNA, 12 bp, Homo sapiens
tacaaactgcaa

SEQ ID NO: 3714083 - DNA, 13 bp, Homo sapiens
tacaaactgcaat

SEQ ID NO: 3714084 - DNA, 22 bp, Homo sapiens
tacaaactgcaatagagactgt

SEQ ID NO: 3714085 - DNA, 23 bp, Homo sapiens
tacaaagtgtattttataaaatt

SEQ ID NO: 3714086 - DNA, 23 bp, Homo sapiens
tacaaatactcttaggaagagaa

SEQ ID NO: 3714087 - DNA, 16 bp, Homo sapiens
tacaaattgcttgaaa

SEQ ID NO: 3714088 - DNA, 18 bp, Homo sapiens
tacaacttaaataataaa

SEQ ID NO: 3714089 - DNA, 14 bp, Homo sapiens
tacaacttcaagtg

SEQ ID NO: 3714090 - DNA, 19 bp, Homo sapiens
tacaagagcagcctgtggc

SEQ ID NO: 3714091 - DNA, 15 bp, Homo sapiens
tacaagataagcttc

SEQ ID NO: 3714092 - DNA, 21 bp, Homo sapiens
tacaagccattctaaggaaat

SEQ ID NO: 3714093 - DNA, 18 bp, Homo sapiens
tacaagcgtgagccactg

SEQ ID NO: 3714094 - DNA, 18 bp, Homo sapiens
tacaagggtctagggaga

SEQ ID NO: 3714095 - DNA, 17 bp, Homo sapiens
tacaagtattctgcctt

SEQ ID NO: 3714096 - DNA, 12 bp, Homo sapiens
tacaagtttcag

SEQ ID NO: 3714097 - DNA, 18 bp, Homo sapiens
tacaagtttcagacaggg

SEQ ID NO: 3714098 - DNA, 21 bp, Homo sapiens
tacaataaaactttgctgcca

SEQ ID NO: 3714099 - DNA, 20 bp, Homo sapiens
tacaataaaatcttgaaaat

SEQ ID NO: 3714100 - DNA, 15 bp, Homo sapiens
tacaatatatattct

SEQ ID NO: 3714101 - DNA, 14 bp, Homo sapiens
tacaatattttaag

SEQ ID NO: 3714102 - DNA, 17 bp, Homo sapiens
tacaatattttaagcat

SEQ ID NO: 3714103 - DNA, 21 bp, Homo sapiens
tacaatattttaagcattact

SEQ ID NO: 3714104 - DNA, 16 bp, Homo sapiens
tacaatctatttattg

SEQ ID NO: 3714105 - DNA, 15 bp, Homo sapiens
tacaattatatcagt

SEQ ID NO: 3714106 - DNA, 18 bp, Homo sapiens
tacaattatttttacagt

SEQ ID NO: 3714107 - DNA, 13 bp, Homo sapiens
tacaattgaaatg

SEQ ID NO: 3714108 - DNA, 20 bp, Homo sapiens
tacaattgaacttaaataaa

SEQ ID NO: 3714109 - DNA, 17 bp, Homo sapiens
tacaattgtaaaactga

SEQ ID NO: 3714110 - DNA, 20 bp, Homo sapiens
tacacaaatacttattcatt

SEQ ID NO: 3714111 - DNA, 15 bp, Homo sapiens
tacacacacatacac

SEQ ID NO: 3714112 - DNA, 17 bp, Homo sapiens
tacacacgtttgtttct

SEQ ID NO: 3714113 - DNA, 17 bp, Homo sapiens
tacacactttatttact

SEQ ID NO: 3714114 - DNA, 22 bp, Homo sapiens
tacacagactattgacatcagc

SEQ ID NO: 3714115 - DNA, 11 bp, Homo sapiens
tacacagttgc

SEQ ID NO: 3714116 - DNA, 19 bp, Homo sapiens
tacaccagagataatatga

SEQ ID NO: 3714117 - DNA, 19 bp, Homo sapiens
tacaccatgtttgagctca

SEQ ID NO: 3714118 - DNA, 15 bp, Homo sapiens
tacaccgggcctgga

SEQ ID NO: 3714119 - DNA, 17 bp, Homo sapiens
tacaccgggcctggaga

SEQ ID NO: 3714120 - DNA, 21 bp, Homo sapiens
tacacctcgttagggaagaga

SEQ ID NO: 3714121 - DNA, 18 bp, Homo sapiens
tacactccagcctgagca

SEQ ID NO: 3714122 - DNA, 15 bp, Homo sapiens
tacactctcctgggc

SEQ ID NO: 3714123 - DNA, 16 bp, Homo sapiens
tacactgtattacata

SEQ ID NO: 3714124 - DNA, 22 bp, Homo sapiens
tacactgtattacataaataaa

SEQ ID NO: 3714125 - DNA, 19 bp, Homo sapiens
tacactgttagaacactat

SEQ ID NO: 3714126 - DNA, 17 bp, Homo sapiens
tacagaaattagccggg

SEQ ID NO: 3714127 - DNA, 13 bp, Homo sapiens
tacagaatactag

SEQ ID NO: 3714128 - DNA, 11 bp, Homo sapiens
tacagaatcat

SEQ ID NO: 3714129 - DNA, 13 bp, Homo sapiens
tacagagaaggaa

SEQ ID NO: 3714130 - DNA, 21 bp, Homo sapiens
tacagagaggagaaacacatc

SEQ ID NO: 3714131 - DNA, 19 bp, Homo sapiens
tacagataggccttcttgt

SEQ ID NO: 3714132 - DNA, 20 bp, Homo sapiens
tacagataggccttcttgtg

SEQ ID NO: 3714133 - DNA, 19 bp, Homo sapiens
tacagatgtcccattttca

SEQ ID NO: 3714134 - DNA, 14 bp, Homo sapiens
tacagcaaatttat

SEQ ID NO: 3714135 - DNA, 22 bp, Homo sapiens
tacagccaaagataatctctca

SEQ ID NO: 3714136 - DNA, 14 bp, Homo sapiens
tacagctgcctgca

SEQ ID NO: 3714137 - DNA, 15 bp, Homo sapiens
tacagcttcaccctg

SEQ ID NO: 3714138 - DNA, 18 bp, Homo sapiens
tacaggaaaagctgctga

SEQ ID NO: 3714139 - DNA, 15 bp, Homo sapiens
tacaggagtgagcac

SEQ ID NO: 3714140 - DNA, 16 bp, Homo sapiens
tacaggcacccaccat

SEQ ID NO: 3714141 - DNA, 15 bp, Homo sapiens
tacaggcctcacaca

SEQ ID NO: 3714142 - DNA, 16 bp, Homo sapiens
tacagggagctgggac

SEQ ID NO: 3714143 - DNA, 22 bp, Homo sapiens
tacagggtagcaggtaccactg

SEQ ID NO: 3714144 - DNA, 16 bp, Homo sapiens
tacagtagtgagaaga

SEQ ID NO: 3714145 - DNA, 18 bp, Homo sapiens
tacagtagtgagaagaat

SEQ ID NO: 3714146 - DNA, 14 bp, Homo sapiens
tagcactcacatgc

SEQ ID NO: 3714147 - DNA, 17 bp, Homo sapiens
tagcacttatgttactg

SEQ ID NO: 3714148 - DNA, 19 bp, Homo sapiens
tagcagagaatgaaagggc

SEQ ID NO: 3714149 - DNA, 23 bp, Homo sapiens
tagcagagaatgaaagggcccag

SEQ ID NO: 3714150 - DNA, 14 bp, Homo sapiens
tagcagattttaat

SEQ ID NO: 3714151 - DNA, 20 bp, Homo sapiens
tagcagattttaattttgaa

SEQ ID NO: 3714152 - DNA, 21 bp, Homo sapiens
tagcagtgatttttatccaat

SEQ ID NO: 3714153 - DNA, 16 bp, Homo sapiens
tagcagttctgcaaat

SEQ ID NO: 3714154 - DNA, 17 bp, Homo sapiens
tagcagttctgcaaata

SEQ ID NO: 3714155 - DNA, 20 bp, Homo sapiens
tagcatgacaagccccaggc

SEQ ID NO: 3714156 - DNA, 18 bp, Homo sapiens
tagcatgcacaaagtgta

SEQ ID NO: 3714157 - DNA, 19 bp, Homo sapiens
tagcatgcacaaagtgtat

SEQ ID NO: 3714158 - DNA, 12 bp, Homo sapiens
tagcatgtaatg

SEQ ID NO: 3714159 - DNA, 21 bp, Homo sapiens
tagcatgtgtttggttctggg

SEQ ID NO: 3714160 - DNA, 22 bp, Homo sapiens
tagcatgtgtttggttctgggg

SEQ ID NO: 3714161 - DNA, 12 bp, Homo sapiens
tagcattaacta

SEQ ID NO: 3714162 - DNA, 16 bp, Homo sapiens
tagcattaactaatct

SEQ ID NO: 3714163 - DNA, 22 bp, Homo sapiens
tagcatttagtccaatgtcttt

SEQ ID NO: 3714164 - DNA, 23 bp, Homo sapiens
tagccaaggtgggctgagccctg

SEQ ID NO: 3714165 - DNA, 14 bp, Homo sapiens
tagccactcaggag

SEQ ID NO: 3714166 - DNA, 22 bp, Homo sapiens
tagccacttaccttcaataaag

SEQ ID NO: 3714167 - DNA, 14 bp, Homo sapiens
tagcccaaaaccaa

SEQ ID NO: 3714168 - DNA, 13 bp, Homo sapiens
tagccccataatt

SEQ ID NO: 3714169 - DNA, 18 bp, Homo sapiens
tagcccccaggctgctgg

SEQ ID NO: 3714170 - DNA, 16 bp, Homo sapiens
tagccgacctcagcct

SEQ ID NO: 3714171 - DNA, 17 bp, Homo sapiens
tagccgacctcagcctt

SEQ ID NO: 3714172 - DNA, 14 bp, Homo sapiens
tagccgagagcctg

SEQ ID NO: 3714173 - DNA, 15 bp, Homo sapiens
tagccgagagcctgc

SEQ ID NO: 3714174 - DNA, 19 bp, Homo sapiens
tagccgagagcctgctccc

SEQ ID NO: 3714175 - DNA, 19 bp, Homo sapiens
tagccggagtgacagagta

SEQ ID NO: 3714176 - DNA, 12 bp, Homo sapiens
tagcctccctga

SEQ ID NO: 3714177 - DNA, 13 bp, Homo sapiens
tagcctccctgaa

SEQ ID NO: 3714178 - DNA, 20 bp, Homo sapiens
tagcctcgccgtctgtgaat

SEQ ID NO: 3714179 - DNA, 15 bp, Homo sapiens
tagcgaggctctaac

SEQ ID NO: 3714180 - DNA, 17 bp, Homo sapiens
tagcgcccagttgggtg

SEQ ID NO: 3714181 - DNA, 21 bp, Homo sapiens
tagcgttggaattaaaacaat

SEQ ID NO: 3714182 - DNA, 15 bp, Homo sapiens
tagctagaggaacca

SEQ ID NO: 3714183 - DNA, 17 bp, Homo sapiens
tagctatatccatgtac

SEQ ID NO: 3714184 - DNA, 20 bp, Homo sapiens
tagctatatccatgtactgt

SEQ ID NO: 3714185 - DNA, 11 bp, Homo sapiens
tagctattttt

SEQ ID NO: 3714186 - DNA, 16 bp, Homo sapiens
tagctatttttatgga

SEQ ID NO: 3714187 - DNA, 17 bp, Homo sapiens
tagctatttttatggaa

SEQ ID NO: 3714188 - DNA, 20 bp, Homo sapiens
tagctcagataatgcccaga

SEQ ID NO: 3714189 - DNA, 14 bp, Homo sapiens
tagctcagccccag

SEQ ID NO: 3714190 - DNA, 20 bp, Homo sapiens
tagctcagccccagcccagc

SEQ ID NO: 3714191 - DNA, 11 bp, Homo sapiens
tagctgcagaa

SEQ ID NO: 3714192 - DNA, 21 bp, Homo sapiens
tagctgccaagccccatcctg

SEQ ID NO: 3714193 - DNA, 23 bp, Homo sapiens
tagctggaattttttattcttgt

SEQ ID NO: 3714194 - DNA, 17 bp, Homo sapiens
tagctgggactacaggc

SEQ ID NO: 3714195 - DNA, 22 bp, Homo sapiens
tagctggtttcctcattcctga

SEQ ID NO: 3714196 - DNA, 18 bp, Homo sapiens
tagcttacatgagaacag

SEQ ID NO: 3714197 - DNA, 18 bp, Homo sapiens
tagcttagacctcagcct

SEQ ID NO: 3714198 - DNA, 19 bp, Homo sapiens
tagcttagacctcagcctg

SEQ ID NO: 3714199 - DNA, 20 bp, Homo sapiens
tagcttagacctcagcctgt

SEQ ID NO: 3714200 - DNA, 19 bp, Homo sapiens
tagcttatcaatttgtcat

SEQ ID NO: 3714201 - DNA, 12 bp, Homo sapiens
tagcttccatga

SEQ ID NO: 3714202 - DNA, 18 bp, Homo sapiens
tagcttctgacctcagca

SEQ ID NO: 3714203 - DNA, 19 bp, Homo sapiens
tagcttgaaggatctgttt

SEQ ID NO: 3714204 - DNA, 15 bp, Homo sapiens
tagcttggaaactgg

SEQ ID NO: 3714205 - DNA, 11 bp, Homo sapiens
tagctttgctc

SEQ ID NO: 3714206 - DNA, 15 bp, Homo sapiens
tagctttgctctttg

SEQ ID NO: 3714207 - DNA, 13 bp, Homo sapiens
tagcttttccctt

SEQ ID NO: 3714208 - DNA, 19 bp, Homo sapiens
taggaaataaaacctttca

SEQ ID NO: 3714209 - DNA, 22 bp, Homo sapiens
taggaagtgtaacagctgaggt

SEQ ID NO: 3714210 - DNA, 20 bp, Homo sapiens
taggacataaattagaggtc

SEQ ID NO: 3714211 - DNA, 13 bp, Homo sapiens
taggacccttccc

SEQ ID NO: 3714212 - DNA, 14 bp, Homo sapiens
taggactctgaggc

SEQ ID NO: 3714213 - DNA, 12 bp, Homo sapiens
taggagcatgag

SEQ ID NO: 3714214 - DNA, 14 bp, Homo sapiens
taggagctgggagg

SEQ ID NO: 3714215 - DNA, 13 bp, Homo sapiens
taggcacccatcc

SEQ ID NO: 3714216 - DNA, 20 bp, Homo sapiens
taggcagattgaaaaggaca

SEQ ID NO: 3714217 - DNA, 13 bp, Homo sapiens
taggcagcagctt

SEQ ID NO: 3714218 - DNA, 24 bp, Homo sapiens
taggcagttagagatgcctccctg

SEQ ID NO: 3714219 - DNA, 14 bp, Homo sapiens
taggcatcccaggg

SEQ ID NO: 3714220 - DNA, 19 bp, Homo sapiens
taggcatcccaggggacca

SEQ ID NO: 3714221 - DNA, 13 bp, Homo sapiens
taggccactcctc

SEQ ID NO: 3714222 - DNA, 13 bp, Homo sapiens
taggcctggccag

SEQ ID NO: 3714223 - DNA, 14 bp, Homo sapiens
taggcctggccaga

SEQ ID NO: 3714224 - DNA, 16 bp, Homo sapiens
taggcctgggtgctgg

SEQ ID NO: 3714225 - DNA, 19 bp, Homo sapiens
taggccttcttgtgatctt

SEQ ID NO: 3714226 - DNA, 16 bp, Homo sapiens
taggcgtgagaagcat

SEQ ID NO: 3714227 - DNA, 11 bp, Homo sapiens
taggctctgca

SEQ ID NO: 3714228 - DNA, 15 bp, Homo sapiens
taggctctgcacaga

SEQ ID NO: 3714229 - DNA, 18 bp, Homo sapiens
taggctctgcacagatgg

SEQ ID NO: 3714230 - DNA, 16 bp, Homo sapiens
taggctgggcccagag

SEQ ID NO: 3714231 - DNA, 18 bp, Homo sapiens
taggctgggtgcccacag

SEQ ID NO: 3714232 - DNA, 13 bp, Homo sapiens
tagggaaatgaaa

SEQ ID NO: 3714233 - DNA, 16 bp, Homo sapiens
tagggaaatgaaagaa

SEQ ID NO: 3714234 - DNA, 17 bp, Homo sapiens
tagggaaggccacctgc

SEQ ID NO: 3714235 - DNA, 21 bp, Homo sapiens
tagggaatggcacagcccaaa

SEQ ID NO: 3714236 - DNA, 22 bp, Homo sapiens
tagggaggaccttatctgtgcg

SEQ ID NO: 3714237 - DNA, 16 bp, Homo sapiens
tagggattcaggctgc

SEQ ID NO: 3714238 - DNA, 21 bp, Homo sapiens
tagggcctggtccctgggagg

SEQ ID NO: 3714239 - DNA, 11 bp, Homo sapiens
tagggctgggt

SEQ ID NO: 3714240 - DNA, 12 bp, Homo sapiens
tagggctgggtg

SEQ ID NO: 3714241 - DNA, 15 bp, Homo sapiens
tagggttataataat

SEQ ID NO: 3714242 - DNA, 14 bp, Homo sapiens
taggtacacagctc

SEQ ID NO: 3714243 - DNA, 18 bp, Homo sapiens
taggtcaagaagaagatg

SEQ ID NO: 3714244 - DNA, 16 bp, Homo sapiens
taggtgacagagtgag

SEQ ID NO: 3714245 - DNA, 19 bp, Homo sapiens
taggtgcccttggaggcca

SEQ ID NO: 3714246 - DNA, 19 bp, Homo sapiens
taggtgctaattaataaag

SEQ ID NO: 3714247 - DNA, 15 bp, Homo sapiens
taggtttaacataaa

SEQ ID NO: 3714248 - DNA, 16 bp, Homo sapiens
taggtttaacataaag

SEQ ID NO: 3714249 - DNA, 18 bp, Homo sapiens
taggtttaacataaaggt

SEQ ID NO: 3714250 - DNA, 23 bp, Homo sapiens
taggttttaataattttttaatt

SEQ ID NO: 3714251 - DNA, 15 bp, Homo sapiens
taggtttttgtttgt

SEQ ID NO: 3714252 - DNA, 13 bp, Homo sapiens
tagtaaagaaatt

SEQ ID NO: 3714253 - DNA, 16 bp, Homo sapiens
tagtacctttgctctt

SEQ ID NO: 3714254 - DNA, 17 bp, Homo sapiens
tagtactcctgcaaaat

SEQ ID NO: 3714255 - DNA, 20 bp, Homo sapiens
tagtactcctgcaaaatttt

SEQ ID NO: 3714256 - DNA, 22 bp, Homo sapiens
tagtagagacagggttttgcca

SEQ ID NO: 3714257 - DNA, 14 bp, Homo sapiens
tagtagcatgttga

SEQ ID NO: 3714258 - DNA, 12 bp, Homo sapiens
tagtatatttat

SEQ ID NO: 3714259 - DNA, 19 bp, Homo sapiens
tagtatatttatataatta

SEQ ID NO: 3714260 - DNA, 13 bp, Homo sapiens
tattaaaatctta

SEQ ID NO: 3714261 - DNA, 15 bp, Homo sapiens
tattaaatagaaggt

SEQ ID NO: 3714262 - DNA, 20 bp, Homo sapiens
tattaaattttttaaaaagc

SEQ ID NO: 3714263 - DNA, 15 bp, Homo sapiens
tattaatattttaat

SEQ ID NO: 3714264 - DNA, 20 bp, Homo sapiens
tattaccactgaagatagaa

SEQ ID NO: 3714265 - DNA, 11 bp, Homo sapiens
tattacctctg

SEQ ID NO: 3714266 - DNA, 19 bp, Homo sapiens
tattacctctgatacctca

SEQ ID NO: 3714267 - DNA, 14 bp, Homo sapiens
tattacttatttgg

SEQ ID NO: 3714268 - DNA, 14 bp, Homo sapiens
tattagctttactg

SEQ ID NO: 3714269 - DNA, 18 bp, Homo sapiens
tattagtcatagaagaac

SEQ ID NO: 3714270 - DNA, 19 bp, Homo sapiens
tattatactaagaaaagat

SEQ ID NO: 3714271 - DNA, 16 bp, Homo sapiens
tattatcatgcaaatg

SEQ ID NO: 3714272 - DNA, 22 bp, Homo sapiens
tattatcatgcaaatgctgtat

SEQ ID NO: 3714273 - DNA, 13 bp, Homo sapiens
tattatccattca

SEQ ID NO: 3714274 - DNA, 13 bp, Homo sapiens
tattatgcaaatt

SEQ ID NO: 3714275 - DNA, 18 bp, Homo sapiens
tattatgcaaattcccag

SEQ ID NO: 3714276 - DNA, 14 bp, Homo sapiens
tattatgcataact

SEQ ID NO: 3714277 - DNA, 20 bp, Homo sapiens
tattatgcataactgacaaa

SEQ ID NO: 3714278 - DNA, 19 bp, Homo sapiens
tattattacttatttttga

SEQ ID NO: 3714279 - DNA, 22 bp, Homo sapiens
tattattcaccatgtaaaacaa

SEQ ID NO: 3714280 - DNA, 15 bp, Homo sapiens
tattattctgcagca

SEQ ID NO: 3714281 - DNA, 13 bp, Homo sapiens
tattatttatata

SEQ ID NO: 3714282 - DNA, 16 bp, Homo sapiens
tattatttcaatgtga

SEQ ID NO: 3714283 - DNA, 23 bp, Homo sapiens
tattcaagaaagccagtcttaac

SEQ ID NO: 3714284 - DNA, 16 bp, Homo sapiens
tattcaatcaaaattt

SEQ ID NO: 3714285 - DNA, 16 bp, Homo sapiens
tattcaattcctctgg

SEQ ID NO: 3714286 - DNA, 17 bp, Homo sapiens
tattcaattcctctggg

SEQ ID NO: 3714287 - DNA, 18 bp, Homo sapiens
tattcaattcctctggga

SEQ ID NO: 3714288 - DNA, 18 bp, Homo sapiens
tattcaccatgtaaaaca

SEQ ID NO: 3714289 - DNA, 21 bp, Homo sapiens
tattcacgtgcagcagcaaca

SEQ ID NO: 3714290 - DNA, 23 bp, Homo sapiens
tattcacgtgcagcagcaacaca

SEQ ID NO: 3714291 - DNA, 20 bp, Homo sapiens
tattcagtaataactctacc

SEQ ID NO: 3714292 - DNA, 18 bp, Homo sapiens
tattcagtgctgtggcct

SEQ ID NO: 3714293 - DNA, 21 bp, Homo sapiens
tattcagtgctgtggcctggg

SEQ ID NO: 3714294 - DNA, 23 bp, Homo sapiens
tattcagttggtaagcttccagg

SEQ ID NO: 3714295 - DNA, 14 bp, Homo sapiens
tattccaccttaaa

SEQ ID NO: 3714296 - DNA, 15 bp, Homo sapiens
tattccaccttaaat

SEQ ID NO: 3714297 - DNA, 22 bp, Homo sapiens
tattccaccttaaattaaacaa

SEQ ID NO: 3714298 - DNA, 19 bp, Homo sapiens
tattccatagtatattaaa

SEQ ID NO: 3714299 - DNA, 17 bp, Homo sapiens
tattccatgaatgtatc

SEQ ID NO: 3714300 - DNA, 20 bp, Homo sapiens
tattcccctatctctagaat

SEQ ID NO: 3714301 - DNA, 21 bp, Homo sapiens
tattccctgtacaatatttaa

SEQ ID NO: 3714302 - DNA, 20 bp, Homo sapiens
tattcctgcatttgtgaaat

SEQ ID NO: 3714303 - DNA, 21 bp, Homo sapiens
tattccttttgtgtacagtgt

SEQ ID NO: 3714304 - DNA, 14 bp, Homo sapiens
tattctacatttca

SEQ ID NO: 3714305 - DNA, 15 bp, Homo sapiens
tattctacatttcac

SEQ ID NO: 3714306 - DNA, 22 bp, Homo sapiens
tattctcactccaccacccaaa

SEQ ID NO: 3714307 - DNA, 16 bp, Homo sapiens
tattctctcctcagac

SEQ ID NO: 3714308 - DNA, 21 bp, Homo sapiens
tattctggctgataaaagata

SEQ ID NO: 3714309 - DNA, 16 bp, Homo sapiens
tattctgttggccagt

SEQ ID NO: 3714310 - DNA, 15 bp, Homo sapiens
tattcttgtgaatat

SEQ ID NO: 3714311 - DNA, 15 bp, Homo sapiens
tattgaaaaaaattg

SEQ ID NO: 3714312 - DNA, 18 bp, Homo sapiens
tattgacatcagcatcac

SEQ ID NO: 3714313 - DNA, 15 bp, Homo sapiens
tattgagacaaaaat

SEQ ID NO: 3714314 - DNA, 20 bp, Homo sapiens
tattgatatgcttatacact

SEQ ID NO: 3714315 - DNA, 21 bp, Homo sapiens
tattgatatgcttatacactt

SEQ ID NO: 3714316 - DNA, 22 bp, Homo sapiens
tattgcagcgattaataacagg

SEQ ID NO: 3714317 - DNA, 13 bp, Homo sapiens
tattgctacttcc

SEQ ID NO: 3714318 - DNA, 16 bp, Homo sapiens
tattggaattaacctg

SEQ ID NO: 3714319 - DNA, 21 bp, Homo sapiens
tattggaattaacctggtgct

SEQ ID NO: 3714320 - DNA, 23 bp, Homo sapiens
tattggaattaacctggtgctgg

SEQ ID NO: 3714321 - DNA, 13 bp, Homo sapiens
tattggtccagct

SEQ ID NO: 3714322 - DNA, 16 bp, Homo sapiens
tattgtcagatatttt

SEQ ID NO: 3714323 - DNA, 19 bp, Homo sapiens
tattgtgaagtacatatta

SEQ ID NO: 3714324 - DNA, 19 bp, Homo sapiens
tattgttccaagacattgt

SEQ ID NO: 3714325 - DNA, 21 bp, Homo sapiens
tattgttccaagacattgtca

SEQ ID NO: 3714326 - DNA, 13 bp, Homo sapiens
tattgttcctaag

SEQ ID NO: 3714327 - DNA, 11 bp, Homo sapiens
tattgtttcta

SEQ ID NO: 3714328 - DNA, 17 bp, Homo sapiens
tatttaaagacaaagac

SEQ ID NO: 3714329 - DNA, 14 bp, Homo sapiens
tatttaaattcttt

SEQ ID NO: 3714330 - DNA, 15 bp, Homo sapiens
tatttaaattctttt

SEQ ID NO: 3714331 - DNA, 15 bp, Homo sapiens
tatttaacaagatct

SEQ ID NO: 3714332 - DNA, 20 bp, Homo sapiens
tatttaagaaaatacaataa

SEQ ID NO: 3714333 - DNA, 15 bp, Homo sapiens
tatttaatgaaagac

SEQ ID NO: 3714334 - DNA, 15 bp, Homo sapiens
tatttaatgttatgt

SEQ ID NO: 3714335 - DNA, 14 bp, Homo sapiens
tatttaattgtaaa

SEQ ID NO: 3714336 - DNA, 15 bp, Homo sapiens
tatttaattgtaaac

SEQ ID NO: 3714337 - DNA, 18 bp, Homo sapiens
tatttaattgtaaactgt

SEQ ID NO: 3714338 - DNA, 19 bp, Homo sapiens
tatttactgagcttctctg

SEQ ID NO: 3714339 - DNA, 18 bp, Homo sapiens
tatttacttcttatacat

SEQ ID NO: 3714340 - DNA, 16 bp, Homo sapiens
tatttataaatatatt

SEQ ID NO: 3714341 - DNA, 14 bp, Homo sapiens
tatttataacagca

SEQ ID NO: 3714342 - DNA, 23 bp, Homo sapiens
tatttataactcatcataaaata

SEQ ID NO: 3714343 - DNA, 17 bp, Homo sapiens
tatttataagcagattt

SEQ ID NO: 3714344 - DNA, 23 bp, Homo sapiens
tatttatataattatgttattga

SEQ ID NO: 3714345 - DNA, 17 bp, Homo sapiens
tatttatatatttataa

SEQ ID NO: 3714346 - DNA, 14 bp, Homo sapiens
tatttatatttcac

SEQ ID NO: 3714347 - DNA, 15 bp, Homo sapiens
tatttatatttcact

SEQ ID NO: 3714348 - DNA, 13 bp, Homo sapiens
tatttatcacata

SEQ ID NO: 3714349 - DNA, 20 bp, Homo sapiens
tatttatctgtgcaaatcct

SEQ ID NO: 3714350 - DNA, 22 bp, Homo sapiens
tatttatctgtgtttttgaaat

SEQ ID NO: 3714351 - DNA, 14 bp, Homo sapiens
tatttatgtgtgag

SEQ ID NO: 3714352 - DNA, 15 bp, Homo sapiens
tatttattaaatttt

SEQ ID NO: 3714353 - DNA, 13 bp, Homo sapiens
tatttattacctc

SEQ ID NO: 3714354 - DNA, 17 bp, Homo sapiens
tatttattgctacttcc

SEQ ID NO: 3714355 - DNA, 11 bp, Homo sapiens
tatttatttaa

SEQ ID NO: 3714356 - DNA, 16 bp, Homo sapiens
tatttatttaagctta

SEQ ID NO: 3714357 - DNA, 17 bp, Homo sapiens
tatttcaaaaatttgga

SEQ ID NO: 3714358 - DNA, 21 bp, Homo sapiens
tatttcaaaaatttggaattc

SEQ ID NO: 3714359 - DNA, 22 bp, Homo sapiens
tatttccctcacctttcccatc

SEQ ID NO: 3714360 - DNA, 18 bp, Homo sapiens
tatttccctctcattttg

SEQ ID NO: 3714361 - DNA, 23 bp, Homo sapiens
tatttcctatattgttttcagtg

SEQ ID NO: 3714362 - DNA, 16 bp, Homo sapiens
tatttctatcccaaac

SEQ ID NO: 3714363 - DNA, 16 bp, Homo sapiens
tatttctgagaaggtc

SEQ ID NO: 3714364 - DNA, 16 bp, Homo sapiens
tatttgagactagttt

SEQ ID NO: 3714365 - DNA, 15 bp, Homo sapiens
tatttgcatgttacc

SEQ ID NO: 3714366 - DNA, 22 bp, Homo sapiens
tatttgttaatggtttgaatat

SEQ ID NO: 3714367 - DNA, 14 bp, Homo sapiens
tattttaagcatta

SEQ ID NO: 3714368 - DNA, 18 bp, Homo sapiens
tattttaccactgctgtg

SEQ ID NO: 3714369 - DNA, 16 bp, Homo sapiens
tattttactgtcttaa

SEQ ID NO: 3714370 - DNA, 20 bp, Homo sapiens
tattttatataataaagtat

SEQ ID NO: 3714371 - DNA, 21 bp, Homo sapiens
tattttatataataaagtatt

SEQ ID NO: 3714372 - DNA, 21 bp, Homo sapiens
tattttattacatctttcaca

SEQ ID NO: 3714373 - DNA, 16 bp, Homo sapiens
tcagcggggacagctc

SEQ ID NO: 3714374 - DNA, 19 bp, Homo sapiens
tcagcggggacagctcctt

SEQ ID NO: 3714375 - DNA, 15 bp, Homo sapiens
tcagctactaatgat

SEQ ID NO: 3714376 - DNA, 17 bp, Homo sapiens
tcagctagcaaaagaag

SEQ ID NO: 3714377 - DNA, 18 bp, Homo sapiens
tcagctccactttcagtg

SEQ ID NO: 3714378 - DNA, 14 bp, Homo sapiens
tcagctccagctca

SEQ ID NO: 3714379 - DNA, 21 bp, Homo sapiens
tcagctccagctcaccagccc

SEQ ID NO: 3714380 - DNA, 22 bp, Homo sapiens
tcagctccagctcaccagcccc

SEQ ID NO: 3714381 - DNA, 14 bp, Homo sapiens
tcagctctggctca

SEQ ID NO: 3714382 - DNA, 20 bp, Homo sapiens
tcagctctggctcacagact

SEQ ID NO: 3714383 - DNA, 15 bp, Homo sapiens
tcagctgaacctggg

SEQ ID NO: 3714384 - DNA, 15 bp, Homo sapiens
tcagctgcctcactt

SEQ ID NO: 3714385 - DNA, 20 bp, Homo sapiens
tcagctgtaagaagagactg

SEQ ID NO: 3714386 - DNA, 18 bp, Homo sapiens
tcagcttaggggctgctg

SEQ ID NO: 3714387 - DNA, 15 bp, Homo sapiens
tcagcttgctgccct

SEQ ID NO: 3714388 - DNA, 21 bp, Homo sapiens
tcagcttgtaaatagctcagg

SEQ ID NO: 3714389 - DNA, 17 bp, Homo sapiens
tcaggaaacatatttaa

SEQ ID NO: 3714390 - DNA, 18 bp, Homo sapiens
tcaggaaatatatatgtg

SEQ ID NO: 3714391 - DNA, 13 bp, Homo sapiens
tcaggaacagaag

SEQ ID NO: 3714392 - DNA, 13 bp, Homo sapiens
tcaggaacctgga

SEQ ID NO: 3714393 - DNA, 16 bp, Homo sapiens
tcaggaacctggacca

SEQ ID NO: 3714394 - DNA, 20 bp, Homo sapiens
tcaggaaggatgagcattta

SEQ ID NO: 3714395 - DNA, 19 bp, Homo sapiens
tcaggaccctcgctggccc

SEQ ID NO: 3714396 - DNA, 20 bp, Homo sapiens
tcaggaccctcgctggcccc

SEQ ID NO: 3714397 - DNA, 12 bp, Homo sapiens
tcaggactccag

SEQ ID NO: 3714398 - DNA, 18 bp, Homo sapiens
tcaggagaggggcagaac

SEQ ID NO: 3714399 - DNA, 16 bp, Homo sapiens
tcaggaggaaggctta

SEQ ID NO: 3714400 - DNA, 13 bp, Homo sapiens
tcaggaggcaggg

SEQ ID NO: 3714401 - DNA, 12 bp, Homo sapiens
tcaggaggctga

SEQ ID NO: 3714402 - DNA, 13 bp, Homo sapiens
tcaggaggctgag

SEQ ID NO: 3714403 - DNA, 22 bp, Homo sapiens
tcaggaggctgaggcagaagaa

SEQ ID NO: 3714404 - DNA, 18 bp, Homo sapiens
tcaggaggctgaggggag

SEQ ID NO: 3714405 - DNA, 21 bp, Homo sapiens
tcaggagttactggatttgtt

SEQ ID NO: 3714406 - DNA, 17 bp, Homo sapiens
tcaggagttagaggcca

SEQ ID NO: 3714407 - DNA, 22 bp, Homo sapiens
tcaggagttagaggccagcctg

SEQ ID NO: 3714408 - DNA, 17 bp, Homo sapiens
tcaggagttgtttctga

SEQ ID NO: 3714409 - DNA, 20 bp, Homo sapiens
tcaggatactctgtcagatg

SEQ ID NO: 3714410 - DNA, 17 bp, Homo sapiens
tcaggatcaagaaagtg

SEQ ID NO: 3714411 - DNA, 15 bp, Homo sapiens
tcaggatgcccaggg

SEQ ID NO: 3714412 - DNA, 21 bp, Homo sapiens
tcaggcaggaagggcaggaag

SEQ ID NO: 3714413 - DNA, 17 bp, Homo sapiens
tcaggcaggtgggatgg

SEQ ID NO: 3714414 - DNA, 20 bp, Homo sapiens
tcaggcataggcctgggtgc

SEQ ID NO: 3714415 - DNA, 14 bp, Homo sapiens
tcaggcatgcctgt

SEQ ID NO: 3714416 - DNA, 17 bp, Homo sapiens
tcaggccacctgccccc

SEQ ID NO: 3714417 - DNA, 16 bp, Homo sapiens
tcaggccacggcagcc

SEQ ID NO: 3714418 - DNA, 17 bp, Homo sapiens
tcaggccacggcagcct

SEQ ID NO: 3714419 - DNA, 18 bp, Homo sapiens
tcaggcctccctctctct

SEQ ID NO: 3714420 - DNA, 20 bp, Homo sapiens
tcaggcgatccacctgtctc

SEQ ID NO: 3714421 - DNA, 21 bp, Homo sapiens
tcaggctcttctcctttcaca

SEQ ID NO: 3714422 - DNA, 17 bp, Homo sapiens
tcaggctgctggaggaa

SEQ ID NO: 3714423 - DNA, 19 bp, Homo sapiens
tcaggctgctggaggaaaa

SEQ ID NO: 3714424 - DNA, 14 bp, Homo sapiens
tcaggcttccttgg

SEQ ID NO: 3714425 - DNA, 23 bp, Homo sapiens
tcaggcttccttggcatcacagg

SEQ ID NO: 3714426 - DNA, 17 bp, Homo sapiens
tcagggaagcccagctc

SEQ ID NO: 3714427 - DNA, 18 bp, Homo sapiens
tcagggacagagacacct

SEQ ID NO: 3714428 - DNA, 15 bp, Homo sapiens
tcagggaccaaggac

SEQ ID NO: 3714429 - DNA, 20 bp, Homo sapiens
tcagggaccaaggacccctc

SEQ ID NO: 3714430 - DNA, 16 bp, Homo sapiens
tcagggacccctgccc

SEQ ID NO: 3714431 - DNA, 17 bp, Homo sapiens
tcagggacccctgccct

SEQ ID NO: 3714432 - DNA, 23 bp, Homo sapiens
tcagggatagcactgagcaaagc

SEQ ID NO: 3714433 - DNA, 20 bp, Homo sapiens
tcagggattttttttttaaa

SEQ ID NO: 3714434 - DNA, 12 bp, Homo sapiens
tcagggggccag

SEQ ID NO: 3714435 - DNA, 19 bp, Homo sapiens
tcaggggtgtgcggccttt

SEQ ID NO: 3714436 - DNA, 23 bp, Homo sapiens
tcaggggtgtgcggcctttggct

SEQ ID NO: 3714437 - DNA, 15 bp, Homo sapiens
tcagggtcatagcat

SEQ ID NO: 3714438 - DNA, 18 bp, Homo sapiens
tcagggttggcccctgcc

SEQ ID NO: 3714439 - DNA, 18 bp, Homo sapiens
tcaggtacagagaaggaa

SEQ ID NO: 3714440 - DNA, 17 bp, Homo sapiens
tcaggtggggcagcttg

SEQ ID NO: 3714441 - DNA, 18 bp, Homo sapiens
tcaggtggggcagcttga

SEQ ID NO: 3714442 - DNA, 18 bp, Homo sapiens
tcaggttcttagtgtcac

SEQ ID NO: 3714443 - DNA, 20 bp, Homo sapiens
tcaggttgtagtaaagaaat

SEQ ID NO: 3714444 - DNA, 15 bp, Homo sapiens
tcagtaataaaacat

SEQ ID NO: 3714445 - DNA, 13 bp, Homo sapiens
tcagtaataactc

SEQ ID NO: 3714446 - DNA, 17 bp, Homo sapiens
tcagtaatttgaggaca

SEQ ID NO: 3714447 - DNA, 18 bp, Homo sapiens
tcagtacccacctgagct

SEQ ID NO: 3714448 - DNA, 15 bp, Homo sapiens
tcagtccatagcaga

SEQ ID NO: 3714449 - DNA, 23 bp, Homo sapiens
tcagtctgattcccaagctctgc

SEQ ID NO: 3714450 - DNA, 24 bp, Homo sapiens
tcagtctgattcccaagctctgct

SEQ ID NO: 3714451 - DNA, 12 bp, Homo sapiens
tcagtcttttcc

SEQ ID NO: 3714452 - DNA, 19 bp, Homo sapiens
tcagtgacagagttcacta

SEQ ID NO: 3714453 - DNA, 23 bp, Homo sapiens
tcagtgcagcccgtgtggcccct

SEQ ID NO: 3714454 - DNA, 15 bp, Homo sapiens
tcagtgctgtggcct

SEQ ID NO: 3714455 - DNA, 22 bp, Homo sapiens
tcagtgctgtggcctgggcaag

SEQ ID NO: 3714456 - DNA, 14 bp, Homo sapiens
tcagtggcagctgc

SEQ ID NO: 3714457 - DNA, 16 bp, Homo sapiens
tcagtggcagctgctt

SEQ ID NO: 3714458 - DNA, 19 bp, Homo sapiens
tcagtggcatggctccagt

SEQ ID NO: 3714459 - DNA, 19 bp, Homo sapiens
tcagtgggaacgtgactgc

SEQ ID NO: 3714460 - DNA, 13 bp, Homo sapiens
tcagtgggagaaa

SEQ ID NO: 3714461 - DNA, 16 bp, Homo sapiens
tcagtgggagaaaaca

SEQ ID NO: 3714462 - DNA, 20 bp, Homo sapiens
tcagtgtcatttatgaaaag

SEQ ID NO: 3714463 - DNA, 13 bp, Homo sapiens
tcagtgttaaaaa

SEQ ID NO: 3714464 - DNA, 15 bp, Homo sapiens
tcagttaagaaaaaa

SEQ ID NO: 3714465 - DNA, 16 bp, Homo sapiens
tcagttactcagccct

SEQ ID NO: 3714466 - DNA, 18 bp, Homo sapiens
tcagttactcagccctgg

SEQ ID NO: 3714467 - DNA, 22 bp, Homo sapiens
tcagttcccttggcctcagaat

SEQ ID NO: 3714468 - DNA, 20 bp, Homo sapiens
tcagttcctgcccttggcct

SEQ ID NO: 3714469 - DNA, 15 bp, Homo sapiens
tcagttggtaagctt

SEQ ID NO: 3714470 - DNA, 16 bp, Homo sapiens
tcagttggtaagcttc

SEQ ID NO: 3714471 - DNA, 20 bp, Homo sapiens
tcagttggtgtgtttttggg

SEQ ID NO: 3714472 - DNA, 19 bp, Homo sapiens
tcagtttcaattcagtgct

SEQ ID NO: 3714473 - DNA, 19 bp, Homo sapiens
tcagttttatcattttcaa

SEQ ID NO: 3714474 - DNA, 21 bp, Homo sapiens
tcataaaataaagtatatata

SEQ ID NO: 3714475 - DNA, 13 bp, Homo sapiens
tcataaactgtgt

SEQ ID NO: 3714476 - DNA, 15 bp, Homo sapiens
tcataaactgtgtgc

SEQ ID NO: 3714477 - DNA, 22 bp, Homo sapiens
tcataacagtgccattgtcttt

SEQ ID NO: 3714478 - DNA, 13 bp, Homo sapiens
tcataagcacact

SEQ ID NO: 3714479 - DNA, 20 bp, Homo sapiens
tcataccaactttagcagaa

SEQ ID NO: 3714480 - DNA, 15 bp, Homo sapiens
tcatactcacctcac

SEQ ID NO: 3714481 - DNA, 19 bp, Homo sapiens
tcatagatttctgatttta

SEQ ID NO: 3714482 - DNA, 19 bp, Homo sapiens
tcatagcattaactaatct

SEQ ID NO: 3714483 - DNA, 21 bp, Homo sapiens
tcatagcattaactaatctat

SEQ ID NO: 3714484 - DNA, 19 bp, Homo sapiens
tcatagggaagacctgctg

SEQ ID NO: 3714485 - DNA, 15 bp, Homo sapiens
tcatataataaatgt

SEQ ID NO: 3714486 - DNA, 14 bp, Homo sapiens
tcctccagaagcct

SEQ ID NO: 3714487 - DNA, 18 bp, Homo sapiens
tcctccagaagcctctgg

SEQ ID NO: 3714488 - DNA, 13 bp, Homo sapiens
tcctccagggcca

SEQ ID NO: 3714489 - DNA, 20 bp, Homo sapiens
tcctccagggccacgtgcca

SEQ ID NO: 3714490 - DNA, 16 bp, Homo sapiens
tcctccatactcagga

SEQ ID NO: 3714491 - DNA, 22 bp, Homo sapiens
tcctcccaaaagtatcgggggc

SEQ ID NO: 3714492 - DNA, 16 bp, Homo sapiens
tcctcccacctcagcc

SEQ ID NO: 3714493 - DNA, 20 bp, Homo sapiens
tcctcccacctcagcctccc

SEQ ID NO: 3714494 - DNA, 21 bp, Homo sapiens
tcctcccaggcgccccttccc

SEQ ID NO: 3714495 - DNA, 15 bp, Homo sapiens
tcctccccctgccag

SEQ ID NO: 3714496 - DNA, 20 bp, Homo sapiens
tcctccccctgccagtgcct

SEQ ID NO: 3714497 - DNA, 17 bp, Homo sapiens
tcctccccttccctgca

SEQ ID NO: 3714498 - DNA, 18 bp, Homo sapiens
tcctccccttccctgcaa

SEQ ID NO: 3714499 - DNA, 15 bp, Homo sapiens
tcctccctccctctt

SEQ ID NO: 3714500 - DNA, 19 bp, Homo sapiens
tcctccctccctctttccc

SEQ ID NO: 3714501 - DNA, 15 bp, Homo sapiens
tcctccctgatgtac

SEQ ID NO: 3714502 - DNA, 12 bp, Homo sapiens
tcctcctgccca

SEQ ID NO: 3714503 - DNA, 16 bp, Homo sapiens
tcctcctgcccacctg

SEQ ID NO: 3714504 - DNA, 17 bp, Homo sapiens
tcctcctgcccacctgt

SEQ ID NO: 3714505 - DNA, 13 bp, Homo sapiens
tcctcgccctggg

SEQ ID NO: 3714506 - DNA, 19 bp, Homo sapiens
tcctcggatcaccgagagt

SEQ ID NO: 3714507 - DNA, 12 bp, Homo sapiens
tcctctccactg

SEQ ID NO: 3714508 - DNA, 16 bp, Homo sapiens
tcctctctaacctcct

SEQ ID NO: 3714509 - DNA, 21 bp, Homo sapiens
tcctctctaacctcctttacc

SEQ ID NO: 3714510 - DNA, 23 bp, Homo sapiens
tcctctgccacctcccctatcca

SEQ ID NO: 3714511 - DNA, 22 bp, Homo sapiens
tcctctgtccaggcactgctgc

SEQ ID NO: 3714512 - DNA, 14 bp, Homo sapiens
tcctctgtccaggg

SEQ ID NO: 3714513 - DNA, 21 bp, Homo sapiens
tcctctttcagaaaacagaaa

SEQ ID NO: 3714514 - DNA, 12 bp, Homo sapiens
tcctctttccat

SEQ ID NO: 3714515 - DNA, 11 bp, Homo sapiens
tcctctttgtt

SEQ ID NO: 3714516 - DNA, 13 bp, Homo sapiens
tcctctttttcca

SEQ ID NO: 3714517 - DNA, 15 bp, Homo sapiens
tcctgaaatttcaga

SEQ ID NO: 3714518 - DNA, 14 bp, Homo sapiens
tcctgaatgaaata

SEQ ID NO: 3714519 - DNA, 15 bp, Homo sapiens
tcctgacctgtctca

SEQ ID NO: 3714520 - DNA, 19 bp, Homo sapiens
tcctgactcaacatgttac

SEQ ID NO: 3714521 - DNA, 15 bp, Homo sapiens
tcctgagcttggcca

SEQ ID NO: 3714522 - DNA, 20 bp, Homo sapiens
tcctgagcttggccagaagg

SEQ ID NO: 3714523 - DNA, 22 bp, Homo sapiens
tcctgagcttggccagaagggg

SEQ ID NO: 3714524 - DNA, 16 bp, Homo sapiens
tcctgatgacccaggc

SEQ ID NO: 3714525 - DNA, 17 bp, Homo sapiens
tcctgatgacccaggct

SEQ ID NO: 3714526 - DNA, 20 bp, Homo sapiens
tcctgatgacccaggctgcc

SEQ ID NO: 3714527 - DNA, 20 bp, Homo sapiens
tcctgattatttatcacata

SEQ ID NO: 3714528 - DNA, 21 bp, Homo sapiens
tcctgcactgacccacagcct

SEQ ID NO: 3714529 - DNA, 16 bp, Homo sapiens
tcctgcattcacccag

SEQ ID NO: 3714530 - DNA, 16 bp, Homo sapiens
tcctgcatttgtgaaa

SEQ ID NO: 3714531 - DNA, 18 bp, Homo sapiens
tcctgccacctggggcag

SEQ ID NO: 3714532 - DNA, 20 bp, Homo sapiens
tcctgccacctggggcagtc

SEQ ID NO: 3714533 - DNA, 14 bp, Homo sapiens
tcctgccaggcatg

SEQ ID NO: 3714534 - DNA, 15 bp, Homo sapiens
tcctgcccccacacc

SEQ ID NO: 3714535 - DNA, 16 bp, Homo sapiens
tcctgcccccacacct

SEQ ID NO: 3714536 - DNA, 23 bp, Homo sapiens
tcctgcccccacacctggccctg

SEQ ID NO: 3714537 - DNA, 17 bp, Homo sapiens
tcctgcctcagcctccc

SEQ ID NO: 3714538 - DNA, 13 bp, Homo sapiens
tcctgcctggcca

SEQ ID NO: 3714539 - DNA, 14 bp, Homo sapiens
tcctgcctggccag

SEQ ID NO: 3714540 - DNA, 21 bp, Homo sapiens
tcctgcctggtctcctgcccc

SEQ ID NO: 3714541 - DNA, 15 bp, Homo sapiens
tcctgctagaaatgg

SEQ ID NO: 3714542 - DNA, 19 bp, Homo sapiens
tcctgctatttcccaagct

SEQ ID NO: 3714543 - DNA, 21 bp, Homo sapiens
tcctgctctctacccagccca

SEQ ID NO: 3714544 - DNA, 14 bp, Homo sapiens
tcctggaagctgtg

SEQ ID NO: 3714545 - DNA, 21 bp, Homo sapiens
tcctggaagctgtgtccttgc

SEQ ID NO: 3714546 - DNA, 18 bp, Homo sapiens
tcctggagagtctcactc

SEQ ID NO: 3714547 - DNA, 13 bp, Homo sapiens
tcctggagcccga

SEQ ID NO: 3714548 - DNA, 20 bp, Homo sapiens
tcctggagcccgaggcacca

SEQ ID NO: 3714549 - DNA, 20 bp, Homo sapiens
tcctggcacccggcccctgc

SEQ ID NO: 3714550 - DNA, 22 bp, Homo sapiens
tcctggcacccggcccctgctg

SEQ ID NO: 3714551 - DNA, 23 bp, Homo sapiens
tcctggcacccggcccctgctgg

SEQ ID NO: 3714552 - DNA, 12 bp, Homo sapiens
tcctggcctcaa

SEQ ID NO: 3714553 - DNA, 13 bp, Homo sapiens
tcctggctcagcc

SEQ ID NO: 3714554 - DNA, 16 bp, Homo sapiens
tcctggctcctgaggg

SEQ ID NO: 3714555 - DNA, 17 bp, Homo sapiens
tcctggctttgcccaac

SEQ ID NO: 3714556 - DNA, 17 bp, Homo sapiens
tcctgggagaacctcag

SEQ ID NO: 3714557 - DNA, 19 bp, Homo sapiens
tcctgggagaacctcaggc

SEQ ID NO: 3714558 - DNA, 20 bp, Homo sapiens
tcctgggagaacctcaggct

SEQ ID NO: 3714559 - DNA, 17 bp, Homo sapiens
tcctgggagtgagctgg

SEQ ID NO: 3714560 - DNA, 21 bp, Homo sapiens
tcctgggcccctccctacctc

SEQ ID NO: 3714561 - DNA, 12 bp, Homo sapiens
tcctgggctcag

SEQ ID NO: 3714562 - DNA, 22 bp, Homo sapiens
tcctggggcctcggagcctcat

SEQ ID NO: 3714563 - DNA, 16 bp, Homo sapiens
tcctggggctctgtgc

SEQ ID NO: 3714564 - DNA, 19 bp, Homo sapiens
tcctggggctctgtgcagg

SEQ ID NO: 3714565 - DNA, 17 bp, Homo sapiens
tcctgggggcctgacct

SEQ ID NO: 3714566 - DNA, 22 bp, Homo sapiens
tcctgggggttctttcttcctc

SEQ ID NO: 3714567 - DNA, 19 bp, Homo sapiens
tcctggggtgccctccact

SEQ ID NO: 3714568 - DNA, 22 bp, Homo sapiens
tcctggggtgccctccactgcc

SEQ ID NO: 3714569 - DNA, 21 bp, Homo sapiens
tcctgggtggtctgcaggcag

SEQ ID NO: 3714570 - DNA, 17 bp, Homo sapiens
tcctggtcttgagatgt

SEQ ID NO: 3714571 - DNA, 20 bp, Homo sapiens
tcctggtcttgagatgtctt

SEQ ID NO: 3714572 - DNA, 16 bp, Homo sapiens
tcctgtacactgaata

SEQ ID NO: 3714573 - DNA, 22 bp, Homo sapiens
tcctgtcggagccctgtctcct

SEQ ID NO: 3714574 - DNA, 13 bp, Homo sapiens
tcctgtctcccct

SEQ ID NO: 3714575 - DNA, 17 bp, Homo sapiens
tcctgtctcccctctgc

SEQ ID NO: 3714576 - DNA, 19 bp, Homo sapiens
tcctgtctcccctctgctg

SEQ ID NO: 3714577 - DNA, 14 bp, Homo sapiens
tcctgtctgccagc

SEQ ID NO: 3714578 - DNA, 21 bp, Homo sapiens
tcctgtctgccagccagcagc

SEQ ID NO: 3714579 - DNA, 22 bp, Homo sapiens
tcctgtctgccagccagcagcc

SEQ ID NO: 3714580 - DNA, 13 bp, Homo sapiens
tcctgtctgttca

SEQ ID NO: 3714581 - DNA, 19 bp, Homo sapiens
tcctgtctttaaggaaaaa

SEQ ID NO: 3714582 - DNA, 18 bp, Homo sapiens
tcctgtgacttcagctct

SEQ ID NO: 3714583 - DNA, 18 bp, Homo sapiens
tcctgtgcatgggtgaag

SEQ ID NO: 3714584 - DNA, 21 bp, Homo sapiens
tcctgtgtggtttagtgtaaa

SEQ ID NO: 3714585 - DNA, 14 bp, Homo sapiens
tcctgtgtgtgcgc

SEQ ID NO: 3714586 - DNA, 15 bp, Homo sapiens
tcctgttcagcattc

SEQ ID NO: 3714587 - DNA, 19 bp, Homo sapiens
tcctgttgttgttaatgaa

SEQ ID NO: 3714588 - DNA, 14 bp, Homo sapiens
tccttaaactgtgt

SEQ ID NO: 3714589 - DNA, 14 bp, Homo sapiens
tccttacccatctg

SEQ ID NO: 3714590 - DNA, 14 bp, Homo sapiens
tccttacctcttcc

SEQ ID NO: 3714591 - DNA, 15 bp, Homo sapiens
tccttagcaacagcc

SEQ ID NO: 3714592 - DNA, 13 bp, Homo sapiens
tccttagctgcca

SEQ ID NO: 3714593 - DNA, 21 bp, Homo sapiens
tccttagcttagacctcagcc

SEQ ID NO: 3714594 - DNA, 16 bp, Homo sapiens
tccttagtcttctcat

SEQ ID NO: 3714595 - DNA, 17 bp, Homo sapiens
tccttagtcttctcata

SEQ ID NO: 3714596 - DNA, 18 bp, Homo sapiens
tccttagtcttctcatag

SEQ ID NO: 3714597 - DNA, 21 bp, Homo sapiens
tccttatcactgacacaaaaa

SEQ ID NO: 3714598 - DNA, 21 bp, Homo sapiens
tccttcaagaactctgggctg

SEQ ID NO: 3714599 - DNA, 18 bp, Homo sapiens
tctgagccaaagagaatg

SEQ ID NO: 3714600 - DNA, 22 bp, Homo sapiens
tctgaggaatcaacagggcagc

SEQ ID NO: 3714601 - DNA, 19 bp, Homo sapiens
tctgaggctctttctgggc

SEQ ID NO: 3714602 - DNA, 18 bp, Homo sapiens
tctgagtatctcctcgca

SEQ ID NO: 3714603 - DNA, 14 bp, Homo sapiens
tctgagtttaccat

SEQ ID NO: 3714604 - DNA, 15 bp, Homo sapiens
tctgagtttaccatt

SEQ ID NO: 3714605 - DNA, 20 bp, Homo sapiens
tctgagtttaccatttgtaa

SEQ ID NO: 3714606 - DNA, 21 bp, Homo sapiens
tctgagtttaccatttgtaat

SEQ ID NO: 3714607 - DNA, 22 bp, Homo sapiens
tctgagtttaccatttgtaata

SEQ ID NO: 3714608 - DNA, 19 bp, Homo sapiens
tctgatattccatgaatgt

SEQ ID NO: 3714609 - DNA, 21 bp, Homo sapiens
tctgatgcaagcaagaaacac

SEQ ID NO: 3714610 - DNA, 23 bp, Homo sapiens
tctgatgcaagcaagaaacactg

SEQ ID NO: 3714611 - DNA, 19 bp, Homo sapiens
tctgatgtaaatgaagtaa

SEQ ID NO: 3714612 - DNA, 20 bp, Homo sapiens
tctgattcccaagctctgct

SEQ ID NO: 3714613 - DNA, 20 bp, Homo sapiens
tctgatttgtccctatgcat

SEQ ID NO: 3714614 - DNA, 22 bp, Homo sapiens
tctgattttatgtaaaattttg

SEQ ID NO: 3714615 - DNA, 20 bp, Homo sapiens
tctgcaagaattgaagcagg

SEQ ID NO: 3714616 - DNA, 14 bp, Homo sapiens
tctgcacaagctgc

SEQ ID NO: 3714617 - DNA, 10 bp, Homo sapiens
tctgcacaga

SEQ ID NO: 3714618 - DNA, 23 bp, Homo sapiens
tctgcaccgccggccagctggga

SEQ ID NO: 3714619 - DNA, 19 bp, Homo sapiens
tctgcagccagcccagccc

SEQ ID NO: 3714620 - DNA, 19 bp, Homo sapiens
tctgcagggggtgtgtctg

SEQ ID NO: 3714621 - DNA, 16 bp, Homo sapiens
tctgcatcatctgtag

SEQ ID NO: 3714622 - DNA, 15 bp, Homo sapiens
tctgcatttagcaca

SEQ ID NO: 3714623 - DNA, 19 bp, Homo sapiens
tctgcattttctgaaacta

SEQ ID NO: 3714624 - DNA, 15 bp, Homo sapiens
tctgccacctcccct

SEQ ID NO: 3714625 - DNA, 15 bp, Homo sapiens
tctgccagccagcag

SEQ ID NO: 3714626 - DNA, 16 bp, Homo sapiens
tctgccagccagcagc

SEQ ID NO: 3714627 - DNA, 19 bp, Homo sapiens
tctgccagccagcagccag

SEQ ID NO: 3714628 - DNA, 13 bp, Homo sapiens
tctgccagggagc

SEQ ID NO: 3714629 - DNA, 19 bp, Homo sapiens
tctgccagggagcttgaaa

SEQ ID NO: 3714630 - DNA, 18 bp, Homo sapiens
tctgcccattccccagcc

SEQ ID NO: 3714631 - DNA, 19 bp, Homo sapiens
tctgcccattccccagcct

SEQ ID NO: 3714632 - DNA, 13 bp, Homo sapiens
tctgcccctcccc

SEQ ID NO: 3714633 - DNA, 16 bp, Homo sapiens
tctgcccctcccccaa

SEQ ID NO: 3714634 - DNA, 18 bp, Homo sapiens
tctgccctccctccttcc

SEQ ID NO: 3714635 - DNA, 18 bp, Homo sapiens
tctgcccttgccaacgga

SEQ ID NO: 3714636 - DNA, 17 bp, Homo sapiens
tctgccggccctggggc

SEQ ID NO: 3714637 - DNA, 16 bp, Homo sapiens
tctgcctattgcagct

SEQ ID NO: 3714638 - DNA, 15 bp, Homo sapiens
tctgcctcctcttca

SEQ ID NO: 3714639 - DNA, 15 bp, Homo sapiens
tctgcctctgacaca

SEQ ID NO: 3714640 - DNA, 16 bp, Homo sapiens
tctgcctctgcctgca

SEQ ID NO: 3714641 - DNA, 13 bp, Homo sapiens
tctgcctgcccag

SEQ ID NO: 3714642 - DNA, 21 bp, Homo sapiens
tctgcctgcccaggcccctgc

SEQ ID NO: 3714643 - DNA, 17 bp, Homo sapiens
tctgcctgtccctctca

SEQ ID NO: 3714644 - DNA, 18 bp, Homo sapiens
tctgcctgtccctctcag

SEQ ID NO: 3714645 - DNA, 21 bp, Homo sapiens
tctgcctgtccctctcaggca

SEQ ID NO: 3714646 - DNA, 14 bp, Homo sapiens
tctgcctgtgagcc

SEQ ID NO: 3714647 - DNA, 16 bp, Homo sapiens
tctgcctttgcagaaa

SEQ ID NO: 3714648 - DNA, 19 bp, Homo sapiens
tctgcctttgcagaaacag

SEQ ID NO: 3714649 - DNA, 21 bp, Homo sapiens
tctgctaacttggagccccag

SEQ ID NO: 3714650 - DNA, 14 bp, Homo sapiens
tctgctatgcttga

SEQ ID NO: 3714651 - DNA, 15 bp, Homo sapiens
tctgctatgcttgaa

SEQ ID NO: 3714652 - DNA, 12 bp, Homo sapiens
tctgctccacca

SEQ ID NO: 3714653 - DNA, 20 bp, Homo sapiens
tctgctccaccacatcctcc

SEQ ID NO: 3714654 - DNA, 20 bp, Homo sapiens
tctgctccacccttggcctg

SEQ ID NO: 3714655 - DNA, 21 bp, Homo sapiens
tctgctccacccttggcctgt

SEQ ID NO: 3714656 - DNA, 23 bp, Homo sapiens
tctgctccacccttggcctgtct

SEQ ID NO: 3714657 - DNA, 14 bp, Homo sapiens
tctgctcggccgtc

SEQ ID NO: 3714658 - DNA, 18 bp, Homo sapiens
tctgctcggccgtcttca

SEQ ID NO: 3714659 - DNA, 15 bp, Homo sapiens
tctgctgccctccat

SEQ ID NO: 3714660 - DNA, 14 bp, Homo sapiens
tctgctggcccagc

SEQ ID NO: 3714661 - DNA, 16 bp, Homo sapiens
tctgcttatccttcca

SEQ ID NO: 3714662 - DNA, 14 bp, Homo sapiens
tctgcttcagcctc

SEQ ID NO: 3714663 - DNA, 21 bp, Homo sapiens
tctgctttgactgagcagact

SEQ ID NO: 3714664 - DNA, 16 bp, Homo sapiens
tctggaaaggaggaag

SEQ ID NO: 3714665 - DNA, 13 bp, Homo sapiens
tctggaagagagg

SEQ ID NO: 3714666 - DNA, 15 bp, Homo sapiens
tctggaatgcagtgg

SEQ ID NO: 3714667 - DNA, 18 bp, Homo sapiens
tctggaatgtaatcaatg

SEQ ID NO: 3714668 - DNA, 19 bp, Homo sapiens
tctggaatttaaggcccaa

SEQ ID NO: 3714669 - DNA, 13 bp, Homo sapiens
tctggactgaagc

SEQ ID NO: 3714670 - DNA, 21 bp, Homo sapiens
tctggactgaagcctgcagga

SEQ ID NO: 3714671 - DNA, 16 bp, Homo sapiens
tctggagaataattct

SEQ ID NO: 3714672 - DNA, 22 bp, Homo sapiens
tctggagaggttataggtcact

SEQ ID NO: 3714673 - DNA, 16 bp, Homo sapiens
tctggagcccttgggt

SEQ ID NO: 3714674 - DNA, 14 bp, Homo sapiens
tctggaggcctctg

SEQ ID NO: 3714675 - DNA, 16 bp, Homo sapiens
tctggagggaaacacc

SEQ ID NO: 3714676 - DNA, 15 bp, Homo sapiens
tctggaggggagctc

SEQ ID NO: 3714677 - DNA, 21 bp, Homo sapiens
tctggagtctcacttgtctca

SEQ ID NO: 3714678 - DNA, 19 bp, Homo sapiens
tctggccctcacccctgcc

SEQ ID NO: 3714679 - DNA, 15 bp, Homo sapiens
tctggccctgccttc

SEQ ID NO: 3714680 - DNA, 16 bp, Homo sapiens
tctggccctgccttct

SEQ ID NO: 3714681 - DNA, 22 bp, Homo sapiens
tctggcgacagttttccttctc

SEQ ID NO: 3714682 - DNA, 16 bp, Homo sapiens
tctggctaaggacagg

SEQ ID NO: 3714683 - DNA, 17 bp, Homo sapiens
tctggctagaggccagc

SEQ ID NO: 3714684 - DNA, 21 bp, Homo sapiens
tctggctagaggccagcccca

SEQ ID NO: 3714685 - DNA, 22 bp, Homo sapiens
tctggctagaggccagccccac

SEQ ID NO: 3714686 - DNA, 13 bp, Homo sapiens
tctggctctgtct

SEQ ID NO: 3714687 - DNA, 23 bp, Homo sapiens
tctggcttccagaaaaccccagc

SEQ ID NO: 3714688 - DNA, 15 bp, Homo sapiens
tctgggaactcccaa

SEQ ID NO: 3714689 - DNA, 16 bp, Homo sapiens
tctgggacctcagttt

SEQ ID NO: 3714690 - DNA, 18 bp, Homo sapiens
tctgggcaggacctcaga

SEQ ID NO: 3714691 - DNA, 18 bp, Homo sapiens
tctgggccaagtcaaaga

SEQ ID NO: 3714692 - DNA, 18 bp, Homo sapiens
tctggggatactggcaaa

SEQ ID NO: 3714693 - DNA, 13 bp, Homo sapiens
tctgggggtcagg

SEQ ID NO: 3714694 - DNA, 17 bp, Homo sapiens
tctggggttcagcccct

SEQ ID NO: 3714695 - DNA, 19 bp, Homo sapiens
tctggggttcagcccctcc

SEQ ID NO: 3714696 - DNA, 22 bp, Homo sapiens
tctggggttcagcccctcctct

SEQ ID NO: 3714697 - DNA, 18 bp, Homo sapiens
tctgggtgctccctacca

SEQ ID NO: 3714698 - DNA, 19 bp, Homo sapiens
tctgggtggttgcccttca

SEQ ID NO: 3714699 - DNA, 13 bp, Homo sapiens
tctgggttctggg

SEQ ID NO: 3714700 - DNA, 13 bp, Homo sapiens
tctggtagacaca

SEQ ID NO: 3714701 - DNA, 14 bp, Homo sapiens
tctggtcccttgca

SEQ ID NO: 3714702 - DNA, 16 bp, Homo sapiens
tctggttagctcagcc

SEQ ID NO: 3714703 - DNA, 20 bp, Homo sapiens
tctgtaacgcctgcttgtcc

SEQ ID NO: 3714704 - DNA, 23 bp, Homo sapiens
tctgtagtactccttaagaacac

SEQ ID NO: 3714705 - DNA, 21 bp, Homo sapiens
tctgtcatctaccttttctct

SEQ ID NO: 3714706 - DNA, 15 bp, Homo sapiens
tctgtcatttgagca

SEQ ID NO: 3714707 - DNA, 20 bp, Homo sapiens
tctgtcatttgagcagggct

SEQ ID NO: 3714708 - DNA, 15 bp, Homo sapiens
tctgtccaaaggagg

SEQ ID NO: 3714709 - DNA, 23 bp, Homo sapiens
tctgtccaaaggaggctggcagg

SEQ ID NO: 3714710 - DNA, 24 bp, Homo sapiens
tctgtccaggcactgctgcccagc

SEQ ID NO: 3714711 - DNA, 15 bp, Homo sapiens
tctgtcctactctgt

SEQ ID NO: 3714712 - DNA, 14 bp, Homo sapiens
tgagatcagcctgg

SEQ ID NO: 3714713 - DNA, 22 bp, Homo sapiens
tgagatctaagcctttccataa

SEQ ID NO: 3714714 - DNA, 21 bp, Homo sapiens
tgagatggaacccttttggcc

SEQ ID NO: 3714715 - DNA, 15 bp, Homo sapiens
tgagattattttaat

SEQ ID NO: 3714716 - DNA, 18 bp, Homo sapiens
tgagcaaactaacttgac

SEQ ID NO: 3714717 - DNA, 15 bp, Homo sapiens
tgagcaaatgtggct

SEQ ID NO: 3714718 - DNA, 18 bp, Homo sapiens
tgagcaaatgtggctcct

SEQ ID NO: 3714719 - DNA, 15 bp, Homo sapiens
tgagcacctcccagc

SEQ ID NO: 3714720 - DNA, 21 bp, Homo sapiens
tgagcactaaggtgtgctctg

SEQ ID NO: 3714721 - DNA, 22 bp, Homo sapiens
tgagcactaaggtgtgctctga

SEQ ID NO: 3714722 - DNA, 16 bp, Homo sapiens
tgagcagactggtgag

SEQ ID NO: 3714723 - DNA, 19 bp, Homo sapiens
tgagcagactggtgagcag

SEQ ID NO: 3714724 - DNA, 16 bp, Homo sapiens
tgagcagggctcagcg

SEQ ID NO: 3714725 - DNA, 22 bp, Homo sapiens
tgagcagggctcagcggggaca

SEQ ID NO: 3714726 - DNA, 17 bp, Homo sapiens
tgagcagtgtgtctcct

SEQ ID NO: 3714727 - DNA, 22 bp, Homo sapiens
tgagcattgtggctgtcagcag

SEQ ID NO: 3714728 - DNA, 23 bp, Homo sapiens
tgagcattgtggctgtcagcagg

SEQ ID NO: 3714729 - DNA, 17 bp, Homo sapiens
tgagccaccgctgccag

SEQ ID NO: 3714730 - DNA, 18 bp, Homo sapiens
tgagcccagccctgttct

SEQ ID NO: 3714731 - DNA, 13 bp, Homo sapiens
tgagcccaggagt

SEQ ID NO: 3714732 - DNA, 17 bp, Homo sapiens
tgagcccggatgcttct

SEQ ID NO: 3714733 - DNA, 21 bp, Homo sapiens
tgagccgagatcacgccactg

SEQ ID NO: 3714734 - DNA, 17 bp, Homo sapiens
tgagccgcatcttctcc

SEQ ID NO: 3714735 - DNA, 21 bp, Homo sapiens
tgagccgcatcttctccatct

SEQ ID NO: 3714736 - DNA, 16 bp, Homo sapiens
tgagcctacagatgaa

SEQ ID NO: 3714737 - DNA, 22 bp, Homo sapiens
tgagcctgggaggtcaaggctg

SEQ ID NO: 3714738 - DNA, 16 bp, Homo sapiens
tgagctcagaccccca

SEQ ID NO: 3714739 - DNA, 17 bp, Homo sapiens
tgagctcagacccccac

SEQ ID NO: 3714740 - DNA, 20 bp, Homo sapiens
tgagctcagacccccactct

SEQ ID NO: 3714741 - DNA, 15 bp, Homo sapiens
tgagctcatgtagca

SEQ ID NO: 3714742 - DNA, 12 bp, Homo sapiens
tgagctccagac

SEQ ID NO: 3714743 - DNA, 15 bp, Homo sapiens
tgagctccagacccc

SEQ ID NO: 3714744 - DNA, 13 bp, Homo sapiens
tgagctcctctgg

SEQ ID NO: 3714745 - DNA, 14 bp, Homo sapiens
tgagctcctctggg

SEQ ID NO: 3714746 - DNA, 13 bp, Homo sapiens
tgagctgagcagg

SEQ ID NO: 3714747 - DNA, 16 bp, Homo sapiens
tgagctgagcagggag

SEQ ID NO: 3714748 - DNA, 15 bp, Homo sapiens
tgagctgccatccag

SEQ ID NO: 3714749 - DNA, 11 bp, Homo sapiens
tgagctgtttt

SEQ ID NO: 3714750 - DNA, 20 bp, Homo sapiens
tgagcttggcagctgaacta

SEQ ID NO: 3714751 - DNA, 14 bp, Homo sapiens
tgagcttggccaga

SEQ ID NO: 3714752 - DNA, 16 bp, Homo sapiens
tgagcttggccagaag

SEQ ID NO: 3714753 - DNA, 23 bp, Homo sapiens
tgagctttggacacacacagctt

SEQ ID NO: 3714754 - DNA, 21 bp, Homo sapiens
tgagctttggacgcacacagc

SEQ ID NO: 3714755 - DNA, 23 bp, Homo sapiens
tgagctttggacgcacacagctt

SEQ ID NO: 3714756 - DNA, 19 bp, Homo sapiens
tgaggaaaggccagctggc

SEQ ID NO: 3714757 - DNA, 19 bp, Homo sapiens
tgaggaatcaacagggcag

SEQ ID NO: 3714758 - DNA, 11 bp, Homo sapiens
tgaggagctgc

SEQ ID NO: 3714759 - DNA, 13 bp, Homo sapiens
tgaggagctgctg

SEQ ID NO: 3714760 - DNA, 17 bp, Homo sapiens
tgaggagctgctggctt

SEQ ID NO: 3714761 - DNA, 12 bp, Homo sapiens
tgaggaggaagg

SEQ ID NO: 3714762 - DNA, 18 bp, Homo sapiens
tgaggaggaaggagagaa

SEQ ID NO: 3714763 - DNA, 19 bp, Homo sapiens
tgaggagtttcctaaaagt

SEQ ID NO: 3714764 - DNA, 16 bp, Homo sapiens
tgaggatcagaaagta

SEQ ID NO: 3714765 - DNA, 16 bp, Homo sapiens
tgaggcaatgtcagga

SEQ ID NO: 3714766 - DNA, 21 bp, Homo sapiens
tgaggcaatgtcaggaacaga

SEQ ID NO: 3714767 - DNA, 20 bp, Homo sapiens
tgaggcacatgtcagcaagt

SEQ ID NO: 3714768 - DNA, 19 bp, Homo sapiens
tgaggcctcagtggacttt

SEQ ID NO: 3714769 - DNA, 22 bp, Homo sapiens
tgaggctggactccagatctgc

SEQ ID NO: 3714770 - DNA, 17 bp, Homo sapiens
tgagggaacagacagga

SEQ ID NO: 3714771 - DNA, 20 bp, Homo sapiens
tgagggaacagacaggagaa

SEQ ID NO: 3714772 - DNA, 21 bp, Homo sapiens
tgagggacaaatttaaaacaa

SEQ ID NO: 3714773 - DNA, 22 bp, Homo sapiens
tgagggacaaatttaaaacaaa

SEQ ID NO: 3714774 - DNA, 23 bp, Homo sapiens
tgagggacaaatttaaaacaaac

SEQ ID NO: 3714775 - DNA, 14 bp, Homo sapiens
tgagggataagcaa

SEQ ID NO: 3714776 - DNA, 17 bp, Homo sapiens
tgagggcgaggggaggg

SEQ ID NO: 3714777 - DNA, 21 bp, Homo sapiens
tgaggggaggaaactcacctg

SEQ ID NO: 3714778 - DNA, 22 bp, Homo sapiens
tgaggggaggatcactggagcc

SEQ ID NO: 3714779 - DNA, 17 bp, Homo sapiens
tgaggggcatctgcccc

SEQ ID NO: 3714780 - DNA, 22 bp, Homo sapiens
tgaggggcatctgcccctcccc

SEQ ID NO: 3714781 - DNA, 15 bp, Homo sapiens
tgaggggctcctgga

SEQ ID NO: 3714782 - DNA, 20 bp, Homo sapiens
tgaggtcaagtaagaagaca

SEQ ID NO: 3714783 - DNA, 14 bp, Homo sapiens
tgaggtcagagcct

SEQ ID NO: 3714784 - DNA, 16 bp, Homo sapiens
tgaggtcagagcctgc

SEQ ID NO: 3714785 - DNA, 13 bp, Homo sapiens
tgaggtcccaggc

SEQ ID NO: 3714786 - DNA, 19 bp, Homo sapiens
tgaggtcccaggcagagaa

SEQ ID NO: 3714787 - DNA, 16 bp, Homo sapiens
tgaggtcctgggggcc

SEQ ID NO: 3714788 - DNA, 17 bp, Homo sapiens
tgaggtctcttgaggga

SEQ ID NO: 3714789 - DNA, 20 bp, Homo sapiens
tgaggtcttttgacatgtgg

SEQ ID NO: 3714790 - DNA, 23 bp, Homo sapiens
tgaggtcttttgacatgtggaaa

SEQ ID NO: 3714791 - DNA, 13 bp, Homo sapiens
tgaggtggtctga

SEQ ID NO: 3714792 - DNA, 17 bp, Homo sapiens
tgaggtggtctgaatgt

SEQ ID NO: 3714793 - DNA, 22 bp, Homo sapiens
tgaggtggtctgaatgttctga

SEQ ID NO: 3714794 - DNA, 12 bp, Homo sapiens
tgaggttaggag

SEQ ID NO: 3714795 - DNA, 19 bp, Homo sapiens
tgaggtttcaaacctccct

SEQ ID NO: 3714796 - DNA, 21 bp, Homo sapiens
tgaggtttccttcagacagat

SEQ ID NO: 3714797 - DNA, 23 bp, Homo sapiens
tgagtaagagctggtgtctgatt

SEQ ID NO: 3714798 - DNA, 21 bp, Homo sapiens
tgagtatctcctcgcaagctg

SEQ ID NO: 3714799 - DNA, 18 bp, Homo sapiens
tgagtcaccaagcccagt

SEQ ID NO: 3714800 - DNA, 22 bp, Homo sapiens
tgagtcaccctacctgtgcctg

SEQ ID NO: 3714801 - DNA, 21 bp, Homo sapiens
tgagtcatgatctccctgccg

SEQ ID NO: 3714802 - DNA, 22 bp, Homo sapiens
tgagtcatgatctccctgccgc

SEQ ID NO: 3714803 - DNA, 13 bp, Homo sapiens
tgagtccagaagt

SEQ ID NO: 3714804 - DNA, 21 bp, Homo sapiens
tgagtcccttccaggccatca

SEQ ID NO: 3714805 - DNA, 15 bp, Homo sapiens
tgagtgatcctccaa

SEQ ID NO: 3714806 - DNA, 22 bp, Homo sapiens
tgagtggggagacacctcagag

SEQ ID NO: 3714807 - DNA, 21 bp, Homo sapiens
tgagtgggtgaataatacagt

SEQ ID NO: 3714808 - DNA, 15 bp, Homo sapiens
tgagtgtaagtgtga

SEQ ID NO: 3714809 - DNA, 15 bp, Homo sapiens
tgagttacttcctat

SEQ ID NO: 3714810 - DNA, 20 bp, Homo sapiens
tgagttggtgttgacatgtg

SEQ ID NO: 3714811 - DNA, 14 bp, Homo sapiens
tgagtttaaagcaa

SEQ ID NO: 3714812 - DNA, 19 bp, Homo sapiens
tgagtttaccatttgtaat

SEQ ID NO: 3714813 - DNA, 18 bp, Homo sapiens
tgagttttattgagaatt

SEQ ID NO: 3714814 - DNA, 19 bp, Homo sapiens
tgagtttttatggggctga

SEQ ID NO: 3714815 - DNA, 17 bp, Homo sapiens
tgagttttttctcttgg

SEQ ID NO: 3714816 - DNA, 18 bp, Homo sapiens
tgagttttttctcttggg

SEQ ID NO: 3714817 - DNA, 14 bp, Homo sapiens
tgataaaaaatttt

SEQ ID NO: 3714818 - DNA, 16 bp, Homo sapiens
tgataaaaaattttgt

SEQ ID NO: 3714819 - DNA, 22 bp, Homo sapiens
tgataaaaaattttgtaatttt

SEQ ID NO: 3714820 - DNA, 17 bp, Homo sapiens
tgataaagaaaagaatc

SEQ ID NO: 3714821 - DNA, 23 bp, Homo sapiens
tgataacagctaccatgacaacc

SEQ ID NO: 3714822 - DNA, 20 bp, Homo sapiens
tgataaggatcagaacagca

SEQ ID NO: 3714823 - DNA, 15 bp, Homo sapiens
tgatacttttgacaa

SEQ ID NO: 3714824 - DNA, 13 bp, Homo sapiens
tgcccctgctgcc

SEQ ID NO: 3714825 - DNA, 23 bp, Homo sapiens
tgcccctgctgcctccccaaccc

SEQ ID NO: 3714826 - DNA, 15 bp, Homo sapiens
tgccccttctacact

SEQ ID NO: 3714827 - DNA, 16 bp, Homo sapiens
tgcccgagctggtgca

SEQ ID NO: 3714828 - DNA, 21 bp, Homo sapiens
tgcccggagattggacggcct

SEQ ID NO: 3714829 - DNA, 16 bp, Homo sapiens
tgcccggattctggga

SEQ ID NO: 3714830 - DNA, 17 bp, Homo sapiens
tgcccggattctgggag

SEQ ID NO: 3714831 - DNA, 23 bp, Homo sapiens
tgcccggggcagctgccagagaa

SEQ ID NO: 3714832 - DNA, 13 bp, Homo sapiens
tgcccgtcttcag

SEQ ID NO: 3714833 - DNA, 17 bp, Homo sapiens
tgcccgtcttcagccta

SEQ ID NO: 3714834 - DNA, 19 bp, Homo sapiens
tgcccgtcttcagcctagc

SEQ ID NO: 3714835 - DNA, 16 bp, Homo sapiens
tgccctagatgagccc

SEQ ID NO: 3714836 - DNA, 14 bp, Homo sapiens
tgccctagctccac

SEQ ID NO: 3714837 - DNA, 21 bp, Homo sapiens
tgccctccacagccgcagcct

SEQ ID NO: 3714838 - DNA, 17 bp, Homo sapiens
tgccctccactgccctc

SEQ ID NO: 3714839 - DNA, 14 bp, Homo sapiens
tgccctccatcccg

SEQ ID NO: 3714840 - DNA, 17 bp, Homo sapiens
tgccctccatcccgaca

SEQ ID NO: 3714841 - DNA, 11 bp, Homo sapiens
tgccctgctgc

SEQ ID NO: 3714842 - DNA, 18 bp, Homo sapiens
tgccctggatccatcagg

SEQ ID NO: 3714843 - DNA, 16 bp, Homo sapiens
tgccctgggatgtcca

SEQ ID NO: 3714844 - DNA, 21 bp, Homo sapiens
tgccctggtccagggaagctg

SEQ ID NO: 3714845 - DNA, 16 bp, Homo sapiens
tgccctggtgctgcca

SEQ ID NO: 3714846 - DNA, 15 bp, Homo sapiens
tgccctggtttcact

SEQ ID NO: 3714847 - DNA, 17 bp, Homo sapiens
tgccctggtttcactgg

SEQ ID NO: 3714848 - DNA, 17 bp, Homo sapiens
tgcccttcacagtgttt

SEQ ID NO: 3714849 - DNA, 13 bp, Homo sapiens
tgccgaaactgga

SEQ ID NO: 3714850 - DNA, 18 bp, Homo sapiens
tgccgaaactggaagtta

SEQ ID NO: 3714851 - DNA, 21 bp, Homo sapiens
tgccgaccagagccccacacg

SEQ ID NO: 3714852 - DNA, 12 bp, Homo sapiens
tgccgcacccca

SEQ ID NO: 3714853 - DNA, 23 bp, Homo sapiens
tgccgcccgaggtggctgcctgg

SEQ ID NO: 3714854 - DNA, 16 bp, Homo sapiens
tgccgcctcaatgtgg

SEQ ID NO: 3714855 - DNA, 14 bp, Homo sapiens
tgccgcctcccagc

SEQ ID NO: 3714856 - DNA, 17 bp, Homo sapiens
tgccgcctcccagcctg

SEQ ID NO: 3714857 - DNA, 18 bp, Homo sapiens
tgccgcctcccagcctgg

SEQ ID NO: 3714858 - DNA, 23 bp, Homo sapiens
tgccgtgggcctgtcgtgccagt

SEQ ID NO: 3714859 - DNA, 19 bp, Homo sapiens
tgccgttactctccaacct

SEQ ID NO: 3714860 - DNA, 13 bp, Homo sapiens
tgcctaagccctc

SEQ ID NO: 3714861 - DNA, 17 bp, Homo sapiens
tgcctaagtattccttt

SEQ ID NO: 3714862 - DNA, 17 bp, Homo sapiens
tgcctaagtggctgctg

SEQ ID NO: 3714863 - DNA, 18 bp, Homo sapiens
tgcctaataaacatcctt

SEQ ID NO: 3714864 - DNA, 18 bp, Homo sapiens
tgcctaatacattaaagc

SEQ ID NO: 3714865 - DNA, 15 bp, Homo sapiens
tgcctacattatcta

SEQ ID NO: 3714866 - DNA, 19 bp, Homo sapiens
tgcctagcactcacatgct

SEQ ID NO: 3714867 - DNA, 17 bp, Homo sapiens
tgcctaggaattcccag

SEQ ID NO: 3714868 - DNA, 17 bp, Homo sapiens
tgcctatagtcccagct

SEQ ID NO: 3714869 - DNA, 22 bp, Homo sapiens
tgcctcaatgtgaatcagaccc

SEQ ID NO: 3714870 - DNA, 24 bp, Homo sapiens
tgcctcaatgtgaatcagacccta

SEQ ID NO: 3714871 - DNA, 13 bp, Homo sapiens
tgcctcagcctcc

SEQ ID NO: 3714872 - DNA, 14 bp, Homo sapiens
tgcctcagcctccc

SEQ ID NO: 3714873 - DNA, 18 bp, Homo sapiens
tgcctcagtaaaatgaac

SEQ ID NO: 3714874 - DNA, 15 bp, Homo sapiens
tgcctccatggtgcc

SEQ ID NO: 3714875 - DNA, 15 bp, Homo sapiens
tgcctccccaaccct

SEQ ID NO: 3714876 - DNA, 20 bp, Homo sapiens
tgcctccccaaccctgcccc

SEQ ID NO: 3714877 - DNA, 23 bp, Homo sapiens
tgcctccccaaccctgcccctgc

SEQ ID NO: 3714878 - DNA, 20 bp, Homo sapiens
tgcctccctgaccctgcaga

SEQ ID NO: 3714879 - DNA, 15 bp, Homo sapiens
tgcctccctgtccac

SEQ ID NO: 3714880 - DNA, 20 bp, Homo sapiens
tgcctcgaactggctgcaaa

SEQ ID NO: 3714881 - DNA, 14 bp, Homo sapiens
tgcctctgacacac

SEQ ID NO: 3714882 - DNA, 16 bp, Homo sapiens
tgcctctgacacacag

SEQ ID NO: 3714883 - DNA, 20 bp, Homo sapiens
tgcctctgacacacagctct

SEQ ID NO: 3714884 - DNA, 13 bp, Homo sapiens
tgcctctgcctct

SEQ ID NO: 3714885 - DNA, 15 bp, Homo sapiens
tgcctctgcctctga

SEQ ID NO: 3714886 - DNA, 18 bp, Homo sapiens
tgcctctgcctgtctccc

SEQ ID NO: 3714887 - DNA, 21 bp, Homo sapiens
tgcctcttctctactctaggg

SEQ ID NO: 3714888 - DNA, 14 bp, Homo sapiens
tgcctgcaccagga

SEQ ID NO: 3714889 - DNA, 16 bp, Homo sapiens
tgcctgcaccaggaga

SEQ ID NO: 3714890 - DNA, 17 bp, Homo sapiens
tgcctgcaccaggagac

SEQ ID NO: 3714891 - DNA, 19 bp, Homo sapiens
tgcctgcaccaggagacag

SEQ ID NO: 3714892 - DNA, 15 bp, Homo sapiens
tgcctgcagccccgc

SEQ ID NO: 3714893 - DNA, 13 bp, Homo sapiens
tgcctgcattctg

SEQ ID NO: 3714894 - DNA, 15 bp, Homo sapiens
tgcctgcccacccgt

SEQ ID NO: 3714895 - DNA, 14 bp, Homo sapiens
tgcctgcccaggcc

SEQ ID NO: 3714896 - DNA, 20 bp, Homo sapiens
tgcctgcccaggcccctgcc

SEQ ID NO: 3714897 - DNA, 17 bp, Homo sapiens
tgcctgcggtcaaggcc

SEQ ID NO: 3714898 - DNA, 14 bp, Homo sapiens
tgcctgctttagaa

SEQ ID NO: 3714899 - DNA, 19 bp, Homo sapiens
tgcctggaagagcagccct

SEQ ID NO: 3714900 - DNA, 20 bp, Homo sapiens
tgcctggagccccactgccc

SEQ ID NO: 3714901 - DNA, 21 bp, Homo sapiens
tgcctgggaaccttcctgtct

SEQ ID NO: 3714902 - DNA, 16 bp, Homo sapiens
tgcctgggaatgtatt

SEQ ID NO: 3714903 - DNA, 21 bp, Homo sapiens
tgcctgggtggggctgctcct

SEQ ID NO: 3714904 - DNA, 24 bp, Homo sapiens
tgcctgggtggggctgctcctcca

SEQ ID NO: 3714905 - DNA, 22 bp, Homo sapiens
tgcctgggttccaatcctggct

SEQ ID NO: 3714906 - DNA, 20 bp, Homo sapiens
tgcctggtctcctgccccca

SEQ ID NO: 3714907 - DNA, 15 bp, Homo sapiens
tgcctggtggcagct

SEQ ID NO: 3714908 - DNA, 16 bp, Homo sapiens
tgcctgtagtcccagg

SEQ ID NO: 3714909 - DNA, 19 bp, Homo sapiens
tgcctgtagttaggaaata

SEQ ID NO: 3714910 - DNA, 21 bp, Homo sapiens
tgcctgtagttaggaaataaa

SEQ ID NO: 3714911 - DNA, 16 bp, Homo sapiens
tgcctgtccagcctgg

SEQ ID NO: 3714912 - DNA, 19 bp, Homo sapiens
tgcctgtccagcctgggca

SEQ ID NO: 3714913 - DNA, 11 bp, Homo sapiens
tgcctgtctcc

SEQ ID NO: 3714914 - DNA, 22 bp, Homo sapiens
tgcctgtctcctttgcaggctc

SEQ ID NO: 3714915 - DNA, 23 bp, Homo sapiens
tgcctgtctcctttgcaggctca

SEQ ID NO: 3714916 - DNA, 17 bp, Homo sapiens
tgcctgtgaggcagggg

SEQ ID NO: 3714917 - DNA, 16 bp, Homo sapiens
tgcctgtgccaataaa

SEQ ID NO: 3714918 - DNA, 21 bp, Homo sapiens
tgcctgtgtgacatcagtggc

SEQ ID NO: 3714919 - DNA, 14 bp, Homo sapiens
tgcctgttcccatt

SEQ ID NO: 3714920 - DNA, 16 bp, Homo sapiens
tgccttaactggagcc

SEQ ID NO: 3714921 - DNA, 14 bp, Homo sapiens
tgccttacctcctg

SEQ ID NO: 3714922 - DNA, 17 bp, Homo sapiens
tgccttacctcctgccc

SEQ ID NO: 3714923 - DNA, 19 bp, Homo sapiens
tgccttacctcctgcccag

SEQ ID NO: 3714924 - DNA, 15 bp, Homo sapiens
tgccttactttgtat

SEQ ID NO: 3714925 - DNA, 17 bp, Homo sapiens
tgccttactttgtatga

SEQ ID NO: 3714926 - DNA, 18 bp, Homo sapiens
tgccttcagctctacagc

SEQ ID NO: 3714927 - DNA, 13 bp, Homo sapiens
tgccttccacgct

SEQ ID NO: 3714928 - DNA, 20 bp, Homo sapiens
tgccttccacgctgtctcca

SEQ ID NO: 3714929 - DNA, 22 bp, Homo sapiens
tgccttccacgctgtctccaga

SEQ ID NO: 3714930 - DNA, 23 bp, Homo sapiens
tgccttccacgctgtctccagac

SEQ ID NO: 3714931 - DNA, 14 bp, Homo sapiens
tgccttccataatt

SEQ ID NO: 3714932 - DNA, 17 bp, Homo sapiens
tgccttccataattatg

SEQ ID NO: 3714933 - DNA, 21 bp, Homo sapiens
tgccttccataattatgacag

SEQ ID NO: 3714934 - DNA, 20 bp, Homo sapiens
tgccttcgttaactgtgtat

SEQ ID NO: 3714935 - DNA, 23 bp, Homo sapiens
tgccttcttcggggaactcctgg

SEQ ID NO: 3714936 - DNA, 17 bp, Homo sapiens
tgccttgggctgctcct

SEQ ID NO: 3714937 - DNA, 15 bp, Homo sapiens
tggcatctgacacaa

SEQ ID NO: 3714938 - DNA, 16 bp, Homo sapiens
tggcatgggggcctca

SEQ ID NO: 3714939 - DNA, 13 bp, Homo sapiens
tggcattaaaact

SEQ ID NO: 3714940 - DNA, 19 bp, Homo sapiens
tggccaaacatcagacctg

SEQ ID NO: 3714941 - DNA, 14 bp, Homo sapiens
tggccaaagtgtta

SEQ ID NO: 3714942 - DNA, 22 bp, Homo sapiens
tggccactccagacccctggct

SEQ ID NO: 3714943 - DNA, 22 bp, Homo sapiens
tggccagaccagagctctggag

SEQ ID NO: 3714944 - DNA, 15 bp, Homo sapiens
tggccagatgcacca

SEQ ID NO: 3714945 - DNA, 14 bp, Homo sapiens
tggccagcagcttg

SEQ ID NO: 3714946 - DNA, 20 bp, Homo sapiens
tggccaggagctcttcaggc

SEQ ID NO: 3714947 - DNA, 14 bp, Homo sapiens
tggccaggatggag

SEQ ID NO: 3714948 - DNA, 20 bp, Homo sapiens
tggccatggtccccaagacc

SEQ ID NO: 3714949 - DNA, 19 bp, Homo sapiens
tggcccacgcacttcggga

SEQ ID NO: 3714950 - DNA, 22 bp, Homo sapiens
tggcccagccaaaccctgtctg

SEQ ID NO: 3714951 - DNA, 15 bp, Homo sapiens
tggcccccactggct

SEQ ID NO: 3714952 - DNA, 18 bp, Homo sapiens
tggcccccactggctgtg

SEQ ID NO: 3714953 - DNA, 20 bp, Homo sapiens
tggcccccactggctgtggg

SEQ ID NO: 3714954 - DNA, 19 bp, Homo sapiens
tggcccctagaatcagcct

SEQ ID NO: 3714955 - DNA, 13 bp, Homo sapiens
tggcccctcacct

SEQ ID NO: 3714956 - DNA, 14 bp, Homo sapiens
tggcccctgcccgg

SEQ ID NO: 3714957 - DNA, 20 bp, Homo sapiens
tggcccctgcccggctgcgg

SEQ ID NO: 3714958 - DNA, 21 bp, Homo sapiens
tggcccctgcccggctgcgga

SEQ ID NO: 3714959 - DNA, 13 bp, Homo sapiens
tggccccttcact

SEQ ID NO: 3714960 - DNA, 16 bp, Homo sapiens
tggccctcacccctgc

SEQ ID NO: 3714961 - DNA, 14 bp, Homo sapiens
tggccctcagtttc

SEQ ID NO: 3714962 - DNA, 12 bp, Homo sapiens
tggccctctggt

SEQ ID NO: 3714963 - DNA, 16 bp, Homo sapiens
tggccctgccttcttc

SEQ ID NO: 3714964 - DNA, 14 bp, Homo sapiens
tggccctggcctgc

SEQ ID NO: 3714965 - DNA, 15 bp, Homo sapiens
tggccctggcctgct

SEQ ID NO: 3714966 - DNA, 12 bp, Homo sapiens
tggccctggggc

SEQ ID NO: 3714967 - DNA, 22 bp, Homo sapiens
tggcccttgcagttcagcacca

SEQ ID NO: 3714968 - DNA, 18 bp, Homo sapiens
tggccgagggtcctggct

SEQ ID NO: 3714969 - DNA, 13 bp, Homo sapiens
tggccgggcacag

SEQ ID NO: 3714970 - DNA, 23 bp, Homo sapiens
tggccgggcgcggtggctcacgc

SEQ ID NO: 3714971 - DNA, 16 bp, Homo sapiens
tggcctaaaaatgcaa

SEQ ID NO: 3714972 - DNA, 17 bp, Homo sapiens
tggcctcaaccctccct

SEQ ID NO: 3714973 - DNA, 18 bp, Homo sapiens
tggcctcaaccctccctc

SEQ ID NO: 3714974 - DNA, 19 bp, Homo sapiens
tggcctcaaccctccctca

SEQ ID NO: 3714975 - DNA, 20 bp, Homo sapiens
tggcctcaaccctccctcag

SEQ ID NO: 3714976 - DNA, 22 bp, Homo sapiens
tggcctcaaccctccctcagcc

SEQ ID NO: 3714977 - DNA, 23 bp, Homo sapiens
tggcctcaaccctccctcagccc

SEQ ID NO: 3714978 - DNA, 17 bp, Homo sapiens
tggcctcagctgcctca

SEQ ID NO: 3714979 - DNA, 15 bp, Homo sapiens
tggcctctgtcatat

SEQ ID NO: 3714980 - DNA, 15 bp, Homo sapiens
tggcctgaggagcag

SEQ ID NO: 3714981 - DNA, 14 bp, Homo sapiens
tggcctgcactaat

SEQ ID NO: 3714982 - DNA, 18 bp, Homo sapiens
tggcctggccaggagctc

SEQ ID NO: 3714983 - DNA, 14 bp, Homo sapiens
tggcctggctccgc

SEQ ID NO: 3714984 - DNA, 18 bp, Homo sapiens
tggcctgtttcaacacag

SEQ ID NO: 3714985 - DNA, 18 bp, Homo sapiens
tggccttgaaaccacctt

SEQ ID NO: 3714986 - DNA, 21 bp, Homo sapiens
tggcctttgcttatgaatatt

SEQ ID NO: 3714987 - DNA, 14 bp, Homo sapiens
tggcgcaagcctgt

SEQ ID NO: 3714988 - DNA, 15 bp, Homo sapiens
tggcggctactcagc

SEQ ID NO: 3714989 - DNA, 21 bp, Homo sapiens
tggcggctactcagcagccct

SEQ ID NO: 3714990 - DNA, 19 bp, Homo sapiens
tggctaatgtactgcatat

SEQ ID NO: 3714991 - DNA, 16 bp, Homo sapiens
tggctatttaaagaca

SEQ ID NO: 3714992 - DNA, 19 bp, Homo sapiens
tggctcacacctgtaatcc

SEQ ID NO: 3714993 - DNA, 19 bp, Homo sapiens
tggctcacgcctgtaatcc

SEQ ID NO: 3714994 - DNA, 19 bp, Homo sapiens
tggctcatattcctgcagc

SEQ ID NO: 3714995 - DNA, 22 bp, Homo sapiens
tggctcatattcctgcagcctg

SEQ ID NO: 3714996 - DNA, 14 bp, Homo sapiens
tggctcccacaggc

SEQ ID NO: 3714997 - DNA, 17 bp, Homo sapiens
tggctcccacaggccct

SEQ ID NO: 3714998 - DNA, 14 bp, Homo sapiens
tggctcccatgacc

SEQ ID NO: 3714999 - DNA, 14 bp, Homo sapiens
tggctcccctctat

SEQ ID NO: 3715000 - DNA, 23 bp, Homo sapiens
tggctcccctctatttagcatga

SEQ ID NO: 3715001 - DNA, 18 bp, Homo sapiens
tggctcctcccggtgccc

SEQ ID NO: 3715002 - DNA, 20 bp, Homo sapiens
tggctcctgaggggcatctg

SEQ ID NO: 3715003 - DNA, 19 bp, Homo sapiens
tggctctgaccgaaacagc

SEQ ID NO: 3715004 - DNA, 17 bp, Homo sapiens
tggctctggaatgacat

SEQ ID NO: 3715005 - DNA, 15 bp, Homo sapiens
tggctgacccagtcc

SEQ ID NO: 3715006 - DNA, 20 bp, Homo sapiens
tggctgacccagtccctggg

SEQ ID NO: 3715007 - DNA, 15 bp, Homo sapiens
tggctgacccccctc

SEQ ID NO: 3715008 - DNA, 23 bp, Homo sapiens
tggctgcaaagggtatcaggtgc

SEQ ID NO: 3715009 - DNA, 13 bp, Homo sapiens
tggctgcccacac

SEQ ID NO: 3715010 - DNA, 20 bp, Homo sapiens
tggctgcccagacccctctg

SEQ ID NO: 3715011 - DNA, 13 bp, Homo sapiens
tggctgctagcac

SEQ ID NO: 3715012 - DNA, 12 bp, Homo sapiens
tggctgggcatg

SEQ ID NO: 3715013 - DNA, 12 bp, Homo sapiens
tggctgggccca

SEQ ID NO: 3715014 - DNA, 15 bp, Homo sapiens
tggctgggcccagaa

SEQ ID NO: 3715015 - DNA, 16 bp, Homo sapiens
tggctgggcccagaag

SEQ ID NO: 3715016 - DNA, 16 bp, Homo sapiens
tggctgggggcaggag

SEQ ID NO: 3715017 - DNA, 17 bp, Homo sapiens
tggctgggggcaggagg

SEQ ID NO: 3715018 - DNA, 21 bp, Homo sapiens
tggctgggggcctcagtgcca

SEQ ID NO: 3715019 - DNA, 18 bp, Homo sapiens
tggctgtgcctctgcctg

SEQ ID NO: 3715020 - DNA, 13 bp, Homo sapiens
tggctgtgggctc

SEQ ID NO: 3715021 - DNA, 15 bp, Homo sapiens
tggctgttggctggg

SEQ ID NO: 3715022 - DNA, 14 bp, Homo sapiens
tggcttcacggaag

SEQ ID NO: 3715023 - DNA, 17 bp, Homo sapiens
tggcttcccgctcagcc

SEQ ID NO: 3715024 - DNA, 20 bp, Homo sapiens
tggcttcccgctcagccctc

SEQ ID NO: 3715025 - DNA, 12 bp, Homo sapiens
tggcttctgatg

SEQ ID NO: 3715026 - DNA, 18 bp, Homo sapiens
tggcttgggactaaatgc

SEQ ID NO: 3715027 - DNA, 15 bp, Homo sapiens
tggctttcagagcct

SEQ ID NO: 3715028 - DNA, 16 bp, Homo sapiens
tggctttccagtcata

SEQ ID NO: 3715029 - DNA, 17 bp, Homo sapiens
tggctttgcccaacctc

SEQ ID NO: 3715030 - DNA, 23 bp, Homo sapiens
tggctttgcccaacctcagcaac

SEQ ID NO: 3715031 - DNA, 13 bp, Homo sapiens
tggctttggaagc

SEQ ID NO: 3715032 - DNA, 16 bp, Homo sapiens
tggcttttcactgctg

SEQ ID NO: 3715033 - DNA, 23 bp, Homo sapiens
tgggaaaaatgcccttaaatcat

SEQ ID NO: 3715034 - DNA, 15 bp, Homo sapiens
tgggaaatggcttga

SEQ ID NO: 3715035 - DNA, 21 bp, Homo sapiens
tgggaacgcagatgatccatg

SEQ ID NO: 3715036 - DNA, 12 bp, Homo sapiens
tgggaagaaaca

SEQ ID NO: 3715037 - DNA, 14 bp, Homo sapiens
tgggaagaaacaaa

SEQ ID NO: 3715038 - DNA, 20 bp, Homo sapiens
tgggaagataggctctgcac

SEQ ID NO: 3715039 - DNA, 13 bp, Homo sapiens
tgggaagggagag

SEQ ID NO: 3715040 - DNA, 16 bp, Homo sapiens
tgggacagggcatggc

SEQ ID NO: 3715041 - DNA, 13 bp, Homo sapiens
tgggaccctttcc

SEQ ID NO: 3715042 - DNA, 14 bp, Homo sapiens
tgggaccctttcct

SEQ ID NO: 3715043 - DNA, 17 bp, Homo sapiens
tgggaccctttccttcc

SEQ ID NO: 3715044 - DNA, 18 bp, Homo sapiens
tgggaccctttccttcct

SEQ ID NO: 3715045 - DNA, 14 bp, Homo sapiens
tgggactacaggca

SEQ ID NO: 3715046 - DNA, 15 bp, Homo sapiens
tgggactacaggcac

SEQ ID NO: 3715047 - DNA, 18 bp, Homo sapiens
tgggactgctgcttctta

SEQ ID NO: 3715048 - DNA, 12 bp, Homo sapiens
tgggactgggag

SEQ ID NO: 3715049 - DNA, 15 bp, Homo sapiens
tgggactgggagggc

SEQ ID NO: 3715050 - DNA, 17 bp, Homo sapiens
tgggactgtacacactt

SEQ ID NO: 3715051 - DNA, 23 bp, Homo sapiens
tgtcggttttttttaaataaaag

SEQ ID NO: 3715052 - DNA, 15 bp, Homo sapiens
tgtcgtgccagtcct

SEQ ID NO: 3715053 - DNA, 17 bp, Homo sapiens
tgtctcagtccacctga

SEQ ID NO: 3715054 - DNA, 19 bp, Homo sapiens
tgtctccagacccccaccc

SEQ ID NO: 3715055 - DNA, 22 bp, Homo sapiens
tgtctccagacccccacccctt

SEQ ID NO: 3715056 - DNA, 23 bp, Homo sapiens
tgtctccctataatgctggagcg

SEQ ID NO: 3715057 - DNA, 14 bp, Homo sapiens
tgtctcttttctct

SEQ ID NO: 3715058 - DNA, 18 bp, Homo sapiens
tgtctcttttctctttct

SEQ ID NO: 3715059 - DNA, 17 bp, Homo sapiens
tgtctgaagtcactgca

SEQ ID NO: 3715060 - DNA, 18 bp, Homo sapiens
tgtctgaagtcactgcac

SEQ ID NO: 3715061 - DNA, 20 bp, Homo sapiens
tgtctgaagtcactgcacag

SEQ ID NO: 3715062 - DNA, 16 bp, Homo sapiens
tgtctgccagccagca

SEQ ID NO: 3715063 - DNA, 23 bp, Homo sapiens
tgtctggctgaggatttcaagcc

SEQ ID NO: 3715064 - DNA, 13 bp, Homo sapiens
tgtcttaattaag

SEQ ID NO: 3715065 - DNA, 14 bp, Homo sapiens
tgtcttatttttag

SEQ ID NO: 3715066 - DNA, 18 bp, Homo sapiens
tgtcttcctgcattcacc

SEQ ID NO: 3715067 - DNA, 22 bp, Homo sapiens
tgtcttctcaggctctgccctg

SEQ ID NO: 3715068 - DNA, 17 bp, Homo sapiens
tgtcttgcaatggcagc

SEQ ID NO: 3715069 - DNA, 15 bp, Homo sapiens
tgtcttgttaatatt

SEQ ID NO: 3715070 - DNA, 14 bp, Homo sapiens
tgtctttaaggaaa

SEQ ID NO: 3715071 - DNA, 19 bp, Homo sapiens
tgtctttaggcagcagctt

SEQ ID NO: 3715072 - DNA, 12 bp, Homo sapiens
tgtctttatatg

SEQ ID NO: 3715073 - DNA, 20 bp, Homo sapiens
tgtctttcagatacatggtt

SEQ ID NO: 3715074 - DNA, 15 bp, Homo sapiens
tgtctttctttggtg

SEQ ID NO: 3715075 - DNA, 22 bp, Homo sapiens
tgtctttctttggtgcctttcc

SEQ ID NO: 3715076 - DNA, 19 bp, Homo sapiens
tgtctttgttggaaaagaa

SEQ ID NO: 3715077 - DNA, 23 bp, Homo sapiens
tgtgaaaagaaaaatgagcctgg

SEQ ID NO: 3715078 - DNA, 22 bp, Homo sapiens
tgtgaaagtcagatgcccagag

SEQ ID NO: 3715079 - DNA, 17 bp, Homo sapiens
tgtgaaccaccacaccc

SEQ ID NO: 3715080 - DNA, 19 bp, Homo sapiens
tgtgaaccaccacacccag

SEQ ID NO: 3715081 - DNA, 23 bp, Homo sapiens
tgtgaaccaccacacccagccca

SEQ ID NO: 3715082 - DNA, 20 bp, Homo sapiens
tgtgaacttggggaacaagg

SEQ ID NO: 3715083 - DNA, 22 bp, Homo sapiens
tgtgaagatgatatactatttt

SEQ ID NO: 3715084 - DNA, 14 bp, Homo sapiens
tgtgaagatgtttg

SEQ ID NO: 3715085 - DNA, 20 bp, Homo sapiens
tgtgaatatggactcagttt

SEQ ID NO: 3715086 - DNA, 18 bp, Homo sapiens
tgtgaatcagaccctacc

SEQ ID NO: 3715087 - DNA, 16 bp, Homo sapiens
tgtgaattgataataa

SEQ ID NO: 3715088 - DNA, 17 bp, Homo sapiens
tgtgaccagcactgtct

SEQ ID NO: 3715089 - DNA, 17 bp, Homo sapiens
tgtgaccctcaattcat

SEQ ID NO: 3715090 - DNA, 19 bp, Homo sapiens
tgtgactagtgctgaagct

SEQ ID NO: 3715091 - DNA, 22 bp, Homo sapiens
tgtgactagtgctgaagcttat

SEQ ID NO: 3715092 - DNA, 13 bp, Homo sapiens
tgtgagaccccca

SEQ ID NO: 3715093 - DNA, 17 bp, Homo sapiens
tgtgagagcgaggctga

SEQ ID NO: 3715094 - DNA, 19 bp, Homo sapiens
tgtgagcaagcatttatgt

SEQ ID NO: 3715095 - DNA, 18 bp, Homo sapiens
tgtgaggagctgctggct

SEQ ID NO: 3715096 - DNA, 20 bp, Homo sapiens
tgtgaggagctgctggcttg

SEQ ID NO: 3715097 - DNA, 12 bp, Homo sapiens
tgtgaggcaggg

SEQ ID NO: 3715098 - DNA, 15 bp, Homo sapiens
tgtgagtaagagctg

SEQ ID NO: 3715099 - DNA, 23 bp, Homo sapiens
tgtgagtgtgtccaagtgtgtgt

SEQ ID NO: 3715100 - DNA, 22 bp, Homo sapiens
tgtgatacccatagcttccatg

SEQ ID NO: 3715101 - DNA, 15 bp, Homo sapiens
tgtgatcagaccata

SEQ ID NO: 3715102 - DNA, 13 bp, Homo sapiens
tgtgatctgggaa

SEQ ID NO: 3715103 - DNA, 15 bp, Homo sapiens
tgtgatgccacacag

SEQ ID NO: 3715104 - DNA, 18 bp, Homo sapiens
tgtgcaaaaatttttgga

SEQ ID NO: 3715105 - DNA, 16 bp, Homo sapiens
tgtgcaagtgtatgca

SEQ ID NO: 3715106 - DNA, 12 bp, Homo sapiens
tgtgcaagtgtg

SEQ ID NO: 3715107 - DNA, 21 bp, Homo sapiens
tgtgcaagtgtgtgcatgtgt

SEQ ID NO: 3715108 - DNA, 22 bp, Homo sapiens
tgtgcacacacaccacacatac

SEQ ID NO: 3715109 - DNA, 18 bp, Homo sapiens
tgtgcacatgtgtgcgtg

SEQ ID NO: 3715110 - DNA, 19 bp, Homo sapiens
tgtgcatgggtgaagggag

SEQ ID NO: 3715111 - DNA, 15 bp, Homo sapiens
tgtgcatgtgtgtgc

SEQ ID NO: 3715112 - DNA, 20 bp, Homo sapiens
tgtgccacccaccagggcga

SEQ ID NO: 3715113 - DNA, 12 bp, Homo sapiens
tgtgcccagctc

SEQ ID NO: 3715114 - DNA, 16 bp, Homo sapiens
tgtgcccagctcagtc

SEQ ID NO: 3715115 - DNA, 15 bp, Homo sapiens
tgtgccccatgcctg

SEQ ID NO: 3715116 - DNA, 23 bp, Homo sapiens
tgtgccccatgcctgtccagcct

SEQ ID NO: 3715117 - DNA, 21 bp, Homo sapiens
tgtgcccccatgtaagcaccc

SEQ ID NO: 3715118 - DNA, 16 bp, Homo sapiens
tgtgcctcctcacccc

SEQ ID NO: 3715119 - DNA, 13 bp, Homo sapiens
tgtgcctctggga

SEQ ID NO: 3715120 - DNA, 16 bp, Homo sapiens
tgtgcctctgggactg

SEQ ID NO: 3715121 - DNA, 15 bp, Homo sapiens
tgtgcctgaccctac

SEQ ID NO: 3715122 - DNA, 14 bp, Homo sapiens
tgtgcctgcaccag

SEQ ID NO: 3715123 - DNA, 17 bp, Homo sapiens
tgtgcctgcaccaggag

SEQ ID NO: 3715124 - DNA, 22 bp, Homo sapiens
tgtgcgtgaaacacaccaggct

SEQ ID NO: 3715125 - DNA, 17 bp, Homo sapiens
tgtgctacatgacgaca

SEQ ID NO: 3715126 - DNA, 17 bp, Homo sapiens
tgtgctactgattgttt

SEQ ID NO: 3715127 - DNA, 17 bp, Homo sapiens
tgtgctcccctttgcct

SEQ ID NO: 3715128 - DNA, 23 bp, Homo sapiens
tgtgctctgatcatccactgtgc

SEQ ID NO: 3715129 - DNA, 13 bp, Homo sapiens
tgtgcttatgttt

SEQ ID NO: 3715130 - DNA, 17 bp, Homo sapiens
tgtggaaaatgaaaatt

SEQ ID NO: 3715131 - DNA, 14 bp, Homo sapiens
tgtggaaagcctct

SEQ ID NO: 3715132 - DNA, 20 bp, Homo sapiens
tgtggaaagcctctgctgcc

SEQ ID NO: 3715133 - DNA, 14 bp, Homo sapiens
tgtggaagggacta

SEQ ID NO: 3715134 - DNA, 18 bp, Homo sapiens
tgtggaagggactaggag

SEQ ID NO: 3715135 - DNA, 16 bp, Homo sapiens
tgtggacacagctctt

SEQ ID NO: 3715136 - DNA, 18 bp, Homo sapiens
tgtggacacagctcttct

SEQ ID NO: 3715137 - DNA, 19 bp, Homo sapiens
tgtggagcccgcaccccca

SEQ ID NO: 3715138 - DNA, 18 bp, Homo sapiens
tgtggcagtaaagagaaa

SEQ ID NO: 3715139 - DNA, 20 bp, Homo sapiens
tgtggcagtaaagagaaact

SEQ ID NO: 3715140 - DNA, 20 bp, Homo sapiens
tgtggccctggcctgctggg

SEQ ID NO: 3715141 - DNA, 22 bp, Homo sapiens
tgtggctcacgtgagagtgtct

SEQ ID NO: 3715142 - DNA, 21 bp, Homo sapiens
tgtggctcctgggggttcttt

SEQ ID NO: 3715143 - DNA, 15 bp, Homo sapiens
tgtggctgggggcag

SEQ ID NO: 3715144 - DNA, 15 bp, Homo sapiens
tgtggctgtcagcag

SEQ ID NO: 3715145 - DNA, 19 bp, Homo sapiens
tgtgggaagaaacaaaccc

SEQ ID NO: 3715146 - DNA, 17 bp, Homo sapiens
tgtgggactagcctggc

SEQ ID NO: 3715147 - DNA, 15 bp, Homo sapiens
tgtgggactgtacac

SEQ ID NO: 3715148 - DNA, 16 bp, Homo sapiens
tgtgggcaggaagtga

SEQ ID NO: 3715149 - DNA, 19 bp, Homo sapiens
tgtgggcctcaaggacttg

SEQ ID NO: 3715150 - DNA, 15 bp, Homo sapiens
tgtggttaatgccat

SEQ ID NO: 3715151 - DNA, 20 bp, Homo sapiens
tgtggttaatgccatggaca

SEQ ID NO: 3715152 - DNA, 19 bp, Homo sapiens
tgtggttatttttatacag

SEQ ID NO: 3715153 - DNA, 21 bp, Homo sapiens
tgtggttatttttatacagta

SEQ ID NO: 3715154 - DNA, 21 bp, Homo sapiens
tgtggtttagtgtaaaaatga

SEQ ID NO: 3715155 - DNA, 21 bp, Homo sapiens
tgtgtaaagtgtaaatccttt

SEQ ID NO: 3715156 - DNA, 18 bp, Homo sapiens
tgtgtaagagaatgttga

SEQ ID NO: 3715157 - DNA, 19 bp, Homo sapiens
tgtgtaagagaatgttgaa

SEQ ID NO: 3715158 - DNA, 15 bp, Homo sapiens
tgtgtaataaagtgt

SEQ ID NO: 3715159 - DNA, 23 bp, Homo sapiens
tgtgtaataaagtgttttcagag

SEQ ID NO: 3715160 - DNA, 23 bp, Homo sapiens
tgtgtacagaattctgctacctc

SEQ ID NO: 3715161 - DNA, 15 bp, Homo sapiens
tgtgtacgtggagag

SEQ ID NO: 3715162 - DNA, 17 bp, Homo sapiens
tgtgtactctggcctct

SEQ ID NO: 3715163 - DNA, 13 bp, Homo sapiens
ttagacctcagcc

SEQ ID NO: 3715164 - DNA, 14 bp, Homo sapiens
ttagacctcagcct

SEQ ID NO: 3715165 - DNA, 17 bp, Homo sapiens
ttagacttgaaatacta

SEQ ID NO: 3715166 - DNA, 18 bp, Homo sapiens
ttagactttagaaataaa

SEQ ID NO: 3715167 - DNA, 21 bp, Homo sapiens
ttagagcagatgacccctccc

SEQ ID NO: 3715168 - DNA, 18 bp, Homo sapiens
ttagagggaggagaatga

SEQ ID NO: 3715169 - DNA, 16 bp, Homo sapiens
ttagatatctttttat

SEQ ID NO: 3715170 - DNA, 16 bp, Homo sapiens
ttagatggttacactg

SEQ ID NO: 3715171 - DNA, 17 bp, Homo sapiens
ttagatggttacactgt

SEQ ID NO: 3715172 - DNA, 13 bp, Homo sapiens
ttagattttaatc

SEQ ID NO: 3715173 - DNA, 12 bp, Homo sapiens
ttagcagttctg

SEQ ID NO: 3715174 - DNA, 18 bp, Homo sapiens
ttagcagttctgcaaata

SEQ ID NO: 3715175 - DNA, 16 bp, Homo sapiens
ttagcagtttgctttg

SEQ ID NO: 3715176 - DNA, 21 bp, Homo sapiens
ttagcatgacaagccccaggc

SEQ ID NO: 3715177 - DNA, 15 bp, Homo sapiens
ttagcatgcacaaag

SEQ ID NO: 3715178 - DNA, 19 bp, Homo sapiens
ttagccaggtaatgtgaat

SEQ ID NO: 3715179 - DNA, 15 bp, Homo sapiens
ttagcctccctgaaa

SEQ ID NO: 3715180 - DNA, 20 bp, Homo sapiens
ttagcctgtggcagtaaaga

SEQ ID NO: 3715181 - DNA, 15 bp, Homo sapiens
ttagctgtctgctca

SEQ ID NO: 3715182 - DNA, 16 bp, Homo sapiens
ttagctgttatttcta

SEQ ID NO: 3715183 - DNA, 19 bp, Homo sapiens
ttagctgttatttctattt

SEQ ID NO: 3715184 - DNA, 17 bp, Homo sapiens
ttagcttagacctcagc

SEQ ID NO: 3715185 - DNA, 15 bp, Homo sapiens
ttagcttatcaattt

SEQ ID NO: 3715186 - DNA, 15 bp, Homo sapiens
ttagctttactgttt

SEQ ID NO: 3715187 - DNA, 17 bp, Homo sapiens
ttagctttactgtttgt

SEQ ID NO: 3715188 - DNA, 15 bp, Homo sapiens
ttaggaaataaaacc

SEQ ID NO: 3715189 - DNA, 18 bp, Homo sapiens
ttaggaaataaaaccttt

SEQ ID NO: 3715190 - DNA, 21 bp, Homo sapiens
ttaggaaataaaacctttcaa

SEQ ID NO: 3715191 - DNA, 13 bp, Homo sapiens
ttaggaagtgtaa

SEQ ID NO: 3715192 - DNA, 21 bp, Homo sapiens
ttaggaagtgtaacagctgag

SEQ ID NO: 3715193 - DNA, 18 bp, Homo sapiens
ttaggttaactatgtaca

SEQ ID NO: 3715194 - DNA, 15 bp, Homo sapiens
ttagtaaagaaatga

SEQ ID NO: 3715195 - DNA, 21 bp, Homo sapiens
ttagtagaaattttacaatag

SEQ ID NO: 3715196 - DNA, 13 bp, Homo sapiens
ttagtagagacag

SEQ ID NO: 3715197 - DNA, 17 bp, Homo sapiens
ttagtagagacagggtt

SEQ ID NO: 3715198 - DNA, 12 bp, Homo sapiens
ttagtagcatgt

SEQ ID NO: 3715199 - DNA, 19 bp, Homo sapiens
ttagtatatttatataatt

SEQ ID NO: 3715200 - DNA, 17 bp, Homo sapiens
ttagtatctaacatgta

SEQ ID NO: 3715201 - DNA, 18 bp, Homo sapiens
ttagtatctaacatgtat

SEQ ID NO: 3715202 - DNA, 15 bp, Homo sapiens
ttagtcatagaagaa

SEQ ID NO: 3715203 - DNA, 15 bp, Homo sapiens
ttagtcattttgctt

SEQ ID NO: 3715204 - DNA, 13 bp, Homo sapiens
ttagtcttctcat

SEQ ID NO: 3715205 - DNA, 18 bp, Homo sapiens
ttagtgtaaaaatgagaa

SEQ ID NO: 3715206 - DNA, 20 bp, Homo sapiens
ttagttgtatctcttttgaa

SEQ ID NO: 3715207 - DNA, 15 bp, Homo sapiens
ttagttttagttgca

SEQ ID NO: 3715208 - DNA, 19 bp, Homo sapiens
ttataaaaaaaatgaaatg

SEQ ID NO: 3715209 - DNA, 16 bp, Homo sapiens
ttataaaattaagcaa

SEQ ID NO: 3715210 - DNA, 15 bp, Homo sapiens
ttataaattaaatat

SEQ ID NO: 3715211 - DNA, 17 bp, Homo sapiens
ttataacagcattcttg

SEQ ID NO: 3715212 - DNA, 20 bp, Homo sapiens
ttataactcatcataaaata

SEQ ID NO: 3715213 - DNA, 22 bp, Homo sapiens
ttataactcatcataaaataaa

SEQ ID NO: 3715214 - DNA, 13 bp, Homo sapiens
ttataacttaaaa

SEQ ID NO: 3715215 - DNA, 17 bp, Homo sapiens
ttataacttaaaatatt

SEQ ID NO: 3715216 - DNA, 14 bp, Homo sapiens
ttataagcagattt

SEQ ID NO: 3715217 - DNA, 15 bp, Homo sapiens
ttataaggactgcat

SEQ ID NO: 3715218 - DNA, 18 bp, Homo sapiens
ttataagtagcaggccaa

SEQ ID NO: 3715219 - DNA, 13 bp, Homo sapiens
ttataatatacta

SEQ ID NO: 3715220 - DNA, 16 bp, Homo sapiens
ttataatttttttcaa

SEQ ID NO: 3715221 - DNA, 15 bp, Homo sapiens
ttatacaatatcatc

SEQ ID NO: 3715222 - DNA, 21 bp, Homo sapiens
ttatacagttttaaagaatca

SEQ ID NO: 3715223 - DNA, 16 bp, Homo sapiens
ttatagaagtttagat

SEQ ID NO: 3715224 - DNA, 21 bp, Homo sapiens
ttatagtgaattatccctttt

SEQ ID NO: 3715225 - DNA, 14 bp, Homo sapiens
ttatagtttataca

SEQ ID NO: 3715226 - DNA, 15 bp, Homo sapiens
ttatagtttatacag

SEQ ID NO: 3715227 - DNA, 17 bp, Homo sapiens
ttatataaagagaaaat

SEQ ID NO: 3715228 - DNA, 18 bp, Homo sapiens
ttatatagtttactattt

SEQ ID NO: 3715229 - DNA, 20 bp, Homo sapiens
ttatatatattttgtttctt

SEQ ID NO: 3715230 - DNA, 14 bp, Homo sapiens
ttatatatgtattt

SEQ ID NO: 3715231 - DNA, 23 bp, Homo sapiens
ttatatatttataactcatcata

SEQ ID NO: 3715232 - DNA, 22 bp, Homo sapiens
ttatatgtatccagtacattta

SEQ ID NO: 3715233 - DNA, 15 bp, Homo sapiens
ttatattgagacaaa

SEQ ID NO: 3715234 - DNA, 15 bp, Homo sapiens
ttatatttttataga

SEQ ID NO: 3715235 - DNA, 15 bp, Homo sapiens
ttatcaaaactttct

SEQ ID NO: 3715236 - DNA, 15 bp, Homo sapiens
ttatcaacaatagtg

SEQ ID NO: 3715237 - DNA, 20 bp, Homo sapiens
ttatcaatttgtcattttga

SEQ ID NO: 3715238 - DNA, 16 bp, Homo sapiens
ttatcagtgacagagt

SEQ ID NO: 3715239 - DNA, 17 bp, Homo sapiens
ttatcagtgacagagtt

SEQ ID NO: 3715240 - DNA, 16 bp, Homo sapiens
ttatcatgctgtcttt

SEQ ID NO: 3715241 - DNA, 16 bp, Homo sapiens
ttatcattttcaaaat

SEQ ID NO: 3715242 - DNA, 22 bp, Homo sapiens
ttatccaaggtgtaactctaat

SEQ ID NO: 3715243 - DNA, 17 bp, Homo sapiens
ttatccaatcttgtttc

SEQ ID NO: 3715244 - DNA, 21 bp, Homo sapiens
ttatcgccttttgacagctgt

SEQ ID NO: 3715245 - DNA, 16 bp, Homo sapiens
ttatcgggaacagtgt

SEQ ID NO: 3715246 - DNA, 17 bp, Homo sapiens
ttatcgggaacagtgtt

SEQ ID NO: 3715247 - DNA, 16 bp, Homo sapiens
ttatcgggagcagtgt

SEQ ID NO: 3715248 - DNA, 18 bp, Homo sapiens
ttatcgggagcagtgtct

SEQ ID NO: 3715249 - DNA, 15 bp, Homo sapiens
ttatctattgtaaga

SEQ ID NO: 3715250 - DNA, 21 bp, Homo sapiens
ttatctattgtaagataaaaa

SEQ ID NO: 3715251 - DNA, 13 bp, Homo sapiens
ttatctatttgta

SEQ ID NO: 3715252 - DNA, 22 bp, Homo sapiens
ttatctatttgtatatatacat

SEQ ID NO: 3715253 - DNA, 14 bp, Homo sapiens
ttatctggcttcaa

SEQ ID NO: 3715254 - DNA, 18 bp, Homo sapiens
ttatctgtgcgtgaaaca

SEQ ID NO: 3715255 - DNA, 16 bp, Homo sapiens
ttatcttaaaactcct

SEQ ID NO: 3715256 - DNA, 15 bp, Homo sapiens
ttatctttgtaatta

SEQ ID NO: 3715257 - DNA, 17 bp, Homo sapiens
ttatcttttctacagca

SEQ ID NO: 3715258 - DNA, 15 bp, Homo sapiens
ttatgaactgcatgt

SEQ ID NO: 3715259 - DNA, 14 bp, Homo sapiens
ttatgaatgaaaaa

SEQ ID NO: 3715260 - DNA, 21 bp, Homo sapiens
ttatgacatcacttgtacaaa

SEQ ID NO: 3715261 - DNA, 18 bp, Homo sapiens
ttatgaggagtgaacatt

SEQ ID NO: 3715262 - DNA, 23 bp, Homo sapiens
ttatgagtttttgatagctttat

SEQ ID NO: 3715263 - DNA, 13 bp, Homo sapiens
ttatgataaaaaa

SEQ ID NO: 3715264 - DNA, 21 bp, Homo sapiens
ttatgatgtgggtcaaggaat

SEQ ID NO: 3715265 - DNA, 17 bp, Homo sapiens
ttatgcaaattcccaga

SEQ ID NO: 3715266 - DNA, 11 bp, Homo sapiens
ttatggcctca

SEQ ID NO: 3715267 - DNA, 11 bp, Homo sapiens
ttatggttttg

SEQ ID NO: 3715268 - DNA, 16 bp, Homo sapiens
ttatgtaataatgtga

SEQ ID NO: 3715269 - DNA, 21 bp, Homo sapiens
ttatgtaataatgtgaatcat

SEQ ID NO: 3715270 - DNA, 15 bp, Homo sapiens
ttatgtagatgtgca

SEQ ID NO: 3715271 - DNA, 16 bp, Homo sapiens
ttatgtagatgtgcat

SEQ ID NO: 3715272 - DNA, 21 bp, Homo sapiens
ttatgtctgctgaataataaa

SEQ ID NO: 3715273 - DNA, 12 bp, Homo sapiens
ttatgtgtgtat

SEQ ID NO: 3715274 - DNA, 18 bp, Homo sapiens
ttatgtgtgtatatgtat

SEQ ID NO: 3715275 - DNA, 15 bp, Homo sapiens
ttatgttacatctgt

SEQ ID NO: 3715276 - DNA, 12 bp, Homo sapiens
ttattaaaatct

SEQ ID NO: 3715277 - DNA, 15 bp, Homo sapiens
ttctcttgggctgag

SEQ ID NO: 3715278 - DNA, 17 bp, Homo sapiens
ttctctttaactcagga

SEQ ID NO: 3715279 - DNA, 16 bp, Homo sapiens
ttctgaaaattccaga

SEQ ID NO: 3715280 - DNA, 18 bp, Homo sapiens
ttctgaaactaatgaaag

SEQ ID NO: 3715281 - DNA, 14 bp, Homo sapiens
ttctgaaatatttt

SEQ ID NO: 3715282 - DNA, 12 bp, Homo sapiens
ttctgaactcgc

SEQ ID NO: 3715283 - DNA, 14 bp, Homo sapiens
ttctgacattaaca

SEQ ID NO: 3715284 - DNA, 15 bp, Homo sapiens
ttctgacattaacag

SEQ ID NO: 3715285 - DNA, 13 bp, Homo sapiens
ttctgaccacact

SEQ ID NO: 3715286 - DNA, 13 bp, Homo sapiens
ttctgactgctga

SEQ ID NO: 3715287 - DNA, 14 bp, Homo sapiens
ttctgagtgttttt

SEQ ID NO: 3715288 - DNA, 20 bp, Homo sapiens
ttctgagtgtttttactaca

SEQ ID NO: 3715289 - DNA, 14 bp, Homo sapiens
ttctgatatagaat

SEQ ID NO: 3715290 - DNA, 18 bp, Homo sapiens
ttctgatatagaattgca

SEQ ID NO: 3715291 - DNA, 13 bp, Homo sapiens
ttctgatgaatct

SEQ ID NO: 3715292 - DNA, 15 bp, Homo sapiens
ttctgattagaaatg

SEQ ID NO: 3715293 - DNA, 17 bp, Homo sapiens
ttctgattagaaatgac

SEQ ID NO: 3715294 - DNA, 15 bp, Homo sapiens
ttctgcaaatagaaa

SEQ ID NO: 3715295 - DNA, 19 bp, Homo sapiens
ttctgcaaatagaaaacag

SEQ ID NO: 3715296 - DNA, 22 bp, Homo sapiens
ttctgcaagcacatctgcattt

SEQ ID NO: 3715297 - DNA, 20 bp, Homo sapiens
ttctgcagcatgacctgtga

SEQ ID NO: 3715298 - DNA, 21 bp, Homo sapiens
ttctgcagcatgacctgtgac

SEQ ID NO: 3715299 - DNA, 15 bp, Homo sapiens
ttctgccacataaaa

SEQ ID NO: 3715300 - DNA, 15 bp, Homo sapiens
ttctgccctgcccac

SEQ ID NO: 3715301 - DNA, 16 bp, Homo sapiens
ttctgccgtgtgccct

SEQ ID NO: 3715302 - DNA, 16 bp, Homo sapiens
ttctgcctgcccaggc

SEQ ID NO: 3715303 - DNA, 18 bp, Homo sapiens
ttctgcctgcccaggccc

SEQ ID NO: 3715304 - DNA, 19 bp, Homo sapiens
ttctgcctttgcagaaaca

SEQ ID NO: 3715305 - DNA, 15 bp, Homo sapiens
ttctgctacctcact

SEQ ID NO: 3715306 - DNA, 16 bp, Homo sapiens
ttctgctacctcactg

SEQ ID NO: 3715307 - DNA, 17 bp, Homo sapiens
ttctgctccacccttgg

SEQ ID NO: 3715308 - DNA, 20 bp, Homo sapiens
ttctgctccacccttggcct

SEQ ID NO: 3715309 - DNA, 15 bp, Homo sapiens
ttctgcttcagcctc

SEQ ID NO: 3715310 - DNA, 16 bp, Homo sapiens
ttctgcttcagcctcc

SEQ ID NO: 3715311 - DNA, 16 bp, Homo sapiens
ttctggaatgtaatca

SEQ ID NO: 3715312 - DNA, 10 bp, Homo sapiens
ttctggagcc

SEQ ID NO: 3715313 - DNA, 14 bp, Homo sapiens
ttctggcctgcctt

SEQ ID NO: 3715314 - DNA, 20 bp, Homo sapiens
ttctggcctgccttcgttaa

SEQ ID NO: 3715315 - DNA, 17 bp, Homo sapiens
ttctgggttctgggtgg

SEQ ID NO: 3715316 - DNA, 17 bp, Homo sapiens
ttctggtagatagaaat

SEQ ID NO: 3715317 - DNA, 18 bp, Homo sapiens
ttctgtattttgtttttg

SEQ ID NO: 3715318 - DNA, 13 bp, Homo sapiens
ttctgtgcccagc

SEQ ID NO: 3715319 - DNA, 22 bp, Homo sapiens
ttctgtgggagaattcttacat

SEQ ID NO: 3715320 - DNA, 21 bp, Homo sapiens
ttctgtgtatttaattgtaaa

SEQ ID NO: 3715321 - DNA, 22 bp, Homo sapiens
ttctgtgtatttaattgtaaac

SEQ ID NO: 3715322 - DNA, 20 bp, Homo sapiens
ttctgtgtgttttcataata

SEQ ID NO: 3715323 - DNA, 21 bp, Homo sapiens
ttctgttggccagtgtgacaa

SEQ ID NO: 3715324 - DNA, 21 bp, Homo sapiens
ttcttaaaatatatttcagat

SEQ ID NO: 3715325 - DNA, 17 bp, Homo sapiens
ttcttaaacaaatgtat

SEQ ID NO: 3715326 - DNA, 13 bp, Homo sapiens
ttcttaaagagtt

SEQ ID NO: 3715327 - DNA, 21 bp, Homo sapiens
ttcttaaatgggctactttgt

SEQ ID NO: 3715328 - DNA, 18 bp, Homo sapiens
ttcttaagacatgtatca

SEQ ID NO: 3715329 - DNA, 22 bp, Homo sapiens
ttcttaagaccacctcaaattt

SEQ ID NO: 3715330 - DNA, 20 bp, Homo sapiens
ttcttaaggattgtgatatt

SEQ ID NO: 3715331 - DNA, 22 bp, Homo sapiens
ttcttaaggattgtgatatttt

SEQ ID NO: 3715332 - DNA, 14 bp, Homo sapiens
ttcttacatgcatt

SEQ ID NO: 3715333 - DNA, 16 bp, Homo sapiens
ttcttacatgcatttg

SEQ ID NO: 3715334 - DNA, 22 bp, Homo sapiens
ttcttactattaagcagtaaaa

SEQ ID NO: 3715335 - DNA, 16 bp, Homo sapiens
ttcttagatatctttt

SEQ ID NO: 3715336 - DNA, 18 bp, Homo sapiens
ttcttagatatcttttta

SEQ ID NO: 3715337 - DNA, 15 bp, Homo sapiens
ttcttagtagatttt

SEQ ID NO: 3715338 - DNA, 17 bp, Homo sapiens
ttcttatgttgcccagt

SEQ ID NO: 3715339 - DNA, 17 bp, Homo sapiens
ttcttcaacatcaatgt

SEQ ID NO: 3715340 - DNA, 17 bp, Homo sapiens
ttcttcagaagacactg

SEQ ID NO: 3715341 - DNA, 14 bp, Homo sapiens
ttcttcatgcaatg

SEQ ID NO: 3715342 - DNA, 18 bp, Homo sapiens
ttcttcatgcaatgacat

SEQ ID NO: 3715343 - DNA, 18 bp, Homo sapiens
ttcttcccttaaaattta

SEQ ID NO: 3715344 - DNA, 14 bp, Homo sapiens
ttcttctccctcag

SEQ ID NO: 3715345 - DNA, 13 bp, Homo sapiens
ttcttgaaagctg

SEQ ID NO: 3715346 - DNA, 16 bp, Homo sapiens
ttcttgccaatgaggt

SEQ ID NO: 3715347 - DNA, 21 bp, Homo sapiens
ttcttgcctactatgccagat

SEQ ID NO: 3715348 - DNA, 23 bp, Homo sapiens
ttcttgctggttgtcatttttgc

SEQ ID NO: 3715349 - DNA, 14 bp, Homo sapiens
ttcttggctttgtt

SEQ ID NO: 3715350 - DNA, 13 bp, Homo sapiens
ttcttgttctgtt

SEQ ID NO: 3715351 - DNA, 13 bp, Homo sapiens
ttcttgtttatca

SEQ ID NO: 3715352 - DNA, 18 bp, Homo sapiens
ttctttaaatttcaaatg

SEQ ID NO: 3715353 - DNA, 20 bp, Homo sapiens
ttctttaaatttcaaatgtt

SEQ ID NO: 3715354 - DNA, 10 bp, Homo sapiens
ttctttcaag

SEQ ID NO: 3715355 - DNA, 20 bp, Homo sapiens
ttctttccattatgattctt

SEQ ID NO: 3715356 - DNA, 21 bp, Homo sapiens
ttctttccctgcttaatgaaa

SEQ ID NO: 3715357 - DNA, 15 bp, Homo sapiens
ttctttgaaattgtt

SEQ ID NO: 3715358 - DNA, 21 bp, Homo sapiens
ttctttggtgcctttcctgtt

SEQ ID NO: 3715359 - DNA, 22 bp, Homo sapiens
ttctttggtggagataaagatt

SEQ ID NO: 3715360 - DNA, 21 bp, Homo sapiens
ttcttttataaaaaaaatgaa

SEQ ID NO: 3715361 - DNA, 23 bp, Homo sapiens
ttcttttcgccgtggctgcggca

SEQ ID NO: 3715362 - DNA, 22 bp, Homo sapiens
ttcttttgcccttcacagtgtt

SEQ ID NO: 3715363 - DNA, 16 bp, Homo sapiens
ttctttttattttctt

SEQ ID NO: 3715364 - DNA, 19 bp, Homo sapiens
ttcttttttaaattttctt

SEQ ID NO: 3715365 - DNA, 14 bp, Homo sapiens
ttctttttttgtga

SEQ ID NO: 3715366 - DNA, 14 bp, Homo sapiens
ttgaaaaaaattgg

SEQ ID NO: 3715367 - DNA, 12 bp, Homo sapiens
ttgaaaaagcag

SEQ ID NO: 3715368 - DNA, 14 bp, Homo sapiens
ttgaaaactacatt

SEQ ID NO: 3715369 - DNA, 16 bp, Homo sapiens
ttgaaaactacatttt

SEQ ID NO: 3715370 - DNA, 16 bp, Homo sapiens
ttgaaaagccatgttt

SEQ ID NO: 3715371 - DNA, 20 bp, Homo sapiens
ttgaaaagccatgtttaaga

SEQ ID NO: 3715372 - DNA, 22 bp, Homo sapiens
ttgaaaagccatgtttaagatt

SEQ ID NO: 3715373 - DNA, 23 bp, Homo sapiens
ttgaaaagccatgtttaagattt

SEQ ID NO: 3715374 - DNA, 20 bp, Homo sapiens
ttgaaaatgtaagtaaatgt

SEQ ID NO: 3715375 - DNA, 13 bp, Homo sapiens
ttgaaagaccttc

SEQ ID NO: 3715376 - DNA, 12 bp, Homo sapiens
ttgaaagctgtg

SEQ ID NO: 3715377 - DNA, 20 bp, Homo sapiens
ttgaaaggcattctctgaag

SEQ ID NO: 3715378 - DNA, 19 bp, Homo sapiens
ttgaaattgtttaagtgtt

SEQ ID NO: 3715379 - DNA, 15 bp, Homo sapiens
ttgaaccaaaacatt

SEQ ID NO: 3715380 - DNA, 12 bp, Homo sapiens
ttgaacccagga

SEQ ID NO: 3715381 - DNA, 17 bp, Homo sapiens
ttgaacccaggagttca

SEQ ID NO: 3715382 - DNA, 15 bp, Homo sapiens
ttgaactcctgggct

SEQ ID NO: 3715383 - DNA, 19 bp, Homo sapiens
ttgaactcttcaatctctt

SEQ ID NO: 3715384 - DNA, 13 bp, Homo sapiens
ttgaagacactga

SEQ ID NO: 3715385 - DNA, 20 bp, Homo sapiens
ttgaagatcgttagtatcta

SEQ ID NO: 3715386 - DNA, 23 bp, Homo sapiens
ttgaagccaagtcagctttgcct

SEQ ID NO: 3715387 - DNA, 19 bp, Homo sapiens
ttgaagctaattattttaa

SEQ ID NO: 3715388 - DNA, 21 bp, Homo sapiens
ttgaaggatgctgtcttcgta

SEQ ID NO: 3715389 - DNA, 16 bp, Homo sapiens
ttgaagtaatgaattt

SEQ ID NO: 3715390 - DNA, 22 bp, Homo sapiens
tttactgccaaagggaaatatc

SEQ ID NO: 3715391 - DNA, 16 bp, Homo sapiens
tttactgtcttaatta

SEQ ID NO: 3715392 - DNA, 21 bp, Homo sapiens
tttacttgcattgaatatatt

SEQ ID NO: 3715393 - DNA, 15 bp, Homo sapiens
tttacttgtttcaga

SEQ ID NO: 3715394 - DNA, 18 bp, Homo sapiens
tttacttttaaacagtga

SEQ ID NO: 3715395 - DNA, 16 bp, Homo sapiens
tttagaaacttatctt

SEQ ID NO: 3715396 - DNA, 20 bp, Homo sapiens
tttagaaacttatcttacaa

SEQ ID NO: 3715397 - DNA, 22 bp, Homo sapiens
tttagaaacttatcttacaaag

SEQ ID NO: 3715398 - DNA, 18 bp, Homo sapiens
tttagatggttacactgt

SEQ ID NO: 3715399 - DNA, 18 bp, Homo sapiens
tttagcacgtttaaagtt

SEQ ID NO: 3715400 - DNA, 18 bp, Homo sapiens
tttagcagaatcaaaatg

SEQ ID NO: 3715401 - DNA, 14 bp, Homo sapiens
tttagcagttctgc

SEQ ID NO: 3715402 - DNA, 23 bp, Homo sapiens
tttagcagttctgcaaatagaaa

SEQ ID NO: 3715403 - DNA, 15 bp, Homo sapiens
tttagtagagacagg

SEQ ID NO: 3715404 - DNA, 19 bp, Homo sapiens
tttagttgcagactcagtt

SEQ ID NO: 3715405 - DNA, 18 bp, Homo sapiens
tttagttgctcaaagagc

SEQ ID NO: 3715406 - DNA, 20 bp, Homo sapiens
tttagttgtatctcttttga

SEQ ID NO: 3715407 - DNA, 22 bp, Homo sapiens
tttataaccatggttttcctga

SEQ ID NO: 3715408 - DNA, 19 bp, Homo sapiens
tttataactcatcataaaa

SEQ ID NO: 3715409 - DNA, 20 bp, Homo sapiens
tttataagcagatttaacaa

SEQ ID NO: 3715410 - DNA, 15 bp, Homo sapiens
tttataattttaaga

SEQ ID NO: 3715411 - DNA, 17 bp, Homo sapiens
tttatacaggggaatat

SEQ ID NO: 3715412 - DNA, 19 bp, Homo sapiens
tttatacagttttaaagaa

SEQ ID NO: 3715413 - DNA, 14 bp, Homo sapiens
tttatataattatg

SEQ ID NO: 3715414 - DNA, 17 bp, Homo sapiens
tttatatcccattttta

SEQ ID NO: 3715415 - DNA, 14 bp, Homo sapiens
tttatatgaacata

SEQ ID NO: 3715416 - DNA, 13 bp, Homo sapiens
tttatattttcaa

SEQ ID NO: 3715417 - DNA, 17 bp, Homo sapiens
tttatcacacttctgtg

SEQ ID NO: 3715418 - DNA, 14 bp, Homo sapiens
tttatcagaattct

SEQ ID NO: 3715419 - DNA, 21 bp, Homo sapiens
tttatcagtgacagagttcac

SEQ ID NO: 3715420 - DNA, 12 bp, Homo sapiens
tttatcattttc

SEQ ID NO: 3715421 - DNA, 18 bp, Homo sapiens
tttatcctgaaatttcag

SEQ ID NO: 3715422 - DNA, 14 bp, Homo sapiens
tttatctattgtaa

SEQ ID NO: 3715423 - DNA, 16 bp, Homo sapiens
tttatctattgtaaga

SEQ ID NO: 3715424 - DNA, 19 bp, Homo sapiens
tttatctgtagtaaactat

SEQ ID NO: 3715425 - DNA, 16 bp, Homo sapiens
tttatcttttctacag

SEQ ID NO: 3715426 - DNA, 21 bp, Homo sapiens
tttatcttttctacagcaaat

SEQ ID NO: 3715427 - DNA, 19 bp, Homo sapiens
tttatgaagaaaaaataca

SEQ ID NO: 3715428 - DNA, 20 bp, Homo sapiens
tttatgaatgaaaaaacagt

SEQ ID NO: 3715429 - DNA, 19 bp, Homo sapiens
tttatgagccagacaaatg

SEQ ID NO: 3715430 - DNA, 19 bp, Homo sapiens
tttatgtaaaattttgcct

SEQ ID NO: 3715431 - DNA, 22 bp, Homo sapiens
tttatgtatgtttacactgtca

SEQ ID NO: 3715432 - DNA, 14 bp, Homo sapiens
tttattaaaatctt

SEQ ID NO: 3715433 - DNA, 16 bp, Homo sapiens
tttattaaaatcttaa

SEQ ID NO: 3715434 - DNA, 14 bp, Homo sapiens
tttattacctctga

SEQ ID NO: 3715435 - DNA, 14 bp, Homo sapiens
tttattacttattt

SEQ ID NO: 3715436 - DNA, 17 bp, Homo sapiens
tttattatgcataactg

SEQ ID NO: 3715437 - DNA, 18 bp, Homo sapiens
tttattatgctgtatttt

SEQ ID NO: 3715438 - DNA, 22 bp, Homo sapiens
tttattcctatatagtttattg

SEQ ID NO: 3715439 - DNA, 22 bp, Homo sapiens
tttattcttgaagtgaaatctg

SEQ ID NO: 3715440 - DNA, 17 bp, Homo sapiens
tttattgcttgatactt

SEQ ID NO: 3715441 - DNA, 15 bp, Homo sapiens
tttatttatcagtga

SEQ ID NO: 3715442 - DNA, 20 bp, Homo sapiens
tttatttgtttgtgcatttg

SEQ ID NO: 3715443 - DNA, 23 bp, Homo sapiens
tttattttagcagttctgcaaat

SEQ ID NO: 3715444 - DNA, 15 bp, Homo sapiens
tttattttttacatt

SEQ ID NO: 3715445 - DNA, 24 bp, Homo sapiens
tttcaaaccagtatacaagataag

SEQ ID NO: 3715446 - DNA, 18 bp, Homo sapiens
tttcaaactgatacagat

SEQ ID NO: 3715447 - DNA, 14 bp, Homo sapiens
tttcaaatttcaca

SEQ ID NO: 3715448 - DNA, 16 bp, Homo sapiens
tttcaacgcagccctg

SEQ ID NO: 3715449 - DNA, 20 bp, Homo sapiens
tttcaagcatctcctgagga

SEQ ID NO: 3715450 - DNA, 18 bp, Homo sapiens
tttcaataacgaagttgg

SEQ ID NO: 3715451 - DNA, 16 bp, Homo sapiens
tttcaattcaaaaatg

SEQ ID NO: 3715452 - DNA, 14 bp, Homo sapiens
tttcaatttccaag

SEQ ID NO: 3715453 - DNA, 19 bp, Homo sapiens
tttcacagtgtgtttgtga

SEQ ID NO: 3715454 - DNA, 13 bp, Homo sapiens
tttcacagttttt

SEQ ID NO: 3715455 - DNA, 14 bp, Homo sapiens
tttcacatagatgt

SEQ ID NO: 3715456 - DNA, 17 bp, Homo sapiens
tttcacccacagaaaga

SEQ ID NO: 3715457 - DNA, 20 bp, Homo sapiens
tttcacccacagaaagagag

SEQ ID NO: 3715458 - DNA, 19 bp, Homo sapiens
tttcactatttttatttat

SEQ ID NO: 3715459 - DNA, 18 bp, Homo sapiens
tttcactgctggctgcct

SEQ ID NO: 3715460 - DNA, 24 bp, Homo sapiens
tttcactgctggctgccttagaac

SEQ ID NO: 3715461 - DNA, 24 bp, Homo sapiens
tttcactgtagaatgatttcatgc

SEQ ID NO: 3715462 - DNA, 18 bp, Homo sapiens
tttcacttgtgttttaaa

SEQ ID NO: 3715463 - DNA, 21 bp, Homo sapiens
tttcactttcacatagatgtc

SEQ ID NO: 3715464 - DNA, 13 bp, Homo sapiens
tttcagaaaacag

SEQ ID NO: 3715465 - DNA, 16 bp, Homo sapiens
tttcagaaaacagaaa

SEQ ID NO: 3715466 - DNA, 19 bp, Homo sapiens
tttcagaaaacagaaaaaa

SEQ ID NO: 3715467 - DNA, 19 bp, Homo sapiens
tttcagaacctcttcccca

SEQ ID NO: 3715468 - DNA, 20 bp, Homo sapiens
tttcagaacctcttccccag

SEQ ID NO: 3715469 - DNA, 23 bp, Homo sapiens
tttcagaatctgaatgtaatttg

SEQ ID NO: 3715470 - DNA, 15 bp, Homo sapiens
tttcagactgcttta

SEQ ID NO: 3715471 - DNA, 13 bp, Homo sapiens
tttcagagcctcc

SEQ ID NO: 3715472 - DNA, 12 bp, Homo sapiens
tttcagatgctt

SEQ ID NO: 3715473 - DNA, 14 bp, Homo sapiens
tttcagatgcttct

SEQ ID NO: 3715474 - DNA, 20 bp, Homo sapiens
tttcagatgcttctgggaga

SEQ ID NO: 3715475 - DNA, 16 bp, Homo sapiens
tttcaggatactctgt

SEQ ID NO: 3715476 - DNA, 19 bp, Homo sapiens
tttcaggatactctgtcag

SEQ ID NO: 3715477 - DNA, 18 bp, Homo sapiens
tttcaggttttgtaaaga

SEQ ID NO: 3715478 - DNA, 19 bp, Homo sapiens
tttcaggttttgtaaagat

SEQ ID NO: 3715479 - DNA, 17 bp, Homo sapiens
tttcagtcttttcctgt

SEQ ID NO: 3715480 - DNA, 18 bp, Homo sapiens
tttcatatgcttcaaact

SEQ ID NO: 3715481 - DNA, 23 bp, Homo sapiens
tttcatccctatgggattcagtg

SEQ ID NO: 3715482 - DNA, 21 bp, Homo sapiens
tttcatgattagcaagttaca

SEQ ID NO: 3715483 - DNA, 21 bp, Homo sapiens
tttcattgatatgaaaaatat

SEQ ID NO: 3715484 - DNA, 16 bp, Homo sapiens
tttcattgccagtgtc

SEQ ID NO: 3715485 - DNA, 22 bp, Homo sapiens
tttcattgctgggcttgtctgt

SEQ ID NO: 3715486 - DNA, 19 bp, Homo sapiens
tttcatttatgatacaaaa

SEQ ID NO: 3715487 - DNA, 14 bp, Homo sapiens
tttcatttcaactg

SEQ ID NO: 3715488 - DNA, 15 bp, Homo sapiens
tttccaaattcacaa

SEQ ID NO: 3715489 - DNA, 14 bp, Homo sapiens
tttccaagagctga

SEQ ID NO: 3715490 - DNA, 13 bp, Homo sapiens
tttccaagcaaat

SEQ ID NO: 3715491 - DNA, 22 bp, Homo sapiens
tttccaagcaaatgttacatag

SEQ ID NO: 3715492 - DNA, 13 bp, Homo sapiens
tttccaaggagct

SEQ ID NO: 3715493 - DNA, 22 bp, Homo sapiens
tttccaaggagctgagaataga

SEQ ID NO: 3715494 - DNA, 15 bp, Homo sapiens
tttccaccccctccc

SEQ ID NO: 3715495 - DNA, 13 bp, Homo sapiens
tttccactactgc

SEQ ID NO: 3715496 - DNA, 14 bp, Homo sapiens
tttccactactgct

SEQ ID NO: 3715497 - DNA, 12 bp, Homo sapiens
tttccagtgcaa

SEQ ID NO: 3715498 - DNA, 22 bp, Homo sapiens
tttccagtggcctggctccgct

SEQ ID NO: 3715499 - DNA, 16 bp, Homo sapiens
tttccatcataattct

SEQ ID NO: 3715500 - DNA, 12 bp, Homo sapiens
tttcccaagctg

SEQ ID NO: 3715501 - DNA, 15 bp, Homo sapiens
tttcccaattaggaa

SEQ ID NO: 3715502 - DNA, 14 bp, Homo sapiens
tttcccataatttt

SEQ ID NO: 3715503 - DNA, 12 bp, Homo sapiens
aaacagtgcctg

SEQ ID NO: 3715504 - DNA, 18 bp, Homo sapiens
aaacagtgcctgctgaat

SEQ ID NO: 3715505 - DNA, 18 bp, Homo sapiens
aaacatagagggagagag

SEQ ID NO: 3715506 - DNA, 14 bp, Homo sapiens
aaacatcacacaca

SEQ ID NO: 3715507 - DNA, 17 bp, Homo sapiens
aaacatcagacctgtct

SEQ ID NO: 3715508 - DNA, 18 bp, Homo sapiens
aaacatccttcaagaact

SEQ ID NO: 3715509 - DNA, 12 bp, Homo sapiens
aaacatgaagtg

SEQ ID NO: 3715510 - DNA, 21 bp, Homo sapiens
aaacatggtagaattggagag

SEQ ID NO: 3715511 - DNA, 22 bp, Homo sapiens
aaacattagttctatttctatc

SEQ ID NO: 3715512 - DNA, 16 bp, Homo sapiens
aaacattgaagtaatg

SEQ ID NO: 3715513 - DNA, 14 bp, Homo sapiens
aaacattgttttgt

SEQ ID NO: 3715514 - DNA, 16 bp, Homo sapiens
aaacattttcacacaa

SEQ ID NO: 3715515 - DNA, 21 bp, Homo sapiens
aaacattttgtggtcattaag

SEQ ID NO: 3715516 - DNA, 12 bp, Homo sapiens
aaaccaagaaga

SEQ ID NO: 3715517 - DNA, 17 bp, Homo sapiens
aaaccacagccctgtca

SEQ ID NO: 3715518 - DNA, 18 bp, Homo sapiens
aaaccacagccctgtcag

SEQ ID NO: 3715519 - DNA, 16 bp, Homo sapiens
aaaccactagaactct

SEQ ID NO: 3715520 - DNA, 19 bp, Homo sapiens
aaaccagggtttatctttt

SEQ ID NO: 3715521 - DNA, 15 bp, Homo sapiens
aaaccccggggctcc

SEQ ID NO: 3715522 - DNA, 16 bp, Homo sapiens
aaacccgacagaggga

SEQ ID NO: 3715523 - DNA, 18 bp, Homo sapiens
aaacccgacagagggaag

SEQ ID NO: 3715524 - DNA, 12 bp, Homo sapiens
aaaccctgtctc

SEQ ID NO: 3715525 - DNA, 15 bp, Homo sapiens
aaaccgccaaggctg

SEQ ID NO: 3715526 - DNA, 11 bp, Homo sapiens
aaacctggaga

SEQ ID NO: 3715527 - DNA, 20 bp, Homo sapiens
aaaccttttggaaaatctgc

SEQ ID NO: 3715528 - DNA, 22 bp, Homo sapiens
aaacgtttcagtaataaaacat

SEQ ID NO: 3715529 - DNA, 16 bp, Homo sapiens
aaacgttttattgtgt

SEQ ID NO: 3715530 - DNA, 21 bp, Homo sapiens
aaacgttttattgtgttttta

SEQ ID NO: 3715531 - DNA, 17 bp, Homo sapiens
aaactaacacattttta

SEQ ID NO: 3715532 - DNA, 15 bp, Homo sapiens
aaactaacagataag

SEQ ID NO: 3715533 - DNA, 13 bp, Homo sapiens
aaactaatgagtt

SEQ ID NO: 3715534 - DNA, 13 bp, Homo sapiens
aaactacatttta

SEQ ID NO: 3715535 - DNA, 17 bp, Homo sapiens
aaactacattttaacat

SEQ ID NO: 3715536 - DNA, 18 bp, Homo sapiens
aaactacattttaacatg

SEQ ID NO: 3715537 - DNA, 15 bp, Homo sapiens
aaactagaatttcat

SEQ ID NO: 3715538 - DNA, 23 bp, Homo sapiens
aaactagcttacatgagaacaga

SEQ ID NO: 3715539 - DNA, 13 bp, Homo sapiens
aaactaggaaaat

SEQ ID NO: 3715540 - DNA, 13 bp, Homo sapiens
aaactatttatct

SEQ ID NO: 3715541 - DNA, 22 bp, Homo sapiens
aaactatttatctgtgtttttg

SEQ ID NO: 3715542 - DNA, 13 bp, Homo sapiens
aaactcaaaatat

SEQ ID NO: 3715543 - DNA, 16 bp, Homo sapiens
aaactcacctgctggc

SEQ ID NO: 3715544 - DNA, 20 bp, Homo sapiens
aaactcacctgctggcccct

SEQ ID NO: 3715545 - DNA, 22 bp, Homo sapiens
aaactcacctgctggcccctca

SEQ ID NO: 3715546 - DNA, 22 bp, Homo sapiens
aaactcatttcctatgtaactg

SEQ ID NO: 3715547 - DNA, 19 bp, Homo sapiens
aaactccgtcttagaagtg

SEQ ID NO: 3715548 - DNA, 14 bp, Homo sapiens
aaactctgccagcc

SEQ ID NO: 3715549 - DNA, 14 bp, Homo sapiens
aaactgaagccaga

SEQ ID NO: 3715550 - DNA, 18 bp, Homo sapiens
aaactgaggaattttctt

SEQ ID NO: 3715551 - DNA, 17 bp, Homo sapiens
aaactgcaatagagact

SEQ ID NO: 3715552 - DNA, 14 bp, Homo sapiens
aaactgcattagaa

SEQ ID NO: 3715553 - DNA, 15 bp, Homo sapiens
aaactggaagttatt

SEQ ID NO: 3715554 - DNA, 20 bp, Homo sapiens
aaactggcatctgacacaaa

SEQ ID NO: 3715555 - DNA, 21 bp, Homo sapiens
aaactggcatctgacacaaaa

SEQ ID NO: 3715556 - DNA, 15 bp, Homo sapiens
aaactgtagaaatga

SEQ ID NO: 3715557 - DNA, 20 bp, Homo sapiens
aaactgtgtaactgcccaaa

SEQ ID NO: 3715558 - DNA, 20 bp, Homo sapiens
aaactgtgtggactgtgatg

SEQ ID NO: 3715559 - DNA, 14 bp, Homo sapiens
aaactgttctctat

SEQ ID NO: 3715560 - DNA, 14 bp, Homo sapiens
aaacttacacacaa

SEQ ID NO: 3715561 - DNA, 21 bp, Homo sapiens
aaacttagtgcggacaagttt

SEQ ID NO: 3715562 - DNA, 20 bp, Homo sapiens
aaacttatcttacaaagtgt

SEQ ID NO: 3715563 - DNA, 16 bp, Homo sapiens
aaacttccaagacctg

SEQ ID NO: 3715564 - DNA, 21 bp, Homo sapiens
aaacttccagtgcaacactga

SEQ ID NO: 3715565 - DNA, 22 bp, Homo sapiens
aaacttgatgtgttatctctta

SEQ ID NO: 3715566 - DNA, 11 bp, Homo sapiens
aaacttgtaaa

SEQ ID NO: 3715567 - DNA, 12 bp, Homo sapiens
aaacttgtaaat

SEQ ID NO: 3715568 - DNA, 14 bp, Homo sapiens
aaactttattttat

SEQ ID NO: 3715569 - DNA, 23 bp, Homo sapiens
aaactttattttatataataaag

SEQ ID NO: 3715570 - DNA, 20 bp, Homo sapiens
aaacttttcttaaaaagtta

SEQ ID NO: 3715571 - DNA, 24 bp, Homo sapiens
aaacttttttgaaataataaatct

SEQ ID NO: 3715572 - DNA, 14 bp, Homo sapiens
aaagaaaataaaat

SEQ ID NO: 3715573 - DNA, 14 bp, Homo sapiens
aaagaaaatatgca

SEQ ID NO: 3715574 - DNA, 23 bp, Homo sapiens
aaagaaacccgacagagggaaga

SEQ ID NO: 3715575 - DNA, 14 bp, Homo sapiens
aaagaaatcatgtt

SEQ ID NO: 3715576 - DNA, 17 bp, Homo sapiens
aaagaaatgcacaatgt

SEQ ID NO: 3715577 - DNA, 19 bp, Homo sapiens
aaagaagacaacattaaaa

SEQ ID NO: 3715578 - DNA, 18 bp, Homo sapiens
aaagaatcattatttatt

SEQ ID NO: 3715579 - DNA, 16 bp, Homo sapiens
aaagaatccctgttca

SEQ ID NO: 3715580 - DNA, 22 bp, Homo sapiens
aaagaatccctgttcattgtaa

SEQ ID NO: 3715581 - DNA, 17 bp, Homo sapiens
aaagacaaattctgttt

SEQ ID NO: 3715582 - DNA, 19 bp, Homo sapiens
aaagacacctactgagtgg

SEQ ID NO: 3715583 - DNA, 14 bp, Homo sapiens
aaagacagagctgg

SEQ ID NO: 3715584 - DNA, 15 bp, Homo sapiens
aaagacatgaatatg

SEQ ID NO: 3715585 - DNA, 19 bp, Homo sapiens
aaagaccctaaatctgagg

SEQ ID NO: 3715586 - DNA, 20 bp, Homo sapiens
aaagaccctaaatctgagga

SEQ ID NO: 3715587 - DNA, 16 bp, Homo sapiens
aaagactgagctcaag

SEQ ID NO: 3715588 - DNA, 14 bp, Homo sapiens
aaagactgtacaaa

SEQ ID NO: 3715589 - DNA, 18 bp, Homo sapiens
aaagacttagtatatttt

SEQ ID NO: 3715590 - DNA, 20 bp, Homo sapiens
aaagacttagtatattttct

SEQ ID NO: 3715591 - DNA, 15 bp, Homo sapiens
aaagagaaaattgaa

SEQ ID NO: 3715592 - DNA, 21 bp, Homo sapiens
aaagagaaactttgtgctaca

SEQ ID NO: 3715593 - DNA, 20 bp, Homo sapiens
aaagagagttaatcaactga

SEQ ID NO: 3715594 - DNA, 11 bp, Homo sapiens
aaagaggtttt

SEQ ID NO: 3715595 - DNA, 16 bp, Homo sapiens
aaagatacgactttat

SEQ ID NO: 3715596 - DNA, 20 bp, Homo sapiens
aaagatgcaaggaccaggac

SEQ ID NO: 3715597 - DNA, 22 bp, Homo sapiens
aaagatgctcaggtacagagaa

SEQ ID NO: 3715598 - DNA, 23 bp, Homo sapiens
aaagatgctcaggtacagagaag

SEQ ID NO: 3715599 - DNA, 14 bp, Homo sapiens
aaagatgcttctca

SEQ ID NO: 3715600 - DNA, 17 bp, Homo sapiens
aaagatgcttctcactg

SEQ ID NO: 3715601 - DNA, 12 bp, Homo sapiens
aaagatggcctt

SEQ ID NO: 3715602 - DNA, 18 bp, Homo sapiens
aaagatggcttttgtttc

SEQ ID NO: 3715603 - DNA, 22 bp, Homo sapiens
aaagatttgtactacagttctt

SEQ ID NO: 3715604 - DNA, 16 bp, Homo sapiens
aaagcacattgaaaga

SEQ ID NO: 3715605 - DNA, 19 bp, Homo sapiens
aaagcacgaaatgttattt

SEQ ID NO: 3715606 - DNA, 22 bp, Homo sapiens
aaagcagaacagttaagcagcc

SEQ ID NO: 3715607 - DNA, 19 bp, Homo sapiens
aaagcagaatagtattttt

SEQ ID NO: 3715608 - DNA, 15 bp, Homo sapiens
aaagcataaatgcaa

SEQ ID NO: 3715609 - DNA, 16 bp, Homo sapiens
aaagcatcacctcagg

SEQ ID NO: 3715610 - DNA, 17 bp, Homo sapiens
aaagcatcacctcaggc

SEQ ID NO: 3715611 - DNA, 18 bp, Homo sapiens
aaagcatcacctcaggcc

SEQ ID NO: 3715612 - DNA, 16 bp, Homo sapiens
aaagcatcacttggga

SEQ ID NO: 3715613 - DNA, 13 bp, Homo sapiens
aaagcatccatgt

SEQ ID NO: 3715614 - DNA, 13 bp, Homo sapiens
aaagcatgaatgg

SEQ ID NO: 3715615 - DNA, 17 bp, Homo sapiens
aaagcatttactttgaa

SEQ ID NO: 3715616 - DNA, 21 bp, Homo sapiens
aacatccaataggaatgctaa

SEQ ID NO: 3715617 - DNA, 22 bp, Homo sapiens
aacatccaataggaatgctaac

SEQ ID NO: 3715618 - DNA, 19 bp, Homo sapiens
aacatcccattgccctggt

SEQ ID NO: 3715619 - DNA, 23 bp, Homo sapiens
aacatctcaataaagtgctttaa

SEQ ID NO: 3715620 - DNA, 16 bp, Homo sapiens
aacatctgaaagccac

SEQ ID NO: 3715621 - DNA, 19 bp, Homo sapiens
aacatgcaattttgcattt

SEQ ID NO: 3715622 - DNA, 21 bp, Homo sapiens
aacatgcctgccccaaacaaa

SEQ ID NO: 3715623 - DNA, 17 bp, Homo sapiens
aacatgctacctgatcc

SEQ ID NO: 3715624 - DNA, 20 bp, Homo sapiens
aacatggagaaaccctgtct

SEQ ID NO: 3715625 - DNA, 23 bp, Homo sapiens
aacatggggttggctgggcccag

SEQ ID NO: 3715626 - DNA, 16 bp, Homo sapiens
aacatgttactgacca

SEQ ID NO: 3715627 - DNA, 17 bp, Homo sapiens
aacatgttactgaccag

SEQ ID NO: 3715628 - DNA, 15 bp, Homo sapiens
aacatgttggtattt

SEQ ID NO: 3715629 - DNA, 18 bp, Homo sapiens
aacattgaagtaatgaat

SEQ ID NO: 3715630 - DNA, 19 bp, Homo sapiens
aacattgaagtaatgaatt

SEQ ID NO: 3715631 - DNA, 19 bp, Homo sapiens
aacattgaccaagaactgc

SEQ ID NO: 3715632 - DNA, 21 bp, Homo sapiens
aacattgaccaagaactgcat

SEQ ID NO: 3715633 - DNA, 16 bp, Homo sapiens
aacattttgtcatata

SEQ ID NO: 3715634 - DNA, 18 bp, Homo sapiens
aacatttttgatttcagg

SEQ ID NO: 3715635 - DNA, 17 bp, Homo sapiens
aaccaaatgcatcaatc

SEQ ID NO: 3715636 - DNA, 18 bp, Homo sapiens
aaccaagccgtggcttcc

SEQ ID NO: 3715637 - DNA, 15 bp, Homo sapiens
aaccaatatttgtag

SEQ ID NO: 3715638 - DNA, 14 bp, Homo sapiens
aaccaatcaagata

SEQ ID NO: 3715639 - DNA, 15 bp, Homo sapiens
aaccaatgtttaaaa

SEQ ID NO: 3715640 - DNA, 22 bp, Homo sapiens
aaccaatgtttaaaaaagttta

SEQ ID NO: 3715641 - DNA, 12 bp, Homo sapiens
aaccacagccct

SEQ ID NO: 3715642 - DNA, 16 bp, Homo sapiens
aaccacagccctgtca

SEQ ID NO: 3715643 - DNA, 18 bp, Homo sapiens
aaccaccgctccccagcc

SEQ ID NO: 3715644 - DNA, 14 bp, Homo sapiens
aaccacggaaaaga

SEQ ID NO: 3715645 - DNA, 15 bp, Homo sapiens
aaccactgtaaaatg

SEQ ID NO: 3715646 - DNA, 13 bp, Homo sapiens
aaccacttaaaaa

SEQ ID NO: 3715647 - DNA, 19 bp, Homo sapiens
aaccacttaaaaaatgtcc

SEQ ID NO: 3715648 - DNA, 15 bp, Homo sapiens
aaccacttcagctga

SEQ ID NO: 3715649 - DNA, 14 bp, Homo sapiens
aaccagagcactgt

SEQ ID NO: 3715650 - DNA, 14 bp, Homo sapiens
aaccagtctgaagt

SEQ ID NO: 3715651 - DNA, 22 bp, Homo sapiens
aaccatacaaaaattccttttc

SEQ ID NO: 3715652 - DNA, 16 bp, Homo sapiens
aaccatatggatatta

SEQ ID NO: 3715653 - DNA, 22 bp, Homo sapiens
aaccatccctgatgtctgtctg

SEQ ID NO: 3715654 - DNA, 20 bp, Homo sapiens
aaccatgcagaggaatatta

SEQ ID NO: 3715655 - DNA, 13 bp, Homo sapiens
aaccattgcttca

SEQ ID NO: 3715656 - DNA, 23 bp, Homo sapiens
aaccattgcttcactacccatcg

SEQ ID NO: 3715657 - DNA, 20 bp, Homo sapiens
aaccattttttttcagcaga

SEQ ID NO: 3715658 - DNA, 15 bp, Homo sapiens
aacccaaacctggag

SEQ ID NO: 3715659 - DNA, 17 bp, Homo sapiens
aacccaaacctggagat

SEQ ID NO: 3715660 - DNA, 13 bp, Homo sapiens
aacccaatagttg

SEQ ID NO: 3715661 - DNA, 14 bp, Homo sapiens
aacccacctgctga

SEQ ID NO: 3715662 - DNA, 12 bp, Homo sapiens
aacccagagagg

SEQ ID NO: 3715663 - DNA, 15 bp, Homo sapiens
aacccatcagaagga

SEQ ID NO: 3715664 - DNA, 19 bp, Homo sapiens
aacccatcagaaggagaag

SEQ ID NO: 3715665 - DNA, 20 bp, Homo sapiens
aacccatctacccctggatg

SEQ ID NO: 3715666 - DNA, 15 bp, Homo sapiens
aacccattgtcttta

SEQ ID NO: 3715667 - DNA, 14 bp, Homo sapiens
aaccccagcatcct

SEQ ID NO: 3715668 - DNA, 12 bp, Homo sapiens
aacccccacccc

SEQ ID NO: 3715669 - DNA, 15 bp, Homo sapiens
aacccccagcctgct

SEQ ID NO: 3715670 - DNA, 21 bp, Homo sapiens
aacccctacatgaaacagaaa

SEQ ID NO: 3715671 - DNA, 13 bp, Homo sapiens
aacccctgtggag

SEQ ID NO: 3715672 - DNA, 17 bp, Homo sapiens
aacccgacagagggaag

SEQ ID NO: 3715673 - DNA, 16 bp, Homo sapiens
aacccgaggcccgcat

SEQ ID NO: 3715674 - DNA, 11 bp, Homo sapiens
aaccctgcccc

SEQ ID NO: 3715675 - DNA, 23 bp, Homo sapiens
aacccttaccccttagcctccct

SEQ ID NO: 3715676 - DNA, 15 bp, Homo sapiens
aaccgatgctccagc

SEQ ID NO: 3715677 - DNA, 17 bp, Homo sapiens
aaccgatgctccagcca

SEQ ID NO: 3715678 - DNA, 13 bp, Homo sapiens
aaccgcaggaagc

SEQ ID NO: 3715679 - DNA, 14 bp, Homo sapiens
aaccgcaggaagct

SEQ ID NO: 3715680 - DNA, 15 bp, Homo sapiens
aaccgcaggaagctg

SEQ ID NO: 3715681 - DNA, 23 bp, Homo sapiens
aaccggggagcccccgccccgcc

SEQ ID NO: 3715682 - DNA, 13 bp, Homo sapiens
aacctaagcaaaa

SEQ ID NO: 3715683 - DNA, 13 bp, Homo sapiens
aacctcagtgtca

SEQ ID NO: 3715684 - DNA, 19 bp, Homo sapiens
aacctcagtgtcatttatg

SEQ ID NO: 3715685 - DNA, 17 bp, Homo sapiens
aacctccgcctcttggg

SEQ ID NO: 3715686 - DNA, 19 bp, Homo sapiens
aacctcctttaccctcatc

SEQ ID NO: 3715687 - DNA, 11 bp, Homo sapiens
aacctcttccc

SEQ ID NO: 3715688 - DNA, 12 bp, Homo sapiens
aacctcttcccc

SEQ ID NO: 3715689 - DNA, 21 bp, Homo sapiens
aacctgaaaagatgttgtgtc

SEQ ID NO: 3715690 - DNA, 20 bp, Homo sapiens
aacctgagatggccctctgg

SEQ ID NO: 3715691 - DNA, 17 bp, Homo sapiens
aacctgatgttaaaatt

SEQ ID NO: 3715692 - DNA, 20 bp, Homo sapiens
aacctgctctcctcttgcca

SEQ ID NO: 3715693 - DNA, 17 bp, Homo sapiens
aacctggaccaaagctg

SEQ ID NO: 3715694 - DNA, 17 bp, Homo sapiens
aacctggagatggggag

SEQ ID NO: 3715695 - DNA, 11 bp, Homo sapiens
aacctgtaaat

SEQ ID NO: 3715696 - DNA, 23 bp, Homo sapiens
aacctgtacttcaagttaaagtg

SEQ ID NO: 3715697 - DNA, 18 bp, Homo sapiens
aaccttattgtacctctc

SEQ ID NO: 3715698 - DNA, 19 bp, Homo sapiens
aaccttattgtacctctct

SEQ ID NO: 3715699 - DNA, 17 bp, Homo sapiens
aaccttccatctcgcca

SEQ ID NO: 3715700 - DNA, 19 bp, Homo sapiens
aaccttccatctcgccacc

SEQ ID NO: 3715701 - DNA, 21 bp, Homo sapiens
aaccttcctgtcttcatcctt

SEQ ID NO: 3715702 - DNA, 23 bp, Homo sapiens
aaccttgtctctatgccagctca

SEQ ID NO: 3715703 - DNA, 18 bp, Homo sapiens
aacctttcaaatttcaca

SEQ ID NO: 3715704 - DNA, 21 bp, Homo sapiens
aacgaaagctgggcaacatgc

SEQ ID NO: 3715705 - DNA, 14 bp, Homo sapiens
aacggagaaaggtg

SEQ ID NO: 3715706 - DNA, 17 bp, Homo sapiens
aacggtaaatttctgtg

SEQ ID NO: 3715707 - DNA, 13 bp, Homo sapiens
aacggttaaaact

SEQ ID NO: 3715708 - DNA, 15 bp, Homo sapiens
aacgtgatgatcagc

SEQ ID NO: 3715709 - DNA, 13 bp, Homo sapiens
aacgtgccctctg

SEQ ID NO: 3715710 - DNA, 18 bp, Homo sapiens
aacgtggggcagcacaga

SEQ ID NO: 3715711 - DNA, 20 bp, Homo sapiens
aacgttttgaactaataaaa

SEQ ID NO: 3715712 - DNA, 13 bp, Homo sapiens
aactaatgagttt

SEQ ID NO: 3715713 - DNA, 13 bp, Homo sapiens
aactacattttaa

SEQ ID NO: 3715714 - DNA, 14 bp, Homo sapiens
aactacattttaac

SEQ ID NO: 3715715 - DNA, 14 bp, Homo sapiens
aactactgtgttcc

SEQ ID NO: 3715716 - DNA, 16 bp, Homo sapiens
aactagaaatctgcca

SEQ ID NO: 3715717 - DNA, 17 bp, Homo sapiens
aactagaatttcattta

SEQ ID NO: 3715718 - DNA, 18 bp, Homo sapiens
aactagaggttttatgat

SEQ ID NO: 3715719 - DNA, 12 bp, Homo sapiens
aactagctggaa

SEQ ID NO: 3715720 - DNA, 22 bp, Homo sapiens
aactagcttacatgagaacaga

SEQ ID NO: 3715721 - DNA, 12 bp, Homo sapiens
aactaggaaaat

SEQ ID NO: 3715722 - DNA, 21 bp, Homo sapiens
aactatgatttggaaaataaa

SEQ ID NO: 3715723 - DNA, 16 bp, Homo sapiens
aactatgtacaatatt

SEQ ID NO: 3715724 - DNA, 15 bp, Homo sapiens
aactatgttgataaa

SEQ ID NO: 3715725 - DNA, 15 bp, Homo sapiens
aactattggaaagta

SEQ ID NO: 3715726 - DNA, 20 bp, Homo sapiens
aactatttatctgtgttttt

SEQ ID NO: 3715727 - DNA, 16 bp, Homo sapiens
aactcaaaatatttgt

SEQ ID NO: 3715728 - DNA, 14 bp, Homo sapiens
aactcaatattttc

SEQ ID NO: 3715729 - DNA, 21 bp, Homo sapiens
aactcaatattttccatgaaa

SEQ ID NO: 3715730 - DNA, 19 bp, Homo sapiens
aaggccagagtggcctggc

SEQ ID NO: 3715731 - DNA, 21 bp, Homo sapiens
aaggccagagtggcctggcca

SEQ ID NO: 3715732 - DNA, 17 bp, Homo sapiens
aaggccagctggcagca

SEQ ID NO: 3715733 - DNA, 14 bp, Homo sapiens
aaggccgagaagca

SEQ ID NO: 3715734 - DNA, 17 bp, Homo sapiens
aaggccgagaagcaaga

SEQ ID NO: 3715735 - DNA, 21 bp, Homo sapiens
aaggctaccttattgtacgtt

SEQ ID NO: 3715736 - DNA, 17 bp, Homo sapiens
aaggctctgaaagccag

SEQ ID NO: 3715737 - DNA, 23 bp, Homo sapiens
aaggctctgagcaaatgtggctc

SEQ ID NO: 3715738 - DNA, 16 bp, Homo sapiens
aaggctgaccaagaga

SEQ ID NO: 3715739 - DNA, 17 bp, Homo sapiens
aaggctgaccaagagag

SEQ ID NO: 3715740 - DNA, 19 bp, Homo sapiens
aaggctgagaggagagaga

SEQ ID NO: 3715741 - DNA, 22 bp, Homo sapiens
aaggctgggggaagaagctctc

SEQ ID NO: 3715742 - DNA, 17 bp, Homo sapiens
aaggctttcagggcctc

SEQ ID NO: 3715743 - DNA, 18 bp, Homo sapiens
aagggaaacagtcatttg

SEQ ID NO: 3715744 - DNA, 15 bp, Homo sapiens
aagggaaatatcatt

SEQ ID NO: 3715745 - DNA, 16 bp, Homo sapiens
aagggaacaggaaaag

SEQ ID NO: 3715746 - DNA, 12 bp, Homo sapiens
aagggacatgaa

SEQ ID NO: 3715747 - DNA, 15 bp, Homo sapiens
aagggatggaaaagg

SEQ ID NO: 3715748 - DNA, 21 bp, Homo sapiens
aagggatggaaaaggaagact

SEQ ID NO: 3715749 - DNA, 24 bp, Homo sapiens
aagggatggaggtcacactggtag

SEQ ID NO: 3715750 - DNA, 22 bp, Homo sapiens
aagggcaggcccaaattatcaa

SEQ ID NO: 3715751 - DNA, 22 bp, Homo sapiens
aagggcagggcatctcctgtgc

SEQ ID NO: 3715752 - DNA, 16 bp, Homo sapiens
aagggcccagattcta

SEQ ID NO: 3715753 - DNA, 16 bp, Homo sapiens
aaggggaggcagccgg

SEQ ID NO: 3715754 - DNA, 20 bp, Homo sapiens
aaggggcagtctggaggggc

SEQ ID NO: 3715755 - DNA, 17 bp, Homo sapiens
aaggggtgcctgggaac

SEQ ID NO: 3715756 - DNA, 19 bp, Homo sapiens
aagggtatcaggtgctgcc

SEQ ID NO: 3715757 - DNA, 20 bp, Homo sapiens
aagggtgctgcttccctctg

SEQ ID NO: 3715758 - DNA, 23 bp, Homo sapiens
aagggtgctgcttccctctgcct

SEQ ID NO: 3715759 - DNA, 15 bp, Homo sapiens
aaggtaaaattctaa

SEQ ID NO: 3715760 - DNA, 16 bp, Homo sapiens
aaggtaaaattgaaag

SEQ ID NO: 3715761 - DNA, 22 bp, Homo sapiens
aaggtattaaattgatgttgct

SEQ ID NO: 3715762 - DNA, 19 bp, Homo sapiens
aaggtctaggtggaggtgg

SEQ ID NO: 3715763 - DNA, 18 bp, Homo sapiens
aaggtctttaaaatattg

SEQ ID NO: 3715764 - DNA, 13 bp, Homo sapiens
aaggtctttggtt

SEQ ID NO: 3715765 - DNA, 19 bp, Homo sapiens
aaggtctttggttcagcta

SEQ ID NO: 3715766 - DNA, 11 bp, Homo sapiens
aaggtgcctgt

SEQ ID NO: 3715767 - DNA, 20 bp, Homo sapiens
aaggtgcctgtgaggcaggg

SEQ ID NO: 3715768 - DNA, 21 bp, Homo sapiens
aaggtgggctgagccctggca

SEQ ID NO: 3715769 - DNA, 19 bp, Homo sapiens
aaggtgggggttggctggg

SEQ ID NO: 3715770 - DNA, 18 bp, Homo sapiens
aaggtgtcagaataataa

SEQ ID NO: 3715771 - DNA, 20 bp, Homo sapiens
aaggttaatgttcatcatcc

SEQ ID NO: 3715772 - DNA, 17 bp, Homo sapiens
aaggttgtattgcatat

SEQ ID NO: 3715773 - DNA, 17 bp, Homo sapiens
aagtaaactaatgagtt

SEQ ID NO: 3715774 - DNA, 18 bp, Homo sapiens
aagtaaatgtctgtggcc

SEQ ID NO: 3715775 - DNA, 20 bp, Homo sapiens
aagtaacaagagtgattctt

SEQ ID NO: 3715776 - DNA, 20 bp, Homo sapiens
aagtaagaaagtgaagcaaa

SEQ ID NO: 3715777 - DNA, 15 bp, Homo sapiens
aagtaagaagacatg

SEQ ID NO: 3715778 - DNA, 20 bp, Homo sapiens
aagtaagaagacatgaacca

SEQ ID NO: 3715779 - DNA, 11 bp, Homo sapiens
aagtaattatc

SEQ ID NO: 3715780 - DNA, 13 bp, Homo sapiens
aagtaattatcgg

SEQ ID NO: 3715781 - DNA, 15 bp, Homo sapiens
aagtactatgtatca

SEQ ID NO: 3715782 - DNA, 16 bp, Homo sapiens
aagtactatgtatcaa

SEQ ID NO: 3715783 - DNA, 20 bp, Homo sapiens
aagtacttctccaccctgct

SEQ ID NO: 3715784 - DNA, 11 bp, Homo sapiens
aagtacttctt

SEQ ID NO: 3715785 - DNA, 19 bp, Homo sapiens
aagtagacttcatttttcc

SEQ ID NO: 3715786 - DNA, 17 bp, Homo sapiens
aagtagtgtatcacagt

SEQ ID NO: 3715787 - DNA, 22 bp, Homo sapiens
aagtatataatttttttatgtt

SEQ ID NO: 3715788 - DNA, 16 bp, Homo sapiens
aagtatcatggaaata

SEQ ID NO: 3715789 - DNA, 21 bp, Homo sapiens
aagtatcgggggctggggcag

SEQ ID NO: 3715790 - DNA, 16 bp, Homo sapiens
aagtatgttttagcat

SEQ ID NO: 3715791 - DNA, 12 bp, Homo sapiens
aagtattcaaga

SEQ ID NO: 3715792 - DNA, 19 bp, Homo sapiens
aagtattccaccttaaatt

SEQ ID NO: 3715793 - DNA, 18 bp, Homo sapiens
aagtattctgcctttgca

SEQ ID NO: 3715794 - DNA, 18 bp, Homo sapiens
aagtattcttatttaatg

SEQ ID NO: 3715795 - DNA, 19 bp, Homo sapiens
aagtattcttatttaatga

SEQ ID NO: 3715796 - DNA, 10 bp, Homo sapiens
aagtatttag

SEQ ID NO: 3715797 - DNA, 16 bp, Homo sapiens
aagtatttaggttttt

SEQ ID NO: 3715798 - DNA, 13 bp, Homo sapiens
aagtatttatata

SEQ ID NO: 3715799 - DNA, 21 bp, Homo sapiens
aagtatttatatatttataac

SEQ ID NO: 3715800 - DNA, 16 bp, Homo sapiens
aagtcaaaaggtgcct

SEQ ID NO: 3715801 - DNA, 23 bp, Homo sapiens
aagtcaaagacattctgacatct

SEQ ID NO: 3715802 - DNA, 13 bp, Homo sapiens
aagtcacacagtg

SEQ ID NO: 3715803 - DNA, 14 bp, Homo sapiens
aagtcaccggagct

SEQ ID NO: 3715804 - DNA, 12 bp, Homo sapiens
aagtcactgcac

SEQ ID NO: 3715805 - DNA, 20 bp, Homo sapiens
aagtcagtgcccaactgtta

SEQ ID NO: 3715806 - DNA, 18 bp, Homo sapiens
aagtcagtgggaacgtga

SEQ ID NO: 3715807 - DNA, 14 bp, Homo sapiens
aagtcatgaacaca

SEQ ID NO: 3715808 - DNA, 17 bp, Homo sapiens
aagtcatgaagcccaag

SEQ ID NO: 3715809 - DNA, 23 bp, Homo sapiens
aagtcatgaagcccaagtgaaat

SEQ ID NO: 3715810 - DNA, 21 bp, Homo sapiens
aagtcatgcgtttaatcacat

SEQ ID NO: 3715811 - DNA, 15 bp, Homo sapiens
aagtcatgtgcattt

SEQ ID NO: 3715812 - DNA, 20 bp, Homo sapiens
aagtcattttaactttatca

SEQ ID NO: 3715813 - DNA, 23 bp, Homo sapiens
aagtccccaggccccaggaagcc

SEQ ID NO: 3715814 - DNA, 17 bp, Homo sapiens
aagtccctgccccctcc

SEQ ID NO: 3715815 - DNA, 18 bp, Homo sapiens
aagtccttacctcttccg

SEQ ID NO: 3715816 - DNA, 21 bp, Homo sapiens
aagtctcactggctgtcagta

SEQ ID NO: 3715817 - DNA, 15 bp, Homo sapiens
aagtctccagcccac

SEQ ID NO: 3715818 - DNA, 18 bp, Homo sapiens
aagtctctatttaaattc

SEQ ID NO: 3715819 - DNA, 19 bp, Homo sapiens
aagtctctatttaaattct

SEQ ID NO: 3715820 - DNA, 16 bp, Homo sapiens
aagtctctgctggccc

SEQ ID NO: 3715821 - DNA, 14 bp, Homo sapiens
aagtctctgtgaat

SEQ ID NO: 3715822 - DNA, 18 bp, Homo sapiens
aagtctgtgcctggagct

SEQ ID NO: 3715823 - DNA, 16 bp, Homo sapiens
aagtcttagatgtata

SEQ ID NO: 3715824 - DNA, 17 bp, Homo sapiens
aagtcttcaagggctgc

SEQ ID NO: 3715825 - DNA, 13 bp, Homo sapiens
aagtcttgctgtg

SEQ ID NO: 3715826 - DNA, 21 bp, Homo sapiens
aagtcttgctgtggtctcttt

SEQ ID NO: 3715827 - DNA, 14 bp, Homo sapiens
aagtgaatttgaat

SEQ ID NO: 3715828 - DNA, 16 bp, Homo sapiens
aagtgaatttgaatga

SEQ ID NO: 3715829 - DNA, 19 bp, Homo sapiens
aagtgacaaggccccagag

SEQ ID NO: 3715830 - DNA, 20 bp, Homo sapiens
aagtgacaaggccccagaga

SEQ ID NO: 3715831 - DNA, 16 bp, Homo sapiens
aagtgactgtatctgt

SEQ ID NO: 3715832 - DNA, 18 bp, Homo sapiens
aagtgactgtatctgtgt

SEQ ID NO: 3715833 - DNA, 15 bp, Homo sapiens
aagtgagaagatggt

SEQ ID NO: 3715834 - DNA, 14 bp, Homo sapiens
aagtgagagctggg

SEQ ID NO: 3715835 - DNA, 15 bp, Homo sapiens
aagtgagcaaacctg

SEQ ID NO: 3715836 - DNA, 20 bp, Homo sapiens
aagtgatcctcccacctcag

SEQ ID NO: 3715837 - DNA, 15 bp, Homo sapiens
aagtgattctcctgc

SEQ ID NO: 3715838 - DNA, 13 bp, Homo sapiens
aagtgcaggctgg

SEQ ID NO: 3715839 - DNA, 22 bp, Homo sapiens
aagtgccactgcccgagctggt

SEQ ID NO: 3715840 - DNA, 23 bp, Homo sapiens
aagtgcccctgctgcctccccaa

SEQ ID NO: 3715841 - DNA, 17 bp, Homo sapiens
aagtggaaggaaagatg

SEQ ID NO: 3715842 - DNA, 19 bp, Homo sapiens
aagtggaccaggacaggac

SEQ ID NO: 3715843 - DNA, 14 bp, Homo sapiens
aatgttaaagtcag

SEQ ID NO: 3715844 - DNA, 15 bp, Homo sapiens
aatgttacattatta

SEQ ID NO: 3715845 - DNA, 18 bp, Homo sapiens
aatgttactgatcatgca

SEQ ID NO: 3715846 - DNA, 22 bp, Homo sapiens
aatgttactgatcatgcattgt

SEQ ID NO: 3715847 - DNA, 22 bp, Homo sapiens
aatgttatagtgaattatccct

SEQ ID NO: 3715848 - DNA, 17 bp, Homo sapiens
aatgttcattgtaatgt

SEQ ID NO: 3715849 - DNA, 21 bp, Homo sapiens
aatgttcattgtaatgttact

SEQ ID NO: 3715850 - DNA, 24 bp, Homo sapiens
aatgttcattgtaatgttactgat

SEQ ID NO: 3715851 - DNA, 17 bp, Homo sapiens
aatgtttaaaaaagttt

SEQ ID NO: 3715852 - DNA, 16 bp, Homo sapiens
aatgtttatgagccag

SEQ ID NO: 3715853 - DNA, 16 bp, Homo sapiens
aatgtttgcctctgcc

SEQ ID NO: 3715854 - DNA, 12 bp, Homo sapiens
aattaaaacaat

SEQ ID NO: 3715855 - DNA, 13 bp, Homo sapiens
aattaaagaaaat

SEQ ID NO: 3715856 - DNA, 17 bp, Homo sapiens
aattaaagaaaataaaa

SEQ ID NO: 3715857 - DNA, 14 bp, Homo sapiens
aattaaataaaata

SEQ ID NO: 3715858 - DNA, 11 bp, Homo sapiens
aattaaatgta

SEQ ID NO: 3715859 - DNA, 12 bp, Homo sapiens
aattaacactgc

SEQ ID NO: 3715860 - DNA, 17 bp, Homo sapiens
aattaacatataatata

SEQ ID NO: 3715861 - DNA, 18 bp, Homo sapiens
aattaacatataatatat

SEQ ID NO: 3715862 - DNA, 20 bp, Homo sapiens
aattaacattgggaaatctt

SEQ ID NO: 3715863 - DNA, 13 bp, Homo sapiens
aattaacctggtg

SEQ ID NO: 3715864 - DNA, 18 bp, Homo sapiens
aattaacctggtgctgga

SEQ ID NO: 3715865 - DNA, 11 bp, Homo sapiens
aattaagaatg

SEQ ID NO: 3715866 - DNA, 12 bp, Homo sapiens
aattaagtaaac

SEQ ID NO: 3715867 - DNA, 13 bp, Homo sapiens
aattaagtactat

SEQ ID NO: 3715868 - DNA, 17 bp, Homo sapiens
aattaagtactatgtat

SEQ ID NO: 3715869 - DNA, 18 bp, Homo sapiens
aattaagtttgtgaatgt

SEQ ID NO: 3715870 - DNA, 21 bp, Homo sapiens
aattaccttgagccagtaatt

SEQ ID NO: 3715871 - DNA, 17 bp, Homo sapiens
aattactacaaaatttg

SEQ ID NO: 3715872 - DNA, 14 bp, Homo sapiens
aattagccgggcgt

SEQ ID NO: 3715873 - DNA, 21 bp, Homo sapiens
aattaggaagtgtaacagctg

SEQ ID NO: 3715874 - DNA, 17 bp, Homo sapiens
aattaggttttgtacaa

SEQ ID NO: 3715875 - DNA, 17 bp, Homo sapiens
aattataaggactgcat

SEQ ID NO: 3715876 - DNA, 16 bp, Homo sapiens
aattatcaagctaata

SEQ ID NO: 3715877 - DNA, 19 bp, Homo sapiens
aattatcaagctaataaaa

SEQ ID NO: 3715878 - DNA, 20 bp, Homo sapiens
aattatcggaagcagtgcct

SEQ ID NO: 3715879 - DNA, 21 bp, Homo sapiens
aattatcggaagcagtgcctt

SEQ ID NO: 3715880 - DNA, 17 bp, Homo sapiens
aattatcgggaacagtg

SEQ ID NO: 3715881 - DNA, 20 bp, Homo sapiens
aattatcgggaacagtgttt

SEQ ID NO: 3715882 - DNA, 13 bp, Homo sapiens
aattatctatttg

SEQ ID NO: 3715883 - DNA, 19 bp, Homo sapiens
aattatctatttgtatata

SEQ ID NO: 3715884 - DNA, 16 bp, Homo sapiens
aattatgttattgaaa

SEQ ID NO: 3715885 - DNA, 17 bp, Homo sapiens
aattatgttattgaaaa

SEQ ID NO: 3715886 - DNA, 20 bp, Homo sapiens
aattattcagttaagaaaaa

SEQ ID NO: 3715887 - DNA, 20 bp, Homo sapiens
aattattgtttatattttca

SEQ ID NO: 3715888 - DNA, 20 bp, Homo sapiens
aattatttatttatggagga

SEQ ID NO: 3715889 - DNA, 13 bp, Homo sapiens
aattatttcagaa

SEQ ID NO: 3715890 - DNA, 13 bp, Homo sapiens
aattcaaaaatgt

SEQ ID NO: 3715891 - DNA, 16 bp, Homo sapiens
aattcaaaaatgtaca

SEQ ID NO: 3715892 - DNA, 18 bp, Homo sapiens
aattcacaagctgcctcc

SEQ ID NO: 3715893 - DNA, 13 bp, Homo sapiens
aattcagctgccc

SEQ ID NO: 3715894 - DNA, 16 bp, Homo sapiens
aattcatatttatgaa

SEQ ID NO: 3715895 - DNA, 17 bp, Homo sapiens
aattcattctggtctct

SEQ ID NO: 3715896 - DNA, 14 bp, Homo sapiens
aattccaaaggaat

SEQ ID NO: 3715897 - DNA, 21 bp, Homo sapiens
aattcccagctgtctgtgtca

SEQ ID NO: 3715898 - DNA, 19 bp, Homo sapiens
aattcccattttgcaaaat

SEQ ID NO: 3715899 - DNA, 23 bp, Homo sapiens
aattccctatcttttagttttag

SEQ ID NO: 3715900 - DNA, 23 bp, Homo sapiens
aattccttagcttagacctcagc

SEQ ID NO: 3715901 - DNA, 19 bp, Homo sapiens
aattctaaatgaatgttta

SEQ ID NO: 3715902 - DNA, 14 bp, Homo sapiens
aattctaacttttt

SEQ ID NO: 3715903 - DNA, 19 bp, Homo sapiens
aattctcagaatctcaaat

SEQ ID NO: 3715904 - DNA, 21 bp, Homo sapiens
aattctcatttgtcacacact

SEQ ID NO: 3715905 - DNA, 16 bp, Homo sapiens
aattctgttcatttgt

SEQ ID NO: 3715906 - DNA, 16 bp, Homo sapiens
aattctgtttcttgag

SEQ ID NO: 3715907 - DNA, 16 bp, Homo sapiens
aattcttaagtatgtt

SEQ ID NO: 3715908 - DNA, 17 bp, Homo sapiens
aattcttacaaacatgt

SEQ ID NO: 3715909 - DNA, 22 bp, Homo sapiens
aattcttcacctaagtctctgt

SEQ ID NO: 3715910 - DNA, 20 bp, Homo sapiens
aattcttgtatattatggaa

SEQ ID NO: 3715911 - DNA, 21 bp, Homo sapiens
aattgaacttaaataaatgtc

SEQ ID NO: 3715912 - DNA, 22 bp, Homo sapiens
aattgaacttaaataaatgtca

SEQ ID NO: 3715913 - DNA, 12 bp, Homo sapiens
aattgaaggaaa

SEQ ID NO: 3715914 - DNA, 14 bp, Homo sapiens
aattgaatttaaca

SEQ ID NO: 3715915 - DNA, 21 bp, Homo sapiens
aattgaatttaacaatgcgaa

SEQ ID NO: 3715916 - DNA, 20 bp, Homo sapiens
aattgaattttcaagcatct

SEQ ID NO: 3715917 - DNA, 19 bp, Homo sapiens
aattgaggtctgctcggcc

SEQ ID NO: 3715918 - DNA, 13 bp, Homo sapiens
aattgataataaa

SEQ ID NO: 3715919 - DNA, 15 bp, Homo sapiens
aattgataataaact

SEQ ID NO: 3715920 - DNA, 22 bp, Homo sapiens
aattgatcattttccccccact

SEQ ID NO: 3715921 - DNA, 21 bp, Homo sapiens
aattgcaattttaacacacat

SEQ ID NO: 3715922 - DNA, 16 bp, Homo sapiens
aattgcatgctgcttt

SEQ ID NO: 3715923 - DNA, 21 bp, Homo sapiens
aattgcatgctgctttaattg

SEQ ID NO: 3715924 - DNA, 20 bp, Homo sapiens
aattgccatgtacagtatgt

SEQ ID NO: 3715925 - DNA, 14 bp, Homo sapiens
aattgctcaagttc

SEQ ID NO: 3715926 - DNA, 22 bp, Homo sapiens
aattgcttgaaagaaaatatgc

SEQ ID NO: 3715927 - DNA, 16 bp, Homo sapiens
aattggcattaaaact

SEQ ID NO: 3715928 - DNA, 21 bp, Homo sapiens
aattgggagcttgggaatgga

SEQ ID NO: 3715929 - DNA, 17 bp, Homo sapiens
aattgtaaaactgaggc

SEQ ID NO: 3715930 - DNA, 18 bp, Homo sapiens
aattgtatcatttgaaca

SEQ ID NO: 3715931 - DNA, 13 bp, Homo sapiens
aattgtccccagt

SEQ ID NO: 3715932 - DNA, 19 bp, Homo sapiens
aattgtctttggtgctttt

SEQ ID NO: 3715933 - DNA, 16 bp, Homo sapiens
aattgtgaattgataa

SEQ ID NO: 3715934 - DNA, 21 bp, Homo sapiens
aattgtgtggtcagtggctct

SEQ ID NO: 3715935 - DNA, 15 bp, Homo sapiens
aattgttaagatatg

SEQ ID NO: 3715936 - DNA, 15 bp, Homo sapiens
aattgtttaagtgtt

SEQ ID NO: 3715937 - DNA, 20 bp, Homo sapiens
aattgtttcaaaataaaaac

SEQ ID NO: 3715938 - DNA, 22 bp, Homo sapiens
aattgtttggggatgagaaagg

SEQ ID NO: 3715939 - DNA, 14 bp, Homo sapiens
aattgttttttatc

SEQ ID NO: 3715940 - DNA, 17 bp, Homo sapiens
aattgttttttatcttt

SEQ ID NO: 3715941 - DNA, 19 bp, Homo sapiens
aattgttttttatcttttc

SEQ ID NO: 3715942 - DNA, 13 bp, Homo sapiens
aatttaaaacaaa

SEQ ID NO: 3715943 - DNA, 12 bp, Homo sapiens
aatttaagcatt

SEQ ID NO: 3715944 - DNA, 13 bp, Homo sapiens
aatttaagcattg

SEQ ID NO: 3715945 - DNA, 14 bp, Homo sapiens
aatttaagcattgt

SEQ ID NO: 3715946 - DNA, 15 bp, Homo sapiens
aatttaagcattgtt

SEQ ID NO: 3715947 - DNA, 16 bp, Homo sapiens
aatttaagcattgttt

SEQ ID NO: 3715948 - DNA, 21 bp, Homo sapiens
aatttaagcattgtttgctta

SEQ ID NO: 3715949 - DNA, 23 bp, Homo sapiens
aatttaagcattgtttgcttatt

SEQ ID NO: 3715950 - DNA, 14 bp, Homo sapiens
aatttaatgcatgt

SEQ ID NO: 3715951 - DNA, 15 bp, Homo sapiens
aatttataattttaa

SEQ ID NO: 3715952 - DNA, 17 bp, Homo sapiens
aatttatagtttataca

SEQ ID NO: 3715953 - DNA, 17 bp, Homo sapiens
aatttatcacacttctg

SEQ ID NO: 3715954 - DNA, 18 bp, Homo sapiens
aatttatcctgaaatttc

SEQ ID NO: 3715955 - DNA, 18 bp, Homo sapiens
aatttatcttgtctctgg

SEQ ID NO: 3715956 - DNA, 18 bp, Homo sapiens
acaactatgatttggaaa

SEQ ID NO: 3715957 - DNA, 14 bp, Homo sapiens
acaacttaaataat

SEQ ID NO: 3715958 - DNA, 15 bp, Homo sapiens
acaacttaaataata

SEQ ID NO: 3715959 - DNA, 18 bp, Homo sapiens
acaagaaaggagagtctt

SEQ ID NO: 3715960 - DNA, 20 bp, Homo sapiens
acaagactttccccatactc

SEQ ID NO: 3715961 - DNA, 14 bp, Homo sapiens
acaagagcagcctg

SEQ ID NO: 3715962 - DNA, 18 bp, Homo sapiens
acaagagcagcctgtggc

SEQ ID NO: 3715963 - DNA, 20 bp, Homo sapiens
acaagagcagcctgtggcat

SEQ ID NO: 3715964 - DNA, 17 bp, Homo sapiens
acaagataagcttccag

SEQ ID NO: 3715965 - DNA, 15 bp, Homo sapiens
acaagatctttcagg

SEQ ID NO: 3715966 - DNA, 14 bp, Homo sapiens
acaagattcccaga

SEQ ID NO: 3715967 - DNA, 15 bp, Homo sapiens
acaagattcccagag

SEQ ID NO: 3715968 - DNA, 14 bp, Homo sapiens
acaagccccaggca

SEQ ID NO: 3715969 - DNA, 15 bp, Homo sapiens
acaagccccaggcag

SEQ ID NO: 3715970 - DNA, 17 bp, Homo sapiens
acaagcgtgagccactg

SEQ ID NO: 3715971 - DNA, 16 bp, Homo sapiens
acaagctcctggtctt

SEQ ID NO: 3715972 - DNA, 13 bp, Homo sapiens
acaagctgcaccc

SEQ ID NO: 3715973 - DNA, 22 bp, Homo sapiens
acaagctgcaccctcaggcagg

SEQ ID NO: 3715974 - DNA, 13 bp, Homo sapiens
acaagctgcctcc

SEQ ID NO: 3715975 - DNA, 18 bp, Homo sapiens
acaaggaatgcctgtgcc

SEQ ID NO: 3715976 - DNA, 19 bp, Homo sapiens
acaaggaatgcctgtgcca

SEQ ID NO: 3715977 - DNA, 20 bp, Homo sapiens
acaaggaatgcctgtgccaa

SEQ ID NO: 3715978 - DNA, 17 bp, Homo sapiens
acaaggattgctactgt

SEQ ID NO: 3715979 - DNA, 17 bp, Homo sapiens
acaaggccccagagact

SEQ ID NO: 3715980 - DNA, 17 bp, Homo sapiens
acaaggctagatcatga

SEQ ID NO: 3715981 - DNA, 20 bp, Homo sapiens
acaaggctgaccaagagaga

SEQ ID NO: 3715982 - DNA, 22 bp, Homo sapiens
acaaggctgaccaagagagaaa

SEQ ID NO: 3715983 - DNA, 20 bp, Homo sapiens
acaagggaagatttatgttt

SEQ ID NO: 3715984 - DNA, 16 bp, Homo sapiens
acaagggcagtggagg

SEQ ID NO: 3715985 - DNA, 18 bp, Homo sapiens
acaagggtctagggagag

SEQ ID NO: 3715986 - DNA, 20 bp, Homo sapiens
acaagggtctagggagagac

SEQ ID NO: 3715987 - DNA, 22 bp, Homo sapiens
acaaggtagccctggccagagg

SEQ ID NO: 3715988 - DNA, 16 bp, Homo sapiens
acaaggtagtttttac

SEQ ID NO: 3715989 - DNA, 21 bp, Homo sapiens
acaagtgagacaaaaagcact

SEQ ID NO: 3715990 - DNA, 22 bp, Homo sapiens
acaagttgcgacggagagaaaa

SEQ ID NO: 3715991 - DNA, 15 bp, Homo sapiens
acaagttgtgtttga

SEQ ID NO: 3715992 - DNA, 13 bp, Homo sapiens
acaagtttcagac

SEQ ID NO: 3715993 - DNA, 18 bp, Homo sapiens
acaataaatgtattcaaa

SEQ ID NO: 3715994 - DNA, 14 bp, Homo sapiens
acaataaatgtgca

SEQ ID NO: 3715995 - DNA, 20 bp, Homo sapiens
acaataactactgtgttcct

SEQ ID NO: 3715996 - DNA, 13 bp, Homo sapiens
acaataatttcag

SEQ ID NO: 3715997 - DNA, 18 bp, Homo sapiens
acaataggtgcttattct

SEQ ID NO: 3715998 - DNA, 14 bp, Homo sapiens
acaatatttaaaat

SEQ ID NO: 3715999 - DNA, 18 bp, Homo sapiens
acaatatttaaaatttat

SEQ ID NO: 3716000 - DNA, 14 bp, Homo sapiens
acaatatttattgt

SEQ ID NO: 3716001 - DNA, 11 bp, Homo sapiens
acaatctattt

SEQ ID NO: 3716002 - DNA, 17 bp, Homo sapiens
acaatctatttattgga

SEQ ID NO: 3716003 - DNA, 20 bp, Homo sapiens
acaatctatttattggacat

SEQ ID NO: 3716004 - DNA, 20 bp, Homo sapiens
acaatgcagatgccagagca

SEQ ID NO: 3716005 - DNA, 16 bp, Homo sapiens
acaatgcgaatggtag

SEQ ID NO: 3716006 - DNA, 21 bp, Homo sapiens
acaatgcgaatggtagtctaa

SEQ ID NO: 3716007 - DNA, 17 bp, Homo sapiens
acaatgtgaaaagaaaa

SEQ ID NO: 3716008 - DNA, 14 bp, Homo sapiens
acaatgtgtctgag

SEQ ID NO: 3716009 - DNA, 23 bp, Homo sapiens
acaattcctagataaaaagatgg

SEQ ID NO: 3716010 - DNA, 15 bp, Homo sapiens
acaattctacattgt

SEQ ID NO: 3716011 - DNA, 20 bp, Homo sapiens
acaatttaaagcaaaggagt

SEQ ID NO: 3716012 - DNA, 15 bp, Homo sapiens
acaattttgtacaaa

SEQ ID NO: 3716013 - DNA, 19 bp, Homo sapiens
acacaaaagtttctctttt

SEQ ID NO: 3716014 - DNA, 18 bp, Homo sapiens
acacaaattatcttaaaa

SEQ ID NO: 3716015 - DNA, 14 bp, Homo sapiens
acacaatacaataa

SEQ ID NO: 3716016 - DNA, 12 bp, Homo sapiens
acacaatgttat

SEQ ID NO: 3716017 - DNA, 14 bp, Homo sapiens
acacacaaagagag

SEQ ID NO: 3716018 - DNA, 15 bp, Homo sapiens
acacacacacacagg

SEQ ID NO: 3716019 - DNA, 11 bp, Homo sapiens
acacacacagg

SEQ ID NO: 3716020 - DNA, 11 bp, Homo sapiens
acacacagctc

SEQ ID NO: 3716021 - DNA, 17 bp, Homo sapiens
acacacagctctgtcct

SEQ ID NO: 3716022 - DNA, 19 bp, Homo sapiens
acacacagctctgtcctgg

SEQ ID NO: 3716023 - DNA, 13 bp, Homo sapiens
acacacaggagga

SEQ ID NO: 3716024 - DNA, 17 bp, Homo sapiens
acacacaggcaactgag

SEQ ID NO: 3716025 - DNA, 18 bp, Homo sapiens
acacacataaaggataaa

SEQ ID NO: 3716026 - DNA, 15 bp, Homo sapiens
acacaccagagccca

SEQ ID NO: 3716027 - DNA, 20 bp, Homo sapiens
acacaccagagcccaccttg

SEQ ID NO: 3716028 - DNA, 12 bp, Homo sapiens
acacaccaggct

SEQ ID NO: 3716029 - DNA, 18 bp, Homo sapiens
acacactgaggcagggaa

SEQ ID NO: 3716030 - DNA, 14 bp, Homo sapiens
acacagaaaccaat

SEQ ID NO: 3716031 - DNA, 23 bp, Homo sapiens
acacagactgcgatttgtcccag

SEQ ID NO: 3716032 - DNA, 13 bp, Homo sapiens
acacagaggaaga

SEQ ID NO: 3716033 - DNA, 20 bp, Homo sapiens
acacagctctgtcctgggag

SEQ ID NO: 3716034 - DNA, 14 bp, Homo sapiens
acacagctcttctc

SEQ ID NO: 3716035 - DNA, 19 bp, Homo sapiens
acacagctgcagagacaga

SEQ ID NO: 3716036 - DNA, 20 bp, Homo sapiens
acacaggatagataactctt

SEQ ID NO: 3716037 - DNA, 15 bp, Homo sapiens
acacaggcaactgag

SEQ ID NO: 3716038 - DNA, 16 bp, Homo sapiens
acacaggcccggctcc

SEQ ID NO: 3716039 - DNA, 20 bp, Homo sapiens
acacaggcccggctccaggc

SEQ ID NO: 3716040 - DNA, 18 bp, Homo sapiens
acacagtattacttctgc

SEQ ID NO: 3716041 - DNA, 18 bp, Homo sapiens
acacataaaggataaact

SEQ ID NO: 3716042 - DNA, 13 bp, Homo sapiens
acacatagattca

SEQ ID NO: 3716043 - DNA, 14 bp, Homo sapiens
acacatctcctcca

SEQ ID NO: 3716044 - DNA, 13 bp, Homo sapiens
acacatcttccac

SEQ ID NO: 3716045 - DNA, 18 bp, Homo sapiens
acacatgctgaacatcac

SEQ ID NO: 3716046 - DNA, 20 bp, Homo sapiens
acacattatcgggagcagtg

SEQ ID NO: 3716047 - DNA, 22 bp, Homo sapiens
acacatttttaaagctttcccc

SEQ ID NO: 3716048 - DNA, 23 bp, Homo sapiens
acaccagagcccaccttggctca

SEQ ID NO: 3716049 - DNA, 17 bp, Homo sapiens
acaccaggagtccctgg

SEQ ID NO: 3716050 - DNA, 19 bp, Homo sapiens
acaccaggagtccctggta

SEQ ID NO: 3716051 - DNA, 14 bp, Homo sapiens
acaccaggctgtgg

SEQ ID NO: 3716052 - DNA, 21 bp, Homo sapiens
acaccaggcttgcctgcaggc

SEQ ID NO: 3716053 - DNA, 20 bp, Homo sapiens
acacccaaagaggtatttat

SEQ ID NO: 3716054 - DNA, 20 bp, Homo sapiens
acacccagcccacttctgcc

SEQ ID NO: 3716055 - DNA, 21 bp, Homo sapiens
acacccagcccacttctgcca

SEQ ID NO: 3716056 - DNA, 18 bp, Homo sapiens
acacccccacctcctgca

SEQ ID NO: 3716057 - DNA, 23 bp, Homo sapiens
acacccctcccctgccctagagc

SEQ ID NO: 3716058 - DNA, 17 bp, Homo sapiens
acacccgactcctcaaa

SEQ ID NO: 3716059 - DNA, 12 bp, Homo sapiens
acaccctctccc

SEQ ID NO: 3716060 - DNA, 18 bp, Homo sapiens
acaccgttcattcaggca

SEQ ID NO: 3716061 - DNA, 17 bp, Homo sapiens
acacctaccctcctttt

SEQ ID NO: 3716062 - DNA, 15 bp, Homo sapiens
acacctattttagac

SEQ ID NO: 3716063 - DNA, 22 bp, Homo sapiens
acacctattttagacaaatcta

SEQ ID NO: 3716064 - DNA, 19 bp, Homo sapiens
acacctcccaggagacagt

SEQ ID NO: 3716065 - DNA, 21 bp, Homo sapiens
acacctcgttagggaagagaa

SEQ ID NO: 3716066 - DNA, 15 bp, Homo sapiens
acacctgcacctccc

SEQ ID NO: 3716067 - DNA, 18 bp, Homo sapiens
acacctgcacctcccccc

SEQ ID NO: 3716068 - DNA, 11 bp, Homo sapiens
acacctggccc

SEQ ID NO: 3716069 - DNA, 13 bp, Homo sapiens
accacacttcctg

SEQ ID NO: 3716070 - DNA, 23 bp, Homo sapiens
accacagggttcaaaatgtctgt

SEQ ID NO: 3716071 - DNA, 22 bp, Homo sapiens
accacaggttcatgccaccatg

SEQ ID NO: 3716072 - DNA, 13 bp, Homo sapiens
accacagtgtctg

SEQ ID NO: 3716073 - DNA, 23 bp, Homo sapiens
accacatagactttatgcaataa

SEQ ID NO: 3716074 - DNA, 14 bp, Homo sapiens
accacatcctccgt

SEQ ID NO: 3716075 - DNA, 20 bp, Homo sapiens
accacatcctccgtccagcc

SEQ ID NO: 3716076 - DNA, 14 bp, Homo sapiens
accaccaggtctcc

SEQ ID NO: 3716077 - DNA, 17 bp, Homo sapiens
accaccgctccccagcc

SEQ ID NO: 3716078 - DNA, 13 bp, Homo sapiens
accaccttcccag

SEQ ID NO: 3716079 - DNA, 22 bp, Homo sapiens
accacgatgtggccctggcctg

SEQ ID NO: 3716080 - DNA, 16 bp, Homo sapiens
accacgctggaccttg

SEQ ID NO: 3716081 - DNA, 18 bp, Homo sapiens
accacgcttgacaggaca

SEQ ID NO: 3716082 - DNA, 17 bp, Homo sapiens
accactacatgcagccc

SEQ ID NO: 3716083 - DNA, 17 bp, Homo sapiens
accactaggactctgag

SEQ ID NO: 3716084 - DNA, 15 bp, Homo sapiens
accactatgaagcta

SEQ ID NO: 3716085 - DNA, 21 bp, Homo sapiens
accactgaagatagaagaaaa

SEQ ID NO: 3716086 - DNA, 21 bp, Homo sapiens
accactgcactccagcctggg

SEQ ID NO: 3716087 - DNA, 20 bp, Homo sapiens
accactgtaaaatgaaatta

SEQ ID NO: 3716088 - DNA, 13 bp, Homo sapiens
accacttcattct

SEQ ID NO: 3716089 - DNA, 16 bp, Homo sapiens
accagaaatcaaaaag

SEQ ID NO: 3716090 - DNA, 15 bp, Homo sapiens
accagaagcaacaga

SEQ ID NO: 3716091 - DNA, 14 bp, Homo sapiens
accagaagggaaac

SEQ ID NO: 3716092 - DNA, 14 bp, Homo sapiens
accagacaccttga

SEQ ID NO: 3716093 - DNA, 22 bp, Homo sapiens
accagacaccttgacagggcac

SEQ ID NO: 3716094 - DNA, 19 bp, Homo sapiens
accagacggttcaccagcc

SEQ ID NO: 3716095 - DNA, 20 bp, Homo sapiens
accagagataatatgagaat

SEQ ID NO: 3716096 - DNA, 15 bp, Homo sapiens
accagagcactgtat

SEQ ID NO: 3716097 - DNA, 13 bp, Homo sapiens
accagagccatgg

SEQ ID NO: 3716098 - DNA, 23 bp, Homo sapiens
accagagccatggactctacact

SEQ ID NO: 3716099 - DNA, 16 bp, Homo sapiens
accagagcccaccttg

SEQ ID NO: 3716100 - DNA, 17 bp, Homo sapiens
accagagctctggagcc

SEQ ID NO: 3716101 - DNA, 17 bp, Homo sapiens
accagcaatatatctga

SEQ ID NO: 3716102 - DNA, 19 bp, Homo sapiens
accagcagatcccagctca

SEQ ID NO: 3716103 - DNA, 14 bp, Homo sapiens
accagcagcctgga

SEQ ID NO: 3716104 - DNA, 18 bp, Homo sapiens
accagccccagtgcccac

SEQ ID NO: 3716105 - DNA, 14 bp, Homo sapiens
accagcctccatgc

SEQ ID NO: 3716106 - DNA, 20 bp, Homo sapiens
accagcctccatgctgcctc

SEQ ID NO: 3716107 - DNA, 23 bp, Homo sapiens
accagcctctcttggtttccttc

SEQ ID NO: 3716108 - DNA, 13 bp, Homo sapiens
accagcctgggca

SEQ ID NO: 3716109 - DNA, 14 bp, Homo sapiens
accagcctgggcag

SEQ ID NO: 3716110 - DNA, 20 bp, Homo sapiens
accagcctggtcaacatggt

SEQ ID NO: 3716111 - DNA, 16 bp, Homo sapiens
accagcctttctccca

SEQ ID NO: 3716112 - DNA, 22 bp, Homo sapiens
accagcctttctcccaggccag

SEQ ID NO: 3716113 - DNA, 14 bp, Homo sapiens
accaggacaggacc

SEQ ID NO: 3716114 - DNA, 15 bp, Homo sapiens
accaggacaggacca

SEQ ID NO: 3716115 - DNA, 18 bp, Homo sapiens
accaggagaaccactaca

SEQ ID NO: 3716116 - DNA, 12 bp, Homo sapiens
accaggagacag

SEQ ID NO: 3716117 - DNA, 23 bp, Homo sapiens
accaggcacgaacccacctgctg

SEQ ID NO: 3716118 - DNA, 19 bp, Homo sapiens
accaggccgccccagcctc

SEQ ID NO: 3716119 - DNA, 18 bp, Homo sapiens
accaggcttgcctgcagg

SEQ ID NO: 3716120 - DNA, 21 bp, Homo sapiens
accagggatgatgcaacatcc

SEQ ID NO: 3716121 - DNA, 18 bp, Homo sapiens
accagggcaccaagccca

SEQ ID NO: 3716122 - DNA, 23 bp, Homo sapiens
accagggcgaacgacaatagctt

SEQ ID NO: 3716123 - DNA, 15 bp, Homo sapiens
accagggtttatctt

SEQ ID NO: 3716124 - DNA, 15 bp, Homo sapiens
accagtaaagtgtaa

SEQ ID NO: 3716125 - DNA, 23 bp, Homo sapiens
accagtctgaagtttcatttatg

SEQ ID NO: 3716126 - DNA, 21 bp, Homo sapiens
accagtgtagccttgcccgga

SEQ ID NO: 3716127 - DNA, 13 bp, Homo sapiens
accataacccagg

SEQ ID NO: 3716128 - DNA, 13 bp, Homo sapiens
accataatgttac

SEQ ID NO: 3716129 - DNA, 18 bp, Homo sapiens
accataatgttacattat

SEQ ID NO: 3716130 - DNA, 18 bp, Homo sapiens
accatagcgctgctctta

SEQ ID NO: 3716131 - DNA, 16 bp, Homo sapiens
accatatgaacatata

SEQ ID NO: 3716132 - DNA, 16 bp, Homo sapiens
accatcatgtctggct

SEQ ID NO: 3716133 - DNA, 19 bp, Homo sapiens
accatcctggccaacatga

SEQ ID NO: 3716134 - DNA, 17 bp, Homo sapiens
accatctcaggccacct

SEQ ID NO: 3716135 - DNA, 14 bp, Homo sapiens
accatgaaacaaag

SEQ ID NO: 3716136 - DNA, 22 bp, Homo sapiens
accatgattaaccacttcagct

SEQ ID NO: 3716137 - DNA, 16 bp, Homo sapiens
accatgcaaatgctat

SEQ ID NO: 3716138 - DNA, 17 bp, Homo sapiens
accatgtaaaacaaaaa

SEQ ID NO: 3716139 - DNA, 15 bp, Homo sapiens
accattccccatggg

SEQ ID NO: 3716140 - DNA, 14 bp, Homo sapiens
accattgtctcaga

SEQ ID NO: 3716141 - DNA, 15 bp, Homo sapiens
accattgtctcagag

SEQ ID NO: 3716142 - DNA, 11 bp, Homo sapiens
accatttataa

SEQ ID NO: 3716143 - DNA, 11 bp, Homo sapiens
accatttcaga

SEQ ID NO: 3716144 - DNA, 13 bp, Homo sapiens
accatttgtaata

SEQ ID NO: 3716145 - DNA, 14 bp, Homo sapiens
accatttgtaataa

SEQ ID NO: 3716146 - DNA, 19 bp, Homo sapiens
accatttgtaataaagtat

SEQ ID NO: 3716147 - DNA, 23 bp, Homo sapiens
acccaaaagtcaaaaggtgcctg

SEQ ID NO: 3716148 - DNA, 14 bp, Homo sapiens
acccaaacctggag

SEQ ID NO: 3716149 - DNA, 18 bp, Homo sapiens
acccaaagaggtatttat

SEQ ID NO: 3716150 - DNA, 23 bp, Homo sapiens
acccaaccacatcccactcacaa

SEQ ID NO: 3716151 - DNA, 20 bp, Homo sapiens
acccacaaaagtacaattta

SEQ ID NO: 3716152 - DNA, 13 bp, Homo sapiens
acccacagaaaga

SEQ ID NO: 3716153 - DNA, 13 bp, Homo sapiens
acccacagcctct

SEQ ID NO: 3716154 - DNA, 19 bp, Homo sapiens
acccacagcctctgcctgt

SEQ ID NO: 3716155 - DNA, 16 bp, Homo sapiens
acccaccagttgaatt

SEQ ID NO: 3716156 - DNA, 15 bp, Homo sapiens
acccaccctcctttc

SEQ ID NO: 3716157 - DNA, 15 bp, Homo sapiens
acccacctcagcctc

SEQ ID NO: 3716158 - DNA, 12 bp, Homo sapiens
acccacctgagc

SEQ ID NO: 3716159 - DNA, 19 bp, Homo sapiens
acccacctggtggcctctg

SEQ ID NO: 3716160 - DNA, 14 bp, Homo sapiens
acccactgctctgg

SEQ ID NO: 3716161 - DNA, 21 bp, Homo sapiens
acccagacagctccctctgcc

SEQ ID NO: 3716162 - DNA, 17 bp, Homo sapiens
acccagcccacttctgc

SEQ ID NO: 3716163 - DNA, 16 bp, Homo sapiens
acccagccccttgaga

SEQ ID NO: 3716164 - DNA, 20 bp, Homo sapiens
acccagccccttgagaaacc

SEQ ID NO: 3716165 - DNA, 17 bp, Homo sapiens
acccagcgagccctggt

SEQ ID NO: 3716166 - DNA, 15 bp, Homo sapiens
acccaggagccccga

SEQ ID NO: 3716167 - DNA, 23 bp, Homo sapiens
acccaggagccccgaggccttct

SEQ ID NO: 3716168 - DNA, 21 bp, Homo sapiens
acccaggaggtggaggttgca

SEQ ID NO: 3716169 - DNA, 19 bp, Homo sapiens
acccaggctggagtgcagt

SEQ ID NO: 3716170 - DNA, 13 bp, Homo sapiens
acccagtccctgg

SEQ ID NO: 3716171 - DNA, 19 bp, Homo sapiens
acccagtgttttaggagca

SEQ ID NO: 3716172 - DNA, 15 bp, Homo sapiens
acccatagcttccat

SEQ ID NO: 3716173 - DNA, 16 bp, Homo sapiens
acccatagcttccatg

SEQ ID NO: 3716174 - DNA, 14 bp, Homo sapiens
acccataggaaatc

SEQ ID NO: 3716175 - DNA, 19 bp, Homo sapiens
acccatcggtgtccattta

SEQ ID NO: 3716176 - DNA, 16 bp, Homo sapiens
acccatctacccctgg

SEQ ID NO: 3716177 - DNA, 17 bp, Homo sapiens
acccatctacccctgga

SEQ ID NO: 3716178 - DNA, 20 bp, Homo sapiens
acccatctgcacccccctgg

SEQ ID NO: 3716179 - DNA, 21 bp, Homo sapiens
acccatctgcacccccctggg

SEQ ID NO: 3716180 - DNA, 20 bp, Homo sapiens
acccatgaggcaatgtcagg

SEQ ID NO: 3716181 - DNA, 13 bp, Homo sapiens
acccattcctatt

SEQ ID NO: 3716182 - DNA, 20 bp, Homo sapiens
actgggtggggtgaggacca

SEQ ID NO: 3716183 - DNA, 22 bp, Homo sapiens
actgggtggggtgaggaccact

SEQ ID NO: 3716184 - DNA, 13 bp, Homo sapiens
actgggttgactt

SEQ ID NO: 3716185 - DNA, 20 bp, Homo sapiens
actgggttgactttcaggta

SEQ ID NO: 3716186 - DNA, 16 bp, Homo sapiens
actggtgagcagactg

SEQ ID NO: 3716187 - DNA, 12 bp, Homo sapiens
actggtggcccg

SEQ ID NO: 3716188 - DNA, 13 bp, Homo sapiens
actgtacaaagta

SEQ ID NO: 3716189 - DNA, 20 bp, Homo sapiens
actgtactcctcccaggcgc

SEQ ID NO: 3716190 - DNA, 18 bp, Homo sapiens
actgtagaatgatttcat

SEQ ID NO: 3716191 - DNA, 16 bp, Homo sapiens
actgtagattgcttct

SEQ ID NO: 3716192 - DNA, 13 bp, Homo sapiens
actgtagtctcag

SEQ ID NO: 3716193 - DNA, 16 bp, Homo sapiens
actgtagtctcaggac

SEQ ID NO: 3716194 - DNA, 21 bp, Homo sapiens
actgtagtttttcttcaacat

SEQ ID NO: 3716195 - DNA, 13 bp, Homo sapiens
actgtatctgtgt

SEQ ID NO: 3716196 - DNA, 13 bp, Homo sapiens
actgtatgctgga

SEQ ID NO: 3716197 - DNA, 12 bp, Homo sapiens
actgtcaataaa

SEQ ID NO: 3716198 - DNA, 17 bp, Homo sapiens
actgtcctacccaccct

SEQ ID NO: 3716199 - DNA, 14 bp, Homo sapiens
actgtcctctttca

SEQ ID NO: 3716200 - DNA, 23 bp, Homo sapiens
actgtcctctttcagaaaacaga

SEQ ID NO: 3716201 - DNA, 20 bp, Homo sapiens
actgtctcaagagggcactg

SEQ ID NO: 3716202 - DNA, 23 bp, Homo sapiens
actgtctcaagagggcactggtg

SEQ ID NO: 3716203 - DNA, 10 bp, Homo sapiens
actgtcttaa

SEQ ID NO: 3716204 - DNA, 17 bp, Homo sapiens
actgtcttaattaagta

SEQ ID NO: 3716205 - DNA, 22 bp, Homo sapiens
actgtgatgccacacagagtgg

SEQ ID NO: 3716206 - DNA, 11 bp, Homo sapiens
actgtgccttt

SEQ ID NO: 3716207 - DNA, 21 bp, Homo sapiens
actgtggccatggtccccaag

SEQ ID NO: 3716208 - DNA, 22 bp, Homo sapiens
actgtggccttggtctaacttt

SEQ ID NO: 3716209 - DNA, 19 bp, Homo sapiens
actgtggctgctagcactt

SEQ ID NO: 3716210 - DNA, 12 bp, Homo sapiens
actgtgtaactg

SEQ ID NO: 3716211 - DNA, 13 bp, Homo sapiens
actgtgtaactgc

SEQ ID NO: 3716212 - DNA, 21 bp, Homo sapiens
actgtgtccctctctctggaa

SEQ ID NO: 3716213 - DNA, 19 bp, Homo sapiens
actgtgtggactgtgatgc

SEQ ID NO: 3716214 - DNA, 21 bp, Homo sapiens
actgttaatagttcaggtaac

SEQ ID NO: 3716215 - DNA, 19 bp, Homo sapiens
actgttagaacactatttt

SEQ ID NO: 3716216 - DNA, 18 bp, Homo sapiens
actgttgccagagatgga

SEQ ID NO: 3716217 - DNA, 12 bp, Homo sapiens
actgttgcccag

SEQ ID NO: 3716218 - DNA, 13 bp, Homo sapiens
actgttgcccagg

SEQ ID NO: 3716219 - DNA, 16 bp, Homo sapiens
actgtttattcaacaa

SEQ ID NO: 3716220 - DNA, 14 bp, Homo sapiens
actgtttccacatt

SEQ ID NO: 3716221 - DNA, 14 bp, Homo sapiens
actgtttctctgct

SEQ ID NO: 3716222 - DNA, 12 bp, Homo sapiens
actgtttgttat

SEQ ID NO: 3716223 - DNA, 23 bp, Homo sapiens
actgtttttcagggaggtggctg

SEQ ID NO: 3716224 - DNA, 20 bp, Homo sapiens
actgttttttaaactaggaa

SEQ ID NO: 3716225 - DNA, 13 bp, Homo sapiens
acttaaaaaaatg

SEQ ID NO: 3716226 - DNA, 14 bp, Homo sapiens
acttaaaaaaatga

SEQ ID NO: 3716227 - DNA, 16 bp, Homo sapiens
acttaaaaaatgtcca

SEQ ID NO: 3716228 - DNA, 13 bp, Homo sapiens
acttaaaaagtct

SEQ ID NO: 3716229 - DNA, 20 bp, Homo sapiens
acttaaaatattcctgcatt

SEQ ID NO: 3716230 - DNA, 19 bp, Homo sapiens
acttaaataaatgtcatta

SEQ ID NO: 3716231 - DNA, 17 bp, Homo sapiens
acttaaattttaattta

SEQ ID NO: 3716232 - DNA, 16 bp, Homo sapiens
acttaaccgcatcaga

SEQ ID NO: 3716233 - DNA, 16 bp, Homo sapiens
acttaaccggagttcg

SEQ ID NO: 3716234 - DNA, 13 bp, Homo sapiens
acttaataaattc

SEQ ID NO: 3716235 - DNA, 17 bp, Homo sapiens
acttaataaattcagat

SEQ ID NO: 3716236 - DNA, 17 bp, Homo sapiens
acttacctagatttaca

SEQ ID NO: 3716237 - DNA, 17 bp, Homo sapiens
acttagcttatcaattt

SEQ ID NO: 3716238 - DNA, 20 bp, Homo sapiens
acttagcttatcaatttgtc

SEQ ID NO: 3716239 - DNA, 18 bp, Homo sapiens
acttaggcatgcacagct

SEQ ID NO: 3716240 - DNA, 19 bp, Homo sapiens
acttatcctaaaacaaata

SEQ ID NO: 3716241 - DNA, 23 bp, Homo sapiens
acttatgttactggtgtccagct

SEQ ID NO: 3716242 - DNA, 18 bp, Homo sapiens
acttattgctttgaaact

SEQ ID NO: 3716243 - DNA, 17 bp, Homo sapiens
acttatttatgaacctg

SEQ ID NO: 3716244 - DNA, 19 bp, Homo sapiens
acttatttttgacagtgtt

SEQ ID NO: 3716245 - DNA, 18 bp, Homo sapiens
acttcaagcaccagggaa

SEQ ID NO: 3716246 - DNA, 22 bp, Homo sapiens
acttcaagtgcatgctctctgc

SEQ ID NO: 3716247 - DNA, 19 bp, Homo sapiens
acttcacactgcaagagcc

SEQ ID NO: 3716248 - DNA, 21 bp, Homo sapiens
acttcagggcagggctctgat

SEQ ID NO: 3716249 - DNA, 22 bp, Homo sapiens
acttcagggttctcctctcccc

SEQ ID NO: 3716250 - DNA, 17 bp, Homo sapiens
acttcatagatttcctt

SEQ ID NO: 3716251 - DNA, 18 bp, Homo sapiens
acttcatatatgaggact

SEQ ID NO: 3716252 - DNA, 19 bp, Homo sapiens
acttcattcttgaaagctg

SEQ ID NO: 3716253 - DNA, 14 bp, Homo sapiens
acttccaccagcct

SEQ ID NO: 3716254 - DNA, 15 bp, Homo sapiens
acttccaccagcctg

SEQ ID NO: 3716255 - DNA, 16 bp, Homo sapiens
acttccaccagcctgc

SEQ ID NO: 3716256 - DNA, 18 bp, Homo sapiens
acttccaccagcctgcac

SEQ ID NO: 3716257 - DNA, 15 bp, Homo sapiens
acttccactgatgga

SEQ ID NO: 3716258 - DNA, 23 bp, Homo sapiens
acttcccagttcaggagtcccaa

SEQ ID NO: 3716259 - DNA, 22 bp, Homo sapiens
acttccccgcattccaggctcc

SEQ ID NO: 3716260 - DNA, 14 bp, Homo sapiens
acttcctgcctggt

SEQ ID NO: 3716261 - DNA, 17 bp, Homo sapiens
acttcctgcctggtctc

SEQ ID NO: 3716262 - DNA, 13 bp, Homo sapiens
acttcctgtccag

SEQ ID NO: 3716263 - DNA, 17 bp, Homo sapiens
acttcctgtccagagag

SEQ ID NO: 3716264 - DNA, 15 bp, Homo sapiens
acttcctgtgacttc

SEQ ID NO: 3716265 - DNA, 16 bp, Homo sapiens
acttctaaatgaagtg

SEQ ID NO: 3716266 - DNA, 23 bp, Homo sapiens
acttctacttctgcccttgccaa

SEQ ID NO: 3716267 - DNA, 16 bp, Homo sapiens
acttctccaccctgct

SEQ ID NO: 3716268 - DNA, 22 bp, Homo sapiens
acttcttccatccaaagaatta

SEQ ID NO: 3716269 - DNA, 22 bp, Homo sapiens
acttcttttataactagtcctt

SEQ ID NO: 3716270 - DNA, 20 bp, Homo sapiens
acttcttttgctcttagctg

SEQ ID NO: 3716271 - DNA, 14 bp, Homo sapiens
acttgaaagcatcc

SEQ ID NO: 3716272 - DNA, 20 bp, Homo sapiens
acttgaagccatctaaagta

SEQ ID NO: 3716273 - DNA, 18 bp, Homo sapiens
acttgacagaacactgtc

SEQ ID NO: 3716274 - DNA, 17 bp, Homo sapiens
acttgacttttaaggct

SEQ ID NO: 3716275 - DNA, 17 bp, Homo sapiens
acttgagaacttgacaa

SEQ ID NO: 3716276 - DNA, 19 bp, Homo sapiens
acttgagaattaccctttt

SEQ ID NO: 3716277 - DNA, 16 bp, Homo sapiens
acttgatggtcagaca

SEQ ID NO: 3716278 - DNA, 22 bp, Homo sapiens
acttgatggtcagacacaaaca

SEQ ID NO: 3716279 - DNA, 19 bp, Homo sapiens
acttgcagactctacagag

SEQ ID NO: 3716280 - DNA, 22 bp, Homo sapiens
acttgcagactctacagaggcc

SEQ ID NO: 3716281 - DNA, 15 bp, Homo sapiens
acttgctgctatttt

SEQ ID NO: 3716282 - DNA, 22 bp, Homo sapiens
acttggaaaaatccagaaagaa

SEQ ID NO: 3716283 - DNA, 14 bp, Homo sapiens
acttggaagctccg

SEQ ID NO: 3716284 - DNA, 11 bp, Homo sapiens
acttggagcca

SEQ ID NO: 3716285 - DNA, 14 bp, Homo sapiens
acttggagccccag

SEQ ID NO: 3716286 - DNA, 13 bp, Homo sapiens
acttggttataca

SEQ ID NO: 3716287 - DNA, 20 bp, Homo sapiens
acttggttatacatgacact

SEQ ID NO: 3716288 - DNA, 16 bp, Homo sapiens
acttggtttttaaaaa

SEQ ID NO: 3716289 - DNA, 23 bp, Homo sapiens
acttgtccttttgtaccatggtg

SEQ ID NO: 3716290 - DNA, 19 bp, Homo sapiens
acttgtcttaaataaaaga

SEQ ID NO: 3716291 - DNA, 16 bp, Homo sapiens
acttgtggacacagct

SEQ ID NO: 3716292 - DNA, 17 bp, Homo sapiens
acttgtggacacagctc

SEQ ID NO: 3716293 - DNA, 18 bp, Homo sapiens
acttgtggacacagctct

SEQ ID NO: 3716294 - DNA, 20 bp, Homo sapiens
acttgtgtgtgggctgtgag

SEQ ID NO: 3716295 - DNA, 16 bp, Homo sapiens
agagacgcaggaatgg

SEQ ID NO: 3716296 - DNA, 15 bp, Homo sapiens
agagactgtagattg

SEQ ID NO: 3716297 - DNA, 22 bp, Homo sapiens
agagactgtagattgcttctgt

SEQ ID NO: 3716298 - DNA, 20 bp, Homo sapiens
agagagaacaactactgtga

SEQ ID NO: 3716299 - DNA, 14 bp, Homo sapiens
agagagacaagaag

SEQ ID NO: 3716300 - DNA, 14 bp, Homo sapiens
agagagatgttttg

SEQ ID NO: 3716301 - DNA, 19 bp, Homo sapiens
agagagctgagtgagctga

SEQ ID NO: 3716302 - DNA, 17 bp, Homo sapiens
agagaggaatcagactt

SEQ ID NO: 3716303 - DNA, 13 bp, Homo sapiens
agagaggagtcag

SEQ ID NO: 3716304 - DNA, 20 bp, Homo sapiens
agagaggagtcagagagaat

SEQ ID NO: 3716305 - DNA, 14 bp, Homo sapiens
agagagggggccac

SEQ ID NO: 3716306 - DNA, 16 bp, Homo sapiens
agagagggggccacct

SEQ ID NO: 3716307 - DNA, 19 bp, Homo sapiens
agagagggggccacctccc

SEQ ID NO: 3716308 - DNA, 21 bp, Homo sapiens
agagagggtggtgacctctgc

SEQ ID NO: 3716309 - DNA, 22 bp, Homo sapiens
agagaggtcaagcccaggagga

SEQ ID NO: 3716310 - DNA, 13 bp, Homo sapiens
agagatacagagg

SEQ ID NO: 3716311 - DNA, 20 bp, Homo sapiens
agagataccaagatgccatc

SEQ ID NO: 3716312 - DNA, 17 bp, Homo sapiens
agagatatggcagcgaa

SEQ ID NO: 3716313 - DNA, 14 bp, Homo sapiens
agagatctgctgtc

SEQ ID NO: 3716314 - DNA, 18 bp, Homo sapiens
agagatgactgagtcctc

SEQ ID NO: 3716315 - DNA, 16 bp, Homo sapiens
agagatgcctccaccg

SEQ ID NO: 3716316 - DNA, 23 bp, Homo sapiens
agagatgcctccaccgctgccta

SEQ ID NO: 3716317 - DNA, 13 bp, Homo sapiens
agagatggaggag

SEQ ID NO: 3716318 - DNA, 14 bp, Homo sapiens
agagatggaggagg

SEQ ID NO: 3716319 - DNA, 16 bp, Homo sapiens
agagattgtggtttca

SEQ ID NO: 3716320 - DNA, 19 bp, Homo sapiens
agagcaaagggccaggaag

SEQ ID NO: 3716321 - DNA, 14 bp, Homo sapiens
agagcagaggcagc

SEQ ID NO: 3716322 - DNA, 17 bp, Homo sapiens
agagcagcctgtggcat

SEQ ID NO: 3716323 - DNA, 19 bp, Homo sapiens
agagcagcctgtggcatct

SEQ ID NO: 3716324 - DNA, 12 bp, Homo sapiens
agagcaggcaca

SEQ ID NO: 3716325 - DNA, 19 bp, Homo sapiens
agagcaggcacatggagga

SEQ ID NO: 3716326 - DNA, 20 bp, Homo sapiens
agagcaggcacatggaggag

SEQ ID NO: 3716327 - DNA, 23 bp, Homo sapiens
agagccaatggagtagacccctg

SEQ ID NO: 3716328 - DNA, 13 bp, Homo sapiens
agagccagctccc

SEQ ID NO: 3716329 - DNA, 13 bp, Homo sapiens
agagcccaccttg

SEQ ID NO: 3716330 - DNA, 15 bp, Homo sapiens
agagcccttcatttg

SEQ ID NO: 3716331 - DNA, 16 bp, Homo sapiens
agagccgggaagcgat

SEQ ID NO: 3716332 - DNA, 13 bp, Homo sapiens
agagcctgctccc

SEQ ID NO: 3716333 - DNA, 15 bp, Homo sapiens
agagcctgctccccc

SEQ ID NO: 3716334 - DNA, 12 bp, Homo sapiens
agagcctgctgc

SEQ ID NO: 3716335 - DNA, 15 bp, Homo sapiens
agagcctgctgcatg

SEQ ID NO: 3716336 - DNA, 20 bp, Homo sapiens
agagcctggttgcccaggga

SEQ ID NO: 3716337 - DNA, 20 bp, Homo sapiens
agagccttggtgtccacctg

SEQ ID NO: 3716338 - DNA, 17 bp, Homo sapiens
agagcgagagtctgtct

SEQ ID NO: 3716339 - DNA, 23 bp, Homo sapiens
agagcgaggctgagcctacagat

SEQ ID NO: 3716340 - DNA, 15 bp, Homo sapiens
agagcgcctgcccct

SEQ ID NO: 3716341 - DNA, 23 bp, Homo sapiens
agagcgcctgcccctcccagaac

SEQ ID NO: 3716342 - DNA, 18 bp, Homo sapiens
agagcgtccttccccctg

SEQ ID NO: 3716343 - DNA, 14 bp, Homo sapiens
agagctagcgctgc

SEQ ID NO: 3716344 - DNA, 21 bp, Homo sapiens
agagctagcgctgccgcaccc

SEQ ID NO: 3716345 - DNA, 19 bp, Homo sapiens
agagctctggagccacctg

SEQ ID NO: 3716346 - DNA, 11 bp, Homo sapiens
agagctgaggc

SEQ ID NO: 3716347 - DNA, 12 bp, Homo sapiens
agagctgggtga

SEQ ID NO: 3716348 - DNA, 16 bp, Homo sapiens
agagctggtgcccgga

SEQ ID NO: 3716349 - DNA, 15 bp, Homo sapiens
agagctggtgtctga

SEQ ID NO: 3716350 - DNA, 15 bp, Homo sapiens
agagcttctggcact

SEQ ID NO: 3716351 - DNA, 15 bp, Homo sapiens
agagctttacaaaaa

SEQ ID NO: 3716352 - DNA, 22 bp, Homo sapiens
agagctttcttcccgaacccca

SEQ ID NO: 3716353 - DNA, 14 bp, Homo sapiens
agaggaaccaaccc

SEQ ID NO: 3716354 - DNA, 17 bp, Homo sapiens
agaggaagagtgcaaaa

SEQ ID NO: 3716355 - DNA, 23 bp, Homo sapiens
agaggaatcagacttcacactgc

SEQ ID NO: 3716356 - DNA, 24 bp, Homo sapiens
agaggaatcagacttcacactgca

SEQ ID NO: 3716357 - DNA, 14 bp, Homo sapiens
agaggacttttctt

SEQ ID NO: 3716358 - DNA, 15 bp, Homo sapiens
agaggagaaacacat

SEQ ID NO: 3716359 - DNA, 13 bp, Homo sapiens
agaggagaggggc

SEQ ID NO: 3716360 - DNA, 18 bp, Homo sapiens
agaggcaactgcattggc

SEQ ID NO: 3716361 - DNA, 19 bp, Homo sapiens
agaggcagagtgccccacc

SEQ ID NO: 3716362 - DNA, 22 bp, Homo sapiens
agaggcagccccattctgcctg

SEQ ID NO: 3716363 - DNA, 13 bp, Homo sapiens
agaggcagggagg

SEQ ID NO: 3716364 - DNA, 19 bp, Homo sapiens
agaggccatgattcgccca

SEQ ID NO: 3716365 - DNA, 16 bp, Homo sapiens
agaggccatggcagaa

SEQ ID NO: 3716366 - DNA, 23 bp, Homo sapiens
agaggccatggcagaataatctt

SEQ ID NO: 3716367 - DNA, 19 bp, Homo sapiens
agaggctgaaagaggccaa

SEQ ID NO: 3716368 - DNA, 22 bp, Homo sapiens
agaggctgcctctcccatcact

SEQ ID NO: 3716369 - DNA, 22 bp, Homo sapiens
agaggctgttcccaccaggctg

SEQ ID NO: 3716370 - DNA, 15 bp, Homo sapiens
agagggaagaaaaga

SEQ ID NO: 3716371 - DNA, 22 bp, Homo sapiens
agagggatgaggtgctgggagg

SEQ ID NO: 3716372 - DNA, 14 bp, Homo sapiens
agagggcccaggca

SEQ ID NO: 3716373 - DNA, 22 bp, Homo sapiens
agaggggaaaccagtgtagcct

SEQ ID NO: 3716374 - DNA, 18 bp, Homo sapiens
agagggtctggagaagca

SEQ ID NO: 3716375 - DNA, 22 bp, Homo sapiens
agagggtctggagaagcagtga

SEQ ID NO: 3716376 - DNA, 13 bp, Homo sapiens
agagggttcctgt

SEQ ID NO: 3716377 - DNA, 16 bp, Homo sapiens
agaggtcaagcccagg

SEQ ID NO: 3716378 - DNA, 19 bp, Homo sapiens
agaggtcttttttaaaagg

SEQ ID NO: 3716379 - DNA, 17 bp, Homo sapiens
agaggttcatttcaaat

SEQ ID NO: 3716380 - DNA, 15 bp, Homo sapiens
agagtaaaaactgaa

SEQ ID NO: 3716381 - DNA, 18 bp, Homo sapiens
agagtagccgagagcctg

SEQ ID NO: 3716382 - DNA, 16 bp, Homo sapiens
agagtcagcagaactg

SEQ ID NO: 3716383 - DNA, 19 bp, Homo sapiens
agagtcatctccatcagct

SEQ ID NO: 3716384 - DNA, 14 bp, Homo sapiens
agagtccaggcccc

SEQ ID NO: 3716385 - DNA, 12 bp, Homo sapiens
agagtcctattt

SEQ ID NO: 3716386 - DNA, 22 bp, Homo sapiens
agagtctcactgttgcccaggc

SEQ ID NO: 3716387 - DNA, 15 bp, Homo sapiens
agagtgagaccctgt

SEQ ID NO: 3716388 - DNA, 17 bp, Homo sapiens
agagtgcaacagtagca

SEQ ID NO: 3716389 - DNA, 12 bp, Homo sapiens
agagtggcctgg

SEQ ID NO: 3716390 - DNA, 15 bp, Homo sapiens
agagtggcctggcca

SEQ ID NO: 3716391 - DNA, 22 bp, Homo sapiens
agagtggcctggccaggagctc

SEQ ID NO: 3716392 - DNA, 12 bp, Homo sapiens
agagtggctcct

SEQ ID NO: 3716393 - DNA, 22 bp, Homo sapiens
agagtgtcttcacggcaggaca

SEQ ID NO: 3716394 - DNA, 14 bp, Homo sapiens
agagtgtgcctgaa

SEQ ID NO: 3716395 - DNA, 19 bp, Homo sapiens
agagtgtgggaagggagag

SEQ ID NO: 3716396 - DNA, 12 bp, Homo sapiens
agagttaagaat

SEQ ID NO: 3716397 - DNA, 14 bp, Homo sapiens
agagttaagaatgt

SEQ ID NO: 3716398 - DNA, 20 bp, Homo sapiens
agagttaatatatagaaggg

SEQ ID NO: 3716399 - DNA, 20 bp, Homo sapiens
agagttaggtttaacataaa

SEQ ID NO: 3716400 - DNA, 13 bp, Homo sapiens
agagttcagtaag

SEQ ID NO: 3716401 - DNA, 17 bp, Homo sapiens
agagttgtgttgttctt

SEQ ID NO: 3716402 - DNA, 20 bp, Homo sapiens
agagtttgagacctgaatag

SEQ ID NO: 3716403 - DNA, 12 bp, Homo sapiens
agataaaaagat

SEQ ID NO: 3716404 - DNA, 21 bp, Homo sapiens
agataaaaagatggcctttgc

SEQ ID NO: 3716405 - DNA, 13 bp, Homo sapiens
agataaactcaga

SEQ ID NO: 3716406 - DNA, 12 bp, Homo sapiens
agataaatgtgc

SEQ ID NO: 3716407 - DNA, 18 bp, Homo sapiens
agataacaagatctttca

SEQ ID NO: 3716408 - DNA, 14 bp, Homo sapiens
agataactctttgg

SEQ ID NO: 3716409 - DNA, 16 bp, Homo sapiens
agcccgcatgcagcag

SEQ ID NO: 3716410 - DNA, 21 bp, Homo sapiens
agcccgcatgcagcagcttgc

SEQ ID NO: 3716411 - DNA, 15 bp, Homo sapiens
agcccgtgtggcccc

SEQ ID NO: 3716412 - DNA, 16 bp, Homo sapiens
agcccgtgtggcccct

SEQ ID NO: 3716413 - DNA, 18 bp, Homo sapiens
agcccgtgtggccccttc

SEQ ID NO: 3716414 - DNA, 12 bp, Homo sapiens
agccctccctgc

SEQ ID NO: 3716415 - DNA, 16 bp, Homo sapiens
agccctccctgtcctc

SEQ ID NO: 3716416 - DNA, 20 bp, Homo sapiens
agccctccctgtcctcctcg

SEQ ID NO: 3716417 - DNA, 13 bp, Homo sapiens
agccctcctcacc

SEQ ID NO: 3716418 - DNA, 14 bp, Homo sapiens
agccctcctcaccc

SEQ ID NO: 3716419 - DNA, 16 bp, Homo sapiens
agccctctcactgtgt

SEQ ID NO: 3716420 - DNA, 19 bp, Homo sapiens
agccctctcactgtgtccc

SEQ ID NO: 3716421 - DNA, 22 bp, Homo sapiens
agccctgctttgggctgccctg

SEQ ID NO: 3716422 - DNA, 23 bp, Homo sapiens
agccctgctttgggctgccctgg

SEQ ID NO: 3716423 - DNA, 23 bp, Homo sapiens
agccctggatttcagaaagagca

SEQ ID NO: 3716424 - DNA, 19 bp, Homo sapiens
agccctgggccccaccacc

SEQ ID NO: 3716425 - DNA, 19 bp, Homo sapiens
agccctgtcagtgcagccc

SEQ ID NO: 3716426 - DNA, 23 bp, Homo sapiens
agcccttccatgtcgcctctgca

SEQ ID NO: 3716427 - DNA, 16 bp, Homo sapiens
agcccttgaagatatc

SEQ ID NO: 3716428 - DNA, 12 bp, Homo sapiens
agcccttgggtt

SEQ ID NO: 3716429 - DNA, 15 bp, Homo sapiens
agccctttggagaac

SEQ ID NO: 3716430 - DNA, 21 bp, Homo sapiens
agccctttgggaggctgaggc

SEQ ID NO: 3716431 - DNA, 12 bp, Homo sapiens
agccgacctcag

SEQ ID NO: 3716432 - DNA, 13 bp, Homo sapiens
agccgagagcctg

SEQ ID NO: 3716433 - DNA, 16 bp, Homo sapiens
agccgagagcctgctc

SEQ ID NO: 3716434 - DNA, 18 bp, Homo sapiens
agccgagagcctgctccc

SEQ ID NO: 3716435 - DNA, 21 bp, Homo sapiens
agccgagagcctgctccccca

SEQ ID NO: 3716436 - DNA, 14 bp, Homo sapiens
agccgcagcctccc

SEQ ID NO: 3716437 - DNA, 16 bp, Homo sapiens
agccgcatcttctcca

SEQ ID NO: 3716438 - DNA, 21 bp, Homo sapiens
agccgcatcttctccatctgg

SEQ ID NO: 3716439 - DNA, 13 bp, Homo sapiens
agccgccacatcc

SEQ ID NO: 3716440 - DNA, 21 bp, Homo sapiens
agccgccaggaccgccaaaga

SEQ ID NO: 3716441 - DNA, 21 bp, Homo sapiens
agccgccatgctcctggccca

SEQ ID NO: 3716442 - DNA, 17 bp, Homo sapiens
agccgccattgccacca

SEQ ID NO: 3716443 - DNA, 19 bp, Homo sapiens
agccgccattgccaccagg

SEQ ID NO: 3716444 - DNA, 20 bp, Homo sapiens
agccgccattgccaccagga

SEQ ID NO: 3716445 - DNA, 21 bp, Homo sapiens
agccgccattgccaccaggag

SEQ ID NO: 3716446 - DNA, 14 bp, Homo sapiens
agccgctcctgtct

SEQ ID NO: 3716447 - DNA, 15 bp, Homo sapiens
agccggggcctgcct

SEQ ID NO: 3716448 - DNA, 18 bp, Homo sapiens
agccggggcctgcctagc

SEQ ID NO: 3716449 - DNA, 19 bp, Homo sapiens
agccggggcctgcctagca

SEQ ID NO: 3716450 - DNA, 19 bp, Homo sapiens
agccgtcagccaaatgtaa

SEQ ID NO: 3716451 - DNA, 16 bp, Homo sapiens
agccgtgccctgcccc

SEQ ID NO: 3716452 - DNA, 16 bp, Homo sapiens
agccgtgccttcagct

SEQ ID NO: 3716453 - DNA, 18 bp, Homo sapiens
agcctaagatgaagagga

SEQ ID NO: 3716454 - DNA, 16 bp, Homo sapiens
agcctacagatgaact

SEQ ID NO: 3716455 - DNA, 19 bp, Homo sapiens
agcctactagggacctggg

SEQ ID NO: 3716456 - DNA, 21 bp, Homo sapiens
agcctactagggacctgggga

SEQ ID NO: 3716457 - DNA, 23 bp, Homo sapiens
agcctagttcatccaatcctcac

SEQ ID NO: 3716458 - DNA, 15 bp, Homo sapiens
agcctattgtaaata

SEQ ID NO: 3716459 - DNA, 20 bp, Homo sapiens
agcctcaacctccccggctc

SEQ ID NO: 3716460 - DNA, 22 bp, Homo sapiens
agcctcacttgaatgtgtcact

SEQ ID NO: 3716461 - DNA, 14 bp, Homo sapiens
agcctcagcatcct

SEQ ID NO: 3716462 - DNA, 19 bp, Homo sapiens
agcctcagcatcctggcac

SEQ ID NO: 3716463 - DNA, 17 bp, Homo sapiens
agcctcatccgaggcag

SEQ ID NO: 3716464 - DNA, 17 bp, Homo sapiens
agcctccatttagttct

SEQ ID NO: 3716465 - DNA, 16 bp, Homo sapiens
agcctcccaaagtgct

SEQ ID NO: 3716466 - DNA, 21 bp, Homo sapiens
agcctcccaaagtgctgggat

SEQ ID NO: 3716467 - DNA, 13 bp, Homo sapiens
agcctcccacccc

SEQ ID NO: 3716468 - DNA, 18 bp, Homo sapiens
agcctcccgagtagctgg

SEQ ID NO: 3716469 - DNA, 15 bp, Homo sapiens
agcctccctctgacc

SEQ ID NO: 3716470 - DNA, 11 bp, Homo sapiens
agcctccctga

SEQ ID NO: 3716471 - DNA, 23 bp, Homo sapiens
agcctccggagtagctgggacca

SEQ ID NO: 3716472 - DNA, 17 bp, Homo sapiens
agcctccgtatttcaga

SEQ ID NO: 3716473 - DNA, 15 bp, Homo sapiens
agcctcgaactcctg

SEQ ID NO: 3716474 - DNA, 12 bp, Homo sapiens
agcctctccagg

SEQ ID NO: 3716475 - DNA, 20 bp, Homo sapiens
agcctctcttcctatcccat

SEQ ID NO: 3716476 - DNA, 21 bp, Homo sapiens
agcctctcttcctatcccatc

SEQ ID NO: 3716477 - DNA, 23 bp, Homo sapiens
agcctctgaaaaccaatgttctc

SEQ ID NO: 3716478 - DNA, 12 bp, Homo sapiens
agcctctgctgc

SEQ ID NO: 3716479 - DNA, 14 bp, Homo sapiens
agcctctgctgcca

SEQ ID NO: 3716480 - DNA, 13 bp, Homo sapiens
agcctctggctag

SEQ ID NO: 3716481 - DNA, 20 bp, Homo sapiens
agcctcttaaagctgcctgt

SEQ ID NO: 3716482 - DNA, 17 bp, Homo sapiens
agcctgaggctgagact

SEQ ID NO: 3716483 - DNA, 16 bp, Homo sapiens
agcctgcctcttctct

SEQ ID NO: 3716484 - DNA, 19 bp, Homo sapiens
agcctgcctcttctctact

SEQ ID NO: 3716485 - DNA, 15 bp, Homo sapiens
agcctgcgtggctga

SEQ ID NO: 3716486 - DNA, 23 bp, Homo sapiens
agcctgctcccccaccccctccc

SEQ ID NO: 3716487 - DNA, 11 bp, Homo sapiens
agcctgctgca

SEQ ID NO: 3716488 - DNA, 14 bp, Homo sapiens
agcctgctttttaa

SEQ ID NO: 3716489 - DNA, 14 bp, Homo sapiens
agcctggaccctgt

SEQ ID NO: 3716490 - DNA, 11 bp, Homo sapiens
agcctggaggc

SEQ ID NO: 3716491 - DNA, 20 bp, Homo sapiens
agcctggcacagggcagtgg

SEQ ID NO: 3716492 - DNA, 14 bp, Homo sapiens
agcctggcttctgg

SEQ ID NO: 3716493 - DNA, 19 bp, Homo sapiens
agcctggcttctggagccc

SEQ ID NO: 3716494 - DNA, 20 bp, Homo sapiens
agcctggcttctggagccct

SEQ ID NO: 3716495 - DNA, 21 bp, Homo sapiens
agcctgggcagccaggctgcc

SEQ ID NO: 3716496 - DNA, 11 bp, Homo sapiens
agcctggtggg

SEQ ID NO: 3716497 - DNA, 15 bp, Homo sapiens
agcctgtaatcccag

SEQ ID NO: 3716498 - DNA, 17 bp, Homo sapiens
agcctgtaatcccagct

SEQ ID NO: 3716499 - DNA, 22 bp, Homo sapiens
agcctgtggcagtaaagagaaa

SEQ ID NO: 3716500 - DNA, 22 bp, Homo sapiens
agcctgtggcatctttgccttg

SEQ ID NO: 3716501 - DNA, 19 bp, Homo sapiens
agcctgtggcggtgcctgg

SEQ ID NO: 3716502 - DNA, 20 bp, Homo sapiens
agcctgtggcggtgcctggg

SEQ ID NO: 3716503 - DNA, 22 bp, Homo sapiens
agcctgtggcggtgcctgggtg

SEQ ID NO: 3716504 - DNA, 18 bp, Homo sapiens
agccttaatcaggtcctc

SEQ ID NO: 3716505 - DNA, 23 bp, Homo sapiens
agccttgggaacatgcgtgtgac

SEQ ID NO: 3716506 - DNA, 16 bp, Homo sapiens
agccttggtgtccacc

SEQ ID NO: 3716507 - DNA, 17 bp, Homo sapiens
agccttggtgtccacct

SEQ ID NO: 3716508 - DNA, 16 bp, Homo sapiens
agccttgtaattctaa

SEQ ID NO: 3716509 - DNA, 22 bp, Homo sapiens
agcctttccataaggaatgtag

SEQ ID NO: 3716510 - DNA, 12 bp, Homo sapiens
agcgaaactccg

SEQ ID NO: 3716511 - DNA, 16 bp, Homo sapiens
agcgagagtctgtctc

SEQ ID NO: 3716512 - DNA, 14 bp, Homo sapiens
agcgagttgtggaa

SEQ ID NO: 3716513 - DNA, 19 bp, Homo sapiens
agcgatgaatttggagact

SEQ ID NO: 3716514 - DNA, 22 bp, Homo sapiens
agcgattcttctgcttcagcct

SEQ ID NO: 3716515 - DNA, 17 bp, Homo sapiens
agcgcacctgccccctg

SEQ ID NO: 3716516 - DNA, 18 bp, Homo sapiens
agcgcacctgccccctgg

SEQ ID NO: 3716517 - DNA, 19 bp, Homo sapiens
agcgcacctgccccctggt

SEQ ID NO: 3716518 - DNA, 21 bp, Homo sapiens
agcgcctagtggggtctccct

SEQ ID NO: 3716519 - DNA, 12 bp, Homo sapiens
agcgcctgcccc

SEQ ID NO: 3716520 - DNA, 19 bp, Homo sapiens
agcgcgccactcgcttccc

SEQ ID NO: 3716521 - DNA, 13 bp, Homo sapiens
agcggaaagcagc

SEQ ID NO: 3716522 - DNA, 21 bp, Homo sapiens
aggagttcaagaccagcctgg

SEQ ID NO: 3716523 - DNA, 21 bp, Homo sapiens
aggagttcgagaccagcctgg

SEQ ID NO: 3716524 - DNA, 18 bp, Homo sapiens
aggagttgtttctgaccc

SEQ ID NO: 3716525 - DNA, 20 bp, Homo sapiens
aggagttgtttctgacccac

SEQ ID NO: 3716526 - DNA, 22 bp, Homo sapiens
aggagttgtttctgacccactg

SEQ ID NO: 3716527 - DNA, 19 bp, Homo sapiens
aggagtttaagaccagcct

SEQ ID NO: 3716528 - DNA, 21 bp, Homo sapiens
aggagtttaagaccagcctgg

SEQ ID NO: 3716529 - DNA, 20 bp, Homo sapiens
aggagtttcctaaaagttca

SEQ ID NO: 3716530 - DNA, 15 bp, Homo sapiens
aggagtttgaatcca

SEQ ID NO: 3716531 - DNA, 16 bp, Homo sapiens
aggagtttgagaccag

SEQ ID NO: 3716532 - DNA, 20 bp, Homo sapiens
aggatagataactctttgga

SEQ ID NO: 3716533 - DNA, 14 bp, Homo sapiens
aggatcactggagc

SEQ ID NO: 3716534 - DNA, 16 bp, Homo sapiens
aggatcactggagccc

SEQ ID NO: 3716535 - DNA, 19 bp, Homo sapiens
aggatcacttgagcccagg

SEQ ID NO: 3716536 - DNA, 13 bp, Homo sapiens
aggatcagaaagt

SEQ ID NO: 3716537 - DNA, 12 bp, Homo sapiens
aggatcagtctg

SEQ ID NO: 3716538 - DNA, 12 bp, Homo sapiens
aggatctcttga

SEQ ID NO: 3716539 - DNA, 18 bp, Homo sapiens
aggatctcttgagcctgg

SEQ ID NO: 3716540 - DNA, 20 bp, Homo sapiens
aggatctgtttttaaaaatc

SEQ ID NO: 3716541 - DNA, 13 bp, Homo sapiens
aggatcttttgaa

SEQ ID NO: 3716542 - DNA, 19 bp, Homo sapiens
aggatgcagagtcagcaga

SEQ ID NO: 3716543 - DNA, 14 bp, Homo sapiens
aggatggagagagg

SEQ ID NO: 3716544 - DNA, 17 bp, Homo sapiens
aggatggagagagggga

SEQ ID NO: 3716545 - DNA, 19 bp, Homo sapiens
aggatggagagaggggaat

SEQ ID NO: 3716546 - DNA, 19 bp, Homo sapiens
aggatggaggggtggtcct

SEQ ID NO: 3716547 - DNA, 18 bp, Homo sapiens
aggatggctttgaatgcg

SEQ ID NO: 3716548 - DNA, 17 bp, Homo sapiens
aggatgggaaggaggga

SEQ ID NO: 3716549 - DNA, 22 bp, Homo sapiens
aggatgtaaacagtgcctgctg

SEQ ID NO: 3716550 - DNA, 15 bp, Homo sapiens
aggatgttctgggac

SEQ ID NO: 3716551 - DNA, 13 bp, Homo sapiens
aggattctatgag

SEQ ID NO: 3716552 - DNA, 15 bp, Homo sapiens
aggattctatgaggc

SEQ ID NO: 3716553 - DNA, 16 bp, Homo sapiens
aggattctatgaggca

SEQ ID NO: 3716554 - DNA, 14 bp, Homo sapiens
aggattctcctttt

SEQ ID NO: 3716555 - DNA, 16 bp, Homo sapiens
aggattcttcctccct

SEQ ID NO: 3716556 - DNA, 17 bp, Homo sapiens
aggattgctactgtcct

SEQ ID NO: 3716557 - DNA, 18 bp, Homo sapiens
aggattgctactgtccta

SEQ ID NO: 3716558 - DNA, 19 bp, Homo sapiens
aggattgcttgagcccagg

SEQ ID NO: 3716559 - DNA, 14 bp, Homo sapiens
aggatttcaagcct

SEQ ID NO: 3716560 - DNA, 15 bp, Homo sapiens
aggatttcaagcctg

SEQ ID NO: 3716561 - DNA, 19 bp, Homo sapiens
aggattttgatccaagctg

SEQ ID NO: 3716562 - DNA, 14 bp, Homo sapiens
aggcaactgaggca

SEQ ID NO: 3716563 - DNA, 17 bp, Homo sapiens
aggcaactgaggcagac

SEQ ID NO: 3716564 - DNA, 19 bp, Homo sapiens
aggcaactgcattggcttt

SEQ ID NO: 3716565 - DNA, 16 bp, Homo sapiens
aggcaacttgggaact

SEQ ID NO: 3716566 - DNA, 17 bp, Homo sapiens
aggcaataaaaatcata

SEQ ID NO: 3716567 - DNA, 14 bp, Homo sapiens
aggcaatcacatag

SEQ ID NO: 3716568 - DNA, 22 bp, Homo sapiens
aggcaatgattgttaatttaca

SEQ ID NO: 3716569 - DNA, 14 bp, Homo sapiens
aggcacaatatggg

SEQ ID NO: 3716570 - DNA, 21 bp, Homo sapiens
aggcacagccggggcctgcct

SEQ ID NO: 3716571 - DNA, 21 bp, Homo sapiens
aggcacccatcctagagaaaa

SEQ ID NO: 3716572 - DNA, 14 bp, Homo sapiens
aggcacgaacccac

SEQ ID NO: 3716573 - DNA, 18 bp, Homo sapiens
aggcacgaacccacctgc

SEQ ID NO: 3716574 - DNA, 20 bp, Homo sapiens
aggcacgaacccacctgctg

SEQ ID NO: 3716575 - DNA, 19 bp, Homo sapiens
aggcactcatgggtaataa

SEQ ID NO: 3716576 - DNA, 22 bp, Homo sapiens
aggcactgctgcccagcctcca

SEQ ID NO: 3716577 - DNA, 14 bp, Homo sapiens
aggcagaaccctgg

SEQ ID NO: 3716578 - DNA, 21 bp, Homo sapiens
aggcagaagaattgaacccag

SEQ ID NO: 3716579 - DNA, 23 bp, Homo sapiens
aggcagaagaattgaacccagga

SEQ ID NO: 3716580 - DNA, 19 bp, Homo sapiens
aggcagacagcagctcagg

SEQ ID NO: 3716581 - DNA, 20 bp, Homo sapiens
aggcagacagcagctcaggc

SEQ ID NO: 3716582 - DNA, 22 bp, Homo sapiens
aggcagacttccctgaatgtat

SEQ ID NO: 3716583 - DNA, 22 bp, Homo sapiens
aggcagagaatcatacttagca

SEQ ID NO: 3716584 - DNA, 13 bp, Homo sapiens
aggcagatacagg

SEQ ID NO: 3716585 - DNA, 16 bp, Homo sapiens
aggcagatctgtgccc

SEQ ID NO: 3716586 - DNA, 16 bp, Homo sapiens
aggcagattgaaaagg

SEQ ID NO: 3716587 - DNA, 17 bp, Homo sapiens
aggcagattgaaaagga

SEQ ID NO: 3716588 - DNA, 20 bp, Homo sapiens
aggcaggaagggcaggaagg

SEQ ID NO: 3716589 - DNA, 12 bp, Homo sapiens
aggcaggatggc

SEQ ID NO: 3716590 - DNA, 19 bp, Homo sapiens
aggcagggaagtccccagg

SEQ ID NO: 3716591 - DNA, 12 bp, Homo sapiens
aggcagggaggg

SEQ ID NO: 3716592 - DNA, 14 bp, Homo sapiens
aggcagggagggga

SEQ ID NO: 3716593 - DNA, 19 bp, Homo sapiens
aggcagggccttgcccaga

SEQ ID NO: 3716594 - DNA, 21 bp, Homo sapiens
aggcagggccttgcccagaga

SEQ ID NO: 3716595 - DNA, 13 bp, Homo sapiens
aggcaggggcgga

SEQ ID NO: 3716596 - DNA, 14 bp, Homo sapiens
aggcagggtcagga

SEQ ID NO: 3716597 - DNA, 20 bp, Homo sapiens
aggcagggtctcactctgtc

SEQ ID NO: 3716598 - DNA, 23 bp, Homo sapiens
aggcagggttttatctctgtcta

SEQ ID NO: 3716599 - DNA, 17 bp, Homo sapiens
aggcataggcctgggtg

SEQ ID NO: 3716600 - DNA, 18 bp, Homo sapiens
aggcataggcctgggtgc

SEQ ID NO: 3716601 - DNA, 19 bp, Homo sapiens
aggcataggcctgggtgct

SEQ ID NO: 3716602 - DNA, 13 bp, Homo sapiens
aggcatcccaggg

SEQ ID NO: 3716603 - DNA, 18 bp, Homo sapiens
aggcatcccaggggacca

SEQ ID NO: 3716604 - DNA, 23 bp, Homo sapiens
aggcatcccaggggaccacacct

SEQ ID NO: 3716605 - DNA, 14 bp, Homo sapiens
aggcatctgcaccc

SEQ ID NO: 3716606 - DNA, 15 bp, Homo sapiens
aggcatgagggatca

SEQ ID NO: 3716607 - DNA, 20 bp, Homo sapiens
aggcatgagggatcacaggg

SEQ ID NO: 3716608 - DNA, 22 bp, Homo sapiens
aggcatgagggatcacagggcc

SEQ ID NO: 3716609 - DNA, 13 bp, Homo sapiens
aggcatgcctgtg

SEQ ID NO: 3716610 - DNA, 20 bp, Homo sapiens
aggcatgttctctgaggaca

SEQ ID NO: 3716611 - DNA, 13 bp, Homo sapiens
aggcattctctga

SEQ ID NO: 3716612 - DNA, 15 bp, Homo sapiens
aggcatttaggaact

SEQ ID NO: 3716613 - DNA, 16 bp, Homo sapiens
aggcatttgctgaata

SEQ ID NO: 3716614 - DNA, 21 bp, Homo sapiens
aggccaaactggcaaacttca

SEQ ID NO: 3716615 - DNA, 14 bp, Homo sapiens
aggccaagagcaga

SEQ ID NO: 3716616 - DNA, 20 bp, Homo sapiens
aggccaagagcagaggcagc

SEQ ID NO: 3716617 - DNA, 14 bp, Homo sapiens
aggccaagaggctg

SEQ ID NO: 3716618 - DNA, 18 bp, Homo sapiens
aggccaaggtgggaggat

SEQ ID NO: 3716619 - DNA, 18 bp, Homo sapiens
aggccaagtcaggccctt

SEQ ID NO: 3716620 - DNA, 21 bp, Homo sapiens
aggccacaccatctcctttca

SEQ ID NO: 3716621 - DNA, 13 bp, Homo sapiens
aggccacctgccc

SEQ ID NO: 3716622 - DNA, 16 bp, Homo sapiens
aggccacctgccccct

SEQ ID NO: 3716623 - DNA, 18 bp, Homo sapiens
aggccagcaaggtggagt

SEQ ID NO: 3716624 - DNA, 20 bp, Homo sapiens
aggccagcaaggtggagtgg

SEQ ID NO: 3716625 - DNA, 16 bp, Homo sapiens
aggccagccccaccca

SEQ ID NO: 3716626 - DNA, 17 bp, Homo sapiens
aggccagctggcagcag

SEQ ID NO: 3716627 - DNA, 18 bp, Homo sapiens
aggccagctggcagcaga

SEQ ID NO: 3716628 - DNA, 12 bp, Homo sapiens
aggccaggctcc

SEQ ID NO: 3716629 - DNA, 22 bp, Homo sapiens
aggccaggctccttcctgtctt

SEQ ID NO: 3716630 - DNA, 16 bp, Homo sapiens
aggccaggggcttttg

SEQ ID NO: 3716631 - DNA, 19 bp, Homo sapiens
aggccatgattcgcccaaa

SEQ ID NO: 3716632 - DNA, 21 bp, Homo sapiens
aggccatgattcgcccaaagc

SEQ ID NO: 3716633 - DNA, 14 bp, Homo sapiens
aggccatgggcctc

SEQ ID NO: 3716634 - DNA, 16 bp, Homo sapiens
aggccatgggcctcct

SEQ ID NO: 3716635 - DNA, 23 bp, Homo sapiens
agtaagatttacccagaatgtca

SEQ ID NO: 3716636 - DNA, 20 bp, Homo sapiens
agtaagccgtgattttcatt

SEQ ID NO: 3716637 - DNA, 14 bp, Homo sapiens
agtaagctgctttt

SEQ ID NO: 3716638 - DNA, 13 bp, Homo sapiens
agtaataaaacat

SEQ ID NO: 3716639 - DNA, 15 bp, Homo sapiens
agtaataaaacatct

SEQ ID NO: 3716640 - DNA, 17 bp, Homo sapiens
agtaataaactgtgttt

SEQ ID NO: 3716641 - DNA, 12 bp, Homo sapiens
agtaatgaattt

SEQ ID NO: 3716642 - DNA, 22 bp, Homo sapiens
agtaatgaatttttatgatatt

SEQ ID NO: 3716643 - DNA, 22 bp, Homo sapiens
agtaattggtccgatctttgac

SEQ ID NO: 3716644 - DNA, 13 bp, Homo sapiens
agtaatttattgt

SEQ ID NO: 3716645 - DNA, 23 bp, Homo sapiens
agtaatttattgtttttccttgt

SEQ ID NO: 3716646 - DNA, 15 bp, Homo sapiens
agtaatttgaggaca

SEQ ID NO: 3716647 - DNA, 14 bp, Homo sapiens
agtacaggcagcac

SEQ ID NO: 3716648 - DNA, 17 bp, Homo sapiens
agtacaggcagcacaga

SEQ ID NO: 3716649 - DNA, 18 bp, Homo sapiens
agtacaggcagcacagag

SEQ ID NO: 3716650 - DNA, 12 bp, Homo sapiens
agtacccacctg

SEQ ID NO: 3716651 - DNA, 17 bp, Homo sapiens
agtacccacctgagctt

SEQ ID NO: 3716652 - DNA, 17 bp, Homo sapiens
agtacctccaagcaagt

SEQ ID NO: 3716653 - DNA, 16 bp, Homo sapiens
agtacctttgctcttg

SEQ ID NO: 3716654 - DNA, 18 bp, Homo sapiens
agtacctttgctcttgca

SEQ ID NO: 3716655 - DNA, 21 bp, Homo sapiens
agtacctttgctcttgcagag

SEQ ID NO: 3716656 - DNA, 22 bp, Homo sapiens
agtactatatctgttttactgc

SEQ ID NO: 3716657 - DNA, 14 bp, Homo sapiens
agtactatgtatca

SEQ ID NO: 3716658 - DNA, 16 bp, Homo sapiens
agtactcctgcaaaat

SEQ ID NO: 3716659 - DNA, 16 bp, Homo sapiens
agtactgtgtacagaa

SEQ ID NO: 3716660 - DNA, 17 bp, Homo sapiens
agtacttctccaccctg

SEQ ID NO: 3716661 - DNA, 21 bp, Homo sapiens
agtacttctccaccctgctct

SEQ ID NO: 3716662 - DNA, 22 bp, Homo sapiens
agtacttctccaccctgctctc

SEQ ID NO: 3716663 - DNA, 17 bp, Homo sapiens
agtagaagtcttagatg

SEQ ID NO: 3716664 - DNA, 21 bp, Homo sapiens
agtagaagtcttagatgtata

SEQ ID NO: 3716665 - DNA, 14 bp, Homo sapiens
agtagaattgattt

SEQ ID NO: 3716666 - DNA, 13 bp, Homo sapiens
agtagacccctgg

SEQ ID NO: 3716667 - DNA, 11 bp, Homo sapiens
agtagagacag

SEQ ID NO: 3716668 - DNA, 12 bp, Homo sapiens
agtagagacagg

SEQ ID NO: 3716669 - DNA, 19 bp, Homo sapiens
agtagagatggggaaagaa

SEQ ID NO: 3716670 - DNA, 14 bp, Homo sapiens
agtagagtcatctc

SEQ ID NO: 3716671 - DNA, 17 bp, Homo sapiens
agtagagtcatctccat

SEQ ID NO: 3716672 - DNA, 20 bp, Homo sapiens
agtagcagtagatgcatgta

SEQ ID NO: 3716673 - DNA, 23 bp, Homo sapiens
agtagcatgagagaattgtatca

SEQ ID NO: 3716674 - DNA, 22 bp, Homo sapiens
agtagccccaacccaaacctgg

SEQ ID NO: 3716675 - DNA, 15 bp, Homo sapiens
agtagccgagagcct

SEQ ID NO: 3716676 - DNA, 17 bp, Homo sapiens
agtagccgagagcctgc

SEQ ID NO: 3716677 - DNA, 18 bp, Homo sapiens
agtagccgagagcctgct

SEQ ID NO: 3716678 - DNA, 14 bp, Homo sapiens
agtagctgggacta

SEQ ID NO: 3716679 - DNA, 20 bp, Homo sapiens
agtagctttccacatttgtc

SEQ ID NO: 3716680 - DNA, 13 bp, Homo sapiens
agtaggtgcttga

SEQ ID NO: 3716681 - DNA, 14 bp, Homo sapiens
agtagtcatttcat

SEQ ID NO: 3716682 - DNA, 15 bp, Homo sapiens
agtatacaagataag

SEQ ID NO: 3716683 - DNA, 15 bp, Homo sapiens
agtatattaaaaatg

SEQ ID NO: 3716684 - DNA, 17 bp, Homo sapiens
agtatatttatataatt

SEQ ID NO: 3716685 - DNA, 18 bp, Homo sapiens
agtatatttatataatta

SEQ ID NO: 3716686 - DNA, 20 bp, Homo sapiens
agtatatttatataattatg

SEQ ID NO: 3716687 - DNA, 13 bp, Homo sapiens
agtatattttctt

SEQ ID NO: 3716688 - DNA, 18 bp, Homo sapiens
agtatattttcttttcct

SEQ ID NO: 3716689 - DNA, 16 bp, Homo sapiens
agtatctaacatgtat

SEQ ID NO: 3716690 - DNA, 18 bp, Homo sapiens
agtatctcctcgcaagct

SEQ ID NO: 3716691 - DNA, 15 bp, Homo sapiens
agtatggtggctggg

SEQ ID NO: 3716692 - DNA, 14 bp, Homo sapiens
agtatgttcaaagt

SEQ ID NO: 3716693 - DNA, 20 bp, Homo sapiens
agtattaaaggggggagggg

SEQ ID NO: 3716694 - DNA, 20 bp, Homo sapiens
agtattataggccaaactgg

SEQ ID NO: 3716695 - DNA, 14 bp, Homo sapiens
agtattccacctta

SEQ ID NO: 3716696 - DNA, 23 bp, Homo sapiens
agtattccaccttaaattaaaca

SEQ ID NO: 3716697 - DNA, 12 bp, Homo sapiens
agtattctgcct

SEQ ID NO: 3716698 - DNA, 16 bp, Homo sapiens
agtatttgcatattct

SEQ ID NO: 3716699 - DNA, 21 bp, Homo sapiens
agtatttttatatttaaatgt

SEQ ID NO: 3716700 - DNA, 17 bp, Homo sapiens
agtcaaaaggtgcctgt

SEQ ID NO: 3716701 - DNA, 21 bp, Homo sapiens
agtcaaagtaaaacttgctgc

SEQ ID NO: 3716702 - DNA, 14 bp, Homo sapiens
agtcaacagtgaaa

SEQ ID NO: 3716703 - DNA, 16 bp, Homo sapiens
agtcaagtgaaaaagg

SEQ ID NO: 3716704 - DNA, 13 bp, Homo sapiens
agtcacaaaggaa

SEQ ID NO: 3716705 - DNA, 23 bp, Homo sapiens
agtcacacagtattacttctgct

SEQ ID NO: 3716706 - DNA, 23 bp, Homo sapiens
agtcacacagtgagtcgaggaca

SEQ ID NO: 3716707 - DNA, 14 bp, Homo sapiens
agtcaccaagccca

SEQ ID NO: 3716708 - DNA, 15 bp, Homo sapiens
agtcaccaagcccag

SEQ ID NO: 3716709 - DNA, 13 bp, Homo sapiens
agtcaccaggaat

SEQ ID NO: 3716710 - DNA, 19 bp, Homo sapiens
agtcaccaggaatgttaaa

SEQ ID NO: 3716711 - DNA, 14 bp, Homo sapiens
agtcaccttttaaa

SEQ ID NO: 3716712 - DNA, 19 bp, Homo sapiens
agtcaccttttaaatcctg

SEQ ID NO: 3716713 - DNA, 13 bp, Homo sapiens
agtcactgcacag

SEQ ID NO: 3716714 - DNA, 23 bp, Homo sapiens
agtcagactggatagtccgtctc

SEQ ID NO: 3716715 - DNA, 23 bp, Homo sapiens
agtcagatgcccagagggcccag

SEQ ID NO: 3716716 - DNA, 22 bp, Homo sapiens
agtcagctttgccttccacgct

SEQ ID NO: 3716717 - DNA, 19 bp, Homo sapiens
agtcagggacccctgccct

SEQ ID NO: 3716718 - DNA, 14 bp, Homo sapiens
agtcatctcaacca

SEQ ID NO: 3716719 - DNA, 18 bp, Homo sapiens
agtcatctccatcagctg

SEQ ID NO: 3716720 - DNA, 20 bp, Homo sapiens
agtcatctccatcagctgta

SEQ ID NO: 3716721 - DNA, 14 bp, Homo sapiens
agtcatgagctgag

SEQ ID NO: 3716722 - DNA, 15 bp, Homo sapiens
agtcatgatctccct

SEQ ID NO: 3716723 - DNA, 17 bp, Homo sapiens
agtcatgatctccctgc

SEQ ID NO: 3716724 - DNA, 13 bp, Homo sapiens
agtcatgtgcatt

SEQ ID NO: 3716725 - DNA, 22 bp, Homo sapiens
agtcattatgagaggcaatgat

SEQ ID NO: 3716726 - DNA, 23 bp, Homo sapiens
agtccaacgtggggcagcacaga

SEQ ID NO: 3716727 - DNA, 17 bp, Homo sapiens
agtccaatgtcttttta

SEQ ID NO: 3716728 - DNA, 18 bp, Homo sapiens
agtccaggccccaaaacc

SEQ ID NO: 3716729 - DNA, 22 bp, Homo sapiens
agtccaggtcgggctcagctct

SEQ ID NO: 3716730 - DNA, 14 bp, Homo sapiens
agtcccaaggaaag

SEQ ID NO: 3716731 - DNA, 15 bp, Homo sapiens
agtcccaccttggct

SEQ ID NO: 3716732 - DNA, 16 bp, Homo sapiens
agtcccaccttggctg

SEQ ID NO: 3716733 - DNA, 20 bp, Homo sapiens
agtcccaccttggctgcagg

SEQ ID NO: 3716734 - DNA, 18 bp, Homo sapiens
agtcccagctactcagga

SEQ ID NO: 3716735 - DNA, 19 bp, Homo sapiens
agtcccagctactcaggag

SEQ ID NO: 3716736 - DNA, 13 bp, Homo sapiens
agtccccaggccc

SEQ ID NO: 3716737 - DNA, 16 bp, Homo sapiens
agtccccctgccccag

SEQ ID NO: 3716738 - DNA, 15 bp, Homo sapiens
agtcccgtcaggacg

SEQ ID NO: 3716739 - DNA, 14 bp, Homo sapiens
agtccctgggggaa

SEQ ID NO: 3716740 - DNA, 20 bp, Homo sapiens
agtccctgggggaagccctg

SEQ ID NO: 3716741 - DNA, 14 bp, Homo sapiens
agtcccttccaggc

SEQ ID NO: 3716742 - DNA, 23 bp, Homo sapiens
agtccgaaagggacttggaagct

SEQ ID NO: 3716743 - DNA, 15 bp, Homo sapiens
agtcctcactcccag

SEQ ID NO: 3716744 - DNA, 13 bp, Homo sapiens
agtcctgcctggc

SEQ ID NO: 3716745 - DNA, 15 bp, Homo sapiens
agtcctgcctggcca

SEQ ID NO: 3716746 - DNA, 21 bp, Homo sapiens
agtcctgcctggccaggcaga

SEQ ID NO: 3716747 - DNA, 19 bp, Homo sapiens
agtcctggctacatcccag

SEQ ID NO: 3716748 - DNA, 13 bp, Homo sapiens
ataaaattatgcc

SEQ ID NO: 3716749 - DNA, 24 bp, Homo sapiens
ataaacacatagattcacctgtaa

SEQ ID NO: 3716750 - DNA, 22 bp, Homo sapiens
ataaacagtggaatataaggaa

SEQ ID NO: 3716751 - DNA, 12 bp, Homo sapiens
ataaagacacct

SEQ ID NO: 3716752 - DNA, 21 bp, Homo sapiens
ataaagagaaaattgaattta

SEQ ID NO: 3716753 - DNA, 20 bp, Homo sapiens
ataaagattatataaagacc

SEQ ID NO: 3716754 - DNA, 20 bp, Homo sapiens
ataaaggttattttctcctg

SEQ ID NO: 3716755 - DNA, 17 bp, Homo sapiens
ataaagtgttttcagag

SEQ ID NO: 3716756 - DNA, 18 bp, Homo sapiens
ataaagtgttttcagagc

SEQ ID NO: 3716757 - DNA, 22 bp, Homo sapiens
ataaagttgaagctaagattta

SEQ ID NO: 3716758 - DNA, 16 bp, Homo sapiens
ataaataaatgcaata

SEQ ID NO: 3716759 - DNA, 15 bp, Homo sapiens
ataaatagctatatc

SEQ ID NO: 3716760 - DNA, 21 bp, Homo sapiens
ataaatagctatatccatgta

SEQ ID NO: 3716761 - DNA, 14 bp, Homo sapiens
ataaatatttatgt

SEQ ID NO: 3716762 - DNA, 14 bp, Homo sapiens
ataaatcaatgtca

SEQ ID NO: 3716763 - DNA, 11 bp, Homo sapiens
ataaatgaatg

SEQ ID NO: 3716764 - DNA, 17 bp, Homo sapiens
ataaatgcaatatgtat

SEQ ID NO: 3716765 - DNA, 22 bp, Homo sapiens
ataaatgcaatatgtattaata

SEQ ID NO: 3716766 - DNA, 15 bp, Homo sapiens
ataaatgtacattaa

SEQ ID NO: 3716767 - DNA, 13 bp, Homo sapiens
ataaatgtatcat

SEQ ID NO: 3716768 - DNA, 21 bp, Homo sapiens
ataaatgtatcatagaaatgt

SEQ ID NO: 3716769 - DNA, 22 bp, Homo sapiens
ataaatgtattcaaataccaat

SEQ ID NO: 3716770 - DNA, 21 bp, Homo sapiens
ataaatgtcattaaaataaat

SEQ ID NO: 3716771 - DNA, 19 bp, Homo sapiens
ataaattaaatatatgtat

SEQ ID NO: 3716772 - DNA, 13 bp, Homo sapiens
ataaattcagata

SEQ ID NO: 3716773 - DNA, 15 bp, Homo sapiens
ataaattccactgga

SEQ ID NO: 3716774 - DNA, 21 bp, Homo sapiens
ataaattctataggaacatat

SEQ ID NO: 3716775 - DNA, 19 bp, Homo sapiens
ataaattgcatgctgcttt

SEQ ID NO: 3716776 - DNA, 16 bp, Homo sapiens
ataaattgctccttga

SEQ ID NO: 3716777 - DNA, 19 bp, Homo sapiens
ataacaagatctttcagga

SEQ ID NO: 3716778 - DNA, 16 bp, Homo sapiens
ataacaatgtgctctc

SEQ ID NO: 3716779 - DNA, 11 bp, Homo sapiens
ataacacacat

SEQ ID NO: 3716780 - DNA, 16 bp, Homo sapiens
ataacagtaaatgtgc

SEQ ID NO: 3716781 - DNA, 19 bp, Homo sapiens
ataacagtcttactgcagg

SEQ ID NO: 3716782 - DNA, 23 bp, Homo sapiens
ataacagtgccattgtctttata

SEQ ID NO: 3716783 - DNA, 15 bp, Homo sapiens
ataacataacaaata

SEQ ID NO: 3716784 - DNA, 20 bp, Homo sapiens
ataacatgtaattaagtact

SEQ ID NO: 3716785 - DNA, 14 bp, Homo sapiens
ataaccaatgttta

SEQ ID NO: 3716786 - DNA, 15 bp, Homo sapiens
ataactactgtgttc

SEQ ID NO: 3716787 - DNA, 16 bp, Homo sapiens
ataactactgtgttcc

SEQ ID NO: 3716788 - DNA, 17 bp, Homo sapiens
ataactcatcataaaat

SEQ ID NO: 3716789 - DNA, 22 bp, Homo sapiens
ataactctgtggcattattgca

SEQ ID NO: 3716790 - DNA, 12 bp, Homo sapiens
ataactgacaaa

SEQ ID NO: 3716791 - DNA, 12 bp, Homo sapiens
ataacttaaaat

SEQ ID NO: 3716792 - DNA, 16 bp, Homo sapiens
ataacttaaaatattt

SEQ ID NO: 3716793 - DNA, 14 bp, Homo sapiens
ataagattcatatt

SEQ ID NO: 3716794 - DNA, 23 bp, Homo sapiens
ataagcaaagggagcactgggtt

SEQ ID NO: 3716795 - DNA, 15 bp, Homo sapiens
ataagcaagagagat

SEQ ID NO: 3716796 - DNA, 17 bp, Homo sapiens
ataagcaagagagatgt

SEQ ID NO: 3716797 - DNA, 16 bp, Homo sapiens
ataagcatcaaactct

SEQ ID NO: 3716798 - DNA, 17 bp, Homo sapiens
ataagcatcaaactctt

SEQ ID NO: 3716799 - DNA, 13 bp, Homo sapiens
ataagctaaagag

SEQ ID NO: 3716800 - DNA, 23 bp, Homo sapiens
ataagcttccaggctgcatagaa

SEQ ID NO: 3716801 - DNA, 20 bp, Homo sapiens
ataaggatcagaacagcaga

SEQ ID NO: 3716802 - DNA, 17 bp, Homo sapiens
ataaggccttaatatgt

SEQ ID NO: 3716803 - DNA, 18 bp, Homo sapiens
ataaggccttaatatgtt

SEQ ID NO: 3716804 - DNA, 22 bp, Homo sapiens
ataagttaactattttattttc

SEQ ID NO: 3716805 - DNA, 12 bp, Homo sapiens
ataataaacttt

SEQ ID NO: 3716806 - DNA, 12 bp, Homo sapiens
ataataaagtat

SEQ ID NO: 3716807 - DNA, 15 bp, Homo sapiens
ataataaattgcatg

SEQ ID NO: 3716808 - DNA, 15 bp, Homo sapiens
ataataagctaaaga

SEQ ID NO: 3716809 - DNA, 12 bp, Homo sapiens
ataataatacaa

SEQ ID NO: 3716810 - DNA, 19 bp, Homo sapiens
ataatacagtatctcaggg

SEQ ID NO: 3716811 - DNA, 13 bp, Homo sapiens
ataatagaagaac

SEQ ID NO: 3716812 - DNA, 14 bp, Homo sapiens
ataatatttttaat

SEQ ID NO: 3716813 - DNA, 13 bp, Homo sapiens
ataatcagcctct

SEQ ID NO: 3716814 - DNA, 15 bp, Homo sapiens
ataatcagcctctta

SEQ ID NO: 3716815 - DNA, 22 bp, Homo sapiens
ataatcggcccacagctcccac

SEQ ID NO: 3716816 - DNA, 19 bp, Homo sapiens
ataatctggactcctctgt

SEQ ID NO: 3716817 - DNA, 20 bp, Homo sapiens
ataatcttgtttctgaaaag

SEQ ID NO: 3716818 - DNA, 13 bp, Homo sapiens
ataatctttgggt

SEQ ID NO: 3716819 - DNA, 15 bp, Homo sapiens
ataatgaatgaaaca

SEQ ID NO: 3716820 - DNA, 22 bp, Homo sapiens
ataatgtataaagaacaaggta

SEQ ID NO: 3716821 - DNA, 10 bp, Homo sapiens
ataatgtctt

SEQ ID NO: 3716822 - DNA, 16 bp, Homo sapiens
ataatgtcttgttaat

SEQ ID NO: 3716823 - DNA, 17 bp, Homo sapiens
ataatgtcttgttaata

SEQ ID NO: 3716824 - DNA, 20 bp, Homo sapiens
ataatgtcttgttaatattc

SEQ ID NO: 3716825 - DNA, 12 bp, Homo sapiens
ataatgttaaca

SEQ ID NO: 3716826 - DNA, 17 bp, Homo sapiens
ataattatccagagttt

SEQ ID NO: 3716827 - DNA, 16 bp, Homo sapiens
ataattatcggaagca

SEQ ID NO: 3716828 - DNA, 20 bp, Homo sapiens
ataattatcggaagcagtgc

SEQ ID NO: 3716829 - DNA, 21 bp, Homo sapiens
ataattatcggaagcagtgcc

SEQ ID NO: 3716830 - DNA, 18 bp, Homo sapiens
ataattatgacagttata

SEQ ID NO: 3716831 - DNA, 18 bp, Homo sapiens
ataattatgttattgaaa

SEQ ID NO: 3716832 - DNA, 22 bp, Homo sapiens
ataattatgttattgaaaaaaa

SEQ ID NO: 3716833 - DNA, 19 bp, Homo sapiens
ataattcttgtatattatg

SEQ ID NO: 3716834 - DNA, 15 bp, Homo sapiens
ataatttaatgcatg

SEQ ID NO: 3716835 - DNA, 18 bp, Homo sapiens
ataatttcccaattagga

SEQ ID NO: 3716836 - DNA, 22 bp, Homo sapiens
ataatttgtacatatgtaaaat

SEQ ID NO: 3716837 - DNA, 13 bp, Homo sapiens
ataattttaagat

SEQ ID NO: 3716838 - DNA, 13 bp, Homo sapiens
ataattttatgaa

SEQ ID NO: 3716839 - DNA, 23 bp, Homo sapiens
ataattttcttcatgcaatgaca

SEQ ID NO: 3716840 - DNA, 19 bp, Homo sapiens
ataatttttaaagtatata

SEQ ID NO: 3716841 - DNA, 21 bp, Homo sapiens
ataatttttaaagtatatatt

SEQ ID NO: 3716842 - DNA, 19 bp, Homo sapiens
atacaaacatatttgttaa

SEQ ID NO: 3716843 - DNA, 16 bp, Homo sapiens
atacaacttaaataat

SEQ ID NO: 3716844 - DNA, 15 bp, Homo sapiens
atacaagataagctt

SEQ ID NO: 3716845 - DNA, 18 bp, Homo sapiens
atacaagataagcttcca

SEQ ID NO: 3716846 - DNA, 20 bp, Homo sapiens
atacaataaactattggaaa

SEQ ID NO: 3716847 - DNA, 15 bp, Homo sapiens
atacaatatcatcca

SEQ ID NO: 3716848 - DNA, 14 bp, Homo sapiens
atacacacacaaag

SEQ ID NO: 3716849 - DNA, 19 bp, Homo sapiens
atacaccagagataatatg

SEQ ID NO: 3716850 - DNA, 13 bp, Homo sapiens
atacacttacact

SEQ ID NO: 3716851 - DNA, 17 bp, Homo sapiens
atacagatgacaatggg

SEQ ID NO: 3716852 - DNA, 18 bp, Homo sapiens
atacagccaaagataatc

SEQ ID NO: 3716853 - DNA, 19 bp, Homo sapiens
atacaggaaaagctgctga

SEQ ID NO: 3716854 - DNA, 16 bp, Homo sapiens
atacaggggaatattt

SEQ ID NO: 3716855 - DNA, 10 bp, Homo sapiens
atacagtagt

SEQ ID NO: 3716856 - DNA, 17 bp, Homo sapiens
atacagtagtgagaaga

SEQ ID NO: 3716857 - DNA, 20 bp, Homo sapiens
atacagtagtgagaagaata

SEQ ID NO: 3716858 - DNA, 15 bp, Homo sapiens
atacagttttcctaa

SEQ ID NO: 3716859 - DNA, 21 bp, Homo sapiens
atacagttttcctaaatgtat

SEQ ID NO: 3716860 - DNA, 13 bp, Homo sapiens
atacatacacata

SEQ ID NO: 3716861 - DNA, 14 bp, Homo sapiens
atacatggataaca

SEQ ID NO: 3716862 - DNA, 14 bp, Homo sapiens
atccctgttcattg

SEQ ID NO: 3716863 - DNA, 12 bp, Homo sapiens
atcctaatgaat

SEQ ID NO: 3716864 - DNA, 13 bp, Homo sapiens
atcctaatgaatg

SEQ ID NO: 3716865 - DNA, 14 bp, Homo sapiens
atcctaccaacctc

SEQ ID NO: 3716866 - DNA, 16 bp, Homo sapiens
atcctatctctccaac

SEQ ID NO: 3716867 - DNA, 15 bp, Homo sapiens
atcctcactgggtgg

SEQ ID NO: 3716868 - DNA, 19 bp, Homo sapiens
atcctcccacctcagcctc

SEQ ID NO: 3716869 - DNA, 20 bp, Homo sapiens
atcctcccacctcagcctcc

SEQ ID NO: 3716870 - DNA, 11 bp, Homo sapiens
atcctcccctt

SEQ ID NO: 3716871 - DNA, 14 bp, Homo sapiens
atcctcgctcccgg

SEQ ID NO: 3716872 - DNA, 16 bp, Homo sapiens
atcctcgctcccggga

SEQ ID NO: 3716873 - DNA, 10 bp, Homo sapiens
atcctctggc

SEQ ID NO: 3716874 - DNA, 14 bp, Homo sapiens
atcctctggctggc

SEQ ID NO: 3716875 - DNA, 24 bp, Homo sapiens
atcctgagccatcggtgaaactaa

SEQ ID NO: 3716876 - DNA, 17 bp, Homo sapiens
atcctggcacccggccc

SEQ ID NO: 3716877 - DNA, 19 bp, Homo sapiens
atcctggcacccggcccct

SEQ ID NO: 3716878 - DNA, 19 bp, Homo sapiens
atcctggctctgtggcttg

SEQ ID NO: 3716879 - DNA, 16 bp, Homo sapiens
atcctggctttgccca

SEQ ID NO: 3716880 - DNA, 20 bp, Homo sapiens
atcctggggcattaaaaaaa

SEQ ID NO: 3716881 - DNA, 22 bp, Homo sapiens
atcctgggtggtctgcaggcag

SEQ ID NO: 3716882 - DNA, 18 bp, Homo sapiens
atcctgtcctcagcttct

SEQ ID NO: 3716883 - DNA, 15 bp, Homo sapiens
atcctgtgtggttta

SEQ ID NO: 3716884 - DNA, 20 bp, Homo sapiens
atcctgtgtggtttagtgta

SEQ ID NO: 3716885 - DNA, 12 bp, Homo sapiens
atccttttctcc

SEQ ID NO: 3716886 - DNA, 15 bp, Homo sapiens
atccttttctgcaga

SEQ ID NO: 3716887 - DNA, 15 bp, Homo sapiens
atcctttttctttat

SEQ ID NO: 3716888 - DNA, 23 bp, Homo sapiens
atcgatgggggagtctgaagcag

SEQ ID NO: 3716889 - DNA, 21 bp, Homo sapiens
atcgatgggggatgcttcatg

SEQ ID NO: 3716890 - DNA, 23 bp, Homo sapiens
atcgatgggggatgcttcatgtg

SEQ ID NO: 3716891 - DNA, 17 bp, Homo sapiens
atcgctccaccttgcag

SEQ ID NO: 3716892 - DNA, 18 bp, Homo sapiens
atcggaagcagtgccttc

SEQ ID NO: 3716893 - DNA, 20 bp, Homo sapiens
atcggaggcttgtcagagct

SEQ ID NO: 3716894 - DNA, 21 bp, Homo sapiens
atcggatctggggctctggga

SEQ ID NO: 3716895 - DNA, 15 bp, Homo sapiens
atcgggaacagtgtt

SEQ ID NO: 3716896 - DNA, 16 bp, Homo sapiens
atcgggagcagtgtct

SEQ ID NO: 3716897 - DNA, 14 bp, Homo sapiens
atcggtcctgtctc

SEQ ID NO: 3716898 - DNA, 22 bp, Homo sapiens
atcgttagtatctaacatgtat

SEQ ID NO: 3716899 - DNA, 21 bp, Homo sapiens
atcgttatgtgtgtatatgta

SEQ ID NO: 3716900 - DNA, 16 bp, Homo sapiens
atcgttctttctagct

SEQ ID NO: 3716901 - DNA, 16 bp, Homo sapiens
atctaaactttaatat

SEQ ID NO: 3716902 - DNA, 17 bp, Homo sapiens
atctaagcctttccata

SEQ ID NO: 3716903 - DNA, 18 bp, Homo sapiens
atctaagcctttccataa

SEQ ID NO: 3716904 - DNA, 18 bp, Homo sapiens
atctaatatgtaacaagc

SEQ ID NO: 3716905 - DNA, 20 bp, Homo sapiens
atctaatatgtaacaagcca

SEQ ID NO: 3716906 - DNA, 16 bp, Homo sapiens
atctaattattttgca

SEQ ID NO: 3716907 - DNA, 16 bp, Homo sapiens
atctagaagaaatgaa

SEQ ID NO: 3716908 - DNA, 14 bp, Homo sapiens
atctagcaaatgtt

SEQ ID NO: 3716909 - DNA, 18 bp, Homo sapiens
atctagcaaatgttatgc

SEQ ID NO: 3716910 - DNA, 13 bp, Homo sapiens
atctagtgcagct

SEQ ID NO: 3716911 - DNA, 17 bp, Homo sapiens
atctagtgcagctgatt

SEQ ID NO: 3716912 - DNA, 19 bp, Homo sapiens
atctagtgcagctgatttt

SEQ ID NO: 3716913 - DNA, 17 bp, Homo sapiens
atctattgggattttct

SEQ ID NO: 3716914 - DNA, 19 bp, Homo sapiens
atctattgggttcattatt

SEQ ID NO: 3716915 - DNA, 12 bp, Homo sapiens
atctattgtaag

SEQ ID NO: 3716916 - DNA, 15 bp, Homo sapiens
atctattgtaagata

SEQ ID NO: 3716917 - DNA, 17 bp, Homo sapiens
atctattgtaagataaa

SEQ ID NO: 3716918 - DNA, 15 bp, Homo sapiens
atctatttctgagaa

SEQ ID NO: 3716919 - DNA, 12 bp, Homo sapiens
atctatttgtat

SEQ ID NO: 3716920 - DNA, 22 bp, Homo sapiens
atctatttgtatatatacataa

SEQ ID NO: 3716921 - DNA, 14 bp, Homo sapiens
atctcaaataacta

SEQ ID NO: 3716922 - DNA, 21 bp, Homo sapiens
atctcaaataactaaaaggta

SEQ ID NO: 3716923 - DNA, 22 bp, Homo sapiens
atctcaataaagtgctttaaaa

SEQ ID NO: 3716924 - DNA, 15 bp, Homo sapiens
atctcacagcacact

SEQ ID NO: 3716925 - DNA, 22 bp, Homo sapiens
atctcaccccatcccacaccct

SEQ ID NO: 3716926 - DNA, 23 bp, Homo sapiens
atctcaccccatcccacaccctg

SEQ ID NO: 3716927 - DNA, 11 bp, Homo sapiens
atctcagccca

SEQ ID NO: 3716928 - DNA, 23 bp, Homo sapiens
atctcagggaagcccagctccag

SEQ ID NO: 3716929 - DNA, 21 bp, Homo sapiens
atctccagggagcaagacaga

SEQ ID NO: 3716930 - DNA, 12 bp, Homo sapiens
atctccctgccg

SEQ ID NO: 3716931 - DNA, 13 bp, Homo sapiens
atctcctattttt

SEQ ID NO: 3716932 - DNA, 18 bp, Homo sapiens
atctcctatttttttaaa

SEQ ID NO: 3716933 - DNA, 22 bp, Homo sapiens
atctcctatttttttaaaatca

SEQ ID NO: 3716934 - DNA, 13 bp, Homo sapiens
atctcctcactga

SEQ ID NO: 3716935 - DNA, 20 bp, Homo sapiens
atctcctcgcaagctgggta

SEQ ID NO: 3716936 - DNA, 20 bp, Homo sapiens
atctcctgaggatcagaaag

SEQ ID NO: 3716937 - DNA, 21 bp, Homo sapiens
atctcctgaggatcagaaagt

SEQ ID NO: 3716938 - DNA, 18 bp, Homo sapiens
atctcctgtgcatgggtg

SEQ ID NO: 3716939 - DNA, 20 bp, Homo sapiens
atctctactaccacaaggaa

SEQ ID NO: 3716940 - DNA, 21 bp, Homo sapiens
atctctagaattttaagtgct

SEQ ID NO: 3716941 - DNA, 15 bp, Homo sapiens
atctctccctcccct

SEQ ID NO: 3716942 - DNA, 22 bp, Homo sapiens
atctctctactcctacctcagc

SEQ ID NO: 3716943 - DNA, 17 bp, Homo sapiens
atctctgaacttcagct

SEQ ID NO: 3716944 - DNA, 16 bp, Homo sapiens
atctctgctttggaaa

SEQ ID NO: 3716945 - DNA, 17 bp, Homo sapiens
atctctgtctaccatct

SEQ ID NO: 3716946 - DNA, 15 bp, Homo sapiens
atctctgtgtgcaca

SEQ ID NO: 3716947 - DNA, 16 bp, Homo sapiens
atctcttattttacaa

SEQ ID NO: 3716948 - DNA, 19 bp, Homo sapiens
atctcttattttacaataa

SEQ ID NO: 3716949 - DNA, 21 bp, Homo sapiens
atctgaagagctattatataa

SEQ ID NO: 3716950 - DNA, 13 bp, Homo sapiens
atctgactgcacg

SEQ ID NO: 3716951 - DNA, 18 bp, Homo sapiens
atctgatgcaagcaagaa

SEQ ID NO: 3716952 - DNA, 15 bp, Homo sapiens
atctgcacccccctg

SEQ ID NO: 3716953 - DNA, 21 bp, Homo sapiens
atctgcaccctcgatgaagcc

SEQ ID NO: 3716954 - DNA, 15 bp, Homo sapiens
atctgcatttagcac

SEQ ID NO: 3716955 - DNA, 16 bp, Homo sapiens
atctgcatttagcaca

SEQ ID NO: 3716956 - DNA, 23 bp, Homo sapiens
atctgcattttcaccccaccctt

SEQ ID NO: 3716957 - DNA, 23 bp, Homo sapiens
atctgcattttctgggttctggg

SEQ ID NO: 3716958 - DNA, 13 bp, Homo sapiens
atctgctatgctt

SEQ ID NO: 3716959 - DNA, 16 bp, Homo sapiens
atctgggaactcccaa

SEQ ID NO: 3716960 - DNA, 17 bp, Homo sapiens
atctgtacttcttcgat

SEQ ID NO: 3716961 - DNA, 14 bp, Homo sapiens
atctgtatatacaa

SEQ ID NO: 3716962 - DNA, 12 bp, Homo sapiens
atctgtcatttg

SEQ ID NO: 3716963 - DNA, 23 bp, Homo sapiens
atctgtccaaaggaggctggcag

SEQ ID NO: 3716964 - DNA, 14 bp, Homo sapiens
atctgtctggaggg

SEQ ID NO: 3716965 - DNA, 14 bp, Homo sapiens
atctgtgcaataaa

SEQ ID NO: 3716966 - DNA, 20 bp, Homo sapiens
atctgtgcaataaaataaca

SEQ ID NO: 3716967 - DNA, 13 bp, Homo sapiens
atctgtgccccat

SEQ ID NO: 3716968 - DNA, 21 bp, Homo sapiens
atctgtgtttttgaaatatta

SEQ ID NO: 3716969 - DNA, 21 bp, Homo sapiens
atctgttgtgtacgtggagag

SEQ ID NO: 3716970 - DNA, 21 bp, Homo sapiens
atctgtttaaagtagattaga

SEQ ID NO: 3716971 - DNA, 14 bp, Homo sapiens
atctgttttactgc

SEQ ID NO: 3716972 - DNA, 18 bp, Homo sapiens
atctgtttttaaaaatca

SEQ ID NO: 3716973 - DNA, 19 bp, Homo sapiens
atcttaaagtgtgtttcta

SEQ ID NO: 3716974 - DNA, 12 bp, Homo sapiens
atcttaactctt

SEQ ID NO: 3716975 - DNA, 14 bp, Homo sapiens
attaatattttaat

SEQ ID NO: 3716976 - DNA, 14 bp, Homo sapiens
attaattaaatgca

SEQ ID NO: 3716977 - DNA, 12 bp, Homo sapiens
attacagagagg

SEQ ID NO: 3716978 - DNA, 19 bp, Homo sapiens
attacagagaggagaaaca

SEQ ID NO: 3716979 - DNA, 19 bp, Homo sapiens
attacagatgggcaaatta

SEQ ID NO: 3716980 - DNA, 15 bp, Homo sapiens
attacagctggagaa

SEQ ID NO: 3716981 - DNA, 16 bp, Homo sapiens
attacaggtgtgaacc

SEQ ID NO: 3716982 - DNA, 21 bp, Homo sapiens
attacatatttgcatatgtat

SEQ ID NO: 3716983 - DNA, 17 bp, Homo sapiens
attacatccttgtggca

SEQ ID NO: 3716984 - DNA, 15 bp, Homo sapiens
attacatctttcaca

SEQ ID NO: 3716985 - DNA, 22 bp, Homo sapiens
attacatctttcacattggcta

SEQ ID NO: 3716986 - DNA, 19 bp, Homo sapiens
attacatgtaaaacattat

SEQ ID NO: 3716987 - DNA, 22 bp, Homo sapiens
attacattccttgataatgttg

SEQ ID NO: 3716988 - DNA, 12 bp, Homo sapiens
attaccactgaa

SEQ ID NO: 3716989 - DNA, 22 bp, Homo sapiens
attaccactgaagatagaagaa

SEQ ID NO: 3716990 - DNA, 21 bp, Homo sapiens
attaccagtaaagtgtaacat

SEQ ID NO: 3716991 - DNA, 22 bp, Homo sapiens
attaccccctcattgtttatta

SEQ ID NO: 3716992 - DNA, 16 bp, Homo sapiens
attacccttctttcca

SEQ ID NO: 3716993 - DNA, 21 bp, Homo sapiens
attacctagtagtcatttcat

SEQ ID NO: 3716994 - DNA, 19 bp, Homo sapiens
attactcttgtaagatttt

SEQ ID NO: 3716995 - DNA, 15 bp, Homo sapiens
attactgtcaataaa

SEQ ID NO: 3716996 - DNA, 15 bp, Homo sapiens
attacttatttttga

SEQ ID NO: 3716997 - DNA, 16 bp, Homo sapiens
attacttatttttgac

SEQ ID NO: 3716998 - DNA, 14 bp, Homo sapiens
attacttctgctac

SEQ ID NO: 3716999 - DNA, 15 bp, Homo sapiens
attagaaataaagca

SEQ ID NO: 3717000 - DNA, 19 bp, Homo sapiens
attagactttagaaataaa

SEQ ID NO: 3717001 - DNA, 20 bp, Homo sapiens
attagactttagaaataaat

SEQ ID NO: 3717002 - DNA, 21 bp, Homo sapiens
attagagggaggagaatgagc

SEQ ID NO: 3717003 - DNA, 21 bp, Homo sapiens
attagattatattgagacaaa

SEQ ID NO: 3717004 - DNA, 17 bp, Homo sapiens
attagcagtttgctttg

SEQ ID NO: 3717005 - DNA, 19 bp, Homo sapiens
attagcatttgtcaacaaa

SEQ ID NO: 3717006 - DNA, 18 bp, Homo sapiens
attagccgggcatggtgg

SEQ ID NO: 3717007 - DNA, 20 bp, Homo sapiens
attagctttactgtttgtta

SEQ ID NO: 3717008 - DNA, 22 bp, Homo sapiens
attaggggttgctaagaagcga

SEQ ID NO: 3717009 - DNA, 19 bp, Homo sapiens
attaggttaactatgtaca

SEQ ID NO: 3717010 - DNA, 20 bp, Homo sapiens
attagttgtgtactctggcc

SEQ ID NO: 3717011 - DNA, 21 bp, Homo sapiens
attataactgaaggagaaggt

SEQ ID NO: 3717012 - DNA, 15 bp, Homo sapiens
attataacttaaaat

SEQ ID NO: 3717013 - DNA, 17 bp, Homo sapiens
attataaggactgcatg

SEQ ID NO: 3717014 - DNA, 17 bp, Homo sapiens
attatactaagaaaaga

SEQ ID NO: 3717015 - DNA, 19 bp, Homo sapiens
attatactaagaaaagata

SEQ ID NO: 3717016 - DNA, 14 bp, Homo sapiens
attatagtgtagaa

SEQ ID NO: 3717017 - DNA, 14 bp, Homo sapiens
attatattgagaca

SEQ ID NO: 3717018 - DNA, 17 bp, Homo sapiens
attatattgagacaaaa

SEQ ID NO: 3717019 - DNA, 14 bp, Homo sapiens
attatcaagctaat

SEQ ID NO: 3717020 - DNA, 17 bp, Homo sapiens
attatcggaagcagtgc

SEQ ID NO: 3717021 - DNA, 19 bp, Homo sapiens
attatcggaagcagtgcct

SEQ ID NO: 3717022 - DNA, 21 bp, Homo sapiens
attatcggaagcagtgccttc

SEQ ID NO: 3717023 - DNA, 16 bp, Homo sapiens
attatcgggagcagtg

SEQ ID NO: 3717024 - DNA, 20 bp, Homo sapiens
attatcgggagcagtgtctt

SEQ ID NO: 3717025 - DNA, 21 bp, Homo sapiens
attatgactgttttttaaact

SEQ ID NO: 3717026 - DNA, 14 bp, Homo sapiens
attatgcaaattcc

SEQ ID NO: 3717027 - DNA, 21 bp, Homo sapiens
attatgcaggggcaaacacct

SEQ ID NO: 3717028 - DNA, 21 bp, Homo sapiens
attattacttatttttgacag

SEQ ID NO: 3717029 - DNA, 21 bp, Homo sapiens
attattagtaagaaaacatca

SEQ ID NO: 3717030 - DNA, 20 bp, Homo sapiens
attattcaccatgtaaaaca

SEQ ID NO: 3717031 - DNA, 22 bp, Homo sapiens
attattccctgtacaatattta

SEQ ID NO: 3717032 - DNA, 12 bp, Homo sapiens
attattgcatta

SEQ ID NO: 3717033 - DNA, 14 bp, Homo sapiens
attattttaaatta

SEQ ID NO: 3717034 - DNA, 14 bp, Homo sapiens
attcaaaaatgtac

SEQ ID NO: 3717035 - DNA, 16 bp, Homo sapiens
attcaaaaatgtacaa

SEQ ID NO: 3717036 - DNA, 16 bp, Homo sapiens
attcaagaaagccagt

SEQ ID NO: 3717037 - DNA, 23 bp, Homo sapiens
attcaagaaagccagtcttaaca

SEQ ID NO: 3717038 - DNA, 17 bp, Homo sapiens
attcaaggtaaaattct

SEQ ID NO: 3717039 - DNA, 19 bp, Homo sapiens
attcaaggtaaaattctaa

SEQ ID NO: 3717040 - DNA, 13 bp, Homo sapiens
attcaataagcat

SEQ ID NO: 3717041 - DNA, 22 bp, Homo sapiens
attcaatgtttatgcaaggaag

SEQ ID NO: 3717042 - DNA, 14 bp, Homo sapiens
attcaattcctctg

SEQ ID NO: 3717043 - DNA, 22 bp, Homo sapiens
attcaattttctttaaccagtc

SEQ ID NO: 3717044 - DNA, 16 bp, Homo sapiens
attcacaagctgcctc

SEQ ID NO: 3717045 - DNA, 13 bp, Homo sapiens
attcacaatagaa

SEQ ID NO: 3717046 - DNA, 14 bp, Homo sapiens
attcacccagacag

SEQ ID NO: 3717047 - DNA, 16 bp, Homo sapiens
attcacctgtaaaact

SEQ ID NO: 3717048 - DNA, 18 bp, Homo sapiens
attcacctgtaaaacttt

SEQ ID NO: 3717049 - DNA, 14 bp, Homo sapiens
attcagctctgcaa

SEQ ID NO: 3717050 - DNA, 18 bp, Homo sapiens
attcagctctgcaagaat

SEQ ID NO: 3717051 - DNA, 18 bp, Homo sapiens
attcaggaacctggacca

SEQ ID NO: 3717052 - DNA, 19 bp, Homo sapiens
attcagtaataactctacc

SEQ ID NO: 3717053 - DNA, 21 bp, Homo sapiens
attcagtgagggtcttcttac

SEQ ID NO: 3717054 - DNA, 17 bp, Homo sapiens
attcagtgctgtggcct

SEQ ID NO: 3717055 - DNA, 14 bp, Homo sapiens
attcagtgcttctt

SEQ ID NO: 3717056 - DNA, 15 bp, Homo sapiens
attcagttaagaaaa

SEQ ID NO: 3717057 - DNA, 18 bp, Homo sapiens
attcagttaagaaaaaaa

SEQ ID NO: 3717058 - DNA, 14 bp, Homo sapiens
attcatatttactt

SEQ ID NO: 3717059 - DNA, 19 bp, Homo sapiens
attcatatttacttcttat

SEQ ID NO: 3717060 - DNA, 20 bp, Homo sapiens
attcatatttacttcttata

SEQ ID NO: 3717061 - DNA, 12 bp, Homo sapiens
attcatgtttct

SEQ ID NO: 3717062 - DNA, 15 bp, Homo sapiens
attcatgtttcttaa

SEQ ID NO: 3717063 - DNA, 16 bp, Homo sapiens
attcattgtataaaaa

SEQ ID NO: 3717064 - DNA, 20 bp, Homo sapiens
attcattgtggttattttta

SEQ ID NO: 3717065 - DNA, 16 bp, Homo sapiens
attccacctgcaatca

SEQ ID NO: 3717066 - DNA, 16 bp, Homo sapiens
attccaccttaaatta

SEQ ID NO: 3717067 - DNA, 17 bp, Homo sapiens
attccaccttaaattaa

SEQ ID NO: 3717068 - DNA, 19 bp, Homo sapiens
attccaccttaaattaaac

SEQ ID NO: 3717069 - DNA, 23 bp, Homo sapiens
attccaccttaaattaaacaatt

SEQ ID NO: 3717070 - DNA, 18 bp, Homo sapiens
attccagagacatcagca

SEQ ID NO: 3717071 - DNA, 21 bp, Homo sapiens
attccagagagtggctcctcc

SEQ ID NO: 3717072 - DNA, 12 bp, Homo sapiens
attccaggctcc

SEQ ID NO: 3717073 - DNA, 20 bp, Homo sapiens
attccataattccatatgct

SEQ ID NO: 3717074 - DNA, 19 bp, Homo sapiens
attccatagtatattaaaa

SEQ ID NO: 3717075 - DNA, 16 bp, Homo sapiens
attccatgaatgtatc

SEQ ID NO: 3717076 - DNA, 16 bp, Homo sapiens
attccatgtgcccagt

SEQ ID NO: 3717077 - DNA, 14 bp, Homo sapiens
attcccaagctctg

SEQ ID NO: 3717078 - DNA, 15 bp, Homo sapiens
attcccaagctctgc

SEQ ID NO: 3717079 - DNA, 16 bp, Homo sapiens
attcccaagctctgct

SEQ ID NO: 3717080 - DNA, 17 bp, Homo sapiens
attcccaagctctgctc

SEQ ID NO: 3717081 - DNA, 19 bp, Homo sapiens
attcccaagctctgctcct

SEQ ID NO: 3717082 - DNA, 12 bp, Homo sapiens
attcccagagac

SEQ ID NO: 3717083 - DNA, 16 bp, Homo sapiens
attcccagagacagga

SEQ ID NO: 3717084 - DNA, 12 bp, Homo sapiens
attcccagccca

SEQ ID NO: 3717085 - DNA, 23 bp, Homo sapiens
attcccattttgcaaaatttcca

SEQ ID NO: 3717086 - DNA, 14 bp, Homo sapiens
attccccagcctct

SEQ ID NO: 3717087 - DNA, 20 bp, Homo sapiens
attccccagcctctcttcct

SEQ ID NO: 3717088 - DNA, 21 bp, Homo sapiens
attttcttgatgactggaatt

SEQ ID NO: 3717089 - DNA, 16 bp, Homo sapiens
attttctttctgtaac

SEQ ID NO: 3717090 - DNA, 15 bp, Homo sapiens
attttctttgaaatt

SEQ ID NO: 3717091 - DNA, 23 bp, Homo sapiens
attttctttgtgtagctttgctc

SEQ ID NO: 3717092 - DNA, 16 bp, Homo sapiens
attttcttttgtaaat

SEQ ID NO: 3717093 - DNA, 17 bp, Homo sapiens
attttcttttgtaaatg

SEQ ID NO: 3717094 - DNA, 19 bp, Homo sapiens
attttcttttgtaaatgtt

SEQ ID NO: 3717095 - DNA, 19 bp, Homo sapiens
attttgaaaactacatttt

SEQ ID NO: 3717096 - DNA, 15 bp, Homo sapiens
attttgaagctaatt

SEQ ID NO: 3717097 - DNA, 20 bp, Homo sapiens
attttgaataaataaatgta

SEQ ID NO: 3717098 - DNA, 18 bp, Homo sapiens
attttgcaaaatttccag

SEQ ID NO: 3717099 - DNA, 19 bp, Homo sapiens
attttgcaaaatttccagt

SEQ ID NO: 3717100 - DNA, 12 bp, Homo sapiens
attttgcataaa

SEQ ID NO: 3717101 - DNA, 16 bp, Homo sapiens
attttgcatttgaata

SEQ ID NO: 3717102 - DNA, 18 bp, Homo sapiens
attttggtccaagttgtg

SEQ ID NO: 3717103 - DNA, 10 bp, Homo sapiens
attttgtaaa

SEQ ID NO: 3717104 - DNA, 19 bp, Homo sapiens
attttgtaaactcaaaata

SEQ ID NO: 3717105 - DNA, 13 bp, Homo sapiens
attttgtaaaggt

SEQ ID NO: 3717106 - DNA, 12 bp, Homo sapiens
attttgtaattt

SEQ ID NO: 3717107 - DNA, 16 bp, Homo sapiens
attttgtaattttctt

SEQ ID NO: 3717108 - DNA, 23 bp, Homo sapiens
attttgtcatataagattcatat

SEQ ID NO: 3717109 - DNA, 19 bp, Homo sapiens
attttgtgcccccatgtaa

SEQ ID NO: 3717110 - DNA, 14 bp, Homo sapiens
attttgtttttaaa

SEQ ID NO: 3717111 - DNA, 17 bp, Homo sapiens
atttttaaagtatatat

SEQ ID NO: 3717112 - DNA, 21 bp, Homo sapiens
atttttaagcaaaatattatt

SEQ ID NO: 3717113 - DNA, 14 bp, Homo sapiens
atttttacagaatt

SEQ ID NO: 3717114 - DNA, 22 bp, Homo sapiens
atttttacagaattgcttgttt

SEQ ID NO: 3717115 - DNA, 20 bp, Homo sapiens
atttttagatggttacactg

SEQ ID NO: 3717116 - DNA, 13 bp, Homo sapiens
atttttatacagt

SEQ ID NO: 3717117 - DNA, 16 bp, Homo sapiens
atttttatacagtagt

SEQ ID NO: 3717118 - DNA, 14 bp, Homo sapiens
atttttatatagct

SEQ ID NO: 3717119 - DNA, 14 bp, Homo sapiens
atttttatatttaa

SEQ ID NO: 3717120 - DNA, 16 bp, Homo sapiens
atttttattaaattat

SEQ ID NO: 3717121 - DNA, 14 bp, Homo sapiens
atttttattatgca

SEQ ID NO: 3717122 - DNA, 20 bp, Homo sapiens
atttttattatgcataactg

SEQ ID NO: 3717123 - DNA, 14 bp, Homo sapiens
atttttatttatat

SEQ ID NO: 3717124 - DNA, 14 bp, Homo sapiens
atttttcagatgct

SEQ ID NO: 3717125 - DNA, 11 bp, Homo sapiens
atttttcttcc

SEQ ID NO: 3717126 - DNA, 14 bp, Homo sapiens
atttttgaaaaggc

SEQ ID NO: 3717127 - DNA, 15 bp, Homo sapiens
atttttggattgaca

SEQ ID NO: 3717128 - DNA, 19 bp, Homo sapiens
atttttggattgacagtaa

SEQ ID NO: 3717129 - DNA, 22 bp, Homo sapiens
atttttgtttcttccaaagcac

SEQ ID NO: 3717130 - DNA, 13 bp, Homo sapiens
atttttgtttgtt

SEQ ID NO: 3717131 - DNA, 14 bp, Homo sapiens
atttttgtttgttt

SEQ ID NO: 3717132 - DNA, 15 bp, Homo sapiens
attttttaaaaagca

SEQ ID NO: 3717133 - DNA, 15 bp, Homo sapiens
attttttaataaccc

SEQ ID NO: 3717134 - DNA, 15 bp, Homo sapiens
attttttaattatta

SEQ ID NO: 3717135 - DNA, 20 bp, Homo sapiens
attttttaattattatttat

SEQ ID NO: 3717136 - DNA, 19 bp, Homo sapiens
attttttacagctgcctgc

SEQ ID NO: 3717137 - DNA, 13 bp, Homo sapiens
attttttatacag

SEQ ID NO: 3717138 - DNA, 22 bp, Homo sapiens
atttttttaaaatcactaacat

SEQ ID NO: 3717139 - DNA, 13 bp, Homo sapiens
atttttttaagtc

SEQ ID NO: 3717140 - DNA, 15 bp, Homo sapiens
atttttttaagtctt

SEQ ID NO: 3717141 - DNA, 16 bp, Homo sapiens
atttttttgagacaga

SEQ ID NO: 3717142 - DNA, 23 bp, Homo sapiens
atttttttttagaacagaaaaca

SEQ ID NO: 3717143 - DNA, 18 bp, Homo sapiens
caaaaaacaatatttatt

SEQ ID NO: 3717144 - DNA, 22 bp, Homo sapiens
caaaaaacaatatttattgtat

SEQ ID NO: 3717145 - DNA, 14 bp, Homo sapiens
caaaaacagcctca

SEQ ID NO: 3717146 - DNA, 15 bp, Homo sapiens
caaaaacagcctcac

SEQ ID NO: 3717147 - DNA, 13 bp, Homo sapiens
caaaaagcttccc

SEQ ID NO: 3717148 - DNA, 14 bp, Homo sapiens
caaaaatactctaa

SEQ ID NO: 3717149 - DNA, 19 bp, Homo sapiens
caaaaatgaaagcatgtct

SEQ ID NO: 3717150 - DNA, 19 bp, Homo sapiens
caaaaatgtacaaaataaa

SEQ ID NO: 3717151 - DNA, 22 bp, Homo sapiens
caaaaatgtacaaaataaagtt

SEQ ID NO: 3717152 - DNA, 17 bp, Homo sapiens
caaaaattagccgggcg

SEQ ID NO: 3717153 - DNA, 20 bp, Homo sapiens
caaaaattatctatttgtat

SEQ ID NO: 3717154 - DNA, 21 bp, Homo sapiens
caaaaattatctatttgtata

SEQ ID NO: 3717155 - DNA, 17 bp, Homo sapiens
caaaaattcacaagctg

SEQ ID NO: 3717156 - DNA, 13 bp, Homo sapiens
caaaaatttgaac

SEQ ID NO: 3717157 - DNA, 20 bp, Homo sapiens
caaaaatttggaattctgtt

SEQ ID NO: 3717158 - DNA, 18 bp, Homo sapiens
caaaaatttttggattga

SEQ ID NO: 3717159 - DNA, 21 bp, Homo sapiens
caaaaatttttggattgacag

SEQ ID NO: 3717160 - DNA, 22 bp, Homo sapiens
caaaaatttttggattgacagt

SEQ ID NO: 3717161 - DNA, 16 bp, Homo sapiens
caaaacacttgtaatt

SEQ ID NO: 3717162 - DNA, 22 bp, Homo sapiens
caaaacatgctacctgatccca

SEQ ID NO: 3717163 - DNA, 16 bp, Homo sapiens
caaaaccacagccctg

SEQ ID NO: 3717164 - DNA, 15 bp, Homo sapiens
caaaaccattgcttc

SEQ ID NO: 3717165 - DNA, 23 bp, Homo sapiens
caaaacgcatggagtgtgtattg

SEQ ID NO: 3717166 - DNA, 19 bp, Homo sapiens
caaaagaacaagaatttct

SEQ ID NO: 3717167 - DNA, 21 bp, Homo sapiens
caaaagatgtatccttccaat

SEQ ID NO: 3717168 - DNA, 15 bp, Homo sapiens
caaaagggacatgaa

SEQ ID NO: 3717169 - DNA, 22 bp, Homo sapiens
caaaagggtttaaactgattca

SEQ ID NO: 3717170 - DNA, 13 bp, Homo sapiens
caaaaggtgcctg

SEQ ID NO: 3717171 - DNA, 15 bp, Homo sapiens
caaaaggtgcctgtg

SEQ ID NO: 3717172 - DNA, 20 bp, Homo sapiens
caaaaggttaataaagtaat

SEQ ID NO: 3717173 - DNA, 19 bp, Homo sapiens
caaaataaagttacattgc

SEQ ID NO: 3717174 - DNA, 15 bp, Homo sapiens
caaaataatgtcttg

SEQ ID NO: 3717175 - DNA, 20 bp, Homo sapiens
caaaataatgtcttgttaat

SEQ ID NO: 3717176 - DNA, 21 bp, Homo sapiens
caaaataatgtcttgttaata

SEQ ID NO: 3717177 - DNA, 14 bp, Homo sapiens
caaaatatgttctt

SEQ ID NO: 3717178 - DNA, 19 bp, Homo sapiens
caaaatatgttgatgaaaa

SEQ ID NO: 3717179 - DNA, 16 bp, Homo sapiens
caaaatatttgtacat

SEQ ID NO: 3717180 - DNA, 17 bp, Homo sapiens
caaaatatttgtacata

SEQ ID NO: 3717181 - DNA, 21 bp, Homo sapiens
caaaatctgtccaaaggaggc

SEQ ID NO: 3717182 - DNA, 18 bp, Homo sapiens
caaaatggaattcattct

SEQ ID NO: 3717183 - DNA, 22 bp, Homo sapiens
caaaatgtctgtagctcctcaa

SEQ ID NO: 3717184 - DNA, 16 bp, Homo sapiens
caaaattatttcagaa

SEQ ID NO: 3717185 - DNA, 23 bp, Homo sapiens
caaaattgggaaaggagtagaaa

SEQ ID NO: 3717186 - DNA, 19 bp, Homo sapiens
caaaatttccagtaccttt

SEQ ID NO: 3717187 - DNA, 14 bp, Homo sapiens
caaaatttgaaatt

SEQ ID NO: 3717188 - DNA, 23 bp, Homo sapiens
caaaattttatagctcagtttat

SEQ ID NO: 3717189 - DNA, 13 bp, Homo sapiens
caaacaaagccag

SEQ ID NO: 3717190 - DNA, 14 bp, Homo sapiens
caaacaaagccaga

SEQ ID NO: 3717191 - DNA, 16 bp, Homo sapiens
caaacaaagccagaag

SEQ ID NO: 3717192 - DNA, 15 bp, Homo sapiens
caaacacctcccagg

SEQ ID NO: 3717193 - DNA, 22 bp, Homo sapiens
caaacacctgctgatgtggcaa

SEQ ID NO: 3717194 - DNA, 13 bp, Homo sapiens
caaacagccacac

SEQ ID NO: 3717195 - DNA, 16 bp, Homo sapiens
caaacagctcaggctg

SEQ ID NO: 3717196 - DNA, 18 bp, Homo sapiens
caaacatcagacctgtct

SEQ ID NO: 3717197 - DNA, 18 bp, Homo sapiens
caaacatgtggttaatgc

SEQ ID NO: 3717198 - DNA, 14 bp, Homo sapiens
caaacatttcaaag

SEQ ID NO: 3717199 - DNA, 13 bp, Homo sapiens
caaacccatgagg

SEQ ID NO: 3717200 - DNA, 18 bp, Homo sapiens
caaacctccaaaagccct

SEQ ID NO: 3717201 - DNA, 23 bp, Homo sapiens
caatgctggctgttggctggggg

SEQ ID NO: 3717202 - DNA, 21 bp, Homo sapiens
caatgctttgcccctgagaca

SEQ ID NO: 3717203 - DNA, 14 bp, Homo sapiens
caatggaagatttg

SEQ ID NO: 3717204 - DNA, 20 bp, Homo sapiens
caatggagactgtctcaaga

SEQ ID NO: 3717205 - DNA, 23 bp, Homo sapiens
caatggagtagacccctggctgg

SEQ ID NO: 3717206 - DNA, 13 bp, Homo sapiens
caatggcagcctt

SEQ ID NO: 3717207 - DNA, 16 bp, Homo sapiens
caatggcagccttggc

SEQ ID NO: 3717208 - DNA, 21 bp, Homo sapiens
caatgggagcctcataaagat

SEQ ID NO: 3717209 - DNA, 18 bp, Homo sapiens
caatggtttgcaaggaag

SEQ ID NO: 3717210 - DNA, 20 bp, Homo sapiens
caatggtttgcaaggaagcc

SEQ ID NO: 3717211 - DNA, 13 bp, Homo sapiens
caatgtgccccca

SEQ ID NO: 3717212 - DNA, 13 bp, Homo sapiens
caatgtgctctcg

SEQ ID NO: 3717213 - DNA, 21 bp, Homo sapiens
caatgtggcctaaaaatgcaa

SEQ ID NO: 3717214 - DNA, 15 bp, Homo sapiens
caatgttcattgtaa

SEQ ID NO: 3717215 - DNA, 18 bp, Homo sapiens
caatgttcattgtaatgt

SEQ ID NO: 3717216 - DNA, 23 bp, Homo sapiens
caatgttcattgtaatgttactg

SEQ ID NO: 3717217 - DNA, 14 bp, Homo sapiens
caatgttctctctt

SEQ ID NO: 3717218 - DNA, 16 bp, Homo sapiens
caatgtttaaaaaagt

SEQ ID NO: 3717219 - DNA, 18 bp, Homo sapiens
caatgtttaaaaaagttt

SEQ ID NO: 3717220 - DNA, 20 bp, Homo sapiens
caatgtttaaaaaagtttaa

SEQ ID NO: 3717221 - DNA, 21 bp, Homo sapiens
caatgtttaaaaaagtttaaa

SEQ ID NO: 3717222 - DNA, 20 bp, Homo sapiens
caatgtttatgcaaggaagg

SEQ ID NO: 3717223 - DNA, 17 bp, Homo sapiens
caatgtttcttctaggt

SEQ ID NO: 3717224 - DNA, 20 bp, Homo sapiens
caattaggaagtgtaacagc

SEQ ID NO: 3717225 - DNA, 22 bp, Homo sapiens
caattaggaagtgtaacagctg

SEQ ID NO: 3717226 - DNA, 23 bp, Homo sapiens
caattaggaagtgtaacagctga

SEQ ID NO: 3717227 - DNA, 16 bp, Homo sapiens
caattagggcctagcc

SEQ ID NO: 3717228 - DNA, 14 bp, Homo sapiens
caattcaacccttt

SEQ ID NO: 3717229 - DNA, 21 bp, Homo sapiens
caattcagtgctgtacttgat

SEQ ID NO: 3717230 - DNA, 20 bp, Homo sapiens
caattcatatttatgaatct

SEQ ID NO: 3717231 - DNA, 15 bp, Homo sapiens
caattcctagataaa

SEQ ID NO: 3717232 - DNA, 15 bp, Homo sapiens
caattcctctgggaa

SEQ ID NO: 3717233 - DNA, 21 bp, Homo sapiens
caattgaacttaaataaatgt

SEQ ID NO: 3717234 - DNA, 21 bp, Homo sapiens
caattgaattaaattaggaat

SEQ ID NO: 3717235 - DNA, 19 bp, Homo sapiens
caattgactgtcactgttc

SEQ ID NO: 3717236 - DNA, 14 bp, Homo sapiens
caattgctgcatct

SEQ ID NO: 3717237 - DNA, 18 bp, Homo sapiens
caattgctgcatcttagt

SEQ ID NO: 3717238 - DNA, 20 bp, Homo sapiens
caattgcttactcattaaaa

SEQ ID NO: 3717239 - DNA, 19 bp, Homo sapiens
caattgtaaaactgaggca

SEQ ID NO: 3717240 - DNA, 13 bp, Homo sapiens
caatttaaagcaa

SEQ ID NO: 3717241 - DNA, 23 bp, Homo sapiens
caatttgtaaaaacagcattgct

SEQ ID NO: 3717242 - DNA, 16 bp, Homo sapiens
caatttgtataaaatg

SEQ ID NO: 3717243 - DNA, 17 bp, Homo sapiens
caatttgtcattttgaa

SEQ ID NO: 3717244 - DNA, 19 bp, Homo sapiens
caattttctggaatacatg

SEQ ID NO: 3717245 - DNA, 20 bp, Homo sapiens
caattttctggaatacatga

SEQ ID NO: 3717246 - DNA, 18 bp, Homo sapiens
caattttgcatgctcgat

SEQ ID NO: 3717247 - DNA, 22 bp, Homo sapiens
cacaaaaaaaatttaaaaaaat

SEQ ID NO: 3717248 - DNA, 22 bp, Homo sapiens
cacaaaaaaagttgaaggcctt

SEQ ID NO: 3717249 - DNA, 14 bp, Homo sapiens
cacaaaagcctctc

SEQ ID NO: 3717250 - DNA, 16 bp, Homo sapiens
cacaaaagtttctctt

SEQ ID NO: 3717251 - DNA, 14 bp, Homo sapiens
cacaaacaaacaag

SEQ ID NO: 3717252 - DNA, 19 bp, Homo sapiens
cacaaagcggggggagggt

SEQ ID NO: 3717253 - DNA, 13 bp, Homo sapiens
cacaaaggagagc

SEQ ID NO: 3717254 - DNA, 21 bp, Homo sapiens
cacaaatatttattttctttc

SEQ ID NO: 3717255 - DNA, 16 bp, Homo sapiens
cacaacacacacactc

SEQ ID NO: 3717256 - DNA, 20 bp, Homo sapiens
cacaacccatctacccctgg

SEQ ID NO: 3717257 - DNA, 21 bp, Homo sapiens
cacaagagcccagcagggcct

SEQ ID NO: 3717258 - DNA, 14 bp, Homo sapiens
cacaagattcccag

SEQ ID NO: 3717259 - DNA, 16 bp, Homo sapiens
cacaagattcccagag

SEQ ID NO: 3717260 - DNA, 19 bp, Homo sapiens
cacaagattcccagagaca

SEQ ID NO: 3717261 - DNA, 15 bp, Homo sapiens
cacaagctgcctccc

SEQ ID NO: 3717262 - DNA, 22 bp, Homo sapiens
cacaagctgcctccctgtccac

SEQ ID NO: 3717263 - DNA, 20 bp, Homo sapiens
cacaaggaaaatagtttagg

SEQ ID NO: 3717264 - DNA, 14 bp, Homo sapiens
cacaaggctgacca

SEQ ID NO: 3717265 - DNA, 22 bp, Homo sapiens
cacaatgcagtgcctttcttct

SEQ ID NO: 3717266 - DNA, 12 bp, Homo sapiens
cacaatgtcttg

SEQ ID NO: 3717267 - DNA, 21 bp, Homo sapiens
cacacaaaatgtacccagtat

SEQ ID NO: 3717268 - DNA, 18 bp, Homo sapiens
cacacaaaggtataattt

SEQ ID NO: 3717269 - DNA, 21 bp, Homo sapiens
cacacaaattatcttaaaact

SEQ ID NO: 3717270 - DNA, 16 bp, Homo sapiens
cacacacacacacagg

SEQ ID NO: 3717271 - DNA, 13 bp, Homo sapiens
cacacacacacag

SEQ ID NO: 3717272 - DNA, 14 bp, Homo sapiens
cacacacacacagg

SEQ ID NO: 3717273 - DNA, 16 bp, Homo sapiens
cacacacacacaggag

SEQ ID NO: 3717274 - DNA, 14 bp, Homo sapiens
cacacacacaggag

SEQ ID NO: 3717275 - DNA, 14 bp, Homo sapiens
cacacacagaggaa

SEQ ID NO: 3717276 - DNA, 11 bp, Homo sapiens
cacacacagct

SEQ ID NO: 3717277 - DNA, 14 bp, Homo sapiens
cacacaccagagcc

SEQ ID NO: 3717278 - DNA, 16 bp, Homo sapiens
cacacaccagagccca

SEQ ID NO: 3717279 - DNA, 13 bp, Homo sapiens
cacacaccccaat

SEQ ID NO: 3717280 - DNA, 19 bp, Homo sapiens
cacacacctgtagtcccag

SEQ ID NO: 3717281 - DNA, 20 bp, Homo sapiens
cacacacctgtagtcccagc

SEQ ID NO: 3717282 - DNA, 12 bp, Homo sapiens
cacacacgttat

SEQ ID NO: 3717283 - DNA, 14 bp, Homo sapiens
cacacactttggct

SEQ ID NO: 3717284 - DNA, 14 bp, Homo sapiens
cacacagagtggtc

SEQ ID NO: 3717285 - DNA, 12 bp, Homo sapiens
cacacagctctg

SEQ ID NO: 3717286 - DNA, 22 bp, Homo sapiens
cacacagcttttagtacccacc

SEQ ID NO: 3717287 - DNA, 13 bp, Homo sapiens
cacacaggcaact

SEQ ID NO: 3717288 - DNA, 16 bp, Homo sapiens
cacacaggcaactgag

SEQ ID NO: 3717289 - DNA, 19 bp, Homo sapiens
cacacaggcaactgaggca

SEQ ID NO: 3717290 - DNA, 20 bp, Homo sapiens
cacacagtattacttctgct

SEQ ID NO: 3717291 - DNA, 21 bp, Homo sapiens
cacacatataaacatcacaca

SEQ ID NO: 3717292 - DNA, 15 bp, Homo sapiens
cacaccagagcccac

SEQ ID NO: 3717293 - DNA, 13 bp, Homo sapiens
cacaccaggctgt

SEQ ID NO: 3717294 - DNA, 17 bp, Homo sapiens
cacaccaggctgtgggc

SEQ ID NO: 3717295 - DNA, 20 bp, Homo sapiens
cacaccaggctgtgggcctc

SEQ ID NO: 3717296 - DNA, 21 bp, Homo sapiens
cacaccaggcttgcctgcagg

SEQ ID NO: 3717297 - DNA, 20 bp, Homo sapiens
cacacccagcccacttctgc

SEQ ID NO: 3717298 - DNA, 17 bp, Homo sapiens
cacaccctctcccagga

SEQ ID NO: 3717299 - DNA, 13 bp, Homo sapiens
cacacctcagttc

SEQ ID NO: 3717300 - DNA, 14 bp, Homo sapiens
cacacgcacacaca

SEQ ID NO: 3717301 - DNA, 20 bp, Homo sapiens
cacacggaggcatctgcacc

SEQ ID NO: 3717302 - DNA, 21 bp, Homo sapiens
cacacggaggcatctgcaccc

SEQ ID NO: 3717303 - DNA, 18 bp, Homo sapiens
cacactagcctctccagg

SEQ ID NO: 3717304 - DNA, 17 bp, Homo sapiens
cacactgaggcagggaa

SEQ ID NO: 3717305 - DNA, 17 bp, Homo sapiens
cacactgcaagagcctt

SEQ ID NO: 3717306 - DNA, 19 bp, Homo sapiens
cacactgcaagagccttgg

SEQ ID NO: 3717307 - DNA, 18 bp, Homo sapiens
cacacttcaggctcttct

SEQ ID NO: 3717308 - DNA, 19 bp, Homo sapiens
cacacttccaccagcctgc

SEQ ID NO: 3717309 - DNA, 15 bp, Homo sapiens
cacacttctgtgaga

SEQ ID NO: 3717310 - DNA, 10 bp, Homo sapiens
cacacttgtc

SEQ ID NO: 3717311 - DNA, 13 bp, Homo sapiens
cacacttgtgtgt

SEQ ID NO: 3717312 - DNA, 19 bp, Homo sapiens
cacacttgtgtgtgggctg

SEQ ID NO: 3717313 - DNA, 21 bp, Homo sapiens
cacacttgtgtgtgggctgtg

SEQ ID NO: 3717314 - DNA, 13 bp, Homo sapiens
cacttctgaccac

SEQ ID NO: 3717315 - DNA, 22 bp, Homo sapiens
cacttctgtgagacccccacac

SEQ ID NO: 3717316 - DNA, 23 bp, Homo sapiens
cacttcttcttggtcttatttat

SEQ ID NO: 3717317 - DNA, 19 bp, Homo sapiens
cacttgatgacccccaacc

SEQ ID NO: 3717318 - DNA, 12 bp, Homo sapiens
cacttgcatttc

SEQ ID NO: 3717319 - DNA, 19 bp, Homo sapiens
cacttggttgggtcctcac

SEQ ID NO: 3717320 - DNA, 20 bp, Homo sapiens
cacttggttgggtcctcaca

SEQ ID NO: 3717321 - DNA, 21 bp, Homo sapiens
cacttggttgggtcctcacat

SEQ ID NO: 3717322 - DNA, 20 bp, Homo sapiens
cacttgtaattttgtatctt

SEQ ID NO: 3717323 - DNA, 17 bp, Homo sapiens
cacttgtacaaaataaa

SEQ ID NO: 3717324 - DNA, 15 bp, Homo sapiens
cacttgtgtgtgggc

SEQ ID NO: 3717325 - DNA, 19 bp, Homo sapiens
cacttgtgtgtgggctgtg

SEQ ID NO: 3717326 - DNA, 22 bp, Homo sapiens
cacttgtgtgtgggctgtgagt

SEQ ID NO: 3717327 - DNA, 17 bp, Homo sapiens
cacttgttccagctctt

SEQ ID NO: 3717328 - DNA, 15 bp, Homo sapiens
cactttatttacttc

SEQ ID NO: 3717329 - DNA, 14 bp, Homo sapiens
cactttcaggaaca

SEQ ID NO: 3717330 - DNA, 16 bp, Homo sapiens
cactttcattgccagt

SEQ ID NO: 3717331 - DNA, 20 bp, Homo sapiens
cactttcattgccagtgtct

SEQ ID NO: 3717332 - DNA, 21 bp, Homo sapiens
cactttcattgccagtgtctt

SEQ ID NO: 3717333 - DNA, 22 bp, Homo sapiens
cactttcattgccagtgtcttt

SEQ ID NO: 3717334 - DNA, 23 bp, Homo sapiens
cactttcattgccagtgtctttc

SEQ ID NO: 3717335 - DNA, 14 bp, Homo sapiens
cactttgcacagct

SEQ ID NO: 3717336 - DNA, 19 bp, Homo sapiens
cactttgggaggccaagga

SEQ ID NO: 3717337 - DNA, 16 bp, Homo sapiens
cacttttcctccctca

SEQ ID NO: 3717338 - DNA, 12 bp, Homo sapiens
cacttttctcca

SEQ ID NO: 3717339 - DNA, 16 bp, Homo sapiens
cagaaaaactctggga

SEQ ID NO: 3717340 - DNA, 21 bp, Homo sapiens
cagaaaaataacttcaagcaa

SEQ ID NO: 3717341 - DNA, 11 bp, Homo sapiens
cagaaaacaac

SEQ ID NO: 3717342 - DNA, 12 bp, Homo sapiens
cagaaaacagaa

SEQ ID NO: 3717343 - DNA, 20 bp, Homo sapiens
cagaaaacagaaaaaaaaca

SEQ ID NO: 3717344 - DNA, 23 bp, Homo sapiens
cagaaacagatttggtgaatttg

SEQ ID NO: 3717345 - DNA, 18 bp, Homo sapiens
cagaaacaggtgcatctg

SEQ ID NO: 3717346 - DNA, 22 bp, Homo sapiens
cagaaacaggtgcatctgggga

SEQ ID NO: 3717347 - DNA, 19 bp, Homo sapiens
cagaaacatcagttactct

SEQ ID NO: 3717348 - DNA, 24 bp, Homo sapiens
cagaaagaagtggggacagagcag

SEQ ID NO: 3717349 - DNA, 21 bp, Homo sapiens
cagaaagatggatgtgctttg

SEQ ID NO: 3717350 - DNA, 16 bp, Homo sapiens
cagaaagcagaggctg

SEQ ID NO: 3717351 - DNA, 19 bp, Homo sapiens
cagaaagccccaagcaatt

SEQ ID NO: 3717352 - DNA, 20 bp, Homo sapiens
cagaaagtaatttcttctca

SEQ ID NO: 3717353 - DNA, 22 bp, Homo sapiens
cagaaagtaatttcttctcaaa

SEQ ID NO: 3717354 - DNA, 22 bp, Homo sapiens
cagaaataccaaaattatttca

SEQ ID NO: 3717355 - DNA, 16 bp, Homo sapiens
cagaaatcagaggaga

SEQ ID NO: 3717356 - DNA, 22 bp, Homo sapiens
cagaaatttaattcatgtttct

SEQ ID NO: 3717357 - DNA, 23 bp, Homo sapiens
cagaaatttaattcatgtttctt

SEQ ID NO: 3717358 - DNA, 19 bp, Homo sapiens
cagaacagttaagcagccg

SEQ ID NO: 3717359 - DNA, 22 bp, Homo sapiens
cagaacagttaagcagccgcca

SEQ ID NO: 3717360 - DNA, 14 bp, Homo sapiens
cagaacctcttccc

SEQ ID NO: 3717361 - DNA, 15 bp, Homo sapiens
cagaacctcttcccc

SEQ ID NO: 3717362 - DNA, 13 bp, Homo sapiens
cagaactgagctc

SEQ ID NO: 3717363 - DNA, 15 bp, Homo sapiens
cagaactgagctcct

SEQ ID NO: 3717364 - DNA, 15 bp, Homo sapiens
cagaagaaggcagca

SEQ ID NO: 3717365 - DNA, 18 bp, Homo sapiens
cagaagaatatgacagct

SEQ ID NO: 3717366 - DNA, 20 bp, Homo sapiens
cagaagagatgggcttgttt

SEQ ID NO: 3717367 - DNA, 16 bp, Homo sapiens
cagaagcctattgtaa

SEQ ID NO: 3717368 - DNA, 18 bp, Homo sapiens
cagaagcctattgtaaat

SEQ ID NO: 3717369 - DNA, 22 bp, Homo sapiens
cagaagcctattgtaaatacaa

SEQ ID NO: 3717370 - DNA, 14 bp, Homo sapiens
cagaagcctctggc

SEQ ID NO: 3717371 - DNA, 19 bp, Homo sapiens
cagaagcctgaggctggga

SEQ ID NO: 3717372 - DNA, 15 bp, Homo sapiens
cagaagctctcgatg

SEQ ID NO: 3717373 - DNA, 13 bp, Homo sapiens
cagaaggaggagg

SEQ ID NO: 3717374 - DNA, 13 bp, Homo sapiens
cagaagggaaaca

SEQ ID NO: 3717375 - DNA, 14 bp, Homo sapiens
cagaagggaaacag

SEQ ID NO: 3717376 - DNA, 14 bp, Homo sapiens
cagaagggggccat

SEQ ID NO: 3717377 - DNA, 16 bp, Homo sapiens
cagaagggggccatga

SEQ ID NO: 3717378 - DNA, 15 bp, Homo sapiens
cagaagggggtctct

SEQ ID NO: 3717379 - DNA, 22 bp, Homo sapiens
cagaagtcactcaattgttttt

SEQ ID NO: 3717380 - DNA, 17 bp, Homo sapiens
cagaagtcatgaagccc

SEQ ID NO: 3717381 - DNA, 23 bp, Homo sapiens
cagaagtttgagatcagcctggg

SEQ ID NO: 3717382 - DNA, 22 bp, Homo sapiens
cagaataaagttctgagtgttt

SEQ ID NO: 3717383 - DNA, 14 bp, Homo sapiens
cagaataatgaatg

SEQ ID NO: 3717384 - DNA, 20 bp, Homo sapiens
cagaatactagccagagctc

SEQ ID NO: 3717385 - DNA, 18 bp, Homo sapiens
cagaatctgaatgtaatt

SEQ ID NO: 3717386 - DNA, 12 bp, Homo sapiens
cagaatgtcaga

SEQ ID NO: 3717387 - DNA, 22 bp, Homo sapiens
cagaatgtcagattcctttccc

SEQ ID NO: 3717388 - DNA, 23 bp, Homo sapiens
cagaattcccagctgtctgtgtc

SEQ ID NO: 3717389 - DNA, 15 bp, Homo sapiens
cagaattccttttct

SEQ ID NO: 3717390 - DNA, 13 bp, Homo sapiens
cagaattctgcta

SEQ ID NO: 3717391 - DNA, 20 bp, Homo sapiens
cagacaaaaacagcctcaca

SEQ ID NO: 3717392 - DNA, 21 bp, Homo sapiens
cagacaaaaacagcctcacag

SEQ ID NO: 3717393 - DNA, 22 bp, Homo sapiens
cagacaaaaacagcctcacaga

SEQ ID NO: 3717394 - DNA, 13 bp, Homo sapiens
cagacaacagaag

SEQ ID NO: 3717395 - DNA, 17 bp, Homo sapiens
cagacaacagaagtcat

SEQ ID NO: 3717396 - DNA, 14 bp, Homo sapiens
cagacacaggcccg

SEQ ID NO: 3717397 - DNA, 21 bp, Homo sapiens
cagacacaggcccggctccag

SEQ ID NO: 3717398 - DNA, 15 bp, Homo sapiens
cagacagacacacac

SEQ ID NO: 3717399 - DNA, 16 bp, Homo sapiens
cagacagacacacaca

SEQ ID NO: 3717400 - DNA, 13 bp, Homo sapiens
cagacagcagctc

SEQ ID NO: 3717401 - DNA, 18 bp, Homo sapiens
cagacagcagctcaggca

SEQ ID NO: 3717402 - DNA, 19 bp, Homo sapiens
cagacagcagctcaggcac

SEQ ID NO: 3717403 - DNA, 15 bp, Homo sapiens
cagacaggaaaggga

SEQ ID NO: 3717404 - DNA, 20 bp, Homo sapiens
cagacaggaaagggaaggcc

SEQ ID NO: 3717405 - DNA, 21 bp, Homo sapiens
cagacaggcaagcacctcctg

SEQ ID NO: 3717406 - DNA, 21 bp, Homo sapiens
cagacaggccatgtgagccac

SEQ ID NO: 3717407 - DNA, 22 bp, Homo sapiens
cagacatgtggtgggacaggga

SEQ ID NO: 3717408 - DNA, 21 bp, Homo sapiens
cagacattctgccaggccccc

SEQ ID NO: 3717409 - DNA, 14 bp, Homo sapiens
cagaccacaaaact

SEQ ID NO: 3717410 - DNA, 20 bp, Homo sapiens
cagaccacaaaacttttcta

SEQ ID NO: 3717411 - DNA, 12 bp, Homo sapiens
cagaccagagct

SEQ ID NO: 3717412 - DNA, 15 bp, Homo sapiens
cagaccagagctctg

SEQ ID NO: 3717413 - DNA, 16 bp, Homo sapiens
cagaccccagcggctg

SEQ ID NO: 3717414 - DNA, 14 bp, Homo sapiens
cagacccccacccc

SEQ ID NO: 3717415 - DNA, 15 bp, Homo sapiens
cagacccccacccct

SEQ ID NO: 3717416 - DNA, 17 bp, Homo sapiens
cagacccccaccccttc

SEQ ID NO: 3717417 - DNA, 18 bp, Homo sapiens
cagacccccagcaaccct

SEQ ID NO: 3717418 - DNA, 13 bp, Homo sapiens
cagacccctctgg

SEQ ID NO: 3717419 - DNA, 17 bp, Homo sapiens
cagacccctctggccag

SEQ ID NO: 3717420 - DNA, 20 bp, Homo sapiens
cagacccctctggccaggat

SEQ ID NO: 3717421 - DNA, 22 bp, Homo sapiens
cagacccctctggccaggatgg

SEQ ID NO: 3717422 - DNA, 14 bp, Homo sapiens
cagacccctggctt

SEQ ID NO: 3717423 - DNA, 15 bp, Homo sapiens
cagacccctggcttt

SEQ ID NO: 3717424 - DNA, 18 bp, Homo sapiens
cagacccctggcttttca

SEQ ID NO: 3717425 - DNA, 23 bp, Homo sapiens
cagacccctggcttttcactgct

SEQ ID NO: 3717426 - DNA, 15 bp, Homo sapiens
cagctagcaaaagaa

SEQ ID NO: 3717427 - DNA, 21 bp, Homo sapiens
cagctagcaaaagaagtaaca

SEQ ID NO: 3717428 - DNA, 21 bp, Homo sapiens
cagctatgggagccccagggt

SEQ ID NO: 3717429 - DNA, 13 bp, Homo sapiens
cagctatttttat

SEQ ID NO: 3717430 - DNA, 19 bp, Homo sapiens
cagctcaaaggcacagtga

SEQ ID NO: 3717431 - DNA, 13 bp, Homo sapiens
cagctcaagtctt

SEQ ID NO: 3717432 - DNA, 16 bp, Homo sapiens
cagctcaccagcccca

SEQ ID NO: 3717433 - DNA, 21 bp, Homo sapiens
cagctcaggcacacttcttct

SEQ ID NO: 3717434 - DNA, 18 bp, Homo sapiens
cagctcagtcccatcaga

SEQ ID NO: 3717435 - DNA, 15 bp, Homo sapiens
cagctccagctcacc

SEQ ID NO: 3717436 - DNA, 14 bp, Homo sapiens
cagctccagggcca

SEQ ID NO: 3717437 - DNA, 21 bp, Homo sapiens
cagctcccaaggctctgagca

SEQ ID NO: 3717438 - DNA, 12 bp, Homo sapiens
cagctcccaccc

SEQ ID NO: 3717439 - DNA, 22 bp, Homo sapiens
cagctcccaccccacccccttc

SEQ ID NO: 3717440 - DNA, 15 bp, Homo sapiens
cagctccctaggaga

SEQ ID NO: 3717441 - DNA, 20 bp, Homo sapiens
cagctccctaggagaccaag

SEQ ID NO: 3717442 - DNA, 16 bp, Homo sapiens
cagctccctctgcctg

SEQ ID NO: 3717443 - DNA, 16 bp, Homo sapiens
cagctccttctgtcct

SEQ ID NO: 3717444 - DNA, 20 bp, Homo sapiens
cagctctagacaaccctgca

SEQ ID NO: 3717445 - DNA, 16 bp, Homo sapiens
cagctctccccttctc

SEQ ID NO: 3717446 - DNA, 17 bp, Homo sapiens
cagctctccctctggcc

SEQ ID NO: 3717447 - DNA, 19 bp, Homo sapiens
cagctctccctctggccct

SEQ ID NO: 3717448 - DNA, 15 bp, Homo sapiens
cagctctgcaagaat

SEQ ID NO: 3717449 - DNA, 22 bp, Homo sapiens
cagctctgcttgccgaaactgg

SEQ ID NO: 3717450 - DNA, 20 bp, Homo sapiens
cagctctggctcacagactg

SEQ ID NO: 3717451 - DNA, 12 bp, Homo sapiens
cagctctggctt

SEQ ID NO: 3717452 - DNA, 14 bp, Homo sapiens
cagctctgtcctgg

SEQ ID NO: 3717453 - DNA, 17 bp, Homo sapiens
cagctctgtcctgggag

SEQ ID NO: 3717454 - DNA, 18 bp, Homo sapiens
cagctctgtcctgggagt

SEQ ID NO: 3717455 - DNA, 13 bp, Homo sapiens
cagctcttctcca

SEQ ID NO: 3717456 - DNA, 18 bp, Homo sapiens
cagctcttctccaggctg

SEQ ID NO: 3717457 - DNA, 22 bp, Homo sapiens
cagctctttgaaatagtctgtg

SEQ ID NO: 3717458 - DNA, 15 bp, Homo sapiens
cagctgaaatactga

SEQ ID NO: 3717459 - DNA, 13 bp, Homo sapiens
cagctgactgtgg

SEQ ID NO: 3717460 - DNA, 19 bp, Homo sapiens
cagctgagggtgagtgggt

SEQ ID NO: 3717461 - DNA, 19 bp, Homo sapiens
cagctgaggtctcttgagg

SEQ ID NO: 3717462 - DNA, 16 bp, Homo sapiens
cagctgcacctgccag

SEQ ID NO: 3717463 - DNA, 17 bp, Homo sapiens
cagctgcacctgccagc

SEQ ID NO: 3717464 - DNA, 21 bp, Homo sapiens
cagctgcacctgccagcctgg

SEQ ID NO: 3717465 - DNA, 22 bp, Homo sapiens
cagctgcacctgccagcctggc

SEQ ID NO: 3717466 - DNA, 17 bp, Homo sapiens
cagctgcatctactcag

SEQ ID NO: 3717467 - DNA, 13 bp, Homo sapiens
cagctgcccctcc

SEQ ID NO: 3717468 - DNA, 16 bp, Homo sapiens
cagctgcccctccctg

SEQ ID NO: 3717469 - DNA, 19 bp, Homo sapiens
cagctgccgaccagagccc

SEQ ID NO: 3717470 - DNA, 22 bp, Homo sapiens
cagctgcctggaagagcagccc

SEQ ID NO: 3717471 - DNA, 21 bp, Homo sapiens
cagctgcggtccacccaggag

SEQ ID NO: 3717472 - DNA, 23 bp, Homo sapiens
cagctgcggtccacccaggagcc

SEQ ID NO: 3717473 - DNA, 16 bp, Homo sapiens
cagctgctcccctccc

SEQ ID NO: 3717474 - DNA, 12 bp, Homo sapiens
cagctgctctgc

SEQ ID NO: 3717475 - DNA, 18 bp, Homo sapiens
cagctgctctgcccagag

SEQ ID NO: 3717476 - DNA, 18 bp, Homo sapiens
cagctggcagcagagtgt

SEQ ID NO: 3717477 - DNA, 20 bp, Homo sapiens
cagctgggatctgactgcac

SEQ ID NO: 3717478 - DNA, 20 bp, Homo sapiens
cagctggtgggaagcgtctg

SEQ ID NO: 3717479 - DNA, 22 bp, Homo sapiens
cagctggtgggaagcgtctgtc

SEQ ID NO: 3717480 - DNA, 19 bp, Homo sapiens
cagctgtaagaagagactg

SEQ ID NO: 3717481 - DNA, 22 bp, Homo sapiens
cagctgtaagaagagactggga

SEQ ID NO: 3717482 - DNA, 13 bp, Homo sapiens
cagctgtccctgt

SEQ ID NO: 3717483 - DNA, 17 bp, Homo sapiens
cagcttcagccaggagc

SEQ ID NO: 3717484 - DNA, 18 bp, Homo sapiens
cagcttcatgcctttgta

SEQ ID NO: 3717485 - DNA, 21 bp, Homo sapiens
cagcttcatttcctgtgtctt

SEQ ID NO: 3717486 - DNA, 22 bp, Homo sapiens
cagcttcccctctctcctcctg

SEQ ID NO: 3717487 - DNA, 23 bp, Homo sapiens
cagcttcccctctctcctcctgc

SEQ ID NO: 3717488 - DNA, 15 bp, Homo sapiens
cagcttgagggttgg

SEQ ID NO: 3717489 - DNA, 22 bp, Homo sapiens
cagcttgcgttagaatgaggag

SEQ ID NO: 3717490 - DNA, 23 bp, Homo sapiens
cagcttgctcttcagtgggagaa

SEQ ID NO: 3717491 - DNA, 14 bp, Homo sapiens
cagcttgctgccct

SEQ ID NO: 3717492 - DNA, 17 bp, Homo sapiens
cagcttgctgccctagg

SEQ ID NO: 3717493 - DNA, 18 bp, Homo sapiens
cagcttgtaaatagctca

SEQ ID NO: 3717494 - DNA, 15 bp, Homo sapiens
cagctttgccttcca

SEQ ID NO: 3717495 - DNA, 18 bp, Homo sapiens
cagctttgccttccacgc

SEQ ID NO: 3717496 - DNA, 19 bp, Homo sapiens
cagcttttagtacccacct

SEQ ID NO: 3717497 - DNA, 22 bp, Homo sapiens
cagcttttagtacccacctgag

SEQ ID NO: 3717498 - DNA, 14 bp, Homo sapiens
caggaaaaaaactt

SEQ ID NO: 3717499 - DNA, 18 bp, Homo sapiens
caggaaaaaaacttttat

SEQ ID NO: 3717500 - DNA, 14 bp, Homo sapiens
caggaaaaaggaca

SEQ ID NO: 3717501 - DNA, 19 bp, Homo sapiens
caggaaaactgacagagga

SEQ ID NO: 3717502 - DNA, 16 bp, Homo sapiens
caggaaaagctgctga

SEQ ID NO: 3717503 - DNA, 20 bp, Homo sapiens
caggaaaagctgctgacagt

SEQ ID NO: 3717504 - DNA, 15 bp, Homo sapiens
caggaaatatatatg

SEQ ID NO: 3717505 - DNA, 17 bp, Homo sapiens
caggaaatatatatgtg

SEQ ID NO: 3717506 - DNA, 13 bp, Homo sapiens
caggaacagaagg

SEQ ID NO: 3717507 - DNA, 14 bp, Homo sapiens
caggaacagaagga

SEQ ID NO: 3717508 - DNA, 19 bp, Homo sapiens
caggaacctggaccaaagc

SEQ ID NO: 3717509 - DNA, 21 bp, Homo sapiens
caggaacctggaccaaagctg

SEQ ID NO: 3717510 - DNA, 19 bp, Homo sapiens
caggaactagactgcctgg

SEQ ID NO: 3717511 - DNA, 13 bp, Homo sapiens
caggaactgggcc

SEQ ID NO: 3717512 - DNA, 22 bp, Homo sapiens
caggaagctgtgagagcagttt

SEQ ID NO: 3717513 - DNA, 16 bp, Homo sapiens
caggaaggagagcctg

SEQ ID NO: 3717514 - DNA, 19 bp, Homo sapiens
caggaaggctgagaggaga

SEQ ID NO: 3717515 - DNA, 22 bp, Homo sapiens
caggaagggcctacagcccatt

SEQ ID NO: 3717516 - DNA, 15 bp, Homo sapiens
caggaaggggctgga

SEQ ID NO: 3717517 - DNA, 23 bp, Homo sapiens
caggaaggggctggactggctgt

SEQ ID NO: 3717518 - DNA, 16 bp, Homo sapiens
caggaagtcttcaggg

SEQ ID NO: 3717519 - DNA, 12 bp, Homo sapiens
caggaataaggc

SEQ ID NO: 3717520 - DNA, 17 bp, Homo sapiens
caggaatggaaagcgga

SEQ ID NO: 3717521 - DNA, 16 bp, Homo sapiens
caggacaacgaggaag

SEQ ID NO: 3717522 - DNA, 19 bp, Homo sapiens
caggacaacgaggaagccc

SEQ ID NO: 3717523 - DNA, 23 bp, Homo sapiens
caggacagcatggtgcatgccgc

SEQ ID NO: 3717524 - DNA, 12 bp, Homo sapiens
caggacaggccc

SEQ ID NO: 3717525 - DNA, 20 bp, Homo sapiens
caggacagtgcttcagcctg

SEQ ID NO: 3717526 - DNA, 15 bp, Homo sapiens
caggaccgccaaaga

SEQ ID NO: 3717527 - DNA, 21 bp, Homo sapiens
caggacctcagagtccaggcc

SEQ ID NO: 3717528 - DNA, 22 bp, Homo sapiens
caggacctcagagtccaggccc

SEQ ID NO: 3717529 - DNA, 12 bp, Homo sapiens
caggactccagc

SEQ ID NO: 3717530 - DNA, 13 bp, Homo sapiens
caggactccagcc

SEQ ID NO: 3717531 - DNA, 21 bp, Homo sapiens
caggactccctcctcacctct

SEQ ID NO: 3717532 - DNA, 12 bp, Homo sapiens
caggactctgcc

SEQ ID NO: 3717533 - DNA, 16 bp, Homo sapiens
caggactctgcctcct

SEQ ID NO: 3717534 - DNA, 19 bp, Homo sapiens
caggactgaattgtcccca

SEQ ID NO: 3717535 - DNA, 21 bp, Homo sapiens
caggactgaattgtccccagt

SEQ ID NO: 3717536 - DNA, 23 bp, Homo sapiens
caggacttggtctgatttcagga

SEQ ID NO: 3717537 - DNA, 17 bp, Homo sapiens
caggagaaccactacat

SEQ ID NO: 3717538 - DNA, 19 bp, Homo sapiens
cagtgtgatcccaagtgcc

SEQ ID NO: 3717539 - DNA, 21 bp, Homo sapiens
cagtgtgggaatgcggcaaga

SEQ ID NO: 3717540 - DNA, 23 bp, Homo sapiens
cagtgtgggaatgcggcaagaag

SEQ ID NO: 3717541 - DNA, 17 bp, Homo sapiens
cagtgtgtttgtgattg

SEQ ID NO: 3717542 - DNA, 14 bp, Homo sapiens
cagtgttaaaaaat

SEQ ID NO: 3717543 - DNA, 19 bp, Homo sapiens
cagtgttgtttgtaaataa

SEQ ID NO: 3717544 - DNA, 20 bp, Homo sapiens
cagtgttgtttgtaaataag

SEQ ID NO: 3717545 - DNA, 14 bp, Homo sapiens
cagtgtttcccata

SEQ ID NO: 3717546 - DNA, 18 bp, Homo sapiens
cagtgtttcccataattt

SEQ ID NO: 3717547 - DNA, 20 bp, Homo sapiens
cagtgtttcccataattttc

SEQ ID NO: 3717548 - DNA, 21 bp, Homo sapiens
cagtgtttcccataattttct

SEQ ID NO: 3717549 - DNA, 15 bp, Homo sapiens
cagtgttttctggga

SEQ ID NO: 3717550 - DNA, 22 bp, Homo sapiens
cagttaagaaaaaaataatttt

SEQ ID NO: 3717551 - DNA, 14 bp, Homo sapiens
cagttactcagccc

SEQ ID NO: 3717552 - DNA, 18 bp, Homo sapiens
cagttactcagccctggg

SEQ ID NO: 3717553 - DNA, 18 bp, Homo sapiens
cagttagagatgcctccc

SEQ ID NO: 3717554 - DNA, 19 bp, Homo sapiens
cagttagggttgagttact

SEQ ID NO: 3717555 - DNA, 21 bp, Homo sapiens
cagttataagtagcaggccaa

SEQ ID NO: 3717556 - DNA, 13 bp, Homo sapiens
cagttcagcacca

SEQ ID NO: 3717557 - DNA, 20 bp, Homo sapiens
cagttcaggagtcccaagga

SEQ ID NO: 3717558 - DNA, 16 bp, Homo sapiens
cagttcccttggcctc

SEQ ID NO: 3717559 - DNA, 18 bp, Homo sapiens
cagttcccttggcctcag

SEQ ID NO: 3717560 - DNA, 14 bp, Homo sapiens
cagttcctcgccct

SEQ ID NO: 3717561 - DNA, 17 bp, Homo sapiens
cagttcctcgccctggg

SEQ ID NO: 3717562 - DNA, 14 bp, Homo sapiens
cagttcctgcagca

SEQ ID NO: 3717563 - DNA, 16 bp, Homo sapiens
cagttcctgcagcaga

SEQ ID NO: 3717564 - DNA, 19 bp, Homo sapiens
cagttcctgcagcagagcc

SEQ ID NO: 3717565 - DNA, 11 bp, Homo sapiens
cagttctgcaa

SEQ ID NO: 3717566 - DNA, 13 bp, Homo sapiens
cagttctgcaaat

SEQ ID NO: 3717567 - DNA, 20 bp, Homo sapiens
cagttctgggtgctccctac

SEQ ID NO: 3717568 - DNA, 18 bp, Homo sapiens
cagttgaaaaacagctga

SEQ ID NO: 3717569 - DNA, 13 bp, Homo sapiens
cagttgcacttgg

SEQ ID NO: 3717570 - DNA, 22 bp, Homo sapiens
cagttgcatttttatggagttc

SEQ ID NO: 3717571 - DNA, 16 bp, Homo sapiens
cagttgggtggatgcc

SEQ ID NO: 3717572 - DNA, 15 bp, Homo sapiens
cagtttcaggtgttt

SEQ ID NO: 3717573 - DNA, 15 bp, Homo sapiens
cagtttgagacagga

SEQ ID NO: 3717574 - DNA, 15 bp, Homo sapiens
cagtttgataactag

SEQ ID NO: 3717575 - DNA, 20 bp, Homo sapiens
cagtttgataactagggaag

SEQ ID NO: 3717576 - DNA, 23 bp, Homo sapiens
cagtttgcagaaaagcacctgcc

SEQ ID NO: 3717577 - DNA, 21 bp, Homo sapiens
cagtttgctttgtatgcactt

SEQ ID NO: 3717578 - DNA, 13 bp, Homo sapiens
cagtttgtcagac

SEQ ID NO: 3717579 - DNA, 14 bp, Homo sapiens
cagttttccatgaa

SEQ ID NO: 3717580 - DNA, 14 bp, Homo sapiens
cataaaaagttaaa

SEQ ID NO: 3717581 - DNA, 22 bp, Homo sapiens
cataaaaagttaaaaaaaataa

SEQ ID NO: 3717582 - DNA, 21 bp, Homo sapiens
cataaaggataaacttttaga

SEQ ID NO: 3717583 - DNA, 23 bp, Homo sapiens
cataaaggataaacttttagaaa

SEQ ID NO: 3717584 - DNA, 20 bp, Homo sapiens
cataaaggtggtatgtgtgt

SEQ ID NO: 3717585 - DNA, 22 bp, Homo sapiens
cataaaggtggtatgtgtgtgt

SEQ ID NO: 3717586 - DNA, 15 bp, Homo sapiens
cataaagtcagtgcc

SEQ ID NO: 3717587 - DNA, 16 bp, Homo sapiens
cataaattgtactgtt

SEQ ID NO: 3717588 - DNA, 17 bp, Homo sapiens
cataacagaatgcacca

SEQ ID NO: 3717589 - DNA, 22 bp, Homo sapiens
cataacagggtaaattattcag

SEQ ID NO: 3717590 - DNA, 14 bp, Homo sapiens
cataacagtgccat

SEQ ID NO: 3717591 - DNA, 15 bp, Homo sapiens
cataaccactgcttc

SEQ ID NO: 3717592 - DNA, 13 bp, Homo sapiens
cataactgacaaa

SEQ ID NO: 3717593 - DNA, 20 bp, Homo sapiens
cataactgacaaatcaagtt

SEQ ID NO: 3717594 - DNA, 21 bp, Homo sapiens
cataactgacaaatcaagttt

SEQ ID NO: 3717595 - DNA, 19 bp, Homo sapiens
cataagaaaactaagaaat

SEQ ID NO: 3717596 - DNA, 23 bp, Homo sapiens
cataatctggactcctctgtcca

SEQ ID NO: 3717597 - DNA, 14 bp, Homo sapiens
cataattatgacag

SEQ ID NO: 3717598 - DNA, 17 bp, Homo sapiens
cataattatgacagtta

SEQ ID NO: 3717599 - DNA, 16 bp, Homo sapiens
cataattcttgtatat

SEQ ID NO: 3717600 - DNA, 20 bp, Homo sapiens
catactgagggaccaactgg

SEQ ID NO: 3717601 - DNA, 15 bp, Homo sapiens
catactttttcaaga

SEQ ID NO: 3717602 - DNA, 21 bp, Homo sapiens
catagactttatgcaataaat

SEQ ID NO: 3717603 - DNA, 21 bp, Homo sapiens
catagaggtgagggaagcctg

SEQ ID NO: 3717604 - DNA, 17 bp, Homo sapiens
catagattcacctgtaa

SEQ ID NO: 3717605 - DNA, 18 bp, Homo sapiens
catagattcacctgtaaa

SEQ ID NO: 3717606 - DNA, 23 bp, Homo sapiens
catagattcacctgtaaaacttt

SEQ ID NO: 3717607 - DNA, 17 bp, Homo sapiens
catagatttctgatttt

SEQ ID NO: 3717608 - DNA, 18 bp, Homo sapiens
catagcagattttaattt

SEQ ID NO: 3717609 - DNA, 15 bp, Homo sapiens
catagccaggaaact

SEQ ID NO: 3717610 - DNA, 18 bp, Homo sapiens
catagcctaatccctggg

SEQ ID NO: 3717611 - DNA, 13 bp, Homo sapiens
catagcttccatg

SEQ ID NO: 3717612 - DNA, 14 bp, Homo sapiens
cataggcctgggtg

SEQ ID NO: 3717613 - DNA, 15 bp, Homo sapiens
cataggcctgggtgc

SEQ ID NO: 3717614 - DNA, 15 bp, Homo sapiens
catagggtctcttca

SEQ ID NO: 3717615 - DNA, 16 bp, Homo sapiens
catagtaccaatcatt

SEQ ID NO: 3717616 - DNA, 17 bp, Homo sapiens
catagtatattaaaaat

SEQ ID NO: 3717617 - DNA, 15 bp, Homo sapiens
catagtatggtggct

SEQ ID NO: 3717618 - DNA, 17 bp, Homo sapiens
catagtatggtggctgg

SEQ ID NO: 3717619 - DNA, 18 bp, Homo sapiens
catagtatggtggctggg

SEQ ID NO: 3717620 - DNA, 13 bp, Homo sapiens
catagtcccagct

SEQ ID NO: 3717621 - DNA, 18 bp, Homo sapiens
catagtgaccggctgctt

SEQ ID NO: 3717622 - DNA, 21 bp, Homo sapiens
catagtgagacccctgtctcc

SEQ ID NO: 3717623 - DNA, 18 bp, Homo sapiens
catagtgatggttcccct

SEQ ID NO: 3717624 - DNA, 22 bp, Homo sapiens
catagtgatggttcccctgttc

SEQ ID NO: 3717625 - DNA, 19 bp, Homo sapiens
catagttcccatgttaaat

SEQ ID NO: 3717626 - DNA, 20 bp, Homo sapiens
catataaacatcacacacac

SEQ ID NO: 3717627 - DNA, 17 bp, Homo sapiens
catataatatatgtttt

SEQ ID NO: 3717628 - DNA, 22 bp, Homo sapiens
catatatacacacacaaagaga

SEQ ID NO: 3717629 - DNA, 23 bp, Homo sapiens
catatatatgttttaagaggcag

SEQ ID NO: 3717630 - DNA, 17 bp, Homo sapiens
catatatgaggacttgt

SEQ ID NO: 3717631 - DNA, 21 bp, Homo sapiens
catatatggggggccaacacc

SEQ ID NO: 3717632 - DNA, 22 bp, Homo sapiens
catatatggggggccaacacca

SEQ ID NO: 3717633 - DNA, 17 bp, Homo sapiens
catatattttttagaaa

SEQ ID NO: 3717634 - DNA, 11 bp, Homo sapiens
catatctaacc

SEQ ID NO: 3717635 - DNA, 17 bp, Homo sapiens
catatctatcagagtat

SEQ ID NO: 3717636 - DNA, 18 bp, Homo sapiens
catatgaaaatacaactt

SEQ ID NO: 3717637 - DNA, 17 bp, Homo sapiens
catatgaaatttaatat

SEQ ID NO: 3717638 - DNA, 22 bp, Homo sapiens
catatgcttcaaactaacacat

SEQ ID NO: 3717639 - DNA, 21 bp, Homo sapiens
catatgtaccatgtacatgaa

SEQ ID NO: 3717640 - DNA, 14 bp, Homo sapiens
catattaggaaaat

SEQ ID NO: 3717641 - DNA, 22 bp, Homo sapiens
catattcctgcagcctggaggc

SEQ ID NO: 3717642 - DNA, 11 bp, Homo sapiens
catatttaagg

SEQ ID NO: 3717643 - DNA, 19 bp, Homo sapiens
catatttgttaaatattta

SEQ ID NO: 3717644 - DNA, 17 bp, Homo sapiens
catcaaactcttagtta

SEQ ID NO: 3717645 - DNA, 16 bp, Homo sapiens
catcaaagtggcaaaa

SEQ ID NO: 3717646 - DNA, 14 bp, Homo sapiens
catcaacatcttgg

SEQ ID NO: 3717647 - DNA, 18 bp, Homo sapiens
catcaagcacagaaggag

SEQ ID NO: 3717648 - DNA, 23 bp, Homo sapiens
catcaagcacagaaggaggagga

SEQ ID NO: 3717649 - DNA, 22 bp, Homo sapiens
catcacaggacacggggcagtg

SEQ ID NO: 3717650 - DNA, 15 bp, Homo sapiens
catttcatctatttc

SEQ ID NO: 3717651 - DNA, 20 bp, Homo sapiens
catttcatctatttctgaga

SEQ ID NO: 3717652 - DNA, 18 bp, Homo sapiens
catttcattcctaacaca

SEQ ID NO: 3717653 - DNA, 21 bp, Homo sapiens
catttcattcctaacacagca

SEQ ID NO: 3717654 - DNA, 16 bp, Homo sapiens
catttccccagacctg

SEQ ID NO: 3717655 - DNA, 20 bp, Homo sapiens
catttccccagacctgagct

SEQ ID NO: 3717656 - DNA, 21 bp, Homo sapiens
catttcgcccctcatttatcc

SEQ ID NO: 3717657 - DNA, 20 bp, Homo sapiens
catttctagcgcatggcctg

SEQ ID NO: 3717658 - DNA, 17 bp, Homo sapiens
catttctctctccagtc

SEQ ID NO: 3717659 - DNA, 12 bp, Homo sapiens
catttcttgggc

SEQ ID NO: 3717660 - DNA, 14 bp, Homo sapiens
catttcttgggccc

SEQ ID NO: 3717661 - DNA, 16 bp, Homo sapiens
catttcttgggccctc

SEQ ID NO: 3717662 - DNA, 14 bp, Homo sapiens
catttgagcagggc

SEQ ID NO: 3717663 - DNA, 14 bp, Homo sapiens
catttgatgctaaa

SEQ ID NO: 3717664 - DNA, 15 bp, Homo sapiens
catttgattctgtgt

SEQ ID NO: 3717665 - DNA, 21 bp, Homo sapiens
catttgcgaatggttccattc

SEQ ID NO: 3717666 - DNA, 16 bp, Homo sapiens
catttgctttttcacc

SEQ ID NO: 3717667 - DNA, 20 bp, Homo sapiens
catttggtcaagattttgaa

SEQ ID NO: 3717668 - DNA, 12 bp, Homo sapiens
catttgtaataa

SEQ ID NO: 3717669 - DNA, 14 bp, Homo sapiens
catttgtaataaag

SEQ ID NO: 3717670 - DNA, 16 bp, Homo sapiens
catttgtaataaagta

SEQ ID NO: 3717671 - DNA, 17 bp, Homo sapiens
catttgtaataaagtat

SEQ ID NO: 3717672 - DNA, 14 bp, Homo sapiens
catttgtgaaatga

SEQ ID NO: 3717673 - DNA, 11 bp, Homo sapiens
catttgtgagg

SEQ ID NO: 3717674 - DNA, 15 bp, Homo sapiens
catttgttattctta

SEQ ID NO: 3717675 - DNA, 18 bp, Homo sapiens
cattttaaagttaaacat

SEQ ID NO: 3717676 - DNA, 16 bp, Homo sapiens
cattttactgtacaga

SEQ ID NO: 3717677 - DNA, 14 bp, Homo sapiens
cattttccccccac

SEQ ID NO: 3717678 - DNA, 15 bp, Homo sapiens
cattttccccccact

SEQ ID NO: 3717679 - DNA, 22 bp, Homo sapiens
cattttccccccactctcccca

SEQ ID NO: 3717680 - DNA, 13 bp, Homo sapiens
cattttgaagcta

SEQ ID NO: 3717681 - DNA, 15 bp, Homo sapiens
cattttgaagctaat

SEQ ID NO: 3717682 - DNA, 22 bp, Homo sapiens
cattttgaagctaattatttta

SEQ ID NO: 3717683 - DNA, 15 bp, Homo sapiens
cattttgcaaaattt

SEQ ID NO: 3717684 - DNA, 22 bp, Homo sapiens
cattttgcagcagtgagtctct

SEQ ID NO: 3717685 - DNA, 21 bp, Homo sapiens
cattttgctaaatgtgaatga

SEQ ID NO: 3717686 - DNA, 24 bp, Homo sapiens
cattttgctaaatgtgaatgatga

SEQ ID NO: 3717687 - DNA, 22 bp, Homo sapiens
cattttggggtacccactgctc

SEQ ID NO: 3717688 - DNA, 17 bp, Homo sapiens
catttttagtagagaca

SEQ ID NO: 3717689 - DNA, 15 bp, Homo sapiens
cattttttaaaacaa

SEQ ID NO: 3717690 - DNA, 22 bp, Homo sapiens
ccaaaaaattctacaacacaca

SEQ ID NO: 3717691 - DNA, 12 bp, Homo sapiens
ccaaaacaaaca

SEQ ID NO: 3717692 - DNA, 22 bp, Homo sapiens
ccaaaagtcaaaaggtgcctgt

SEQ ID NO: 3717693 - DNA, 14 bp, Homo sapiens
ccaaaataatgtct

SEQ ID NO: 3717694 - DNA, 16 bp, Homo sapiens
ccaaacagccacactg

SEQ ID NO: 3717695 - DNA, 13 bp, Homo sapiens
ccaaacatcagac

SEQ ID NO: 3717696 - DNA, 15 bp, Homo sapiens
ccaaaccccggggct

SEQ ID NO: 3717697 - DNA, 14 bp, Homo sapiens
ccaaagagctgcct

SEQ ID NO: 3717698 - DNA, 13 bp, Homo sapiens
ccaaagccaccag

SEQ ID NO: 3717699 - DNA, 21 bp, Homo sapiens
ccaaagggtgaagctatttat

SEQ ID NO: 3717700 - DNA, 13 bp, Homo sapiens
ccaaatctgccta

SEQ ID NO: 3717701 - DNA, 17 bp, Homo sapiens
ccaacaagggcagtgga

SEQ ID NO: 3717702 - DNA, 21 bp, Homo sapiens
ccaacatcccattgccctggt

SEQ ID NO: 3717703 - DNA, 22 bp, Homo sapiens
ccaacatggagaaaccctgtct

SEQ ID NO: 3717704 - DNA, 18 bp, Homo sapiens
ccaacccaaacctggaga

SEQ ID NO: 3717705 - DNA, 16 bp, Homo sapiens
ccaacccccaccccac

SEQ ID NO: 3717706 - DNA, 19 bp, Homo sapiens
ccaacccccaccccacact

SEQ ID NO: 3717707 - DNA, 20 bp, Homo sapiens
ccaacccccaccccacactt

SEQ ID NO: 3717708 - DNA, 12 bp, Homo sapiens
ccaacccctgtg

SEQ ID NO: 3717709 - DNA, 14 bp, Homo sapiens
ccaaccctcagagc

SEQ ID NO: 3717710 - DNA, 11 bp, Homo sapiens
ccaacctcagc

SEQ ID NO: 3717711 - DNA, 16 bp, Homo sapiens
ccaacctgaccaacat

SEQ ID NO: 3717712 - DNA, 22 bp, Homo sapiens
ccaacctgaccaacatggagaa

SEQ ID NO: 3717713 - DNA, 14 bp, Homo sapiens
ccaacgaaaagcac

SEQ ID NO: 3717714 - DNA, 19 bp, Homo sapiens
ccaacgaaaagcacatcca

SEQ ID NO: 3717715 - DNA, 20 bp, Homo sapiens
ccaacgtggggcagcacaga

SEQ ID NO: 3717716 - DNA, 14 bp, Homo sapiens
ccaactcacctgag

SEQ ID NO: 3717717 - DNA, 22 bp, Homo sapiens
ccaactgagaaaacgaaactgc

SEQ ID NO: 3717718 - DNA, 16 bp, Homo sapiens
ccaactggccctcttc

SEQ ID NO: 3717719 - DNA, 18 bp, Homo sapiens
ccaagaactgaaaacata

SEQ ID NO: 3717720 - DNA, 21 bp, Homo sapiens
ccaagaactgaaaacataaaa

SEQ ID NO: 3717721 - DNA, 14 bp, Homo sapiens
ccaagaactgcatg

SEQ ID NO: 3717722 - DNA, 14 bp, Homo sapiens
ccaagaaggctggg

SEQ ID NO: 3717723 - DNA, 24 bp, Homo sapiens
ccaagacagatgccccagagctgt

SEQ ID NO: 3717724 - DNA, 15 bp, Homo sapiens
ccaagacctgactca

SEQ ID NO: 3717725 - DNA, 16 bp, Homo sapiens
ccaagactccagccct

SEQ ID NO: 3717726 - DNA, 12 bp, Homo sapiens
ccaagagagaaa

SEQ ID NO: 3717727 - DNA, 13 bp, Homo sapiens
ccaagagagaaag

SEQ ID NO: 3717728 - DNA, 15 bp, Homo sapiens
ccaagagagaaagaa

SEQ ID NO: 3717729 - DNA, 14 bp, Homo sapiens
ccaagagatgaaga

SEQ ID NO: 3717730 - DNA, 17 bp, Homo sapiens
ccaagatgcttttcaaa

SEQ ID NO: 3717731 - DNA, 20 bp, Homo sapiens
ccaagcaaaggtgaagagac

SEQ ID NO: 3717732 - DNA, 12 bp, Homo sapiens
ccaagcagccaa

SEQ ID NO: 3717733 - DNA, 13 bp, Homo sapiens
ccaagcaggaagc

SEQ ID NO: 3717734 - DNA, 14 bp, Homo sapiens
ccaagcaggaagct

SEQ ID NO: 3717735 - DNA, 17 bp, Homo sapiens
ccaagcaggaagctcag

SEQ ID NO: 3717736 - DNA, 21 bp, Homo sapiens
ccaagcatagagaagagtctg

SEQ ID NO: 3717737 - DNA, 14 bp, Homo sapiens
ccaagccccatcct

SEQ ID NO: 3717738 - DNA, 17 bp, Homo sapiens
ccaagccgtggcttccc

SEQ ID NO: 3717739 - DNA, 18 bp, Homo sapiens
ccaagctcacagttcctc

SEQ ID NO: 3717740 - DNA, 22 bp, Homo sapiens
ccaagctcacagttcctcgccc

SEQ ID NO: 3717741 - DNA, 14 bp, Homo sapiens
ccaagctccttggg

SEQ ID NO: 3717742 - DNA, 22 bp, Homo sapiens
ccaagctggagtgcagtggtgc

SEQ ID NO: 3717743 - DNA, 12 bp, Homo sapiens
ccaagctggtcc

SEQ ID NO: 3717744 - DNA, 20 bp, Homo sapiens
ccaagctggtcccactcagt

SEQ ID NO: 3717745 - DNA, 23 bp, Homo sapiens
ccaagcttgtccaacccgaggcc

SEQ ID NO: 3717746 - DNA, 22 bp, Homo sapiens
ccaaggacccctcaccttgcaa

SEQ ID NO: 3717747 - DNA, 15 bp, Homo sapiens
ccaaggagaaacaga

SEQ ID NO: 3717748 - DNA, 21 bp, Homo sapiens
ccaaggagaaacagagacagg

SEQ ID NO: 3717749 - DNA, 12 bp, Homo sapiens
ccaaggagacca

SEQ ID NO: 3717750 - DNA, 23 bp, Homo sapiens
ccaaggagatgaagcaaacacat

SEQ ID NO: 3717751 - DNA, 15 bp, Homo sapiens
ccaaggagctgagaa

SEQ ID NO: 3717752 - DNA, 15 bp, Homo sapiens
ccaaggccagagtgg

SEQ ID NO: 3717753 - DNA, 18 bp, Homo sapiens
ccaaggccagagtggcct

SEQ ID NO: 3717754 - DNA, 20 bp, Homo sapiens
ccaagggttcagagactcag

SEQ ID NO: 3717755 - DNA, 13 bp, Homo sapiens
ccaaggtgggagg

SEQ ID NO: 3717756 - DNA, 17 bp, Homo sapiens
ccaaggtgggctgagcc

SEQ ID NO: 3717757 - DNA, 18 bp, Homo sapiens
ccaaggtgggctgagccc

SEQ ID NO: 3717758 - DNA, 20 bp, Homo sapiens
ccaaggtgggctgagccctg

SEQ ID NO: 3717759 - DNA, 17 bp, Homo sapiens
ccaagtaaatagcaaca

SEQ ID NO: 3717760 - DNA, 20 bp, Homo sapiens
ccaagtcaagtgaaaaagga

SEQ ID NO: 3717761 - DNA, 22 bp, Homo sapiens
ccaagtccaggtcgggctcagc

SEQ ID NO: 3717762 - DNA, 12 bp, Homo sapiens
ccaagtcccacc

SEQ ID NO: 3717763 - DNA, 12 bp, Homo sapiens
ccaagtgtgtgt

SEQ ID NO: 3717764 - DNA, 20 bp, Homo sapiens
ccagggctcagcctggtggg

SEQ ID NO: 3717765 - DNA, 20 bp, Homo sapiens
ccaggggaaaatcagcctgc

SEQ ID NO: 3717766 - DNA, 18 bp, Homo sapiens
ccaggggaccacacctcc

SEQ ID NO: 3717767 - DNA, 18 bp, Homo sapiens
ccaggggatgagtggagg

SEQ ID NO: 3717768 - DNA, 16 bp, Homo sapiens
ccaggggatgggaggt

SEQ ID NO: 3717769 - DNA, 14 bp, Homo sapiens
ccaggggtcccagc

SEQ ID NO: 3717770 - DNA, 14 bp, Homo sapiens
ccagggtcttccct

SEQ ID NO: 3717771 - DNA, 23 bp, Homo sapiens
ccagggtcttccctacctcaggc

SEQ ID NO: 3717772 - DNA, 14 bp, Homo sapiens
ccaggtagaacaca

SEQ ID NO: 3717773 - DNA, 16 bp, Homo sapiens
ccaggtggccactcca

SEQ ID NO: 3717774 - DNA, 16 bp, Homo sapiens
ccaggtggctgaccca

SEQ ID NO: 3717775 - DNA, 17 bp, Homo sapiens
ccaggtggctgacccag

SEQ ID NO: 3717776 - DNA, 14 bp, Homo sapiens
ccaggttcagcttg

SEQ ID NO: 3717777 - DNA, 22 bp, Homo sapiens
ccaggttctggttagctcagcc

SEQ ID NO: 3717778 - DNA, 16 bp, Homo sapiens
ccaggttgaaagacct

SEQ ID NO: 3717779 - DNA, 24 bp, Homo sapiens
ccagtaaagtgtaacatatgcaaa

SEQ ID NO: 3717780 - DNA, 18 bp, Homo sapiens
ccagtacctccaagcaag

SEQ ID NO: 3717781 - DNA, 16 bp, Homo sapiens
ccagtacctttgtcac

SEQ ID NO: 3717782 - DNA, 17 bp, Homo sapiens
ccagtacctttgtcaca

SEQ ID NO: 3717783 - DNA, 16 bp, Homo sapiens
ccagtacgtgctaaca

SEQ ID NO: 3717784 - DNA, 14 bp, Homo sapiens
ccagtactggagct

SEQ ID NO: 3717785 - DNA, 19 bp, Homo sapiens
ccagtcaggtagttgcaat

SEQ ID NO: 3717786 - DNA, 22 bp, Homo sapiens
ccagtccctgggggaagccctg

SEQ ID NO: 3717787 - DNA, 16 bp, Homo sapiens
ccagtcctgcctggcc

SEQ ID NO: 3717788 - DNA, 14 bp, Homo sapiens
ccagtcctgctctc

SEQ ID NO: 3717789 - DNA, 19 bp, Homo sapiens
ccagtctcccaggccccct

SEQ ID NO: 3717790 - DNA, 22 bp, Homo sapiens
ccagtctcccaggccccctgca

SEQ ID NO: 3717791 - DNA, 17 bp, Homo sapiens
ccagtctgaagtttcat

SEQ ID NO: 3717792 - DNA, 21 bp, Homo sapiens
ccagtctgaagtttcatttat

SEQ ID NO: 3717793 - DNA, 14 bp, Homo sapiens
ccagtgaaaactag

SEQ ID NO: 3717794 - DNA, 15 bp, Homo sapiens
ccagtgaaaactaga

SEQ ID NO: 3717795 - DNA, 16 bp, Homo sapiens
ccagtgacacttcaga

SEQ ID NO: 3717796 - DNA, 19 bp, Homo sapiens
ccagtgacacttcagagag

SEQ ID NO: 3717797 - DNA, 23 bp, Homo sapiens
ccagtgacacttcagagagctgg

SEQ ID NO: 3717798 - DNA, 17 bp, Homo sapiens
ccagtgacccctgacct

SEQ ID NO: 3717799 - DNA, 18 bp, Homo sapiens
ccagtgacctgaggaagc

SEQ ID NO: 3717800 - DNA, 21 bp, Homo sapiens
ccagtgatgctaaaggttgta

SEQ ID NO: 3717801 - DNA, 14 bp, Homo sapiens
ccagtgcaacactg

SEQ ID NO: 3717802 - DNA, 23 bp, Homo sapiens
ccagtgcccacaggatcagtctg

SEQ ID NO: 3717803 - DNA, 21 bp, Homo sapiens
ccagtgccttacctcctgccc

SEQ ID NO: 3717804 - DNA, 22 bp, Homo sapiens
ccagtggaacagcgggagacct

SEQ ID NO: 3717805 - DNA, 17 bp, Homo sapiens
ccagtggcctcaaccct

SEQ ID NO: 3717806 - DNA, 14 bp, Homo sapiens
ccagtgtgacaagg

SEQ ID NO: 3717807 - DNA, 22 bp, Homo sapiens
ccagtgtgggaatgcggcaaga

SEQ ID NO: 3717808 - DNA, 16 bp, Homo sapiens
ccagtgtgtggctttc

SEQ ID NO: 3717809 - DNA, 23 bp, Homo sapiens
ccagtgtgtggctttcagagcct

SEQ ID NO: 3717810 - DNA, 17 bp, Homo sapiens
ccagtgttgtttgtaaa

SEQ ID NO: 3717811 - DNA, 21 bp, Homo sapiens
ccagtgttgtttgtaaataag

SEQ ID NO: 3717812 - DNA, 22 bp, Homo sapiens
ccagttagcctctgcaggatgt

SEQ ID NO: 3717813 - DNA, 20 bp, Homo sapiens
ccagttattttccgccctca

SEQ ID NO: 3717814 - DNA, 14 bp, Homo sapiens
ccagttcaggagtc

SEQ ID NO: 3717815 - DNA, 21 bp, Homo sapiens
ccagttcctttcaatggtttg

SEQ ID NO: 3717816 - DNA, 23 bp, Homo sapiens
ccagttgggtggatgcctggtgg

SEQ ID NO: 3717817 - DNA, 13 bp, Homo sapiens
ccagtttgcagaa

SEQ ID NO: 3717818 - DNA, 17 bp, Homo sapiens
ccataagcctccattta

SEQ ID NO: 3717819 - DNA, 17 bp, Homo sapiens
ccataattttcttcatg

SEQ ID NO: 3717820 - DNA, 18 bp, Homo sapiens
ccatactctgtctcccta

SEQ ID NO: 3717821 - DNA, 21 bp, Homo sapiens
ccatagcaagattgcttaaaa

SEQ ID NO: 3717822 - DNA, 22 bp, Homo sapiens
ccatagtatattaaaaatggta

SEQ ID NO: 3717823 - DNA, 12 bp, Homo sapiens
ccatatgctgtt

SEQ ID NO: 3717824 - DNA, 19 bp, Homo sapiens
ccatattctgttggccagt

SEQ ID NO: 3717825 - DNA, 23 bp, Homo sapiens
ccatattctgttggccagtgtga

SEQ ID NO: 3717826 - DNA, 16 bp, Homo sapiens
ccatcaaagtggcaaa

SEQ ID NO: 3717827 - DNA, 13 bp, Homo sapiens
ccatcaacctctg

SEQ ID NO: 3717828 - DNA, 16 bp, Homo sapiens
ccatcacgcctgtgca

SEQ ID NO: 3717829 - DNA, 18 bp, Homo sapiens
ccatcactggagcaccag

SEQ ID NO: 3717830 - DNA, 12 bp, Homo sapiens
ccatcagaggcc

SEQ ID NO: 3717831 - DNA, 24 bp, Homo sapiens
ccatcagctgtaagaagagactgg

SEQ ID NO: 3717832 - DNA, 13 bp, Homo sapiens
ccatcatgtctgg

SEQ ID NO: 3717833 - DNA, 22 bp, Homo sapiens
ccatccactctaccctcccacc

SEQ ID NO: 3717834 - DNA, 21 bp, Homo sapiens
ccatccagggatgccatctgt

SEQ ID NO: 3717835 - DNA, 12 bp, Homo sapiens
ccatcccacacc

SEQ ID NO: 3717836 - DNA, 15 bp, Homo sapiens
ccatcccatcccatc

SEQ ID NO: 3717837 - DNA, 13 bp, Homo sapiens
ccatcccatcccg

SEQ ID NO: 3717838 - DNA, 17 bp, Homo sapiens
ccatcccctatggacca

SEQ ID NO: 3717839 - DNA, 21 bp, Homo sapiens
ccatcctaatcatccaatgct

SEQ ID NO: 3717840 - DNA, 14 bp, Homo sapiens
ccatcctccccttc

SEQ ID NO: 3717841 - DNA, 17 bp, Homo sapiens
ccatcctccccttccct

SEQ ID NO: 3717842 - DNA, 18 bp, Homo sapiens
ccatcctccccttccctg

SEQ ID NO: 3717843 - DNA, 21 bp, Homo sapiens
ccatcctccccttccctgcaa

SEQ ID NO: 3717844 - DNA, 16 bp, Homo sapiens
ccatcgctgtcatctc

SEQ ID NO: 3717845 - DNA, 18 bp, Homo sapiens
ccatcggtcctgtctccc

SEQ ID NO: 3717846 - DNA, 14 bp, Homo sapiens
ccatctacccctgg

SEQ ID NO: 3717847 - DNA, 18 bp, Homo sapiens
ccatctacccctggatga

SEQ ID NO: 3717848 - DNA, 13 bp, Homo sapiens
ccatctaccctcc

SEQ ID NO: 3717849 - DNA, 24 bp, Homo sapiens
ccatctccctcgaacccacactgc

SEQ ID NO: 3717850 - DNA, 17 bp, Homo sapiens
ccatctcctttcaggga

SEQ ID NO: 3717851 - DNA, 22 bp, Homo sapiens
ccatctcgccacccctccttcc

SEQ ID NO: 3717852 - DNA, 14 bp, Homo sapiens
ccatctctccctcc

SEQ ID NO: 3717853 - DNA, 19 bp, Homo sapiens
ccatctgcacccccctggg

SEQ ID NO: 3717854 - DNA, 19 bp, Homo sapiens
ccatcttgcccgctcaggc

SEQ ID NO: 3717855 - DNA, 19 bp, Homo sapiens
ccatgaaaacgttttattg

SEQ ID NO: 3717856 - DNA, 23 bp, Homo sapiens
ccatgaaaacgttttattgtgtt

SEQ ID NO: 3717857 - DNA, 18 bp, Homo sapiens
ccatgaactggaggccag

SEQ ID NO: 3717858 - DNA, 19 bp, Homo sapiens
ccatgaagacaggacagtg

SEQ ID NO: 3717859 - DNA, 18 bp, Homo sapiens
ccatgacttgagaaacaa

SEQ ID NO: 3717860 - DNA, 13 bp, Homo sapiens
ccatgagctccag

SEQ ID NO: 3717861 - DNA, 16 bp, Homo sapiens
ccatgagctccagacc

SEQ ID NO: 3717862 - DNA, 18 bp, Homo sapiens
ccatgagctccagacccc

SEQ ID NO: 3717863 - DNA, 20 bp, Homo sapiens
ccatgaggagttgctgtttg

SEQ ID NO: 3717864 - DNA, 13 bp, Homo sapiens
ccatgcaaggtgc

SEQ ID NO: 3717865 - DNA, 20 bp, Homo sapiens
ccatgcaaggtgcccacatg

SEQ ID NO: 3717866 - DNA, 21 bp, Homo sapiens
ccatgcaccctcatacacaga

SEQ ID NO: 3717867 - DNA, 13 bp, Homo sapiens
ccatgcctgtcca

SEQ ID NO: 3717868 - DNA, 14 bp, Homo sapiens
ccatgcctgtccag

SEQ ID NO: 3717869 - DNA, 19 bp, Homo sapiens
ccatgcctgtccagcctgg

SEQ ID NO: 3717870 - DNA, 13 bp, Homo sapiens
ccatgctcctggc

SEQ ID NO: 3717871 - DNA, 17 bp, Homo sapiens
ccatggagacaagaagg

SEQ ID NO: 3717872 - DNA, 21 bp, Homo sapiens
ccatggcgtgtccctctcgga

SEQ ID NO: 3717873 - DNA, 17 bp, Homo sapiens
ccatgggcctcctgtgt

SEQ ID NO: 3717874 - DNA, 14 bp, Homo sapiens
ccatggtgcctctg

SEQ ID NO: 3717875 - DNA, 16 bp, Homo sapiens
ccatggtgcctctgga

SEQ ID NO: 3717876 - DNA, 16 bp, Homo sapiens
cccctcccaccacagc

SEQ ID NO: 3717877 - DNA, 12 bp, Homo sapiens
cccctcccaggg

SEQ ID NO: 3717878 - DNA, 21 bp, Homo sapiens
cccctcccccaacccccaccc

SEQ ID NO: 3717879 - DNA, 19 bp, Homo sapiens
cccctcccctaatgcctgc

SEQ ID NO: 3717880 - DNA, 15 bp, Homo sapiens
cccctccctggctcc

SEQ ID NO: 3717881 - DNA, 15 bp, Homo sapiens
cccctcccttcaacc

SEQ ID NO: 3717882 - DNA, 11 bp, Homo sapiens
cccctcctctg

SEQ ID NO: 3717883 - DNA, 14 bp, Homo sapiens
cccctcctctgcca

SEQ ID NO: 3717884 - DNA, 12 bp, Homo sapiens
cccctccttctc

SEQ ID NO: 3717885 - DNA, 15 bp, Homo sapiens
cccctccttgcctcc

SEQ ID NO: 3717886 - DNA, 17 bp, Homo sapiens
cccctctcccagttgtc

SEQ ID NO: 3717887 - DNA, 12 bp, Homo sapiens
cccctctctcct

SEQ ID NO: 3717888 - DNA, 12 bp, Homo sapiens
cccctctgctgg

SEQ ID NO: 3717889 - DNA, 13 bp, Homo sapiens
cccctctggccag

SEQ ID NO: 3717890 - DNA, 16 bp, Homo sapiens
cccctctggccaggat

SEQ ID NO: 3717891 - DNA, 22 bp, Homo sapiens
cccctgcactggagtccagtct

SEQ ID NO: 3717892 - DNA, 24 bp, Homo sapiens
cccctgcatctatcgagtttgcaa

SEQ ID NO: 3717893 - DNA, 14 bp, Homo sapiens
cccctgccaccctg

SEQ ID NO: 3717894 - DNA, 22 bp, Homo sapiens
cccctgccccgtcaccatctca

SEQ ID NO: 3717895 - DNA, 23 bp, Homo sapiens
cccctgccccttctacactctcc

SEQ ID NO: 3717896 - DNA, 17 bp, Homo sapiens
cccctgcccggctgcgg

SEQ ID NO: 3717897 - DNA, 13 bp, Homo sapiens
cccctgccctgct

SEQ ID NO: 3717898 - DNA, 15 bp, Homo sapiens
cccctgccctgctgc

SEQ ID NO: 3717899 - DNA, 13 bp, Homo sapiens
cccctgccctggg

SEQ ID NO: 3717900 - DNA, 14 bp, Homo sapiens
cccctgctgcctcc

SEQ ID NO: 3717901 - DNA, 20 bp, Homo sapiens
cccctgctgcctccccaacc

SEQ ID NO: 3717902 - DNA, 20 bp, Homo sapiens
cccctggcttttcactgctg

SEQ ID NO: 3717903 - DNA, 23 bp, Homo sapiens
cccctggcttttcactgctggct

SEQ ID NO: 3717904 - DNA, 13 bp, Homo sapiens
cccctgggctctg

SEQ ID NO: 3717905 - DNA, 21 bp, Homo sapiens
cccctgggctctgccccagct

SEQ ID NO: 3717906 - DNA, 19 bp, Homo sapiens
cccctggtggacagtcctg

SEQ ID NO: 3717907 - DNA, 23 bp, Homo sapiens
cccctggtggacagtcctgggag

SEQ ID NO: 3717908 - DNA, 14 bp, Homo sapiens
cccctgtactccag

SEQ ID NO: 3717909 - DNA, 13 bp, Homo sapiens
ccccttcagtgcc

SEQ ID NO: 3717910 - DNA, 14 bp, Homo sapiens
ccccttcagtgccc

SEQ ID NO: 3717911 - DNA, 13 bp, Homo sapiens
ccccttccccact

SEQ ID NO: 3717912 - DNA, 14 bp, Homo sapiens
ccccttccctgcaa

SEQ ID NO: 3717913 - DNA, 19 bp, Homo sapiens
ccccttctacactctcctg

SEQ ID NO: 3717914 - DNA, 17 bp, Homo sapiens
ccccttgcccagggctc

SEQ ID NO: 3717915 - DNA, 18 bp, Homo sapiens
cccctttttactcccctt

SEQ ID NO: 3717916 - DNA, 19 bp, Homo sapiens
cccctttttactccccttg

SEQ ID NO: 3717917 - DNA, 17 bp, Homo sapiens
cccgaatagctgggact

SEQ ID NO: 3717918 - DNA, 23 bp, Homo sapiens
cccgagctgggggccatgagctc

SEQ ID NO: 3717919 - DNA, 12 bp, Homo sapiens
cccgagctggtg

SEQ ID NO: 3717920 - DNA, 14 bp, Homo sapiens
cccgagctggtgca

SEQ ID NO: 3717921 - DNA, 22 bp, Homo sapiens
cccgagctggtgcattacagag

SEQ ID NO: 3717922 - DNA, 19 bp, Homo sapiens
cccgaggctgcccactatg

SEQ ID NO: 3717923 - DNA, 21 bp, Homo sapiens
cccgagtagctgggactacag

SEQ ID NO: 3717924 - DNA, 22 bp, Homo sapiens
cccgcaatgtgcccccagacgc

SEQ ID NO: 3717925 - DNA, 16 bp, Homo sapiens
cccgcacccccaccct

SEQ ID NO: 3717926 - DNA, 17 bp, Homo sapiens
cccgcacccccaccctt

SEQ ID NO: 3717927 - DNA, 19 bp, Homo sapiens
cccgcaccccccaagctgt

SEQ ID NO: 3717928 - DNA, 16 bp, Homo sapiens
cccgcatgcagcagct

SEQ ID NO: 3717929 - DNA, 19 bp, Homo sapiens
cccgcatgcagcagcttgc

SEQ ID NO: 3717930 - DNA, 22 bp, Homo sapiens
cccgcatgcagcagcttgctgc

SEQ ID NO: 3717931 - DNA, 15 bp, Homo sapiens
cccgcattccaggct

SEQ ID NO: 3717932 - DNA, 17 bp, Homo sapiens
cccgcctggcagaactg

SEQ ID NO: 3717933 - DNA, 12 bp, Homo sapiens
cccgctcagccc

SEQ ID NO: 3717934 - DNA, 23 bp, Homo sapiens
cccgctcagccctccctgcccct

SEQ ID NO: 3717935 - DNA, 15 bp, Homo sapiens
cccgctcttttccta

SEQ ID NO: 3717936 - DNA, 22 bp, Homo sapiens
cccgctggctgggggcctcact

SEQ ID NO: 3717937 - DNA, 15 bp, Homo sapiens
cccgcttgtccagcg

SEQ ID NO: 3717938 - DNA, 18 bp, Homo sapiens
cccgcttgtccagcgcct

SEQ ID NO: 3717939 - DNA, 19 bp, Homo sapiens
cccggagattggacggcct

SEQ ID NO: 3717940 - DNA, 21 bp, Homo sapiens
cccggagctaacactggcccc

SEQ ID NO: 3717941 - DNA, 15 bp, Homo sapiens
cccggctccaggctc

SEQ ID NO: 3717942 - DNA, 22 bp, Homo sapiens
cccgggtttggcgggccaagga

SEQ ID NO: 3717943 - DNA, 18 bp, Homo sapiens
cccgtcatgttcctcaaa

SEQ ID NO: 3717944 - DNA, 15 bp, Homo sapiens
cccgtcttcagccta

SEQ ID NO: 3717945 - DNA, 17 bp, Homo sapiens
cccgtcttcagcctagc

SEQ ID NO: 3717946 - DNA, 18 bp, Homo sapiens
cccgtcttcagcctagcc

SEQ ID NO: 3717947 - DNA, 16 bp, Homo sapiens
cccgtgcaaaacatgc

SEQ ID NO: 3717948 - DNA, 19 bp, Homo sapiens
cccgttttatgatttactc

SEQ ID NO: 3717949 - DNA, 17 bp, Homo sapiens
ccctaacctcttttctg

SEQ ID NO: 3717950 - DNA, 20 bp, Homo sapiens
ccctacagttgaaaaacagc

SEQ ID NO: 3717951 - DNA, 17 bp, Homo sapiens
ccctaccacctccccag

SEQ ID NO: 3717952 - DNA, 18 bp, Homo sapiens
ccctacttcttttgctct

SEQ ID NO: 3717953 - DNA, 19 bp, Homo sapiens
ccctacttcttttgctctt

SEQ ID NO: 3717954 - DNA, 19 bp, Homo sapiens
ccctagagggttcctgtag

SEQ ID NO: 3717955 - DNA, 17 bp, Homo sapiens
ccctagggctgggtgta

SEQ ID NO: 3717956 - DNA, 22 bp, Homo sapiens
ccctaggtcagcttgctgccct

SEQ ID NO: 3717957 - DNA, 23 bp, Homo sapiens
ccctatatgtagtataaagaaaa

SEQ ID NO: 3717958 - DNA, 14 bp, Homo sapiens
ccctatccacccag

SEQ ID NO: 3717959 - DNA, 17 bp, Homo sapiens
ccctattggtaaagaat

SEQ ID NO: 3717960 - DNA, 13 bp, Homo sapiens
ccctcacccctgc

SEQ ID NO: 3717961 - DNA, 17 bp, Homo sapiens
ccctcacctgggcacct

SEQ ID NO: 3717962 - DNA, 18 bp, Homo sapiens
ccctcaccttgcaacaca

SEQ ID NO: 3717963 - DNA, 13 bp, Homo sapiens
ccctcagagccac

SEQ ID NO: 3717964 - DNA, 12 bp, Homo sapiens
ccctcagcccct

SEQ ID NO: 3717965 - DNA, 21 bp, Homo sapiens
ccctcagcccctcttgccccc

SEQ ID NO: 3717966 - DNA, 23 bp, Homo sapiens
ccctcagcccctcttgcccccca

SEQ ID NO: 3717967 - DNA, 21 bp, Homo sapiens
ccctcaggaccctcgctggcc

SEQ ID NO: 3717968 - DNA, 18 bp, Homo sapiens
ccctcaggcataggcctg

SEQ ID NO: 3717969 - DNA, 23 bp, Homo sapiens
ccctcaggcataggcctgggtgc

SEQ ID NO: 3717970 - DNA, 14 bp, Homo sapiens
ccctcatgccaacc

SEQ ID NO: 3717971 - DNA, 12 bp, Homo sapiens
ccctccactcct

SEQ ID NO: 3717972 - DNA, 17 bp, Homo sapiens
ccctccactccttcctg

SEQ ID NO: 3717973 - DNA, 17 bp, Homo sapiens
ccctccatgtgggctag

SEQ ID NO: 3717974 - DNA, 13 bp, Homo sapiens
ccctcccagctct

SEQ ID NO: 3717975 - DNA, 15 bp, Homo sapiens
ccctcccagctctga

SEQ ID NO: 3717976 - DNA, 13 bp, Homo sapiens
ccctccccagggg

SEQ ID NO: 3717977 - DNA, 16 bp, Homo sapiens
ccctcccccaaccccc

SEQ ID NO: 3717978 - DNA, 16 bp, Homo sapiens
ccctccccgcaccccc

SEQ ID NO: 3717979 - DNA, 13 bp, Homo sapiens
ccctccctacctc

SEQ ID NO: 3717980 - DNA, 14 bp, Homo sapiens
ccctccctacctca

SEQ ID NO: 3717981 - DNA, 13 bp, Homo sapiens
ccctccctcagcc

SEQ ID NO: 3717982 - DNA, 16 bp, Homo sapiens
ccctccctcagcccct

SEQ ID NO: 3717983 - DNA, 13 bp, Homo sapiens
ccctccctctttc

SEQ ID NO: 3717984 - DNA, 14 bp, Homo sapiens
ccctccctgcccct

SEQ ID NO: 3717985 - DNA, 17 bp, Homo sapiens
ccctccctggcctgttc

SEQ ID NO: 3717986 - DNA, 16 bp, Homo sapiens
ccctccctggctccca

SEQ ID NO: 3717987 - DNA, 13 bp, Homo sapiens
ccctccctgtcct

SEQ ID NO: 3717988 - DNA, 16 bp, Homo sapiens
ccctccgccaggcgag

SEQ ID NO: 3717989 - DNA, 18 bp, Homo sapiens
ccctccgccaggcgagat

SEQ ID NO: 3717990 - DNA, 15 bp, Homo sapiens
cctctccccagcaag

SEQ ID NO: 3717991 - DNA, 20 bp, Homo sapiens
cctctccccagcaagtgaga

SEQ ID NO: 3717992 - DNA, 13 bp, Homo sapiens
cctctccctgttg

SEQ ID NO: 3717993 - DNA, 19 bp, Homo sapiens
cctctcggtggccagcagg

SEQ ID NO: 3717994 - DNA, 16 bp, Homo sapiens
cctctctaacctcctt

SEQ ID NO: 3717995 - DNA, 17 bp, Homo sapiens
cctctctaacctccttt

SEQ ID NO: 3717996 - DNA, 19 bp, Homo sapiens
cctctctcttctgctccac

SEQ ID NO: 3717997 - DNA, 21 bp, Homo sapiens
cctctctcttctgctccaccc

SEQ ID NO: 3717998 - DNA, 23 bp, Homo sapiens
cctctctgatcttgtgctcagca

SEQ ID NO: 3717999 - DNA, 16 bp, Homo sapiens
cctctcttcctatccc

SEQ ID NO: 3718000 - DNA, 23 bp, Homo sapiens
cctctcttcctatcccatcccat

SEQ ID NO: 3718001 - DNA, 18 bp, Homo sapiens
cctctcttggtttccttc

SEQ ID NO: 3718002 - DNA, 23 bp, Homo sapiens
cctctgaaaaccaatgttctctc

SEQ ID NO: 3718003 - DNA, 16 bp, Homo sapiens
cctctgacacacagct

SEQ ID NO: 3718004 - DNA, 21 bp, Homo sapiens
cctctgacacacagctctgtc

SEQ ID NO: 3718005 - DNA, 14 bp, Homo sapiens
cctctgactcccaa

SEQ ID NO: 3718006 - DNA, 21 bp, Homo sapiens
cctctgactcccaaagagctg

SEQ ID NO: 3718007 - DNA, 22 bp, Homo sapiens
cctctgactcccaaagagctgc

SEQ ID NO: 3718008 - DNA, 12 bp, Homo sapiens
cctctgccacct

SEQ ID NO: 3718009 - DNA, 13 bp, Homo sapiens
cctctgccacctc

SEQ ID NO: 3718010 - DNA, 16 bp, Homo sapiens
cctctgccacctcccc

SEQ ID NO: 3718011 - DNA, 12 bp, Homo sapiens
cctctgcctcaa

SEQ ID NO: 3718012 - DNA, 13 bp, Homo sapiens
cctctgcctcaat

SEQ ID NO: 3718013 - DNA, 21 bp, Homo sapiens
cctctgcctctgacacacagc

SEQ ID NO: 3718014 - DNA, 23 bp, Homo sapiens
cctctgcctctgacacacagctc

SEQ ID NO: 3718015 - DNA, 11 bp, Homo sapiens
cctctgcctga

SEQ ID NO: 3718016 - DNA, 20 bp, Homo sapiens
cctctgcctgaagtcacaca

SEQ ID NO: 3718017 - DNA, 17 bp, Homo sapiens
cctctgcctgtccctct

SEQ ID NO: 3718018 - DNA, 19 bp, Homo sapiens
cctctgctggccgggcaca

SEQ ID NO: 3718019 - DNA, 14 bp, Homo sapiens
cctctggactggct

SEQ ID NO: 3718020 - DNA, 15 bp, Homo sapiens
cctctggactggcta

SEQ ID NO: 3718021 - DNA, 17 bp, Homo sapiens
cctctggactggctaga

SEQ ID NO: 3718022 - DNA, 18 bp, Homo sapiens
cctctggactggctagag

SEQ ID NO: 3718023 - DNA, 18 bp, Homo sapiens
cctctggaggcctctggg

SEQ ID NO: 3718024 - DNA, 19 bp, Homo sapiens
cctctggaggcctctgggc

SEQ ID NO: 3718025 - DNA, 12 bp, Homo sapiens
cctctggctaga

SEQ ID NO: 3718026 - DNA, 24 bp, Homo sapiens
cctctggctagaggccagccccac

SEQ ID NO: 3718027 - DNA, 22 bp, Homo sapiens
cctctggctggctaactggaag

SEQ ID NO: 3718028 - DNA, 10 bp, Homo sapiens
cctctgggct

SEQ ID NO: 3718029 - DNA, 23 bp, Homo sapiens
cctctgtatttgaatcagcctac

SEQ ID NO: 3718030 - DNA, 14 bp, Homo sapiens
cctctgtccagggc

SEQ ID NO: 3718031 - DNA, 18 bp, Homo sapiens
cctcttaaaaaataaaaa

SEQ ID NO: 3718032 - DNA, 17 bp, Homo sapiens
cctcttaaagctgcctg

SEQ ID NO: 3718033 - DNA, 22 bp, Homo sapiens
cctcttaaagctgcctgtagtt

SEQ ID NO: 3718034 - DNA, 17 bp, Homo sapiens
cctcttaaataaacctt

SEQ ID NO: 3718035 - DNA, 18 bp, Homo sapiens
cctcttatgtacctcttt

SEQ ID NO: 3718036 - DNA, 12 bp, Homo sapiens
cctcttccccac

SEQ ID NO: 3718037 - DNA, 22 bp, Homo sapiens
cctcttccccagaaaggagact

SEQ ID NO: 3718038 - DNA, 20 bp, Homo sapiens
cctcttccggagatgtagca

SEQ ID NO: 3718039 - DNA, 16 bp, Homo sapiens
cctcttcctccctcat

SEQ ID NO: 3718040 - DNA, 17 bp, Homo sapiens
cctcttctattttgtaa

SEQ ID NO: 3718041 - DNA, 14 bp, Homo sapiens
cctcttcttacttg

SEQ ID NO: 3718042 - DNA, 15 bp, Homo sapiens
cctcttcttcttcag

SEQ ID NO: 3718043 - DNA, 12 bp, Homo sapiens
cctcttgccccc

SEQ ID NO: 3718044 - DNA, 16 bp, Homo sapiens
cctcttgccccccacc

SEQ ID NO: 3718045 - DNA, 17 bp, Homo sapiens
cctcttgcggtcccttc

SEQ ID NO: 3718046 - DNA, 17 bp, Homo sapiens
cctctttcagaaaacag

SEQ ID NO: 3718047 - DNA, 21 bp, Homo sapiens
cctctttcagaaaacagaaaa

SEQ ID NO: 3718048 - DNA, 23 bp, Homo sapiens
cctctttcagaaaacagaaaaaa

SEQ ID NO: 3718049 - DNA, 19 bp, Homo sapiens
cctctttccctcccttcct

SEQ ID NO: 3718050 - DNA, 17 bp, Homo sapiens
cctcttttagtcatttt

SEQ ID NO: 3718051 - DNA, 20 bp, Homo sapiens
cctctttttccatcataatt

SEQ ID NO: 3718052 - DNA, 21 bp, Homo sapiens
cctgaaaatgtttttctgcca

SEQ ID NO: 3718053 - DNA, 14 bp, Homo sapiens
cctgaaagccctga

SEQ ID NO: 3718054 - DNA, 19 bp, Homo sapiens
cctgaacacttattgcttt

SEQ ID NO: 3718055 - DNA, 14 bp, Homo sapiens
cctgaagaacagta

SEQ ID NO: 3718056 - DNA, 17 bp, Homo sapiens
cctgaagtcacacagtg

SEQ ID NO: 3718057 - DNA, 20 bp, Homo sapiens
cctgaagtcacacagtgagt

SEQ ID NO: 3718058 - DNA, 14 bp, Homo sapiens
cctgaccctgcaga

SEQ ID NO: 3718059 - DNA, 20 bp, Homo sapiens
cctgacggcgcccccagtgt

SEQ ID NO: 3718060 - DNA, 13 bp, Homo sapiens
cctgactctctgt

SEQ ID NO: 3718061 - DNA, 15 bp, Homo sapiens
cctgactctctgtga

SEQ ID NO: 3718062 - DNA, 16 bp, Homo sapiens
cctgactctctgtgac

SEQ ID NO: 3718063 - DNA, 15 bp, Homo sapiens
cctgagacaaatgga

SEQ ID NO: 3718064 - DNA, 19 bp, Homo sapiens
cctgagatggccctctggt

SEQ ID NO: 3718065 - DNA, 21 bp, Homo sapiens
cctgagcaacagagtgagacc

SEQ ID NO: 3718066 - DNA, 19 bp, Homo sapiens
cctgagcacctcccagccc

SEQ ID NO: 3718067 - DNA, 15 bp, Homo sapiens
cctgagctcggtgga

SEQ ID NO: 3718068 - DNA, 16 bp, Homo sapiens
cctgagctcggtggac

SEQ ID NO: 3718069 - DNA, 19 bp, Homo sapiens
cctgagctcggtggaccca

SEQ ID NO: 3718070 - DNA, 20 bp, Homo sapiens
cctgagctcggtggacccag

SEQ ID NO: 3718071 - DNA, 17 bp, Homo sapiens
cctgagcttggccagaa

SEQ ID NO: 3718072 - DNA, 15 bp, Homo sapiens
cctgagctttggaca

SEQ ID NO: 3718073 - DNA, 18 bp, Homo sapiens
cctgagctttggacacac

SEQ ID NO: 3718074 - DNA, 23 bp, Homo sapiens
cctgagctttggacgcacacagc

SEQ ID NO: 3718075 - DNA, 23 bp, Homo sapiens
cctgaggaagcgtgaaggccgag

SEQ ID NO: 3718076 - DNA, 17 bp, Homo sapiens
cctgaggatcagaaagt

SEQ ID NO: 3718077 - DNA, 21 bp, Homo sapiens
cctgaggctgagactgcggga

SEQ ID NO: 3718078 - DNA, 19 bp, Homo sapiens
cctgaggctggactccaga

SEQ ID NO: 3718079 - DNA, 18 bp, Homo sapiens
cctgaggggcatctgccc

SEQ ID NO: 3718080 - DNA, 23 bp, Homo sapiens
cctgaggggcatctgcccctccc

SEQ ID NO: 3718081 - DNA, 15 bp, Homo sapiens
cctgagtcaccagga

SEQ ID NO: 3718082 - DNA, 15 bp, Homo sapiens
cctgagtcacccatg

SEQ ID NO: 3718083 - DNA, 18 bp, Homo sapiens
cctgatcccactcctagg

SEQ ID NO: 3718084 - DNA, 19 bp, Homo sapiens
cctgatcccactcctagga

SEQ ID NO: 3718085 - DNA, 19 bp, Homo sapiens
cctgatgacccaggctgcc

SEQ ID NO: 3718086 - DNA, 21 bp, Homo sapiens
cctgatgacccaggctgcctg

SEQ ID NO: 3718087 - DNA, 14 bp, Homo sapiens
cctgatgctccctc

SEQ ID NO: 3718088 - DNA, 19 bp, Homo sapiens
cctgatgctccctcccctg

SEQ ID NO: 3718089 - DNA, 20 bp, Homo sapiens
cctgattgtgtatattcata

SEQ ID NO: 3718090 - DNA, 14 bp, Homo sapiens
cctgcaaaatttta

SEQ ID NO: 3718091 - DNA, 22 bp, Homo sapiens
cctgcacaaagcccttccatgt

SEQ ID NO: 3718092 - DNA, 12 bp, Homo sapiens
cctgcaccagga

SEQ ID NO: 3718093 - DNA, 17 bp, Homo sapiens
cctgcaccaggagacag

SEQ ID NO: 3718094 - DNA, 17 bp, Homo sapiens
cctgcacctccccccac

SEQ ID NO: 3718095 - DNA, 21 bp, Homo sapiens
cctgcactaatttgatgttta

SEQ ID NO: 3718096 - DNA, 20 bp, Homo sapiens
cctgcactgacccacagcct

SEQ ID NO: 3718097 - DNA, 20 bp, Homo sapiens
cctgcactggagtccagtct

SEQ ID NO: 3718098 - DNA, 18 bp, Homo sapiens
cctgcacttgcagactct

SEQ ID NO: 3718099 - DNA, 14 bp, Homo sapiens
cctgcagcagagcc

SEQ ID NO: 3718100 - DNA, 21 bp, Homo sapiens
cctgcagcagagcctggaaga

SEQ ID NO: 3718101 - DNA, 13 bp, Homo sapiens
cctgcagcctgga

SEQ ID NO: 3718102 - DNA, 20 bp, Homo sapiens
cctgcagtactttacctcct

SEQ ID NO: 3718103 - DNA, 17 bp, Homo sapiens
cgatgtggccctggcct

SEQ ID NO: 3718104 - DNA, 22 bp, Homo sapiens
cgatgtggccctggcctgctgg

SEQ ID NO: 3718105 - DNA, 14 bp, Homo sapiens
cgatttgtcccagg

SEQ ID NO: 3718106 - DNA, 18 bp, Homo sapiens
cgcaatgtgcccccagac

SEQ ID NO: 3718107 - DNA, 10 bp, Homo sapiens
cgcacacaca

SEQ ID NO: 3718108 - DNA, 15 bp, Homo sapiens
cgcacacacacacac

SEQ ID NO: 3718109 - DNA, 13 bp, Homo sapiens
cgcacccccaccc

SEQ ID NO: 3718110 - DNA, 17 bp, Homo sapiens
cgcaccccccaagctgt

SEQ ID NO: 3718111 - DNA, 10 bp, Homo sapiens
cgcagccctg

SEQ ID NO: 3718112 - DNA, 13 bp, Homo sapiens
cgcaggaagctgc

SEQ ID NO: 3718113 - DNA, 13 bp, Homo sapiens
cgcatcagacaga

SEQ ID NO: 3718114 - DNA, 21 bp, Homo sapiens
cgcatcttctccatctggcag

SEQ ID NO: 3718115 - DNA, 22 bp, Homo sapiens
cgcatggagtgtgtattgttcc

SEQ ID NO: 3718116 - DNA, 13 bp, Homo sapiens
cgccaaggctggg

SEQ ID NO: 3718117 - DNA, 17 bp, Homo sapiens
cgccacccctccttcct

SEQ ID NO: 3718118 - DNA, 21 bp, Homo sapiens
cgccactacactccagcctga

SEQ ID NO: 3718119 - DNA, 22 bp, Homo sapiens
cgccactacactccagcctgag

SEQ ID NO: 3718120 - DNA, 13 bp, Homo sapiens
cgccactgcactc

SEQ ID NO: 3718121 - DNA, 22 bp, Homo sapiens
cgccaggggaaaatcagcctgc

SEQ ID NO: 3718122 - DNA, 14 bp, Homo sapiens
cgccagtctcccag

SEQ ID NO: 3718123 - DNA, 23 bp, Homo sapiens
cgcccagctgcacctgccagcct

SEQ ID NO: 3718124 - DNA, 15 bp, Homo sapiens
cgcccaggagacatc

SEQ ID NO: 3718125 - DNA, 19 bp, Homo sapiens
cgcccagtctggaatgcag

SEQ ID NO: 3718126 - DNA, 21 bp, Homo sapiens
cgcccagtctggaatgcagtg

SEQ ID NO: 3718127 - DNA, 23 bp, Homo sapiens
cgcccagttgggtggatgcctgg

SEQ ID NO: 3718128 - DNA, 13 bp, Homo sapiens
cgcccatgtgtga

SEQ ID NO: 3718129 - DNA, 12 bp, Homo sapiens
cgccccagcctc

SEQ ID NO: 3718130 - DNA, 14 bp, Homo sapiens
cgccccagcctctg

SEQ ID NO: 3718131 - DNA, 23 bp, Homo sapiens
cgcccccgggtttggcgggccaa

SEQ ID NO: 3718132 - DNA, 13 bp, Homo sapiens
cgccccgccccac

SEQ ID NO: 3718133 - DNA, 17 bp, Homo sapiens
cgcccgaggtggctgcc

SEQ ID NO: 3718134 - DNA, 15 bp, Homo sapiens
cgccctaggcctggc

SEQ ID NO: 3718135 - DNA, 20 bp, Homo sapiens
cgccctcattacggctcctc

SEQ ID NO: 3718136 - DNA, 13 bp, Homo sapiens
cgccctcttcccc

SEQ ID NO: 3718137 - DNA, 15 bp, Homo sapiens
cgcctcccagcctgg

SEQ ID NO: 3718138 - DNA, 13 bp, Homo sapiens
cgcctctgcattc

SEQ ID NO: 3718139 - DNA, 11 bp, Homo sapiens
cgcctggcaga

SEQ ID NO: 3718140 - DNA, 18 bp, Homo sapiens
cgcctgtaatcccagcag

SEQ ID NO: 3718141 - DNA, 20 bp, Homo sapiens
cgcctgtagtcctagccact

SEQ ID NO: 3718142 - DNA, 23 bp, Homo sapiens
cgccttaggtacttattccagat

SEQ ID NO: 3718143 - DNA, 19 bp, Homo sapiens
cgcggtggctcacgcctgt

SEQ ID NO: 3718144 - DNA, 16 bp, Homo sapiens
cgcgtgcacacaccag

SEQ ID NO: 3718145 - DNA, 21 bp, Homo sapiens
cgctaatcccgattcaccctg

SEQ ID NO: 3718146 - DNA, 21 bp, Homo sapiens
cgctcagccctccctgcccct

SEQ ID NO: 3718147 - DNA, 17 bp, Homo sapiens
cgctcctgtctgccagc

SEQ ID NO: 3718148 - DNA, 17 bp, Homo sapiens
cgctgcctaagtggctg

SEQ ID NO: 3718149 - DNA, 18 bp, Homo sapiens
cgctggagtgcagtgagc

SEQ ID NO: 3718150 - DNA, 12 bp, Homo sapiens
cgctggccccca

SEQ ID NO: 3718151 - DNA, 16 bp, Homo sapiens
cgctgtctccagaccc

SEQ ID NO: 3718152 - DNA, 12 bp, Homo sapiens
cgcttctgactg

SEQ ID NO: 3718153 - DNA, 20 bp, Homo sapiens
cgcttgtccagcgcctagtg

SEQ ID NO: 3718154 - DNA, 17 bp, Homo sapiens
cgctttctacactgtat

SEQ ID NO: 3718155 - DNA, 19 bp, Homo sapiens
cgcttttgctggtcactgc

SEQ ID NO: 3718156 - DNA, 13 bp, Homo sapiens
cggaaagcagctc

SEQ ID NO: 3718157 - DNA, 15 bp, Homo sapiens
cggaacaagcctaaa

SEQ ID NO: 3718158 - DNA, 13 bp, Homo sapiens
cggaagagccttg

SEQ ID NO: 3718159 - DNA, 18 bp, Homo sapiens
cggaaggacctatgtttg

SEQ ID NO: 3718160 - DNA, 19 bp, Homo sapiens
cggaaggacctatgtttgc

SEQ ID NO: 3718161 - DNA, 17 bp, Homo sapiens
cggaatagttggctagg

SEQ ID NO: 3718162 - DNA, 17 bp, Homo sapiens
cggaatcctgtcctcag

SEQ ID NO: 3718163 - DNA, 13 bp, Homo sapiens
cggacaagtttta

SEQ ID NO: 3718164 - DNA, 21 bp, Homo sapiens
cggacagccacggccaggcca

SEQ ID NO: 3718165 - DNA, 12 bp, Homo sapiens
cggacgggctgt

SEQ ID NO: 3718166 - DNA, 23 bp, Homo sapiens
cggagagcgcctgcccctcccag

SEQ ID NO: 3718167 - DNA, 22 bp, Homo sapiens
cggagcctcatccgaggcaggg

SEQ ID NO: 3718168 - DNA, 18 bp, Homo sapiens
cggaggcttgtcagagct

SEQ ID NO: 3718169 - DNA, 23 bp, Homo sapiens
cggaggcttgtcagagctgggag

SEQ ID NO: 3718170 - DNA, 17 bp, Homo sapiens
cggagggattcccctaa

SEQ ID NO: 3718171 - DNA, 13 bp, Homo sapiens
cggaggttgcagg

SEQ ID NO: 3718172 - DNA, 20 bp, Homo sapiens
cggagtcccaccttggctgc

SEQ ID NO: 3718173 - DNA, 23 bp, Homo sapiens
cggagtcccaccttggctgcagg

SEQ ID NO: 3718174 - DNA, 16 bp, Homo sapiens
cggagttcctaacagg

SEQ ID NO: 3718175 - DNA, 22 bp, Homo sapiens
cggcaggacaacgaggaagccc

SEQ ID NO: 3718176 - DNA, 20 bp, Homo sapiens
cggcagttctgggtgctccc

SEQ ID NO: 3718177 - DNA, 23 bp, Homo sapiens
cggcattggttccctttgctcca

SEQ ID NO: 3718178 - DNA, 12 bp, Homo sapiens
cggccaggccag

SEQ ID NO: 3718179 - DNA, 17 bp, Homo sapiens
cggcccaggatggcttt

SEQ ID NO: 3718180 - DNA, 18 bp, Homo sapiens
cggcccctgctggttcag

SEQ ID NO: 3718181 - DNA, 16 bp, Homo sapiens
cggccgcattccctga

SEQ ID NO: 3718182 - DNA, 18 bp, Homo sapiens
cggccgcattccctgagt

SEQ ID NO: 3718183 - DNA, 19 bp, Homo sapiens
cggccgtcttcactcgccc

SEQ ID NO: 3718184 - DNA, 17 bp, Homo sapiens
cggcctgatgctccctc

SEQ ID NO: 3718185 - DNA, 19 bp, Homo sapiens
cggccttcaactgaaaaga

SEQ ID NO: 3718186 - DNA, 15 bp, Homo sapiens
cggcctttggcttca

SEQ ID NO: 3718187 - DNA, 17 bp, Homo sapiens
cggcgcccccagtgtgc

SEQ ID NO: 3718188 - DNA, 13 bp, Homo sapiens
cggcgcggtggct

SEQ ID NO: 3718189 - DNA, 17 bp, Homo sapiens
cggctcactgcagcctc

SEQ ID NO: 3718190 - DNA, 14 bp, Homo sapiens
cggctccaggctcc

SEQ ID NO: 3718191 - DNA, 16 bp, Homo sapiens
cggctccaggctcctt

SEQ ID NO: 3718192 - DNA, 12 bp, Homo sapiens
cggctcctggac

SEQ ID NO: 3718193 - DNA, 15 bp, Homo sapiens
cggctggtgcagggc

SEQ ID NO: 3718194 - DNA, 13 bp, Homo sapiens
cgggaacagtgtt

SEQ ID NO: 3718195 - DNA, 16 bp, Homo sapiens
cgggaagccaccctcc

SEQ ID NO: 3718196 - DNA, 12 bp, Homo sapiens
cgggaagcggag

SEQ ID NO: 3718197 - DNA, 14 bp, Homo sapiens
cgggaaggagggtt

SEQ ID NO: 3718198 - DNA, 16 bp, Homo sapiens
cgggagacctgtgcta

SEQ ID NO: 3718199 - DNA, 14 bp, Homo sapiens
cgggagcagtgtct

SEQ ID NO: 3718200 - DNA, 15 bp, Homo sapiens
cgggagcagtgtctt

SEQ ID NO: 3718201 - DNA, 16 bp, Homo sapiens
cgggaggtcgaggcag

SEQ ID NO: 3718202 - DNA, 18 bp, Homo sapiens
cgggatggtcctggggct

SEQ ID NO: 3718203 - DNA, 14 bp, Homo sapiens
cgggcacaataaat

SEQ ID NO: 3718204 - DNA, 12 bp, Homo sapiens
cgggccaaggac

SEQ ID NO: 3718205 - DNA, 12 bp, Homo sapiens
cgggccacagag

SEQ ID NO: 3718206 - DNA, 17 bp, Homo sapiens
cgggccacagagaaagt

SEQ ID NO: 3718207 - DNA, 16 bp, Homo sapiens
cgggcctggagaacta

SEQ ID NO: 3718208 - DNA, 20 bp, Homo sapiens
cgggcctggagaactagaga

SEQ ID NO: 3718209 - DNA, 15 bp, Homo sapiens
cgggctctctgctgt

SEQ ID NO: 3718210 - DNA, 20 bp, Homo sapiens
cgggctgggagctctgcaga

SEQ ID NO: 3718211 - DNA, 15 bp, Homo sapiens
cggggacagctcctt

SEQ ID NO: 3718212 - DNA, 14 bp, Homo sapiens
cggggcagctgcca

SEQ ID NO: 3718213 - DNA, 16 bp, Homo sapiens
cggggcatgctggggc

SEQ ID NO: 3718214 - DNA, 17 bp, Homo sapiens
cggggcatgctggggca

SEQ ID NO: 3718215 - DNA, 13 bp, Homo sapiens
cggggccagaggc

SEQ ID NO: 3718216 - DNA, 19 bp, Homo sapiens
cggggctccccttcgcgta

SEQ ID NO: 3718217 - DNA, 20 bp, Homo sapiens
ctatggattttctaaggaag

SEQ ID NO: 3718218 - DNA, 17 bp, Homo sapiens
ctatgggagccccaggg

SEQ ID NO: 3718219 - DNA, 16 bp, Homo sapiens
ctatggggacattcca

SEQ ID NO: 3718220 - DNA, 15 bp, Homo sapiens
ctatggggatggtcc

SEQ ID NO: 3718221 - DNA, 16 bp, Homo sapiens
ctatggtaaagatatt

SEQ ID NO: 3718222 - DNA, 15 bp, Homo sapiens
ctatgtacaatattt

SEQ ID NO: 3718223 - DNA, 16 bp, Homo sapiens
ctatgtacaatatttt

SEQ ID NO: 3718224 - DNA, 13 bp, Homo sapiens
ctatgtatcaatg

SEQ ID NO: 3718225 - DNA, 16 bp, Homo sapiens
ctatgtcccttgctgt

SEQ ID NO: 3718226 - DNA, 14 bp, Homo sapiens
ctatgttgcccagg

SEQ ID NO: 3718227 - DNA, 15 bp, Homo sapiens
ctatgttgcccaggc

SEQ ID NO: 3718228 - DNA, 17 bp, Homo sapiens
ctatgttgcccaggcag

SEQ ID NO: 3718229 - DNA, 11 bp, Homo sapiens
ctatgtttgct

SEQ ID NO: 3718230 - DNA, 20 bp, Homo sapiens
ctattaagcagtaaaaactg

SEQ ID NO: 3718231 - DNA, 20 bp, Homo sapiens
ctattaccactgaagataga

SEQ ID NO: 3718232 - DNA, 17 bp, Homo sapiens
ctattataatttaatgc

SEQ ID NO: 3718233 - DNA, 21 bp, Homo sapiens
ctattataatttaatgcatgt

SEQ ID NO: 3718234 - DNA, 20 bp, Homo sapiens
ctattattttcactgtagaa

SEQ ID NO: 3718235 - DNA, 22 bp, Homo sapiens
ctattattttcactgtagaatg

SEQ ID NO: 3718236 - DNA, 23 bp, Homo sapiens
ctattcagtaataactctaccct

SEQ ID NO: 3718237 - DNA, 16 bp, Homo sapiens
ctattctctcctcaga

SEQ ID NO: 3718238 - DNA, 16 bp, Homo sapiens
ctattgacaagtcatt

SEQ ID NO: 3718239 - DNA, 22 bp, Homo sapiens
ctattgacatcagcatcaccta

SEQ ID NO: 3718240 - DNA, 17 bp, Homo sapiens
ctattgcagctgggaga

SEQ ID NO: 3718241 - DNA, 23 bp, Homo sapiens
ctattgggttcattattggaatt

SEQ ID NO: 3718242 - DNA, 16 bp, Homo sapiens
ctattgtaagataaaa

SEQ ID NO: 3718243 - DNA, 14 bp, Homo sapiens
ctatttaaattctt

SEQ ID NO: 3718244 - DNA, 13 bp, Homo sapiens
ctatttagcatga

SEQ ID NO: 3718245 - DNA, 16 bp, Homo sapiens
ctatttatctgtgttt

SEQ ID NO: 3718246 - DNA, 19 bp, Homo sapiens
ctatttatctgtgtttttg

SEQ ID NO: 3718247 - DNA, 14 bp, Homo sapiens
ctatttatttactg

SEQ ID NO: 3718248 - DNA, 19 bp, Homo sapiens
ctatttcaaaaatttggaa

SEQ ID NO: 3718249 - DNA, 18 bp, Homo sapiens
ctatttgcttatttaata

SEQ ID NO: 3718250 - DNA, 21 bp, Homo sapiens
ctattttactgtcttaattaa

SEQ ID NO: 3718251 - DNA, 16 bp, Homo sapiens
ctattttcagaatctg

SEQ ID NO: 3718252 - DNA, 23 bp, Homo sapiens
ctattttcagaatctgaatgtaa

SEQ ID NO: 3718253 - DNA, 19 bp, Homo sapiens
ctattttgtaaactcaaaa

SEQ ID NO: 3718254 - DNA, 17 bp, Homo sapiens
ctatttttttaaaatca

SEQ ID NO: 3718255 - DNA, 13 bp, Homo sapiens
ctcaaaaggaaac

SEQ ID NO: 3718256 - DNA, 14 bp, Homo sapiens
ctcaaaaggaaacc

SEQ ID NO: 3718257 - DNA, 20 bp, Homo sapiens
ctcaaacctccaaaagccct

SEQ ID NO: 3718258 - DNA, 17 bp, Homo sapiens
ctcaaactgccttggct

SEQ ID NO: 3718259 - DNA, 20 bp, Homo sapiens
ctcaacatgttactgaccag

SEQ ID NO: 3718260 - DNA, 15 bp, Homo sapiens
ctcaaccatcccctc

SEQ ID NO: 3718261 - DNA, 20 bp, Homo sapiens
ctcaaccatcccctccgtgg

SEQ ID NO: 3718262 - DNA, 18 bp, Homo sapiens
ctcaaccccaccacttct

SEQ ID NO: 3718263 - DNA, 16 bp, Homo sapiens
ctcaaccctccctcag

SEQ ID NO: 3718264 - DNA, 22 bp, Homo sapiens
ctcaaccctccctcagcccctc

SEQ ID NO: 3718265 - DNA, 17 bp, Homo sapiens
ctcaacctgtaaattat

SEQ ID NO: 3718266 - DNA, 17 bp, Homo sapiens
ctcaactcacctaatgt

SEQ ID NO: 3718267 - DNA, 16 bp, Homo sapiens
ctcaagaggctgaggc

SEQ ID NO: 3718268 - DNA, 16 bp, Homo sapiens
ctcaagccaagcagcc

SEQ ID NO: 3718269 - DNA, 18 bp, Homo sapiens
ctcaagccaagcagccaa

SEQ ID NO: 3718270 - DNA, 21 bp, Homo sapiens
ctcaagccaagcagccaagct

SEQ ID NO: 3718271 - DNA, 23 bp, Homo sapiens
ctcaaggacaaagtctccagccc

SEQ ID NO: 3718272 - DNA, 18 bp, Homo sapiens
ctcaaggacttgaaagca

SEQ ID NO: 3718273 - DNA, 20 bp, Homo sapiens
ctcaaggacttgaaagcatc

SEQ ID NO: 3718274 - DNA, 14 bp, Homo sapiens
ctcaagtcctcttt

SEQ ID NO: 3718275 - DNA, 18 bp, Homo sapiens
ctcaagtcttccctgatc

SEQ ID NO: 3718276 - DNA, 20 bp, Homo sapiens
ctcaagtgattctcctgcct

SEQ ID NO: 3718277 - DNA, 18 bp, Homo sapiens
ctcaagttcaaggaccaa

SEQ ID NO: 3718278 - DNA, 13 bp, Homo sapiens
ctcaataaaatca

SEQ ID NO: 3718279 - DNA, 22 bp, Homo sapiens
ctcaataaaatcatgtacattt

SEQ ID NO: 3718280 - DNA, 18 bp, Homo sapiens
ctcaatattcctgaatga

SEQ ID NO: 3718281 - DNA, 18 bp, Homo sapiens
ctcaatattttccatgaa

SEQ ID NO: 3718282 - DNA, 18 bp, Homo sapiens
ctcaatcccagctactca

SEQ ID NO: 3718283 - DNA, 20 bp, Homo sapiens
ctcaatgtgaatcagaccct

SEQ ID NO: 3718284 - DNA, 17 bp, Homo sapiens
ctcacaacagctgcctg

SEQ ID NO: 3718285 - DNA, 23 bp, Homo sapiens
ctcacaccaggcttgcctgcagg

SEQ ID NO: 3718286 - DNA, 17 bp, Homo sapiens
ctcacagaacccttgga

SEQ ID NO: 3718287 - DNA, 23 bp, Homo sapiens
ctcacagactggagacaatgcag

SEQ ID NO: 3718288 - DNA, 16 bp, Homo sapiens
ctcacagagacacagg

SEQ ID NO: 3718289 - DNA, 16 bp, Homo sapiens
ctcacagctgtaataa

SEQ ID NO: 3718290 - DNA, 20 bp, Homo sapiens
ctcacagtctctttaatctt

SEQ ID NO: 3718291 - DNA, 19 bp, Homo sapiens
ctcacagtgggagccaggg

SEQ ID NO: 3718292 - DNA, 21 bp, Homo sapiens
ctcacagtgttgcccaggctg

SEQ ID NO: 3718293 - DNA, 16 bp, Homo sapiens
ctcacagttcctcgcc

SEQ ID NO: 3718294 - DNA, 13 bp, Homo sapiens
ctcacatgctgga

SEQ ID NO: 3718295 - DNA, 15 bp, Homo sapiens
ctcacatgctggaca

SEQ ID NO: 3718296 - DNA, 22 bp, Homo sapiens
ctcacatgctggacaggtctgg

SEQ ID NO: 3718297 - DNA, 23 bp, Homo sapiens
ctcacatgctggacaggtctggg

SEQ ID NO: 3718298 - DNA, 19 bp, Homo sapiens
ctcacatttattctgctca

SEQ ID NO: 3718299 - DNA, 18 bp, Homo sapiens
ctcaccagccccagtgcc

SEQ ID NO: 3718300 - DNA, 19 bp, Homo sapiens
ctcaccagccccagtgccc

SEQ ID NO: 3718301 - DNA, 19 bp, Homo sapiens
ctcaccccatcccacaccc

SEQ ID NO: 3718302 - DNA, 22 bp, Homo sapiens
ctcaccccatcccacaccctgg

SEQ ID NO: 3718303 - DNA, 21 bp, Homo sapiens
ctcacccccaaggggcagtct

SEQ ID NO: 3718304 - DNA, 15 bp, Homo sapiens
ctcaccccgtctggg

SEQ ID NO: 3718305 - DNA, 21 bp, Homo sapiens
ctcaccgtggctaagagtgtc

SEQ ID NO: 3718306 - DNA, 12 bp, Homo sapiens
ctcacctctgcc

SEQ ID NO: 3718307 - DNA, 13 bp, Homo sapiens
ctcacctctgcct

SEQ ID NO: 3718308 - DNA, 19 bp, Homo sapiens
ctcacctctgcctcaatgt

SEQ ID NO: 3718309 - DNA, 21 bp, Homo sapiens
ctcacctgggcacctggggag

SEQ ID NO: 3718310 - DNA, 11 bp, Homo sapiens
ctcacctgggg

SEQ ID NO: 3718311 - DNA, 22 bp, Homo sapiens
ctcaccttgaacaccacgcttg

SEQ ID NO: 3718312 - DNA, 18 bp, Homo sapiens
ctcaccttgcaacacaca

SEQ ID NO: 3718313 - DNA, 19 bp, Homo sapiens
ctcaccttgcaacacacag

SEQ ID NO: 3718314 - DNA, 21 bp, Homo sapiens
ctcaccttgcaacacacagac

SEQ ID NO: 3718315 - DNA, 20 bp, Homo sapiens
ctcacgcctgtaatcccagc

SEQ ID NO: 3718316 - DNA, 22 bp, Homo sapiens
ctcacgcctgtaatcccagcag

SEQ ID NO: 3718317 - DNA, 23 bp, Homo sapiens
ctcactatgttgcccaggcaggt

SEQ ID NO: 3718318 - DNA, 17 bp, Homo sapiens
ctcactccaccacccaa

SEQ ID NO: 3718319 - DNA, 17 bp, Homo sapiens
ctcactcccttctcctt

SEQ ID NO: 3718320 - DNA, 16 bp, Homo sapiens
ctcactcctacctggt

SEQ ID NO: 3718321 - DNA, 12 bp, Homo sapiens
ctcactctgtcg

SEQ ID NO: 3718322 - DNA, 13 bp, Homo sapiens
ctcactgcagcct

SEQ ID NO: 3718323 - DNA, 16 bp, Homo sapiens
ctcactgcagcctcga

SEQ ID NO: 3718324 - DNA, 13 bp, Homo sapiens
ctcactggcagcc

SEQ ID NO: 3718325 - DNA, 17 bp, Homo sapiens
ctcactggggtcctggg

SEQ ID NO: 3718326 - DNA, 13 bp, Homo sapiens
ctcactgggtggg

SEQ ID NO: 3718327 - DNA, 16 bp, Homo sapiens
ctcactgttgcccagg

SEQ ID NO: 3718328 - DNA, 21 bp, Homo sapiens
ctcacttatcccaagagaatg

SEQ ID NO: 3718329 - DNA, 15 bp, Homo sapiens
ctcgtcctccccctg

SEQ ID NO: 3718330 - DNA, 16 bp, Homo sapiens
ctcgtcctccccctgc

SEQ ID NO: 3718331 - DNA, 20 bp, Homo sapiens
ctcgtcggggggacagctcc

SEQ ID NO: 3718332 - DNA, 15 bp, Homo sapiens
ctcgtgctttaagtg

SEQ ID NO: 3718333 - DNA, 22 bp, Homo sapiens
ctctaaatgaggggcctcaggt

SEQ ID NO: 3718334 - DNA, 14 bp, Homo sapiens
ctctaacaggggct

SEQ ID NO: 3718335 - DNA, 14 bp, Homo sapiens
ctctaacctccttt

SEQ ID NO: 3718336 - DNA, 23 bp, Homo sapiens
ctctaatagcgaggctctaacca

SEQ ID NO: 3718337 - DNA, 18 bp, Homo sapiens
ctctaatgctcacgctcc

SEQ ID NO: 3718338 - DNA, 20 bp, Homo sapiens
ctctaattcccattttgcaa

SEQ ID NO: 3718339 - DNA, 12 bp, Homo sapiens
ctctaattctaa

SEQ ID NO: 3718340 - DNA, 18 bp, Homo sapiens
ctctaattgaattttcaa

SEQ ID NO: 3718341 - DNA, 16 bp, Homo sapiens
ctctacagaggccatg

SEQ ID NO: 3718342 - DNA, 19 bp, Homo sapiens
ctctacagaggccatgggc

SEQ ID NO: 3718343 - DNA, 21 bp, Homo sapiens
ctctacagctaatcagcattc

SEQ ID NO: 3718344 - DNA, 20 bp, Homo sapiens
ctctaccatcccctgtagag

SEQ ID NO: 3718345 - DNA, 20 bp, Homo sapiens
ctctacccagcccatcttgc

SEQ ID NO: 3718346 - DNA, 19 bp, Homo sapiens
ctctacccatattacagat

SEQ ID NO: 3718347 - DNA, 17 bp, Homo sapiens
ctctaccctcccacccc

SEQ ID NO: 3718348 - DNA, 18 bp, Homo sapiens
ctctactaaaaatacaaa

SEQ ID NO: 3718349 - DNA, 22 bp, Homo sapiens
ctctactaaaaatacaaaaatt

SEQ ID NO: 3718350 - DNA, 19 bp, Homo sapiens
ctctactaccacaaggaaa

SEQ ID NO: 3718351 - DNA, 23 bp, Homo sapiens
ctctagacaaccctgcaaaggac

SEQ ID NO: 3718352 - DNA, 21 bp, Homo sapiens
ctctagccggagtgacagagt

SEQ ID NO: 3718353 - DNA, 18 bp, Homo sapiens
ctctagggaaggccacct

SEQ ID NO: 3718354 - DNA, 20 bp, Homo sapiens
ctctagggaaggccacctgc

SEQ ID NO: 3718355 - DNA, 13 bp, Homo sapiens
ctctagtgccctc

SEQ ID NO: 3718356 - DNA, 14 bp, Homo sapiens
ctctagtgccctcc

SEQ ID NO: 3718357 - DNA, 21 bp, Homo sapiens
ctctagtgccctccacagccg

SEQ ID NO: 3718358 - DNA, 17 bp, Homo sapiens
ctctataattgccactg

SEQ ID NO: 3718359 - DNA, 22 bp, Homo sapiens
ctctatatttagattgttaaaa

SEQ ID NO: 3718360 - DNA, 19 bp, Homo sapiens
ctctatggtaaagatatta

SEQ ID NO: 3718361 - DNA, 22 bp, Homo sapiens
ctctattaccactgaagataga

SEQ ID NO: 3718362 - DNA, 10 bp, Homo sapiens
ctctatttaa

SEQ ID NO: 3718363 - DNA, 12 bp, Homo sapiens
ctctatttaaat

SEQ ID NO: 3718364 - DNA, 15 bp, Homo sapiens
ctctatttaaattct

SEQ ID NO: 3718365 - DNA, 16 bp, Homo sapiens
ctctatttaaattctt

SEQ ID NO: 3718366 - DNA, 17 bp, Homo sapiens
ctctatttaaattcttt

SEQ ID NO: 3718367 - DNA, 18 bp, Homo sapiens
ctctatttaaattctttt

SEQ ID NO: 3718368 - DNA, 14 bp, Homo sapiens
ctctatttagcatg

SEQ ID NO: 3718369 - DNA, 16 bp, Homo sapiens
ctctcagaaggtattc

SEQ ID NO: 3718370 - DNA, 23 bp, Homo sapiens
ctctcagccaacgagtaatttat

SEQ ID NO: 3718371 - DNA, 14 bp, Homo sapiens
ctctcaggatcaag

SEQ ID NO: 3718372 - DNA, 21 bp, Homo sapiens
ctctcaggcatgcctgtgtga

SEQ ID NO: 3718373 - DNA, 16 bp, Homo sapiens
ctctccaacctggaca

SEQ ID NO: 3718374 - DNA, 10 bp, Homo sapiens
ctctccacct

SEQ ID NO: 3718375 - DNA, 13 bp, Homo sapiens
ctctccacctcag

SEQ ID NO: 3718376 - DNA, 14 bp, Homo sapiens
ctctccacctcagc

SEQ ID NO: 3718377 - DNA, 17 bp, Homo sapiens
ctctccacctcagcctt

SEQ ID NO: 3718378 - DNA, 12 bp, Homo sapiens
ctctccactgcc

SEQ ID NO: 3718379 - DNA, 12 bp, Homo sapiens
ctctcccaggac

SEQ ID NO: 3718380 - DNA, 14 bp, Homo sapiens
ctctcccatcactt

SEQ ID NO: 3718381 - DNA, 18 bp, Homo sapiens
ctctcccatcacttccct

SEQ ID NO: 3718382 - DNA, 20 bp, Homo sapiens
ctctcccatcacttccctac

SEQ ID NO: 3718383 - DNA, 20 bp, Homo sapiens
ctctccccaatatcctcgct

SEQ ID NO: 3718384 - DNA, 13 bp, Homo sapiens
ctctccccagcaa

SEQ ID NO: 3718385 - DNA, 24 bp, Homo sapiens
ctctccccagcaagtgagagctgg

SEQ ID NO: 3718386 - DNA, 16 bp, Homo sapiens
ctctcccctgccctgc

SEQ ID NO: 3718387 - DNA, 18 bp, Homo sapiens
ctctccctctggccctgc

SEQ ID NO: 3718388 - DNA, 22 bp, Homo sapiens
ctctccctctggccctgccttc

SEQ ID NO: 3718389 - DNA, 13 bp, Homo sapiens
ctctccctggccc

SEQ ID NO: 3718390 - DNA, 12 bp, Homo sapiens
ctctccctgttg

SEQ ID NO: 3718391 - DNA, 21 bp, Homo sapiens
ctctccgaccagacaccttga

SEQ ID NO: 3718392 - DNA, 15 bp, Homo sapiens
ctctccggtctctct

SEQ ID NO: 3718393 - DNA, 15 bp, Homo sapiens
ctctcctcctgccca

SEQ ID NO: 3718394 - DNA, 22 bp, Homo sapiens
ctctcctcttgccactgcctct

SEQ ID NO: 3718395 - DNA, 15 bp, Homo sapiens
ctctcctgggcccct

SEQ ID NO: 3718396 - DNA, 17 bp, Homo sapiens
ctctcctgggcccctcc

SEQ ID NO: 3718397 - DNA, 19 bp, Homo sapiens
ctctcctgggcccctccct

SEQ ID NO: 3718398 - DNA, 18 bp, Homo sapiens
ctctcggaaggctggctg

SEQ ID NO: 3718399 - DNA, 19 bp, Homo sapiens
ctctcggaaggctggctgg

SEQ ID NO: 3718400 - DNA, 22 bp, Homo sapiens
ctctcggaaggctggctgggca

SEQ ID NO: 3718401 - DNA, 19 bp, Homo sapiens
ctctcggagtatctgggaa

SEQ ID NO: 3718402 - DNA, 15 bp, Homo sapiens
ctctctaacctcctt

SEQ ID NO: 3718403 - DNA, 18 bp, Homo sapiens
ctctctaacctcctttac

SEQ ID NO: 3718404 - DNA, 22 bp, Homo sapiens
ctctctacccagcccatcttgc

SEQ ID NO: 3718405 - DNA, 14 bp, Homo sapiens
ctctctccacccta

SEQ ID NO: 3718406 - DNA, 20 bp, Homo sapiens
ctctctccagtcttccacct

SEQ ID NO: 3718407 - DNA, 14 bp, Homo sapiens
ctctctccatcaga

SEQ ID NO: 3718408 - DNA, 17 bp, Homo sapiens
ctctctcctcctgccca

SEQ ID NO: 3718409 - DNA, 12 bp, Homo sapiens
ctctctcttctg

SEQ ID NO: 3718410 - DNA, 21 bp, Homo sapiens
ctctctgcagccagcccagcc

SEQ ID NO: 3718411 - DNA, 14 bp, Homo sapiens
ctctctgcctgtga

SEQ ID NO: 3718412 - DNA, 21 bp, Homo sapiens
ctctctgtaataaactcattt

SEQ ID NO: 3718413 - DNA, 19 bp, Homo sapiens
ctctcttacccttctgtgc

SEQ ID NO: 3718414 - DNA, 23 bp, Homo sapiens
ctctcttatagaatatttattac

SEQ ID NO: 3718415 - DNA, 15 bp, Homo sapiens
ctctcttcctatccc

SEQ ID NO: 3718416 - DNA, 19 bp, Homo sapiens
ctctcttcctatcccatcc

SEQ ID NO: 3718417 - DNA, 15 bp, Homo sapiens
ctctcttctgctcca

SEQ ID NO: 3718418 - DNA, 23 bp, Homo sapiens
ctctgaagagtgggtttcacaag

SEQ ID NO: 3718419 - DNA, 19 bp, Homo sapiens
ctctgaaggacccttcaga

SEQ ID NO: 3718420 - DNA, 19 bp, Homo sapiens
ctctgaagggcatcatgca

SEQ ID NO: 3718421 - DNA, 23 bp, Homo sapiens
ctctgaagggcatcatgcatctt

SEQ ID NO: 3718422 - DNA, 12 bp, Homo sapiens
ctctgaattcca

SEQ ID NO: 3718423 - DNA, 18 bp, Homo sapiens
ctctgaattccaagtaga

SEQ ID NO: 3718424 - DNA, 15 bp, Homo sapiens
ctctgacacacagct

SEQ ID NO: 3718425 - DNA, 16 bp, Homo sapiens
ctctgacacacagctc

SEQ ID NO: 3718426 - DNA, 19 bp, Homo sapiens
ctctgaccgaaacagcgct

SEQ ID NO: 3718427 - DNA, 14 bp, Homo sapiens
ctctgacctgcagg

SEQ ID NO: 3718428 - DNA, 21 bp, Homo sapiens
ctctgactcccaaagagctgc

SEQ ID NO: 3718429 - DNA, 22 bp, Homo sapiens
ctctgactcccaaagagctgcc

SEQ ID NO: 3718430 - DNA, 16 bp, Homo sapiens
ctctgagcaaatgtgg

SEQ ID NO: 3718431 - DNA, 22 bp, Homo sapiens
ctctgagcccctgggactgctg

SEQ ID NO: 3718432 - DNA, 17 bp, Homo sapiens
ctctgaggactgcacca

SEQ ID NO: 3718433 - DNA, 21 bp, Homo sapiens
ctctgagtttaccatttgtaa

SEQ ID NO: 3718434 - DNA, 19 bp, Homo sapiens
ctctgatattccatgaatg

SEQ ID NO: 3718435 - DNA, 17 bp, Homo sapiens
ctctgatcttgtgctca

SEQ ID NO: 3718436 - DNA, 15 bp, Homo sapiens
ctctgattttcaaag

SEQ ID NO: 3718437 - DNA, 19 bp, Homo sapiens
ctctgattttcaaagcttt

SEQ ID NO: 3718438 - DNA, 20 bp, Homo sapiens
ctctgattttcaaagctttt

SEQ ID NO: 3718439 - DNA, 22 bp, Homo sapiens
ctctgcaagaattgaagcagga

SEQ ID NO: 3718440 - DNA, 14 bp, Homo sapiens
ctctgcacaagctg

SEQ ID NO: 3718441 - DNA, 21 bp, Homo sapiens
ctctgcacaagctgcaccctc

SEQ ID NO: 3718442 - DNA, 11 bp, Homo sapiens
ctgcagcctgg

SEQ ID NO: 3718443 - DNA, 20 bp, Homo sapiens
ctgcagcctggaggccgggt

SEQ ID NO: 3718444 - DNA, 14 bp, Homo sapiens
ctgcagctgggctg

SEQ ID NO: 3718445 - DNA, 11 bp, Homo sapiens
ctgcaggcccc

SEQ ID NO: 3718446 - DNA, 17 bp, Homo sapiens
ctgcagggactgccagt

SEQ ID NO: 3718447 - DNA, 17 bp, Homo sapiens
ctgcagggggtgtgtct

SEQ ID NO: 3718448 - DNA, 20 bp, Homo sapiens
ctgcagggggtgtgtctgct

SEQ ID NO: 3718449 - DNA, 22 bp, Homo sapiens
ctgcagtcatcttgaccaagca

SEQ ID NO: 3718450 - DNA, 15 bp, Homo sapiens
ctgcagtgagctgtg

SEQ ID NO: 3718451 - DNA, 20 bp, Homo sapiens
ctgcatagaaggaggagagg

SEQ ID NO: 3718452 - DNA, 13 bp, Homo sapiens
ctgcatcatctgt

SEQ ID NO: 3718453 - DNA, 16 bp, Homo sapiens
ctgcatcgtttcatct

SEQ ID NO: 3718454 - DNA, 14 bp, Homo sapiens
ctgcatctactcag

SEQ ID NO: 3718455 - DNA, 12 bp, Homo sapiens
ctgcatggacct

SEQ ID NO: 3718456 - DNA, 18 bp, Homo sapiens
ctgcatggacctaacatt

SEQ ID NO: 3718457 - DNA, 19 bp, Homo sapiens
ctgcatggacctaacattc

SEQ ID NO: 3718458 - DNA, 22 bp, Homo sapiens
ctgcatggacctaacattcgat

SEQ ID NO: 3718459 - DNA, 19 bp, Homo sapiens
ctgcatggtaatttatagt

SEQ ID NO: 3718460 - DNA, 15 bp, Homo sapiens
ctgcattagaaatta

SEQ ID NO: 3718461 - DNA, 20 bp, Homo sapiens
ctgcattcacccagacagct

SEQ ID NO: 3718462 - DNA, 21 bp, Homo sapiens
ctgcattcacccagacagctc

SEQ ID NO: 3718463 - DNA, 20 bp, Homo sapiens
ctgcattcaggatcaaaccc

SEQ ID NO: 3718464 - DNA, 19 bp, Homo sapiens
ctgcattctgccgtgtgcc

SEQ ID NO: 3718465 - DNA, 23 bp, Homo sapiens
ctgcattgcctgcggtcaaggcc

SEQ ID NO: 3718466 - DNA, 13 bp, Homo sapiens
ctgcattggcttt

SEQ ID NO: 3718467 - DNA, 14 bp, Homo sapiens
ctgcatttagcaca

SEQ ID NO: 3718468 - DNA, 23 bp, Homo sapiens
ctgcatttagcacaaaaaaaatt

SEQ ID NO: 3718469 - DNA, 13 bp, Homo sapiens
ctgcatttgtgaa

SEQ ID NO: 3718470 - DNA, 15 bp, Homo sapiens
ctgcatttgtgaaat

SEQ ID NO: 3718471 - DNA, 18 bp, Homo sapiens
ctgcattttcaccccacc

SEQ ID NO: 3718472 - DNA, 21 bp, Homo sapiens
ctgcattttctgggttctggg

SEQ ID NO: 3718473 - DNA, 18 bp, Homo sapiens
ctgcatttttagaccatt

SEQ ID NO: 3718474 - DNA, 22 bp, Homo sapiens
ctgccaaggccagagtggcctg

SEQ ID NO: 3718475 - DNA, 12 bp, Homo sapiens
ctgccacacagg

SEQ ID NO: 3718476 - DNA, 24 bp, Homo sapiens
ctgccacacgtctgaccctctcca

SEQ ID NO: 3718477 - DNA, 13 bp, Homo sapiens
ctgccacacttca

SEQ ID NO: 3718478 - DNA, 15 bp, Homo sapiens
ctgccaccctgggga

SEQ ID NO: 3718479 - DNA, 20 bp, Homo sapiens
ctgccaccctggggagaaag

SEQ ID NO: 3718480 - DNA, 15 bp, Homo sapiens
ctgccacctgctgct

SEQ ID NO: 3718481 - DNA, 14 bp, Homo sapiens
ctgccacctggggc

SEQ ID NO: 3718482 - DNA, 16 bp, Homo sapiens
ctgccacctggggcag

SEQ ID NO: 3718483 - DNA, 23 bp, Homo sapiens
ctgccactttggtacatggccag

SEQ ID NO: 3718484 - DNA, 22 bp, Homo sapiens
ctgccagacggcacccacccag

SEQ ID NO: 3718485 - DNA, 20 bp, Homo sapiens
ctgccagagaagcatcggag

SEQ ID NO: 3718486 - DNA, 16 bp, Homo sapiens
ctgccagcacccccac

SEQ ID NO: 3718487 - DNA, 15 bp, Homo sapiens
ctgccagccagcagc

SEQ ID NO: 3718488 - DNA, 23 bp, Homo sapiens
ctgccagccagcagccagctctc

SEQ ID NO: 3718489 - DNA, 23 bp, Homo sapiens
ctgccagcctggcttctggagcc

SEQ ID NO: 3718490 - DNA, 17 bp, Homo sapiens
ctgccagtccccctgcc

SEQ ID NO: 3718491 - DNA, 12 bp, Homo sapiens
ctgccagtgcct

SEQ ID NO: 3718492 - DNA, 13 bp, Homo sapiens
ctgccagtgcctt

SEQ ID NO: 3718493 - DNA, 17 bp, Homo sapiens
ctgccagtgccttacct

SEQ ID NO: 3718494 - DNA, 18 bp, Homo sapiens
ctgccagtgccttacctc

SEQ ID NO: 3718495 - DNA, 22 bp, Homo sapiens
ctgccagtgccttacctcctgc

SEQ ID NO: 3718496 - DNA, 21 bp, Homo sapiens
ctgccatattctgttggccag

SEQ ID NO: 3718497 - DNA, 17 bp, Homo sapiens
ctgccatccagggatgc

SEQ ID NO: 3718498 - DNA, 16 bp, Homo sapiens
ctgccatccaggttca

SEQ ID NO: 3718499 - DNA, 23 bp, Homo sapiens
ctgccatgaactggaggccagga

SEQ ID NO: 3718500 - DNA, 15 bp, Homo sapiens
ctgccatgccagctt

SEQ ID NO: 3718501 - DNA, 17 bp, Homo sapiens
ctgccatggaggcacac

SEQ ID NO: 3718502 - DNA, 16 bp, Homo sapiens
ctgccatttctgagat

SEQ ID NO: 3718503 - DNA, 17 bp, Homo sapiens
ctgcccaacctgctctc

SEQ ID NO: 3718504 - DNA, 12 bp, Homo sapiens
ctgcccacccgt

SEQ ID NO: 3718505 - DNA, 21 bp, Homo sapiens
ctgcccagaattcccagctgt

SEQ ID NO: 3718506 - DNA, 13 bp, Homo sapiens
ctgcccagagctg

SEQ ID NO: 3718507 - DNA, 17 bp, Homo sapiens
ctgcccagcctccaagc

SEQ ID NO: 3718508 - DNA, 17 bp, Homo sapiens
ctgcccaggagagccag

SEQ ID NO: 3718509 - DNA, 21 bp, Homo sapiens
ctgcccaggagagccagccct

SEQ ID NO: 3718510 - DNA, 22 bp, Homo sapiens
ctgcccaggagagccagccctc

SEQ ID NO: 3718511 - DNA, 14 bp, Homo sapiens
ctgcccaggcccct

SEQ ID NO: 3718512 - DNA, 20 bp, Homo sapiens
ctgcccaggcccctgccacc

SEQ ID NO: 3718513 - DNA, 12 bp, Homo sapiens
ctgcccagtgtt

SEQ ID NO: 3718514 - DNA, 22 bp, Homo sapiens
ctgcccagtgttgtttgtaaat

SEQ ID NO: 3718515 - DNA, 15 bp, Homo sapiens
ctgccccaaacaaat

SEQ ID NO: 3718516 - DNA, 14 bp, Homo sapiens
ctgccccaactcct

SEQ ID NO: 3718517 - DNA, 20 bp, Homo sapiens
ctgccccaactcctggaagc

SEQ ID NO: 3718518 - DNA, 15 bp, Homo sapiens
ctgccccagctctgg

SEQ ID NO: 3718519 - DNA, 14 bp, Homo sapiens
ctgcccccacacct

SEQ ID NO: 3718520 - DNA, 20 bp, Homo sapiens
ctgcccccacacctggccct

SEQ ID NO: 3718521 - DNA, 17 bp, Homo sapiens
ctgcccccgctcatggg

SEQ ID NO: 3718522 - DNA, 19 bp, Homo sapiens
ctgcccccttctcccacac

SEQ ID NO: 3718523 - DNA, 20 bp, Homo sapiens
ctgcccccttctcccacact

SEQ ID NO: 3718524 - DNA, 22 bp, Homo sapiens
ctgcccccttctcccacactgc

SEQ ID NO: 3718525 - DNA, 23 bp, Homo sapiens
ctgcccccttctcccacactgct

SEQ ID NO: 3718526 - DNA, 16 bp, Homo sapiens
ctgccccgcccagctg

SEQ ID NO: 3718527 - DNA, 22 bp, Homo sapiens
ctgccccgtctcatgaggggcc

SEQ ID NO: 3718528 - DNA, 15 bp, Homo sapiens
ctgcccctcccagaa

SEQ ID NO: 3718529 - DNA, 14 bp, Homo sapiens
ctgcccctccccca

SEQ ID NO: 3718530 - DNA, 16 bp, Homo sapiens
ctgcccctccctgcca

SEQ ID NO: 3718531 - DNA, 11 bp, Homo sapiens
ctgcccctgcc

SEQ ID NO: 3718532 - DNA, 14 bp, Homo sapiens
ctgcccctgccccg

SEQ ID NO: 3718533 - DNA, 11 bp, Homo sapiens
ctgcccctggc

SEQ ID NO: 3718534 - DNA, 19 bp, Homo sapiens
ctgccccttctacactctc

SEQ ID NO: 3718535 - DNA, 21 bp, Homo sapiens
ctgccccttctacactctcct

SEQ ID NO: 3718536 - DNA, 16 bp, Homo sapiens
ctgcccgagctggtgc

SEQ ID NO: 3718537 - DNA, 13 bp, Homo sapiens
ctgcccggggcag

SEQ ID NO: 3718538 - DNA, 15 bp, Homo sapiens
ctgcccgtcttcagc

SEQ ID NO: 3718539 - DNA, 18 bp, Homo sapiens
ctgcccgtcttcagccta

SEQ ID NO: 3718540 - DNA, 21 bp, Homo sapiens
ctgccctagagcacactgtag

SEQ ID NO: 3718541 - DNA, 22 bp, Homo sapiens
ctgccctagctccacaccctct

SEQ ID NO: 3718542 - DNA, 12 bp, Homo sapiens
ctgccctaggct

SEQ ID NO: 3718543 - DNA, 18 bp, Homo sapiens
ctgccctaggctccgtca

SEQ ID NO: 3718544 - DNA, 14 bp, Homo sapiens
ctgccctccatccc

SEQ ID NO: 3718545 - DNA, 19 bp, Homo sapiens
ctgccctctgttcagtaac

SEQ ID NO: 3718546 - DNA, 11 bp, Homo sapiens
ctgccctgctg

SEQ ID NO: 3718547 - DNA, 21 bp, Homo sapiens
ctgccctgctgccgcctccca

SEQ ID NO: 3718548 - DNA, 19 bp, Homo sapiens
ctgccctgggatgtccaca

SEQ ID NO: 3718549 - DNA, 21 bp, Homo sapiens
ctgccctggtccagggaagct

SEQ ID NO: 3718550 - DNA, 21 bp, Homo sapiens
ctgccctggtgctgccacact

SEQ ID NO: 3718551 - DNA, 21 bp, Homo sapiens
ctgccctgtaccccagcactt

SEQ ID NO: 3718552 - DNA, 15 bp, Homo sapiens
ctgcccttgtcccac

SEQ ID NO: 3718553 - DNA, 22 bp, Homo sapiens
ctgccgaccgaggctggagctg

SEQ ID NO: 3718554 - DNA, 23 bp, Homo sapiens
ctgccgaccgaggctggagctgg

SEQ ID NO: 3718555 - DNA, 12 bp, Homo sapiens
ctgggtgcccac

SEQ ID NO: 3718556 - DNA, 13 bp, Homo sapiens
ctgggtgcccaca

SEQ ID NO: 3718557 - DNA, 14 bp, Homo sapiens
ctgggtgcccacag

SEQ ID NO: 3718558 - DNA, 15 bp, Homo sapiens
ctgggtgctccctac

SEQ ID NO: 3718559 - DNA, 18 bp, Homo sapiens
ctgggtggcaccagcagc

SEQ ID NO: 3718560 - DNA, 20 bp, Homo sapiens
ctgggtggcaccagcagcct

SEQ ID NO: 3718561 - DNA, 18 bp, Homo sapiens
ctgggtggggctgctcct

SEQ ID NO: 3718562 - DNA, 20 bp, Homo sapiens
ctgggtggggctgctcctcc

SEQ ID NO: 3718563 - DNA, 21 bp, Homo sapiens
ctgggtggggctgctcctcca

SEQ ID NO: 3718564 - DNA, 21 bp, Homo sapiens
ctgggtggggtgaggaccact

SEQ ID NO: 3718565 - DNA, 18 bp, Homo sapiens
ctgggttggaaaacagta

SEQ ID NO: 3718566 - DNA, 22 bp, Homo sapiens
ctggtaggaatagcatgtcact

SEQ ID NO: 3718567 - DNA, 19 bp, Homo sapiens
ctggtatgggtttctccca

SEQ ID NO: 3718568 - DNA, 19 bp, Homo sapiens
ctggtcaacttgagcatgt

SEQ ID NO: 3718569 - DNA, 20 bp, Homo sapiens
ctggtcacaggactctgcct

SEQ ID NO: 3718570 - DNA, 17 bp, Homo sapiens
ctggtccagggaagctg

SEQ ID NO: 3718571 - DNA, 19 bp, Homo sapiens
ctggtccatgatggagtca

SEQ ID NO: 3718572 - DNA, 14 bp, Homo sapiens
ctggtcccactcag

SEQ ID NO: 3718573 - DNA, 18 bp, Homo sapiens
ctggtcccactcagtcca

SEQ ID NO: 3718574 - DNA, 15 bp, Homo sapiens
ctggtccctgggagg

SEQ ID NO: 3718575 - DNA, 17 bp, Homo sapiens
ctggtcccttgcagcta

SEQ ID NO: 3718576 - DNA, 19 bp, Homo sapiens
ctggtccttccaggccccc

SEQ ID NO: 3718577 - DNA, 20 bp, Homo sapiens
ctggtcttgtggaattggga

SEQ ID NO: 3718578 - DNA, 16 bp, Homo sapiens
ctggtgagcagactgg

SEQ ID NO: 3718579 - DNA, 19 bp, Homo sapiens
ctggtgaggaagctccagt

SEQ ID NO: 3718580 - DNA, 17 bp, Homo sapiens
ctggtgcagggcctcca

SEQ ID NO: 3718581 - DNA, 20 bp, Homo sapiens
ctggtgcagggcctccattc

SEQ ID NO: 3718582 - DNA, 14 bp, Homo sapiens
ctggtgcattacag

SEQ ID NO: 3718583 - DNA, 12 bp, Homo sapiens
ctggtgctgcca

SEQ ID NO: 3718584 - DNA, 14 bp, Homo sapiens
ctggtggcagctgc

SEQ ID NO: 3718585 - DNA, 21 bp, Homo sapiens
ctggtggcccgacagcctggc

SEQ ID NO: 3718586 - DNA, 14 bp, Homo sapiens
ctggtggcctctgc

SEQ ID NO: 3718587 - DNA, 22 bp, Homo sapiens
ctggtgggcaccaagagccaat

SEQ ID NO: 3718588 - DNA, 17 bp, Homo sapiens
ctggtgggcctcctctg

SEQ ID NO: 3718589 - DNA, 13 bp, Homo sapiens
ctggttagcagag

SEQ ID NO: 3718590 - DNA, 14 bp, Homo sapiens
ctggttagctcagc

SEQ ID NO: 3718591 - DNA, 15 bp, Homo sapiens
ctggttagctcagcc

SEQ ID NO: 3718592 - DNA, 21 bp, Homo sapiens
ctggttagctcagccccagcc

SEQ ID NO: 3718593 - DNA, 23 bp, Homo sapiens
ctggttagctcagccccagccca

SEQ ID NO: 3718594 - DNA, 22 bp, Homo sapiens
ctggttaggttaggacttgccc

SEQ ID NO: 3718595 - DNA, 20 bp, Homo sapiens
ctggttcttgtgttggctgt

SEQ ID NO: 3718596 - DNA, 14 bp, Homo sapiens
ctggttgtcatttt

SEQ ID NO: 3718597 - DNA, 20 bp, Homo sapiens
ctgtaaaactttattttata

SEQ ID NO: 3718598 - DNA, 20 bp, Homo sapiens
ctgtaaattattttaaatta

SEQ ID NO: 3718599 - DNA, 22 bp, Homo sapiens
ctgtaaattattttaaattata

SEQ ID NO: 3718600 - DNA, 19 bp, Homo sapiens
ctgtaatcatataataaat

SEQ ID NO: 3718601 - DNA, 13 bp, Homo sapiens
ctgtaatcccagc

SEQ ID NO: 3718602 - DNA, 20 bp, Homo sapiens
ctgtaatcccagcactttgg

SEQ ID NO: 3718603 - DNA, 22 bp, Homo sapiens
ctgtacaaaagggacatgaaat

SEQ ID NO: 3718604 - DNA, 13 bp, Homo sapiens
ctgtacaaagtag

SEQ ID NO: 3718605 - DNA, 17 bp, Homo sapiens
ctgtacaatatttaaaa

SEQ ID NO: 3718606 - DNA, 20 bp, Homo sapiens
ctgtacacactttatttact

SEQ ID NO: 3718607 - DNA, 19 bp, Homo sapiens
ctgtacactgaatatttat

SEQ ID NO: 3718608 - DNA, 20 bp, Homo sapiens
ctgtacatatttgagactag

SEQ ID NO: 3718609 - DNA, 18 bp, Homo sapiens
ctgtacgtctgacaggca

SEQ ID NO: 3718610 - DNA, 20 bp, Homo sapiens
ctgtacgtctgacaggcaat

SEQ ID NO: 3718611 - DNA, 22 bp, Homo sapiens
ctgtactagtctgtgtgggact

SEQ ID NO: 3718612 - DNA, 13 bp, Homo sapiens
ctgtactcaggag

SEQ ID NO: 3718613 - DNA, 15 bp, Homo sapiens
ctgtactcctcccag

SEQ ID NO: 3718614 - DNA, 16 bp, Homo sapiens
ctgtactcctcccagg

SEQ ID NO: 3718615 - DNA, 13 bp, Homo sapiens
ctgtacttaataa

SEQ ID NO: 3718616 - DNA, 22 bp, Homo sapiens
ctgtagacctagggaggacctt

SEQ ID NO: 3718617 - DNA, 15 bp, Homo sapiens
ctgtagagtgggagc

SEQ ID NO: 3718618 - DNA, 16 bp, Homo sapiens
ctgtagatgctgggcc

SEQ ID NO: 3718619 - DNA, 17 bp, Homo sapiens
ctgtagcattacagtgg

SEQ ID NO: 3718620 - DNA, 18 bp, Homo sapiens
ctgtagtaaactatttat

SEQ ID NO: 3718621 - DNA, 18 bp, Homo sapiens
ctgtagtactccttaaga

SEQ ID NO: 3718622 - DNA, 23 bp, Homo sapiens
ctgtagtactccttaagaacaca

SEQ ID NO: 3718623 - DNA, 15 bp, Homo sapiens
ctgtagtcccagcta

SEQ ID NO: 3718624 - DNA, 18 bp, Homo sapiens
ctgtagtcccagctactc

SEQ ID NO: 3718625 - DNA, 23 bp, Homo sapiens
ctgtagtcccagctactcaggag

SEQ ID NO: 3718626 - DNA, 22 bp, Homo sapiens
ctgtagtcctagccactcagga

SEQ ID NO: 3718627 - DNA, 14 bp, Homo sapiens
ctgtagtctcagga

SEQ ID NO: 3718628 - DNA, 15 bp, Homo sapiens
ctgtagtctcaggac

SEQ ID NO: 3718629 - DNA, 15 bp, Homo sapiens
ctgtagttaggaaat

SEQ ID NO: 3718630 - DNA, 15 bp, Homo sapiens
ctgtatagtactggc

SEQ ID NO: 3718631 - DNA, 19 bp, Homo sapiens
ctgtatatacaataacata

SEQ ID NO: 3718632 - DNA, 19 bp, Homo sapiens
ctgtatcaacccagaaaca

SEQ ID NO: 3718633 - DNA, 22 bp, Homo sapiens
ctgtatcccatgagcctcagca

SEQ ID NO: 3718634 - DNA, 14 bp, Homo sapiens
ctgtatctgtgtag

SEQ ID NO: 3718635 - DNA, 18 bp, Homo sapiens
ctgtatttatgtgtgagg

SEQ ID NO: 3718636 - DNA, 23 bp, Homo sapiens
ctgtatttatgtgtgaggagctg

SEQ ID NO: 3718637 - DNA, 18 bp, Homo sapiens
ctgtatttgaatcagcct

SEQ ID NO: 3718638 - DNA, 22 bp, Homo sapiens
ctgtcaaacaaagccagaagct

SEQ ID NO: 3718639 - DNA, 22 bp, Homo sapiens
ctgtcaagttaacaaggaatgc

SEQ ID NO: 3718640 - DNA, 13 bp, Homo sapiens
ctgtcaataaaca

SEQ ID NO: 3718641 - DNA, 19 bp, Homo sapiens
ctgtcacgcagccaccagg

SEQ ID NO: 3718642 - DNA, 22 bp, Homo sapiens
ctgtcagatgggaagacatgaa

SEQ ID NO: 3718643 - DNA, 17 bp, Homo sapiens
ctgtcatttgagcaggg

SEQ ID NO: 3718644 - DNA, 23 bp, Homo sapiens
ctgtcatttgagcagggctcagc

SEQ ID NO: 3718645 - DNA, 18 bp, Homo sapiens
ctgtccaaaggaggctgg

SEQ ID NO: 3718646 - DNA, 19 bp, Homo sapiens
ctgtccaaaggaggctggc

SEQ ID NO: 3718647 - DNA, 16 bp, Homo sapiens
ctgtccaacctaaccc

SEQ ID NO: 3718648 - DNA, 18 bp, Homo sapiens
ctgtccagagagagaagt

SEQ ID NO: 3718649 - DNA, 17 bp, Homo sapiens
ctgtccagcctgggcag

SEQ ID NO: 3718650 - DNA, 18 bp, Homo sapiens
ctgtccagcctgggcagc

SEQ ID NO: 3718651 - DNA, 19 bp, Homo sapiens
ctgtccaggcactgctgcc

SEQ ID NO: 3718652 - DNA, 21 bp, Homo sapiens
ctgtccaggcactgctgccca

SEQ ID NO: 3718653 - DNA, 19 bp, Homo sapiens
ctgtccagggccctgagct

SEQ ID NO: 3718654 - DNA, 22 bp, Homo sapiens
ctgtcccagtgccgagaaggaa

SEQ ID NO: 3718655 - DNA, 15 bp, Homo sapiens
ctgtccctctcaggc

SEQ ID NO: 3718656 - DNA, 16 bp, Homo sapiens
ctgtccctggccatct

SEQ ID NO: 3718657 - DNA, 17 bp, Homo sapiens
ctgtccctggccatctc

SEQ ID NO: 3718658 - DNA, 18 bp, Homo sapiens
ctgtcctgacctgtctca

SEQ ID NO: 3718659 - DNA, 13 bp, Homo sapiens
ctgtcctgggagt

SEQ ID NO: 3718660 - DNA, 14 bp, Homo sapiens
ctgtcctgggagtg

SEQ ID NO: 3718661 - DNA, 12 bp, Homo sapiens
ctgtccttaccc

SEQ ID NO: 3718662 - DNA, 16 bp, Homo sapiens
ctgtccttgcacactc

SEQ ID NO: 3718663 - DNA, 16 bp, Homo sapiens
ctgtcgtgccagtcct

SEQ ID NO: 3718664 - DNA, 14 bp, Homo sapiens
ctgtctaccatctc

SEQ ID NO: 3718665 - DNA, 23 bp, Homo sapiens
ctgtctcaaaaaaacacaaaagt

SEQ ID NO: 3718666 - DNA, 22 bp, Homo sapiens
ctgtctcaagagggcactggtg

SEQ ID NO: 3718667 - DNA, 18 bp, Homo sapiens
cttctacactctcctggg

SEQ ID NO: 3718668 - DNA, 15 bp, Homo sapiens
cttctactgcttcta

SEQ ID NO: 3718669 - DNA, 13 bp, Homo sapiens
cttctacttctgc

SEQ ID NO: 3718670 - DNA, 21 bp, Homo sapiens
cttctacttctgcccttgcca

SEQ ID NO: 3718671 - DNA, 17 bp, Homo sapiens
cttctagaaccaggcaa

SEQ ID NO: 3718672 - DNA, 13 bp, Homo sapiens
cttctattttatt

SEQ ID NO: 3718673 - DNA, 15 bp, Homo sapiens
cttctattttgtaaa

SEQ ID NO: 3718674 - DNA, 16 bp, Homo sapiens
cttctattttgtaaac

SEQ ID NO: 3718675 - DNA, 13 bp, Homo sapiens
cttctcaggctct

SEQ ID NO: 3718676 - DNA, 20 bp, Homo sapiens
cttctcaggctctgccctgc

SEQ ID NO: 3718677 - DNA, 21 bp, Homo sapiens
cttctcaggctctgccctgcc

SEQ ID NO: 3718678 - DNA, 22 bp, Homo sapiens
cttctcatagcattaactaatc

SEQ ID NO: 3718679 - DNA, 16 bp, Homo sapiens
cttctccaccctgctc

SEQ ID NO: 3718680 - DNA, 14 bp, Homo sapiens
cttctccactggat

SEQ ID NO: 3718681 - DNA, 15 bp, Homo sapiens
cttctccactggatg

SEQ ID NO: 3718682 - DNA, 17 bp, Homo sapiens
cttctccagacaaacca

SEQ ID NO: 3718683 - DNA, 23 bp, Homo sapiens
cttctccagacaaaccagaagca

SEQ ID NO: 3718684 - DNA, 17 bp, Homo sapiens
cttctccatctggcagg

SEQ ID NO: 3718685 - DNA, 14 bp, Homo sapiens
cttctcccacactg

SEQ ID NO: 3718686 - DNA, 20 bp, Homo sapiens
cttctccttgataacagcta

SEQ ID NO: 3718687 - DNA, 17 bp, Homo sapiens
cttctcctttcacaacc

SEQ ID NO: 3718688 - DNA, 15 bp, Homo sapiens
cttctctacagactt

SEQ ID NO: 3718689 - DNA, 14 bp, Homo sapiens
cttctctcacctcc

SEQ ID NO: 3718690 - DNA, 15 bp, Homo sapiens
cttctctcacctcct

SEQ ID NO: 3718691 - DNA, 13 bp, Homo sapiens
cttctctgcccat

SEQ ID NO: 3718692 - DNA, 13 bp, Homo sapiens
cttctctgctcca

SEQ ID NO: 3718693 - DNA, 22 bp, Homo sapiens
cttctctgctccaccacatcct

SEQ ID NO: 3718694 - DNA, 21 bp, Homo sapiens
cttctctgtgaacgatttaga

SEQ ID NO: 3718695 - DNA, 22 bp, Homo sapiens
cttctctgtgaacgatttagaa

SEQ ID NO: 3718696 - DNA, 12 bp, Homo sapiens
cttctcttaatt

SEQ ID NO: 3718697 - DNA, 15 bp, Homo sapiens
cttctcttaatttaa

SEQ ID NO: 3718698 - DNA, 20 bp, Homo sapiens
cttctctttaactcaggact

SEQ ID NO: 3718699 - DNA, 22 bp, Homo sapiens
cttctctttaactcaggactcc

SEQ ID NO: 3718700 - DNA, 15 bp, Homo sapiens
cttctgaccacactt

SEQ ID NO: 3718701 - DNA, 17 bp, Homo sapiens
cttctgaccacacttcc

SEQ ID NO: 3718702 - DNA, 18 bp, Homo sapiens
cttctgaccacacttcct

SEQ ID NO: 3718703 - DNA, 13 bp, Homo sapiens
cttctgactgctg

SEQ ID NO: 3718704 - DNA, 22 bp, Homo sapiens
cttctgcccatcctgtctgttc

SEQ ID NO: 3718705 - DNA, 12 bp, Homo sapiens
cttctgcctgca

SEQ ID NO: 3718706 - DNA, 12 bp, Homo sapiens
cttctgctccac

SEQ ID NO: 3718707 - DNA, 21 bp, Homo sapiens
cttctgctccacccttggcct

SEQ ID NO: 3718708 - DNA, 13 bp, Homo sapiens
cttctggagccct

SEQ ID NO: 3718709 - DNA, 14 bp, Homo sapiens
cttctgtacgtctg

SEQ ID NO: 3718710 - DNA, 15 bp, Homo sapiens
cttctgtacgtctga

SEQ ID NO: 3718711 - DNA, 21 bp, Homo sapiens
cttctgtagtactccttaaga

SEQ ID NO: 3718712 - DNA, 16 bp, Homo sapiens
cttctgtcatctacct

SEQ ID NO: 3718713 - DNA, 19 bp, Homo sapiens
cttctgtcctactctgtgt

SEQ ID NO: 3718714 - DNA, 20 bp, Homo sapiens
cttctgtgagacccccacac

SEQ ID NO: 3718715 - DNA, 12 bp, Homo sapiens
cttctgtgccca

SEQ ID NO: 3718716 - DNA, 15 bp, Homo sapiens
cttctgtgcccagct

SEQ ID NO: 3718717 - DNA, 22 bp, Homo sapiens
cttctgtggctcacagaaccct

SEQ ID NO: 3718718 - DNA, 22 bp, Homo sapiens
cttcttattctcactccaccac

SEQ ID NO: 3718719 - DNA, 17 bp, Homo sapiens
cttcttcagccacctct

SEQ ID NO: 3718720 - DNA, 17 bp, Homo sapiens
cttcttcggggaactcc

SEQ ID NO: 3718721 - DNA, 20 bp, Homo sapiens
cttcttcggggaactcctgg

SEQ ID NO: 3718722 - DNA, 14 bp, Homo sapiens
cttcttcttcagaa

SEQ ID NO: 3718723 - DNA, 14 bp, Homo sapiens
cttcttggctttgt

SEQ ID NO: 3718724 - DNA, 13 bp, Homo sapiens
cttcttgttcccc

SEQ ID NO: 3718725 - DNA, 23 bp, Homo sapiens
cttcttttaagatgtgtcttcaa

SEQ ID NO: 3718726 - DNA, 23 bp, Homo sapiens
cttctttttattttcttttgtaa

SEQ ID NO: 3718727 - DNA, 16 bp, Homo sapiens
cttcttttttttcatt

SEQ ID NO: 3718728 - DNA, 17 bp, Homo sapiens
cttgaaagaaaggggca

SEQ ID NO: 3718729 - DNA, 15 bp, Homo sapiens
cttgaacactggggg

SEQ ID NO: 3718730 - DNA, 15 bp, Homo sapiens
cttgaacccaggagg

SEQ ID NO: 3718731 - DNA, 18 bp, Homo sapiens
cttgaactcctggcctca

SEQ ID NO: 3718732 - DNA, 18 bp, Homo sapiens
cttgaactgggtacttgt

SEQ ID NO: 3718733 - DNA, 20 bp, Homo sapiens
cttgaagatcgttagtatct

SEQ ID NO: 3718734 - DNA, 21 bp, Homo sapiens
cttgaagccactgaagctggg

SEQ ID NO: 3718735 - DNA, 16 bp, Homo sapiens
cttgacagaacactgt

SEQ ID NO: 3718736 - DNA, 19 bp, Homo sapiens
cttgaccaagcaggaagct

SEQ ID NO: 3718737 - DNA, 20 bp, Homo sapiens
cttgaccagcagatcccagc

SEQ ID NO: 3718738 - DNA, 23 bp, Homo sapiens
cttgaccagcagatcccagctca

SEQ ID NO: 3718739 - DNA, 12 bp, Homo sapiens
cttgagaaacct

SEQ ID NO: 3718740 - DNA, 11 bp, Homo sapiens
cttgagaactt

SEQ ID NO: 3718741 - DNA, 16 bp, Homo sapiens
cttgagcatgttactg

SEQ ID NO: 3718742 - DNA, 13 bp, Homo sapiens
cttgagccagtaa

SEQ ID NO: 3718743 - DNA, 15 bp, Homo sapiens
cttgagcccaggagt

SEQ ID NO: 3718744 - DNA, 16 bp, Homo sapiens
cttgagctgagatgga

SEQ ID NO: 3718745 - DNA, 20 bp, Homo sapiens
cttgagggttgggctggtgt

SEQ ID NO: 3718746 - DNA, 21 bp, Homo sapiens
cttgagggttgggctggtgtc

SEQ ID NO: 3718747 - DNA, 14 bp, Homo sapiens
cttgaggtcttttg

SEQ ID NO: 3718748 - DNA, 16 bp, Homo sapiens
cttgagtgctcagtag

SEQ ID NO: 3718749 - DNA, 21 bp, Homo sapiens
cttgagttgattcagctctgc

SEQ ID NO: 3718750 - DNA, 21 bp, Homo sapiens
cttgataatgttgtggtttgt

SEQ ID NO: 3718751 - DNA, 16 bp, Homo sapiens
cttgatgactggaatt

SEQ ID NO: 3718752 - DNA, 20 bp, Homo sapiens
cttgatgactggaattttta

SEQ ID NO: 3718753 - DNA, 22 bp, Homo sapiens
cttgatgagtgtaacaagaaag

SEQ ID NO: 3718754 - DNA, 16 bp, Homo sapiens
cttgatggtcagacac

SEQ ID NO: 3718755 - DNA, 16 bp, Homo sapiens
cttgatggtttatgtt

SEQ ID NO: 3718756 - DNA, 18 bp, Homo sapiens
cttgatgtgttatctctt

SEQ ID NO: 3718757 - DNA, 18 bp, Homo sapiens
cttgattcacaatgaaat

SEQ ID NO: 3718758 - DNA, 14 bp, Homo sapiens
cttgcaacacacag

SEQ ID NO: 3718759 - DNA, 14 bp, Homo sapiens
cttgcaatggcagc

SEQ ID NO: 3718760 - DNA, 17 bp, Homo sapiens
cttgcaatggcagcctt

SEQ ID NO: 3718761 - DNA, 23 bp, Homo sapiens
cttgcacactcccctgcactgga

SEQ ID NO: 3718762 - DNA, 19 bp, Homo sapiens
cttgcacgcccatgtgtga

SEQ ID NO: 3718763 - DNA, 13 bp, Homo sapiens
cttgcagagaagc

SEQ ID NO: 3718764 - DNA, 20 bp, Homo sapiens
cttgcataataagctaaaga

SEQ ID NO: 3718765 - DNA, 17 bp, Homo sapiens
cttgccactgcactcca

SEQ ID NO: 3718766 - DNA, 22 bp, Homo sapiens
cttgcccagagatgcctccacc

SEQ ID NO: 3718767 - DNA, 14 bp, Homo sapiens
cttgcccagggctc

SEQ ID NO: 3718768 - DNA, 16 bp, Homo sapiens
cttgcccagggctcag

SEQ ID NO: 3718769 - DNA, 19 bp, Homo sapiens
cttgcccagggctcagcct

SEQ ID NO: 3718770 - DNA, 19 bp, Homo sapiens
cttgccccccaccccagcc

SEQ ID NO: 3718771 - DNA, 15 bp, Homo sapiens
cttgccctagatgag

SEQ ID NO: 3718772 - DNA, 15 bp, Homo sapiens
cttgccgaaactgga

SEQ ID NO: 3718773 - DNA, 17 bp, Homo sapiens
cttgccgaaactggaag

SEQ ID NO: 3718774 - DNA, 14 bp, Homo sapiens
cttgcctagggcct

SEQ ID NO: 3718775 - DNA, 18 bp, Homo sapiens
cttgcctagggcctggtc

SEQ ID NO: 3718776 - DNA, 20 bp, Homo sapiens
cttgctagctatgtgacctt

SEQ ID NO: 3718777 - DNA, 16 bp, Homo sapiens
cttgctctatctcaca

SEQ ID NO: 3718778 - DNA, 22 bp, Homo sapiens
cttgctctgctgacagacacag

SEQ ID NO: 3718779 - DNA, 19 bp, Homo sapiens
cttgctgctattttactgt

SEQ ID NO: 3718780 - DNA, 17 bp, Homo sapiens
ctttttaagcttattta

SEQ ID NO: 3718781 - DNA, 15 bp, Homo sapiens
ctttttaataaaaag

SEQ ID NO: 3718782 - DNA, 19 bp, Homo sapiens
ctttttattgatgtgcaaa

SEQ ID NO: 3718783 - DNA, 18 bp, Homo sapiens
ctttttattttttaatta

SEQ ID NO: 3718784 - DNA, 15 bp, Homo sapiens
ctttttcaagattga

SEQ ID NO: 3718785 - DNA, 21 bp, Homo sapiens
ctttttcaagattgatcattt

SEQ ID NO: 3718786 - DNA, 13 bp, Homo sapiens
ctttttccagagg

SEQ ID NO: 3718787 - DNA, 13 bp, Homo sapiens
ctttttcttcctc

SEQ ID NO: 3718788 - DNA, 15 bp, Homo sapiens
cttttttcactacat

SEQ ID NO: 3718789 - DNA, 20 bp, Homo sapiens
cttttttgaaataataaatc

SEQ ID NO: 3718790 - DNA, 19 bp, Homo sapiens
gaaaaaaaagtttcagaga

SEQ ID NO: 3718791 - DNA, 20 bp, Homo sapiens
gaaaaaaaataacacagaga

SEQ ID NO: 3718792 - DNA, 14 bp, Homo sapiens
gaaaaaaactttta

SEQ ID NO: 3718793 - DNA, 20 bp, Homo sapiens
gaaaaaaagtttgccagaag

SEQ ID NO: 3718794 - DNA, 23 bp, Homo sapiens
gaaaaaaataattttatgaactg

SEQ ID NO: 3718795 - DNA, 21 bp, Homo sapiens
gaaaaaagaagtgtccgagaa

SEQ ID NO: 3718796 - DNA, 17 bp, Homo sapiens
gaaaaaatacattttat

SEQ ID NO: 3718797 - DNA, 19 bp, Homo sapiens
gaaaaaatattttcctgcc

SEQ ID NO: 3718798 - DNA, 15 bp, Homo sapiens
gaaaaacaataagag

SEQ ID NO: 3718799 - DNA, 18 bp, Homo sapiens
gaaaaacatctgaaagcc

SEQ ID NO: 3718800 - DNA, 16 bp, Homo sapiens
gaaaaagaaaaaatat

SEQ ID NO: 3718801 - DNA, 12 bp, Homo sapiens
gaaaaaggagga

SEQ ID NO: 3718802 - DNA, 18 bp, Homo sapiens
gaaaaagtatcatggaaa

SEQ ID NO: 3718803 - DNA, 10 bp, Homo sapiens
gaaaaatatg

SEQ ID NO: 3718804 - DNA, 13 bp, Homo sapiens
gaaaaatatttaa

SEQ ID NO: 3718805 - DNA, 14 bp, Homo sapiens
gaaaaatatttaag

SEQ ID NO: 3718806 - DNA, 18 bp, Homo sapiens
gaaaaatccagaaagaaa

SEQ ID NO: 3718807 - DNA, 20 bp, Homo sapiens
gaaaaatgcccttaaatcat

SEQ ID NO: 3718808 - DNA, 16 bp, Homo sapiens
gaaaaatttaagcatt

SEQ ID NO: 3718809 - DNA, 18 bp, Homo sapiens
gaaaaatttaagcattgt

SEQ ID NO: 3718810 - DNA, 14 bp, Homo sapiens
gaaaacaacaaaaa

SEQ ID NO: 3718811 - DNA, 23 bp, Homo sapiens
gaaaacaggaaaaaaacttttat

SEQ ID NO: 3718812 - DNA, 12 bp, Homo sapiens
gaaaacataaaa

SEQ ID NO: 3718813 - DNA, 21 bp, Homo sapiens
gaaaaccaagccgtggcttcc

SEQ ID NO: 3718814 - DNA, 12 bp, Homo sapiens
gaaaacccagag

SEQ ID NO: 3718815 - DNA, 22 bp, Homo sapiens
gaaaacccagagaggaatcaga

SEQ ID NO: 3718816 - DNA, 19 bp, Homo sapiens
gaaaacgttttattgtgtt

SEQ ID NO: 3718817 - DNA, 17 bp, Homo sapiens
gaaaacgttttgtttga

SEQ ID NO: 3718818 - DNA, 18 bp, Homo sapiens
gaaaactacattttaaca

SEQ ID NO: 3718819 - DNA, 19 bp, Homo sapiens
gaaaactacattttaacat

SEQ ID NO: 3718820 - DNA, 20 bp, Homo sapiens
gaaaactacattttaacatg

SEQ ID NO: 3718821 - DNA, 23 bp, Homo sapiens
gaaaagaaaaatgagcctggcaa

SEQ ID NO: 3718822 - DNA, 16 bp, Homo sapiens
gaaaagatacgacttt

SEQ ID NO: 3718823 - DNA, 19 bp, Homo sapiens
gaaaagatacgactttatt

SEQ ID NO: 3718824 - DNA, 22 bp, Homo sapiens
gaaaagatacgactttattttc

SEQ ID NO: 3718825 - DNA, 15 bp, Homo sapiens
gaaaagccatgttta

SEQ ID NO: 3718826 - DNA, 17 bp, Homo sapiens
gaaaagccatgtttaag

SEQ ID NO: 3718827 - DNA, 19 bp, Homo sapiens
gaaaagccatgtttaagat

SEQ ID NO: 3718828 - DNA, 19 bp, Homo sapiens
gaaaaggaggccattctga

SEQ ID NO: 3718829 - DNA, 11 bp, Homo sapiens
gaaaaggcagg

SEQ ID NO: 3718830 - DNA, 20 bp, Homo sapiens
gaaaaggttcttactgcttg

SEQ ID NO: 3718831 - DNA, 18 bp, Homo sapiens
gaaaagtggcaagaccaa

SEQ ID NO: 3718832 - DNA, 12 bp, Homo sapiens
gaaaataaaatt

SEQ ID NO: 3718833 - DNA, 23 bp, Homo sapiens
gaaaataaatcaatgctataact

SEQ ID NO: 3718834 - DNA, 18 bp, Homo sapiens
gaaaatagtttaggagaa

SEQ ID NO: 3718835 - DNA, 18 bp, Homo sapiens
gaaaatgcaacaacatgt

SEQ ID NO: 3718836 - DNA, 20 bp, Homo sapiens
gaaaatgcaacaacatgtat

SEQ ID NO: 3718837 - DNA, 23 bp, Homo sapiens
gaaaatgctgtattagtcacaga

SEQ ID NO: 3718838 - DNA, 20 bp, Homo sapiens
gaaaatgtaagtaaatgtct

SEQ ID NO: 3718839 - DNA, 13 bp, Homo sapiens
gaaaattaacact

SEQ ID NO: 3718840 - DNA, 18 bp, Homo sapiens
gaaaattaggatttcatg

SEQ ID NO: 3718841 - DNA, 22 bp, Homo sapiens
gaaaattaggatttcatgattt

SEQ ID NO: 3718842 - DNA, 18 bp, Homo sapiens
gaaaattccagaaaggat

SEQ ID NO: 3718843 - DNA, 16 bp, Homo sapiens
gaaaattgaatttaac

SEQ ID NO: 3718844 - DNA, 17 bp, Homo sapiens
gaaaattgaatttaaca

SEQ ID NO: 3718845 - DNA, 22 bp, Homo sapiens
gaaaattgaatttaacaatgcg

SEQ ID NO: 3718846 - DNA, 19 bp, Homo sapiens
gaaacaaaaacactaaaaa

SEQ ID NO: 3718847 - DNA, 23 bp, Homo sapiens
gaaacaaaaacactaaaaataaa

SEQ ID NO: 3718848 - DNA, 19 bp, Homo sapiens
gaaacaaagtggaaggaaa

SEQ ID NO: 3718849 - DNA, 20 bp, Homo sapiens
gaaacaaagtggaaggaaag

SEQ ID NO: 3718850 - DNA, 14 bp, Homo sapiens
gaaacacaatattt

SEQ ID NO: 3718851 - DNA, 17 bp, Homo sapiens
gaaacacaccaggctgt

SEQ ID NO: 3718852 - DNA, 17 bp, Homo sapiens
gaaacactgactcctgt

SEQ ID NO: 3718853 - DNA, 17 bp, Homo sapiens
gaaacagagacaggccc

SEQ ID NO: 3718854 - DNA, 14 bp, Homo sapiens
gaaacagatttggt

SEQ ID NO: 3718855 - DNA, 23 bp, Homo sapiens
gaaacatcagttactctgaaggg

SEQ ID NO: 3718856 - DNA, 17 bp, Homo sapiens
gaaacatctcaataaag

SEQ ID NO: 3718857 - DNA, 20 bp, Homo sapiens
gaaacatgactcgtatatgt

SEQ ID NO: 3718858 - DNA, 23 bp, Homo sapiens
gaaaccaatcaagataaaggaca

SEQ ID NO: 3718859 - DNA, 17 bp, Homo sapiens
gaaaccgtcctcttttt

SEQ ID NO: 3718860 - DNA, 17 bp, Homo sapiens
gaaacctacagaatact

SEQ ID NO: 3718861 - DNA, 15 bp, Homo sapiens
gaaacgtgccctctg

SEQ ID NO: 3718862 - DNA, 17 bp, Homo sapiens
gaaactcaccatgtaaa

SEQ ID NO: 3718863 - DNA, 22 bp, Homo sapiens
gaaactcacctgctggcccctc

SEQ ID NO: 3718864 - DNA, 15 bp, Homo sapiens
gaaacttacacacaa

SEQ ID NO: 3718865 - DNA, 22 bp, Homo sapiens
gaaacttcaagcaccagggaag

SEQ ID NO: 3718866 - DNA, 20 bp, Homo sapiens
gaaacttgttagaaatgcaa

SEQ ID NO: 3718867 - DNA, 11 bp, Homo sapiens
gaaacttttct

SEQ ID NO: 3718868 - DNA, 21 bp, Homo sapiens
gaaacttttcttaaaaagtta

SEQ ID NO: 3718869 - DNA, 17 bp, Homo sapiens
gaaagaaaatatgcatc

SEQ ID NO: 3718870 - DNA, 21 bp, Homo sapiens
gaaagaaacccgacagaggga

SEQ ID NO: 3718871 - DNA, 15 bp, Homo sapiens
gaaagaaagaaggaa

SEQ ID NO: 3718872 - DNA, 21 bp, Homo sapiens
gaaagacggattgcattagaa

SEQ ID NO: 3718873 - DNA, 23 bp, Homo sapiens
gaaagagataccaagatgccatc

SEQ ID NO: 3718874 - DNA, 18 bp, Homo sapiens
gaaagagttaagaatgtc

SEQ ID NO: 3718875 - DNA, 23 bp, Homo sapiens
gaaagatggctgtgcctctgcct

SEQ ID NO: 3718876 - DNA, 19 bp, Homo sapiens
gaaagcagaggctggcctc

SEQ ID NO: 3718877 - DNA, 18 bp, Homo sapiens
gaaagcatcacctcaggc

SEQ ID NO: 3718878 - DNA, 15 bp, Homo sapiens
gaaagcatccatgtg

SEQ ID NO: 3718879 - DNA, 22 bp, Homo sapiens
gaaagcatgtggcatgttcatc

SEQ ID NO: 3718880 - DNA, 22 bp, Homo sapiens
gaaagctgattactgtcaataa

SEQ ID NO: 3718881 - DNA, 23 bp, Homo sapiens
gaaagctgattactgtcaataaa

SEQ ID NO: 3718882 - DNA, 16 bp, Homo sapiens
gaaaggatatttaaga

SEQ ID NO: 3718883 - DNA, 21 bp, Homo sapiens
gaaaggatatttaagaaaata

SEQ ID NO: 3718884 - DNA, 12 bp, Homo sapiens
gaaaggccagct

SEQ ID NO: 3718885 - DNA, 14 bp, Homo sapiens
gaaaggctcagtct

SEQ ID NO: 3718886 - DNA, 22 bp, Homo sapiens
gaaagggacttggaagctccgc

SEQ ID NO: 3718887 - DNA, 22 bp, Homo sapiens
gaaagggagctatcaggaacag

SEQ ID NO: 3718888 - DNA, 20 bp, Homo sapiens
gaaagggattttcagccctc

SEQ ID NO: 3718889 - DNA, 18 bp, Homo sapiens
gaaaggttaccctgtaac

SEQ ID NO: 3718890 - DNA, 14 bp, Homo sapiens
gaaagtaatttctt

SEQ ID NO: 3718891 - DNA, 17 bp, Homo sapiens
gaaagtcatgaacacat

SEQ ID NO: 3718892 - DNA, 23 bp, Homo sapiens
gacacaaacaaacaagctaggtg

SEQ ID NO: 3718893 - DNA, 14 bp, Homo sapiens
gacacacacagctt

SEQ ID NO: 3718894 - DNA, 13 bp, Homo sapiens
gacacacagctct

SEQ ID NO: 3718895 - DNA, 15 bp, Homo sapiens
gacacacgcacacac

SEQ ID NO: 3718896 - DNA, 21 bp, Homo sapiens
gacacagctcttctccaggct

SEQ ID NO: 3718897 - DNA, 22 bp, Homo sapiens
gacacagctcttctccaggctg

SEQ ID NO: 3718898 - DNA, 21 bp, Homo sapiens
gacacaggatagataactctt

SEQ ID NO: 3718899 - DNA, 12 bp, Homo sapiens
gacacaggcccg

SEQ ID NO: 3718900 - DNA, 15 bp, Homo sapiens
gacacaggcccggct

SEQ ID NO: 3718901 - DNA, 17 bp, Homo sapiens
gacacaggcccggctcc

SEQ ID NO: 3718902 - DNA, 21 bp, Homo sapiens
gacacaggcccggctccaggc

SEQ ID NO: 3718903 - DNA, 17 bp, Homo sapiens
gacacctactgagtggc

SEQ ID NO: 3718904 - DNA, 13 bp, Homo sapiens
gacacctcagagc

SEQ ID NO: 3718905 - DNA, 16 bp, Homo sapiens
gacacctgcacctccc

SEQ ID NO: 3718906 - DNA, 19 bp, Homo sapiens
gacacctgcacctcccccc

SEQ ID NO: 3718907 - DNA, 22 bp, Homo sapiens
gacacctgcacctccccccact

SEQ ID NO: 3718908 - DNA, 15 bp, Homo sapiens
gacaccttgacaggg

SEQ ID NO: 3718909 - DNA, 15 bp, Homo sapiens
gacacttcagagagc

SEQ ID NO: 3718910 - DNA, 14 bp, Homo sapiens
gacagaacactgtc

SEQ ID NO: 3718911 - DNA, 13 bp, Homo sapiens
gacagaagaaggc

SEQ ID NO: 3718912 - DNA, 16 bp, Homo sapiens
gacagacacaggcccg

SEQ ID NO: 3718913 - DNA, 22 bp, Homo sapiens
gacagacacaggcccggctcca

SEQ ID NO: 3718914 - DNA, 15 bp, Homo sapiens
gacagacttgagaac

SEQ ID NO: 3718915 - DNA, 21 bp, Homo sapiens
gacagagccccaccctcagat

SEQ ID NO: 3718916 - DNA, 12 bp, Homo sapiens
gacagaggcagc

SEQ ID NO: 3718917 - DNA, 20 bp, Homo sapiens
gacagagggaaacacagcag

SEQ ID NO: 3718918 - DNA, 19 bp, Homo sapiens
gacagagtgagactctgtc

SEQ ID NO: 3718919 - DNA, 23 bp, Homo sapiens
gacagatcatagatttctgattt

SEQ ID NO: 3718920 - DNA, 19 bp, Homo sapiens
gacagatctctgctttgga

SEQ ID NO: 3718921 - DNA, 19 bp, Homo sapiens
gacagatgccccagagctg

SEQ ID NO: 3718922 - DNA, 20 bp, Homo sapiens
gacagatgccccagagctgt

SEQ ID NO: 3718923 - DNA, 18 bp, Homo sapiens
gacagcagctcaggcaca

SEQ ID NO: 3718924 - DNA, 21 bp, Homo sapiens
gacagcatggtgcatgccgct

SEQ ID NO: 3718925 - DNA, 22 bp, Homo sapiens
gacagcatggtgcatgccgctg

SEQ ID NO: 3718926 - DNA, 17 bp, Homo sapiens
gacagcccactgagaag

SEQ ID NO: 3718927 - DNA, 16 bp, Homo sapiens
gacagcctcccacccc

SEQ ID NO: 3718928 - DNA, 12 bp, Homo sapiens
gacagcctggca

SEQ ID NO: 3718929 - DNA, 15 bp, Homo sapiens
gacagctccttctgt

SEQ ID NO: 3718930 - DNA, 16 bp, Homo sapiens
gacagctgtccctgtc

SEQ ID NO: 3718931 - DNA, 18 bp, Homo sapiens
gacagctgtccctgtcac

SEQ ID NO: 3718932 - DNA, 19 bp, Homo sapiens
gacagctgtccctgtcacc

SEQ ID NO: 3718933 - DNA, 22 bp, Homo sapiens
gacagctgtccctgtcaccaag

SEQ ID NO: 3718934 - DNA, 15 bp, Homo sapiens
gacagctgtgctgta

SEQ ID NO: 3718935 - DNA, 22 bp, Homo sapiens
gacagcttctcatcctgcaggc

SEQ ID NO: 3718936 - DNA, 13 bp, Homo sapiens
gacaggacctgac

SEQ ID NO: 3718937 - DNA, 18 bp, Homo sapiens
gacaggagacctggcact

SEQ ID NO: 3718938 - DNA, 18 bp, Homo sapiens
gacaggatgtttgctcag

SEQ ID NO: 3718939 - DNA, 20 bp, Homo sapiens
gacaggcaagcacctcctgc

SEQ ID NO: 3718940 - DNA, 18 bp, Homo sapiens
gacaggcatgttctctga

SEQ ID NO: 3718941 - DNA, 18 bp, Homo sapiens
gacaggccatgtgagcca

SEQ ID NO: 3718942 - DNA, 13 bp, Homo sapiens
gacagggacccac

SEQ ID NO: 3718943 - DNA, 23 bp, Homo sapiens
gacagggcacaccgggcactcag

SEQ ID NO: 3718944 - DNA, 24 bp, Homo sapiens
gacagggcacaccgggcactcaga

SEQ ID NO: 3718945 - DNA, 14 bp, Homo sapiens
gacagggcatggcc

SEQ ID NO: 3718946 - DNA, 13 bp, Homo sapiens
gacagggtcctgc

SEQ ID NO: 3718947 - DNA, 14 bp, Homo sapiens
gacaggtctgggag

SEQ ID NO: 3718948 - DNA, 16 bp, Homo sapiens
gacagtcaaggagtgg

SEQ ID NO: 3718949 - DNA, 14 bp, Homo sapiens
gacagtcctgggag

SEQ ID NO: 3718950 - DNA, 13 bp, Homo sapiens
gacagtgcctggg

SEQ ID NO: 3718951 - DNA, 21 bp, Homo sapiens
gacagtgcctgggaatgtatt

SEQ ID NO: 3718952 - DNA, 16 bp, Homo sapiens
gacagtgcttcagcct

SEQ ID NO: 3718953 - DNA, 20 bp, Homo sapiens
gacagtggattgcatttctt

SEQ ID NO: 3718954 - DNA, 16 bp, Homo sapiens
gacataatttcactga

SEQ ID NO: 3718955 - DNA, 13 bp, Homo sapiens
gacatattcattt

SEQ ID NO: 3718956 - DNA, 13 bp, Homo sapiens
gacatcagcatca

SEQ ID NO: 3718957 - DNA, 18 bp, Homo sapiens
gacatcagcatcacctag

SEQ ID NO: 3718958 - DNA, 20 bp, Homo sapiens
gacatcttcaaagcttgaag

SEQ ID NO: 3718959 - DNA, 21 bp, Homo sapiens
gacatcttcaaagcttgaaga

SEQ ID NO: 3718960 - DNA, 14 bp, Homo sapiens
gacatgaatatgat

SEQ ID NO: 3718961 - DNA, 14 bp, Homo sapiens
gacatgatcttctt

SEQ ID NO: 3718962 - DNA, 21 bp, Homo sapiens
gacatgatggagcgcacctgc

SEQ ID NO: 3718963 - DNA, 17 bp, Homo sapiens
gacatggacccggagct

SEQ ID NO: 3718964 - DNA, 13 bp, Homo sapiens
gacatgtggaaag

SEQ ID NO: 3718965 - DNA, 17 bp, Homo sapiens
gacattaacagttttcc

SEQ ID NO: 3718966 - DNA, 22 bp, Homo sapiens
gacattaacagttttccatgaa

SEQ ID NO: 3718967 - DNA, 23 bp, Homo sapiens
gacattaacagttttccatgaaa

SEQ ID NO: 3718968 - DNA, 17 bp, Homo sapiens
gacattgcggacagcca

SEQ ID NO: 3718969 - DNA, 19 bp, Homo sapiens
gacattgtagagcttctgg

SEQ ID NO: 3718970 - DNA, 17 bp, Homo sapiens
gaccaaaaaaataaggt

SEQ ID NO: 3718971 - DNA, 22 bp, Homo sapiens
gaccaacatggagaaaccctgt

SEQ ID NO: 3718972 - DNA, 14 bp, Homo sapiens
gaccaagagagaaa

SEQ ID NO: 3718973 - DNA, 16 bp, Homo sapiens
gaccaagagagaaaga

SEQ ID NO: 3718974 - DNA, 14 bp, Homo sapiens
gaccaagttataaa

SEQ ID NO: 3718975 - DNA, 12 bp, Homo sapiens
gaccacacctcc

SEQ ID NO: 3718976 - DNA, 20 bp, Homo sapiens
gaccacacttcctgtccaga

SEQ ID NO: 3718977 - DNA, 21 bp, Homo sapiens
gaccacagggttcaaaatgtc

SEQ ID NO: 3718978 - DNA, 16 bp, Homo sapiens
gaccagaagccaaaga

SEQ ID NO: 3718979 - DNA, 22 bp, Homo sapiens
gaccagacaccttgacagggca

SEQ ID NO: 3718980 - DNA, 24 bp, Homo sapiens
gaccagacaccttgacagggcaca

SEQ ID NO: 3718981 - DNA, 16 bp, Homo sapiens
gaccagcagatcccag

SEQ ID NO: 3718982 - DNA, 22 bp, Homo sapiens
gaccagcctggccaacatggta

SEQ ID NO: 3718983 - DNA, 16 bp, Homo sapiens
gaccaggacaggacca

SEQ ID NO: 3718984 - DNA, 16 bp, Homo sapiens
gaccaggactccctcc

SEQ ID NO: 3718985 - DNA, 21 bp, Homo sapiens
gaccaggactccctcctcacc

SEQ ID NO: 3718986 - DNA, 23 bp, Homo sapiens
gaccatccactctaccctcccac

SEQ ID NO: 3718987 - DNA, 21 bp, Homo sapiens
gaccatttataatgttagtag

SEQ ID NO: 3718988 - DNA, 15 bp, Homo sapiens
gaccatttcaggggt

SEQ ID NO: 3718989 - DNA, 13 bp, Homo sapiens
gacccaaggagga

SEQ ID NO: 3718990 - DNA, 14 bp, Homo sapiens
gacccacagcctct

SEQ ID NO: 3718991 - DNA, 23 bp, Homo sapiens
gacccacttcacacacaggcaac

SEQ ID NO: 3718992 - DNA, 22 bp, Homo sapiens
gacccagccccttgagaaacct

SEQ ID NO: 3718993 - DNA, 16 bp, Homo sapiens
gacccaggctgcctga

SEQ ID NO: 3718994 - DNA, 18 bp, Homo sapiens
gacccaggctgcctgagc

SEQ ID NO: 3718995 - DNA, 15 bp, Homo sapiens
gacccagtccctggg

SEQ ID NO: 3718996 - DNA, 12 bp, Homo sapiens
gacccccacccc

SEQ ID NO: 3718997 - DNA, 13 bp, Homo sapiens
gacccccacccct

SEQ ID NO: 3718998 - DNA, 15 bp, Homo sapiens
gacccccaccccttc

SEQ ID NO: 3718999 - DNA, 19 bp, Homo sapiens
gacccccaccccttcccca

SEQ ID NO: 3719000 - DNA, 18 bp, Homo sapiens
gacccccactctcattcc

SEQ ID NO: 3719001 - DNA, 20 bp, Homo sapiens
gacccccagcaaccctccta

SEQ ID NO: 3719002 - DNA, 18 bp, Homo sapiens
gacccccctcaggaccct

SEQ ID NO: 3719003 - DNA, 14 bp, Homo sapiens
gacccctcaccttg

SEQ ID NO: 3719004 - DNA, 14 bp, Homo sapiens
gacccctccatgtg

SEQ ID NO: 3719005 - DNA, 18 bp, Homo sapiens
gaggacatgatggagcgc

SEQ ID NO: 3719006 - DNA, 13 bp, Homo sapiens
gaggaccactcct

SEQ ID NO: 3719007 - DNA, 15 bp, Homo sapiens
gaggaccttatctgt

SEQ ID NO: 3719008 - DNA, 19 bp, Homo sapiens
gaggaccttatctgtgcgt

SEQ ID NO: 3719009 - DNA, 14 bp, Homo sapiens
gaggacttgtgtct

SEQ ID NO: 3719010 - DNA, 16 bp, Homo sapiens
gaggacttttctttgt

SEQ ID NO: 3719011 - DNA, 23 bp, Homo sapiens
gaggacttttctttgtggcttcc

SEQ ID NO: 3719012 - DNA, 13 bp, Homo sapiens
gaggagagacggt

SEQ ID NO: 3719013 - DNA, 15 bp, Homo sapiens
gaggagcttggggga

SEQ ID NO: 3719014 - DNA, 20 bp, Homo sapiens
gaggaggtggcagccctgta

SEQ ID NO: 3719015 - DNA, 15 bp, Homo sapiens
gaggatggagagagg

SEQ ID NO: 3719016 - DNA, 20 bp, Homo sapiens
gaggatgttctgggacacag

SEQ ID NO: 3719017 - DNA, 20 bp, Homo sapiens
gaggattgcttgagctcagg

SEQ ID NO: 3719018 - DNA, 20 bp, Homo sapiens
gaggatttaagggatggaaa

SEQ ID NO: 3719019 - DNA, 20 bp, Homo sapiens
gaggcacacagctgcagaga

SEQ ID NO: 3719020 - DNA, 24 bp, Homo sapiens
gaggcacacagctgcagagacaga

SEQ ID NO: 3719021 - DNA, 18 bp, Homo sapiens
gaggcagaaagcagaggc

SEQ ID NO: 3719022 - DNA, 21 bp, Homo sapiens
gaggcagaaagcagaggctgg

SEQ ID NO: 3719023 - DNA, 23 bp, Homo sapiens
gaggcagaagaattgaacccagg

SEQ ID NO: 3719024 - DNA, 19 bp, Homo sapiens
gaggcagacagcagctcag

SEQ ID NO: 3719025 - DNA, 20 bp, Homo sapiens
gaggcagacagcagctcagg

SEQ ID NO: 3719026 - DNA, 22 bp, Homo sapiens
gaggcagacagcagctcaggca

SEQ ID NO: 3719027 - DNA, 22 bp, Homo sapiens
gaggcagacttccctgaatgta

SEQ ID NO: 3719028 - DNA, 14 bp, Homo sapiens
gaggcagagtgccc

SEQ ID NO: 3719029 - DNA, 9 bp, Homo sapiens
gaggcaggg

SEQ ID NO: 3719030 - DNA, 22 bp, Homo sapiens
gaggcagggaagtccccaggcc

SEQ ID NO: 3719031 - DNA, 20 bp, Homo sapiens
gaggcagggccttgcccaga

SEQ ID NO: 3719032 - DNA, 13 bp, Homo sapiens
gaggcagggtcag

SEQ ID NO: 3719033 - DNA, 14 bp, Homo sapiens
gaggcagggtctca

SEQ ID NO: 3719034 - DNA, 18 bp, Homo sapiens
gaggcagggtctcactct

SEQ ID NO: 3719035 - DNA, 18 bp, Homo sapiens
gaggcaggtgacagtgag

SEQ ID NO: 3719036 - DNA, 14 bp, Homo sapiens
gaggccagccccac

SEQ ID NO: 3719037 - DNA, 12 bp, Homo sapiens
gaggccagcctg

SEQ ID NO: 3719038 - DNA, 14 bp, Homo sapiens
gaggccagcctggc

SEQ ID NO: 3719039 - DNA, 20 bp, Homo sapiens
gaggccatgattcgcccaaa

SEQ ID NO: 3719040 - DNA, 14 bp, Homo sapiens
gaggccccactggg

SEQ ID NO: 3719041 - DNA, 14 bp, Homo sapiens
gaggccttctctga

SEQ ID NO: 3719042 - DNA, 18 bp, Homo sapiens
gaggccttctctgaagga

SEQ ID NO: 3719043 - DNA, 19 bp, Homo sapiens
gaggccttctctgaaggac

SEQ ID NO: 3719044 - DNA, 12 bp, Homo sapiens
gaggcgggtgga

SEQ ID NO: 3719045 - DNA, 20 bp, Homo sapiens
gaggctctaaccacacagcc

SEQ ID NO: 3719046 - DNA, 20 bp, Homo sapiens
gaggctgaaagaggccaatg

SEQ ID NO: 3719047 - DNA, 18 bp, Homo sapiens
gaggctgaggcagaagaa

SEQ ID NO: 3719048 - DNA, 12 bp, Homo sapiens
gaggctgaggcg

SEQ ID NO: 3719049 - DNA, 20 bp, Homo sapiens
gaggctggactccagatctg

SEQ ID NO: 3719050 - DNA, 15 bp, Homo sapiens
gaggctggagctggc

SEQ ID NO: 3719051 - DNA, 16 bp, Homo sapiens
gaggctggaggcaggg

SEQ ID NO: 3719052 - DNA, 19 bp, Homo sapiens
gaggctggaggcagggcct

SEQ ID NO: 3719053 - DNA, 12 bp, Homo sapiens
gaggctggcagg

SEQ ID NO: 3719054 - DNA, 13 bp, Homo sapiens
gaggctggcaggt

SEQ ID NO: 3719055 - DNA, 15 bp, Homo sapiens
gaggctgggccaagc

SEQ ID NO: 3719056 - DNA, 21 bp, Homo sapiens
gaggctgggccaagccaggga

SEQ ID NO: 3719057 - DNA, 16 bp, Homo sapiens
gaggcttcttcagatc

SEQ ID NO: 3719058 - DNA, 19 bp, Homo sapiens
gaggcttgtcagagctggg

SEQ ID NO: 3719059 - DNA, 15 bp, Homo sapiens
gagggaacagacagg

SEQ ID NO: 3719060 - DNA, 19 bp, Homo sapiens
gagggaacagacaggagaa

SEQ ID NO: 3719061 - DNA, 18 bp, Homo sapiens
gagggaccaactgggccc

SEQ ID NO: 3719062 - DNA, 19 bp, Homo sapiens
gagggaccaactgggccca

SEQ ID NO: 3719063 - DNA, 14 bp, Homo sapiens
gagggagaagcatg

SEQ ID NO: 3719064 - DNA, 13 bp, Homo sapiens
gagggaggaatcg

SEQ ID NO: 3719065 - DNA, 15 bp, Homo sapiens
gagggagggcaatag

SEQ ID NO: 3719066 - DNA, 14 bp, Homo sapiens
gagggagtgacaga

SEQ ID NO: 3719067 - DNA, 22 bp, Homo sapiens
gagggagtgacagaggcagccc

SEQ ID NO: 3719068 - DNA, 22 bp, Homo sapiens
gagggatgaggtgctgggaggg

SEQ ID NO: 3719069 - DNA, 15 bp, Homo sapiens
gagggcagaggctgg

SEQ ID NO: 3719070 - DNA, 16 bp, Homo sapiens
gagggcccaggcaggc

SEQ ID NO: 3719071 - DNA, 20 bp, Homo sapiens
gagggcgtgactcacccaag

SEQ ID NO: 3719072 - DNA, 21 bp, Homo sapiens
gagggctgcccggctgcccac

SEQ ID NO: 3719073 - DNA, 13 bp, Homo sapiens
gagggctgccctg

SEQ ID NO: 3719074 - DNA, 21 bp, Homo sapiens
gaggggaggatcactggagcc

SEQ ID NO: 3719075 - DNA, 20 bp, Homo sapiens
gaggggcaacgaagaaaaaa

SEQ ID NO: 3719076 - DNA, 18 bp, Homo sapiens
gaggggcagaacagccgc

SEQ ID NO: 3719077 - DNA, 17 bp, Homo sapiens
gaggggcatctgcccct

SEQ ID NO: 3719078 - DNA, 13 bp, Homo sapiens
gaggggcccgagc

SEQ ID NO: 3719079 - DNA, 13 bp, Homo sapiens
gaggggcctggca

SEQ ID NO: 3719080 - DNA, 14 bp, Homo sapiens
gaggggcctggcag

SEQ ID NO: 3719081 - DNA, 12 bp, Homo sapiens
gaggggctcctg

SEQ ID NO: 3719082 - DNA, 14 bp, Homo sapiens
gagggggagggggt

SEQ ID NO: 3719083 - DNA, 14 bp, Homo sapiens
gaggggtgctctgc

SEQ ID NO: 3719084 - DNA, 13 bp, Homo sapiens
gagggtcagagag

SEQ ID NO: 3719085 - DNA, 15 bp, Homo sapiens
gagggtcaggaagga

SEQ ID NO: 3719086 - DNA, 21 bp, Homo sapiens
gagggtcctggctcctgaggg

SEQ ID NO: 3719087 - DNA, 14 bp, Homo sapiens
gagggtctgaggaa

SEQ ID NO: 3719088 - DNA, 12 bp, Homo sapiens
gagggtggaata

SEQ ID NO: 3719089 - DNA, 19 bp, Homo sapiens
gagggtgggagagcccagc

SEQ ID NO: 3719090 - DNA, 14 bp, Homo sapiens
gagggttgggctgg

SEQ ID NO: 3719091 - DNA, 17 bp, Homo sapiens
gagggttggggaggggc

SEQ ID NO: 3719092 - DNA, 18 bp, Homo sapiens
gagggttgttctcctaga

SEQ ID NO: 3719093 - DNA, 21 bp, Homo sapiens
gaggtaggtggatcacctgag

SEQ ID NO: 3719094 - DNA, 19 bp, Homo sapiens
gaggtatttatctttactt

SEQ ID NO: 3719095 - DNA, 22 bp, Homo sapiens
gaggtcaacagagaaggcagga

SEQ ID NO: 3719096 - DNA, 20 bp, Homo sapiens
gaggtcaagcccaggaggac

SEQ ID NO: 3719097 - DNA, 24 bp, Homo sapiens
gaggtcaagcccaggaggactgcc

SEQ ID NO: 3719098 - DNA, 12 bp, Homo sapiens
gaggtcagagcc

SEQ ID NO: 3719099 - DNA, 17 bp, Homo sapiens
gaggtcagagcctgcag

SEQ ID NO: 3719100 - DNA, 12 bp, Homo sapiens
gaggtcccaggc

SEQ ID NO: 3719101 - DNA, 13 bp, Homo sapiens
gaggtcctggggg

SEQ ID NO: 3719102 - DNA, 21 bp, Homo sapiens
gaggtcctgggggcctgacct

SEQ ID NO: 3719103 - DNA, 22 bp, Homo sapiens
gaggtcgaccccaaagcccctt

SEQ ID NO: 3719104 - DNA, 19 bp, Homo sapiens
gaggtctgctcggccgtct

SEQ ID NO: 3719105 - DNA, 15 bp, Homo sapiens
gaggtgaaagggagc

SEQ ID NO: 3719106 - DNA, 23 bp, Homo sapiens
gaggtgaccccaggtttctatgt

SEQ ID NO: 3719107 - DNA, 18 bp, Homo sapiens
gaggtgcagagtgcccag

SEQ ID NO: 3719108 - DNA, 15 bp, Homo sapiens
gaggtggaagccctc

SEQ ID NO: 3719109 - DNA, 20 bp, Homo sapiens
gaggtggaagccctccttcc

SEQ ID NO: 3719110 - DNA, 19 bp, Homo sapiens
gaggtggaggctgcagtga

SEQ ID NO: 3719111 - DNA, 15 bp, Homo sapiens
gaggtggcagccctg

SEQ ID NO: 3719112 - DNA, 20 bp, Homo sapiens
gaggtggctctggaatgaca

SEQ ID NO: 3719113 - DNA, 11 bp, Homo sapiens
gaggtgggagg

SEQ ID NO: 3719114 - DNA, 16 bp, Homo sapiens
gaggtggtctgaatgt

SEQ ID NO: 3719115 - DNA, 15 bp, Homo sapiens
gaggttaaggctgag

SEQ ID NO: 3719116 - DNA, 22 bp, Homo sapiens
gaggttaggagttcgagaccag

SEQ ID NO: 3719117 - DNA, 22 bp, Homo sapiens
gaggttataggtcactcctggg

SEQ ID NO: 3719118 - DNA, 21 bp, Homo sapiens
gatcccgcctcttcttcttca

SEQ ID NO: 3719119 - DNA, 17 bp, Homo sapiens
gatcctcccacctcagc

SEQ ID NO: 3719120 - DNA, 18 bp, Homo sapiens
gatcctcccacctcagcc

SEQ ID NO: 3719121 - DNA, 20 bp, Homo sapiens
gatcctcccacctcagcctc

SEQ ID NO: 3719122 - DNA, 20 bp, Homo sapiens
gatcctgtctttaaggaaaa

SEQ ID NO: 3719123 - DNA, 13 bp, Homo sapiens
gatcgcagtttgc

SEQ ID NO: 3719124 - DNA, 18 bp, Homo sapiens
gatcgcagtttgcctggt

SEQ ID NO: 3719125 - DNA, 22 bp, Homo sapiens
gatcggaggcttgtcagagctg

SEQ ID NO: 3719126 - DNA, 15 bp, Homo sapiens
gatcgtgctaaattt

SEQ ID NO: 3719127 - DNA, 21 bp, Homo sapiens
gatctcagggaagcccagctc

SEQ ID NO: 3719128 - DNA, 17 bp, Homo sapiens
gatctcattcagtatta

SEQ ID NO: 3719129 - DNA, 14 bp, Homo sapiens
gatctccaaagctt

SEQ ID NO: 3719130 - DNA, 14 bp, Homo sapiens
gatctccctgccgc

SEQ ID NO: 3719131 - DNA, 15 bp, Homo sapiens
gatctccctgccgcc

SEQ ID NO: 3719132 - DNA, 16 bp, Homo sapiens
gatctcttgagcctgg

SEQ ID NO: 3719133 - DNA, 19 bp, Homo sapiens
gatctgaacagaaatacca

SEQ ID NO: 3719134 - DNA, 22 bp, Homo sapiens
gatctgggaccctttccttcct

SEQ ID NO: 3719135 - DNA, 20 bp, Homo sapiens
gatctgggttcactgcaacc

SEQ ID NO: 3719136 - DNA, 23 bp, Homo sapiens
gatctgtatatttttttctaaga

SEQ ID NO: 3719137 - DNA, 20 bp, Homo sapiens
gatcttgctctatctcacag

SEQ ID NO: 3719138 - DNA, 13 bp, Homo sapiens
gatcttgtgctca

SEQ ID NO: 3719139 - DNA, 17 bp, Homo sapiens
gatctttgcagacaggc

SEQ ID NO: 3719140 - DNA, 16 bp, Homo sapiens
gatgaagcaaacacat

SEQ ID NO: 3719141 - DNA, 19 bp, Homo sapiens
gatgaatgaggtcccaggc

SEQ ID NO: 3719142 - DNA, 21 bp, Homo sapiens
gatgacccaggctgcctgagc

SEQ ID NO: 3719143 - DNA, 12 bp, Homo sapiens
gatgacccctcc

SEQ ID NO: 3719144 - DNA, 15 bp, Homo sapiens
gatgactagaggcag

SEQ ID NO: 3719145 - DNA, 18 bp, Homo sapiens
gatgagaattcagctgcc

SEQ ID NO: 3719146 - DNA, 18 bp, Homo sapiens
gatgagcatttagggcaa

SEQ ID NO: 3719147 - DNA, 21 bp, Homo sapiens
gatgagcatttagggcaagga

SEQ ID NO: 3719148 - DNA, 14 bp, Homo sapiens
gatgaggggaggaa

SEQ ID NO: 3719149 - DNA, 14 bp, Homo sapiens
gatgaggtgctggg

SEQ ID NO: 3719150 - DNA, 19 bp, Homo sapiens
gatgaggtgctgggaggga

SEQ ID NO: 3719151 - DNA, 18 bp, Homo sapiens
gatgagtgtaacaagaaa

SEQ ID NO: 3719152 - DNA, 21 bp, Homo sapiens
gatgagtgtaacaagaaagga

SEQ ID NO: 3719153 - DNA, 13 bp, Homo sapiens
gatgatcctaggc

SEQ ID NO: 3719154 - DNA, 14 bp, Homo sapiens
gatgatcctaggca

SEQ ID NO: 3719155 - DNA, 20 bp, Homo sapiens
gatgatctttgcagacaggc

SEQ ID NO: 3719156 - DNA, 21 bp, Homo sapiens
gatgatctttgcagacaggca

SEQ ID NO: 3719157 - DNA, 23 bp, Homo sapiens
gatgatgacgacgacaacgatga

SEQ ID NO: 3719158 - DNA, 14 bp, Homo sapiens
gatgatgctgccag

SEQ ID NO: 3719159 - DNA, 14 bp, Homo sapiens
gatgcaaggaccag

SEQ ID NO: 3719160 - DNA, 17 bp, Homo sapiens
gatgcaaggaccaggac

SEQ ID NO: 3719161 - DNA, 18 bp, Homo sapiens
gatgcaatgtgctactga

SEQ ID NO: 3719162 - DNA, 15 bp, Homo sapiens
gatgcaccagccctt

SEQ ID NO: 3719163 - DNA, 23 bp, Homo sapiens
gatgcaccagcccttagcaggga

SEQ ID NO: 3719164 - DNA, 14 bp, Homo sapiens
gatgcagtgcttcc

SEQ ID NO: 3719165 - DNA, 17 bp, Homo sapiens
gatgcccactgaggaat

SEQ ID NO: 3719166 - DNA, 12 bp, Homo sapiens
gatgcctccacc

SEQ ID NO: 3719167 - DNA, 17 bp, Homo sapiens
gatgcctccaccgctgc

SEQ ID NO: 3719168 - DNA, 20 bp, Homo sapiens
gatgcctccaccgctgccta

SEQ ID NO: 3719169 - DNA, 14 bp, Homo sapiens
gatgcctgaacttg

SEQ ID NO: 3719170 - DNA, 14 bp, Homo sapiens
gatgcctggtggca

SEQ ID NO: 3719171 - DNA, 18 bp, Homo sapiens
gatgcctggtggcagctg

SEQ ID NO: 3719172 - DNA, 16 bp, Homo sapiens
gatgctccagccaacc

SEQ ID NO: 3719173 - DNA, 13 bp, Homo sapiens
gatgctccctccc

SEQ ID NO: 3719174 - DNA, 20 bp, Homo sapiens
gatgctgaaacaggagagaa

SEQ ID NO: 3719175 - DNA, 17 bp, Homo sapiens
gatgctgactgtactcc

SEQ ID NO: 3719176 - DNA, 20 bp, Homo sapiens
gatgctgactgtactcctcc

SEQ ID NO: 3719177 - DNA, 16 bp, Homo sapiens
gatgctgcctgagtca

SEQ ID NO: 3719178 - DNA, 18 bp, Homo sapiens
gatgctggatgctccttc

SEQ ID NO: 3719179 - DNA, 23 bp, Homo sapiens
gatgcttctcactgccatgccag

SEQ ID NO: 3719180 - DNA, 18 bp, Homo sapiens
gatgcttgtaacaagaaa

SEQ ID NO: 3719181 - DNA, 21 bp, Homo sapiens
gatgcttgtaacaagaaaaca

SEQ ID NO: 3719182 - DNA, 15 bp, Homo sapiens
gatggaaacaaagtg

SEQ ID NO: 3719183 - DNA, 20 bp, Homo sapiens
gatggaacccttttggcccc

SEQ ID NO: 3719184 - DNA, 22 bp, Homo sapiens
gatggaacccttttggcccccg

SEQ ID NO: 3719185 - DNA, 15 bp, Homo sapiens
gatggagagagggga

SEQ ID NO: 3719186 - DNA, 12 bp, Homo sapiens
gatggaggagga

SEQ ID NO: 3719187 - DNA, 21 bp, Homo sapiens
gatggaggggtggtcctgact

SEQ ID NO: 3719188 - DNA, 22 bp, Homo sapiens
gatggccgggcgcggtggctca

SEQ ID NO: 3719189 - DNA, 17 bp, Homo sapiens
gatggctgtgcctctgc

SEQ ID NO: 3719190 - DNA, 18 bp, Homo sapiens
gatggctgtgcctctgcc

SEQ ID NO: 3719191 - DNA, 19 bp, Homo sapiens
gatggctgtgcctctgcct

SEQ ID NO: 3719192 - DNA, 21 bp, Homo sapiens
gatggctttgaatgcggccca

SEQ ID NO: 3719193 - DNA, 14 bp, Homo sapiens
gatgggactgggag

SEQ ID NO: 3719194 - DNA, 20 bp, Homo sapiens
gatgggcaacccccagcctg

SEQ ID NO: 3719195 - DNA, 21 bp, Homo sapiens
gatgggcaacccccagcctgc

SEQ ID NO: 3719196 - DNA, 14 bp, Homo sapiens
gatggggaaggagg

SEQ ID NO: 3719197 - DNA, 15 bp, Homo sapiens
gatggggccacagcc

SEQ ID NO: 3719198 - DNA, 22 bp, Homo sapiens
gatggggtggggtggagaactc

SEQ ID NO: 3719199 - DNA, 21 bp, Homo sapiens
gatggtcctggggctctgtgc

SEQ ID NO: 3719200 - DNA, 23 bp, Homo sapiens
gatggttacactgttagaacact

SEQ ID NO: 3719201 - DNA, 21 bp, Homo sapiens
gatggttcccctgttcactct

SEQ ID NO: 3719202 - DNA, 23 bp, Homo sapiens
gatgtaaataaccccattctttg

SEQ ID NO: 3719203 - DNA, 17 bp, Homo sapiens
gatgtacagttgggaaa

SEQ ID NO: 3719204 - DNA, 23 bp, Homo sapiens
gatgtacagttgggaaaatatgt

SEQ ID NO: 3719205 - DNA, 19 bp, Homo sapiens
gatgtaccatgaaacaaag

SEQ ID NO: 3719206 - DNA, 19 bp, Homo sapiens
gatgtagggtaaggtgcct

SEQ ID NO: 3719207 - DNA, 20 bp, Homo sapiens
gatgtagggtaaggtgcctt

SEQ ID NO: 3719208 - DNA, 19 bp, Homo sapiens
gatgtcatcccattgtctt

SEQ ID NO: 3719209 - DNA, 21 bp, Homo sapiens
gatgtcatcccattgtcttct

SEQ ID NO: 3719210 - DNA, 20 bp, Homo sapiens
gatgtccacagatgcctcca

SEQ ID NO: 3719211 - DNA, 14 bp, Homo sapiens
gatgtctaatagtt

SEQ ID NO: 3719212 - DNA, 16 bp, Homo sapiens
gatgtcttatttttag

SEQ ID NO: 3719213 - DNA, 22 bp, Homo sapiens
gatgtgcaaaaatttttggatt

SEQ ID NO: 3719214 - DNA, 23 bp, Homo sapiens
gatgtgcatttttgtgaaatgaa

SEQ ID NO: 3719215 - DNA, 12 bp, Homo sapiens
gatgtggagcac

SEQ ID NO: 3719216 - DNA, 13 bp, Homo sapiens
gatgtggccctgg

SEQ ID NO: 3719217 - DNA, 20 bp, Homo sapiens
gatgtggccctggcctgctg

SEQ ID NO: 3719218 - DNA, 14 bp, Homo sapiens
gatgttaaccagaa

SEQ ID NO: 3719219 - DNA, 14 bp, Homo sapiens
gatgttctgggaca

SEQ ID NO: 3719220 - DNA, 16 bp, Homo sapiens
gatgttctgggacaca

SEQ ID NO: 3719221 - DNA, 23 bp, Homo sapiens
gatgtttacaggtggacacacaa

SEQ ID NO: 3719222 - DNA, 22 bp, Homo sapiens
gattaagagatgggtttgacaa

SEQ ID NO: 3719223 - DNA, 18 bp, Homo sapiens
gattaaggtctctctttg

SEQ ID NO: 3719224 - DNA, 23 bp, Homo sapiens
gattacaagcgtgagccactgca

SEQ ID NO: 3719225 - DNA, 20 bp, Homo sapiens
gattacaggtgtgaaccacc

SEQ ID NO: 3719226 - DNA, 14 bp, Homo sapiens
gattacatgcatgt

SEQ ID NO: 3719227 - DNA, 17 bp, Homo sapiens
gattactgtcaataaac

SEQ ID NO: 3719228 - DNA, 15 bp, Homo sapiens
gattagtaaagaaat

SEQ ID NO: 3719229 - DNA, 20 bp, Homo sapiens
gattatagattggagccacc

SEQ ID NO: 3719230 - DNA, 20 bp, Homo sapiens
gcatcatctgtagatactag

SEQ ID NO: 3719231 - DNA, 22 bp, Homo sapiens
gcatcattatttgcagagacag

SEQ ID NO: 3719232 - DNA, 16 bp, Homo sapiens
gcatcccaggggacca

SEQ ID NO: 3719233 - DNA, 20 bp, Homo sapiens
gcatcccagtggcctcaacc

SEQ ID NO: 3719234 - DNA, 14 bp, Homo sapiens
gcatcctggcaccc

SEQ ID NO: 3719235 - DNA, 18 bp, Homo sapiens
gcatcctgtctggcattt

SEQ ID NO: 3719236 - DNA, 16 bp, Homo sapiens
gcatctaaactttaat

SEQ ID NO: 3719237 - DNA, 20 bp, Homo sapiens
gcatctatcgagtttgcaat

SEQ ID NO: 3719238 - DNA, 13 bp, Homo sapiens
gcatctcagccca

SEQ ID NO: 3719239 - DNA, 15 bp, Homo sapiens
gcatctcagcccaca

SEQ ID NO: 3719240 - DNA, 16 bp, Homo sapiens
gcatctcctgtgcatg

SEQ ID NO: 3719241 - DNA, 16 bp, Homo sapiens
gcatctgacacaaaaa

SEQ ID NO: 3719242 - DNA, 18 bp, Homo sapiens
gcatctgcccctccccca

SEQ ID NO: 3719243 - DNA, 17 bp, Homo sapiens
gcatcttctcactccct

SEQ ID NO: 3719244 - DNA, 13 bp, Homo sapiens
gcatcttctccat

SEQ ID NO: 3719245 - DNA, 14 bp, Homo sapiens
gcatcttctccatc

SEQ ID NO: 3719246 - DNA, 15 bp, Homo sapiens
gcatgacaagcccca

SEQ ID NO: 3719247 - DNA, 18 bp, Homo sapiens
gcatgacaagccccaggc

SEQ ID NO: 3719248 - DNA, 22 bp, Homo sapiens
gcatgacctgtgaccagcactg

SEQ ID NO: 3719249 - DNA, 14 bp, Homo sapiens
gcatgcagaaaggg

SEQ ID NO: 3719250 - DNA, 15 bp, Homo sapiens
gcatgcattttgcag

SEQ ID NO: 3719251 - DNA, 13 bp, Homo sapiens
gcatgcctgtgtg

SEQ ID NO: 3719252 - DNA, 15 bp, Homo sapiens
gcatgcctgtgtgac

SEQ ID NO: 3719253 - DNA, 14 bp, Homo sapiens
gcatgctctctgca

SEQ ID NO: 3719254 - DNA, 15 bp, Homo sapiens
gcatgctctctgcag

SEQ ID NO: 3719255 - DNA, 16 bp, Homo sapiens
gcatgctggggcaagt

SEQ ID NO: 3719256 - DNA, 17 bp, Homo sapiens
gcatggagtgtgtattg

SEQ ID NO: 3719257 - DNA, 18 bp, Homo sapiens
gcatggagtgtgtattgt

SEQ ID NO: 3719258 - DNA, 20 bp, Homo sapiens
gcatggagtgtgtattgttc

SEQ ID NO: 3719259 - DNA, 24 bp, Homo sapiens
gcatggagtgtgtattgttcccag

SEQ ID NO: 3719260 - DNA, 20 bp, Homo sapiens
gcatggcaaggactgcaggg

SEQ ID NO: 3719261 - DNA, 21 bp, Homo sapiens
gcatggcacctgtcgcccagt

SEQ ID NO: 3719262 - DNA, 18 bp, Homo sapiens
gcatggcagcaggcctgt

SEQ ID NO: 3719263 - DNA, 14 bp, Homo sapiens
gcatggccaggtgg

SEQ ID NO: 3719264 - DNA, 22 bp, Homo sapiens
gcatggcgtagagggtgctgcc

SEQ ID NO: 3719265 - DNA, 23 bp, Homo sapiens
gcatggcgtagagggtgctgccc

SEQ ID NO: 3719266 - DNA, 13 bp, Homo sapiens
gcatggctccagt

SEQ ID NO: 3719267 - DNA, 22 bp, Homo sapiens
gcatggctccagtctgctgccc

SEQ ID NO: 3719268 - DNA, 23 bp, Homo sapiens
gcatggggataaaggagaaggca

SEQ ID NO: 3719269 - DNA, 15 bp, Homo sapiens
gcatgtaggagaatc

SEQ ID NO: 3719270 - DNA, 19 bp, Homo sapiens
gcatgtgtgcgagtgtgtg

SEQ ID NO: 3719271 - DNA, 16 bp, Homo sapiens
gcatgtgtgtgctcag

SEQ ID NO: 3719272 - DNA, 20 bp, Homo sapiens
gcatgtgtttggttctgggg

SEQ ID NO: 3719273 - DNA, 18 bp, Homo sapiens
gcatgttgagccaggcct

SEQ ID NO: 3719274 - DNA, 14 bp, Homo sapiens
gcattacagagagg

SEQ ID NO: 3719275 - DNA, 19 bp, Homo sapiens
gcattacagagaggagaaa

SEQ ID NO: 3719276 - DNA, 17 bp, Homo sapiens
gcattactcttgtaaga

SEQ ID NO: 3719277 - DNA, 19 bp, Homo sapiens
gcattactcttgtaagatt

SEQ ID NO: 3719278 - DNA, 21 bp, Homo sapiens
gcattactcttgtaagatttt

SEQ ID NO: 3719279 - DNA, 24 bp, Homo sapiens
gcattactcttgtaagattttgaa

SEQ ID NO: 3719280 - DNA, 16 bp, Homo sapiens
gcattagaaatagaca

SEQ ID NO: 3719281 - DNA, 14 bp, Homo sapiens
gcattattgcatta

SEQ ID NO: 3719282 - DNA, 13 bp, Homo sapiens
gcattccaggctc

SEQ ID NO: 3719283 - DNA, 12 bp, Homo sapiens
gcattccccact

SEQ ID NO: 3719284 - DNA, 13 bp, Homo sapiens
gcattccctgagt

SEQ ID NO: 3719285 - DNA, 16 bp, Homo sapiens
gcattcctacaaagat

SEQ ID NO: 3719286 - DNA, 13 bp, Homo sapiens
gcattctagtact

SEQ ID NO: 3719287 - DNA, 15 bp, Homo sapiens
gcattctcactccta

SEQ ID NO: 3719288 - DNA, 18 bp, Homo sapiens
gcattctcactcctacct

SEQ ID NO: 3719289 - DNA, 22 bp, Homo sapiens
gcattcttagcctgtggcagta

SEQ ID NO: 3719290 - DNA, 22 bp, Homo sapiens
gcattgagaactgcatatgttt

SEQ ID NO: 3719291 - DNA, 17 bp, Homo sapiens
gcattgatggggaagga

SEQ ID NO: 3719292 - DNA, 12 bp, Homo sapiens
gcattgctttcc

SEQ ID NO: 3719293 - DNA, 20 bp, Homo sapiens
gcattgctttctgaaattag

SEQ ID NO: 3719294 - DNA, 15 bp, Homo sapiens
gcattgttgaggtgg

SEQ ID NO: 3719295 - DNA, 17 bp, Homo sapiens
gcattgtttgcttattg

SEQ ID NO: 3719296 - DNA, 20 bp, Homo sapiens
gcattgtttgcttattgttc

SEQ ID NO: 3719297 - DNA, 21 bp, Homo sapiens
gcattgtttgcttattgttcc

SEQ ID NO: 3719298 - DNA, 17 bp, Homo sapiens
gcatttactttgaattt

SEQ ID NO: 3719299 - DNA, 19 bp, Homo sapiens
gcatttatggtcaacactt

SEQ ID NO: 3719300 - DNA, 13 bp, Homo sapiens
gcatttgctgaat

SEQ ID NO: 3719301 - DNA, 14 bp, Homo sapiens
gcatttgctgaata

SEQ ID NO: 3719302 - DNA, 17 bp, Homo sapiens
gcatttgctgaatacag

SEQ ID NO: 3719303 - DNA, 13 bp, Homo sapiens
gcatttgtcaatg

SEQ ID NO: 3719304 - DNA, 13 bp, Homo sapiens
gcatttgtgatca

SEQ ID NO: 3719305 - DNA, 17 bp, Homo sapiens
gcattttactgtacaga

SEQ ID NO: 3719306 - DNA, 13 bp, Homo sapiens
gcattttctgaaa

SEQ ID NO: 3719307 - DNA, 17 bp, Homo sapiens
gcattttctgaaactaa

SEQ ID NO: 3719308 - DNA, 21 bp, Homo sapiens
gcattttctgaaactaatgaa

SEQ ID NO: 3719309 - DNA, 23 bp, Homo sapiens
gcattttctgaaactaatgaaag

SEQ ID NO: 3719310 - DNA, 22 bp, Homo sapiens
gcattttgctaaatgtgaatga

SEQ ID NO: 3719311 - DNA, 18 bp, Homo sapiens
gcatttttgtgaaatgaa

SEQ ID NO: 3719312 - DNA, 21 bp, Homo sapiens
gcatttttgtgaaatgaaaac

SEQ ID NO: 3719313 - DNA, 22 bp, Homo sapiens
gccaaacccatgaggcaatgtc

SEQ ID NO: 3719314 - DNA, 19 bp, Homo sapiens
gccaaagacttagtatatt

SEQ ID NO: 3719315 - DNA, 20 bp, Homo sapiens
gccaaagccaaagctaggcc

SEQ ID NO: 3719316 - DNA, 22 bp, Homo sapiens
gccaaagctaggcctggccaga

SEQ ID NO: 3719317 - DNA, 16 bp, Homo sapiens
gccaaatatattctct

SEQ ID NO: 3719318 - DNA, 14 bp, Homo sapiens
gccaacccctgtgg

SEQ ID NO: 3719319 - DNA, 23 bp, Homo sapiens
gccaacgacaaagccaaactctg

SEQ ID NO: 3719320 - DNA, 18 bp, Homo sapiens
gccaagatgcttttcaaa

SEQ ID NO: 3719321 - DNA, 17 bp, Homo sapiens
gccaagctccttgggag

SEQ ID NO: 3719322 - DNA, 17 bp, Homo sapiens
gccaaggactgccgacc

SEQ ID NO: 3719323 - DNA, 18 bp, Homo sapiens
gccaaggtgggctgagcc

SEQ ID NO: 3719324 - DNA, 20 bp, Homo sapiens
gccaagtgcaggctggcacc

SEQ ID NO: 3719325 - DNA, 21 bp, Homo sapiens
gccaagttcctctagtgccct

SEQ ID NO: 3719326 - DNA, 15 bp, Homo sapiens
gccaagtttatatac

SEQ ID NO: 3719327 - DNA, 12 bp, Homo sapiens
gccaatgaggtc

SEQ ID NO: 3719328 - DNA, 19 bp, Homo sapiens
gccaatgaggtctgaaatg

SEQ ID NO: 3719329 - DNA, 22 bp, Homo sapiens
gccaatgaggtctgaaatggag

SEQ ID NO: 3719330 - DNA, 19 bp, Homo sapiens
gccaatggagactgtctca

SEQ ID NO: 3719331 - DNA, 19 bp, Homo sapiens
gccaattgaataggatcaa

SEQ ID NO: 3719332 - DNA, 19 bp, Homo sapiens
gccacaccatctcctttca

SEQ ID NO: 3719333 - DNA, 21 bp, Homo sapiens
gccacacgtctgaccctctcc

SEQ ID NO: 3719334 - DNA, 20 bp, Homo sapiens
gccacacttcaggctcttct

SEQ ID NO: 3719335 - DNA, 23 bp, Homo sapiens
gccacacttcaggctcttctcct

SEQ ID NO: 3719336 - DNA, 20 bp, Homo sapiens
gccacagagaaagtacttct

SEQ ID NO: 3719337 - DNA, 16 bp, Homo sapiens
gccacagcagcctctg

SEQ ID NO: 3719338 - DNA, 20 bp, Homo sapiens
gccacagcagcctctgaagt

SEQ ID NO: 3719339 - DNA, 14 bp, Homo sapiens
gccacagccagaac

SEQ ID NO: 3719340 - DNA, 11 bp, Homo sapiens
gccacagctct

SEQ ID NO: 3719341 - DNA, 18 bp, Homo sapiens
gccaccaactggccctct

SEQ ID NO: 3719342 - DNA, 14 bp, Homo sapiens
gccaccatggccag

SEQ ID NO: 3719343 - DNA, 13 bp, Homo sapiens
gccggccctgggg

SEQ ID NO: 3719344 - DNA, 20 bp, Homo sapiens
gccggccctggggctaggct

SEQ ID NO: 3719345 - DNA, 16 bp, Homo sapiens
gccgggtgctcagggc

SEQ ID NO: 3719346 - DNA, 20 bp, Homo sapiens
gccgtcttcactcgcccccg

SEQ ID NO: 3719347 - DNA, 15 bp, Homo sapiens
gccgtgatgcctccc

SEQ ID NO: 3719348 - DNA, 15 bp, Homo sapiens
gccgtgccttcagct

SEQ ID NO: 3719349 - DNA, 17 bp, Homo sapiens
gccgtgccttcagctct

SEQ ID NO: 3719350 - DNA, 19 bp, Homo sapiens
gccgtgccttcagctctac

SEQ ID NO: 3719351 - DNA, 12 bp, Homo sapiens
gccgtggcttcc

SEQ ID NO: 3719352 - DNA, 21 bp, Homo sapiens
gccgtggcttcccgctcagcc

SEQ ID NO: 3719353 - DNA, 23 bp, Homo sapiens
gccgtggtgatttagcaggaagc

SEQ ID NO: 3719354 - DNA, 14 bp, Homo sapiens
gccgttactctcca

SEQ ID NO: 3719355 - DNA, 18 bp, Homo sapiens
gccgttactctccaacct

SEQ ID NO: 3719356 - DNA, 17 bp, Homo sapiens
gcctaaaaatgcaactt

SEQ ID NO: 3719357 - DNA, 14 bp, Homo sapiens
gcctaatccctggg

SEQ ID NO: 3719358 - DNA, 23 bp, Homo sapiens
gcctaatccctgggcattgcttt

SEQ ID NO: 3719359 - DNA, 19 bp, Homo sapiens
gcctactagggacctgggg

SEQ ID NO: 3719360 - DNA, 12 bp, Homo sapiens
gcctactcacga

SEQ ID NO: 3719361 - DNA, 17 bp, Homo sapiens
gcctagatccacacaca

SEQ ID NO: 3719362 - DNA, 18 bp, Homo sapiens
gcctagccgacctcagcc

SEQ ID NO: 3719363 - DNA, 22 bp, Homo sapiens
gcctaggggtcagggaccaagg

SEQ ID NO: 3719364 - DNA, 15 bp, Homo sapiens
gcctagtcagccaca

SEQ ID NO: 3719365 - DNA, 19 bp, Homo sapiens
gcctagtcagccacatggg

SEQ ID NO: 3719366 - DNA, 13 bp, Homo sapiens
gcctatagtccca

SEQ ID NO: 3719367 - DNA, 15 bp, Homo sapiens
gcctatgatcccagc

SEQ ID NO: 3719368 - DNA, 18 bp, Homo sapiens
gcctattgtaaatacaag

SEQ ID NO: 3719369 - DNA, 14 bp, Homo sapiens
gcctcaaccctccc

SEQ ID NO: 3719370 - DNA, 17 bp, Homo sapiens
gcctcaaccctccctca

SEQ ID NO: 3719371 - DNA, 22 bp, Homo sapiens
gcctcaaccctccctcagcccc

SEQ ID NO: 3719372 - DNA, 20 bp, Homo sapiens
gcctcaagtgattctcctgc

SEQ ID NO: 3719373 - DNA, 22 bp, Homo sapiens
gcctcaagtgattctcctgcct

SEQ ID NO: 3719374 - DNA, 23 bp, Homo sapiens
gcctcagaattgatcattttccc

SEQ ID NO: 3719375 - DNA, 18 bp, Homo sapiens
gcctcagcatcctggcac

SEQ ID NO: 3719376 - DNA, 23 bp, Homo sapiens
gcctcagcctcccaaagtgctgg

SEQ ID NO: 3719377 - DNA, 21 bp, Homo sapiens
gcctcagggcagcctgcctgg

SEQ ID NO: 3719378 - DNA, 17 bp, Homo sapiens
gcctcatccgaggcagg

SEQ ID NO: 3719379 - DNA, 22 bp, Homo sapiens
gcctcatccgaggcagggtcag

SEQ ID NO: 3719380 - DNA, 17 bp, Homo sapiens
gcctccaaatgccaact

SEQ ID NO: 3719381 - DNA, 18 bp, Homo sapiens
gcctccaccccccagaac

SEQ ID NO: 3719382 - DNA, 18 bp, Homo sapiens
gcctccaccgctgcctaa

SEQ ID NO: 3719383 - DNA, 21 bp, Homo sapiens
gcctccagccctctcactgtg

SEQ ID NO: 3719384 - DNA, 12 bp, Homo sapiens
gcctccagctca

SEQ ID NO: 3719385 - DNA, 14 bp, Homo sapiens
gcctccatggtgcc

SEQ ID NO: 3719386 - DNA, 17 bp, Homo sapiens
gcctccatggtgcctct

SEQ ID NO: 3719387 - DNA, 18 bp, Homo sapiens
gcctccattcctggagcc

SEQ ID NO: 3719388 - DNA, 21 bp, Homo sapiens
gcctccattcctggagcccga

SEQ ID NO: 3719389 - DNA, 17 bp, Homo sapiens
gcctccattctgaccat

SEQ ID NO: 3719390 - DNA, 18 bp, Homo sapiens
gcctcccaaagtgctggg

SEQ ID NO: 3719391 - DNA, 12 bp, Homo sapiens
gcctcccacccc

SEQ ID NO: 3719392 - DNA, 10 bp, Homo sapiens
gcctcccagc

SEQ ID NO: 3719393 - DNA, 14 bp, Homo sapiens
gcctcccagcctgg

SEQ ID NO: 3719394 - DNA, 12 bp, Homo sapiens
gcctccccacct

SEQ ID NO: 3719395 - DNA, 20 bp, Homo sapiens
gcctcccgaatagctgggac

SEQ ID NO: 3719396 - DNA, 21 bp, Homo sapiens
gcctcccgagtagctgggact

SEQ ID NO: 3719397 - DNA, 23 bp, Homo sapiens
gcctcccgagtagctgggactac

SEQ ID NO: 3719398 - DNA, 18 bp, Homo sapiens
gcctccctcccctgccct

SEQ ID NO: 3719399 - DNA, 21 bp, Homo sapiens
gcctccctctctcttctgctc

SEQ ID NO: 3719400 - DNA, 20 bp, Homo sapiens
gcctccctctgacctgcagg

SEQ ID NO: 3719401 - DNA, 11 bp, Homo sapiens
gcctccctgaa

SEQ ID NO: 3719402 - DNA, 20 bp, Homo sapiens
gcctcctctaacaggggctg

SEQ ID NO: 3719403 - DNA, 22 bp, Homo sapiens
gcctcctctaacaggggctggt

SEQ ID NO: 3719404 - DNA, 23 bp, Homo sapiens
gcctcctctctcagtttttatat

SEQ ID NO: 3719405 - DNA, 13 bp, Homo sapiens
gcctcctgtgtaa

SEQ ID NO: 3719406 - DNA, 18 bp, Homo sapiens
gcctcctgtgtagctggg

SEQ ID NO: 3719407 - DNA, 20 bp, Homo sapiens
gcctccttccttgctgtcct

SEQ ID NO: 3719408 - DNA, 19 bp, Homo sapiens
gcctcgaactcctgggctc

SEQ ID NO: 3719409 - DNA, 17 bp, Homo sapiens
gcctcgaactggctgca

SEQ ID NO: 3719410 - DNA, 20 bp, Homo sapiens
gcctcgaactggctgcaaag

SEQ ID NO: 3719411 - DNA, 14 bp, Homo sapiens
gcctcggagcctca

SEQ ID NO: 3719412 - DNA, 15 bp, Homo sapiens
gcctcggagcctcat

SEQ ID NO: 3719413 - DNA, 17 bp, Homo sapiens
gcctcggagcctcatcc

SEQ ID NO: 3719414 - DNA, 23 bp, Homo sapiens
gcctcggagcctcatccgaggca

SEQ ID NO: 3719415 - DNA, 17 bp, Homo sapiens
gcctctcttcctatccc

SEQ ID NO: 3719416 - DNA, 22 bp, Homo sapiens
gcctctcttcctatcccatccc

SEQ ID NO: 3719417 - DNA, 15 bp, Homo sapiens
gcctctgcattcagg

SEQ ID NO: 3719418 - DNA, 13 bp, Homo sapiens
gcctctgcctctg

SEQ ID NO: 3719419 - DNA, 12 bp, Homo sapiens
gcctctgcctgt

SEQ ID NO: 3719420 - DNA, 13 bp, Homo sapiens
gcctctgcctgtc

SEQ ID NO: 3719421 - DNA, 16 bp, Homo sapiens
gcctctgcctgtgcac

SEQ ID NO: 3719422 - DNA, 20 bp, Homo sapiens
gcctctggaggcctctgggc

SEQ ID NO: 3719423 - DNA, 21 bp, Homo sapiens
gcctctggaggcctctgggcc

SEQ ID NO: 3719424 - DNA, 21 bp, Homo sapiens
gcctctggctagaggccagcc

SEQ ID NO: 3719425 - DNA, 12 bp, Homo sapiens
gcctctgggact

SEQ ID NO: 3719426 - DNA, 13 bp, Homo sapiens
gcctctgggcctc

SEQ ID NO: 3719427 - DNA, 19 bp, Homo sapiens
gcctcttaaagctgcctgt

SEQ ID NO: 3719428 - DNA, 23 bp, Homo sapiens
gcctcttaaagctgcctgtagtt

SEQ ID NO: 3719429 - DNA, 19 bp, Homo sapiens
gcctcttaaataaaccttt

SEQ ID NO: 3719430 - DNA, 20 bp, Homo sapiens
gcctcttcttcttcagaaga

SEQ ID NO: 3719431 - DNA, 20 bp, Homo sapiens
gcctcttgcggtcccttctt

SEQ ID NO: 3719432 - DNA, 15 bp, Homo sapiens
gcctgaagtcacaca

SEQ ID NO: 3719433 - DNA, 16 bp, Homo sapiens
gcctgaagtcacacag

SEQ ID NO: 3719434 - DNA, 17 bp, Homo sapiens
gcctgaagtcacacagt

SEQ ID NO: 3719435 - DNA, 18 bp, Homo sapiens
gcctgaagtcacacagtg

SEQ ID NO: 3719436 - DNA, 20 bp, Homo sapiens
gcctgacctccccctccttc

SEQ ID NO: 3719437 - DNA, 13 bp, Homo sapiens
gcctgagagtatt

SEQ ID NO: 3719438 - DNA, 21 bp, Homo sapiens
gcctgagagtatttaggcaga

SEQ ID NO: 3719439 - DNA, 17 bp, Homo sapiens
gcctgagcacctcccag

SEQ ID NO: 3719440 - DNA, 19 bp, Homo sapiens
gcctgagcacctcccagcc

SEQ ID NO: 3719441 - DNA, 13 bp, Homo sapiens
gcctgaggctgag

SEQ ID NO: 3719442 - DNA, 23 bp, Homo sapiens
gcctgagggcgaggggagggtgg

SEQ ID NO: 3719443 - DNA, 13 bp, Homo sapiens
gcctgcaccagga

SEQ ID NO: 3719444 - DNA, 15 bp, Homo sapiens
gcctgcaccaggaga

SEQ ID NO: 3719445 - DNA, 16 bp, Homo sapiens
gcctgcaccaggagac

SEQ ID NO: 3719446 - DNA, 21 bp, Homo sapiens
gcctgcaccaggagacagaca

SEQ ID NO: 3719447 - DNA, 10 bp, Homo sapiens
gcctgcagcc

SEQ ID NO: 3719448 - DNA, 11 bp, Homo sapiens
gcctgcccagg

SEQ ID NO: 3719449 - DNA, 16 bp, Homo sapiens
gcctgcccctcccaga

SEQ ID NO: 3719450 - DNA, 21 bp, Homo sapiens
gcctgcctagcactcacatgc

SEQ ID NO: 3719451 - DNA, 17 bp, Homo sapiens
gcctgcggcctgctgga

SEQ ID NO: 3719452 - DNA, 19 bp, Homo sapiens
gcctgcggtcaaggccagc

SEQ ID NO: 3719453 - DNA, 16 bp, Homo sapiens
gcctgcgtggctgacc

SEQ ID NO: 3719454 - DNA, 17 bp, Homo sapiens
gcctgcgtggctgaccc

SEQ ID NO: 3719455 - DNA, 22 bp, Homo sapiens
gcctgcgtggctgacccccctc

SEQ ID NO: 3719456 - DNA, 15 bp, Homo sapiens
gctctgcccagagct

SEQ ID NO: 3719457 - DNA, 18 bp, Homo sapiens
gctctgccccagctctgg

SEQ ID NO: 3719458 - DNA, 13 bp, Homo sapiens
gctctgccctgcc

SEQ ID NO: 3719459 - DNA, 13 bp, Homo sapiens
gctctgcctgtgg

SEQ ID NO: 3719460 - DNA, 13 bp, Homo sapiens
gctctgctcctct

SEQ ID NO: 3719461 - DNA, 18 bp, Homo sapiens
gctctgctgacagacaca

SEQ ID NO: 3719462 - DNA, 22 bp, Homo sapiens
gctctggctcacagactggaga

SEQ ID NO: 3719463 - DNA, 21 bp, Homo sapiens
gctctgggatagctgacccag

SEQ ID NO: 3719464 - DNA, 19 bp, Homo sapiens
gctctggtgacaccagcct

SEQ ID NO: 3719465 - DNA, 20 bp, Homo sapiens
gctctggtgacaccagcctt

SEQ ID NO: 3719466 - DNA, 15 bp, Homo sapiens
gctctgtcctgggag

SEQ ID NO: 3719467 - DNA, 14 bp, Homo sapiens
gctctgtgcaggga

SEQ ID NO: 3719468 - DNA, 15 bp, Homo sapiens
gctcttgcagagaag

SEQ ID NO: 3719469 - DNA, 17 bp, Homo sapiens
gctgaaacaggagagaa

SEQ ID NO: 3719470 - DNA, 18 bp, Homo sapiens
gctgaagaattatttttt

SEQ ID NO: 3719471 - DNA, 15 bp, Homo sapiens
gctgaagagtgagga

SEQ ID NO: 3719472 - DNA, 22 bp, Homo sapiens
gctgaagcttattaatgctaag

SEQ ID NO: 3719473 - DNA, 17 bp, Homo sapiens
gctgaatggttttcaaa

SEQ ID NO: 3719474 - DNA, 17 bp, Homo sapiens
gctgacagacacaggcc

SEQ ID NO: 3719475 - DNA, 13 bp, Homo sapiens
gctgaccaagaga

SEQ ID NO: 3719476 - DNA, 20 bp, Homo sapiens
gctgaccaagagagaaagaa

SEQ ID NO: 3719477 - DNA, 19 bp, Homo sapiens
gctgacccagtccctgggg

SEQ ID NO: 3719478 - DNA, 16 bp, Homo sapiens
gctgacctccacagct

SEQ ID NO: 3719479 - DNA, 20 bp, Homo sapiens
gctgaccttgaactcctggg

SEQ ID NO: 3719480 - DNA, 14 bp, Homo sapiens
gctgacgaggctgg

SEQ ID NO: 3719481 - DNA, 18 bp, Homo sapiens
gctgacgaggctgggcca

SEQ ID NO: 3719482 - DNA, 23 bp, Homo sapiens
gctgactagaagggccagtcctg

SEQ ID NO: 3719483 - DNA, 18 bp, Homo sapiens
gctgactgatgttgaggg

SEQ ID NO: 3719484 - DNA, 20 bp, Homo sapiens
gctgactgtggccccctccg

SEQ ID NO: 3719485 - DNA, 15 bp, Homo sapiens
gctgagaatagaagg

SEQ ID NO: 3719486 - DNA, 16 bp, Homo sapiens
gctgagaatagaagga

SEQ ID NO: 3719487 - DNA, 17 bp, Homo sapiens
gctgagaatagaaggaa

SEQ ID NO: 3719488 - DNA, 14 bp, Homo sapiens
gctgagactgcggg

SEQ ID NO: 3719489 - DNA, 20 bp, Homo sapiens
gctgagactggatactgccc

SEQ ID NO: 3719490 - DNA, 22 bp, Homo sapiens
gctgagagacccaaggaggaaa

SEQ ID NO: 3719491 - DNA, 12 bp, Homo sapiens
gctgagccctgg

SEQ ID NO: 3719492 - DNA, 12 bp, Homo sapiens
gctgaggaaagg

SEQ ID NO: 3719493 - DNA, 19 bp, Homo sapiens
gctgaggatttcaagcctg

SEQ ID NO: 3719494 - DNA, 15 bp, Homo sapiens
gctgaggcaggagga

SEQ ID NO: 3719495 - DNA, 16 bp, Homo sapiens
gctgagggaccagcca

SEQ ID NO: 3719496 - DNA, 22 bp, Homo sapiens
gctgaggggaggatcactggag

SEQ ID NO: 3719497 - DNA, 11 bp, Homo sapiens
gctgaggggca

SEQ ID NO: 3719498 - DNA, 23 bp, Homo sapiens
gctgaggggcaacgaagaaaaaa

SEQ ID NO: 3719499 - DNA, 14 bp, Homo sapiens
gctgaggtgggagg

SEQ ID NO: 3719500 - DNA, 23 bp, Homo sapiens
gctgagtgggggatcacagcctc

SEQ ID NO: 3719501 - DNA, 20 bp, Homo sapiens
gctgatatatgtgtttttca

SEQ ID NO: 3719502 - DNA, 16 bp, Homo sapiens
gctgatcgtgctaaat

SEQ ID NO: 3719503 - DNA, 22 bp, Homo sapiens
gctgatctcagggaagcccagc

SEQ ID NO: 3719504 - DNA, 21 bp, Homo sapiens
gctgattactgtcaataaaca

SEQ ID NO: 3719505 - DNA, 19 bp, Homo sapiens
gctgcaccctcaggcaggt

SEQ ID NO: 3719506 - DNA, 19 bp, Homo sapiens
gctgcacctgccagcctgg

SEQ ID NO: 3719507 - DNA, 16 bp, Homo sapiens
gctgcatccgtgagca

SEQ ID NO: 3719508 - DNA, 15 bp, Homo sapiens
gctgccaaattttgg

SEQ ID NO: 3719509 - DNA, 15 bp, Homo sapiens
gctgccaagccccat

SEQ ID NO: 3719510 - DNA, 17 bp, Homo sapiens
gctgccaaggccagagt

SEQ ID NO: 3719511 - DNA, 17 bp, Homo sapiens
gctgccacacttcaggc

SEQ ID NO: 3719512 - DNA, 23 bp, Homo sapiens
gctgccacacttcaggctcttct

SEQ ID NO: 3719513 - DNA, 12 bp, Homo sapiens
gctgccagagaa

SEQ ID NO: 3719514 - DNA, 14 bp, Homo sapiens
gctgccagcacaga

SEQ ID NO: 3719515 - DNA, 21 bp, Homo sapiens
gctgccatccaggttcagctt

SEQ ID NO: 3719516 - DNA, 17 bp, Homo sapiens
gctgcccacacacccca

SEQ ID NO: 3719517 - DNA, 14 bp, Homo sapiens
gctgccccagctga

SEQ ID NO: 3719518 - DNA, 21 bp, Homo sapiens
gctgccccagctgactgtggc

SEQ ID NO: 3719519 - DNA, 20 bp, Homo sapiens
gctgccccatgaagccacag

SEQ ID NO: 3719520 - DNA, 21 bp, Homo sapiens
gctgccccatgaagccacagc

SEQ ID NO: 3719521 - DNA, 21 bp, Homo sapiens
gctgcccccgctcatgggccc

SEQ ID NO: 3719522 - DNA, 19 bp, Homo sapiens
gctgcccgtcttcagccta

SEQ ID NO: 3719523 - DNA, 19 bp, Homo sapiens
gctgccctccatcccgaca

SEQ ID NO: 3719524 - DNA, 12 bp, Homo sapiens
gctgccctggtg

SEQ ID NO: 3719525 - DNA, 13 bp, Homo sapiens
gctgccctggtgc

SEQ ID NO: 3719526 - DNA, 19 bp, Homo sapiens
gctgccctggtgctgccac

SEQ ID NO: 3719527 - DNA, 17 bp, Homo sapiens
gctgcctaagtggctgc

SEQ ID NO: 3719528 - DNA, 12 bp, Homo sapiens
gctgcctcactt

SEQ ID NO: 3719529 - DNA, 13 bp, Homo sapiens
gctgcctccccaa

SEQ ID NO: 3719530 - DNA, 12 bp, Homo sapiens
gctgcctccctg

SEQ ID NO: 3719531 - DNA, 15 bp, Homo sapiens
gctgcctgagcacct

SEQ ID NO: 3719532 - DNA, 16 bp, Homo sapiens
gctgcctgtagttagg

SEQ ID NO: 3719533 - DNA, 19 bp, Homo sapiens
gctgcctgtagttaggaaa

SEQ ID NO: 3719534 - DNA, 20 bp, Homo sapiens
gctgcctgtagttaggaaat

SEQ ID NO: 3719535 - DNA, 12 bp, Homo sapiens
gctgcctgttca

SEQ ID NO: 3719536 - DNA, 17 bp, Homo sapiens
gctgcctgttcagctcc

SEQ ID NO: 3719537 - DNA, 22 bp, Homo sapiens
gctgcctgttcagctccagctc

SEQ ID NO: 3719538 - DNA, 15 bp, Homo sapiens
gctgccttagaacct

SEQ ID NO: 3719539 - DNA, 20 bp, Homo sapiens
gctgctaatcttcagggcac

SEQ ID NO: 3719540 - DNA, 11 bp, Homo sapiens
gctgctcctcc

SEQ ID NO: 3719541 - DNA, 14 bp, Homo sapiens
gctgctcctccagg

SEQ ID NO: 3719542 - DNA, 13 bp, Homo sapiens
gctgctctgccca

SEQ ID NO: 3719543 - DNA, 18 bp, Homo sapiens
gctgctctgcccagagct

SEQ ID NO: 3719544 - DNA, 19 bp, Homo sapiens
gctgctctgcccagagctg

SEQ ID NO: 3719545 - DNA, 20 bp, Homo sapiens
gctgctctgcccagagctgg

SEQ ID NO: 3719546 - DNA, 12 bp, Homo sapiens
gctgctggagga

SEQ ID NO: 3719547 - DNA, 12 bp, Homo sapiens
gctgcttccctc

SEQ ID NO: 3719548 - DNA, 14 bp, Homo sapiens
gctgcttccctctg

SEQ ID NO: 3719549 - DNA, 21 bp, Homo sapiens
gctgcttccctctgcctgtcc

SEQ ID NO: 3719550 - DNA, 21 bp, Homo sapiens
gctgcttcttaaccccagtaa

SEQ ID NO: 3719551 - DNA, 18 bp, Homo sapiens
gctggaccttgaactggg

SEQ ID NO: 3719552 - DNA, 22 bp, Homo sapiens
gctggactccagatctgcaccg

SEQ ID NO: 3719553 - DNA, 13 bp, Homo sapiens
gctggactggctg

SEQ ID NO: 3719554 - DNA, 12 bp, Homo sapiens
gctggagctggc

SEQ ID NO: 3719555 - DNA, 22 bp, Homo sapiens
gctggagctggcgtctgtcttc

SEQ ID NO: 3719556 - DNA, 14 bp, Homo sapiens
gctggagtgcagtg

SEQ ID NO: 3719557 - DNA, 20 bp, Homo sapiens
gctggagtgcggtggtgtga

SEQ ID NO: 3719558 - DNA, 14 bp, Homo sapiens
gctggataaaatga

SEQ ID NO: 3719559 - DNA, 19 bp, Homo sapiens
gctggatctcccagggcta

SEQ ID NO: 3719560 - DNA, 20 bp, Homo sapiens
gctggatctcccagggctac

SEQ ID NO: 3719561 - DNA, 19 bp, Homo sapiens
gctggcaaagacagaagcc

SEQ ID NO: 3719562 - DNA, 18 bp, Homo sapiens
gctggcaccgccttctct

SEQ ID NO: 3719563 - DNA, 13 bp, Homo sapiens
gctggcagcagag

SEQ ID NO: 3719564 - DNA, 19 bp, Homo sapiens
gctggcccccactggctgt

SEQ ID NO: 3719565 - DNA, 12 bp, Homo sapiens
gctggcccctca

SEQ ID NO: 3719566 - DNA, 19 bp, Homo sapiens
gctggcccctcacctgggc

SEQ ID NO: 3719567 - DNA, 20 bp, Homo sapiens
gctggcccctcacctgggca

SEQ ID NO: 3719568 - DNA, 15 bp, Homo sapiens
gctggccgagggtcc

SEQ ID NO: 3719569 - DNA, 12 bp, Homo sapiens
gcttgagcccag

SEQ ID NO: 3719570 - DNA, 23 bp, Homo sapiens
gcttgcaagtatgttttagcatg

SEQ ID NO: 3719571 - DNA, 23 bp, Homo sapiens
gcttgcataataagctaaagagg

SEQ ID NO: 3719572 - DNA, 16 bp, Homo sapiens
gcttgccgaaactgga

SEQ ID NO: 3719573 - DNA, 18 bp, Homo sapiens
gcttgccgaaactggaag

SEQ ID NO: 3719574 - DNA, 22 bp, Homo sapiens
gcttgcctagggcctggtccat

SEQ ID NO: 3719575 - DNA, 13 bp, Homo sapiens
gcttgcctgcagg

SEQ ID NO: 3719576 - DNA, 14 bp, Homo sapiens
gcttgcctgcaggc

SEQ ID NO: 3719577 - DNA, 22 bp, Homo sapiens
gcttgctagctatgtgaccttg

SEQ ID NO: 3719578 - DNA, 13 bp, Homo sapiens
gcttggcagctga

SEQ ID NO: 3719579 - DNA, 13 bp, Homo sapiens
gcttggccagaag

SEQ ID NO: 3719580 - DNA, 23 bp, Homo sapiens
gcttgggtgtaacaggtctcctc

SEQ ID NO: 3719581 - DNA, 17 bp, Homo sapiens
gcttgtaaatagctcag

SEQ ID NO: 3719582 - DNA, 15 bp, Homo sapiens
gcttgtaacaagaaa

SEQ ID NO: 3719583 - DNA, 15 bp, Homo sapiens
gcttgtcagagctgg

SEQ ID NO: 3719584 - DNA, 18 bp, Homo sapiens
gcttgtcagagctgggag

SEQ ID NO: 3719585 - DNA, 18 bp, Homo sapiens
gcttgtcattaccagacg

SEQ ID NO: 3719586 - DNA, 15 bp, Homo sapiens
gcttgtccagcgcct

SEQ ID NO: 3719587 - DNA, 19 bp, Homo sapiens
gcttgtcccctcctcactc

SEQ ID NO: 3719588 - DNA, 17 bp, Homo sapiens
gcttgtgatctgggaac

SEQ ID NO: 3719589 - DNA, 15 bp, Homo sapiens
gctttacaaaaagac

SEQ ID NO: 3719590 - DNA, 18 bp, Homo sapiens
gctttacttagcttatca

SEQ ID NO: 3719591 - DNA, 13 bp, Homo sapiens
gctttatttttta

SEQ ID NO: 3719592 - DNA, 22 bp, Homo sapiens
gctttcccccacttttctctct

SEQ ID NO: 3719593 - DNA, 23 bp, Homo sapiens
gctttcctggagagtctcactcc

SEQ ID NO: 3719594 - DNA, 19 bp, Homo sapiens
gctttctacccagcgagcc

SEQ ID NO: 3719595 - DNA, 13 bp, Homo sapiens
gctttctggagag

SEQ ID NO: 3719596 - DNA, 13 bp, Homo sapiens
gctttcttgctgg

SEQ ID NO: 3719597 - DNA, 15 bp, Homo sapiens
gctttgactgagcag

SEQ ID NO: 3719598 - DNA, 20 bp, Homo sapiens
gctttgattccatctccttg

SEQ ID NO: 3719599 - DNA, 21 bp, Homo sapiens
gctttgcttatggtaataaaa

SEQ ID NO: 3719600 - DNA, 14 bp, Homo sapiens
gctttggaagccat

SEQ ID NO: 3719601 - DNA, 15 bp, Homo sapiens
gctttgggctgccct

SEQ ID NO: 3719602 - DNA, 22 bp, Homo sapiens
gcttttagtacccacctgagct

SEQ ID NO: 3719603 - DNA, 19 bp, Homo sapiens
gcttttccctaagccaagg

SEQ ID NO: 3719604 - DNA, 14 bp, Homo sapiens
gcttttccttgggg

SEQ ID NO: 3719605 - DNA, 20 bp, Homo sapiens
gcttttccttggggcaggca

SEQ ID NO: 3719606 - DNA, 15 bp, Homo sapiens
gcttttgctggtcac

SEQ ID NO: 3719607 - DNA, 15 bp, Homo sapiens
gctttttaatattga

SEQ ID NO: 3719608 - DNA, 14 bp, Homo sapiens
ggaaaaaaactttt

SEQ ID NO: 3719609 - DNA, 14 bp, Homo sapiens
ggaaaaaaatgact

SEQ ID NO: 3719610 - DNA, 23 bp, Homo sapiens
ggaaaaaggacaggcagaaagag

SEQ ID NO: 3719611 - DNA, 21 bp, Homo sapiens
ggaaaaagtatcatggaaata

SEQ ID NO: 3719612 - DNA, 13 bp, Homo sapiens
ggaaaaatagcct

SEQ ID NO: 3719613 - DNA, 23 bp, Homo sapiens
ggaaaaatggatccccagtgaaa

SEQ ID NO: 3719614 - DNA, 21 bp, Homo sapiens
ggaaaaccaagccgtggcttc

SEQ ID NO: 3719615 - DNA, 22 bp, Homo sapiens
ggaaaagagcgcatcaggcctg

SEQ ID NO: 3719616 - DNA, 19 bp, Homo sapiens
ggaaaatcagcctgctcca

SEQ ID NO: 3719617 - DNA, 15 bp, Homo sapiens
ggaaacaggaccaca

SEQ ID NO: 3719618 - DNA, 14 bp, Homo sapiens
ggaaacagtcattt

SEQ ID NO: 3719619 - DNA, 14 bp, Homo sapiens
ggaaactaaaactt

SEQ ID NO: 3719620 - DNA, 17 bp, Homo sapiens
ggaaactgttgccagag

SEQ ID NO: 3719621 - DNA, 16 bp, Homo sapiens
ggaaagaaagaaggaa

SEQ ID NO: 3719622 - DNA, 22 bp, Homo sapiens
ggaaagcagctcaaaggcacag

SEQ ID NO: 3719623 - DNA, 16 bp, Homo sapiens
ggaaaggatattttct

SEQ ID NO: 3719624 - DNA, 18 bp, Homo sapiens
ggaaaggccagctggcag

SEQ ID NO: 3719625 - DNA, 20 bp, Homo sapiens
ggaaaggctctgaaagccag

SEQ ID NO: 3719626 - DNA, 14 bp, Homo sapiens
ggaaagtgaatttg

SEQ ID NO: 3719627 - DNA, 22 bp, Homo sapiens
ggaaataaaaaagtctctattt

SEQ ID NO: 3719628 - DNA, 22 bp, Homo sapiens
ggaaataaaacctttcaaattt

SEQ ID NO: 3719629 - DNA, 16 bp, Homo sapiens
ggaaatatcagttact

SEQ ID NO: 3719630 - DNA, 14 bp, Homo sapiens
ggaaatattatgca

SEQ ID NO: 3719631 - DNA, 17 bp, Homo sapiens
ggaaatgcctaagaaga

SEQ ID NO: 3719632 - DNA, 17 bp, Homo sapiens
ggaaattggaagagcac

SEQ ID NO: 3719633 - DNA, 17 bp, Homo sapiens
ggaacagacaggagaaa

SEQ ID NO: 3719634 - DNA, 19 bp, Homo sapiens
ggaacagcgggagacctgt

SEQ ID NO: 3719635 - DNA, 23 bp, Homo sapiens
ggaacagtgtttcccataatttt

SEQ ID NO: 3719636 - DNA, 19 bp, Homo sapiens
ggaaccagagccatggact

SEQ ID NO: 3719637 - DNA, 15 bp, Homo sapiens
ggaaccgcaggaagc

SEQ ID NO: 3719638 - DNA, 18 bp, Homo sapiens
ggaacctggaccaaagct

SEQ ID NO: 3719639 - DNA, 21 bp, Homo sapiens
ggaactagagggatacactga

SEQ ID NO: 3719640 - DNA, 15 bp, Homo sapiens
ggaactcccaagaac

SEQ ID NO: 3719641 - DNA, 21 bp, Homo sapiens
ggaacttgagcgtgaatctgt

SEQ ID NO: 3719642 - DNA, 14 bp, Homo sapiens
ggaagacaatgtga

SEQ ID NO: 3719643 - DNA, 22 bp, Homo sapiens
ggaagacaatgtgaaaagaaaa

SEQ ID NO: 3719644 - DNA, 13 bp, Homo sapiens
ggaagagaaacag

SEQ ID NO: 3719645 - DNA, 14 bp, Homo sapiens
ggaagagcaggcac

SEQ ID NO: 3719646 - DNA, 18 bp, Homo sapiens
ggaagattttaaattcac

SEQ ID NO: 3719647 - DNA, 16 bp, Homo sapiens
ggaagcacagaaaact

SEQ ID NO: 3719648 - DNA, 19 bp, Homo sapiens
ggaagcacagaaaactaga

SEQ ID NO: 3719649 - DNA, 21 bp, Homo sapiens
ggaagcagtgccttccataat

SEQ ID NO: 3719650 - DNA, 20 bp, Homo sapiens
ggaagcatattgttattata

SEQ ID NO: 3719651 - DNA, 20 bp, Homo sapiens
ggaagcatgtaggagaatcc

SEQ ID NO: 3719652 - DNA, 16 bp, Homo sapiens
ggaagccctccttcca

SEQ ID NO: 3719653 - DNA, 17 bp, Homo sapiens
ggaagccctccttccac

SEQ ID NO: 3719654 - DNA, 11 bp, Homo sapiens
ggaagccctgg

SEQ ID NO: 3719655 - DNA, 15 bp, Homo sapiens
ggaagccctggattt

SEQ ID NO: 3719656 - DNA, 20 bp, Homo sapiens
ggaagcggaggttgcaggga

SEQ ID NO: 3719657 - DNA, 22 bp, Homo sapiens
ggaagcgtgaaggccgagaagc

SEQ ID NO: 3719658 - DNA, 13 bp, Homo sapiens
ggaagctgctccg

SEQ ID NO: 3719659 - DNA, 18 bp, Homo sapiens
ggaagctggccgagggtc

SEQ ID NO: 3719660 - DNA, 17 bp, Homo sapiens
ggaagctgtgtccttgc

SEQ ID NO: 3719661 - DNA, 21 bp, Homo sapiens
ggaagctgtgtccttgcacct

SEQ ID NO: 3719662 - DNA, 19 bp, Homo sapiens
ggaagcttcttaaatgaga

SEQ ID NO: 3719663 - DNA, 19 bp, Homo sapiens
ggaaggacctatgtttgct

SEQ ID NO: 3719664 - DNA, 21 bp, Homo sapiens
ggaaggagactcacctctgcc

SEQ ID NO: 3719665 - DNA, 22 bp, Homo sapiens
ggaaggagactcacctctgcct

SEQ ID NO: 3719666 - DNA, 16 bp, Homo sapiens
ggaaggagagcctgct

SEQ ID NO: 3719667 - DNA, 13 bp, Homo sapiens
ggaaggagggagg

SEQ ID NO: 3719668 - DNA, 20 bp, Homo sapiens
ggaaggagggttagggaggg

SEQ ID NO: 3719669 - DNA, 14 bp, Homo sapiens
ggaaggccacctgc

SEQ ID NO: 3719670 - DNA, 17 bp, Homo sapiens
ggaaggccacctgcagg

SEQ ID NO: 3719671 - DNA, 12 bp, Homo sapiens
ggaagggcagga

SEQ ID NO: 3719672 - DNA, 21 bp, Homo sapiens
ggaagggcaggaaggagagcc

SEQ ID NO: 3719673 - DNA, 18 bp, Homo sapiens
ggaaggggcccgtgggag

SEQ ID NO: 3719674 - DNA, 21 bp, Homo sapiens
ggaaggggcccgtgggagtca

SEQ ID NO: 3719675 - DNA, 17 bp, Homo sapiens
ggaagtctaggagctgg

SEQ ID NO: 3719676 - DNA, 21 bp, Homo sapiens
ggaagtgagggtcagagagga

SEQ ID NO: 3719677 - DNA, 13 bp, Homo sapiens
ggaatattttatt

SEQ ID NO: 3719678 - DNA, 16 bp, Homo sapiens
ggaatcaacagggcag

SEQ ID NO: 3719679 - DNA, 23 bp, Homo sapiens
ggaatcagacttcacactgcaag

SEQ ID NO: 3719680 - DNA, 12 bp, Homo sapiens
ggaatgcagtgg

SEQ ID NO: 3719681 - DNA, 23 bp, Homo sapiens
ggaatgctcccccatcctcccct

SEQ ID NO: 3719682 - DNA, 22 bp, Homo sapiens
ggccatcggtcctgtctcccct

SEQ ID NO: 3719683 - DNA, 21 bp, Homo sapiens
ggccatctctgaacttcagct

SEQ ID NO: 3719684 - DNA, 15 bp, Homo sapiens
ggccatgaactttgt

SEQ ID NO: 3719685 - DNA, 21 bp, Homo sapiens
ggccatgattcgcccaaagcc

SEQ ID NO: 3719686 - DNA, 13 bp, Homo sapiens
ggccatggcagaa

SEQ ID NO: 3719687 - DNA, 15 bp, Homo sapiens
ggccatgtgagccac

SEQ ID NO: 3719688 - DNA, 21 bp, Homo sapiens
ggcccaaattatcaagctaat

SEQ ID NO: 3719689 - DNA, 19 bp, Homo sapiens
ggcccaagagatgaagagt

SEQ ID NO: 3719690 - DNA, 19 bp, Homo sapiens
ggcccacagctcccacccc

SEQ ID NO: 3719691 - DNA, 22 bp, Homo sapiens
ggcccacctaccttcaaagctg

SEQ ID NO: 3719692 - DNA, 16 bp, Homo sapiens
ggcccagaggcacagc

SEQ ID NO: 3719693 - DNA, 16 bp, Homo sapiens
ggccccaaaaccacag

SEQ ID NO: 3719694 - DNA, 12 bp, Homo sapiens
ggccccagagac

SEQ ID NO: 3719695 - DNA, 13 bp, Homo sapiens
ggccccagagact

SEQ ID NO: 3719696 - DNA, 21 bp, Homo sapiens
ggccccagcactaaagcagtg

SEQ ID NO: 3719697 - DNA, 16 bp, Homo sapiens
ggcccccactggctgt

SEQ ID NO: 3719698 - DNA, 15 bp, Homo sapiens
ggcccccgagctggg

SEQ ID NO: 3719699 - DNA, 13 bp, Homo sapiens
ggccccctgcatc

SEQ ID NO: 3719700 - DNA, 19 bp, Homo sapiens
ggccccgcttgtccagcgc

SEQ ID NO: 3719701 - DNA, 21 bp, Homo sapiens
ggccccgcttgtccagcgcct

SEQ ID NO: 3719702 - DNA, 12 bp, Homo sapiens
ggcccctgccac

SEQ ID NO: 3719703 - DNA, 16 bp, Homo sapiens
ggcccctgccaccctg

SEQ ID NO: 3719704 - DNA, 16 bp, Homo sapiens
ggcccctgcccggctg

SEQ ID NO: 3719705 - DNA, 14 bp, Homo sapiens
ggcccctgctggtt

SEQ ID NO: 3719706 - DNA, 23 bp, Homo sapiens
ggcccctgctggttcagggttgg

SEQ ID NO: 3719707 - DNA, 20 bp, Homo sapiens
ggccccttcacttctgacca

SEQ ID NO: 3719708 - DNA, 22 bp, Homo sapiens
ggccccttcacttctgaccaca

SEQ ID NO: 3719709 - DNA, 15 bp, Homo sapiens
ggcccgacagcctgg

SEQ ID NO: 3719710 - DNA, 15 bp, Homo sapiens
ggcccgcctggcaga

SEQ ID NO: 3719711 - DNA, 19 bp, Homo sapiens
ggcccgcctggcagaactg

SEQ ID NO: 3719712 - DNA, 23 bp, Homo sapiens
ggcccggcgcggtggctcacgcc

SEQ ID NO: 3719713 - DNA, 13 bp, Homo sapiens
ggcccggggctgg

SEQ ID NO: 3719714 - DNA, 20 bp, Homo sapiens
ggccctcacccctgccctgg

SEQ ID NO: 3719715 - DNA, 21 bp, Homo sapiens
ggccctcacccctgccctggg

SEQ ID NO: 3719716 - DNA, 19 bp, Homo sapiens
ggccctgagctcggtggac

SEQ ID NO: 3719717 - DNA, 11 bp, Homo sapiens
ggccctggggc

SEQ ID NO: 3719718 - DNA, 14 bp, Homo sapiens
ggccctggggcctg

SEQ ID NO: 3719719 - DNA, 15 bp, Homo sapiens
ggccctggtccttcc

SEQ ID NO: 3719720 - DNA, 13 bp, Homo sapiens
ggcccttcctctc

SEQ ID NO: 3719721 - DNA, 15 bp, Homo sapiens
ggcccttcctctcca

SEQ ID NO: 3719722 - DNA, 18 bp, Homo sapiens
ggcccttcctctccactg

SEQ ID NO: 3719723 - DNA, 21 bp, Homo sapiens
ggcccttgcagttcagcacca

SEQ ID NO: 3719724 - DNA, 18 bp, Homo sapiens
ggccgagggtcctggctc

SEQ ID NO: 3719725 - DNA, 14 bp, Homo sapiens
ggccgggcacagct

SEQ ID NO: 3719726 - DNA, 15 bp, Homo sapiens
ggccgggcacagctg

SEQ ID NO: 3719727 - DNA, 16 bp, Homo sapiens
ggcctcaaccctccct

SEQ ID NO: 3719728 - DNA, 19 bp, Homo sapiens
ggcctcaaccctccctcag

SEQ ID NO: 3719729 - DNA, 21 bp, Homo sapiens
ggcctcaaccctccctcagcc

SEQ ID NO: 3719730 - DNA, 14 bp, Homo sapiens
ggcctcaagtgatt

SEQ ID NO: 3719731 - DNA, 15 bp, Homo sapiens
ggcctcagctgcctc

SEQ ID NO: 3719732 - DNA, 11 bp, Homo sapiens
ggcctcagggc

SEQ ID NO: 3719733 - DNA, 20 bp, Homo sapiens
ggcctccagccctctcactg

SEQ ID NO: 3719734 - DNA, 17 bp, Homo sapiens
ggcctccattcctggag

SEQ ID NO: 3719735 - DNA, 21 bp, Homo sapiens
ggcctccattcctggagcccg

SEQ ID NO: 3719736 - DNA, 15 bp, Homo sapiens
ggcctccctctctct

SEQ ID NO: 3719737 - DNA, 15 bp, Homo sapiens
ggcctcctctaacag

SEQ ID NO: 3719738 - DNA, 14 bp, Homo sapiens
ggcctcctgtgtgt

SEQ ID NO: 3719739 - DNA, 13 bp, Homo sapiens
ggcctcggagcct

SEQ ID NO: 3719740 - DNA, 15 bp, Homo sapiens
ggcctcggagcctca

SEQ ID NO: 3719741 - DNA, 22 bp, Homo sapiens
ggcctcggagcctcatccgagg

SEQ ID NO: 3719742 - DNA, 20 bp, Homo sapiens
ggcctcggtgtggagaagcg

SEQ ID NO: 3719743 - DNA, 19 bp, Homo sapiens
ggcctcttccgtgacgtca

SEQ ID NO: 3719744 - DNA, 19 bp, Homo sapiens
ggcctcttgggtcccccac

SEQ ID NO: 3719745 - DNA, 16 bp, Homo sapiens
ggcctgacctccccct

SEQ ID NO: 3719746 - DNA, 19 bp, Homo sapiens
ggcctgacctccccctcct

SEQ ID NO: 3719747 - DNA, 20 bp, Homo sapiens
ggcctgacctccccctcctt

SEQ ID NO: 3719748 - DNA, 17 bp, Homo sapiens
ggcctgaggagcagcag

SEQ ID NO: 3719749 - DNA, 17 bp, Homo sapiens
ggcctgatgctccctcc

SEQ ID NO: 3719750 - DNA, 22 bp, Homo sapiens
ggcctgatgctccctcccctgc

SEQ ID NO: 3719751 - DNA, 13 bp, Homo sapiens
ggcctgcactaat

SEQ ID NO: 3719752 - DNA, 21 bp, Homo sapiens
ggcctggccagatgcaccagc

SEQ ID NO: 3719753 - DNA, 16 bp, Homo sapiens
ggcctggccaggagct

SEQ ID NO: 3719754 - DNA, 14 bp, Homo sapiens
ggcctggctccgct

SEQ ID NO: 3719755 - DNA, 21 bp, Homo sapiens
ggcctggtccatgatggagtc

SEQ ID NO: 3719756 - DNA, 19 bp, Homo sapiens
ggcctgtacaaaagggaca

SEQ ID NO: 3719757 - DNA, 11 bp, Homo sapiens
ggcctgttgcc

SEQ ID NO: 3719758 - DNA, 16 bp, Homo sapiens
ggccttctctgaagga

SEQ ID NO: 3719759 - DNA, 13 bp, Homo sapiens
ggccttgcccaga

SEQ ID NO: 3719760 - DNA, 14 bp, Homo sapiens
ggccttgcccagag

SEQ ID NO: 3719761 - DNA, 15 bp, Homo sapiens
ggccttgcccagaga

SEQ ID NO: 3719762 - DNA, 23 bp, Homo sapiens
ggcctttgcttatgaatatttat

SEQ ID NO: 3719763 - DNA, 14 bp, Homo sapiens
ggcgcaagcctgta

SEQ ID NO: 3719764 - DNA, 22 bp, Homo sapiens
ggcgcaagcctgtaatcccagc

SEQ ID NO: 3719765 - DNA, 16 bp, Homo sapiens
ggcgggagcatctctt

SEQ ID NO: 3719766 - DNA, 15 bp, Homo sapiens
ggcgtctgtcttcaa

SEQ ID NO: 3719767 - DNA, 19 bp, Homo sapiens
ggcgtgcagtggtgcgatc

SEQ ID NO: 3719768 - DNA, 16 bp, Homo sapiens
ggcgtggagccaggga

SEQ ID NO: 3719769 - DNA, 19 bp, Homo sapiens
ggcgtggagccagggagcg

SEQ ID NO: 3719770 - DNA, 17 bp, Homo sapiens
ggctactcagcagccct

SEQ ID NO: 3719771 - DNA, 18 bp, Homo sapiens
ggctactcagcagccctc

SEQ ID NO: 3719772 - DNA, 16 bp, Homo sapiens
ggctagaggccagccc

SEQ ID NO: 3719773 - DNA, 18 bp, Homo sapiens
ggctagaggccagcccca

SEQ ID NO: 3719774 - DNA, 15 bp, Homo sapiens
ggctagatcatgaag

SEQ ID NO: 3719775 - DNA, 22 bp, Homo sapiens
ggctaggacccctccatgtggg

SEQ ID NO: 3719776 - DNA, 13 bp, Homo sapiens
ggctagtcagaga

SEQ ID NO: 3719777 - DNA, 19 bp, Homo sapiens
ggctatagctacaggaagc

SEQ ID NO: 3719778 - DNA, 13 bp, Homo sapiens
ggctattcacaac

SEQ ID NO: 3719779 - DNA, 19 bp, Homo sapiens
ggctattccataattccat

SEQ ID NO: 3719780 - DNA, 19 bp, Homo sapiens
ggctcagcaaaagatgctt

SEQ ID NO: 3719781 - DNA, 12 bp, Homo sapiens
ggctcagcctgg

SEQ ID NO: 3719782 - DNA, 14 bp, Homo sapiens
ggctcagctctggc

SEQ ID NO: 3719783 - DNA, 18 bp, Homo sapiens
ggctcagctctggctcac

SEQ ID NO: 3719784 - DNA, 14 bp, Homo sapiens
ggctcagtctcagg

SEQ ID NO: 3719785 - DNA, 17 bp, Homo sapiens
ggctcagtctcaggagc

SEQ ID NO: 3719786 - DNA, 11 bp, Homo sapiens
ggctccaggct

SEQ ID NO: 3719787 - DNA, 15 bp, Homo sapiens
ggctccaggctcctt

SEQ ID NO: 3719788 - DNA, 22 bp, Homo sapiens
ggctccagtctgctgccctcca

SEQ ID NO: 3719789 - DNA, 24 bp, Homo sapiens
ggctccagtctgctgccctccatc

SEQ ID NO: 3719790 - DNA, 18 bp, Homo sapiens
ggctcccacaggcccttc

SEQ ID NO: 3719791 - DNA, 20 bp, Homo sapiens
ggctcccacaggcccttcct

SEQ ID NO: 3719792 - DNA, 13 bp, Homo sapiens
ggctcccttcctc

SEQ ID NO: 3719793 - DNA, 22 bp, Homo sapiens
ggctccgtcagtatcaggcctg

SEQ ID NO: 3719794 - DNA, 12 bp, Homo sapiens
ggctcctggact

SEQ ID NO: 3719795 - DNA, 16 bp, Homo sapiens
ggctctccacctcagc

SEQ ID NO: 3719796 - DNA, 11 bp, Homo sapiens
ggtccagggaa

SEQ ID NO: 3719797 - DNA, 21 bp, Homo sapiens
ggtccagggaagctggccgag

SEQ ID NO: 3719798 - DNA, 14 bp, Homo sapiens
ggtcccactcagtc

SEQ ID NO: 3719799 - DNA, 14 bp, Homo sapiens
ggtcccagccaccc

SEQ ID NO: 3719800 - DNA, 23 bp, Homo sapiens
ggtccctgggaggaaatttgaat

SEQ ID NO: 3719801 - DNA, 21 bp, Homo sapiens
ggtcccttgagacctcagcca

SEQ ID NO: 3719802 - DNA, 23 bp, Homo sapiens
ggtcccttgcagctagttttcta

SEQ ID NO: 3719803 - DNA, 15 bp, Homo sapiens
ggtcctggctcctga

SEQ ID NO: 3719804 - DNA, 15 bp, Homo sapiens
ggtcctgggggcctg

SEQ ID NO: 3719805 - DNA, 13 bp, Homo sapiens
ggtcctgtctccc

SEQ ID NO: 3719806 - DNA, 21 bp, Homo sapiens
ggtcctgtctcccctctgctg

SEQ ID NO: 3719807 - DNA, 21 bp, Homo sapiens
ggtccttcaagttagctcagg

SEQ ID NO: 3719808 - DNA, 16 bp, Homo sapiens
ggtccttccaggcccc

SEQ ID NO: 3719809 - DNA, 21 bp, Homo sapiens
ggtcctttgggaaaggagaag

SEQ ID NO: 3719810 - DNA, 20 bp, Homo sapiens
ggtcgaccccaaagcccctt

SEQ ID NO: 3719811 - DNA, 12 bp, Homo sapiens
ggtcgcccagga

SEQ ID NO: 3719812 - DNA, 14 bp, Homo sapiens
ggtcgcccaggaga

SEQ ID NO: 3719813 - DNA, 23 bp, Homo sapiens
ggtctcaaactcctgggctcagg

SEQ ID NO: 3719814 - DNA, 22 bp, Homo sapiens
ggtctcactatgttgcccaggc

SEQ ID NO: 3719815 - DNA, 22 bp, Homo sapiens
ggtctcccgggaagccaccctc

SEQ ID NO: 3719816 - DNA, 20 bp, Homo sapiens
ggtctcgctttgttgcccag

SEQ ID NO: 3719817 - DNA, 21 bp, Homo sapiens
ggtctcgctttgttgcccagg

SEQ ID NO: 3719818 - DNA, 13 bp, Homo sapiens
ggtctctctttgg

SEQ ID NO: 3719819 - DNA, 13 bp, Homo sapiens
ggtctgaaatgga

SEQ ID NO: 3719820 - DNA, 15 bp, Homo sapiens
ggtctgaaggactgg

SEQ ID NO: 3719821 - DNA, 21 bp, Homo sapiens
ggtctgaatgttctgacatta

SEQ ID NO: 3719822 - DNA, 13 bp, Homo sapiens
ggtctgcaggcag

SEQ ID NO: 3719823 - DNA, 23 bp, Homo sapiens
ggtctgcaggcagggctgactct

SEQ ID NO: 3719824 - DNA, 22 bp, Homo sapiens
ggtctggagaagcagtgagccg

SEQ ID NO: 3719825 - DNA, 22 bp, Homo sapiens
ggtcttccctacctcaggcagg

SEQ ID NO: 3719826 - DNA, 22 bp, Homo sapiens
ggtcttcttacatgcatttgag

SEQ ID NO: 3719827 - DNA, 19 bp, Homo sapiens
ggtgaaagaaatcatgtta

SEQ ID NO: 3719828 - DNA, 14 bp, Homo sapiens
ggtgacctctgcct

SEQ ID NO: 3719829 - DNA, 21 bp, Homo sapiens
ggtgacctctgcctgaagtca

SEQ ID NO: 3719830 - DNA, 15 bp, Homo sapiens
ggtgaggaccactcc

SEQ ID NO: 3719831 - DNA, 23 bp, Homo sapiens
ggtgagtggggagacacctcaga

SEQ ID NO: 3719832 - DNA, 20 bp, Homo sapiens
ggtgatttagcaggaagctg

SEQ ID NO: 3719833 - DNA, 15 bp, Homo sapiens
ggtgcagcagtgagg

SEQ ID NO: 3719834 - DNA, 19 bp, Homo sapiens
ggtgcattacagagaggag

SEQ ID NO: 3719835 - DNA, 22 bp, Homo sapiens
ggtgccccccttgccagacatg

SEQ ID NO: 3719836 - DNA, 17 bp, Homo sapiens
ggtgcccttggaggcca

SEQ ID NO: 3719837 - DNA, 22 bp, Homo sapiens
ggtgcccttggaggccagccag

SEQ ID NO: 3719838 - DNA, 19 bp, Homo sapiens
ggtgcctgggtggggctgc

SEQ ID NO: 3719839 - DNA, 17 bp, Homo sapiens
ggtgcctgtgaggcagg

SEQ ID NO: 3719840 - DNA, 19 bp, Homo sapiens
ggtgcctgtgaggcagggg

SEQ ID NO: 3719841 - DNA, 23 bp, Homo sapiens
ggtgccttcttattctcactcca

SEQ ID NO: 3719842 - DNA, 17 bp, Homo sapiens
ggtgcctttcctgttca

SEQ ID NO: 3719843 - DNA, 19 bp, Homo sapiens
ggtgcctttcctgttcagc

SEQ ID NO: 3719844 - DNA, 17 bp, Homo sapiens
ggtgctaattaataaag

SEQ ID NO: 3719845 - DNA, 22 bp, Homo sapiens
ggtgctgttgtcattgctttac

SEQ ID NO: 3719846 - DNA, 15 bp, Homo sapiens
ggtggacagtcctgg

SEQ ID NO: 3719847 - DNA, 16 bp, Homo sapiens
ggtggacagtcctggg

SEQ ID NO: 3719848 - DNA, 18 bp, Homo sapiens
ggtggaggagagcctggt

SEQ ID NO: 3719849 - DNA, 21 bp, Homo sapiens
ggtggatgcctggtggcagct

SEQ ID NO: 3719850 - DNA, 18 bp, Homo sapiens
ggtggcagccctgtaggg

SEQ ID NO: 3719851 - DNA, 12 bp, Homo sapiens
ggtggcagctgc

SEQ ID NO: 3719852 - DNA, 13 bp, Homo sapiens
ggtggcagctgcg

SEQ ID NO: 3719853 - DNA, 21 bp, Homo sapiens
ggtggcagtgcagcaaccaga

SEQ ID NO: 3719854 - DNA, 20 bp, Homo sapiens
ggtggccactccagacccct

SEQ ID NO: 3719855 - DNA, 21 bp, Homo sapiens
ggtggccactccagacccctg

SEQ ID NO: 3719856 - DNA, 16 bp, Homo sapiens
ggtggcccgacagcct

SEQ ID NO: 3719857 - DNA, 16 bp, Homo sapiens
ggtggctagtcagaga

SEQ ID NO: 3719858 - DNA, 15 bp, Homo sapiens
ggtggctgacccagt

SEQ ID NO: 3719859 - DNA, 18 bp, Homo sapiens
ggtggctgggttggaggg

SEQ ID NO: 3719860 - DNA, 17 bp, Homo sapiens
ggtgggatggaggagaa

SEQ ID NO: 3719861 - DNA, 20 bp, Homo sapiens
ggtgggccagcccctcccac

SEQ ID NO: 3719862 - DNA, 17 bp, Homo sapiens
ggtggggctgctcctcc

SEQ ID NO: 3719863 - DNA, 18 bp, Homo sapiens
ggtggggctgctcctcca

SEQ ID NO: 3719864 - DNA, 22 bp, Homo sapiens
ggtggggctgctcctccagggc

SEQ ID NO: 3719865 - DNA, 13 bp, Homo sapiens
ggtgggggcctcg

SEQ ID NO: 3719866 - DNA, 15 bp, Homo sapiens
ggtggtctgaatgtt

SEQ ID NO: 3719867 - DNA, 18 bp, Homo sapiens
ggtggtctgaatgttctg

SEQ ID NO: 3719868 - DNA, 21 bp, Homo sapiens
ggtggttatggagagggtgtc

SEQ ID NO: 3719869 - DNA, 16 bp, Homo sapiens
ggtgtaacctgagatg

SEQ ID NO: 3719870 - DNA, 23 bp, Homo sapiens
ggtgtatttattttcctccccag

SEQ ID NO: 3719871 - DNA, 20 bp, Homo sapiens
ggtgtgaaagtcagatgccc

SEQ ID NO: 3719872 - DNA, 18 bp, Homo sapiens
ggtgtgagtcaccaagcc

SEQ ID NO: 3719873 - DNA, 13 bp, Homo sapiens
ggtgtgctctgat

SEQ ID NO: 3719874 - DNA, 14 bp, Homo sapiens
ggtgtggagaagcg

SEQ ID NO: 3719875 - DNA, 14 bp, Homo sapiens
ggtgtgtgtagcca

SEQ ID NO: 3719876 - DNA, 14 bp, Homo sapiens
ggtgtgtttttggg

SEQ ID NO: 3719877 - DNA, 13 bp, Homo sapiens
ggtgtttatacag

SEQ ID NO: 3719878 - DNA, 11 bp, Homo sapiens
ggttaaaactg

SEQ ID NO: 3719879 - DNA, 13 bp, Homo sapiens
ggttaaaactgtc

SEQ ID NO: 3719880 - DNA, 14 bp, Homo sapiens
ggttacaaactgca

SEQ ID NO: 3719881 - DNA, 21 bp, Homo sapiens
ggttacccagttagctctcaa

SEQ ID NO: 3719882 - DNA, 20 bp, Homo sapiens
ggttaggagttcgagaccag

SEQ ID NO: 3719883 - DNA, 15 bp, Homo sapiens
ggttagggaggggta

SEQ ID NO: 3719884 - DNA, 23 bp, Homo sapiens
ggttatacatgacactgaaatgc

SEQ ID NO: 3719885 - DNA, 13 bp, Homo sapiens
ggttatggagagg

SEQ ID NO: 3719886 - DNA, 22 bp, Homo sapiens
ggttatgtgtatgtgccattta

SEQ ID NO: 3719887 - DNA, 12 bp, Homo sapiens
ggttatttttat

SEQ ID NO: 3719888 - DNA, 22 bp, Homo sapiens
ggttcaagcgattcttctgctt

SEQ ID NO: 3719889 - DNA, 12 bp, Homo sapiens
ggttcaccagcc

SEQ ID NO: 3719890 - DNA, 13 bp, Homo sapiens
ggttcaccagcct

SEQ ID NO: 3719891 - DNA, 22 bp, Homo sapiens
ggttcacgcctgtaatcccagc

SEQ ID NO: 3719892 - DNA, 15 bp, Homo sapiens
ggttcactaaagcag

SEQ ID NO: 3719893 - DNA, 17 bp, Homo sapiens
ggttcagcccctcctct

SEQ ID NO: 3719894 - DNA, 19 bp, Homo sapiens
ggttcagcccctcctctgc

SEQ ID NO: 3719895 - DNA, 12 bp, Homo sapiens
ggttcagcttgt

SEQ ID NO: 3719896 - DNA, 22 bp, Homo sapiens
ggttcatcagtgttaaaaaatt

SEQ ID NO: 3719897 - DNA, 19 bp, Homo sapiens
ggttcattattggaattaa

SEQ ID NO: 3719898 - DNA, 23 bp, Homo sapiens
ggttcgtggaaagggtgctgctt

SEQ ID NO: 3719899 - DNA, 23 bp, Homo sapiens
ggttctcacagtgggagccaggg

SEQ ID NO: 3719900 - DNA, 18 bp, Homo sapiens
ggttctggttagctcagc

SEQ ID NO: 3719901 - DNA, 20 bp, Homo sapiens
ggttctggttagctcagccc

SEQ ID NO: 3719902 - DNA, 16 bp, Homo sapiens
ggttcttagtgtcact

SEQ ID NO: 3719903 - DNA, 13 bp, Homo sapiens
ggttcttcccttt

SEQ ID NO: 3719904 - DNA, 14 bp, Homo sapiens
ggttctttcttcct

SEQ ID NO: 3719905 - DNA, 16 bp, Homo sapiens
ggttctttcttcctct

SEQ ID NO: 3719906 - DNA, 18 bp, Homo sapiens
ggttctttcttcctctgc

SEQ ID NO: 3719907 - DNA, 13 bp, Homo sapiens
ggttgagaaatga

SEQ ID NO: 3719908 - DNA, 22 bp, Homo sapiens
gtcctccccctgccagtgcctt

SEQ ID NO: 3719909 - DNA, 20 bp, Homo sapiens
gtcctctttcagaaaacaga

SEQ ID NO: 3719910 - DNA, 16 bp, Homo sapiens
gtcctgacggcgcccc

SEQ ID NO: 3719911 - DNA, 15 bp, Homo sapiens
gtcctgcctcagcct

SEQ ID NO: 3719912 - DNA, 19 bp, Homo sapiens
gtcctggctacatcccagc

SEQ ID NO: 3719913 - DNA, 22 bp, Homo sapiens
gtcctggctacatcccagcctg

SEQ ID NO: 3719914 - DNA, 15 bp, Homo sapiens
gtcctgggagtgagc

SEQ ID NO: 3719915 - DNA, 15 bp, Homo sapiens
gtcctggggctctgt

SEQ ID NO: 3719916 - DNA, 17 bp, Homo sapiens
gtcctgggggcctgacc

SEQ ID NO: 3719917 - DNA, 18 bp, Homo sapiens
gtcctgtcggagccctgt

SEQ ID NO: 3719918 - DNA, 18 bp, Homo sapiens
gtcctgtctcccctctgc

SEQ ID NO: 3719919 - DNA, 20 bp, Homo sapiens
gtccttaatgatccgttcca

SEQ ID NO: 3719920 - DNA, 22 bp, Homo sapiens
gtccttccaggcccccaccact

SEQ ID NO: 3719921 - DNA, 21 bp, Homo sapiens
gtccttccctctccccaagac

SEQ ID NO: 3719922 - DNA, 17 bp, Homo sapiens
gtccttctctcacctcc

SEQ ID NO: 3719923 - DNA, 19 bp, Homo sapiens
gtccttctctcacctccta

SEQ ID NO: 3719924 - DNA, 12 bp, Homo sapiens
gtccttgcacac

SEQ ID NO: 3719925 - DNA, 22 bp, Homo sapiens
gtccttgcacactcccctgcac

SEQ ID NO: 3719926 - DNA, 15 bp, Homo sapiens
gtccttgcacctgca

SEQ ID NO: 3719927 - DNA, 16 bp, Homo sapiens
gtccttgcacctgcat

SEQ ID NO: 3719928 - DNA, 15 bp, Homo sapiens
gtcctttccagtggc

SEQ ID NO: 3719929 - DNA, 23 bp, Homo sapiens
gtcctttccagtggcctggctcc

SEQ ID NO: 3719930 - DNA, 14 bp, Homo sapiens
gtcctttccctcca

SEQ ID NO: 3719931 - DNA, 17 bp, Homo sapiens
gtccttttgtaccatgg

SEQ ID NO: 3719932 - DNA, 12 bp, Homo sapiens
gtcgcccaggag

SEQ ID NO: 3719933 - DNA, 18 bp, Homo sapiens
gtcgggagttcgagacca

SEQ ID NO: 3719934 - DNA, 21 bp, Homo sapiens
gtcgggctcagctctggctca

SEQ ID NO: 3719935 - DNA, 18 bp, Homo sapiens
gtcgggggctgaggggca

SEQ ID NO: 3719936 - DNA, 17 bp, Homo sapiens
gtcggggggacagctcc

SEQ ID NO: 3719937 - DNA, 15 bp, Homo sapiens
gtcgtggcagataat

SEQ ID NO: 3719938 - DNA, 16 bp, Homo sapiens
gtctaaccaaatgcat

SEQ ID NO: 3719939 - DNA, 18 bp, Homo sapiens
gtctaacttttgtgtgaa

SEQ ID NO: 3719940 - DNA, 13 bp, Homo sapiens
gtctaccatctcc

SEQ ID NO: 3719941 - DNA, 14 bp, Homo sapiens
gtctaccatctccc

SEQ ID NO: 3719942 - DNA, 19 bp, Homo sapiens
gtctagcagagcaggggca

SEQ ID NO: 3719943 - DNA, 14 bp, Homo sapiens
gtctatgggactca

SEQ ID NO: 3719944 - DNA, 19 bp, Homo sapiens
gtctcaaaaaaagaaaaag

SEQ ID NO: 3719945 - DNA, 16 bp, Homo sapiens
gtctcaaactcctggg

SEQ ID NO: 3719946 - DNA, 20 bp, Homo sapiens
gtctcaagagggcactggtg

SEQ ID NO: 3719947 - DNA, 23 bp, Homo sapiens
gtctcacagtgttgcccaggctg

SEQ ID NO: 3719948 - DNA, 20 bp, Homo sapiens
gtctcactatgttgcccagg

SEQ ID NO: 3719949 - DNA, 23 bp, Homo sapiens
gtctcactatgttgcccaggcag

SEQ ID NO: 3719950 - DNA, 16 bp, Homo sapiens
gtctcactctgtcgcc

SEQ ID NO: 3719951 - DNA, 18 bp, Homo sapiens
gtctcactctgtcgccca

SEQ ID NO: 3719952 - DNA, 16 bp, Homo sapiens
gtctcagaatctttcc

SEQ ID NO: 3719953 - DNA, 13 bp, Homo sapiens
gtctcagcctccc

SEQ ID NO: 3719954 - DNA, 16 bp, Homo sapiens
gtctcaggagcatggg

SEQ ID NO: 3719955 - DNA, 14 bp, Homo sapiens
gtctcatccccagg

SEQ ID NO: 3719956 - DNA, 21 bp, Homo sapiens
gtctccagtatccactttgca

SEQ ID NO: 3719957 - DNA, 13 bp, Homo sapiens
gtctccatgtttg

SEQ ID NO: 3719958 - DNA, 17 bp, Homo sapiens
gtctcccaggccccctg

SEQ ID NO: 3719959 - DNA, 18 bp, Homo sapiens
gtctcccatcttaactct

SEQ ID NO: 3719960 - DNA, 18 bp, Homo sapiens
gtctccccatgtgcctgc

SEQ ID NO: 3719961 - DNA, 15 bp, Homo sapiens
gtctcccctctgctg

SEQ ID NO: 3719962 - DNA, 16 bp, Homo sapiens
gtctcccctctgctgg

SEQ ID NO: 3719963 - DNA, 17 bp, Homo sapiens
gtctcccctctgctggc

SEQ ID NO: 3719964 - DNA, 14 bp, Homo sapiens
gtctccctctcctg

SEQ ID NO: 3719965 - DNA, 22 bp, Homo sapiens
gtctccctctcctgcctactca

SEQ ID NO: 3719966 - DNA, 22 bp, Homo sapiens
gtctcctcttaaaaaataaaaa

SEQ ID NO: 3719967 - DNA, 14 bp, Homo sapiens
gtctcctgccccca

SEQ ID NO: 3719968 - DNA, 17 bp, Homo sapiens
gtctcgctttgttgccc

SEQ ID NO: 3719969 - DNA, 23 bp, Homo sapiens
gtctcgggtggctagtcagagag

SEQ ID NO: 3719970 - DNA, 23 bp, Homo sapiens
gtctctatgccagctcagtccca

SEQ ID NO: 3719971 - DNA, 16 bp, Homo sapiens
gtctctctttggactc

SEQ ID NO: 3719972 - DNA, 21 bp, Homo sapiens
gtctctctttggactctcccc

SEQ ID NO: 3719973 - DNA, 11 bp, Homo sapiens
gtctctgccat

SEQ ID NO: 3719974 - DNA, 21 bp, Homo sapiens
gtctctgccatgaactggagg

SEQ ID NO: 3719975 - DNA, 17 bp, Homo sapiens
gtctcttaaaaaaataa

SEQ ID NO: 3719976 - DNA, 14 bp, Homo sapiens
gtctcttctccact

SEQ ID NO: 3719977 - DNA, 23 bp, Homo sapiens
gtctcttgagggagcttagccaa

SEQ ID NO: 3719978 - DNA, 12 bp, Homo sapiens
gtctcttgcttg

SEQ ID NO: 3719979 - DNA, 18 bp, Homo sapiens
gtctctttaatcttcagt

SEQ ID NO: 3719980 - DNA, 20 bp, Homo sapiens
gtctctttaatgtcacaggc

SEQ ID NO: 3719981 - DNA, 16 bp, Homo sapiens
gtctgaagtcactgca

SEQ ID NO: 3719982 - DNA, 17 bp, Homo sapiens
gtctgaagtcactgcac

SEQ ID NO: 3719983 - DNA, 14 bp, Homo sapiens
gtctgaatgttctg

SEQ ID NO: 3719984 - DNA, 18 bp, Homo sapiens
gtctgaatgttctgacat

SEQ ID NO: 3719985 - DNA, 12 bp, Homo sapiens
gtctgacaggca

SEQ ID NO: 3719986 - DNA, 13 bp, Homo sapiens
gtctgacaggcaa

SEQ ID NO: 3719987 - DNA, 14 bp, Homo sapiens
gtctgacaggcaat

SEQ ID NO: 3719988 - DNA, 18 bp, Homo sapiens
gtctgacaggcaatgctg

SEQ ID NO: 3719989 - DNA, 14 bp, Homo sapiens
gtctgaccctctcc

SEQ ID NO: 3719990 - DNA, 18 bp, Homo sapiens
gtctgaggaatccagacc

SEQ ID NO: 3719991 - DNA, 19 bp, Homo sapiens
gtctgaggaatccagaccc

SEQ ID NO: 3719992 - DNA, 18 bp, Homo sapiens
gtctgattcccaagctct

SEQ ID NO: 3719993 - DNA, 15 bp, Homo sapiens
gtctgcattttctga

SEQ ID NO: 3719994 - DNA, 14 bp, Homo sapiens
gtctgccagccagc

SEQ ID NO: 3719995 - DNA, 16 bp, Homo sapiens
gtctgccagccagcag

SEQ ID NO: 3719996 - DNA, 17 bp, Homo sapiens
gtctgctgaataataaa

SEQ ID NO: 3719997 - DNA, 13 bp, Homo sapiens
gtctgctgccctc

SEQ ID NO: 3719998 - DNA, 16 bp, Homo sapiens
gtctgctgccctccat

SEQ ID NO: 3719999 - DNA, 19 bp, Homo sapiens
gtctgctgccctccatccc

SEQ ID NO: 3720000 - DNA, 16 bp, Homo sapiens
gtctgcttctgcacct

SEQ ID NO: 3720001 - DNA, 23 bp, Homo sapiens
gtctgcttctgcaccttatctta

SEQ ID NO: 3720002 - DNA, 15 bp, Homo sapiens
gtctggaatgcagtg

SEQ ID NO: 3720003 - DNA, 16 bp, Homo sapiens
gtctggaatgcagtgg

SEQ ID NO: 3720004 - DNA, 18 bp, Homo sapiens
gtctggaatgcagtggta

SEQ ID NO: 3720005 - DNA, 21 bp, Homo sapiens
gtctggagaataattctttga

SEQ ID NO: 3720006 - DNA, 10 bp, Homo sapiens
gtctggaggg

SEQ ID NO: 3720007 - DNA, 14 bp, Homo sapiens
gtctggcccttcct

SEQ ID NO: 3720008 - DNA, 15 bp, Homo sapiens
gtctggcttcacaga

SEQ ID NO: 3720009 - DNA, 14 bp, Homo sapiens
gtctgggggtcagg

SEQ ID NO: 3720010 - DNA, 16 bp, Homo sapiens
gtctggggttcagccc

SEQ ID NO: 3720011 - DNA, 13 bp, Homo sapiens
gtctggtttctag

SEQ ID NO: 3720012 - DNA, 18 bp, Homo sapiens
gtctgtaatgacaaataa

SEQ ID NO: 3720013 - DNA, 19 bp, Homo sapiens
gtctgtatttatgtgtgag

SEQ ID NO: 3720014 - DNA, 15 bp, Homo sapiens
gtctgtcccaccagc

SEQ ID NO: 3720015 - DNA, 15 bp, Homo sapiens
gtctgtcttcacagc

SEQ ID NO: 3720016 - DNA, 21 bp, Homo sapiens
gtctgtgaattggaccatcct

SEQ ID NO: 3720017 - DNA, 16 bp, Homo sapiens
gtctgttaacttaata

SEQ ID NO: 3720018 - DNA, 17 bp, Homo sapiens
gtctgttcacttttcct

SEQ ID NO: 3720019 - DNA, 15 bp, Homo sapiens
gtcttaattaagtaa

SEQ ID NO: 3720020 - DNA, 20 bp, Homo sapiens
gtcttaattaagtaaactaa

SEQ ID NO: 3720021 - DNA, 23 bp, Homo sapiens
gttaacaaggaatgcctgtgcca

SEQ ID NO: 3720022 - DNA, 23 bp, Homo sapiens
gttaacattgaccaagaactgca

SEQ ID NO: 3720023 - DNA, 18 bp, Homo sapiens
gttaagaaaaaaataatt

SEQ ID NO: 3720024 - DNA, 15 bp, Homo sapiens
gttaagaatgtcgat

SEQ ID NO: 3720025 - DNA, 19 bp, Homo sapiens
gttaagcagccgccacatc

SEQ ID NO: 3720026 - DNA, 16 bp, Homo sapiens
gttaatattctttcaa

SEQ ID NO: 3720027 - DNA, 16 bp, Homo sapiens
gttaatcttgctttct

SEQ ID NO: 3720028 - DNA, 21 bp, Homo sapiens
gttaatcttgctttctttgtt

SEQ ID NO: 3720029 - DNA, 16 bp, Homo sapiens
gttaatgaaaatgtca

SEQ ID NO: 3720030 - DNA, 17 bp, Homo sapiens
gttaatgaaaatgtcag

SEQ ID NO: 3720031 - DNA, 9 bp, Homo sapiens
gttacaaac

SEQ ID NO: 3720032 - DNA, 16 bp, Homo sapiens
gttacaaactgcaata

SEQ ID NO: 3720033 - DNA, 19 bp, Homo sapiens
gttacaaactgcaatagag

SEQ ID NO: 3720034 - DNA, 14 bp, Homo sapiens
gttacactgttaga

SEQ ID NO: 3720035 - DNA, 19 bp, Homo sapiens
gttacactgttagaacact

SEQ ID NO: 3720036 - DNA, 20 bp, Homo sapiens
gttacactgttagaacacta

SEQ ID NO: 3720037 - DNA, 22 bp, Homo sapiens
gttacactgttagaacactatt

SEQ ID NO: 3720038 - DNA, 19 bp, Homo sapiens
gttacataagataaatgtg

SEQ ID NO: 3720039 - DNA, 23 bp, Homo sapiens
gttacattgctggtcttgtaaga

SEQ ID NO: 3720040 - DNA, 23 bp, Homo sapiens
gttactaattggcctctttaaga

SEQ ID NO: 3720041 - DNA, 16 bp, Homo sapiens
gttactatcctggctt

SEQ ID NO: 3720042 - DNA, 14 bp, Homo sapiens
gttactcagccctg

SEQ ID NO: 3720043 - DNA, 18 bp, Homo sapiens
gttactcagccctgggcc

SEQ ID NO: 3720044 - DNA, 14 bp, Homo sapiens
gttactctccaacc

SEQ ID NO: 3720045 - DNA, 19 bp, Homo sapiens
gttactgatcatgcattgt

SEQ ID NO: 3720046 - DNA, 22 bp, Homo sapiens
gttactggatttgttgttcttt

SEQ ID NO: 3720047 - DNA, 16 bp, Homo sapiens
gttactgttatagagg

SEQ ID NO: 3720048 - DNA, 15 bp, Homo sapiens
gttagaaatgcaaat

SEQ ID NO: 3720049 - DNA, 19 bp, Homo sapiens
gttagaaatgcagaatcct

SEQ ID NO: 3720050 - DNA, 20 bp, Homo sapiens
gttagaacactattttcaga

SEQ ID NO: 3720051 - DNA, 21 bp, Homo sapiens
gttagaacactattttcagaa

SEQ ID NO: 3720052 - DNA, 20 bp, Homo sapiens
gttagctcaggaggcttgga

SEQ ID NO: 3720053 - DNA, 13 bp, Homo sapiens
gttaggctgggcc

SEQ ID NO: 3720054 - DNA, 18 bp, Homo sapiens
gttaggctgggcccagag

SEQ ID NO: 3720055 - DNA, 11 bp, Homo sapiens
gttagggaggg

SEQ ID NO: 3720056 - DNA, 22 bp, Homo sapiens
gttatagagggtctaagattca

SEQ ID NO: 3720057 - DNA, 15 bp, Homo sapiens
gttatagtgaattat

SEQ ID NO: 3720058 - DNA, 13 bp, Homo sapiens
gttatataaagag

SEQ ID NO: 3720059 - DNA, 16 bp, Homo sapiens
gttatataaagagaaa

SEQ ID NO: 3720060 - DNA, 22 bp, Homo sapiens
gttatataaagagaaaattgaa

SEQ ID NO: 3720061 - DNA, 20 bp, Homo sapiens
gttatattttactactgtgg

SEQ ID NO: 3720062 - DNA, 13 bp, Homo sapiens
gttatgcatcatt

SEQ ID NO: 3720063 - DNA, 21 bp, Homo sapiens
gttattacatccttgtggcac

SEQ ID NO: 3720064 - DNA, 14 bp, Homo sapiens
gttattgaaaaaaa

SEQ ID NO: 3720065 - DNA, 13 bp, Homo sapiens
gttatttaaagaa

SEQ ID NO: 3720066 - DNA, 23 bp, Homo sapiens
gttattttctttgaaattgttta

SEQ ID NO: 3720067 - DNA, 16 bp, Homo sapiens
gttattttttaattat

SEQ ID NO: 3720068 - DNA, 14 bp, Homo sapiens
gttcaaaaagtcta

SEQ ID NO: 3720069 - DNA, 19 bp, Homo sapiens
gttcaagcgattcttctgc

SEQ ID NO: 3720070 - DNA, 12 bp, Homo sapiens
gttcacccctcc

SEQ ID NO: 3720071 - DNA, 14 bp, Homo sapiens
gttcacccctccac

SEQ ID NO: 3720072 - DNA, 18 bp, Homo sapiens
gttcacgtaagatacaag

SEQ ID NO: 3720073 - DNA, 21 bp, Homo sapiens
gttcactactacacccagcta

SEQ ID NO: 3720074 - DNA, 16 bp, Homo sapiens
gttcagcattcttagc

SEQ ID NO: 3720075 - DNA, 14 bp, Homo sapiens
gttcagcccctcct

SEQ ID NO: 3720076 - DNA, 15 bp, Homo sapiens
gttcagcccctcctc

SEQ ID NO: 3720077 - DNA, 19 bp, Homo sapiens
gttcagcccctcctctgcc

SEQ ID NO: 3720078 - DNA, 20 bp, Homo sapiens
gttcagcccctcctctgcca

SEQ ID NO: 3720079 - DNA, 23 bp, Homo sapiens
gttcagcccctcctctgccacct

SEQ ID NO: 3720080 - DNA, 13 bp, Homo sapiens
gttcagctccagc

SEQ ID NO: 3720081 - DNA, 16 bp, Homo sapiens
gttcagctccagctca

SEQ ID NO: 3720082 - DNA, 15 bp, Homo sapiens
gttcaggagtcccaa

SEQ ID NO: 3720083 - DNA, 18 bp, Homo sapiens
gttcaggagtcccaagga

SEQ ID NO: 3720084 - DNA, 21 bp, Homo sapiens
gttcaggagtcccaaggaaag

SEQ ID NO: 3720085 - DNA, 19 bp, Homo sapiens
gttcagggttggcccctgc

SEQ ID NO: 3720086 - DNA, 21 bp, Homo sapiens
gttcagggttggcccctgccc

SEQ ID NO: 3720087 - DNA, 19 bp, Homo sapiens
gttcataacagtgccattg

SEQ ID NO: 3720088 - DNA, 20 bp, Homo sapiens
gttcataacagtgccattgt

SEQ ID NO: 3720089 - DNA, 22 bp, Homo sapiens
gttcataacagtgccattgtct

SEQ ID NO: 3720090 - DNA, 24 bp, Homo sapiens
gttcataacagtgccattgtcttt

SEQ ID NO: 3720091 - DNA, 18 bp, Homo sapiens
gttcatagggtctcttca

SEQ ID NO: 3720092 - DNA, 19 bp, Homo sapiens
gttcatgagaatctatatt

SEQ ID NO: 3720093 - DNA, 16 bp, Homo sapiens
gttcattaaagcatga

SEQ ID NO: 3720094 - DNA, 20 bp, Homo sapiens
gttcattaaagcatgaatgg

SEQ ID NO: 3720095 - DNA, 20 bp, Homo sapiens
gttcatttcaaatacatctt

SEQ ID NO: 3720096 - DNA, 13 bp, Homo sapiens
gttccaagacatt

SEQ ID NO: 3720097 - DNA, 15 bp, Homo sapiens
gttccaagacattgt

SEQ ID NO: 3720098 - DNA, 19 bp, Homo sapiens
gttccaagacattgtcaat

SEQ ID NO: 3720099 - DNA, 23 bp, Homo sapiens
gttccaatcctggctctgtggct

SEQ ID NO: 3720100 - DNA, 14 bp, Homo sapiens
gttccagctctttg

SEQ ID NO: 3720101 - DNA, 19 bp, Homo sapiens
gttcccaccaggctgctca

SEQ ID NO: 3720102 - DNA, 14 bp, Homo sapiens
gttcccacttggag

SEQ ID NO: 3720103 - DNA, 21 bp, Homo sapiens
gttcccagtgacacttcagag

SEQ ID NO: 3720104 - DNA, 20 bp, Homo sapiens
gttcccccagccctgtggaa

SEQ ID NO: 3720105 - DNA, 17 bp, Homo sapiens
gttcccctttgcttcat

SEQ ID NO: 3720106 - DNA, 20 bp, Homo sapiens
gttccctacttcctgtgact

SEQ ID NO: 3720107 - DNA, 17 bp, Homo sapiens
gttccctgaaaacccag

SEQ ID NO: 3720108 - DNA, 18 bp, Homo sapiens
gttccctgaaaacccaga

SEQ ID NO: 3720109 - DNA, 13 bp, Homo sapiens
gttcccttggcct

SEQ ID NO: 3720110 - DNA, 19 bp, Homo sapiens
gttcccttggcctcagaat

SEQ ID NO: 3720111 - DNA, 22 bp, Homo sapiens
gttccctttccttccatcccta

SEQ ID NO: 3720112 - DNA, 15 bp, Homo sapiens
gttcctcgccctggg

SEQ ID NO: 3720113 - DNA, 19 bp, Homo sapiens
gttcctgatgacccaggct

SEQ ID NO: 3720114 - DNA, 18 bp, Homo sapiens
gttcctgcagcagagcct

SEQ ID NO: 3720115 - DNA, 21 bp, Homo sapiens
gttcctggcaatagtgtgttc

SEQ ID NO: 3720116 - DNA, 15 bp, Homo sapiens
gttcctggctcagcc

SEQ ID NO: 3720117 - DNA, 23 bp, Homo sapiens
gttccttgatctgtatatacaat

SEQ ID NO: 3720118 - DNA, 17 bp, Homo sapiens
gttcgagaccagcctgg

SEQ ID NO: 3720119 - DNA, 18 bp, Homo sapiens
gttcgagaccagcctggc

SEQ ID NO: 3720120 - DNA, 17 bp, Homo sapiens
gttcgtggaaagggtgc

SEQ ID NO: 3720121 - DNA, 23 bp, Homo sapiens
gttcgttcttgttctgttttgtt

SEQ ID NO: 3720122 - DNA, 17 bp, Homo sapiens
gttctatttctatccca

SEQ ID NO: 3720123 - DNA, 18 bp, Homo sapiens
gttctatttctatcccaa

SEQ ID NO: 3720124 - DNA, 23 bp, Homo sapiens
gttctctctatggtaaagatatt

SEQ ID NO: 3720125 - DNA, 13 bp, Homo sapiens
gttctgaaatatt

SEQ ID NO: 3720126 - DNA, 21 bp, Homo sapiens
gttctgaaatattttaccact

SEQ ID NO: 3720127 - DNA, 17 bp, Homo sapiens
gttctgacattaacagt

SEQ ID NO: 3720128 - DNA, 22 bp, Homo sapiens
gttctgagattattttaatcta

SEQ ID NO: 3720129 - DNA, 14 bp, Homo sapiens
gttctgattagaaa

SEQ ID NO: 3720130 - DNA, 18 bp, Homo sapiens
gttctgattagaaatgac

SEQ ID NO: 3720131 - DNA, 20 bp, Homo sapiens
gttctgattagaaatgacca

SEQ ID NO: 3720132 - DNA, 14 bp, Homo sapiens
gttctgcaaataga

SEQ ID NO: 3720133 - DNA, 24 bp, Homo sapiens
taaacaatttattttattttagca

SEQ ID NO: 3720134 - DNA, 18 bp, Homo sapiens
taaacagtgcctgctgaa

SEQ ID NO: 3720135 - DNA, 17 bp, Homo sapiens
taaacatccttcaagaa

SEQ ID NO: 3720136 - DNA, 18 bp, Homo sapiens
taaacattagttctattt

SEQ ID NO: 3720137 - DNA, 20 bp, Homo sapiens
taaaccccacctttattcct

SEQ ID NO: 3720138 - DNA, 17 bp, Homo sapiens
taaacgtgatgatcagc

SEQ ID NO: 3720139 - DNA, 15 bp, Homo sapiens
taaacgtttcagtaa

SEQ ID NO: 3720140 - DNA, 16 bp, Homo sapiens
taaactcaaaatattt

SEQ ID NO: 3720141 - DNA, 21 bp, Homo sapiens
taaactcaaaatatttgtaca

SEQ ID NO: 3720142 - DNA, 13 bp, Homo sapiens
taaactgccctgt

SEQ ID NO: 3720143 - DNA, 19 bp, Homo sapiens
taaactgtactagtctgtg

SEQ ID NO: 3720144 - DNA, 17 bp, Homo sapiens
taaactgtcctctttca

SEQ ID NO: 3720145 - DNA, 18 bp, Homo sapiens
taaactgtcctctttcag

SEQ ID NO: 3720146 - DNA, 20 bp, Homo sapiens
taaactgtgtggactgtgat

SEQ ID NO: 3720147 - DNA, 22 bp, Homo sapiens
taaacttagtgcggacaagttt

SEQ ID NO: 3720148 - DNA, 22 bp, Homo sapiens
taaacttggtttttaaaaaact

SEQ ID NO: 3720149 - DNA, 12 bp, Homo sapiens
taaactttaata

SEQ ID NO: 3720150 - DNA, 15 bp, Homo sapiens
taaactttaatatgt

SEQ ID NO: 3720151 - DNA, 16 bp, Homo sapiens
taaactttcaatatct

SEQ ID NO: 3720152 - DNA, 15 bp, Homo sapiens
taaagaataatatgc

SEQ ID NO: 3720153 - DNA, 17 bp, Homo sapiens
taaagaatcattattta

SEQ ID NO: 3720154 - DNA, 20 bp, Homo sapiens
taaagacaaagacaaattct

SEQ ID NO: 3720155 - DNA, 15 bp, Homo sapiens
taaagacagaggcag

SEQ ID NO: 3720156 - DNA, 21 bp, Homo sapiens
taaagaccctaaatctgagga

SEQ ID NO: 3720157 - DNA, 17 bp, Homo sapiens
taaagacgatttgtcag

SEQ ID NO: 3720158 - DNA, 12 bp, Homo sapiens
taaagagaaact

SEQ ID NO: 3720159 - DNA, 14 bp, Homo sapiens
taaagagaaacttt

SEQ ID NO: 3720160 - DNA, 19 bp, Homo sapiens
taaagagaaactttgtgct

SEQ ID NO: 3720161 - DNA, 12 bp, Homo sapiens
taaagagagaat

SEQ ID NO: 3720162 - DNA, 20 bp, Homo sapiens
taaagagttgtgttgttctt

SEQ ID NO: 3720163 - DNA, 21 bp, Homo sapiens
taaagagttgtgttgttcttt

SEQ ID NO: 3720164 - DNA, 21 bp, Homo sapiens
taaagatgcaaggaccaggac

SEQ ID NO: 3720165 - DNA, 14 bp, Homo sapiens
taaagatttcttga

SEQ ID NO: 3720166 - DNA, 19 bp, Homo sapiens
taaagcagtcacttttcct

SEQ ID NO: 3720167 - DNA, 13 bp, Homo sapiens
taaagcagtggac

SEQ ID NO: 3720168 - DNA, 19 bp, Homo sapiens
taaagcagtggacaccagg

SEQ ID NO: 3720169 - DNA, 15 bp, Homo sapiens
taaagcatctaaact

SEQ ID NO: 3720170 - DNA, 22 bp, Homo sapiens
taaagcatgaatggtatggaac

SEQ ID NO: 3720171 - DNA, 21 bp, Homo sapiens
taaagcctgctttttaagtgt

SEQ ID NO: 3720172 - DNA, 14 bp, Homo sapiens
taaagctgaaaact

SEQ ID NO: 3720173 - DNA, 21 bp, Homo sapiens
taaagctgcctgtagttagga

SEQ ID NO: 3720174 - DNA, 23 bp, Homo sapiens
taaagctgcctgtagttaggaaa

SEQ ID NO: 3720175 - DNA, 19 bp, Homo sapiens
taaagcttgcaacaaaatt

SEQ ID NO: 3720176 - DNA, 17 bp, Homo sapiens
taaaggagaaggcatga

SEQ ID NO: 3720177 - DNA, 21 bp, Homo sapiens
taaagggaaaggattcatgtg
